United States Patent 11,801,313 (MATERIALS AND METHODS FOR TREATMENT OF PAIN RELATED DISORDERS) - sequence listing, part 4

SEQ ID NO: 41165 - DNA, 20 bp, Artificial Sequence
  Description of Artificial Sequence: Synthetic oligonucleotide
  Target: SCN10A; (-) strand; PAM type: YTN; PAM sequence: TTG
tctggctgaccagggctaaa

SEQ ID NO: 41166 - DNA, 20 bp, Artificial Sequence
  Description of Artificial Sequence: Synthetic oligonucleotide
  Target: SCN10A; (-) strand; PAM type: YTN; PAM sequence: TTC
caccaattgtctggctgacc

SEQ ID NO: 41167 - DNA, 20 bp, Artificial Sequence
  Description of Artificial Sequence: Synthetic oligonucleotide
  Target: SCN10A; (-) strand; PAM type: YTN; PAM sequence: TTT
ccaccaattgtctggctgac

SEQ ID NO: 41168 - DNA, 20 bp, Artificial Sequence
  Description of Artificial Sequence: Synthetic oligonucleotide
  Target: SCN10A; (-) strand; PAM type: YTN; PAM sequence: TTT
tccaccaattgtctggctga

SEQ ID NO: 41169 - DNA, 20 bp, Artificial Sequence
  Description of Artificial Sequence: Synthetic oligonucleotide
  Target: SCN10A; (-) strand; PAM type: YTN; PAM sequence: CTT
ttccaccaattgtctggctg

SEQ ID NO: 41170 - DNA, 20 bp, Artificial Sequence
  Description of Artificial Sequence: Synthetic oligonucleotide
  Target: SCN10A; (-) strand; PAM type: YTN; PAM sequence: CTA
acttttccaccaattgtctg

SEQ ID NO: 41171 - DNA, 20 bp, Artificial Sequence
  Description of Artificial Sequence: Synthetic oligonucleotide
  Target: SCN10A; (-) strand; PAM type: YTN; PAM sequence: TTG
gaatcctaacttttccacca

SEQ ID NO: 41172 - DNA, 20 bp, Artificial Sequence
  Description of Artificial Sequence: Synthetic oligonucleotide
  Target: SCN10A; (-) strand; PAM type: YTN; PAM sequence: CTG
gaaatgccagttggaatcct

SEQ ID NO: 41173 - DNA, 20 bp, Artificial Sequence
  Description of Artificial Sequence: Synthetic oligonucleotide
  Target: SCN10A; (-) strand; PAM type: YTN; PAM sequence: CTG
ggatctggaaatgccagttg

SEQ ID NO: 41174 - DNA, 20 bp, Artificial Sequence
  Description of Artificial Sequence: Synthetic oligonucleotide
  Target: SCN10A; (-) strand; PAM type: YTN; PAM sequence: CTG
tcctgggatctggaaatgcc

SEQ ID NO: 41175 - DNA, 20 bp, Artificial Sequence
  Description of Artificial Sequence: Synthetic oligonucleotide
  Target: SCN10A; (-) strand; PAM type: YTN; PAM sequence: CTG
ggtggagcaggaaagagcac

SEQ ID NO: 41176 - DNA, 20 bp, Artificial Sequence
  Description of Artificial Sequence: Synthetic oligonucleotide
  Target: SCN10A; (-) strand; PAM type: YTN; PAM sequence: TTG
aggctgggtggagcaggaaa

SEQ ID NO: 41177 - DNA, 20 bp, Artificial Sequence
  Description of Artificial Sequence: Synthetic oligonucleotide
  Target: SCN10A; (-) strand; PAM type: YTN; PAM sequence: TTG
agattgaggctgggtggagc

SEQ ID NO: 41178 - DNA, 20 bp, Artificial Sequence
  Description of Artificial Sequence: Synthetic oligonucleotide
  Target: SCN10A; (-) strand; PAM type: YTN; PAM sequence: TTT
gagattgaggctgggtggag

SEQ ID NO: 41179 - DNA, 20 bp, Artificial Sequence
  Description of Artificial Sequence: Synthetic oligonucleotide
  Target: SCN10A; (-) strand; PAM type: YTN; PAM sequence: TTC
agtttgagattgaggctggg

SEQ ID NO: 41180 - DNA, 20 bp, Artificial Sequence
  Description of Artificial Sequence: Synthetic oligonucleotide
  Target: SCN10A; (-) strand; PAM type: YTN; PAM sequence: TTT
cagtttgagattgaggctgg

SEQ ID NO: 41181 - DNA, 20 bp, Artificial Sequence
  Description of Artificial Sequence: Synthetic oligonucleotide
  Target: SCN10A; (-) strand; PAM type: YTN; PAM sequence: TTT
tcagtttgagattgaggctg

SEQ ID NO: 41182 - DNA, 20 bp, Artificial Sequence
  Description of Artificial Sequence: Synthetic oligonucleotide
  Target: SCN10A; (-) strand; PAM type: YTN; PAM sequence: TTT
ttcagtttgagattgaggct

SEQ ID NO: 41183 - DNA, 20 bp, Artificial Sequence
  Description of Artificial Sequence: Synthetic oligonucleotide
  Target: SCN10A; (-) strand; PAM type: YTN; PAM sequence: CTG
atatttttcagtttgagatt

SEQ ID NO: 41184 - DNA, 20 bp, Artificial Sequence
  Description of Artificial Sequence: Synthetic oligonucleotide
  Target: SCN10A; (-) strand; PAM type: YTN; PAM sequence: CTG
ggatcctgatatttttcagt

SEQ ID NO: 41185 - DNA, 20 bp, Artificial Sequence
  Description of Artificial Sequence: Synthetic oligonucleotide
  Target: SCN10A; (-) strand; PAM type: YTN; PAM sequence: TTC
tgggatcctgatatttttca

SEQ ID NO: 41186 - DNA, 20 bp, Artificial Sequence
  Description of Artificial Sequence: Synthetic oligonucleotide
  Target: SCN10A; (-) strand; PAM type: YTN; PAM sequence: TTT
ctgggatcctgatatttttc

SEQ ID NO: 41187 - DNA, 20 bp, Artificial Sequence
  Description of Artificial Sequence: Synthetic oligonucleotide
  Target: SCN10A; (-) strand; PAM type: YTN; PAM sequence: CTT
tctgggatcctgatattttt

SEQ ID NO: 41188 - DNA, 20 bp, Artificial Sequence
  Description of Artificial Sequence: Synthetic oligonucleotide
  Target: SCN10A; (-) strand; PAM type: YTN; PAM sequence: CTC
actttctgggatcctgatat

SEQ ID NO: 41189 - DNA, 20 bp, Artificial Sequence
  Description of Artificial Sequence: Synthetic oligonucleotide
  Target: SCN10A; (-) strand; PAM type: YTN; PAM sequence: TTA
cccctcactttctgggatcc

SEQ ID NO: 41190 - DNA, 20 bp, Artificial Sequence
  Description of Artificial Sequence: Synthetic oligonucleotide
  Target: SCN10A; (-) strand; PAM type: YTN; PAM sequence: CTT
acccctcactttctgggatc

SEQ ID NO: 41191 - DNA, 20 bp, Artificial Sequence
  Description of Artificial Sequence: Synthetic oligonucleotide
  Target: SCN10A; (-) strand; PAM type: YTN; PAM sequence: CTG
tatcatgagtcacttacccc

SEQ ID NO: 41192 - DNA, 20 bp, Artificial Sequence
  Description of Artificial Sequence: Synthetic oligonucleotide
  Target: SCN10A; (-) strand; PAM type: YTN; PAM sequence: CTG
acctgtatcatgagtcactt

SEQ ID NO: 41193 - DNA, 20 bp, Artificial Sequence
  Description of Artificial Sequence: Synthetic oligonucleotide
  Target: SCN10A; (-) strand; PAM type: YTN; PAM sequence: CTG
tgatgctgacctgtatcatg

SEQ ID NO: 41194 - DNA, 20 bp, Artificial Sequence
  Description of Artificial Sequence: Synthetic oligonucleotide
  Target: SCN10A; (-) strand; PAM type: YTN; PAM sequence: TTC
tgtgatgctgacctgtatca

SEQ ID NO: 41195 - DNA, 20 bp, Artificial Sequence
  Description of Artificial Sequence: Synthetic oligonucleotide
  Target: SCN10A; (-) strand; PAM type: YTN; PAM sequence: TTT
ctgtgatgctgacctgtatc

SEQ ID NO: 41196 - DNA, 20 bp, Artificial Sequence
  Description of Artificial Sequence: Synthetic oligonucleotide
  Target: SCN10A; (-) strand; PAM type: YTN; PAM sequence: TTA
tttctgtgatgctgacctgt

SEQ ID NO: 41197 - DNA, 20 bp, Artificial Sequence
  Description of Artificial Sequence: Synthetic oligonucleotide
  Target: SCN10A; (-) strand; PAM type: YTN; PAM sequence: CTT
atttctgtgatgctgacctg

SEQ ID NO: 41198 - DNA, 20 bp, Artificial Sequence
  Description of Artificial Sequence: Synthetic oligonucleotide
  Target: SCN10A; (-) strand; PAM type: YTN; PAM sequence: CTC
ttatttctgtgatgctgacc

SEQ ID NO: 41199 - DNA, 20 bp, Artificial Sequence
  Description of Artificial Sequence: Synthetic oligonucleotide
  Target: SCN10A; (-) strand; PAM type: YTN; PAM sequence: TTC
tcttatttctgtgatgctga

SEQ ID NO: 41200 - DNA, 20 bp, Artificial Sequence
  Description of Artificial Sequence: Synthetic oligonucleotide
  Target: SCN10A; (-) strand; PAM type: YTN; PAM sequence: TTT
ctcttatttctgtgatgctg

SEQ ID NO: 41201 - DNA, 20 bp, Artificial Sequence
  Description of Artificial Sequence: Synthetic oligonucleotide
  Target: SCN10A; (-) strand; PAM type: YTN; PAM sequence: TTT
tctcttatttctgtgatgct

SEQ ID NO: 41202 - DNA, 20 bp, Artificial Sequence
  Description of Artificial Sequence: Synthetic oligonucleotide
  Target: SCN10A; (-) strand; PAM type: YTN; PAM sequence: TTT
ttctcttatttctgtgatgc

SEQ ID NO: 41203 - DNA, 20 bp, Artificial Sequence
  Description of Artificial Sequence: Synthetic oligonucleotide
  Target: SCN10A; (-) strand; PAM type: YTN; PAM sequence: TTA
tttttctcttatttctgtga

SEQ ID NO: 41204 - DNA, 20 bp, Artificial Sequence
  Description of Artificial Sequence: Synthetic oligonucleotide
  Target: SCN10A; (-) strand; PAM type: YTN; PAM sequence: TTT
atttttctcttatttctgtg

SEQ ID NO: 41205 - DNA, 20 bp, Artificial Sequence
  Description of Artificial Sequence: Synthetic oligonucleotide
  Target: SCN10A; (-) strand; PAM type: YTN; PAM sequence: TTT
tatttttctcttatttctgt

SEQ ID NO: 41206 - DNA, 20 bp, Artificial Sequence
  Description of Artificial Sequence: Synthetic oligonucleotide
  Target: SCN10A; (-) strand; PAM type: YTN; PAM sequence: TTA
tatcataaagcatcatttta

SEQ ID NO: 41207 - DNA, 20 bp, Artificial Sequence
  Description of Artificial Sequence: Synthetic oligonucleotide
  Target: SCN10A; (-) strand; PAM type: YTN; PAM sequence: TTA
aatgtatgtccacaccagcg

SEQ ID NO: 41208 - DNA, 20 bp, Artificial Sequence
  Description of Artificial Sequence: Synthetic oligonucleotide
  Target: SCN10A; (-) strand; PAM type: YTN; PAM sequence: TTT
aaatgtatgtccacaccagc

SEQ ID NO: 41209 - DNA, 20 bp, Artificial Sequence
  Description of Artificial Sequence: Synthetic oligonucleotide
  Target: SCN10A; (-) strand; PAM type: YTN; PAM sequence: TTT
taaatgtatgtccacaccag

SEQ ID NO: 41210 - DNA, 20 bp, Artificial Sequence
  Description of Artificial Sequence: Synthetic oligonucleotide
  Target: SCN10A; (-) strand; PAM type: YTN; PAM sequence: TTT
ttaaatgtatgtccacacca

SEQ ID NO: 41211 - DNA, 20 bp, Artificial Sequence
  Description of Artificial Sequence: Synthetic oligonucleotide
  Target: SCN10A; (-) strand; PAM type: YTN; PAM sequence: TTA
atatttttaaatgtatgtcc

SEQ ID NO: 41212 - DNA, 20 bp, Artificial Sequence
  Description of Artificial Sequence: Synthetic oligonucleotide
  Target: SCN10A; (-) strand; PAM type: YTN; PAM sequence: TTA
aaattaatatttttaaatgt

SEQ ID NO: 41213 - DNA, 20 bp, Artificial Sequence
  Description of Artificial Sequence: Synthetic oligonucleotide
  Target: SCN10A; (-) strand; PAM type: YTN; PAM sequence: TTG
agatatccattaaaattaat

SEQ ID NO: 41214 - DNA, 20 bp, Artificial Sequence
  Description of Artificial Sequence: Synthetic oligonucleotide
  Target: SCN10A; (-) strand; PAM type: YTN; PAM sequence: TTT
gagatatccattaaaattaa

SEQ ID NO: 41215 - DNA, 20 bp, Artificial Sequence
  Description of Artificial Sequence: Synthetic oligonucleotide
  Target: SCN10A; (-) strand; PAM type: YTN; PAM sequence: CTT
tgagatatccattaaaatta

SEQ ID NO: 41216 - DNA, 20 bp, Artificial Sequence
  Description of Artificial Sequence: Synthetic oligonucleotide
  Target: SCN10A; (-) strand; PAM type: YTN; PAM sequence: CTA
tgtcatgaaaagcctttgag

SEQ ID NO: 41217 - DNA, 20 bp, Artificial Sequence
  Description of Artificial Sequence: Synthetic oligonucleotide
  Target: SCN10A; (-) strand; PAM type: YTN; PAM sequence: CTG
tggcctatgtcatgaaaagc

SEQ ID NO: 41218 - DNA, 20 bp, Artificial Sequence
  Description of Artificial Sequence: Synthetic oligonucleotide
  Target: SCN10A; (-) strand; PAM type: YTN; PAM sequence: CTG
acccagggtaacacctgtgg

SEQ ID NO: 41219 - DNA, 20 bp, Artificial Sequence
  Description of Artificial Sequence: Synthetic oligonucleotide
  Target: SCN10A; (-) strand; PAM type: YTN; PAM sequence: CTC
tgacccagggtaacacctgt

SEQ ID NO: 41220 - DNA, 20 bp, Artificial Sequence
  Description of Artificial Sequence: Synthetic oligonucleotide
  Target: SCN10A; (-) strand; PAM type: YTN; PAM sequence: CTG
ctctgacccagggtaacacc

SEQ ID NO: 41221 - DNA, 20 bp, Artificial Sequence
  Description of Artificial Sequence: Synthetic oligonucleotide
  Target: SCN10A; (-) strand; PAM type: YTN; PAM sequence: CTG
tcggacaactgctctgaccc

SEQ ID NO: 41222 - DNA, 20 bp, Artificial Sequence
  Description of Artificial Sequence: Synthetic oligonucleotide
  Target: SCN10A; (-) strand; PAM type: YTN; PAM sequence: CTG
catgtgagagctgtcggaca

SEQ ID NO: 41223 - DNA, 20 bp, Artificial Sequence
  Description of Artificial Sequence: Synthetic oligonucleotide
  Target: SCN10A; (-) strand; PAM type: YTN; PAM sequence: TTG
catgactgcatgtgagagct

SEQ ID NO: 41224 - DNA, 20 bp, Artificial Sequence
  Description of Artificial Sequence: Synthetic oligonucleotide
  Target: SCN10A; (-) strand; PAM type: YTN; PAM sequence: TTT
gcatgactgcatgtgagagc

SEQ ID NO: 41225 - DNA, 20 bp, Artificial Sequence
  Description of Artificial Sequence: Synthetic oligonucleotide
  Target: SCN10A; (-) strand; PAM type: YTN; PAM sequence: TTT
tgcatgactgcatgtgagag

SEQ ID NO: 41226 - DNA, 20 bp, Artificial Sequence
  Description of Artificial Sequence: Synthetic oligonucleotide
  Target: SCN10A; (-) strand; PAM type: YTN; PAM sequence: TTA
ggattttgcatgactgcatg

SEQ ID NO: 41227 - DNA, 20 bp, Artificial Sequence
  Description of Artificial Sequence: Synthetic oligonucleotide
  Target: SCN10A; (-) strand; PAM type: YTN; PAM sequence: TTT
aggattttgcatgactgcat

SEQ ID NO: 41228 - DNA, 20 bp, Artificial Sequence
  Description of Artificial Sequence: Synthetic oligonucleotide
  Target: SCN10A; (-) strand; PAM type: YTN; PAM sequence: TTA
tttaggattttgcatgactg

SEQ ID NO: 41229 - DNA, 20 bp, Artificial Sequence
  Description of Artificial Sequence: Synthetic oligonucleotide
  Target: SCN10A; (-) strand; PAM type: YTN; PAM sequence: TTG
gcaatattatttaggatttt

SEQ ID NO: 41230 - DNA, 20 bp, Artificial Sequence
  Description of Artificial Sequence: Synthetic oligonucleotide
  Target: SCN10A; (-) strand; PAM type: YTN; PAM sequence: CTG
tggagcaccatacagagatt

SEQ ID NO: 41231 - DNA, 20 bp, Artificial Sequence
  Description of Artificial Sequence: Synthetic oligonucleotide
  Target: SCN10A; (-) strand; PAM type: YTN; PAM sequence: CTC
tgtggagcaccatacagaga

SEQ ID NO: 41232 - DNA, 20 bp, Artificial Sequence
  Description of Artificial Sequence: Synthetic oligonucleotide
  Target: SCN10A; (-) strand; PAM type: YTN; PAM sequence: CTG
aaggtccaaggtagtcctct

SEQ ID NO: 41233 - DNA, 20 bp, Artificial Sequence
  Description of Artificial Sequence: Synthetic oligonucleotide
  Target: SCN10A; (-) strand; PAM type: YTN; PAM sequence: TTA
ctgaaggtccaaggtagtcc

SEQ ID NO: 41234 - DNA, 20 bp, Artificial Sequence
  Description of Artificial Sequence: Synthetic oligonucleotide
  Target: SCN10A; (-) strand; PAM type: YTN; PAM sequence: TTC
caaagatatagaacaagaac

SEQ ID NO: 41235 - DNA, 20 bp, Artificial Sequence
  Description of Artificial Sequence: Synthetic oligonucleotide
  Target: SCN10A; (-) strand; PAM type: YTN; PAM sequence: CTT
ccaaagatatagaacaagaa

SEQ ID NO: 41236 - DNA, 20 bp, Artificial Sequence
  Description of Artificial Sequence: Synthetic oligonucleotide
  Target: SCN10A; (-) strand; PAM type: YTN; PAM sequence: CTC
aggaccagaacttccaaaga

SEQ ID NO: 41237 - DNA, 20 bp, Artificial Sequence
  Description of Artificial Sequence: Synthetic oligonucleotide
  Target: SCN10A; (-) strand; PAM type: YTN; PAM sequence: TTC
tcaggaccagaacttccaaa

SEQ ID NO: 41238 - DNA, 20 bp, Artificial Sequence
  Description of Artificial Sequence: Synthetic oligonucleotide
  Target: SCN10A; (-) strand; PAM type: YTN; PAM sequence: CTT
ctcaggaccagaacttccaa

SEQ ID NO: 41239 - DNA, 20 bp, Artificial Sequence
  Description of Artificial Sequence: Synthetic oligonucleotide
  Target: SCN10A; (-) strand; PAM type: YTN; PAM sequence: CTG
agacaaacttctcaggacca

SEQ ID NO: 41240 - DNA, 20 bp, Artificial Sequence
  Description of Artificial Sequence: Synthetic oligonucleotide
  Target: SCN10A; (-) strand; PAM type: YTN; PAM sequence: TTA
ctgagacaaacttctcagga

SEQ ID NO: 41241 - DNA, 20 bp, Artificial Sequence
  Description of Artificial Sequence: Synthetic oligonucleotide
  Target: SCN10A; (-) strand; PAM type: YTN; PAM sequence: TTT
actgagacaaacttctcagg

SEQ ID NO: 41242 - DNA, 20 bp, Artificial Sequence
  Description of Artificial Sequence: Synthetic oligonucleotide
  Target: SCN10A; (-) strand; PAM type: YTN; PAM sequence: TTA
tatttactgagacaaacttc

SEQ ID NO: 41243 - DNA, 20 bp, Artificial Sequence
  Description of Artificial Sequence: Synthetic oligonucleotide
  Target: SCN10A; (-) strand; PAM type: YTN; PAM sequence: TTG
taatcagattatatttactg

SEQ ID NO: 41244 - DNA, 20 bp, Artificial Sequence
  Description of Artificial Sequence: Synthetic oligonucleotide
  Target: SCN10A; (-) strand; PAM type: YTN; PAM sequence: TTG
ttgtaatcagattatattta

SEQ ID NO: 41245 - DNA, 20 bp, Artificial Sequence
  Description of Artificial Sequence: Synthetic oligonucleotide
  Target: SCN10A; (-) strand; PAM type: YTN; PAM sequence: TTT
gttgtaatcagattatattt

SEQ ID NO: 41246 - DNA, 20 bp, Artificial Sequence
  Description of Artificial Sequence: Synthetic oligonucleotide
  Target: SCN10A; (-) strand; PAM type: YTN; PAM sequence: TTT
tgttgtaatcagattatatt

SEQ ID NO: 41247 - DNA, 20 bp, Artificial Sequence
  Description of Artificial Sequence: Synthetic oligonucleotide
  Target: SCN10A; (-) strand; PAM type: YTN; PAM sequence: TTT
ttgttgtaatcagattatat

SEQ ID NO: 41248 - DNA, 20 bp, Artificial Sequence
  Description of Artificial Sequence: Synthetic oligonucleotide
  Target: SCN10A; (-) strand; PAM type: YTN; PAM sequence: TTA
tttttgttgtaatcagatta

SEQ ID NO: 41249 - DNA, 20 bp, Artificial Sequence
  Description of Artificial Sequence: Synthetic oligonucleotide
  Target: SCN10A; (-) strand; PAM type: YTN; PAM sequence: TTT
atttttgttgtaatcagatt

SEQ ID NO: 41250 - DNA, 20 bp, Artificial Sequence
  Description of Artificial Sequence: Synthetic oligonucleotide
  Target: SCN10A; (-) strand; PAM type: YTN; PAM sequence: TTT
tatttttgttgtaatcagat

SEQ ID NO: 41251 - DNA, 20 bp, Artificial Sequence
  Description of Artificial Sequence: Synthetic oligonucleotide
  Target: SCN10A; (-) strand; PAM type: YTN; PAM sequence: CTT
ttatttttgttgtaatcaga

SEQ ID NO: 41252 - DNA, 20 bp, Artificial Sequence
  Description of Artificial Sequence: Synthetic oligonucleotide
  Target: SCN10A; (-) strand; PAM type: YTN; PAM sequence: TTG
tccttttatttttgttgtaa

SEQ ID NO: 41253 - DNA, 20 bp, Artificial Sequence
  Description of Artificial Sequence: Synthetic oligonucleotide
  Target: SCN10A; (-) strand; PAM type: YTN; PAM sequence: CTT
gtccttttatttttgttgta

SEQ ID NO: 41254 - DNA, 20 bp, Artificial Sequence
  Description of Artificial Sequence: Synthetic oligonucleotide
  Target: SCN10A; (-) strand; PAM type: YTN; PAM sequence: CTC
cagaaaatatcccttgtcct

SEQ ID NO: 41255 - DNA, 20 bp, Artificial Sequence
  Description of Artificial Sequence: Synthetic oligonucleotide
  Target: SCN10A; (-) strand; PAM type: YTN; PAM sequence: CTC
tccagaaaatatcccttgtc

SEQ ID NO: 41256 - DNA, 20 bp, Artificial Sequence
  Description of Artificial Sequence: Synthetic oligonucleotide
  Target: SCN10A; (-) strand; PAM type: YTN; PAM sequence: TTA
ctctccagaaaatatccctt

SEQ ID NO: 41257 - DNA, 20 bp, Artificial Sequence
  Description of Artificial Sequence: Synthetic oligonucleotide
  Target: SCN10A; (-) strand; PAM type: YTN; PAM sequence: CTT
actctccagaaaatatccct

SEQ ID NO: 41258 - DNA, 20 bp, Artificial Sequence
  Description of Artificial Sequence: Synthetic oligonucleotide
  Target: SCN10A; (-) strand; PAM type: YTN; PAM sequence: CTC
ttactctccagaaaatatcc

SEQ ID NO: 41259 - DNA, 20 bp, Artificial Sequence
  Description of Artificial Sequence: Synthetic oligonucleotide
  Target: SCN10A; (-) strand; PAM type: YTN; PAM sequence: TTC
tcttactctccagaaaatat

SEQ ID NO: 41260 - DNA, 20 bp, Artificial Sequence
  Description of Artificial Sequence: Synthetic oligonucleotide
  Target: SCN10A; (-) strand; PAM type: YTN; PAM sequence: TTC
aatatcagatcatgggttct

SEQ ID NO: 41261 - DNA, 20 bp, Artificial Sequence
  Description of Artificial Sequence: Synthetic oligonucleotide
  Target: SCN10A; (-) strand; PAM type: YTN; PAM sequence: TTT
caatatcagatcatgggttc

SEQ ID NO: 41262 - DNA, 20 bp, Artificial Sequence
  Description of Artificial Sequence: Synthetic oligonucleotide
  Target: SCN10A; (-) strand; PAM type: YTN; PAM sequence: CTG
aatttcaatatcagatcatg

SEQ ID NO: 41263 - DNA, 20 bp, Artificial Sequence
  Description of Artificial Sequence: Synthetic oligonucleotide
  Target: SCN10A; (-) strand; PAM type: YTN; PAM sequence: TTC
tgaatttcaatatcagatca

SEQ ID NO: 41264 - DNA, 20 bp, Artificial Sequence
  Description of Artificial Sequence: Synthetic oligonucleotide
  Target: SCN10A; (-) strand; PAM type: YTN; PAM sequence: CTT
ctgaatttcaatatcagatc

SEQ ID NO: 41265 - DNA, 20 bp, Artificial Sequence
  Description of Artificial Sequence: Synthetic oligonucleotide
  Target: SCN10A; (-) strand; PAM type: YTN; PAM sequence: TTC
ccttctgaatttcaatatca

SEQ ID NO: 41266 - DNA, 20 bp, Artificial Sequence
  Description of Artificial Sequence: Synthetic oligonucleotide
  Target: SCN10A; (-) strand; PAM type: YTN; PAM sequence: TTT
cccttctgaatttcaatatc

SEQ ID NO: 41267 - DNA, 20 bp, Artificial Sequence
  Description of Artificial Sequence: Synthetic oligonucleotide
  Target: SCN10A; (-) strand; PAM type: YTN; PAM sequence: CTG
tgatttcccttctgaatttc

SEQ ID NO: 41268 - DNA, 20 bp, Artificial Sequence
  Description of Artificial Sequence: Synthetic oligonucleotide
  Target: SCN10A; (-) strand; PAM type: YTN; PAM sequence: TTC
cactgtgatttcccttctga

SEQ ID NO: 41269 - DNA, 20 bp, Artificial Sequence
  Description of Artificial Sequence: Synthetic oligonucleotide
  Target: SCN10A; (-) strand; PAM type: YTN; PAM sequence: CTT
ccactgtgatttcccttctg

SEQ ID NO: 41270 - DNA, 20 bp, Artificial Sequence
  Description of Artificial Sequence: Synthetic oligonucleotide
  Target: SCN10A; (-) strand; PAM type: YTN; PAM sequence: CTA
agagcacttccactgtgatt

SEQ ID NO: 41271 - DNA, 20 bp, Artificial Sequence
  Description of Artificial Sequence: Synthetic oligonucleotide
  Target: SCN10A; (-) strand; PAM type: YTN; PAM sequence: TTG
aaaaaaccatcatacacaaa

SEQ ID NO: 41272 - DNA, 20 bp, Artificial Sequence
  Description of Artificial Sequence: Synthetic oligonucleotide
  Target: SCN10A; (-) strand; PAM type: YTN; PAM sequence: TTT
gaaaaaaccatcatacacaa

SEQ ID NO: 41273 - DNA, 20 bp, Artificial Sequence
  Description of Artificial Sequence: Synthetic oligonucleotide
  Target: SCN10A; (-) strand; PAM type: YTN; PAM sequence: CTT
tgaaaaaaccatcatacaca

SEQ ID NO: 41274 - DNA, 20 bp, Artificial Sequence
  Description of Artificial Sequence: Synthetic oligonucleotide
  Target: SCN10A; (-) strand; PAM type: YTN; PAM sequence: CTG
gtaaccacctttgaaaaaac

SEQ ID NO: 41275 - DNA, 20 bp, Artificial Sequence
  Description of Artificial Sequence: Synthetic oligonucleotide
  Target: SCN10A; (-) strand; PAM type: YTN; PAM sequence: CTG
ggcagggaatgcaactggta

SEQ ID NO: 41276 - DNA, 20 bp, Artificial Sequence
  Description of Artificial Sequence: Synthetic oligonucleotide
  Target: SCN10A; (-) strand; PAM type: YTN; PAM sequence: CTG
gtcacaatgtcagaactggg

SEQ ID NO: 41277 - DNA, 20 bp, Artificial Sequence
  Description of Artificial Sequence: Synthetic oligonucleotide
  Target: SCN10A; (-) strand; PAM type: YTN; PAM sequence: CTC
accaatgcatgccactggtc

SEQ ID NO: 41278 - DNA, 20 bp, Artificial Sequence
  Description of Artificial Sequence: Synthetic oligonucleotide
  Target: SCN10A; (-) strand; PAM type: YTN; PAM sequence: CTA
cagcctcaccaatgcatgcc

SEQ ID NO: 41279 - DNA, 20 bp, Artificial Sequence
  Description of Artificial Sequence: Synthetic oligonucleotide
  Target: SCN10A; (-) strand; PAM type: YTN; PAM sequence: TTG
cagatcacacccagctacag

SEQ ID NO: 41280 - DNA, 20 bp, Artificial Sequence
  Description of Artificial Sequence: Synthetic oligonucleotide
  Target: SCN10A; (-) strand; PAM type: YTN; PAM sequence: TTC
ccattgcagatcacacccag

SEQ ID NO: 41281 - DNA, 20 bp, Artificial Sequence
  Description of Artificial Sequence: Synthetic oligonucleotide
  Target: SCN10A; (-) strand; PAM type: YTN; PAM sequence: TTT
cccattgcagatcacaccca

SEQ ID NO: 41282 - DNA, 20 bp, Artificial Sequence
  Description of Artificial Sequence: Synthetic oligonucleotide
  Target: SCN10A; (-) strand; PAM type: YTN; PAM sequence: CTT
tcccattgcagatcacaccc

SEQ ID NO: 41283 - DNA, 20 bp, Artificial Sequence
  Description of Artificial Sequence: Synthetic oligonucleotide
  Target: SCN10A; (-) strand; PAM type: YTN; PAM sequence: CTC
tttcccattgcagatcacac

SEQ ID NO: 41284 - DNA, 20 bp, Artificial Sequence
  Description of Artificial Sequence: Synthetic oligonucleotide
  Target: SCN10A; (-) strand; PAM type: YTN; PAM sequence: TTA
actctttcccattgcagatc

SEQ ID NO: 41285 - DNA, 20 bp, Artificial Sequence
  Description of Artificial Sequence: Synthetic oligonucleotide
  Target: SCN10A; (-) strand; PAM type: YTN; PAM sequence: CTG
tgttaactctttcccattgc

SEQ ID NO: 41286 - DNA, 20 bp, Artificial Sequence
  Description of Artificial Sequence: Synthetic oligonucleotide
  Target: SCN10A; (-) strand; PAM type: YTN; PAM sequence: CTC
tgtgttaactctttcccatt

SEQ ID NO: 41287 - DNA, 20 bp, Artificial Sequence
  Description of Artificial Sequence: Synthetic oligonucleotide
  Target: SCN10A; (-) strand; PAM type: YTN; PAM sequence: CTG
ctctgtgttaactctttccc

SEQ ID NO: 41288 - DNA, 20 bp, Artificial Sequence
  Description of Artificial Sequence: Synthetic oligonucleotide
  Target: SCN10A; (-) strand; PAM type: YTN; PAM sequence: TTC
tgctctgtgttaactctttc

SEQ ID NO: 41289 - DNA, 20 bp, Artificial Sequence
  Description of Artificial Sequence: Synthetic oligonucleotide
  Target: SCN10A; (-) strand; PAM type: YTN; PAM sequence: CTT
ctgctctgtgttaactcttt

SEQ ID NO: 41290 - DNA, 20 bp, Artificial Sequence
  Description of Artificial Sequence: Synthetic oligonucleotide
  Target: SCN10A; (-) strand; PAM type: YTN; PAM sequence: TTA
tgatgcgtccttctgctctg

SEQ ID NO: 41291 - DNA, 20 bp, Artificial Sequence
  Description of Artificial Sequence: Synthetic oligonucleotide
  Target: SCN10A; (-) strand; PAM type: YTN; PAM sequence: TTC
agttatgatgcgtccttctg

SEQ ID NO: 41292 - DNA, 20 bp, Artificial Sequence
  Description of Artificial Sequence: Synthetic oligonucleotide
  Target: SCN10A; (-) strand; PAM type: YTN; PAM sequence: CTG
gatatgttcagttatgatgc

SEQ ID NO: 41293 - DNA, 20 bp, Artificial Sequence
  Description of Artificial Sequence: Synthetic oligonucleotide
  Target: SCN10A; (-) strand; PAM type: YTN; PAM sequence: CTC
cagcctggatatgttcagtt

SEQ ID NO: 41294 - DNA, 20 bp, Artificial Sequence
  Description of Artificial Sequence: Synthetic oligonucleotide
  Target: SCN10A; (-) strand; PAM type: YTN; PAM sequence: CTA
gtgagaacactccagcctgg

SEQ ID NO: 41295 - DNA, 20 bp, Artificial Sequence
  Description of Artificial Sequence: Synthetic oligonucleotide
  Target: SCN10A; (-) strand; PAM type: YTN; PAM sequence: CTG
ggccctagtgagaacactcc

SEQ ID NO: 41296 - DNA, 20 bp, Artificial Sequence
  Description of Artificial Sequence: Synthetic oligonucleotide
  Target: SCN10A; (-) strand; PAM type: YTN; PAM sequence: TTG
cccctgggccctagtgagaa

SEQ ID NO: 41297 - DNA, 20 bp, Artificial Sequence
  Description of Artificial Sequence: Synthetic oligonucleotide
  Target: SCN10A; (-) strand; PAM type: YTN; PAM sequence: CTG
attgcccctgggccctagtg

SEQ ID NO: 41298 - DNA, 20 bp, Artificial Sequence
  Description of Artificial Sequence: Synthetic oligonucleotide
  Target: SCN10A; (-) strand; PAM type: YTN; PAM sequence: CTC
aatacaaaatgaagatgaag

SEQ ID NO: 41299 - DNA, 20 bp, Artificial Sequence
  Description of Artificial Sequence: Synthetic oligonucleotide
  Target: SCN10A; (-) strand; PAM type: YTN; PAM sequence: CTA
gctcaatacaaaatgaagat

SEQ ID NO: 41300 - DNA, 20 bp, Artificial Sequence
  Description of Artificial Sequence: Synthetic oligonucleotide
  Target: SCN10A; (-) strand; PAM type: YTN; PAM sequence: TTA
gtgatagagtcaacatgagg

SEQ ID NO: 41301 - DNA, 20 bp, Artificial Sequence
  Description of Artificial Sequence: Synthetic oligonucleotide
  Target: SCN10A; (-) strand; PAM type: YTN; PAM sequence: CTT
agtgatagagtcaacatgag

SEQ ID NO: 41302 - DNA, 20 bp, Artificial Sequence
  Description of Artificial Sequence: Synthetic oligonucleotide
  Target: SCN10A; (-) strand; PAM type: YTN; PAM sequence: CTA
gaggccttagtgatagagtc

SEQ ID NO: 41303 - DNA, 20 bp, Artificial Sequence
  Description of Artificial Sequence: Synthetic oligonucleotide
  Target: SCN10A; (-) strand; PAM type: YTN; PAM sequence: CTA
tgagagtgtcactagaggcc

SEQ ID NO: 41304 - DNA, 20 bp, Artificial Sequence
  Description of Artificial Sequence: Synthetic oligonucleotide
  Target: SCN10A; (-) strand; PAM type: YTN; PAM sequence: TTC
ccaccgtcctatgagagtgt

SEQ ID NO: 41305 - DNA, 20 bp, Artificial Sequence
  Description of Artificial Sequence: Synthetic oligonucleotide
  Target: SCN10A; (-) strand; PAM type: YTN; PAM sequence: CTG
ccacatcattcccaccgtcc

SEQ ID NO: 41306 - DNA, 20 bp, Artificial Sequence
  Description of Artificial Sequence: Synthetic oligonucleotide
  Target: SCN10A; (-) strand; PAM type: YTN; PAM sequence: TTC
tgccacatcattcccaccgt

SEQ ID NO: 41307 - DNA, 20 bp, Artificial Sequence
  Description of Artificial Sequence: Synthetic oligonucleotide
  Target: SCN10A; (-) strand; PAM type: YTN; PAM sequence: CTT
ctgccacatcattcccaccg

SEQ ID NO: 41308 - DNA, 20 bp, Artificial Sequence
  Description of Artificial Sequence: Synthetic oligonucleotide
  Target: SCN10A; (-) strand; PAM type: YTN; PAM sequence: CTG
cttctgccacatcattccca

SEQ ID NO: 41309 - DNA, 20 bp, Artificial Sequence
  Description of Artificial Sequence: Synthetic oligonucleotide
  Target: SCN10A; (-) strand; PAM type: YTN; PAM sequence: CTG
aaactgcttctgccacatca

SEQ ID NO: 41310 - DNA, 20 bp, Artificial Sequence
  Description of Artificial Sequence: Synthetic oligonucleotide
  Target: SCN10A; (-) strand; PAM type: YTN; PAM sequence: CTC
ccagacaaatctgaaactgc

SEQ ID NO: 41311 - DNA, 20 bp, Artificial Sequence
  Description of Artificial Sequence: Synthetic oligonucleotide
  Target: SCN10A; (-) strand; PAM type: YTN; PAM sequence: TTG
tgtactcccagacaaatctg

SEQ ID NO: 41312 - DNA, 20 bp, Artificial Sequence
  Description of Artificial Sequence: Synthetic oligonucleotide
  Target: SCN10A; (-) strand; PAM type: YTN; PAM sequence: TTC
acagcaaatgaaaattgtgt

SEQ ID NO: 41313 - DNA, 20 bp, Artificial Sequence
  Description of Artificial Sequence: Synthetic oligonucleotide
  Target: SCN10A; (-) strand; PAM type: YTN; PAM sequence: TTG
cattcacagcaaatgaaaat

SEQ ID NO: 41314 - DNA, 20 bp, Artificial Sequence
  Description of Artificial Sequence: Synthetic oligonucleotide
  Target: SCN10A; (-) strand; PAM type: YTN; PAM sequence: TTG
ttgcattcacagcaaatgaa

SEQ ID NO: 41315 - DNA, 20 bp, Artificial Sequence
  Description of Artificial Sequence: Synthetic oligonucleotide
  Target: SCN10A; (-) strand; PAM type: YTN; PAM sequence: TTT
gttgcattcacagcaaatga

SEQ ID NO: 41316 - DNA, 20 bp, Artificial Sequence
  Description of Artificial Sequence: Synthetic oligonucleotide
  Target: SCN10A; (-) strand; PAM type: YTN; PAM sequence: TTT
tgttgcattcacagcaaatg

SEQ ID NO: 41317 - DNA, 20 bp, Artificial Sequence
  Description of Artificial Sequence: Synthetic oligonucleotide
  Target: SCN10A; (-) strand; PAM type: YTN; PAM sequence: CTC
ccagatgaaggttttgttgc

SEQ ID NO: 41318 - DNA, 20 bp, Artificial Sequence
  Description of Artificial Sequence: Synthetic oligonucleotide
  Target: SCN10A; (-) strand; PAM type: YTN; PAM sequence: CTG
catcactcccagatgaaggt

SEQ ID NO: 41319 - DNA, 20 bp, Artificial Sequence
  Description of Artificial Sequence: Synthetic oligonucleotide
  Target: SCN10A; (-) strand; PAM type: YTN; PAM sequence: CTG
aggaggaggctgcatcactc

SEQ ID NO: 41320 - DNA, 20 bp, Artificial Sequence
  Description of Artificial Sequence: Synthetic oligonucleotide
  Target: SCN10A; (-) strand; PAM type: YTN; PAM sequence: CTA
acaccccatgtgtgcccaga

SEQ ID NO: 41321 - DNA, 20 bp, Artificial Sequence
  Description of Artificial Sequence: Synthetic oligonucleotide
  Target: SCN10A; (-) strand; PAM type: YTN; PAM sequence: CTC
taacaccccatgtgtgccca

SEQ ID NO: 41322 - DNA, 20 bp, Artificial Sequence
  Description of Artificial Sequence: Synthetic oligonucleotide
  Target: SCN10A; (-) strand; PAM type: YTN; PAM sequence: CTC
tctaacaccccatgtgtgcc

SEQ ID NO: 41323 - DNA, 20 bp, Artificial Sequence
  Description of Artificial Sequence: Synthetic oligonucleotide
  Target: SCN10A; (-) strand; PAM type: YTN; PAM sequence: CTC
catggcactctctaacaccc

SEQ ID NO: 41324 - DNA, 20 bp, Artificial Sequence
  Description of Artificial Sequence: Synthetic oligonucleotide
  Target: SCN10A; (-) strand; PAM type: YTN; PAM sequence: CTG
caccgctccatggcactctc

SEQ ID NO: 41325 - DNA, 20 bp, Artificial Sequence
  Description of Artificial Sequence: Synthetic oligonucleotide
  Target: SCN10A; (-) strand; PAM type: YTN; PAM sequence: CTA
tgtgctgcaccgctccatgg

SEQ ID NO: 41326 - DNA, 20 bp, Artificial Sequence
  Description of Artificial Sequence: Synthetic oligonucleotide
  Target: SCN10A; (-) strand; PAM type: YTN; PAM sequence: CTA
tcggagctatgtgctgcacc

SEQ ID NO: 41327 - DNA, 20 bp, Artificial Sequence
  Description of Artificial Sequence: Synthetic oligonucleotide
  Target: SCN10A; (-) strand; PAM type: YTN; PAM sequence: TTC
aaaaggcctatcggagctat

SEQ ID NO: 41328 - DNA, 20 bp, Artificial Sequence
  Description of Artificial Sequence: Synthetic oligonucleotide
  Target: SCN10A; (-) strand; PAM type: YTN; PAM sequence: CTG
tcattcaaaaggcctatcgg

SEQ ID NO: 41329 - DNA, 20 bp, Artificial Sequence
  Description of Artificial Sequence: Synthetic oligonucleotide
  Target: SCN10A; (-) strand; PAM type: YTN; PAM sequence: TTC
agccactgtcattcaaaagg

SEQ ID NO: 41330 - DNA, 20 bp, Artificial Sequence
  Description of Artificial Sequence: Synthetic oligonucleotide
  Target: SCN10A; (-) strand; PAM type: YTN; PAM sequence: TTT
cagccactgtcattcaaaag

SEQ ID NO: 41331 - DNA, 20 bp, Artificial Sequence
  Description of Artificial Sequence: Synthetic oligonucleotide
  Target: SCN10A; (-) strand; PAM type: YTN; PAM sequence: CTC
cgatggaagcaagaagacat

SEQ ID NO: 41332 - DNA, 20 bp, Artificial Sequence
  Description of Artificial Sequence: Synthetic oligonucleotide
  Target: SCN10A; (-) strand; PAM type: YTN; PAM sequence: CTC
tccgatggaagcaagaagac

SEQ ID NO: 41333 - DNA, 20 bp, Artificial Sequence
  Description of Artificial Sequence: Synthetic oligonucleotide
  Target: SCN10A; (-) strand; PAM type: YTN; PAM sequence: CTA
tgaaccaatagcaaccactc

SEQ ID NO: 41334 - DNA, 20 bp, Artificial Sequence
  Description of Artificial Sequence: Synthetic oligonucleotide
  Target: SCN10A; (-) strand; PAM type: YTN; PAM sequence: TTC
aaaatcatcctatgaaccaa

SEQ ID NO: 41335 - DNA, 20 bp, Artificial Sequence
  Description of Artificial Sequence: Synthetic oligonucleotide
  Target: SCN10A; (-) strand; PAM type: YTN; PAM sequence: TTT
caaaatcatcctatgaacca

SEQ ID NO: 41336 - DNA, 20 bp, Artificial Sequence
  Description of Artificial Sequence: Synthetic oligonucleotide
  Target: SCN10A; (-) strand; PAM type: YTN; PAM sequence: CTT
tcaaaatcatcctatgaacc

SEQ ID NO: 41337 - DNA, 20 bp, Artificial Sequence
  Description of Artificial Sequence: Synthetic oligonucleotide
  Target: SCN10A; (-) strand; PAM type: YTN; PAM sequence: CTA
atctttcaaaatcatcctat

SEQ ID NO: 41338 - DNA, 20 bp, Artificial Sequence
  Description of Artificial Sequence: Synthetic oligonucleotide
  Target: SCN10A; (-) strand; PAM type: YTN; PAM sequence: TTA
tggcaactaatctttcaaaa

SEQ ID NO: 41339 - DNA, 20 bp, Artificial Sequence
  Description of Artificial Sequence: Synthetic oligonucleotide
  Target: SCN10A; (-) strand; PAM type: YTN; PAM sequence: TTT
atggcaactaatctttcaaa

SEQ ID NO: 41340 - DNA, 20 bp, Artificial Sequence
  Description of Artificial Sequence: Synthetic oligonucleotide
  Target: SCN10A; (-) strand; PAM type: YTN; PAM sequence: CTG
aaggcaaatatggaggagaa

SEQ ID NO: 41341 - DNA, 20 bp, Artificial Sequence
  Description of Artificial Sequence: Synthetic oligonucleotide
  Target: SCN10A; (-) strand; PAM type: YTN; PAM sequence: CTC
tgaaggcaaatatggaggag

SEQ ID NO: 41342 - DNA, 20 bp, Artificial Sequence
  Description of Artificial Sequence: Synthetic oligonucleotide
  Target: SCN10A; (-) strand; PAM type: YTN; PAM sequence: TTC
tctgaaggcaaatatggagg

SEQ ID NO: 41343 - DNA, 20 bp, Artificial Sequence
  Description of Artificial Sequence: Synthetic oligonucleotide
  Target: SCN10A; (-) strand; PAM type: YTN; PAM sequence: TTG
gattctctgaaggcaaatat

SEQ ID NO: 41344 - DNA, 20 bp, Artificial Sequence
  Description of Artificial Sequence: Synthetic oligonucleotide
  Target: SCN10A; (-) strand; PAM type: YTN; PAM sequence: CTA
ggagaatccggggagttgga

SEQ ID NO: 41345 - DNA, 20 bp, Artificial Sequence
  Description of Artificial Sequence: Synthetic oligonucleotide
  Target: SCN10A; (-) strand; PAM type: YTN; PAM sequence: TTC
accaagaatgtcctaggaga

SEQ ID NO: 41346 - DNA, 20 bp, Artificial Sequence
  Description of Artificial Sequence: Synthetic oligonucleotide
  Target: SCN10A; (-) strand; PAM type: YTN; PAM sequence: TTT
caccaagaatgtcctaggag

SEQ ID NO: 41347 - DNA, 20 bp, Artificial Sequence
  Description of Artificial Sequence: Synthetic oligonucleotide
  Target: SCN10A; (-) strand; PAM type: YTN; PAM sequence: CTT
tcaccaagaatgtcctagga

SEQ ID NO: 41348 - DNA, 20 bp, Artificial Sequence
  Description of Artificial Sequence: Synthetic oligonucleotide
  Target: SCN10A; (-) strand; PAM type: YTN; PAM sequence: TTG
ctttcaccaagaatgtccta

SEQ ID NO: 41349 - DNA, 20 bp, Artificial Sequence
  Description of Artificial Sequence: Synthetic oligonucleotide
  Target: SCN10A; (-) strand; PAM type: YTN; PAM sequence: TTT
gctttcaccaagaatgtcct

SEQ ID NO: 41350 - DNA, 20 bp, Artificial Sequence
  Description of Artificial Sequence: Synthetic oligonucleotide
  Target: SCN10A; (-) strand; PAM type: YTN; PAM sequence: TTT
tgctttcaccaagaatgtcc

SEQ ID NO: 41351 - DNA, 20 bp, Artificial Sequence
  Description of Artificial Sequence: Synthetic oligonucleotide
  Target: SCN10A; (-) strand; PAM type: YTN; PAM sequence: TTT
ttgctttcaccaagaatgtc

SEQ ID NO: 41352 - DNA, 20 bp, Artificial Sequence
  Description of Artificial Sequence: Synthetic oligonucleotide
  Target: SCN10A; (-) strand; PAM type: YTN; PAM sequence: CTT
tttgctttcaccaagaatgt

SEQ ID NO: 41353 - DNA, 20 bp, Artificial Sequence
  Description of Artificial Sequence: Synthetic oligonucleotide
  Target: SCN10A; (-) strand; PAM type: YTN; PAM sequence: TTG
gacatcctttttgctttcac

SEQ ID NO: 41354 - DNA, 20 bp, Artificial Sequence
  Description of Artificial Sequence: Synthetic oligonucleotide
  Target: SCN10A; (-) strand; PAM type: YTN; PAM sequence: CTT
ggacatcctttttgctttca

SEQ ID NO: 41355 - DNA, 20 bp, Artificial Sequence
  Description of Artificial Sequence: Synthetic oligonucleotide
  Target: SCN10A; (-) strand; PAM type: YTN; PAM sequence: CTG
cttggacatcctttttgctt

SEQ ID NO: 41356 - DNA, 20 bp, Artificial Sequence
  Description of Artificial Sequence: Synthetic oligonucleotide
  Target: SCN10A; (-) strand; PAM type: YTN; PAM sequence: CTG
gagataagatccactgcttg

SEQ ID NO: 41357 - DNA, 20 bp, Artificial Sequence
  Description of Artificial Sequence: Synthetic oligonucleotide
  Target: SCN10A; (-) strand; PAM type: YTN; PAM sequence: TTG
gtccctggagataagatcca

SEQ ID NO: 41358 - DNA, 20 bp, Artificial Sequence
  Description of Artificial Sequence: Synthetic oligonucleotide
  Target: SCN10A; (-) strand; PAM type: YTN; PAM sequence: TTT
ggtccctggagataagatcc

SEQ ID NO: 41359 - DNA, 20 bp, Artificial Sequence
  Description of Artificial Sequence: Synthetic oligonucleotide
  Target: SCN10A; (-) strand; PAM type: YTN; PAM sequence: CTT
tggtccctggagataagatc

SEQ ID NO: 41360 - DNA, 20 bp, Artificial Sequence
  Description of Artificial Sequence: Synthetic oligonucleotide
  Target: SCN10A; (-) strand; PAM type: YTN; PAM sequence: CTG
cctttggtccctggagataa

SEQ ID NO: 41361 - DNA, 20 bp, Artificial Sequence
  Description of Artificial Sequence: Synthetic oligonucleotide
  Target: SCN10A; (-) strand; PAM type: YTN; PAM sequence: CTG
atccagatggacctgccttt

SEQ ID NO: 41362 - DNA, 20 bp, Artificial Sequence
  Description of Artificial Sequence: Synthetic oligonucleotide
  Target: SCN10A; (-) strand; PAM type: YTN; PAM sequence: CTG
agaatcccaaaacccaatcg

SEQ ID NO: 41363 - DNA, 20 bp, Artificial Sequence
  Description of Artificial Sequence: Synthetic oligonucleotide
  Target: SCN10A; (-) strand; PAM type: YTN; PAM sequence: CTG
gtcccctgagaatcccaaaa

SEQ ID NO: 41364 - DNA, 20 bp, Artificial Sequence
  Description of Artificial Sequence: Synthetic oligonucleotide
  Target: SCN10A; (-) strand; PAM type: YTN; PAM sequence: CTC
tggtcccctgagaatcccaa

SEQ ID NO: 41365 - DNA, 20 bp, Artificial Sequence
  Description of Artificial Sequence: Synthetic oligonucleotide
  Target: SCN10A; (-) strand; PAM type: YTN; PAM sequence: CTC
tctggtcccctgagaatccc

SEQ ID NO: 41366 - DNA, 20 bp, Artificial Sequence
  Description of Artificial Sequence: Synthetic oligonucleotide
  Target: SCN10A; (-) strand; PAM type: YTN; PAM sequence: CTC
tctctggtcccctgagaatc

SEQ ID NO: 41367 - DNA, 20 bp, Artificial Sequence
  Description of Artificial Sequence: Synthetic oligonucleotide
  Target: SCN10A; (-) strand; PAM type: YTN; PAM sequence: TTG
cagacactctctctggtccc

SEQ ID NO: 41368 - DNA, 20 bp, Artificial Sequence
  Description of Artificial Sequence: Synthetic oligonucleotide
  Target: SCN10A; (-) strand; PAM type: YTN; PAM sequence: TTT
gcagacactctctctggtcc

SEQ ID NO: 41369 - DNA, 20 bp, Artificial Sequence
  Description of Artificial Sequence: Synthetic oligonucleotide
  Target: SCN10A; (-) strand; PAM type: YTN; PAM sequence: CTT
tgcagacactctctctggtc

SEQ ID NO: 41370 - DNA, 20 bp, Artificial Sequence
  Description of Artificial Sequence: Synthetic oligonucleotide
  Target: SCN10A; (-) strand; PAM type: YTN; PAM sequence: CTC
ggactttgcagacactctct

SEQ ID NO: 41371 - DNA, 20 bp, Artificial Sequence
  Description of Artificial Sequence: Synthetic oligonucleotide
  Target: SCN10A; (-) strand; PAM type: YTN; PAM sequence: CTC
tcggactttgcagacactct

SEQ ID NO: 41372 - DNA, 20 bp, Artificial Sequence
  Description of Artificial Sequence: Synthetic oligonucleotide
  Target: SCN10A; (-) strand; PAM type: YTN; PAM sequence: CTC
tctcggactttgcagacact

SEQ ID NO: 41373 - DNA, 20 bp, Artificial Sequence
  Description of Artificial Sequence: Synthetic oligonucleotide
  Target: SCN10A; (-) strand; PAM type: YTN; PAM sequence: CTG
ctctctcggactttgcagac

SEQ ID NO: 41374 - DNA, 20 bp, Artificial Sequence
  Description of Artificial Sequence: Synthetic oligonucleotide
  Target: SCN10A; (-) strand; PAM type: YTN; PAM sequence: TTC
tgctctctcggactttgcag

SEQ ID NO: 41375 - DNA, 20 bp, Artificial Sequence
  Description of Artificial Sequence: Synthetic oligonucleotide
  Target: SCN10A; (-) strand; PAM type: YTN; PAM sequence: TTT
ctgctctctcggactttgca

SEQ ID NO: 41376 - DNA, 20 bp, Artificial Sequence
  Description of Artificial Sequence: Synthetic oligonucleotide
  Target: SCN10A; (-) strand; PAM type: YTN; PAM sequence: TTT
tctgctctctcggactttgc

SEQ ID NO: 41377 - DNA, 20 bp, Artificial Sequence
  Description of Artificial Sequence: Synthetic oligonucleotide
  Target: SCN10A; (-) strand; PAM type: YTN; PAM sequence: CTT
ttctgctctctcggactttg

SEQ ID NO: 41378 - DNA, 20 bp, Artificial Sequence
  Description of Artificial Sequence: Synthetic oligonucleotide
  Target: SCN10A; (-) strand; PAM type: YTN; PAM sequence: TTA
ccttttctgctctctcggac

SEQ ID NO: 41379 - DNA, 20 bp, Artificial Sequence
  Description of Artificial Sequence: Synthetic oligonucleotide
  Target: SCN10A; (-) strand; PAM type: YTN; PAM sequence: TTA
ttaccttttctgctctctcg

SEQ ID NO: 41380 - DNA, 20 bp, Artificial Sequence
  Description of Artificial Sequence: Synthetic oligonucleotide
  Target: SCN10A; (-) strand; PAM type: YTN; PAM sequence: TTT
attaccttttctgctctctc

SEQ ID NO: 41381 - DNA, 20 bp, Artificial Sequence
  Description of Artificial Sequence: Synthetic oligonucleotide
  Target: SCN10A; (-) strand; PAM type: YTN; PAM sequence: CTC
agtttattaccttttctgct

SEQ ID NO: 41382 - DNA, 20 bp, Artificial Sequence
  Description of Artificial Sequence: Synthetic oligonucleotide
  Target: SCN10A; (-) strand; PAM type: YTN; PAM sequence: TTG
acccagaggccactcagttt

SEQ ID NO: 41383 - DNA, 20 bp, Artificial Sequence
  Description of Artificial Sequence: Synthetic oligonucleotide
  Target: SCN10A; (-) strand; PAM type: YTN; PAM sequence: TTT
gacccagaggccactcagtt

SEQ ID NO: 41384 - DNA, 20 bp, Artificial Sequence
  Description of Artificial Sequence: Synthetic oligonucleotide
  Target: SCN10A; (-) strand; PAM type: YTN; PAM sequence: CTG
ggagaagtttgacccagagg

SEQ ID NO: 41385 - DNA, 20 bp, Artificial Sequence
  Description of Artificial Sequence: Synthetic oligonucleotide
  Target: SCN10A; (-) strand; PAM type: YTN; PAM sequence: CTA
tgagacctgggagaagtttg

SEQ ID NO: 41386 - DNA, 20 bp, Artificial Sequence
  Description of Artificial Sequence: Synthetic oligonucleotide
  Target: SCN10A; (-) strand; PAM type: YTN; PAM sequence: TTC
tatgagacctgggagaagtt

SEQ ID NO: 41387 - DNA, 20 bp, Artificial Sequence
  Description of Artificial Sequence: Synthetic oligonucleotide
  Target: SCN10A; (-) strand; PAM type: YTN; PAM sequence: TTG
acatgttctatgagacctgg

SEQ ID NO: 41388 - DNA, 20 bp, Artificial Sequence
  Description of Artificial Sequence: Synthetic oligonucleotide
  Target: SCN10A; (-) strand; PAM type: YTN; PAM sequence: TTT
gacatgttctatgagacctg

SEQ ID NO: 41389 - DNA, 20 bp, Artificial Sequence
  Description of Artificial Sequence: Synthetic oligonucleotide
  Target: SCN10A; (-) strand; PAM type: YTN; PAM sequence: CTT
tgacatgttctatgagacct

SEQ ID NO: 41390 - DNA, 20 bp, Artificial Sequence
  Description of Artificial Sequence: Synthetic oligonucleotide
  Target: SCN10A; (-) strand; PAM type: YTN; PAM sequence: CTG
agtgaggacgactttgacat

SEQ ID NO: 41391 - DNA, 20 bp, Artificial Sequence
  Description of Artificial Sequence: Synthetic oligonucleotide
  Target: SCN10A; (-) strand; PAM type: YTN; PAM sequence: CTG
agcccctgagtgaggacgac

SEQ ID NO: 41392 - DNA, 20 bp, Artificial Sequence
  Description of Artificial Sequence: Synthetic oligonucleotide
  Target: SCN10A; (-) strand; PAM type: YTN; PAM sequence: TTC
aatgtggccacggaggagag

SEQ ID NO: 41393 - DNA, 20 bp, Artificial Sequence
  Description of Artificial Sequence: Synthetic oligonucleotide
  Target: SCN10A; (-) strand; PAM type: YTN; PAM sequence: CTT
caatgtggccacggaggaga

SEQ ID NO: 41394 - DNA, 20 bp, Artificial Sequence
  Description of Artificial Sequence: Synthetic oligonucleotide
  Target: SCN10A; (-) strand; PAM type: YTN; PAM sequence: CTG
gagaacttcaatgtggccac

SEQ ID NO: 41395 - DNA, 20 bp, Artificial Sequence
  Description of Artificial Sequence: Synthetic oligonucleotide
  Target: SCN10A; (-) strand; PAM type: YTN; PAM sequence: TTC
tggagaacttcaatgtggcc

SEQ ID NO: 41396 - DNA, 20 bp, Artificial Sequence
  Description of Artificial Sequence: Synthetic oligonucleotide
  Target: SCN10A; (-) strand; PAM type: YTN; PAM sequence: TTG
cagtgattctggagaacttc

SEQ ID NO: 41397 - DNA, 20 bp, Artificial Sequence
  Description of Artificial Sequence: Synthetic oligonucleotide
  Target: SCN10A; (-) strand; PAM type: YTN; PAM sequence: CTC
atcatggtcaacatgtacat

SEQ ID NO: 41398 - DNA, 20 bp, Artificial Sequence
  Description of Artificial Sequence: Synthetic oligonucleotide
  Target: SCN10A; (-) strand; PAM type: YTN; PAM sequence: TTC
ctcatcatggtcaacatgta

SEQ ID NO: 41399 - DNA, 20 bp, Artificial Sequence
  Description of Artificial Sequence: Synthetic oligonucleotide
  Target: SCN10A; (-) strand; PAM type: YTN; PAM sequence: CTT
cctcatcatggtcaacatgt

SEQ ID NO: 41400 - DNA, 20 bp, Artificial Sequence
  Description of Artificial Sequence: Synthetic oligonucleotide
  Target: SCN10A; (-) strand; PAM type: YTN; PAM sequence: CTC
cttcctcatcatggtcaaca

SEQ ID NO: 41401 - DNA, 20 bp, Artificial Sequence
  Description of Artificial Sequence: Synthetic oligonucleotide
  Target: SCN10A; (-) strand; PAM type: YTN; PAM sequence: CTA
catcatcatctccttcctca

SEQ ID NO: 41402 - DNA, 20 bp, Artificial Sequence
  Description of Artificial Sequence: Synthetic oligonucleotide
  Target: SCN10A; (-) strand; PAM type: YTN; PAM sequence: TTC
accacctacatcatcatctc

SEQ ID NO: 41403 - DNA, 20 bp, Artificial Sequence
  Description of Artificial Sequence: Synthetic oligonucleotide
  Target: SCN10A; (-) strand; PAM type: YTN; PAM sequence: CTT
caccacctacatcatcatct

SEQ ID NO: 41404 - DNA, 20 bp, Artificial Sequence
  Description of Artificial Sequence: Synthetic oligonucleotide
  Target: SCN10A; (-) strand; PAM type: YTN; PAM sequence: TTC
ttcaccacctacatcatcat

SEQ ID NO: 41405 - DNA, 20 bp, Artificial Sequence
  Description of Artificial Sequence: Synthetic oligonucleotide
  Target: SCN10A; (-) strand; PAM type: YTN; PAM sequence: CTT
cttcaccacctacatcatca

SEQ ID NO: 41406 - DNA, 20 bp, Artificial Sequence
  Description of Artificial Sequence: Synthetic oligonucleotide
  Target: SCN10A; (-) strand; PAM type: YTN; PAM sequence: CTG
tgggagcccagccgtaggca

SEQ ID NO: 41407 - DNA, 20 bp, Artificial Sequence
  Description of Artificial Sequence: Synthetic oligonucleotide
  Target: SCN10A; (-) strand; PAM type: YTN; PAM sequence: CTG
cccaacagcaatggcaccag

SEQ ID NO: 41408 - DNA, 20 bp, Artificial Sequence
  Description of Artificial Sequence: Synthetic oligonucleotide
  Target: SCN10A; (-) strand; PAM type: YTN; PAM sequence: CTG
tgaccccaatctgcccaaca

SEQ ID NO: 41409 - DNA, 20 bp, Artificial Sequence
  Description of Artificial Sequence: Synthetic oligonucleotide
  Target: SCN10A; (-) strand; PAM type: YTN; PAM sequence: CTA
ctgtgaccccaatctgccca

SEQ ID NO: 41410 - DNA, 20 bp, Artificial Sequence
  Description of Artificial Sequence: Synthetic oligonucleotide
  Target: SCN10A; (-) strand; PAM type: YTN; PAM sequence: CTC
aacacagggcccccctactg

SEQ ID NO: 41411 - DNA, 20 bp, Artificial Sequence
  Description of Artificial Sequence: Synthetic oligonucleotide
  Target: SCN10A; (-) strand; PAM type: YTN; PAM sequence: CTC
agccccatcctcaacacagg

SEQ ID NO: 41412 - DNA, 20 bp, Artificial Sequence
  Description of Artificial Sequence: Synthetic oligonucleotide
  Target: SCN10A; (-) strand; PAM type: YTN; PAM sequence: CTC
ctcagccccatcctcaacac

SEQ ID NO: 41413 - DNA, 20 bp, Artificial Sequence
  Description of Artificial Sequence: Synthetic oligonucleotide
  Target: SCN10A; (-) strand; PAM type: YTN; PAM sequence: CTG
ggatggcctcctcagcccca

SEQ ID NO: 41414 - DNA, 20 bp, Artificial Sequence
  Description of Artificial Sequence: Synthetic oligonucleotide
  Target: SCN10A; (-) strand; PAM type: YTN; PAM sequence: TTA
ccacgtcggccggctgggat

SEQ ID NO: 41415 - DNA, 20 bp, Artificial Sequence
  Description of Artificial Sequence: Synthetic oligonucleotide
  Target: SCN10A; (-) strand; PAM type: YTN; PAM sequence: TTC
cagattaccacgtcggccgg

SEQ ID NO: 41416 - DNA, 20 bp, Artificial Sequence
  Description of Artificial Sequence: Synthetic oligonucleotide
  Target: SCN10A; (-) strand; PAM type: YTN; PAM sequence: CTT
ccagattaccacgtcggccg

SEQ ID NO: 41417 - DNA, 20 bp, Artificial Sequence
  Description of Artificial Sequence: Synthetic oligonucleotide
  Target: SCN10A; (-) strand; PAM type: YTN; PAM sequence: CTC
ttccagattaccacgtcggc

SEQ ID NO: 41418 - DNA, 20 bp, Artificial Sequence
  Description of Artificial Sequence: Synthetic oligonucleotide
  Target: SCN10A; (-) strand; PAM type: YTN; PAM sequence: CTG
tgcctcttccagattaccac

SEQ ID NO: 41419 - DNA, 20 bp, Artificial Sequence
  Description of Artificial Sequence: Synthetic oligonucleotide
  Target: SCN10A; (-) strand; PAM type: YTN; PAM sequence: TTC
gccaacagcatgctgtgcct

SEQ ID NO: 41420 - DNA, 20 bp, Artificial Sequence
  Description of Artificial Sequence: Synthetic oligonucleotide
  Target: SCN10A; (-) strand; PAM type: YTN; PAM sequence: CTT
cgccaacagcatgctgtgcc

SEQ ID NO: 41421 - DNA, 20 bp, Artificial Sequence
  Description of Artificial Sequence: Synthetic oligonucleotide
  Target: SCN10A; (-) strand; PAM type: YTN; PAM sequence: TTC
cagaccttcgccaacagcat

SEQ ID NO: 41422 - DNA, 20 bp, Artificial Sequence
  Description of Artificial Sequence: Synthetic oligonucleotide
  Target: SCN10A; (-) strand; PAM type: YTN; PAM sequence: CTT
ccagaccttcgccaacagca

SEQ ID NO: 41423 - DNA, 20 bp, Artificial Sequence
  Description of Artificial Sequence: Synthetic oligonucleotide
  Target: SCN10A; (-) strand; PAM type: YTN; PAM sequence: TTC
aacttccagaccttcgccaa

SEQ ID NO: 41424 - DNA, 20 bp, Artificial Sequence
  Description of Artificial Sequence: Synthetic oligonucleotide
  Target: SCN10A; (-) strand; PAM type: YTN; PAM sequence: CTG
gcatcgacgacatgttcaac

SEQ ID NO: 41425 - DNA, 20 bp, Artificial Sequence
  Description of Artificial Sequence: Synthetic oligonucleotide
  Target: SCN10A; (-) strand; PAM type: YTN; PAM sequence: TTC
cccatgtgaggtgggaggct

SEQ ID NO: 41426 - DNA, 20 bp, Artificial Sequence
  Description of Artificial Sequence: Synthetic oligonucleotide
  Target: SCN10A; (-) strand; PAM type: YTN; PAM sequence: TTT
ccccatgtgaggtgggaggc

SEQ ID NO: 41427 - DNA, 20 bp, Artificial Sequence
  Description of Artificial Sequence: Synthetic oligonucleotide
  Target: SCN10A; (-) strand; PAM type: YTN; PAM sequence: CTT
tccccatgtgaggtgggagg

SEQ ID NO: 41428 - DNA, 20 bp, Artificial Sequence
  Description of Artificial Sequence: Synthetic oligonucleotide
  Target: SCN10A; (-) strand; PAM type: YTN; PAM sequence: TTC
ggtatgtccagctttcccca

SEQ ID NO: 41429 - DNA, 20 bp, Artificial Sequence
  Description of Artificial Sequence: Synthetic oligonucleotide
  Target: SCN10A; (-) strand; PAM type: YTN; PAM sequence: CTT
cggtatgtccagctttcccc

SEQ ID NO: 41430 - DNA, 20 bp, Artificial Sequence
  Description of Artificial Sequence: Synthetic oligonucleotide
  Target: SCN10A; (-) strand; PAM type: YTN; PAM sequence: CTA
tcttcggtatgtccagcttt

SEQ ID NO: 41431 - DNA, 20 bp, Artificial Sequence
  Description of Artificial Sequence: Synthetic oligonucleotide
  Target: SCN10A; (-) strand; PAM type: YTN; PAM sequence: CTC
tatcttcggtatgtccagct

SEQ ID NO: 41432 - DNA, 20 bp, Artificial Sequence
  Description of Artificial Sequence: Synthetic oligonucleotide
  Target: SCN10A; (-) strand; PAM type: YTN; PAM sequence: CTA
ctctatcttcggtatgtcca

SEQ ID NO: 41433 - DNA, 20 bp, Artificial Sequence
  Description of Artificial Sequence: Synthetic oligonucleotide
  Target: SCN10A; (-) strand; PAM type: YTN; PAM sequence: TTC
atctactctatcttcggtat

SEQ ID NO: 41434 - DNA, 20 bp, Artificial Sequence
  Description of Artificial Sequence: Synthetic oligonucleotide
  Target: SCN10A; (-) strand; PAM type: YTN; PAM sequence: TTG
tcatgttcatctactctatc

SEQ ID NO: 41435 - DNA, 20 bp, Artificial Sequence
  Description of Artificial Sequence: Synthetic oligonucleotide
  Target: SCN10A; (-) strand; PAM type: YTN; PAM sequence: CTT
gtcatgttcatctactctat

SEQ ID NO: 41436 - DNA, 20 bp, Artificial Sequence
  Description of Artificial Sequence: Synthetic oligonucleotide
  Target: SCN10A; (-) strand; PAM type: YTN; PAM sequence: TTC
cttgtcatgttcatctactc

SEQ ID NO: 41437 - DNA, 20 bp, Artificial Sequence
  Description of Artificial Sequence: Synthetic oligonucleotide
  Target: SCN10A; (-) strand; PAM type: YTN; PAM sequence: CTA
ttccttgtcatgttcatcta

SEQ ID NO: 41438 - DNA, 20 bp, Artificial Sequence
  Description of Artificial Sequence: Synthetic oligonucleotide
  Target: SCN10A; (-) strand; PAM type: YTN; PAM sequence: TTG
ctattccttgtcatgttcat

SEQ ID NO: 41439 - DNA, 20 bp, Artificial Sequence
  Description of Artificial Sequence: Synthetic oligonucleotide
  Target: SCN10A; (-) strand; PAM type: YTN; PAM sequence: CTG
ttgctattccttgtcatgtt

SEQ ID NO: 41440 - DNA, 20 bp, Artificial Sequence
  Description of Artificial Sequence: Synthetic oligonucleotide
  Target: SCN10A; (-) strand; PAM type: YTN; PAM sequence: TTC
aacatcgggctgttgctatt

SEQ ID NO: 41441 - DNA, 20 bp, Artificial Sequence
  Description of Artificial Sequence: Synthetic oligonucleotide
  Target: SCN10A; (-) strand; PAM type: YTN; PAM sequence: CTT
caacatcgggctgttgctat

SEQ ID NO: 41442 - DNA, 20 bp, Artificial Sequence
  Description of Artificial Sequence: Synthetic oligonucleotide
  Target: SCN10A; (-) strand; PAM type: YTN; PAM sequence: CTC
ttcaacatcgggctgttgct

SEQ ID NO: 41443 - DNA, 20 bp, Artificial Sequence
  Description of Artificial Sequence: Synthetic oligonucleotide
  Target: SCN10A; (-) strand; PAM type: YTN; PAM sequence: CTG
ccctcttcaacatcgggctg

SEQ ID NO: 41444 - DNA, 20 bp, Artificial Sequence
  Description of Artificial Sequence: Synthetic oligonucleotide
  Target: SCN10A; (-) strand; PAM type: YTN; PAM sequence: CTG
cctgccctcttcaacatcgg

SEQ ID NO: 41445 - DNA, 20 bp, Artificial Sequence
  Description of Artificial Sequence: Synthetic oligonucleotide
  Target: SCN10A; (-) strand; PAM type: YTN; PAM sequence: CTC
atgatgtccctgcctgccct

SEQ ID NO: 41446 - DNA, 20 bp, Artificial Sequence
  Description of Artificial Sequence: Synthetic oligonucleotide
  Target: SCN10A; (-) strand; PAM type: YTN; PAM sequence: TTG
ccctcatgatgtccctgcct

SEQ ID NO: 41447 - DNA, 20 bp, Artificial Sequence
  Description of Artificial Sequence: Synthetic oligonucleotide
  Target: SCN10A; (-) strand; PAM type: YTN; PAM sequence: TTT
gccctcatgatgtccctgcc

SEQ ID NO: 41448 - DNA, 20 bp, Artificial Sequence
  Description of Artificial Sequence: Synthetic oligonucleotide
  Target: SCN10A; (-) strand; PAM type: YTN; PAM sequence: CTT
tgccctcatgatgtccctgc

SEQ ID NO: 41449 - DNA, 20 bp, Artificial Sequence
  Description of Artificial Sequence: Synthetic oligonucleotide
  Target: SCN10A; (-) strand; PAM type: YTN; PAM sequence: CTC
tttgccctcatgatgtccct

SEQ ID NO: 41450 - DNA, 20 bp, Artificial Sequence
  Description of Artificial Sequence: Synthetic oligonucleotide
  Target: SCN10A; (-) strand; PAM type: YTN; PAM sequence: CTG
ctctttgccctcatgatgtc

SEQ ID NO: 41451 - DNA, 20 bp, Artificial Sequence
  Description of Artificial Sequence: Synthetic oligonucleotide
  Target: SCN10A; (-) strand; PAM type: YTN; PAM sequence: CTG
atccgagcggccaaggggat

SEQ ID NO: 41452 - DNA, 20 bp, Artificial Sequence
  Description of Artificial Sequence: Synthetic oligonucleotide
  Target: SCN10A; (-) strand; PAM type: YTN; PAM sequence: CTC
agactgatccgagcggccaa

SEQ ID NO: 41453 - DNA, 20 bp, Artificial Sequence
  Description of Artificial Sequence: Synthetic oligonucleotide
  Target: SCN10A; (-) strand; PAM type: YTN; PAM sequence: TTG
gccgcatcctcagactgatc

SEQ ID NO: 41454 - DNA, 20 bp, Artificial Sequence
  Description of Artificial Sequence: Synthetic oligonucleotide
  Target: SCN10A; (-) strand; PAM type: YTN; PAM sequence: CTG
gcccgaattggccgcatcct

SEQ ID NO: 41455 - DNA, 20 bp, Artificial Sequence
  Description of Artificial Sequence: Synthetic oligonucleotide
  Target: SCN10A; (-) strand; PAM type: YTN; PAM sequence: TTC
agagtcatccgcctggcccg

SEQ ID NO: 41456 - DNA, 20 bp, Artificial Sequence
  Description of Artificial Sequence: Synthetic oligonucleotide
  Target: SCN10A; (-) strand; PAM type: YTN; PAM sequence: CTT
cagagtcatccgcctggccc

SEQ ID NO: 41457 - DNA, 20 bp, Artificial Sequence
  Description of Artificial Sequence: Synthetic oligonucleotide
  Target: SCN10A; (-) strand; PAM type: YTN; PAM sequence: CTC
ttcagagtcatccgcctggc

SEQ ID NO: 41458 - DNA, 20 bp, Artificial Sequence
  Description of Artificial Sequence: Synthetic oligonucleotide
  Target: SCN10A; (-) strand; PAM type: YTN; PAM sequence: CTC
cccaacgctcttcagagtca

SEQ ID NO: 41459 - DNA, 20 bp, Artificial Sequence
  Description of Artificial Sequence: Synthetic oligonucleotide
  Target: SCN10A; (-) strand; PAM type: YTN; PAM sequence: TTC
tccccaacgctcttcagagt

SEQ ID NO: 41460 - DNA, 20 bp, Artificial Sequence
  Description of Artificial Sequence: Synthetic oligonucleotide
  Target: SCN10A; (-) strand; PAM type: YTN; PAM sequence: CTT
ctccccaacgctcttcagag

SEQ ID NO: 41461 - DNA, 20 bp, Artificial Sequence
  Description of Artificial Sequence: Synthetic oligonucleotide
  Target: SCN10A; (-) strand; PAM type: YTN; PAM sequence: TTA
cttctccccaacgctcttca

SEQ ID NO: 41462 - DNA, 20 bp, Artificial Sequence
  Description of Artificial Sequence: Synthetic oligonucleotide
  Target: SCN10A; (-) strand; PAM type: YTN; PAM sequence: TTC
aaagttacttctccccaacg

SEQ ID NO: 41463 - DNA, 20 bp, Artificial Sequence
  Description of Artificial Sequence: Synthetic oligonucleotide
  Target: SCN10A; (-) strand; PAM type: YTN; PAM sequence: CTT
caaagttacttctccccaac

SEQ ID NO: 41464 - DNA, 20 bp, Artificial Sequence
  Description of Artificial Sequence: Synthetic oligonucleotide
  Target: SCN10A; (-) strand; PAM type: YTN; PAM sequence: TTA
agtcacttcaaagttacttc

SEQ ID NO: 41465 - DNA, 20 bp, Artificial Sequence
  Description of Artificial Sequence: Synthetic oligonucleotide
  Target: SCN10A; (-) strand; PAM type: YTN; PAM sequence: CTT
aagtcacttcaaagttactt

SEQ ID NO: 41466 - DNA, 20 bp, Artificial Sequence
  Description of Artificial Sequence: Synthetic oligonucleotide
  Target: SCN10A; (-) strand; PAM type: YTN; PAM sequence: TTC
ttaagtcacttcaaagttac

SEQ ID NO: 41467 - DNA, 20 bp, Artificial Sequence
  Description of Artificial Sequence: Synthetic oligonucleotide
  Target: SCN10A; (-) strand; PAM type: YTN; PAM sequence: CTG
caattcttaagtcacttcaa

SEQ ID NO: 41468 - DNA, 20 bp, Artificial Sequence
  Description of Artificial Sequence: Synthetic oligonucleotide
  Target: SCN10A; (-) strand; PAM type: YTN; PAM sequence: TTC
tgcaattcttaagtcacttc

SEQ ID NO: 41469 - DNA, 20 bp, Artificial Sequence
  Description of Artificial Sequence: Synthetic oligonucleotide
  Target: SCN10A; (-) strand; PAM type: YTN; PAM sequence: TTT
ctgcaattcttaagtcactt

SEQ ID NO: 41470 - DNA, 20 bp, Artificial Sequence
  Description of Artificial Sequence: Synthetic oligonucleotide
  Target: SCN10A; (-) strand; PAM type: YTN; PAM sequence: TTT
tctgcaattcttaagtcact

SEQ ID NO: 41471 - DNA, 20 bp, Artificial Sequence
  Description of Artificial Sequence: Synthetic oligonucleotide
  Target: SCN10A; (-) strand; PAM type: YTN; PAM sequence: TTT
ttctgcaattcttaagtcac

SEQ ID NO: 41472 - DNA, 20 bp, Artificial Sequence
  Description of Artificial Sequence: Synthetic oligonucleotide
  Target: SCN10A; (-) strand; PAM type: YTN; PAM sequence: TTT
tttctgcaattcttaagtca

SEQ ID NO: 41473 - DNA, 20 bp, Artificial Sequence
  Description of Artificial Sequence: Synthetic oligonucleotide
  Target: SCN10A; (-) strand; PAM type: YTN; PAM sequence: CTG
attttttctgcaattcttaa

SEQ ID NO: 41474 - DNA, 20 bp, Artificial Sequence
  Description of Artificial Sequence: Synthetic oligonucleotide
  Target: SCN10A; (-) strand; PAM type: YTN; PAM sequence: TTA
aaggcctgattttttctgca

SEQ ID NO: 41475 - DNA, 20 bp, Artificial Sequence
  Description of Artificial Sequence: Synthetic oligonucleotide
  Target: SCN10A; (-) strand; PAM type: YTN; PAM sequence: TTT
aaaggcctgattttttctgc

SEQ ID NO: 41476 - DNA, 20 bp, Artificial Sequence
  Description of Artificial Sequence: Synthetic oligonucleotide
  Target: SCN10A; (-) strand; PAM type: YTN; PAM sequence: TTT
taaaggcctgattttttctg

SEQ ID NO: 41477 - DNA, 20 bp, Artificial Sequence
  Description of Artificial Sequence: Synthetic oligonucleotide
  Target: SCN10A; (-) strand; PAM type: YTN; PAM sequence: CTT
ttaaaggcctgattttttct

SEQ ID NO: 41478 - DNA, 20 bp, Artificial Sequence
  Description of Artificial Sequence: Synthetic oligonucleotide
  Target: SCN10A; (-) strand; PAM type: YTN; PAM sequence: TTC
ttttaaaggcctgatttttt

SEQ ID NO: 41479 - DNA, 20 bp, Artificial Sequence
  Description of Artificial Sequence: Synthetic oligonucleotide
  Target: SCN10A; (-) strand; PAM type: YTN; PAM sequence: CTT
cttttaaaggcctgattttt

SEQ ID NO: 41480 - DNA, 20 bp, Artificial Sequence
  Description of Artificial Sequence: Synthetic oligonucleotide
  Target: SCN10A; (-) strand; PAM type: YTN; PAM sequence: TTC
cttcttttaaaggcctgatt

SEQ ID NO: 41481 - DNA, 20 bp, Artificial Sequence
  Description of Artificial Sequence: Synthetic oligonucleotide
  Target: SCN10A; (-) strand; PAM type: YTN; PAM sequence: CTT
ccttcttttaaaggcctgat

SEQ ID NO: 41482 - DNA, 20 bp, Artificial Sequence
  Description of Artificial Sequence: Synthetic oligonucleotide
  Target: SCN10A; (-) strand; PAM type: YTN; PAM sequence: TTC
ttccttcttttaaaggcctg

SEQ ID NO: 41483 - DNA, 20 bp, Artificial Sequence
  Description of Artificial Sequence: Synthetic oligonucleotide
  Target: SCN10A; (-) strand; PAM type: YTN; PAM sequence: TTT
cttccttcttttaaaggcct

SEQ ID NO: 41484 - DNA, 20 bp, Artificial Sequence
  Description of Artificial Sequence: Synthetic oligonucleotide
  Target: SCN10A; (-) strand; PAM type: YTN; PAM sequence: TTA
gataatttcttccttctttt

SEQ ID NO: 41485 - DNA, 20 bp, Artificial Sequence
  Description of Artificial Sequence: Synthetic oligonucleotide
  Target: SCN10A; (-) strand; PAM type: YTN; PAM sequence: CTA
attagataatttcttccttc

SEQ ID NO: 41486 - DNA, 20 bp, Artificial Sequence
  Description of Artificial Sequence: Synthetic oligonucleotide
  Target: SCN10A; (-) strand; PAM type: YTN; PAM sequence: CTG
gagatactaattagataatt

SEQ ID NO: 41487 - DNA, 20 bp, Artificial Sequence
  Description of Artificial Sequence: Synthetic oligonucleotide
  Target: SCN10A; (-) strand; PAM type: YTN; PAM sequence: CTC
atggctggagatactaatta

SEQ ID NO: 41488 - DNA, 20 bp, Artificial Sequence
  Description of Artificial Sequence: Synthetic oligonucleotide
  Target: SCN10A; (-) strand; PAM type: YTN; PAM sequence: TTG
tcacgtctcatggctggaga

SEQ ID NO: 41489 - DNA, 20 bp, Artificial Sequence
  Description of Artificial Sequence: Synthetic oligonucleotide
  Target: SCN10A; (-) strand; PAM type: YTN; PAM sequence: TTT
gtcacgtctcatggctggag

SEQ ID NO: 41490 - DNA, 20 bp, Artificial Sequence
  Description of Artificial Sequence: Synthetic oligonucleotide
  Target: SCN10A; (-) strand; PAM type: YTN; PAM sequence: CTT
tgtcacgtctcatggctgga

SEQ ID NO: 41491 - DNA, 20 bp, Artificial Sequence
  Description of Artificial Sequence: Synthetic oligonucleotide
  Target: SCN10A; (-) strand; PAM type: YTN; PAM sequence: CTA
taccaagcaaagcagagtgt

SEQ ID NO: 41492 - DNA, 20 bp, Artificial Sequence
  Description of Artificial Sequence: Synthetic oligonucleotide
  Target: SCN10A; (-) strand; PAM type: YTN; PAM sequence: CTC
aaatgtggatgcccaagtgg

SEQ ID NO: 41493 - DNA, 20 bp, Artificial Sequence
  Description of Artificial Sequence: Synthetic oligonucleotide
  Target: SCN10A; (-) strand; PAM type: YTN; PAM sequence: CTG
agggcccagagtcctcaaat

SEQ ID NO: 41494 - DNA, 20 bp, Artificial Sequence
  Description of Artificial Sequence: Synthetic oligonucleotide
  Target: SCN10A; (-) strand; PAM type: YTN; PAM sequence: CTC
tgagggcccagagtcctcaa

SEQ ID NO: 41495 - DNA, 20 bp, Artificial Sequence
  Description of Artificial Sequence: Synthetic oligonucleotide
  Target: SCN10A; (-) strand; PAM type: YTN; PAM sequence: CTA
ccatgccaggctctgagggc

SEQ ID NO: 41496 - DNA, 20 bp, Artificial Sequence
  Description of Artificial Sequence: Synthetic oligonucleotide
  Target: SCN10A; (-) strand; PAM type: YTN; PAM sequence: CTA
cctaccatgccaggctctga

SEQ ID NO: 41497 - DNA, 20 bp, Artificial Sequence
  Description of Artificial Sequence: Synthetic oligonucleotide
  Target: SCN10A; (-) strand; PAM type: YTN; PAM sequence: TTG
tgctacctaccatgccaggc

SEQ ID NO: 41498 - DNA, 20 bp, Artificial Sequence
  Description of Artificial Sequence: Synthetic oligonucleotide
  Target: SCN10A; (-) strand; PAM type: YTN; PAM sequence: TTT
gtgctacctaccatgccagg

SEQ ID NO: 41499 - DNA, 20 bp, Artificial Sequence
  Description of Artificial Sequence: Synthetic oligonucleotide
  Target: SCN10A; (-) strand; PAM type: YTN; PAM sequence: CTT
tgtgctacctaccatgccag

SEQ ID NO: 41500 - DNA, 20 bp, Artificial Sequence
  Description of Artificial Sequence: Synthetic oligonucleotide
  Target: SCN10A; (-) strand; PAM type: YTN; PAM sequence: CTA
ctttgtgctacctaccatgc

SEQ ID NO: 41501 - DNA, 20 bp, Artificial Sequence
  Description of Artificial Sequence: Synthetic oligonucleotide
  Target: SCN10A; (-) strand; PAM type: YTN; PAM sequence: CTG
agcccctactttgtgctacc

SEQ ID NO: 41502 - DNA, 20 bp, Artificial Sequence
  Description of Artificial Sequence: Synthetic oligonucleotide
  Target: SCN10A; (-) strand; PAM type: YTN; PAM sequence: TTA
ctgagcccctactttgtgct

SEQ ID NO: 41503 - DNA, 20 bp, Artificial Sequence
  Description of Artificial Sequence: Synthetic oligonucleotide
  Target: SCN10A; (-) strand; PAM type: YTN; PAM sequence: TTT
actgagcccctactttgtgc

SEQ ID NO: 41504 - DNA, 20 bp, Artificial Sequence
  Description of Artificial Sequence: Synthetic oligonucleotide
  Target: SCN10A; (-) strand; PAM type: YTN; PAM sequence: TTA
tgcaatgggcatttactgag

SEQ ID NO: 41505 - DNA, 20 bp, Artificial Sequence
  Description of Artificial Sequence: Synthetic oligonucleotide
  Target: SCN10A; (-) strand; PAM type: YTN; PAM sequence: CTT
atgcaatgggcatttactga

SEQ ID NO: 41506 - DNA, 20 bp, Artificial Sequence
  Description of Artificial Sequence: Synthetic oligonucleotide
  Target: SCN10A; (-) strand; PAM type: YTN; PAM sequence: CTA
ggcggaggcaaagataacat

SEQ ID NO: 41507 - DNA, 20 bp, Artificial Sequence
  Description of Artificial Sequence: Synthetic oligonucleotide
  Target: SCN10A; (-) strand; PAM type: YTN; PAM sequence: TTC
taggcggaggcaaagataac

SEQ ID NO: 41508 - DNA, 20 bp, Artificial Sequence
  Description of Artificial Sequence: Synthetic oligonucleotide
  Target: SCN10A; (-) strand; PAM type: YTN; PAM sequence: TTG
accaagaggatattctaggc

SEQ ID NO: 41509 - DNA, 20 bp, Artificial Sequence
  Description of Artificial Sequence: Synthetic oligonucleotide
  Target: SCN10A; (-) strand; PAM type: YTN; PAM sequence: CTG
tggaggttgaccaagaggat

SEQ ID NO: 41510 - DNA, 20 bp, Artificial Sequence
  Description of Artificial Sequence: Synthetic oligonucleotide
  Target: SCN10A; (-) strand; PAM type: YTN; PAM sequence: TTG
actgtggaggttgaccaaga

SEQ ID NO: 41511 - DNA, 20 bp, Artificial Sequence
  Description of Artificial Sequence: Synthetic oligonucleotide
  Target: SCN10A; (-) strand; PAM type: YTN; PAM sequence: TTT
gactgtggaggttgaccaag

SEQ ID NO: 41512 - DNA, 20 bp, Artificial Sequence
  Description of Artificial Sequence: Synthetic oligonucleotide
  Target: SCN10A; (-) strand; PAM type: YTN; PAM sequence: TTT
tgactgtggaggttgaccaa

SEQ ID NO: 41513 - DNA, 20 bp, Artificial Sequence
  Description of Artificial Sequence: Synthetic oligonucleotide
  Target: SCN10A; (-) strand; PAM type: YTN; PAM sequence: TTT
ttgactgtggaggttgacca

SEQ ID NO: 41514 - DNA, 20 bp, Artificial Sequence
  Description of Artificial Sequence: Synthetic oligonucleotide
  Target: SCN10A; (-) strand; PAM type: YTN; PAM sequence: CTG
cagaagataagtttttgact

SEQ ID NO: 41515 - DNA, 20 bp, Artificial Sequence
  Description of Artificial Sequence: Synthetic oligonucleotide
  Target: SCN10A; (-) strand; PAM type: YTN; PAM sequence: TTG
gctgcagaagataagttttt

SEQ ID NO: 41516 - DNA, 20 bp, Artificial Sequence
  Description of Artificial Sequence: Synthetic oligonucleotide
  Target: SCN10A; (-) strand; PAM type: YTN; PAM sequence: CTT
ggctgcagaagataagtttt

SEQ ID NO: 41517 - DNA, 20 bp, Artificial Sequence
  Description of Artificial Sequence: Synthetic oligonucleotide
  Target: SCN10A; (-) strand; PAM type: YTN; PAM sequence: CTG
aacttggctgcagaagataa

SEQ ID NO: 41518 - DNA, 20 bp, Artificial Sequence
  Description of Artificial Sequence: Synthetic oligonucleotide
  Target: SCN10A; (-) strand; PAM type: YTN; PAM sequence: TTC
cagctgaacttggctgcaga

SEQ ID NO: 41519 - DNA, 20 bp, Artificial Sequence
  Description of Artificial Sequence: Synthetic oligonucleotide
  Target: SCN10A; (-) strand; PAM type: YTN; PAM sequence: CTT
ccagctgaacttggctgcag

SEQ ID NO: 41520 - DNA, 20 bp, Artificial Sequence
  Description of Artificial Sequence: Synthetic oligonucleotide
  Target: SCN10A; (-) strand; PAM type: YTN; PAM sequence: CTG
cagtcacttccagctgaact

SEQ ID NO: 41521 - DNA, 20 bp, Artificial Sequence
  Description of Artificial Sequence: Synthetic oligonucleotide
  Target: SCN10A; (-) strand; PAM type: YTN; PAM sequence: CTG
tggaataaactgcagtcact

SEQ ID NO: 41522 - DNA, 20 bp, Artificial Sequence
  Description of Artificial Sequence: Synthetic oligonucleotide
  Target: SCN10A; (-) strand; PAM type: YTN; PAM sequence: CTG
tgagcctgtggaataaactg

SEQ ID NO: 41523 - DNA, 20 bp, Artificial Sequence
  Description of Artificial Sequence: Synthetic oligonucleotide
  Target: SCN10A; (-) strand; PAM type: YTN; PAM sequence: CTG
tgtcataggaaaaaacaggc

SEQ ID NO: 41524 - DNA, 20 bp, Artificial Sequence
  Description of Artificial Sequence: Synthetic oligonucleotide
  Target: SCN10A; (-) strand; PAM type: YTN; PAM sequence: CTG
cagtatcagggaggagcagg

SEQ ID NO: 41525 - DNA, 20 bp, Artificial Sequence
  Description of Artificial Sequence: Synthetic oligonucleotide
  Target: SCN10A; (-) strand; PAM type: YTN; PAM sequence: TTC
acagagcacaggaccagggt

SEQ ID NO: 41526 - DNA, 20 bp, Artificial Sequence
  Description of Artificial Sequence: Synthetic oligonucleotide
  Target: SCN10A; (-) strand; PAM type: YTN; PAM sequence: CTT
cacagagcacaggaccaggg

SEQ ID NO: 41527 - DNA, 20 bp, Artificial Sequence
  Description of Artificial Sequence: Synthetic oligonucleotide
  Target: SCN10A; (-) strand; PAM type: YTN; PAM sequence: CTG
gccttcacagagcacaggac

SEQ ID NO: 41528 - DNA, 20 bp, Artificial Sequence
  Description of Artificial Sequence: Synthetic oligonucleotide
  Target: SCN10A; (-) strand; PAM type: YTN; PAM sequence: TTC
acagtaggaggtagggagag

SEQ ID NO: 41529 - DNA, 20 bp, Artificial Sequence
  Description of Artificial Sequence: Synthetic oligonucleotide
  Target: SCN10A; (-) strand; PAM type: YTN; PAM sequence: CTT
cacagtaggaggtagggaga

SEQ ID NO: 41530 - DNA, 20 bp, Artificial Sequence
  Description of Artificial Sequence: Synthetic oligonucleotide
  Target: SCN10A; (-) strand; PAM type: YTN; PAM sequence: TTA
gccacaggaccgggtgccag

SEQ ID NO: 41531 - DNA, 20 bp, Artificial Sequence
  Description of Artificial Sequence: Synthetic oligonucleotide
  Target: SCN10A; (-) strand; PAM type: YTN; PAM sequence: CTC
cgtacaattagccacaggac

SEQ ID NO: 41532 - DNA, 20 bp, Artificial Sequence
  Description of Artificial Sequence: Synthetic oligonucleotide
  Target: SCN10A; (-) strand; PAM type: YTN; PAM sequence: TTA
acaccaggctccgtacaatt

SEQ ID NO: 41533 - DNA, 20 bp, Artificial Sequence
  Description of Artificial Sequence: Synthetic oligonucleotide
  Target: SCN10A; (-) strand; PAM type: YTN; PAM sequence: TTG
taattaacaccaggctccgt

SEQ ID NO: 41534 - DNA, 20 bp, Artificial Sequence
  Description of Artificial Sequence: Synthetic oligonucleotide
  Target: SCN10A; (-) strand; PAM type: YTN; PAM sequence: CTT
gtaattaacaccaggctccg

SEQ ID NO: 41535 - DNA, 20 bp, Artificial Sequence
  Description of Artificial Sequence: Synthetic oligonucleotide
  Target: SCN10A; (-) strand; PAM type: YTN; PAM sequence: CTC
aggcccccttgtaattaaca

SEQ ID NO: 41536 - DNA, 20 bp, Artificial Sequence
  Description of Artificial Sequence: Synthetic oligonucleotide
  Target: SCN10A; (-) strand; PAM type: YTN; PAM sequence: TTG
cccgaatcctcaggccccct

SEQ ID NO: 41537 - DNA, 20 bp, Artificial Sequence
  Description of Artificial Sequence: Synthetic oligonucleotide
  Target: SCN10A; (-) strand; PAM type: YTN; PAM sequence: CTG
tcagccagttgcccgaatcc

SEQ ID NO: 41538 - DNA, 20 bp, Artificial Sequence
  Description of Artificial Sequence: Synthetic oligonucleotide
  Target: SCN10A; (-) strand; PAM type: YTN; PAM sequence: TTA
gctgtcagccagttgcccga

SEQ ID NO: 41539 - DNA, 20 bp, Artificial Sequence
  Description of Artificial Sequence: Synthetic oligonucleotide
  Target: SCN10A; (-) strand; PAM type: YTN; PAM sequence: TTT
agctgtcagccagttgcccg

SEQ ID NO: 41540 - DNA, 20 bp, Artificial Sequence
  Description of Artificial Sequence: Synthetic oligonucleotide
  Target: SCN10A; (-) strand; PAM type: YTN; PAM sequence: CTT
tagctgtcagccagttgccc

SEQ ID NO: 41541 - DNA, 20 bp, Artificial Sequence
  Description of Artificial Sequence: Synthetic oligonucleotide
  Target: SCN10A; (-) strand; PAM type: YTN; PAM sequence: TTA
tgctttagctgtcagccagt

SEQ ID NO: 41542 - DNA, 20 bp, Artificial Sequence
  Description of Artificial Sequence: Synthetic oligonucleotide
  Target: SCN10A; (-) strand; PAM type: YTN; PAM sequence: CTT
atgctttagctgtcagccag

SEQ ID NO: 41543 - DNA, 20 bp, Artificial Sequence
  Description of Artificial Sequence: Synthetic oligonucleotide
  Target: SCN10A; (-) strand; PAM type: YTN; PAM sequence: TTC
aaatcccttatgctttagct

SEQ ID NO: 41544 - DNA, 20 bp, Artificial Sequence
  Description of Artificial Sequence: Synthetic oligonucleotide
  Target: SCN10A; (-) strand; PAM type: YTN; PAM sequence: CTG
gtcattcaaatcccttatgc

SEQ ID NO: 41545 - DNA, 20 bp, Artificial Sequence
  Description of Artificial Sequence: Synthetic oligonucleotide
  Target: SCN10A; (-) strand; PAM type: YTN; PAM sequence: TTG
tgcagacagctggtcattca

SEQ ID NO: 41546 - DNA, 20 bp, Artificial Sequence
  Description of Artificial Sequence: Synthetic oligonucleotide
  Target: SCN10A; (-) strand; PAM type: YTN; PAM sequence: TTA
aggcattgtgcagacagctg

SEQ ID NO: 41547 - DNA, 20 bp, Artificial Sequence
  Description of Artificial Sequence: Synthetic oligonucleotide
  Target: SCN10A; (-) strand; PAM type: YTN; PAM sequence: CTG
gaaccgaaaaaaaaaaaaaa

SEQ ID NO: 41548 - DNA, 20 bp, Artificial Sequence
  Description of Artificial Sequence: Synthetic oligonucleotide
  Target: SCN10A; (-) strand; PAM type: YTN; PAM sequence: TTC
aaaaacagctggaaccgaaa

SEQ ID NO: 41549 - DNA, 20 bp, Artificial Sequence
  Description of Artificial Sequence: Synthetic oligonucleotide
  Target: SCN10A; (-) strand; PAM type: YTN; PAM sequence: CTA
acataaagttcaaaaacagc

SEQ ID NO: 41550 - DNA, 20 bp, Artificial Sequence
  Description of Artificial Sequence: Synthetic oligonucleotide
  Target: SCN10A; (-) strand; PAM type: YTN; PAM sequence: CTC
caggccctaacataaagttc

SEQ ID NO: 41551 - DNA, 20 bp, Artificial Sequence
  Description of Artificial Sequence: Synthetic oligonucleotide
  Target: SCN10A; (-) strand; PAM type: YTN; PAM sequence: CTA
tctccaggccctaacataaa

SEQ ID NO: 41552 - DNA, 20 bp, Artificial Sequence
  Description of Artificial Sequence: Synthetic oligonucleotide
  Target: SCN10A; (-) strand; PAM type: YTN; PAM sequence: CTC
ccccaaaaaaacctatctcc

SEQ ID NO: 41553 - DNA, 20 bp, Artificial Sequence
  Description of Artificial Sequence: Synthetic oligonucleotide
  Target: SCN10A; (-) strand; PAM type: YTN; PAM sequence: CTG
actcccccaaaaaaacctat

SEQ ID NO: 41554 - DNA, 20 bp, Artificial Sequence
  Description of Artificial Sequence: Synthetic oligonucleotide
  Target: SCN10A; (-) strand; PAM type: YTN; PAM sequence: TTG
ggggcagtaactgactcccc

SEQ ID NO: 41555 - DNA, 20 bp, Artificial Sequence
  Description of Artificial Sequence: Synthetic oligonucleotide
  Target: SCN10A; (-) strand; PAM type: YTN; PAM sequence: TTG
gagttgggggcagtaactga

SEQ ID NO: 41556 - DNA, 20 bp, Artificial Sequence
  Description of Artificial Sequence: Synthetic oligonucleotide
  Target: SCN10A; (-) strand; PAM type: YTN; PAM sequence: TTC
atagttggagttgggggcag

SEQ ID NO: 41557 - DNA, 20 bp, Artificial Sequence
  Description of Artificial Sequence: Synthetic oligonucleotide
  Target: SCN10A; (-) strand; PAM type: YTN; PAM sequence: TTG
ttcatagttggagttggggg

SEQ ID NO: 41558 - DNA, 20 bp, Artificial Sequence
  Description of Artificial Sequence: Synthetic oligonucleotide
  Target: SCN10A; (-) strand; PAM type: YTN; PAM sequence: TTT
gttcatagttggagttgggg

SEQ ID NO: 41559 - DNA, 20 bp, Artificial Sequence
  Description of Artificial Sequence: Synthetic oligonucleotide
  Target: SCN10A; (-) strand; PAM type: YTN; PAM sequence: CTT
tgttcatagttggagttggg

SEQ ID NO: 41560 - DNA, 20 bp, Artificial Sequence
  Description of Artificial Sequence: Synthetic oligonucleotide
  Target: SCN10A; (-) strand; PAM type: YTN; PAM sequence: TTC
caactttgttcatagttgga

SEQ ID NO: 41561 - DNA, 20 bp, Artificial Sequence
  Description of Artificial Sequence: Synthetic oligonucleotide
  Target: SCN10A; (-) strand; PAM type: YTN; PAM sequence: TTT
ccaactttgttcatagttgg

SEQ ID NO: 41562 - DNA, 20 bp, Artificial Sequence
  Description of Artificial Sequence: Synthetic oligonucleotide
  Target: SCN10A; (-) strand; PAM type: YTN; PAM sequence: TTA
tatttccaactttgttcata

SEQ ID NO: 41563 - DNA, 20 bp, Artificial Sequence
  Description of Artificial Sequence: Synthetic oligonucleotide
  Target: SCN10A; (-) strand; PAM type: YTN; PAM sequence: TTT
atatttccaactttgttcat

SEQ ID NO: 41564 - DNA, 20 bp, Artificial Sequence
  Description of Artificial Sequence: Synthetic oligonucleotide
  Target: SCN10A; (-) strand; PAM type: YTN; PAM sequence: CTT
tatatttccaactttgttca

SEQ ID NO: 41565 - DNA, 20 bp, Artificial Sequence
  Description of Artificial Sequence: Synthetic oligonucleotide
  Target: SCN10A; (-) strand; PAM type: YTN; PAM sequence: TTC
tttatatttccaactttgtt

SEQ ID NO: 41566 - DNA, 20 bp, Artificial Sequence
  Description of Artificial Sequence: Synthetic oligonucleotide
  Target: SCN10A; (-) strand; PAM type: YTN; PAM sequence: TTA
gacatcatatagagggacat

SEQ ID NO: 41567 - DNA, 20 bp, Artificial Sequence
  Description of Artificial Sequence: Synthetic oligonucleotide
  Target: SCN10A; (-) strand; PAM type: YTN; PAM sequence: TTC
aagttagacatcatatagag

SEQ ID NO: 41568 - DNA, 20 bp, Artificial Sequence
  Description of Artificial Sequence: Synthetic oligonucleotide
  Target: SCN10A; (-) strand; PAM type: YTN; PAM sequence: CTT
caagttagacatcatataga

SEQ ID NO: 41569 - DNA, 20 bp, Artificial Sequence
  Description of Artificial Sequence: Synthetic oligonucleotide
  Target: SCN10A; (-) strand; PAM type: YTN; PAM sequence: CTC
cccaggtccccaagaccaaa

SEQ ID NO: 41570 - DNA, 20 bp, Artificial Sequence
  Description of Artificial Sequence: Synthetic oligonucleotide
  Target: SCN10A; (-) strand; PAM type: YTN; PAM sequence: TTG
gtacaaataaggctccccag

SEQ ID NO: 41571 - DNA, 20 bp, Artificial Sequence
  Description of Artificial Sequence: Synthetic oligonucleotide
  Target: SCN10A; (-) strand; PAM type: YTN; PAM sequence: TTT
ggtacaaataaggctcccca

SEQ ID NO: 41572 - DNA, 20 bp, Artificial Sequence
  Description of Artificial Sequence: Synthetic oligonucleotide
  Target: SCN10A; (-) strand; PAM type: YTN; PAM sequence: CTT
tggtacaaataaggctcccc

SEQ ID NO: 41573 - DNA, 20 bp, Artificial Sequence
  Description of Artificial Sequence: Synthetic oligonucleotide
  Target: SCN10A; (-) strand; PAM type: YTN; PAM sequence: TTG
gtggaggcctttggtacaaa

SEQ ID NO: 41574 - DNA, 20 bp, Artificial Sequence
  Description of Artificial Sequence: Synthetic oligonucleotide
  Target: SCN10A; (-) strand; PAM type: YTN; PAM sequence: TTT
ggtggaggcctttggtacaa

SEQ ID NO: 41575 - DNA, 20 bp, Artificial Sequence
  Description of Artificial Sequence: Synthetic oligonucleotide
  Target: SCN10A; (-) strand; PAM type: YTN; PAM sequence: CTT
tggtggaggcctttggtaca

SEQ ID NO: 41576 - DNA, 20 bp, Artificial Sequence
  Description of Artificial Sequence: Synthetic oligonucleotide
  Target: SCN10A; (-) strand; PAM type: YTN; PAM sequence: CTC
atctttggtggaggcctttg

SEQ ID NO: 41577 - DNA, 20 bp, Artificial Sequence
  Description of Artificial Sequence: Synthetic oligonucleotide
  Target: SCN10A; (-) strand; PAM type: YTN; PAM sequence: TTG
cctcatctttggtggaggcc

SEQ ID NO: 41578 - DNA, 20 bp, Artificial Sequence
  Description of Artificial Sequence: Synthetic oligonucleotide
  Target: SCN10A; (-) strand; PAM type: YTN; PAM sequence: CTT
gcctcatctttggtggaggc

SEQ ID NO: 41579 - DNA, 20 bp, Artificial Sequence
  Description of Artificial Sequence: Synthetic oligonucleotide
  Target: SCN10A; (-) strand; PAM type: YTN; PAM sequence: CTA
aaggccttgcctcatctttg

SEQ ID NO: 41580 - DNA, 20 bp, Artificial Sequence
  Description of Artificial Sequence: Synthetic oligonucleotide
  Target: SCN10A; (-) strand; PAM type: YTN; PAM sequence: TTA
cctaaaggccttgcctcatc

SEQ ID NO: 41581 - DNA, 20 bp, Artificial Sequence
  Description of Artificial Sequence: Synthetic oligonucleotide
  Target: SCN10A; (-) strand; PAM type: YTN; PAM sequence: CTT
acctaaaggccttgcctcat

SEQ ID NO: 41582 - DNA, 20 bp, Artificial Sequence
  Description of Artificial Sequence: Synthetic oligonucleotide
  Target: SCN10A; (-) strand; PAM type: YTN; PAM sequence: CTC
ttacctaaaggccttgcctc

SEQ ID NO: 41583 - DNA, 20 bp, Artificial Sequence
  Description of Artificial Sequence: Synthetic oligonucleotide
  Target: SCN10A; (-) strand; PAM type: YTN; PAM sequence: CTC
tcttacctaaaggccttgcc

SEQ ID NO: 41584 - DNA, 20 bp, Artificial Sequence
  Description of Artificial Sequence: Synthetic oligonucleotide
  Target: SCN10A; (-) strand; PAM type: YTN; PAM sequence: TTG
aaccctctcttacctaaagg

SEQ ID NO: 41585 - DNA, 20 bp, Artificial Sequence
  Description of Artificial Sequence: Synthetic oligonucleotide
  Target: SCN10A; (-) strand; PAM type: YTN; PAM sequence: CTG
tgagatgttgaaccctctct

SEQ ID NO: 41586 - DNA, 20 bp, Artificial Sequence
  Description of Artificial Sequence: Synthetic oligonucleotide
  Target: SCN10A; (-) strand; PAM type: YTN; PAM sequence: TTC
ctgtgagatgttgaaccctc

SEQ ID NO: 41587 - DNA, 20 bp, Artificial Sequence
  Description of Artificial Sequence: Synthetic oligonucleotide
  Target: SCN10A; (-) strand; PAM type: YTN; PAM sequence: TTT
cctgtgagatgttgaaccct

SEQ ID NO: 41588 - DNA, 20 bp, Artificial Sequence
  Description of Artificial Sequence: Synthetic oligonucleotide
  Target: SCN10A; (-) strand; PAM type: YTN; PAM sequence: TTT
tcctgtgagatgttgaaccc

SEQ ID NO: 41589 - DNA, 20 bp, Artificial Sequence
  Description of Artificial Sequence: Synthetic oligonucleotide
  Target: SCN10A; (-) strand; PAM type: YTN; PAM sequence: TTT
ttcctgtgagatgttgaacc

SEQ ID NO: 41590 - DNA, 20 bp, Artificial Sequence
  Description of Artificial Sequence: Synthetic oligonucleotide
  Target: SCN10A; (-) strand; PAM type: YTN; PAM sequence: CTC
accatttttcctgtgagatg

SEQ ID NO: 41591 - DNA, 20 bp, Artificial Sequence
  Description of Artificial Sequence: Synthetic oligonucleotide
  Target: SCN10A; (-) strand; PAM type: YTN; PAM sequence: CTA
catccctcaccatttttcct

SEQ ID NO: 41592 - DNA, 20 bp, Artificial Sequence
  Description of Artificial Sequence: Synthetic oligonucleotide
  Target: SCN10A; (-) strand; PAM type: YTN; PAM sequence: CTG
ctacatccctcaccattttt

SEQ ID NO: 41593 - DNA, 20 bp, Artificial Sequence
  Description of Artificial Sequence: Synthetic oligonucleotide
  Target: SCN10A; (-) strand; PAM type: YTN; PAM sequence: TTG
ctgctacatccctcaccatt

SEQ ID NO: 41594 - DNA, 20 bp, Artificial Sequence
  Description of Artificial Sequence: Synthetic oligonucleotide
  Target: SCN10A; (-) strand; PAM type: YTN; PAM sequence: CTT
gctgctacatccctcaccat

SEQ ID NO: 41595 - DNA, 20 bp, Artificial Sequence
  Description of Artificial Sequence: Synthetic oligonucleotide
  Target: SCN10A; (-) strand; PAM type: YTN; PAM sequence: CTG
gcaaggagcgagagcttgct

SEQ ID NO: 41596 - DNA, 20 bp, Artificial Sequence
  Description of Artificial Sequence: Synthetic oligonucleotide
  Target: SCN10A; (-) strand; PAM type: YTN; PAM sequence: TTG
tgacccatgtgcataacaac

SEQ ID NO: 41597 - DNA, 20 bp, Artificial Sequence
  Description of Artificial Sequence: Synthetic oligonucleotide
  Target: SCN10A; (-) strand; PAM type: YTN; PAM sequence: TTC
caacacaatattgtgaccca

SEQ ID NO: 41598 - DNA, 20 bp, Artificial Sequence
  Description of Artificial Sequence: Synthetic oligonucleotide
  Target: SCN10A; (-) strand; PAM type: YTN; PAM sequence: TTT
ccaacacaatattgtgaccc

SEQ ID NO: 41599 - DNA, 20 bp, Artificial Sequence
  Description of Artificial Sequence: Synthetic oligonucleotide
  Target: SCN10A; (-) strand; PAM type: YTN; PAM sequence: CTT
tccaacacaatattgtgacc

SEQ ID NO: 41600 - DNA, 20 bp, Artificial Sequence
  Description of Artificial Sequence: Synthetic oligonucleotide
  Target: SCN10A; (-) strand; PAM type: YTN; PAM sequence: CTC
tttccaacacaatattgtga

SEQ ID NO: 41601 - DNA, 20 bp, Artificial Sequence
  Description of Artificial Sequence: Synthetic oligonucleotide
  Target: SCN10A; (-) strand; PAM type: YTN; PAM sequence: TTC
ctctttccaacacaatattg

SEQ ID NO: 41602 - DNA, 20 bp, Artificial Sequence
  Description of Artificial Sequence: Synthetic oligonucleotide
  Target: SCN10A; (-) strand; PAM type: YTN; PAM sequence: CTT
cctctttccaacacaatatt

SEQ ID NO: 41603 - DNA, 20 bp, Artificial Sequence
  Description of Artificial Sequence: Synthetic oligonucleotide
  Target: SCN10A; (-) strand; PAM type: YTN; PAM sequence: TTC
ttcctctttccaacacaata

SEQ ID NO: 41604 - DNA, 20 bp, Artificial Sequence
  Description of Artificial Sequence: Synthetic oligonucleotide
  Target: SCN10A; (-) strand; PAM type: YTN; PAM sequence: TTT
cttcctctttccaacacaat

SEQ ID NO: 41605 - DNA, 20 bp, Artificial Sequence
  Description of Artificial Sequence: Synthetic oligonucleotide
  Target: SCN10A; (-) strand; PAM type: YTN; PAM sequence: CTT
tcttcctctttccaacacaa

SEQ ID NO: 41606 - DNA, 20 bp, Artificial Sequence
  Description of Artificial Sequence: Synthetic oligonucleotide
  Target: SCN10A; (-) strand; PAM type: YTN; PAM sequence: CTA
ctttcttcctctttccaaca

SEQ ID NO: 41607 - DNA, 20 bp, Artificial Sequence
  Description of Artificial Sequence: Synthetic oligonucleotide
  Target: SCN10A; (-) strand; PAM type: YTN; PAM sequence: TTC
tactttcttcctctttccaa

SEQ ID NO: 41608 - DNA, 20 bp, Artificial Sequence
  Description of Artificial Sequence: Synthetic oligonucleotide
  Target: SCN10A; (-) strand; PAM type: YTN; PAM sequence: CTT
ctactttcttcctctttcca

SEQ ID NO: 41609 - DNA, 20 bp, Artificial Sequence
  Description of Artificial Sequence: Synthetic oligonucleotide
  Target: SCN10A; (-) strand; PAM type: YTN; PAM sequence: TTC
ccaagtccccttctactttc

SEQ ID NO: 41610 - DNA, 20 bp, Artificial Sequence
  Description of Artificial Sequence: Synthetic oligonucleotide
  Target: SCN10A; (-) strand; PAM type: YTN; PAM sequence: TTT
cccaagtccccttctacttt

SEQ ID NO: 41611 - DNA, 20 bp, Artificial Sequence
  Description of Artificial Sequence: Synthetic oligonucleotide
  Target: SCN10A; (-) strand; PAM type: YTN; PAM sequence: TTA
tttcccaagtccccttctac

SEQ ID NO: 41612 - DNA, 20 bp, Artificial Sequence
  Description of Artificial Sequence: Synthetic oligonucleotide
  Target: SCN10A; (-) strand; PAM type: YTN; PAM sequence: TTA
taattatttcccaagtcccc

SEQ ID NO: 41613 - DNA, 20 bp, Artificial Sequence
  Description of Artificial Sequence: Synthetic oligonucleotide
  Target: SCN10A; (-) strand; PAM type: YTN; PAM sequence: TTA
taatccaaaattataattat

SEQ ID NO: 41614 - DNA, 20 bp, Artificial Sequence
  Description of Artificial Sequence: Synthetic oligonucleotide
  Target: SCN10A; (-) strand; PAM type: YTN; PAM sequence: TTT
ataatccaaaattataatta

SEQ ID NO: 41615 - DNA, 20 bp, Artificial Sequence
  Description of Artificial Sequence: Synthetic oligonucleotide
  Target: SCN10A; (-) strand; PAM type: YTN; PAM sequence: TTT
tataatccaaaattataatt

SEQ ID NO: 41616 - DNA, 20 bp, Artificial Sequence
  Description of Artificial Sequence: Synthetic oligonucleotide
  Target: SCN10A; (-) strand; PAM type: YTN; PAM sequence: TTC
cacaaagattttataatcca

SEQ ID NO: 41617 - DNA, 20 bp, Artificial Sequence
  Description of Artificial Sequence: Synthetic oligonucleotide
  Target: SCN10A; (-) strand; PAM type: YTN; PAM sequence: CTT
ccacaaagattttataatcc

SEQ ID NO: 41618 - DNA, 20 bp, Artificial Sequence
  Description of Artificial Sequence: Synthetic oligonucleotide
  Target: SCN10A; (-) strand; PAM type: YTN; PAM sequence: TTC
acagaaggtcttccacaaag

SEQ ID NO: 41619 - DNA, 20 bp, Artificial Sequence
  Description of Artificial Sequence: Synthetic oligonucleotide
  Target: SCN10A; (-) strand; PAM type: YTN; PAM sequence: CTG
gaaattcacagaaggtcttc

SEQ ID NO: 41620 - DNA, 20 bp, Artificial Sequence
  Description of Artificial Sequence: Synthetic oligonucleotide
  Target: SCN10A; (-) strand; PAM type: YTN; PAM sequence: TTA
aactggaaattcacagaagg

SEQ ID NO: 41621 - DNA, 20 bp, Artificial Sequence
  Description of Artificial Sequence: Synthetic oligonucleotide
  Target: SCN10A; (-) strand; PAM type: YTN; PAM sequence: CTA
gttaaactggaaattcacag

SEQ ID NO: 41622 - DNA, 20 bp, Artificial Sequence
  Description of Artificial Sequence: Synthetic oligonucleotide
  Target: SCN10A; (-) strand; PAM type: YTN; PAM sequence: CTA
cacgatgggaacatgtccta

SEQ ID NO: 41623 - DNA, 20 bp, Artificial Sequence
  Description of Artificial Sequence: Synthetic oligonucleotide
  Target: SCN10A; (-) strand; PAM type: YTN; PAM sequence: TTA
ccagagtatgtagacaaata

SEQ ID NO: 41624 - DNA, 20 bp, Artificial Sequence
  Description of Artificial Sequence: Synthetic oligonucleotide
  Target: SCN10A; (-) strand; PAM type: YTN; PAM sequence: TTT
accagagtatgtagacaaat

SEQ ID NO: 41625 - DNA, 20 bp, Artificial Sequence
  Description of Artificial Sequence: Synthetic oligonucleotide
  Target: SCN10A; (-) strand; PAM type: YTN; PAM sequence: TTT
taccagagtatgtagacaaa

SEQ ID NO: 41626 - DNA, 20 bp, Artificial Sequence
  Description of Artificial Sequence: Synthetic oligonucleotide
  Target: SCN10A; (-) strand; PAM type: YTN; PAM sequence: CTG
gcagaaaattttaccagagt

SEQ ID NO: 41627 - DNA, 20 bp, Artificial Sequence
  Description of Artificial Sequence: Synthetic oligonucleotide
  Target: SCN10A; (-) strand; PAM type: YTN; PAM sequence: TTG
tctggcagaaaattttacca

SEQ ID NO: 41628 - DNA, 20 bp, Artificial Sequence
  Description of Artificial Sequence: Synthetic oligonucleotide
  Target: SCN10A; (-) strand; PAM type: YTN; PAM sequence: CTG
tagaccagttgtctggcaga

SEQ ID NO: 41629 - DNA, 20 bp, Artificial Sequence
  Description of Artificial Sequence: Synthetic oligonucleotide
  Target: SCN10A; (-) strand; PAM type: YTN; PAM sequence: TTA
aaatgtgctgtagaccagtt

SEQ ID NO: 41630 - DNA, 20 bp, Artificial Sequence
  Description of Artificial Sequence: Synthetic oligonucleotide
  Target: SCN10A; (-) strand; PAM type: YTN; PAM sequence: CTG
gagcaaattaaaatgtgctg

SEQ ID NO: 41631 - DNA, 20 bp, Artificial Sequence
  Description of Artificial Sequence: Synthetic oligonucleotide
  Target: SCN10A; (-) strand; PAM type: YTN; PAM sequence: TTA
aaataagatcctggagcaaa

SEQ ID NO: 41632 - DNA, 20 bp, Artificial Sequence
  Description of Artificial Sequence: Synthetic oligonucleotide
  Target: SCN10A; (-) strand; PAM type: YTN; PAM sequence: CTT
aaaataagatcctggagcaa

SEQ ID NO: 41633 - DNA, 20 bp, Artificial Sequence
  Description of Artificial Sequence: Synthetic oligonucleotide
  Target: SCN10A; (-) strand; PAM type: YTN; PAM sequence: CTC
ccttaaaataagatcctgga

SEQ ID NO: 41634 - DNA, 20 bp, Artificial Sequence
  Description of Artificial Sequence: Synthetic oligonucleotide
  Target: SCN10A; (-) strand; PAM type: YTN; PAM sequence: TTC
tcccttaaaataagatcctg

SEQ ID NO: 41635 - DNA, 20 bp, Artificial Sequence
  Description of Artificial Sequence: Synthetic oligonucleotide
  Target: SCN10A; (-) strand; PAM type: YTN; PAM sequence: TTA
caagtacgaggaaccattct

SEQ ID NO: 41636 - DNA, 20 bp, Artificial Sequence
  Description of Artificial Sequence: Synthetic oligonucleotide
  Target: SCN10A; (-) strand; PAM type: YTN; PAM sequence: TTG
ttacaagtacgaggaaccat

SEQ ID NO: 41637 - DNA, 20 bp, Artificial Sequence
  Description of Artificial Sequence: Synthetic oligonucleotide
  Target: SCN10A; (-) strand; PAM type: YTN; PAM sequence: CTA
attgttacaagtacgaggaa

SEQ ID NO: 41638 - DNA, 20 bp, Artificial Sequence
  Description of Artificial Sequence: Synthetic oligonucleotide
  Target: SCN10A; (-) strand; PAM type: YTN; PAM sequence: TTG
agtatctaattgttacaagt

SEQ ID NO: 41639 - DNA, 20 bp, Artificial Sequence
  Description of Artificial Sequence: Synthetic oligonucleotide
  Target: SCN10A; (-) strand; PAM type: YTN; PAM sequence: TTC
ccaccaacaagaggtgattg

SEQ ID NO: 41640 - DNA, 20 bp, Artificial Sequence
  Description of Artificial Sequence: Synthetic oligonucleotide
  Target: SCN10A; (-) strand; PAM type: YTN; PAM sequence: TTT
cccaccaacaagaggtgatt

SEQ ID NO: 41641 - DNA, 20 bp, Artificial Sequence
  Description of Artificial Sequence: Synthetic oligonucleotide
  Target: SCN10A; (-) strand; PAM type: YTN; PAM sequence: CTT
tcccaccaacaagaggtgat

SEQ ID NO: 41642 - DNA, 20 bp, Artificial Sequence
  Description of Artificial Sequence: Synthetic oligonucleotide
  Target: SCN10A; (-) strand; PAM type: YTN; PAM sequence: TTC
tttcccaccaacaagaggtg

SEQ ID NO: 41643 - DNA, 20 bp, Artificial Sequence
  Description of Artificial Sequence: Synthetic oligonucleotide
  Target: SCN10A; (-) strand; PAM type: YTN; PAM sequence: CTT
ctttcccaccaacaagaggt

SEQ ID NO: 41644 - DNA, 20 bp, Artificial Sequence
  Description of Artificial Sequence: Synthetic oligonucleotide
  Target: SCN10A; (-) strand; PAM type: YTN; PAM sequence: TTC
ttctttcccaccaacaagag

SEQ ID NO: 41645 - DNA, 20 bp, Artificial Sequence
  Description of Artificial Sequence: Synthetic oligonucleotide
  Target: SCN10A; (-) strand; PAM type: YTN; PAM sequence: TTT
cttctttcccaccaacaaga

SEQ ID NO: 41646 - DNA, 20 bp, Artificial Sequence
  Description of Artificial Sequence: Synthetic oligonucleotide
  Target: SCN10A; (-) strand; PAM type: YTN; PAM sequence: CTT
tcttctttcccaccaacaag

SEQ ID NO: 41647 - DNA, 20 bp, Artificial Sequence
  Description of Artificial Sequence: Synthetic oligonucleotide
  Target: SCN10A; (-) strand; PAM type: YTN; PAM sequence: CTC
cctttcttctttcccaccaa

SEQ ID NO: 41648 - DNA, 20 bp, Artificial Sequence
  Description of Artificial Sequence: Synthetic oligonucleotide
  Target: SCN10A; (-) strand; PAM type: YTN; PAM sequence: TTA
cctccctttcttctttccca

SEQ ID NO: 41649 - DNA, 20 bp, Artificial Sequence
  Description of Artificial Sequence: Synthetic oligonucleotide
  Target: SCN10A; (-) strand; PAM type: YTN; PAM sequence: CTT
acctccctttcttctttccc

SEQ ID NO: 41650 - DNA, 20 bp, Artificial Sequence
  Description of Artificial Sequence: Synthetic oligonucleotide
  Target: SCN10A; (-) strand; PAM type: YTN; PAM sequence: CTC
cttacctccctttcttcttt

SEQ ID NO: 41651 - DNA, 20 bp, Artificial Sequence
  Description of Artificial Sequence: Synthetic oligonucleotide
  Target: SCN10A; (-) strand; PAM type: YTN; PAM sequence: CTC
tccttacctccctttcttct

SEQ ID NO: 41652 - DNA, 20 bp, Artificial Sequence
  Description of Artificial Sequence: Synthetic oligonucleotide
  Target: SCN10A; (-) strand; PAM type: YTN; PAM sequence: CTC
tctccttacctccctttctt

SEQ ID NO: 41653 - DNA, 20 bp, Artificial Sequence
  Description of Artificial Sequence: Synthetic oligonucleotide
  Target: SCN10A; (-) strand; PAM type: YTN; PAM sequence: CTA
ccctctctccttacctccct

SEQ ID NO: 41654 - DNA, 20 bp, Artificial Sequence
  Description of Artificial Sequence: Synthetic oligonucleotide
  Target: SCN10A; (-) strand; PAM type: YTN; PAM sequence: TTC
taccctctctccttacctcc

SEQ ID NO: 41655 - DNA, 20 bp, Artificial Sequence
  Description of Artificial Sequence: Synthetic oligonucleotide
  Target: SCN10A; (-) strand; PAM type: YTN; PAM sequence: TTT
ctaccctctctccttacctc

SEQ ID NO: 41656 - DNA, 20 bp, Artificial Sequence
  Description of Artificial Sequence: Synthetic oligonucleotide
  Target: SCN10A; (-) strand; PAM type: YTN; PAM sequence: CTT
tctaccctctctccttacct

SEQ ID NO: 41657 - DNA, 20 bp, Artificial Sequence
  Description of Artificial Sequence: Synthetic oligonucleotide
  Target: SCN10A; (-) strand; PAM type: YTN; PAM sequence: CTG
gaaaataagcagaaaaaacc

SEQ ID NO: 41658 - DNA, 20 bp, Artificial Sequence
  Description of Artificial Sequence: Synthetic oligonucleotide
  Target: SCN10A; (-) strand; PAM type: YTN; PAM sequence: TTA
tagagctggaaaataagcag

SEQ ID NO: 41659 - DNA, 20 bp, Artificial Sequence
  Description of Artificial Sequence: Synthetic oligonucleotide
  Target: SCN10A; (-) strand; PAM type: YTN; PAM sequence: CTT
atagagctggaaaataagca

SEQ ID NO: 41660 - DNA, 20 bp, Artificial Sequence
  Description of Artificial Sequence: Synthetic oligonucleotide
  Target: SCN10A; (-) strand; PAM type: YTN; PAM sequence: CTG
gggcaggaatcccttataga

SEQ ID NO: 41661 - DNA, 20 bp, Artificial Sequence
  Description of Artificial Sequence: Synthetic oligonucleotide
  Target: SCN10A; (-) strand; PAM type: YTN; PAM sequence: TTA
cagggtagcaccatccgctg

SEQ ID NO: 41662 - DNA, 20 bp, Artificial Sequence
  Description of Artificial Sequence: Synthetic oligonucleotide
  Target: SCN10A; (-) strand; PAM type: YTN; PAM sequence: CTT
acagggtagcaccatccgct

SEQ ID NO: 41663 - DNA, 20 bp, Artificial Sequence
  Description of Artificial Sequence: Synthetic oligonucleotide
  Target: SCN10A; (-) strand; PAM type: YTN; PAM sequence: CTG
tggcttacagggtagcacca

SEQ ID NO: 41664 - DNA, 20 bp, Artificial Sequence
  Description of Artificial Sequence: Synthetic oligonucleotide
  Target: SCN10A; (-) strand; PAM type: YTN; PAM sequence: TTC
ctgtggcttacagggtagca

SEQ ID NO: 41665 - DNA, 20 bp, Artificial Sequence
  Description of Artificial Sequence: Synthetic oligonucleotide
  Target: SCN10A; (-) strand; PAM type: YTN; PAM sequence: CTA
ccagttcctgtggcttacag

SEQ ID NO: 41666 - DNA, 20 bp, Artificial Sequence
  Description of Artificial Sequence: Synthetic oligonucleotide
  Target: SCN10A; (-) strand; PAM type: YTN; PAM sequence: TTA
actaccagttcctgtggctt

SEQ ID NO: 41667 - DNA, 20 bp, Artificial Sequence
  Description of Artificial Sequence: Synthetic oligonucleotide
  Target: SCN10A; (-) strand; PAM type: YTN; PAM sequence: CTT
aactaccagttcctgtggct

SEQ ID NO: 41668 - DNA, 20 bp, Artificial Sequence
  Description of Artificial Sequence: Synthetic oligonucleotide
  Target: SCN10A; (-) strand; PAM type: YTN; PAM sequence: CTA
tgatggggatatcttaacta

SEQ ID NO: 41669 - DNA, 20 bp, Artificial Sequence
  Description of Artificial Sequence: Synthetic oligonucleotide
  Target: SCN10A; (-) strand; PAM type: YTN; PAM sequence: TTC
tatgatggggatatcttaac

SEQ ID NO: 41670 - DNA, 20 bp, Artificial Sequence
  Description of Artificial Sequence: Synthetic oligonucleotide
  Target: SCN10A; (-) strand; PAM type: YTN; PAM sequence: TTA
gttctatgatggggatatct

SEQ ID NO: 41671 - DNA, 20 bp, Artificial Sequence
  Description of Artificial Sequence: Synthetic oligonucleotide
  Target: SCN10A; (-) strand; PAM type: YTN; PAM sequence: CTT
agttctatgatggggatatc

SEQ ID NO: 41672 - DNA, 20 bp, Artificial Sequence
  Description of Artificial Sequence: Synthetic oligonucleotide
  Target: SCN10A; (-) strand; PAM type: YTN; PAM sequence: TTG
tgtatcagtaatatagaaat

SEQ ID NO: 41673 - DNA, 20 bp, Artificial Sequence
  Description of Artificial Sequence: Synthetic oligonucleotide
  Target: SCN10A; (-) strand; PAM type: YTN; PAM sequence: TTT
gtgtatcagtaatatagaaa

SEQ ID NO: 41674 - DNA, 20 bp, Artificial Sequence
  Description of Artificial Sequence: Synthetic oligonucleotide
  Target: SCN10A; (-) strand; PAM type: YTN; PAM sequence: TTG
tttgtgtatcagtaatatag

SEQ ID NO: 41675 - DNA, 20 bp, Artificial Sequence
  Description of Artificial Sequence: Synthetic oligonucleotide
  Target: SCN10A; (-) strand; PAM type: YTN; PAM sequence: CTT
gtttgtgtatcagtaatata

SEQ ID NO: 41676 - DNA, 20 bp, Artificial Sequence
  Description of Artificial Sequence: Synthetic oligonucleotide
  Target: SCN10A; (-) strand; PAM type: YTN; PAM sequence: TTA
aagaagggagcttgtttgtg

SEQ ID NO: 41677 - DNA, 20 bp, Artificial Sequence
  Description of Artificial Sequence: Synthetic oligonucleotide
  Target: SCN10A; (-) strand; PAM type: YTN; PAM sequence: TTA
tattaaagaagggagcttgt

SEQ ID NO: 41678 - DNA, 20 bp, Artificial Sequence
  Description of Artificial Sequence: Synthetic oligonucleotide
  Target: SCN10A; (-) strand; PAM type: YTN; PAM sequence: TTT
atattaaagaagggagcttg

SEQ ID NO: 41679 - DNA, 20 bp, Artificial Sequence
  Description of Artificial Sequence: Synthetic oligonucleotide
  Target: SCN10A; (-) strand; PAM type: YTN; PAM sequence: TTT
tatattaaagaagggagctt

SEQ ID NO: 41680 - DNA, 20 bp, Artificial Sequence
  Description of Artificial Sequence: Synthetic oligonucleotide
  Target: SCN10A; (-) strand; PAM type: YTN; PAM sequence: TTG
attttatattaaagaaggga

SEQ ID NO: 41681 - DNA, 20 bp, Artificial Sequence
  Description of Artificial Sequence: Synthetic oligonucleotide
  Target: SCN10A; (-) strand; PAM type: YTN; PAM sequence: TTT
gattttatattaaagaaggg

SEQ ID NO: 41682 - DNA, 20 bp, Artificial Sequence
  Description of Artificial Sequence: Synthetic oligonucleotide
  Target: SCN10A; (-) strand; PAM type: YTN; PAM sequence: TTT
tgattttatattaaagaagg

SEQ ID NO: 41683 - DNA, 20 bp, Artificial Sequence
  Description of Artificial Sequence: Synthetic oligonucleotide
  Target: SCN10A; (-) strand; PAM type: YTN; PAM sequence: CTA
ttttgattttatattaaaga

SEQ ID NO: 41684 - DNA, 20 bp, Artificial Sequence
  Description of Artificial Sequence: Synthetic oligonucleotide
  Target: SCN10A; (-) strand; PAM type: YTN; PAM sequence: TTC
caaaggctattttgatttta

SEQ ID NO: 41685 - DNA, 20 bp, Artificial Sequence
  Description of Artificial Sequence: Synthetic oligonucleotide
  Target: SCN10A; (-) strand; PAM type: YTN; PAM sequence: TTC
caaaatgaaagattccaaag

SEQ ID NO: 41686 - DNA, 20 bp, Artificial Sequence
  Description of Artificial Sequence: Synthetic oligonucleotide
  Target: SCN10A; (-) strand; PAM type: YTN; PAM sequence: CTT
ccaaaatgaaagattccaaa

SEQ ID NO: 41687 - DNA, 20 bp, Artificial Sequence
  Description of Artificial Sequence: Synthetic oligonucleotide
  Target: SCN10A; (-) strand; PAM type: YTN; PAM sequence: TTG
tcttccaaaatgaaagattc

SEQ ID NO: 41688 - DNA, 20 bp, Artificial Sequence
  Description of Artificial Sequence: Synthetic oligonucleotide
  Target: SCN10A; (-) strand; PAM type: YTN; PAM sequence: TTT
gtcttccaaaatgaaagatt

SEQ ID NO: 41689 - DNA, 20 bp, Artificial Sequence
  Description of Artificial Sequence: Synthetic oligonucleotide
  Target: SCN10A; (-) strand; PAM type: YTN; PAM sequence: TTG
tttgtcttccaaaatgaaag

SEQ ID NO: 41690 - DNA, 20 bp, Artificial Sequence
  Description of Artificial Sequence: Synthetic oligonucleotide
  Target: SCN10A; (-) strand; PAM type: YTN; PAM sequence: TTT
gtttgtcttccaaaatgaaa

SEQ ID NO: 41691 - DNA, 20 bp, Artificial Sequence
  Description of Artificial Sequence: Synthetic oligonucleotide
  Target: SCN10A; (-) strand; PAM type: YTN; PAM sequence: TTT
tgtttgtcttccaaaatgaa

SEQ ID NO: 41692 - DNA, 20 bp, Artificial Sequence
  Description of Artificial Sequence: Synthetic oligonucleotide
  Target: SCN10A; (-) strand; PAM type: YTN; PAM sequence: TTG
ttttgtttgtcttccaaaat

SEQ ID NO: 41693 - DNA, 20 bp, Artificial Sequence
  Description of Artificial Sequence: Synthetic oligonucleotide
  Target: SCN10A; (-) strand; PAM type: YTN; PAM sequence: TTT
gttttgtttgtcttccaaaa

SEQ ID NO: 41694 - DNA, 20 bp, Artificial Sequence
  Description of Artificial Sequence: Synthetic oligonucleotide
  Target: SCN10A; (-) strand; PAM type: YTN; PAM sequence: TTT
tgttttgtttgtcttccaaa

SEQ ID NO: 41695 - DNA, 20 bp, Artificial Sequence
  Description of Artificial Sequence: Synthetic oligonucleotide
  Target: SCN10A; (-) strand; PAM type: YTN; PAM sequence: TTG
ttttgttttgtttgtcttcc

SEQ ID NO: 41696 - DNA, 20 bp, Artificial Sequence
  Description of Artificial Sequence: Synthetic oligonucleotide
  Target: SCN10A; (-) strand; PAM type: YTN; PAM sequence: TTT
gttttgttttgtttgtcttc

SEQ ID NO: 41697 - DNA, 20 bp, Artificial Sequence
  Description of Artificial Sequence: Synthetic oligonucleotide
  Target: SCN10A; (-) strand; PAM type: YTN; PAM sequence: TTT
tgttttgttttgtttgtctt

SEQ ID NO: 41698 - DNA, 20 bp, Artificial Sequence
  Description of Artificial Sequence: Synthetic oligonucleotide
  Target: SCN10A; (-) strand; PAM type: YTN; PAM sequence: TTT
ttgttttgttttgtttgtct

SEQ ID NO: 41699 - DNA, 20 bp, Artificial Sequence
  Description of Artificial Sequence: Synthetic oligonucleotide
  Target: SCN10A; (-) strand; PAM type: YTN; PAM sequence: TTC
atttttgttttgttttgttt

SEQ ID NO: 41700 - DNA, 20 bp, Artificial Sequence
  Description of Artificial Sequence: Synthetic oligonucleotide
  Target: SCN10A; (-) strand; PAM type: YTN; PAM sequence: TTT
catttttgttttgttttgtt

SEQ ID NO: 41701 - DNA, 20 bp, Artificial Sequence
  Description of Artificial Sequence: Synthetic oligonucleotide
  Target: SCN10A; (-) strand; PAM type: YTN; PAM sequence: TTT
tcatttttgttttgttttgt

SEQ ID NO: 41702 - DNA, 20 bp, Artificial Sequence
  Description of Artificial Sequence: Synthetic oligonucleotide
  Target: SCN10A; (-) strand; PAM type: YTN; PAM sequence: TTG
ttttcatttttgttttgttt

SEQ ID NO: 41703 - DNA, 20 bp, Artificial Sequence
  Description of Artificial Sequence: Synthetic oligonucleotide
  Target: SCN10A; (-) strand; PAM type: YTN; PAM sequence: TTA
gttgttttcatttttgtttt

SEQ ID NO: 41704 - DNA, 20 bp, Artificial Sequence
  Description of Artificial Sequence: Synthetic oligonucleotide
  Target: SCN10A; (-) strand; PAM type: YTN; PAM sequence: TTG
gttagttgttttcatttttg

SEQ ID NO: 41705 - DNA, 20 bp, Artificial Sequence
  Description of Artificial Sequence: Synthetic oligonucleotide
  Target: SCN10A; (-) strand; PAM type: YTN; PAM sequence: TTG
gttggttagttgttttcatt

SEQ ID NO: 41706 - DNA, 20 bp, Artificial Sequence
  Description of Artificial Sequence: Synthetic oligonucleotide
  Target: SCN10A; (-) strand; PAM type: YTN; PAM sequence: TTG
gttggttggttagttgtttt

SEQ ID NO: 41707 - DNA, 20 bp, Artificial Sequence
  Description of Artificial Sequence: Synthetic oligonucleotide
  Target: SCN10A; (-) strand; PAM type: YTN; PAM sequence: TTG
ttggttggttggttagttgt

SEQ ID NO: 41708 - DNA, 20 bp, Artificial Sequence
  Description of Artificial Sequence: Synthetic oligonucleotide
  Target: SCN10A; (-) strand; PAM type: YTN; PAM sequence: TTT
gttggttggttggttagttg

SEQ ID NO: 41709 - DNA, 20 bp, Artificial Sequence
  Description of Artificial Sequence: Synthetic oligonucleotide
  Target: SCN10A; (-) strand; PAM type: YTN; PAM sequence: TTT
tgttggttggttggttagtt

SEQ ID NO: 41710 - DNA, 20 bp, Artificial Sequence
  Description of Artificial Sequence: Synthetic oligonucleotide
  Target: SCN10A; (-) strand; PAM type: YTN; PAM sequence: TTT
ttgttggttggttggttagt

SEQ ID NO: 41711 - DNA, 20 bp, Artificial Sequence
  Description of Artificial Sequence: Synthetic oligonucleotide
  Target: SCN10A; (-) strand; PAM type: YTN; PAM sequence: TTA
gcataataggagtttttgtt

SEQ ID NO: 41712 - DNA, 20 bp, Artificial Sequence
  Description of Artificial Sequence: Synthetic oligonucleotide
  Target: SCN10A; (-) strand; PAM type: YTN; PAM sequence: CTT
agcataataggagtttttgt

SEQ ID NO: 41713 - DNA, 20 bp, Artificial Sequence
  Description of Artificial Sequence: Synthetic oligonucleotide
  Target: SCN10A; (-) strand; PAM type: YTN; PAM sequence: CTC
acttagcataataggagttt

SEQ ID NO: 41714 - DNA, 20 bp, Artificial Sequence
  Description of Artificial Sequence: Synthetic oligonucleotide
  Target: SCN10A; (-) strand; PAM type: YTN; PAM sequence: TTA
tctcacttagcataatagga

SEQ ID NO: 41715 - DNA, 20 bp, Artificial Sequence
  Description of Artificial Sequence: Synthetic oligonucleotide
  Target: SCN10A; (-) strand; PAM type: YTN; PAM sequence: CTT
atctcacttagcataatagg

SEQ ID NO: 41716 - DNA, 20 bp, Artificial Sequence
  Description of Artificial Sequence: Synthetic oligonucleotide
  Target: SCN10A; (-) strand; PAM type: YTN; PAM sequence: CTG
gcttatctcacttagcataa

SEQ ID NO: 41717 - DNA, 20 bp, Artificial Sequence
  Description of Artificial Sequence: Synthetic oligonucleotide
  Target: SCN10A; (-) strand; PAM type: YTN; PAM sequence: CTG
tgtctggcttatctcactta

SEQ ID NO: 41718 - DNA, 20 bp, Artificial Sequence
  Description of Artificial Sequence: Synthetic oligonucleotide
  Target: SCN10A; (-) strand; PAM type: YTN; PAM sequence: TTC
tgtgtctggcttatctcact

SEQ ID NO: 41719 - DNA, 20 bp, Artificial Sequence
  Description of Artificial Sequence: Synthetic oligonucleotide
  Target: SCN10A; (-) strand; PAM type: YTN; PAM sequence: CTT
ctgtgtctggcttatctcac

SEQ ID NO: 41720 - DNA, 20 bp, Artificial Sequence
  Description of Artificial Sequence: Synthetic oligonucleotide
  Target: SCN10A; (-) strand; PAM type: YTN; PAM sequence: TTG
tccttctgtgtctggcttat

SEQ ID NO: 41721 - DNA, 20 bp, Artificial Sequence
  Description of Artificial Sequence: Synthetic oligonucleotide
  Target: SCN10A; (-) strand; PAM type: YTN; PAM sequence: TTT
gtccttctgtgtctggctta

SEQ ID NO: 41722 - DNA, 20 bp, Artificial Sequence
  Description of Artificial Sequence: Synthetic oligonucleotide
  Target: SCN10A; (-) strand; PAM type: YTN; PAM sequence: TTT
tgtccttctgtgtctggctt

SEQ ID NO: 41723 - DNA, 20 bp, Artificial Sequence
  Description of Artificial Sequence: Synthetic oligonucleotide
  Target: SCN10A; (-) strand; PAM type: YTN; PAM sequence: TTT
ttgtccttctgtgtctggct

SEQ ID NO: 41724 - DNA, 20 bp, Artificial Sequence
  Description of Artificial Sequence: Synthetic oligonucleotide
  Target: SCN10A; (-) strand; PAM type: YTN; PAM sequence: TTA
tataaatgcaatcatgtcgt

SEQ ID NO: 41725 - DNA, 20 bp, Artificial Sequence
  Description of Artificial Sequence: Synthetic oligonucleotide
  Target: SCN10A; (-) strand; PAM type: YTN; PAM sequence: CTT
atataaatgcaatcatgtcg

SEQ ID NO: 41726 - DNA, 20 bp, Artificial Sequence
  Description of Artificial Sequence: Synthetic oligonucleotide
  Target: SCN10A; (-) strand; PAM type: YTN; PAM sequence: TTC
cttatataaatgcaatcatg

SEQ ID NO: 41727 - DNA, 20 bp, Artificial Sequence
  Description of Artificial Sequence: Synthetic oligonucleotide
  Target: SCN10A; (-) strand; PAM type: YTN; PAM sequence: TTA
gattccttatataaatgcaa

SEQ ID NO: 41728 - DNA, 20 bp, Artificial Sequence
  Description of Artificial Sequence: Synthetic oligonucleotide
  Target: SCN10A; (-) strand; PAM type: YTN; PAM sequence: TTT
agattccttatataaatgca

SEQ ID NO: 41729 - DNA, 20 bp, Artificial Sequence
  Description of Artificial Sequence: Synthetic oligonucleotide
  Target: SCN10A; (-) strand; PAM type: YTN; PAM sequence: TTT
tagattccttatataaatgc

SEQ ID NO: 41730 - DNA, 20 bp, Artificial Sequence
  Description of Artificial Sequence: Synthetic oligonucleotide
  Target: SCN10A; (-) strand; PAM type: YTN; PAM sequence: CTA
ttttagattccttatataaa

SEQ ID NO: 41731 - DNA, 20 bp, Artificial Sequence
  Description of Artificial Sequence: Synthetic oligonucleotide
  Target: SCN10A; (-) strand; PAM type: YTN; PAM sequence: TTG
actattttagattccttata

SEQ ID NO: 41732 - DNA, 20 bp, Artificial Sequence
  Description of Artificial Sequence: Synthetic oligonucleotide
  Target: SCN10A; (-) strand; PAM type: YTN; PAM sequence: TTT
gactattttagattccttat

SEQ ID NO: 41733 - DNA, 20 bp, Artificial Sequence
  Description of Artificial Sequence: Synthetic oligonucleotide
  Target: SCN10A; (-) strand; PAM type: YTN; PAM sequence: CTC
ccatgagtttgactatttta

SEQ ID NO: 41734 - DNA, 20 bp, Artificial Sequence
  Description of Artificial Sequence: Synthetic oligonucleotide
  Target: SCN10A; (-) strand; PAM type: YTN; PAM sequence: CTG
ctcccatgagtttgactatt

SEQ ID NO: 41735 - DNA, 20 bp, Artificial Sequence
  Description of Artificial Sequence: Synthetic oligonucleotide
  Target: SCN10A; (-) strand; PAM type: YTN; PAM sequence: CTC
tgctcccatgagtttgacta

SEQ ID NO: 41736 - DNA, 20 bp, Artificial Sequence
  Description of Artificial Sequence: Synthetic oligonucleotide
  Target: SCN10A; (-) strand; PAM type: YTN; PAM sequence: TTC
tctgctcccatgagtttgac

SEQ ID NO: 41737 - DNA, 20 bp, Artificial Sequence
  Description of Artificial Sequence: Synthetic oligonucleotide
  Target: SCN10A; (-) strand; PAM type: YTN; PAM sequence: CTA
ttctctgctcccatgagttt

SEQ ID NO: 41738 - DNA, 20 bp, Artificial Sequence
  Description of Artificial Sequence: Synthetic oligonucleotide
  Target: SCN10A; (-) strand; PAM type: YTN; PAM sequence: TTC
tattctctgctcccatgagt

SEQ ID NO: 41739 - DNA, 20 bp, Artificial Sequence
  Description of Artificial Sequence: Synthetic oligonucleotide
  Target: SCN10A; (-) strand; PAM type: YTN; PAM sequence: CTG
gaaaccaccattctattctc

SEQ ID NO: 41740 - DNA, 20 bp, Artificial Sequence
  Description of Artificial Sequence: Synthetic oligonucleotide
  Target: SCN10A; (-) strand; PAM type: YTN; PAM sequence: CTC
ctggaaaccaccattctatt

SEQ ID NO: 41741 - DNA, 20 bp, Artificial Sequence
  Description of Artificial Sequence: Synthetic oligonucleotide
  Target: SCN10A; (-) strand; PAM type: YTN; PAM sequence: CTC
ccagctcctggaaaccacca

SEQ ID NO: 41742 - DNA, 20 bp, Artificial Sequence
  Description of Artificial Sequence: Synthetic oligonucleotide
  Target: SCN10A; (-) strand; PAM type: YTN; PAM sequence: CTC
ctcccagctcctggaaacca

SEQ ID NO: 41743 - DNA, 20 bp, Artificial Sequence
  Description of Artificial Sequence: Synthetic oligonucleotide
  Target: SCN10A; (-) strand; PAM type: YTN; PAM sequence: TTC
ccctcctcccagctcctgga

SEQ ID NO: 41744 - DNA, 20 bp, Artificial Sequence
  Description of Artificial Sequence: Synthetic oligonucleotide
  Target: SCN10A; (-) strand; PAM type: YTN; PAM sequence: TTT
cccctcctcccagctcctgg

SEQ ID NO: 41745 - DNA, 20 bp, Artificial Sequence
  Description of Artificial Sequence: Synthetic oligonucleotide
  Target: SCN10A; (-) strand; PAM type: YTN; PAM sequence: CTC
cccaatttcccctcctccca

SEQ ID NO: 41746 - DNA, 20 bp, Artificial Sequence
  Description of Artificial Sequence: Synthetic oligonucleotide
  Target: SCN10A; (-) strand; PAM type: YTN; PAM sequence: TTG
acaagtacctccccaatttc

SEQ ID NO: 41747 - DNA, 20 bp, Artificial Sequence
  Description of Artificial Sequence: Synthetic oligonucleotide
  Target: SCN10A; (-) strand; PAM type: YTN; PAM sequence: TTT
gacaagtacctccccaattt

SEQ ID NO: 41748 - DNA, 20 bp, Artificial Sequence
  Description of Artificial Sequence: Synthetic oligonucleotide
  Target: SCN10A; (-) strand; PAM type: YTN; PAM sequence: CTT
tgacaagtacctccccaatt

SEQ ID NO: 41749 - DNA, 20 bp, Artificial Sequence
  Description of Artificial Sequence: Synthetic oligonucleotide
  Target: SCN10A; (-) strand; PAM type: YTN; PAM sequence: TTG
tacactttgacaagtacctc

SEQ ID NO: 41750 - DNA, 20 bp, Artificial Sequence
  Description of Artificial Sequence: Synthetic oligonucleotide
  Target: SCN10A; (-) strand; PAM type: YTN; PAM sequence: TTT
gtacactttgacaagtacct

SEQ ID NO: 41751 - DNA, 20 bp, Artificial Sequence
  Description of Artificial Sequence: Synthetic oligonucleotide
  Target: SCN10A; (-) strand; PAM type: YTN; PAM sequence: CTG
gaagtttgtacactttgaca

SEQ ID NO: 41752 - DNA, 20 bp, Artificial Sequence
  Description of Artificial Sequence: Synthetic oligonucleotide
  Target: SCN10A; (-) strand; PAM type: YTN; PAM sequence: TTC
atgtcacataactggaagtt

SEQ ID NO: 41753 - DNA, 20 bp, Artificial Sequence
  Description of Artificial Sequence: Synthetic oligonucleotide
  Target: SCN10A; (-) strand; PAM type: YTN; PAM sequence: TTA
ttcatgtcacataactggaa

SEQ ID NO: 41754 - DNA, 20 bp, Artificial Sequence
  Description of Artificial Sequence: Synthetic oligonucleotide
  Target: SCN10A; (-) strand; PAM type: YTN; PAM sequence: TTT
attcatgtcacataactgga

SEQ ID NO: 41755 - DNA, 20 bp, Artificial Sequence
  Description of Artificial Sequence: Synthetic oligonucleotide
  Target: SCN10A; (-) strand; PAM type: YTN; PAM sequence: CTA
ggatttattcatgtcacata

SEQ ID NO: 41756 - DNA, 20 bp, Artificial Sequence
  Description of Artificial Sequence: Synthetic oligonucleotide
  Target: SCN10A; (-) strand; PAM type: YTN; PAM sequence: CTC
taggatttattcatgtcaca

SEQ ID NO: 41757 - DNA, 20 bp, Artificial Sequence
  Description of Artificial Sequence: Synthetic oligonucleotide
  Target: SCN10A; (-) strand; PAM type: YTN; PAM sequence: CTA
taagtagagctctaggattt

SEQ ID NO: 41758 - DNA, 20 bp, Artificial Sequence
  Description of Artificial Sequence: Synthetic oligonucleotide
  Target: SCN10A; (-) strand; PAM type: YTN; PAM sequence: CTA
tgctataagtagagctctag

SEQ ID NO: 41759 - DNA, 20 bp, Artificial Sequence
  Description of Artificial Sequence: Synthetic oligonucleotide
  Target: SCN10A; (-) strand; PAM type: YTN; PAM sequence: CTA
tagggactatgctataagta

SEQ ID NO: 41760 - DNA, 20 bp, Artificial Sequence
  Description of Artificial Sequence: Synthetic oligonucleotide
  Target: SCN10A; (-) strand; PAM type: YTN; PAM sequence: CTA
actatagggactatgctata

SEQ ID NO: 41761 - DNA, 20 bp, Artificial Sequence
  Description of Artificial Sequence: Synthetic oligonucleotide
  Target: SCN10A; (-) strand; PAM type: YTN; PAM sequence: TTG
ctaactatagggactatgct

SEQ ID NO: 41762 - DNA, 20 bp, Artificial Sequence
  Description of Artificial Sequence: Synthetic oligonucleotide
  Target: SCN10A; (-) strand; PAM type: YTN; PAM sequence: TTA
ggtagacaacacggtattgc

SEQ ID NO: 41763 - DNA, 20 bp, Artificial Sequence
  Description of Artificial Sequence: Synthetic oligonucleotide
  Target: SCN10A; (-) strand; PAM type: YTN; PAM sequence: TTT
aggtagacaacacggtattg

SEQ ID NO: 41764 - DNA, 20 bp, Artificial Sequence
  Description of Artificial Sequence: Synthetic oligonucleotide
  Target: SCN10A; (-) strand; PAM type: YTN; PAM sequence: TTT
taggtagacaacacggtatt

SEQ ID NO: 41765 - DNA, 20 bp, Artificial Sequence
  Description of Artificial Sequence: Synthetic oligonucleotide
  Target: SCN10A; (-) strand; PAM type: YTN; PAM sequence: TTT
ttaggtagacaacacggtat

SEQ ID NO: 41766 - DNA, 20 bp, Artificial Sequence
  Description of Artificial Sequence: Synthetic oligonucleotide
  Target: SCN10A; (-) strand; PAM type: YTN; PAM sequence: TTG
gcaaatttttaggtagacaa

SEQ ID NO: 41767 - DNA, 20 bp, Artificial Sequence
  Description of Artificial Sequence: Synthetic oligonucleotide
  Target: SCN10A; (-) strand; PAM type: YTN; PAM sequence: CTT
ggcaaatttttaggtagaca

SEQ ID NO: 41768 - DNA, 20 bp, Artificial Sequence
  Description of Artificial Sequence: Synthetic oligonucleotide
  Target: SCN10A; (-) strand; PAM type: YTN; PAM sequence: CTC
ttggcaaatttttaggtaga

SEQ ID NO: 41769 - DNA, 20 bp, Artificial Sequence
  Description of Artificial Sequence: Synthetic oligonucleotide
  Target: SCN10A; (-) strand; PAM type: YTN; PAM sequence: TTC
tcttggcaaatttttaggta

SEQ ID NO: 41770 - DNA, 20 bp, Artificial Sequence
  Description of Artificial Sequence: Synthetic oligonucleotide
  Target: SCN10A; (-) strand; PAM type: YTN; PAM sequence: TTA
ttctcttggcaaatttttag

SEQ ID NO: 41771 - DNA, 20 bp, Artificial Sequence
  Description of Artificial Sequence: Synthetic oligonucleotide
  Target: SCN10A; (-) strand; PAM type: YTN; PAM sequence: TTT
attctcttggcaaattttta

SEQ ID NO: 41772 - DNA, 20 bp, Artificial Sequence
  Description of Artificial Sequence: Synthetic oligonucleotide
  Target: SCN10A; (-) strand; PAM type: YTN; PAM sequence: TTA
agatttattctcttggcaaa

SEQ ID NO: 41773 - DNA, 20 bp, Artificial Sequence
  Description of Artificial Sequence: Synthetic oligonucleotide
  Target: SCN10A; (-) strand; PAM type: YTN; PAM sequence: CTT
aagatttattctcttggcaa

SEQ ID NO: 41774 - DNA, 20 bp, Artificial Sequence
  Description of Artificial Sequence: Synthetic oligonucleotide
  Target: SCN10A; (-) strand; PAM type: YTN; PAM sequence: CTA
ggaacacttaagatttattc

SEQ ID NO: 41775 - DNA, 20 bp, Artificial Sequence
  Description of Artificial Sequence: Synthetic oligonucleotide
  Target: SCN10A; (-) strand; PAM type: YTN; PAM sequence: TTG
ggtgctaggaacacttaaga

SEQ ID NO: 41776 - DNA, 20 bp, Artificial Sequence
  Description of Artificial Sequence: Synthetic oligonucleotide
  Target: SCN10A; (-) strand; PAM type: YTN; PAM sequence: TTA
ttgggtgctaggaacactta

SEQ ID NO: 41777 - DNA, 20 bp, Artificial Sequence
  Description of Artificial Sequence: Synthetic oligonucleotide
  Target: SCN10A; (-) strand; PAM type: YTN; PAM sequence: TTT
attgggtgctaggaacactt

SEQ ID NO: 41778 - DNA, 20 bp, Artificial Sequence
  Description of Artificial Sequence: Synthetic oligonucleotide
  Target: SCN10A; (-) strand; PAM type: YTN; PAM sequence: TTA
tttattgggtgctaggaaca

SEQ ID NO: 41779 - DNA, 20 bp, Artificial Sequence
  Description of Artificial Sequence: Synthetic oligonucleotide
  Target: SCN10A; (-) strand; PAM type: YTN; PAM sequence: TTT
atttattgggtgctaggaac

SEQ ID NO: 41780 - DNA, 20 bp, Artificial Sequence
  Description of Artificial Sequence: Synthetic oligonucleotide
  Target: SCN10A; (-) strand; PAM type: YTN; PAM sequence: TTA
tttatttattgggtgctagg

SEQ ID NO: 41781 - DNA, 20 bp, Artificial Sequence
  Description of Artificial Sequence: Synthetic oligonucleotide
  Target: SCN10A; (-) strand; PAM type: YTN; PAM sequence: TTT
atttatttattgggtgctag

SEQ ID NO: 41782 - DNA, 20 bp, Artificial Sequence
  Description of Artificial Sequence: Synthetic oligonucleotide
  Target: SCN10A; (-) strand; PAM type: YTN; PAM sequence: CTA
tttatttatttattgggtgc

SEQ ID NO: 41783 - DNA, 20 bp, Artificial Sequence
  Description of Artificial Sequence: Synthetic oligonucleotide
  Target: SCN10A; (-) strand; PAM type: YTN; PAM sequence: CTG
cctatttatttatttattgg

SEQ ID NO: 41784 - DNA, 20 bp, Artificial Sequence
  Description of Artificial Sequence: Synthetic oligonucleotide
  Target: SCN10A; (-) strand; PAM type: YTN; PAM sequence: CTC
ctgcctatttatttatttat

SEQ ID NO: 41785 - DNA, 20 bp, Artificial Sequence
  Description of Artificial Sequence: Synthetic oligonucleotide
  Target: SCN10A; (-) strand; PAM type: YTN; PAM sequence: TTC
ctcctgcctatttatttatt

SEQ ID NO: 41786 - DNA, 20 bp, Artificial Sequence
  Description of Artificial Sequence: Synthetic oligonucleotide
  Target: SCN10A; (-) strand; PAM type: YTN; PAM sequence: TTT
cctcctgcctatttatttat

SEQ ID NO: 41787 - DNA, 20 bp, Artificial Sequence
  Description of Artificial Sequence: Synthetic oligonucleotide
  Target: SCN10A; (-) strand; PAM type: YTN; PAM sequence: CTC
caaatatttcctcctgccta

SEQ ID NO: 41788 - DNA, 20 bp, Artificial Sequence
  Description of Artificial Sequence: Synthetic oligonucleotide
  Target: SCN10A; (-) strand; PAM type: YTN; PAM sequence: TTG
gagataagtatacacccatg

SEQ ID NO: 41789 - DNA, 20 bp, Artificial Sequence
  Description of Artificial Sequence: Synthetic oligonucleotide
  Target: SCN10A; (-) strand; PAM type: YTN; PAM sequence: TTT
ggagataagtatacacccat

SEQ ID NO: 41790 - DNA, 20 bp, Artificial Sequence
  Description of Artificial Sequence: Synthetic oligonucleotide
  Target: SCN10A; (-) strand; PAM type: YTN; PAM sequence: TTA
tgagtttggagataagtata

SEQ ID NO: 41791 - DNA, 20 bp, Artificial Sequence
  Description of Artificial Sequence: Synthetic oligonucleotide
  Target: SCN10A; (-) strand; PAM type: YTN; PAM sequence: TTT
atgagtttggagataagtat

SEQ ID NO: 41792 - DNA, 20 bp, Artificial Sequence
  Description of Artificial Sequence: Synthetic oligonucleotide
  Target: SCN10A; (-) strand; PAM type: YTN; PAM sequence: CTT
tatgagtttggagataagta

SEQ ID NO: 41793 - DNA, 20 bp, Artificial Sequence
  Description of Artificial Sequence: Synthetic oligonucleotide
  Target: SCN10A; (-) strand; PAM type: YTN; PAM sequence: TTA
atgtacacaactttatgagt

SEQ ID NO: 41794 - DNA, 20 bp, Artificial Sequence
  Description of Artificial Sequence: Synthetic oligonucleotide
  Target: SCN10A; (-) strand; PAM type: YTN; PAM sequence: TTT
aatgtacacaactttatgag

SEQ ID NO: 41795 - DNA, 20 bp, Artificial Sequence
  Description of Artificial Sequence: Synthetic oligonucleotide
  Target: SCN10A; (-) strand; PAM type: YTN; PAM sequence: CTA
tacatgtttaatgtacacaa

SEQ ID NO: 41796 - DNA, 20 bp, Artificial Sequence
  Description of Artificial Sequence: Synthetic oligonucleotide
  Target: SCN10A; (-) strand; PAM type: YTN; PAM sequence: TTG
aggtatgatccacatgtaaa

SEQ ID NO: 41797 - DNA, 20 bp, Artificial Sequence
  Description of Artificial Sequence: Synthetic oligonucleotide
  Target: SCN10A; (-) strand; PAM type: YTN; PAM sequence: TTA
ttgaggtatgatccacatgt

SEQ ID NO: 41798 - DNA, 20 bp, Artificial Sequence
  Description of Artificial Sequence: Synthetic oligonucleotide
  Target: SCN10A; (-) strand; PAM type: YTN; PAM sequence: TTT
attgaggtatgatccacatg

SEQ ID NO: 41799 - DNA, 20 bp, Artificial Sequence
  Description of Artificial Sequence: Synthetic oligonucleotide
  Target: SCN10A; (-) strand; PAM type: YTN; PAM sequence: CTT
tattgaggtatgatccacat

SEQ ID NO: 41800 - DNA, 20 bp, Artificial Sequence
  Description of Artificial Sequence: Synthetic oligonucleotide
  Target: SCN10A; (-) strand; PAM type: YTN; PAM sequence: TTA
acactttattgaggtatgat

SEQ ID NO: 41801 - DNA, 20 bp, Artificial Sequence
  Description of Artificial Sequence: Synthetic oligonucleotide
  Target: SCN10A; (-) strand; PAM type: YTN; PAM sequence: TTT
aacactttattgaggtatga

SEQ ID NO: 41802 - DNA, 20 bp, Artificial Sequence
  Description of Artificial Sequence: Synthetic oligonucleotide
  Target: SCN10A; (-) strand; PAM type: YTN; PAM sequence: TTT
taacactttattgaggtatg

SEQ ID NO: 41803 - DNA, 20 bp, Artificial Sequence
  Description of Artificial Sequence: Synthetic oligonucleotide
  Target: SCN10A; (-) strand; PAM type: YTN; PAM sequence: TTT
ttaacactttattgaggtat

SEQ ID NO: 41804 - DNA, 20 bp, Artificial Sequence
  Description of Artificial Sequence: Synthetic oligonucleotide
  Target: SCN10A; (-) strand; PAM type: YTN; PAM sequence: TTT
tttaacactttattgaggta

SEQ ID NO: 41805 - DNA, 20 bp, Artificial Sequence
  Description of Artificial Sequence: Synthetic oligonucleotide
  Target: SCN10A; (-) strand; PAM type: YTN; PAM sequence: CTG
ttttttaacactttattgag

SEQ ID NO: 41806 - DNA, 20 bp, Artificial Sequence
  Description of Artificial Sequence: Synthetic oligonucleotide
  Target: SCN10A; (-) strand; PAM type: YTN; PAM sequence: CTC
tgttttttaacactttattg

SEQ ID NO: 41807 - DNA, 20 bp, Artificial Sequence
  Description of Artificial Sequence: Synthetic oligonucleotide
  Target: SCN10A; (-) strand; PAM type: YTN; PAM sequence: CTG
ctctgttttttaacacttta

SEQ ID NO: 41808 - DNA, 20 bp, Artificial Sequence
  Description of Artificial Sequence: Synthetic oligonucleotide
  Target: SCN10A; (-) strand; PAM type: YTN; PAM sequence: TTG
ctgctctgttttttaacact

SEQ ID NO: 41809 - DNA, 20 bp, Artificial Sequence
  Description of Artificial Sequence: Synthetic oligonucleotide
  Target: SCN10A; (-) strand; PAM type: YTN; PAM sequence: TTG
atattgctgctctgtttttt

SEQ ID NO: 41810 - DNA, 20 bp, Artificial Sequence
  Description of Artificial Sequence: Synthetic oligonucleotide
  Target: SCN10A; (-) strand; PAM type: YTN; PAM sequence: TTT
gatattgctgctctgttttt

SEQ ID NO: 41811 - DNA, 20 bp, Artificial Sequence
  Description of Artificial Sequence: Synthetic oligonucleotide
  Target: SCN10A; (-) strand; PAM type: YTN; PAM sequence: TTT
tgatattgctgctctgtttt

SEQ ID NO: 41812 - DNA, 20 bp, Artificial Sequence
  Description of Artificial Sequence: Synthetic oligonucleotide
  Target: SCN10A; (-) strand; PAM type: YTN; PAM sequence: TTA
ttttgatattgctgctctgt

SEQ ID NO: 41813 - DNA, 20 bp, Artificial Sequence
  Description of Artificial Sequence: Synthetic oligonucleotide
  Target: SCN10A; (-) strand; PAM type: YTN; PAM sequence: TTT
attttgatattgctgctctg

SEQ ID NO: 41814 - DNA, 20 bp, Artificial Sequence
  Description of Artificial Sequence: Synthetic oligonucleotide
  Target: SCN10A; (-) strand; PAM type: YTN; PAM sequence: TTT
tattttgatattgctgctct

SEQ ID NO: 41815 - DNA, 20 bp, Artificial Sequence
  Description of Artificial Sequence: Synthetic oligonucleotide
  Target: SCN10A; (-) strand; PAM type: YTN; PAM sequence: TTG
ttttattttgatattgctgc

SEQ ID NO: 41816 - DNA, 20 bp, Artificial Sequence
  Description of Artificial Sequence: Synthetic oligonucleotide
  Target: SCN10A; (-) strand; PAM type: YTN; PAM sequence: CTT
gttttattttgatattgctg

SEQ ID NO: 41817 - DNA, 20 bp, Artificial Sequence
  Description of Artificial Sequence: Synthetic oligonucleotide
  Target: SCN10A; (-) strand; PAM type: YTN; PAM sequence: TTC
ttgttttattttgatattgc

SEQ ID NO: 41818 - DNA, 20 bp, Artificial Sequence
  Description of Artificial Sequence: Synthetic oligonucleotide
  Target: SCN10A; (-) strand; PAM type: YTN; PAM sequence: TTG
ttcttgttttattttgatat

SEQ ID NO: 41819 - DNA, 20 bp, Artificial Sequence
  Description of Artificial Sequence: Synthetic oligonucleotide
  Target: SCN10A; (-) strand; PAM type: YTN; PAM sequence: TTT
gttcttgttttattttgata

SEQ ID NO: 41820 - DNA, 20 bp, Artificial Sequence
  Description of Artificial Sequence: Synthetic oligonucleotide
  Target: SCN10A; (-) strand; PAM type: YTN; PAM sequence: TTT
tgttcttgttttattttgat

SEQ ID NO: 41821 - DNA, 20 bp, Artificial Sequence
  Description of Artificial Sequence: Synthetic oligonucleotide
  Target: SCN10A; (-) strand; PAM type: YTN; PAM sequence: TTT
ttgttcttgttttattttga

SEQ ID NO: 41822 - DNA, 20 bp, Artificial Sequence
  Description of Artificial Sequence: Synthetic oligonucleotide
  Target: SCN10A; (-) strand; PAM type: YTN; PAM sequence: TTG
tttttgttcttgttttattt

SEQ ID NO: 41823 - DNA, 20 bp, Artificial Sequence
  Description of Artificial Sequence: Synthetic oligonucleotide
  Target: SCN10A; (-) strand; PAM type: YTN; PAM sequence: TTT
gtttttgttcttgttttatt

SEQ ID NO: 41824 - DNA, 20 bp, Artificial Sequence
  Description of Artificial Sequence: Synthetic oligonucleotide
  Target: SCN10A; (-) strand; PAM type: YTN; PAM sequence: TTC
agtttgtttttgttcttgtt

SEQ ID NO: 41825 - DNA, 20 bp, Artificial Sequence
  Description of Artificial Sequence: Synthetic oligonucleotide
  Target: SCN10A; (-) strand; PAM type: YTN; PAM sequence: TTT
cagtttgtttttgttcttgt

SEQ ID NO: 41826 - DNA, 20 bp, Artificial Sequence
  Description of Artificial Sequence: Synthetic oligonucleotide
  Target: SCN10A; (-) strand; PAM type: YTN; PAM sequence: TTC
cggggatttcagtttgtttt

SEQ ID NO: 41827 - DNA, 20 bp, Artificial Sequence
  Description of Artificial Sequence: Synthetic oligonucleotide
  Target: SCN10A; (-) strand; PAM type: YTN; PAM sequence: TTT
ccggggatttcagtttgttt

SEQ ID NO: 41828 - DNA, 20 bp, Artificial Sequence
  Description of Artificial Sequence: Synthetic oligonucleotide
  Target: SCN10A; (-) strand; PAM type: YTN; PAM sequence: TTG
cgtgtatttccggggatttc

SEQ ID NO: 41829 - DNA, 20 bp, Artificial Sequence
  Description of Artificial Sequence: Synthetic oligonucleotide
  Target: SCN10A; (-) strand; PAM type: YTN; PAM sequence: TTG
ggttgcgtgtatttccgggg

SEQ ID NO: 41830 - DNA, 20 bp, Artificial Sequence
  Description of Artificial Sequence: Synthetic oligonucleotide
  Target: SCN10A; (-) strand; PAM type: YTN; PAM sequence: CTT
gggttgcgtgtatttccggg

SEQ ID NO: 41831 - DNA, 20 bp, Artificial Sequence
  Description of Artificial Sequence: Synthetic oligonucleotide
  Target: SCN10A; (-) strand; PAM type: YTN; PAM sequence: CTG
aaacacagccttgggttgcg

SEQ ID NO: 41832 - DNA, 20 bp, Artificial Sequence
  Description of Artificial Sequence: Synthetic oligonucleotide
  Target: SCN10A; (-) strand; PAM type: YTN; PAM sequence: TTG
gtgctgaaacacagccttgg

SEQ ID NO: 41833 - DNA, 20 bp, Artificial Sequence
  Description of Artificial Sequence: Synthetic oligonucleotide
  Target: SCN10A; (-) strand; PAM type: YTN; PAM sequence: CTT
ggtgctgaaacacagccttg

SEQ ID NO: 41834 - DNA, 20 bp, Artificial Sequence
  Description of Artificial Sequence: Synthetic oligonucleotide
  Target: SCN10A; (-) strand; PAM type: YTN; PAM sequence: CTC
cccaccttggtgctgaaaca

SEQ ID NO: 41835 - DNA, 20 bp, Artificial Sequence
  Description of Artificial Sequence: Synthetic oligonucleotide
  Target: SCN10A; (-) strand; PAM type: YTN; PAM sequence: TTC
atcaacctccccaccttggt

SEQ ID NO: 41836 - DNA, 20 bp, Artificial Sequence
  Description of Artificial Sequence: Synthetic oligonucleotide
  Target: SCN10A; (-) strand; PAM type: YTN; PAM sequence: TTT
catcaacctccccaccttgg

SEQ ID NO: 41837 - DNA, 20 bp, Artificial Sequence
  Description of Artificial Sequence: Synthetic oligonucleotide
  Target: SCN10A; (-) strand; PAM type: YTN; PAM sequence: TTA
acagcatttcatcaacctcc

SEQ ID NO: 41838 - DNA, 20 bp, Artificial Sequence
  Description of Artificial Sequence: Synthetic oligonucleotide
  Target: SCN10A; (-) strand; PAM type: YTN; PAM sequence: CTT
aacagcatttcatcaacctc

SEQ ID NO: 41839 - DNA, 20 bp, Artificial Sequence
  Description of Artificial Sequence: Synthetic oligonucleotide
  Target: SCN10A; (-) strand; PAM type: YTN; PAM sequence: CTA
aatacaacttaacagcattt

SEQ ID NO: 41840 - DNA, 20 bp, Artificial Sequence
  Description of Artificial Sequence: Synthetic oligonucleotide
  Target: SCN10A; (-) strand; PAM type: YTN; PAM sequence: CTG
agagtatctaaatacaactt

SEQ ID NO: 41841 - DNA, 20 bp, Artificial Sequence
  Description of Artificial Sequence: Synthetic oligonucleotide
  Target: SCN10A; (-) strand; PAM type: YTN; PAM sequence: TTA
gtaacaagagctgagagtat

SEQ ID NO: 41842 - DNA, 20 bp, Artificial Sequence
  Description of Artificial Sequence: Synthetic oligonucleotide
  Target: SCN10A; (-) strand; PAM type: YTN; PAM sequence: TTT
agtaacaagagctgagagta

SEQ ID NO: 41843 - DNA, 20 bp, Artificial Sequence
  Description of Artificial Sequence: Synthetic oligonucleotide
  Target: SCN10A; (-) strand; PAM type: YTN; PAM sequence: CTG
atttagtaacaagagctgag

SEQ ID NO: 41844 - DNA, 20 bp, Artificial Sequence
  Description of Artificial Sequence: Synthetic oligonucleotide
  Target: SCN10A; (-) strand; PAM type: YTN; PAM sequence: TTG
ccactgatttagtaacaaga

SEQ ID NO: 41845 - DNA, 20 bp, Artificial Sequence
  Description of Artificial Sequence: Synthetic oligonucleotide
  Target: SCN10A; (-) strand; PAM type: YTN; PAM sequence: TTT
gccactgatttagtaacaag

SEQ ID NO: 41846 - DNA, 20 bp, Artificial Sequence
  Description of Artificial Sequence: Synthetic oligonucleotide
  Target: SCN10A; (-) strand; PAM type: YTN; PAM sequence: TTA
atttgccactgatttagtaa

SEQ ID NO: 41847 - DNA, 20 bp, Artificial Sequence
  Description of Artificial Sequence: Synthetic oligonucleotide
  Target: SCN10A; (-) strand; PAM type: YTN; PAM sequence: TTT
aatttgccactgatttagta

SEQ ID NO: 41848 - DNA, 20 bp, Artificial Sequence
  Description of Artificial Sequence: Synthetic oligonucleotide
  Target: SCN10A; (-) strand; PAM type: YTN; PAM sequence: CTG
tagatttaatttgccactga

SEQ ID NO: 41849 - DNA, 20 bp, Artificial Sequence
  Description of Artificial Sequence: Synthetic oligonucleotide
  Target: SCN10A; (-) strand; PAM type: YTN; PAM sequence: TTC
atgtcggggtgtagctgtag

SEQ ID NO: 41850 - DNA, 20 bp, Artificial Sequence
  Description of Artificial Sequence: Synthetic oligonucleotide
  Target: SCN10A; (-) strand; PAM type: YTN; PAM sequence: TTT
catgtcggggtgtagctgta

SEQ ID NO: 41851 - DNA, 20 bp, Artificial Sequence
  Description of Artificial Sequence: Synthetic oligonucleotide
  Target: SCN10A; (-) strand; PAM type: YTN; PAM sequence: TTT
tcatgtcggggtgtagctgt

SEQ ID NO: 41852 - DNA, 20 bp, Artificial Sequence
  Description of Artificial Sequence: Synthetic oligonucleotide
  Target: SCN10A; (-) strand; PAM type: YTN; PAM sequence: CTT
ttcatgtcggggtgtagctg

SEQ ID NO: 41853 - DNA, 20 bp, Artificial Sequence
  Description of Artificial Sequence: Synthetic oligonucleotide
  Target: SCN10A; (-) strand; PAM type: YTN; PAM sequence: TTA
cttttcatgtcggggtgtag

SEQ ID NO: 41854 - DNA, 20 bp, Artificial Sequence
  Description of Artificial Sequence: Synthetic oligonucleotide
  Target: SCN10A; (-) strand; PAM type: YTN; PAM sequence: CTT
acttttcatgtcggggtgta

SEQ ID NO: 41855 - DNA, 20 bp, Artificial Sequence
  Description of Artificial Sequence: Synthetic oligonucleotide
  Target: SCN10A; (-) strand; PAM type: YTN; PAM sequence: CTG
cttacttttcatgtcggggt

SEQ ID NO: 41856 - DNA, 20 bp, Artificial Sequence
  Description of Artificial Sequence: Synthetic oligonucleotide
  Target: SCN10A; (-) strand; PAM type: YTN; PAM sequence: CTG
acctgcttacttttcatgtc

SEQ ID NO: 41857 - DNA, 20 bp, Artificial Sequence
  Description of Artificial Sequence: Synthetic oligonucleotide
  Target: SCN10A; (-) strand; PAM type: YTN; PAM sequence: TTA
tatcctgacctgcttacttt

SEQ ID NO: 41858 - DNA, 20 bp, Artificial Sequence
  Description of Artificial Sequence: Synthetic oligonucleotide
  Target: SCN10A; (-) strand; PAM type: YTN; PAM sequence: TTG
gttatatcctgacctgctta

SEQ ID NO: 41859 - DNA, 20 bp, Artificial Sequence
  Description of Artificial Sequence: Synthetic oligonucleotide
  Target: SCN10A; (-) strand; PAM type: YTN; PAM sequence: TTG
attggttatatcctgacctg

SEQ ID NO: 41860 - DNA, 20 bp, Artificial Sequence
  Description of Artificial Sequence: Synthetic oligonucleotide
  Target: SCN10A; (-) strand; PAM type: YTN; PAM sequence: CTT
gattggttatatcctgacct

SEQ ID NO: 41861 - DNA, 20 bp, Artificial Sequence
  Description of Artificial Sequence: Synthetic oligonucleotide
  Target: SCN10A; (-) strand; PAM type: YTN; PAM sequence: TTA
taaatgtatcttgattggtt

SEQ ID NO: 41862 - DNA, 20 bp, Artificial Sequence
  Description of Artificial Sequence: Synthetic oligonucleotide
  Target: SCN10A; (-) strand; PAM type: YTN; PAM sequence: CTG
gcattataaatgtatcttga

SEQ ID NO: 41863 - DNA, 20 bp, Artificial Sequence
  Description of Artificial Sequence: Synthetic oligonucleotide
  Target: SCN10A; (-) strand; PAM type: YTN; PAM sequence: TTC
acctggcattataaatgtat

SEQ ID NO: 41864 - DNA, 20 bp, Artificial Sequence
  Description of Artificial Sequence: Synthetic oligonucleotide
  Target: SCN10A; (-) strand; PAM type: YTN; PAM sequence: CTT
cacctggcattataaatgta

SEQ ID NO: 41865 - DNA, 20 bp, Artificial Sequence
  Description of Artificial Sequence: Synthetic oligonucleotide
  Target: SCN10A; (-) strand; PAM type: YTN; PAM sequence: CTC
accagcttcacctggcatta

SEQ ID NO: 41866 - DNA, 20 bp, Artificial Sequence
  Description of Artificial Sequence: Synthetic oligonucleotide
  Target: SCN10A; (-) strand; PAM type: YTN; PAM sequence: CTA
taaaggccaaatcatgctca

SEQ ID NO: 41867 - DNA, 20 bp, Artificial Sequence
  Description of Artificial Sequence: Synthetic oligonucleotide
  Target: SCN10A; (-) strand; PAM type: YTN; PAM sequence: TTG
accctataaaggccaaatca

SEQ ID NO: 41868 - DNA, 20 bp, Artificial Sequence
  Description of Artificial Sequence: Synthetic oligonucleotide
  Target: SCN10A; (-) strand; PAM type: YTN; PAM sequence: TTT
gaccctataaaggccaaatc

SEQ ID NO: 41869 - DNA, 20 bp, Artificial Sequence
  Description of Artificial Sequence: Synthetic oligonucleotide
  Target: SCN10A; (-) strand; PAM type: YTN; PAM sequence: CTG
aagtttgaccctataaaggc

SEQ ID NO: 41870 - DNA, 20 bp, Artificial Sequence
  Description of Artificial Sequence: Synthetic oligonucleotide
  Target: SCN10A; (-) strand; PAM type: YTN; PAM sequence: TTA
gctgaagtttgaccctataa

SEQ ID NO: 41871 - DNA, 20 bp, Artificial Sequence
  Description of Artificial Sequence: Synthetic oligonucleotide
  Target: SCN10A; (-) strand; PAM type: YTN; PAM sequence: TTA
tgggttagctgaagtttgac

SEQ ID NO: 41872 - DNA, 20 bp, Artificial Sequence
  Description of Artificial Sequence: Synthetic oligonucleotide
  Target: SCN10A; (-) strand; PAM type: YTN; PAM sequence: CTT
atgggttagctgaagtttga

SEQ ID NO: 41873 - DNA, 20 bp, Artificial Sequence
  Description of Artificial Sequence: Synthetic oligonucleotide
  Target: SCN10A; (-) strand; PAM type: YTN; PAM sequence: CTG
ggcttatgggttagctgaag

SEQ ID NO: 41874 - DNA, 20 bp, Artificial Sequence
  Description of Artificial Sequence: Synthetic oligonucleotide
  Target: SCN10A; (-) strand; PAM type: YTN; PAM sequence: CTG
tccctgggcttatgggttag

SEQ ID NO: 41875 - DNA, 20 bp, Artificial Sequence
  Description of Artificial Sequence: Synthetic oligonucleotide
  Target: SCN10A; (-) strand; PAM type: YTN; PAM sequence: CTG
tcaccaacagccaagagact

SEQ ID NO: 41876 - DNA, 20 bp, Artificial Sequence
  Description of Artificial Sequence: Synthetic oligonucleotide
  Target: SCN10A; (-) strand; PAM type: YTN; PAM sequence: CTG
cctgtcaccaacagccaaga

SEQ ID NO: 41877 - DNA, 20 bp, Artificial Sequence
  Description of Artificial Sequence: Synthetic oligonucleotide
  Target: SCN10A; (-) strand; PAM type: YTN; PAM sequence: TTG
ctgcctgtcaccaacagcca

SEQ ID NO: 41878 - DNA, 20 bp, Artificial Sequence
  Description of Artificial Sequence: Synthetic oligonucleotide
  Target: SCN10A; (-) strand; PAM type: YTN; PAM sequence: CTT
gctgcctgtcaccaacagcc

SEQ ID NO: 41879 - DNA, 20 bp, Artificial Sequence
  Description of Artificial Sequence: Synthetic oligonucleotide
  Target: SCN10A; (-) strand; PAM type: YTN; PAM sequence: CTA
atgaacttgctgcctgtcac

SEQ ID NO: 41880 - DNA, 20 bp, Artificial Sequence
  Description of Artificial Sequence: Synthetic oligonucleotide
  Target: SCN10A; (-) strand; PAM type: YTN; PAM sequence: TTC
taatgaacttgctgcctgtc

SEQ ID NO: 41881 - DNA, 20 bp, Artificial Sequence
  Description of Artificial Sequence: Synthetic oligonucleotide
  Target: SCN10A; (-) strand; PAM type: YTN; PAM sequence: CTT
ctaatgaacttgctgcctgt

SEQ ID NO: 41882 - DNA, 20 bp, Artificial Sequence
  Description of Artificial Sequence: Synthetic oligonucleotide
  Target: SCN10A; (-) strand; PAM type: YTN; PAM sequence: CTC
caatcttctaatgaacttgc

SEQ ID NO: 41883 - DNA, 20 bp, Artificial Sequence
  Description of Artificial Sequence: Synthetic oligonucleotide
  Target: SCN10A; (-) strand; PAM type: YTN; PAM sequence: TTA
gaacaggctccaatcttcta

SEQ ID NO: 41884 - DNA, 20 bp, Artificial Sequence
  Description of Artificial Sequence: Synthetic oligonucleotide
  Target: SCN10A; (-) strand; PAM type: YTN; PAM sequence: TTT
agaacaggctccaatcttct

SEQ ID NO: 41885 - DNA, 20 bp, Artificial Sequence
  Description of Artificial Sequence: Synthetic oligonucleotide
  Target: SCN10A; (-) strand; PAM type: YTN; PAM sequence: CTG
agtttagaacaggctccaat

SEQ ID NO: 41886 - DNA, 20 bp, Artificial Sequence
  Description of Artificial Sequence: Synthetic oligonucleotide
  Target: SCN10A; (-) strand; PAM type: YTN; PAM sequence: TTG
aagctgagtttagaacaggc

SEQ ID NO: 41887 - DNA, 20 bp, Artificial Sequence
  Description of Artificial Sequence: Synthetic oligonucleotide
  Target: SCN10A; (-) strand; PAM type: YTN; PAM sequence: TTC
caagggttgaagctgagttt

SEQ ID NO: 41888 - DNA, 20 bp, Artificial Sequence
  Description of Artificial Sequence: Synthetic oligonucleotide
  Target: SCN10A; (-) strand; PAM type: YTN; PAM sequence: TTT
ccaagggttgaagctgagtt

SEQ ID NO: 41889 - DNA, 20 bp, Artificial Sequence
  Description of Artificial Sequence: Synthetic oligonucleotide
  Target: SCN10A; (-) strand; PAM type: YTN; PAM sequence: TTA
tgcagggtcacagagtttcc

SEQ ID NO: 41890 - DNA, 20 bp, Artificial Sequence
  Description of Artificial Sequence: Synthetic oligonucleotide
  Target: SCN10A; (-) strand; PAM type: YTN; PAM sequence: CTC
agagatcaagaatattatgc

SEQ ID NO: 41891 - DNA, 20 bp, Artificial Sequence
  Description of Artificial Sequence: Synthetic oligonucleotide
  Target: SCN10A; (-) strand; PAM type: YTN; PAM sequence: TTG
agactcagagatcaagaata

SEQ ID NO: 41892 - DNA, 20 bp, Artificial Sequence
  Description of Artificial Sequence: Synthetic oligonucleotide
  Target: SCN10A; (-) strand; PAM type: YTN; PAM sequence: TTA
aaattgagactcagagatca

SEQ ID NO: 41893 - DNA, 20 bp, Artificial Sequence
  Description of Artificial Sequence: Synthetic oligonucleotide
  Target: SCN10A; (-) strand; PAM type: YTN; PAM sequence: TTT
aaaattgagactcagagatc

SEQ ID NO: 41894 - DNA, 20 bp, Artificial Sequence
  Description of Artificial Sequence: Synthetic oligonucleotide
  Target: SCN10A; (-) strand; PAM type: YTN; PAM sequence: TTA
tacatttaaaattgagactc

SEQ ID NO: 41895 - DNA, 20 bp, Artificial Sequence
  Description of Artificial Sequence: Synthetic oligonucleotide
  Target: SCN10A; (-) strand; PAM type: YTN; PAM sequence: TTT
atacatttaaaattgagact

SEQ ID NO: 41896 - DNA, 20 bp, Artificial Sequence
  Description of Artificial Sequence: Synthetic oligonucleotide
  Target: SCN10A; (-) strand; PAM type: YTN; PAM sequence: TTT
tatacatttaaaattgagac

SEQ ID NO: 41897 - DNA, 20 bp, Artificial Sequence
  Description of Artificial Sequence: Synthetic oligonucleotide
  Target: SCN10A; (-) strand; PAM type: YTN; PAM sequence: TTA
ttttatacatttaaaattga

SEQ ID NO: 41898 - DNA, 20 bp, Artificial Sequence
  Description of Artificial Sequence: Synthetic oligonucleotide
  Target: SCN10A; (-) strand; PAM type: YTN; PAM sequence: CTT
attttatacatttaaaattg

SEQ ID NO: 41899 - DNA, 20 bp, Artificial Sequence
  Description of Artificial Sequence: Synthetic oligonucleotide
  Target: SCN10A; (-) strand; PAM type: YTN; PAM sequence: TTA
tccttattttatacatttaa

SEQ ID NO: 41900 - DNA, 20 bp, Artificial Sequence
  Description of Artificial Sequence: Synthetic oligonucleotide
  Target: SCN10A; (-) strand; PAM type: YTN; PAM sequence: TTA
ttatccttattttatacatt

SEQ ID NO: 41901 - DNA, 20 bp, Artificial Sequence
  Description of Artificial Sequence: Synthetic oligonucleotide
  Target: SCN10A; (-) strand; PAM type: YTN; PAM sequence: CTG
tcaagcaggtgttattatcc

SEQ ID NO: 41902 - DNA, 20 bp, Artificial Sequence
  Description of Artificial Sequence: Synthetic oligonucleotide
  Target: SCN10A; (-) strand; PAM type: YTN; PAM sequence: TTC
acagcagccctgtcaagcag

SEQ ID NO: 41903 - DNA, 20 bp, Artificial Sequence
  Description of Artificial Sequence: Synthetic oligonucleotide
  Target: SCN10A; (-) strand; PAM type: YTN; PAM sequence: CTC
catgaatgttcacagcagcc

SEQ ID NO: 41904 - DNA, 20 bp, Artificial Sequence
  Description of Artificial Sequence: Synthetic oligonucleotide
  Target: SCN10A; (-) strand; PAM type: YTN; PAM sequence: CTG
ggctccatgaatgttcacag

SEQ ID NO: 41905 - DNA, 20 bp, Artificial Sequence
  Description of Artificial Sequence: Synthetic oligonucleotide
  Target: SCN10A; (-) strand; PAM type: YTN; PAM sequence: CTG
agctgggctccatgaatgtt

SEQ ID NO: 41906 - DNA, 20 bp, Artificial Sequence
  Description of Artificial Sequence: Synthetic oligonucleotide
  Target: SCN10A; (-) strand; PAM type: YTN; PAM sequence: CTG
agcactgagctgggctccat

SEQ ID NO: 41907 - DNA, 20 bp, Artificial Sequence
  Description of Artificial Sequence: Synthetic oligonucleotide
  Target: SCN10A; (-) strand; PAM type: YTN; PAM sequence: TTC
tgagcactgagctgggctcc

SEQ ID NO: 41908 - DNA, 20 bp, Artificial Sequence
  Description of Artificial Sequence: Synthetic oligonucleotide
  Target: SCN10A; (-) strand; PAM type: YTN; PAM sequence: CTA
agttctgagcactgagctgg

SEQ ID NO: 41909 - DNA, 20 bp, Artificial Sequence
  Description of Artificial Sequence: Synthetic oligonucleotide
  Target: SCN10A; (-) strand; PAM type: YTN; PAM sequence: TTC
ctaagttctgagcactgagc

SEQ ID NO: 41910 - DNA, 20 bp, Artificial Sequence
  Description of Artificial Sequence: Synthetic oligonucleotide
  Target: SCN10A; (-) strand; PAM type: YTN; PAM sequence: CTT
cctaagttctgagcactgag

SEQ ID NO: 41911 - DNA, 20 bp, Artificial Sequence
  Description of Artificial Sequence: Synthetic oligonucleotide
  Target: SCN10A; (-) strand; PAM type: YTN; PAM sequence: CTG
aatacttcctaagttctgag

SEQ ID NO: 41912 - DNA, 20 bp, Artificial Sequence
  Description of Artificial Sequence: Synthetic oligonucleotide
  Target: SCN10A; (-) strand; PAM type: YTN; PAM sequence: TTG
actgaatacttcctaagttc

SEQ ID NO: 41913 - DNA, 20 bp, Artificial Sequence
  Description of Artificial Sequence: Synthetic oligonucleotide
  Target: SCN10A; (-) strand; PAM type: YTN; PAM sequence: CTT
gactgaatacttcctaagtt

SEQ ID NO: 41914 - DNA, 20 bp, Artificial Sequence
  Description of Artificial Sequence: Synthetic oligonucleotide
  Target: SCN10A; (-) strand; PAM type: YTN; PAM sequence: CTG
ccttgactgaatacttccta

SEQ ID NO: 41915 - DNA, 20 bp, Artificial Sequence
  Description of Artificial Sequence: Synthetic oligonucleotide
  Target: SCN10A; (-) strand; PAM type: YTN; PAM sequence: CTA
acatggggaaatggagctgc

SEQ ID NO: 41916 - DNA, 20 bp, Artificial Sequence
  Description of Artificial Sequence: Synthetic oligonucleotide
  Target: SCN10A; (-) strand; PAM type: YTN; PAM sequence: TTA
gaggctaacatggggaaatg

SEQ ID NO: 41917 - DNA, 20 bp, Artificial Sequence
  Description of Artificial Sequence: Synthetic oligonucleotide
  Target: SCN10A; (-) strand; PAM type: YTN; PAM sequence: CTA
gagttagaggctaacatggg

SEQ ID NO: 41918 - DNA, 20 bp, Artificial Sequence
  Description of Artificial Sequence: Synthetic oligonucleotide
  Target: SCN10A; (-) strand; PAM type: YTN; PAM sequence: TTA
ctagagttagaggctaacat

SEQ ID NO: 41919 - DNA, 20 bp, Artificial Sequence
  Description of Artificial Sequence: Synthetic oligonucleotide
  Target: SCN10A; (-) strand; PAM type: YTN; PAM sequence: TTC
agagaaaattactagagtta

SEQ ID NO: 41920 - DNA, 20 bp, Artificial Sequence
  Description of Artificial Sequence: Synthetic oligonucleotide
  Target: SCN10A; (-) strand; PAM type: YTN; PAM sequence: TTG
ggtccagtggtgttcagaga

SEQ ID NO: 41921 - DNA, 20 bp, Artificial Sequence
  Description of Artificial Sequence: Synthetic oligonucleotide
  Target: SCN10A; (-) strand; PAM type: YTN; PAM sequence: TTT
gggtccagtggtgttcagag

SEQ ID NO: 41922 - DNA, 20 bp, Artificial Sequence
  Description of Artificial Sequence: Synthetic oligonucleotide
  Target: SCN10A; (-) strand; PAM type: YTN; PAM sequence: TTT
tgggtccagtggtgttcaga

SEQ ID NO: 41923 - DNA, 20 bp, Artificial Sequence
  Description of Artificial Sequence: Synthetic oligonucleotide
  Target: SCN10A; (-) strand; PAM type: YTN; PAM sequence: TTG
aatgacaggcccagtatttt

SEQ ID NO: 41924 - DNA, 20 bp, Artificial Sequence
  Description of Artificial Sequence: Synthetic oligonucleotide
  Target: SCN10A; (-) strand; PAM type: YTN; PAM sequence: TTG
ttgaatgacaggcccagtat

SEQ ID NO: 41925 - DNA, 20 bp, Artificial Sequence
  Description of Artificial Sequence: Synthetic oligonucleotide
  Target: SCN10A; (-) strand; PAM type: YTN; PAM sequence: CTG
ggtgttgttgaatgacaggc

SEQ ID NO: 41926 - DNA, 20 bp, Artificial Sequence
  Description of Artificial Sequence: Synthetic oligonucleotide
  Target: SCN10A; (-) strand; PAM type: YTN; PAM sequence: TTA
aggcccagtctgggtgttgt

SEQ ID NO: 41927 - DNA, 20 bp, Artificial Sequence
  Description of Artificial Sequence: Synthetic oligonucleotide
  Target: SCN10A; (-) strand; PAM type: YTN; PAM sequence: CTG
ttaaggcccagtctgggtgt

SEQ ID NO: 41928 - DNA, 20 bp, Artificial Sequence
  Description of Artificial Sequence: Synthetic oligonucleotide
  Target: SCN10A; (-) strand; PAM type: YTN; PAM sequence: TTA
atactgttaaggcccagtct

SEQ ID NO: 41929 - DNA, 20 bp, Artificial Sequence
  Description of Artificial Sequence: Synthetic oligonucleotide
  Target: SCN10A; (-) strand; PAM type: YTN; PAM sequence: TTA
gggaacatgagtgatagaaa

SEQ ID NO: 41930 - DNA, 20 bp, Artificial Sequence
  Description of Artificial Sequence: Synthetic oligonucleotide
  Target: SCN10A; (-) strand; PAM type: YTN; PAM sequence: CTA
ttagggaacatgagtgatag

SEQ ID NO: 41931 - DNA, 20 bp, Artificial Sequence
  Description of Artificial Sequence: Synthetic oligonucleotide
  Target: SCN10A; (-) strand; PAM type: YTN; PAM sequence: TTC
tattagggaacatgagtgat

SEQ ID NO: 41932 - DNA, 20 bp, Artificial Sequence
  Description of Artificial Sequence: Synthetic oligonucleotide
  Target: SCN10A; (-) strand; PAM type: YTN; PAM sequence: CTG
ttctattagggaacatgagt

SEQ ID NO: 41933 - DNA, 20 bp, Artificial Sequence
  Description of Artificial Sequence: Synthetic oligonucleotide
  Target: SCN10A; (-) strand; PAM type: YTN; PAM sequence: CTA
cacaactgttctattaggga

SEQ ID NO: 41934 - DNA, 20 bp, Artificial Sequence
  Description of Artificial Sequence: Synthetic oligonucleotide
  Target: SCN10A; (-) strand; PAM type: YTN; PAM sequence: CTC
tacacaactgttctattagg

SEQ ID NO: 41935 - DNA, 20 bp, Artificial Sequence
  Description of Artificial Sequence: Synthetic oligonucleotide
  Target: SCN10A; (-) strand; PAM type: YTN; PAM sequence: TTA
aatctctacacaactgttct

SEQ ID NO: 41936 - DNA, 20 bp, Artificial Sequence
  Description of Artificial Sequence: Synthetic oligonucleotide
  Target: SCN10A; (-) strand; PAM type: YTN; PAM sequence: CTG
gaattaaatctctacacaac

SEQ ID NO: 41937 - DNA, 20 bp, Artificial Sequence
  Description of Artificial Sequence: Synthetic oligonucleotide
  Target: SCN10A; (-) strand; PAM type: YTN; PAM sequence: CTA
gggtctggaattaaatctct

SEQ ID NO: 41938 - DNA, 20 bp, Artificial Sequence
  Description of Artificial Sequence: Synthetic oligonucleotide
  Target: SCN10A; (-) strand; PAM type: YTN; PAM sequence: CTC
aagtctagggtctggaatta

SEQ ID NO: 41939 - DNA, 20 bp, Artificial Sequence
  Description of Artificial Sequence: Synthetic oligonucleotide
  Target: SCN10A; (-) strand; PAM type: YTN; PAM sequence: TTC
tcaagtctagggtctggaat

SEQ ID NO: 41940 - DNA, 20 bp, Artificial Sequence
  Description of Artificial Sequence: Synthetic oligonucleotide
  Target: SCN10A; (-) strand; PAM type: YTN; PAM sequence: TTC
aaaggagattctcaagtcta

SEQ ID NO: 41941 - DNA, 20 bp, Artificial Sequence
  Description of Artificial Sequence: Synthetic oligonucleotide
  Target: SCN10A; (-) strand; PAM type: YTN; PAM sequence: TTG
ttcaaaggagattctcaagt

SEQ ID NO: 41942 - DNA, 20 bp, Artificial Sequence
  Description of Artificial Sequence: Synthetic oligonucleotide
  Target: SCN10A; (-) strand; PAM type: YTN; PAM sequence: CTG
ggaggagattgttcaaagga

SEQ ID NO: 41943 - DNA, 20 bp, Artificial Sequence
  Description of Artificial Sequence: Synthetic oligonucleotide
  Target: SCN10A; (-) strand; PAM type: YTN; PAM sequence: TTG
ccatcaaagtgaggaaagac

SEQ ID NO: 41944 - DNA, 20 bp, Artificial Sequence
  Description of Artificial Sequence: Synthetic oligonucleotide
  Target: SCN10A; (-) strand; PAM type: YTN; PAM sequence: CTG
gaaaaggagatggattgcca

SEQ ID NO: 41945 - DNA, 20 bp, Artificial Sequence
  Description of Artificial Sequence: Synthetic oligonucleotide
  Target: SCN10A; (-) strand; PAM type: YTN; PAM sequence: TTC
tggaaaaggagatggattgc

SEQ ID NO: 41946 - DNA, 20 bp, Artificial Sequence
  Description of Artificial Sequence: Synthetic oligonucleotide
  Target: SCN10A; (-) strand; PAM type: YTN; PAM sequence: CTG
ttctggaaaaggagatggat

SEQ ID NO: 41947 - DNA, 20 bp, Artificial Sequence
  Description of Artificial Sequence: Synthetic oligonucleotide
  Target: SCN10A; (-) strand; PAM type: YTN; PAM sequence: TTA
aaatctgttctggaaaagga

SEQ ID NO: 41948 - DNA, 20 bp, Artificial Sequence
  Description of Artificial Sequence: Synthetic oligonucleotide
  Target: SCN10A; (-) strand; PAM type: YTN; PAM sequence: CTT
aaaatctgttctggaaaagg

SEQ ID NO: 41949 - DNA, 20 bp, Artificial Sequence
  Description of Artificial Sequence: Synthetic oligonucleotide
  Target: SCN10A; (-) strand; PAM type: YTN; PAM sequence: TTG
aaagcagggggcaggtggtg

SEQ ID NO: 41950 - DNA, 20 bp, Artificial Sequence
  Description of Artificial Sequence: Synthetic oligonucleotide
  Target: SCN10A; (-) strand; PAM type: YTN; PAM sequence: CTT
gaaagcagggggcaggtggt

SEQ ID NO: 41951 - DNA, 20 bp, Artificial Sequence
  Description of Artificial Sequence: Synthetic oligonucleotide
  Target: SCN10A; (-) strand; PAM type: YTN; PAM sequence: TTA
tggtcttgaaagcagggggc

SEQ ID NO: 41952 - DNA, 20 bp, Artificial Sequence
  Description of Artificial Sequence: Synthetic oligonucleotide
  Target: SCN10A; (-) strand; PAM type: YTN; PAM sequence: TTT
atggtcttgaaagcaggggg

SEQ ID NO: 41953 - DNA, 20 bp, Artificial Sequence
  Description of Artificial Sequence: Synthetic oligonucleotide
  Target: SCN10A; (-) strand; PAM type: YTN; PAM sequence: TTT
tatggtcttgaaagcagggg

SEQ ID NO: 41954 - DNA, 20 bp, Artificial Sequence
  Description of Artificial Sequence: Synthetic oligonucleotide
  Target: SCN10A; (-) strand; PAM type: YTN; PAM sequence: CTT
ttatggtcttgaaagcaggg

SEQ ID NO: 41955 - DNA, 20 bp, Artificial Sequence
  Description of Artificial Sequence: Synthetic oligonucleotide
  Target: SCN10A; (-) strand; PAM type: YTN; PAM sequence: TTA
cttttatggtcttgaaagca

SEQ ID NO: 41956 - DNA, 20 bp, Artificial Sequence
  Description of Artificial Sequence: Synthetic oligonucleotide
  Target: SCN10A; (-) strand; PAM type: YTN; PAM sequence: CTT
acttttatggtcttgaaagc

SEQ ID NO: 41957 - DNA, 20 bp, Artificial Sequence
  Description of Artificial Sequence: Synthetic oligonucleotide
  Target: SCN10A; (-) strand; PAM type: YTN; PAM sequence: CTC
cagcagaccttacttttatg

SEQ ID NO: 41958 - DNA, 20 bp, Artificial Sequence
  Description of Artificial Sequence: Synthetic oligonucleotide
  Target: SCN10A; (-) strand; PAM type: YTN; PAM sequence: CTC
agaccgtaagatgatggagt

SEQ ID NO: 41959 - DNA, 20 bp, Artificial Sequence
  Description of Artificial Sequence: Synthetic oligonucleotide
  Target: SCN10A; (-) strand; PAM type: YTN; PAM sequence: CTG
agaacctcagaccgtaagat

SEQ ID NO: 41960 - DNA, 20 bp, Artificial Sequence
  Description of Artificial Sequence: Synthetic oligonucleotide
  Target: SCN10A; (-) strand; PAM type: YTN; PAM sequence: CTC
ctgagaacctcagaccgtaa

SEQ ID NO: 41961 - DNA, 20 bp, Artificial Sequence
  Description of Artificial Sequence: Synthetic oligonucleotide
  Target: SCN10A; (-) strand; PAM type: YTN; PAM sequence: CTC
ctcctgagaacctcagaccg

SEQ ID NO: 41962 - DNA, 20 bp, Artificial Sequence
  Description of Artificial Sequence: Synthetic oligonucleotide
  Target: SCN10A; (-) strand; PAM type: YTN; PAM sequence: CTG
acagggaataatcactcctc

SEQ ID NO: 41963 - DNA, 20 bp, Artificial Sequence
  Description of Artificial Sequence: Synthetic oligonucleotide
  Target: SCN10A; (-) strand; PAM type: YTN; PAM sequence: CTC
aggggctgacagggaataat

SEQ ID NO: 41964 - DNA, 20 bp, Artificial Sequence
  Description of Artificial Sequence: Synthetic oligonucleotide
  Target: SCN10A; (-) strand; PAM type: YTN; PAM sequence: CTA
gaacctcaggggctgacagg

SEQ ID NO: 41965 - DNA, 20 bp, Artificial Sequence
  Description of Artificial Sequence: Synthetic oligonucleotide
  Target: SCN10A; (-) strand; PAM type: YTN; PAM sequence: CTG
tgtgcacagcccatggctag

SEQ ID NO: 41966 - DNA, 20 bp, Artificial Sequence
  Description of Artificial Sequence: Synthetic oligonucleotide
  Target: SCN10A; (-) strand; PAM type: YTN; PAM sequence: CTA
ctgtgtgcacagcccatggc

SEQ ID NO: 41967 - DNA, 20 bp, Artificial Sequence
  Description of Artificial Sequence: Synthetic oligonucleotide
  Target: SCN10A; (-) strand; PAM type: YTN; PAM sequence: TTC
aggcacctactgtgtgcaca

SEQ ID NO: 41968 - DNA, 20 bp, Artificial Sequence
  Description of Artificial Sequence: Synthetic oligonucleotide
  Target: SCN10A; (-) strand; PAM type: YTN; PAM sequence: TTT
caggcacctactgtgtgcac

SEQ ID NO: 41969 - DNA, 20 bp, Artificial Sequence
  Description of Artificial Sequence: Synthetic oligonucleotide
  Target: SCN10A; (-) strand; PAM type: YTN; PAM sequence: TTT
tcaggcacctactgtgtgca

SEQ ID NO: 41970 - DNA, 20 bp, Artificial Sequence
  Description of Artificial Sequence: Synthetic oligonucleotide
  Target: SCN10A; (-) strand; PAM type: YTN; PAM sequence: CTC
acacgaagtgttttcaggca

SEQ ID NO: 41971 - DNA, 20 bp, Artificial Sequence
  Description of Artificial Sequence: Synthetic oligonucleotide
  Target: SCN10A; (-) strand; PAM type: YTN; PAM sequence: CTC
catgctcacacgaagtgttt

SEQ ID NO: 41972 - DNA, 20 bp, Artificial Sequence
  Description of Artificial Sequence: Synthetic oligonucleotide
  Target: SCN10A; (-) strand; PAM type: YTN; PAM sequence: TTC
tccatgctcacacgaagtgt

SEQ ID NO: 41973 - DNA, 20 bp, Artificial Sequence
  Description of Artificial Sequence: Synthetic oligonucleotide
  Target: SCN10A; (-) strand; PAM type: YTN; PAM sequence: CTT
ctccatgctcacacgaagtg

SEQ ID NO: 41974 - DNA, 20 bp, Artificial Sequence
  Description of Artificial Sequence: Synthetic oligonucleotide
  Target: SCN10A; (-) strand; PAM type: YTN; PAM sequence: TTG
gccttctccatgctcacacg

SEQ ID NO: 41975 - DNA, 20 bp, Artificial Sequence
  Description of Artificial Sequence: Synthetic oligonucleotide
  Target: SCN10A; (-) strand; PAM type: YTN; PAM sequence: CTT
ggccttctccatgctcacac

SEQ ID NO: 41976 - DNA, 20 bp, Artificial Sequence
  Description of Artificial Sequence: Synthetic oligonucleotide
  Target: SCN10A; (-) strand; PAM type: YTN; PAM sequence: CTC
ttggccttctccatgctcac

SEQ ID NO: 41977 - DNA, 20 bp, Artificial Sequence
  Description of Artificial Sequence: Synthetic oligonucleotide
  Target: SCN10A; (-) strand; PAM type: YTN; PAM sequence: TTC
tcttggccttctccatgctc

SEQ ID NO: 41978 - DNA, 20 bp, Artificial Sequence
  Description of Artificial Sequence: Synthetic oligonucleotide
  Target: SCN10A; (-) strand; PAM type: YTN; PAM sequence: CTC
agtgaaatgaagaggttctc

SEQ ID NO: 41979 - DNA, 20 bp, Artificial Sequence
  Description of Artificial Sequence: Synthetic oligonucleotide
  Target: SCN10A; (-) strand; PAM type: YTN; PAM sequence: CTC
tcagtgaaatgaagaggttc

SEQ ID NO: 41980 - DNA, 20 bp, Artificial Sequence
  Description of Artificial Sequence: Synthetic oligonucleotide
  Target: SCN10A; (-) strand; PAM type: YTN; PAM sequence: CTC
tctcagtgaaatgaagaggt

SEQ ID NO: 41981 - DNA, 20 bp, Artificial Sequence
  Description of Artificial Sequence: Synthetic oligonucleotide
  Target: SCN10A; (-) strand; PAM type: YTN; PAM sequence: CTG
ctctctcagtgaaatgaaga

SEQ ID NO: 41982 - DNA, 20 bp, Artificial Sequence
  Description of Artificial Sequence: Synthetic oligonucleotide
  Target: SCN10A; (-) strand; PAM type: YTN; PAM sequence: TTG
ggctgctctctcagtgaaat

SEQ ID NO: 41983 - DNA, 20 bp, Artificial Sequence
  Description of Artificial Sequence: Synthetic oligonucleotide
  Target: SCN10A; (-) strand; PAM type: YTN; PAM sequence: CTT
gggctgctctctcagtgaaa

SEQ ID NO: 41984 - DNA, 20 bp, Artificial Sequence
  Description of Artificial Sequence: Synthetic oligonucleotide
  Target: SCN10A; (-) strand; PAM type: YTN; PAM sequence: TTA
aatgccttgggctgctctct

SEQ ID NO: 41985 - DNA, 20 bp, Artificial Sequence
  Description of Artificial Sequence: Synthetic oligonucleotide
  Target: SCN10A; (-) strand; PAM type: YTN; PAM sequence: TTT
aaatgccttgggctgctctc

SEQ ID NO: 41986 - DNA, 20 bp, Artificial Sequence
  Description of Artificial Sequence: Synthetic oligonucleotide
  Target: SCN10A; (-) strand; PAM type: YTN; PAM sequence: TTT
taaatgccttgggctgctct

SEQ ID NO: 41987 - DNA, 20 bp, Artificial Sequence
  Description of Artificial Sequence: Synthetic oligonucleotide
  Target: SCN10A; (-) strand; PAM type: YTN; PAM sequence: TTC
caagagtagcaagttttaaa

SEQ ID NO: 41988 - DNA, 20 bp, Artificial Sequence
  Description of Artificial Sequence: Synthetic oligonucleotide
  Target: SCN10A; (-) strand; PAM type: YTN; PAM sequence: TTT
ccaagagtagcaagttttaa

SEQ ID NO: 41989 - DNA, 20 bp, Artificial Sequence
  Description of Artificial Sequence: Synthetic oligonucleotide
  Target: SCN10A; (-) strand; PAM type: YTN; PAM sequence: CTT
tccaagagtagcaagtttta

SEQ ID NO: 41990 - DNA, 20 bp, Artificial Sequence
  Description of Artificial Sequence: Synthetic oligonucleotide
  Target: SCN10A; (-) strand; PAM type: YTN; PAM sequence: TTG
cagctttccaagagtagcaa

SEQ ID NO: 41991 - DNA, 20 bp, Artificial Sequence
  Description of Artificial Sequence: Synthetic oligonucleotide
  Target: SCN10A; (-) strand; PAM type: YTN; PAM sequence: TTT
gcagctttccaagagtagca

SEQ ID NO: 41992 - DNA, 20 bp, Artificial Sequence
  Description of Artificial Sequence: Synthetic oligonucleotide
  Target: SCN10A; (-) strand; PAM type: YTN; PAM sequence: CTG
tatttgcagctttccaagag

SEQ ID NO: 41993 - DNA, 20 bp, Artificial Sequence
  Description of Artificial Sequence: Synthetic oligonucleotide
  Target: SCN10A; (-) strand; PAM type: YTN; PAM sequence: TTA
gaagaaccctgtatttgcag

SEQ ID NO: 41994 - DNA, 20 bp, Artificial Sequence
  Description of Artificial Sequence: Synthetic oligonucleotide
  Target: SCN10A; (-) strand; PAM type: YTN; PAM sequence: TTA
tgttagaagaaccctgtatt

SEQ ID NO: 41995 - DNA, 20 bp, Artificial Sequence
  Description of Artificial Sequence: Synthetic oligonucleotide
  Target: SCN10A; (-) strand; PAM type: YTN; PAM sequence: TTT
atgttagaagaaccctgtat

SEQ ID NO: 41996 - DNA, 20 bp, Artificial Sequence
  Description of Artificial Sequence: Synthetic oligonucleotide
  Target: SCN10A; (-) strand; PAM type: YTN; PAM sequence: TTG
aaatacgtgtttatgttaga

SEQ ID NO: 41997 - DNA, 20 bp, Artificial Sequence
  Description of Artificial Sequence: Synthetic oligonucleotide
  Target: SCN10A; (-) strand; PAM type: YTN; PAM sequence: TTT
gaaatacgtgtttatgttag

SEQ ID NO: 41998 - DNA, 20 bp, Artificial Sequence
  Description of Artificial Sequence: Synthetic oligonucleotide
  Target: SCN10A; (-) strand; PAM type: YTN; PAM sequence: TTT
tgaaatacgtgtttatgtta

SEQ ID NO: 41999 - DNA, 20 bp, Artificial Sequence
  Description of Artificial Sequence: Synthetic oligonucleotide
  Target: SCN10A; (-) strand; PAM type: YTN; PAM sequence: TTT
ttgaaatacgtgtttatgtt

SEQ ID NO: 42000 - DNA, 20 bp, Artificial Sequence
  Description of Artificial Sequence: Synthetic oligonucleotide
  Target: SCN10A; (-) strand; PAM type: YTN; PAM sequence: CTT
tttgaaatacgtgtttatgt

SEQ ID NO: 42001 - DNA, 20 bp, Artificial Sequence
  Description of Artificial Sequence: Synthetic oligonucleotide
  Target: SCN10A; (-) strand; PAM type: YTN; PAM sequence: CTA
aaaccaaggaaataaccaac

SEQ ID NO: 42002 - DNA, 20 bp, Artificial Sequence
  Description of Artificial Sequence: Synthetic oligonucleotide
  Target: SCN10A; (-) strand; PAM type: YTN; PAM sequence: TTC
taaaaccaaggaaataacca

SEQ ID NO: 42003 - DNA, 20 bp, Artificial Sequence
  Description of Artificial Sequence: Synthetic oligonucleotide
  Target: SCN10A; (-) strand; PAM type: YTN; PAM sequence: CTT
ctaaaaccaaggaaataacc

SEQ ID NO: 42004 - DNA, 20 bp, Artificial Sequence
  Description of Artificial Sequence: Synthetic oligonucleotide
  Target: SCN10A; (-) strand; PAM type: YTN; PAM sequence: CTC
ttctaaaaccaaggaaataa

SEQ ID NO: 42005 - DNA, 20 bp, Artificial Sequence
  Description of Artificial Sequence: Synthetic oligonucleotide
  Target: SCN10A; (-) strand; PAM type: YTN; PAM sequence: TTG
ggatgctcttctaaaaccaa

SEQ ID NO: 42006 - DNA, 20 bp, Artificial Sequence
  Description of Artificial Sequence: Synthetic oligonucleotide
  Target: SCN10A; (-) strand; PAM type: YTN; PAM sequence: TTT
gggatgctcttctaaaacca

SEQ ID NO: 42007 - DNA, 20 bp, Artificial Sequence
  Description of Artificial Sequence: Synthetic oligonucleotide
  Target: SCN10A; (-) strand; PAM type: YTN; PAM sequence: CTT
tgggatgctcttctaaaacc

SEQ ID NO: 42008 - DNA, 20 bp, Artificial Sequence
  Description of Artificial Sequence: Synthetic oligonucleotide
  Target: SCN10A; (-) strand; PAM type: YTN; PAM sequence: TTG
ggggtctttgggatgctctt

SEQ ID NO: 42009 - DNA, 20 bp, Artificial Sequence
  Description of Artificial Sequence: Synthetic oligonucleotide
  Target: SCN10A; (-) strand; PAM type: YTN; PAM sequence: TTT
gggggtctttgggatgctct

SEQ ID NO: 42010 - DNA, 20 bp, Artificial Sequence
  Description of Artificial Sequence: Synthetic oligonucleotide
  Target: SCN10A; (-) strand; PAM type: YTN; PAM sequence: CTG
tttgggggtctttgggatgc

SEQ ID NO: 42011 - DNA, 20 bp, Artificial Sequence
  Description of Artificial Sequence: Synthetic oligonucleotide
  Target: SCN10A; (-) strand; PAM type: YTN; PAM sequence: CTC
tgtttgggggtctttgggat

SEQ ID NO: 42012 - DNA, 20 bp, Artificial Sequence
  Description of Artificial Sequence: Synthetic oligonucleotide
  Target: SCN10A; (-) strand; PAM type: YTN; PAM sequence: TTG
cgagtaagtgggcagccacg

SEQ ID NO: 42013 - DNA, 20 bp, Artificial Sequence
  Description of Artificial Sequence: Synthetic oligonucleotide
  Target: SCN10A; (-) strand; PAM type: YTN; PAM sequence: CTC
cattgcgagtaagtgggcag

SEQ ID NO: 42014 - DNA, 20 bp, Artificial Sequence
  Description of Artificial Sequence: Synthetic oligonucleotide
  Target: SCN10A; (-) strand; PAM type: YTN; PAM sequence: CTC
tccattgcgagtaagtgggc

SEQ ID NO: 42015 - DNA, 20 bp, Artificial Sequence
  Description of Artificial Sequence: Synthetic oligonucleotide
  Target: SCN10A; (-) strand; PAM type: YTN; PAM sequence: TTC
tctccattgcgagtaagtgg

SEQ ID NO: 42016 - DNA, 20 bp, Artificial Sequence
  Description of Artificial Sequence: Synthetic oligonucleotide
  Target: SCN10A; (-) strand; PAM type: YTN; PAM sequence: TTG
tggtggttctctccattgcg

SEQ ID NO: 42017 - DNA, 20 bp, Artificial Sequence
  Description of Artificial Sequence: Synthetic oligonucleotide
  Target: SCN10A; (-) strand; PAM type: YTN; PAM sequence: TTC
attgtggtggttctctccat

SEQ ID NO: 42018 - DNA, 20 bp, Artificial Sequence
  Description of Artificial Sequence: Synthetic oligonucleotide
  Target: SCN10A; (-) strand; PAM type: YTN; PAM sequence: CTT
cattgtggtggttctctcca

SEQ ID NO: 42019 - DNA, 20 bp, Artificial Sequence
  Description of Artificial Sequence: Synthetic oligonucleotide
  Target: SCN10A; (-) strand; PAM type: YTN; PAM sequence: TTG
acttcattgtggtggttctc

SEQ ID NO: 42020 - DNA, 20 bp, Artificial Sequence
  Description of Artificial Sequence: Synthetic oligonucleotide
  Target: SCN10A; (-) strand; PAM type: YTN; PAM sequence: TTT
gacttcattgtggtggttct

SEQ ID NO: 42021 - DNA, 20 bp, Artificial Sequence
  Description of Artificial Sequence: Synthetic oligonucleotide
  Target: SCN10A; (-) strand; PAM type: YTN; PAM sequence: CTG
gaatgtgtttgacttcattg

SEQ ID NO: 42022 - DNA, 20 bp, Artificial Sequence
  Description of Artificial Sequence: Synthetic oligonucleotide
  Target: SCN10A; (-) strand; PAM type: YTN; PAM sequence: TTC
acaaatggctggaatgtgtt

SEQ ID NO: 42023 - DNA, 20 bp, Artificial Sequence
  Description of Artificial Sequence: Synthetic oligonucleotide
  Target: SCN10A; (-) strand; PAM type: YTN; PAM sequence: CTT
cacaaatggctggaatgtgt

SEQ ID NO: 42024 - DNA, 20 bp, Artificial Sequence
  Description of Artificial Sequence: Synthetic oligonucleotide
  Target: SCN10A; (-) strand; PAM type: YTN; PAM sequence: CTA
cttcacaaatggctggaatg

SEQ ID NO: 42025 - DNA, 20 bp, Artificial Sequence
  Description of Artificial Sequence: Synthetic oligonucleotide
  Target: SCN10A; (-) strand; PAM type: YTN; PAM sequence: TTG
aggcagtactacttcacaaa

SEQ ID NO: 42026 - DNA, 20 bp, Artificial Sequence
  Description of Artificial Sequence: Synthetic oligonucleotide
  Target: SCN10A; (-) strand; PAM type: YTN; PAM sequence: TTT
gaggcagtactacttcacaa

SEQ ID NO: 42027 - DNA, 20 bp, Artificial Sequence
  Description of Artificial Sequence: Synthetic oligonucleotide
  Target: SCN10A; (-) strand; PAM type: YTN; PAM sequence: CTT
tgaggcagtactacttcaca

SEQ ID NO: 42028 - DNA, 20 bp, Artificial Sequence
  Description of Artificial Sequence: Synthetic oligonucleotide
  Target: SCN10A; (-) strand; PAM type: YTN; PAM sequence: TTC
gctttgaggcagtactactt

SEQ ID NO: 42029 - DNA, 20 bp, Artificial Sequence
  Description of Artificial Sequence: Synthetic oligonucleotide
  Target: SCN10A; (-) strand; PAM type: YTN; PAM sequence: TTC
acaggcgaatgtgtcatgaa

SEQ ID NO: 42030 - DNA, 20 bp, Artificial Sequence
  Description of Artificial Sequence: Synthetic oligonucleotide
  Target: SCN10A; (-) strand; PAM type: YTN; PAM sequence: CTT
cacaggcgaatgtgtcatga

SEQ ID NO: 42031 - DNA, 20 bp, Artificial Sequence
  Description of Artificial Sequence: Synthetic oligonucleotide
  Target: SCN10A; (-) strand; PAM type: YTN; PAM sequence: TTG
tggccgtcttcacaggcgaa

SEQ ID NO: 42032 - DNA, 20 bp, Artificial Sequence
  Description of Artificial Sequence: Synthetic oligonucleotide
  Target: SCN10A; (-) strand; PAM type: YTN; PAM sequence: TTT
gtggccgtcttcacaggcga

SEQ ID NO: 42033 - DNA, 20 bp, Artificial Sequence
  Description of Artificial Sequence: Synthetic oligonucleotide
  Target: SCN10A; (-) strand; PAM type: YTN; PAM sequence: CTT
tgtggccgtcttcacaggcg

SEQ ID NO: 42034 - DNA, 20 bp, Artificial Sequence
  Description of Artificial Sequence: Synthetic oligonucleotide
  Target: SCN10A; (-) strand; PAM type: YTN; PAM sequence: TTC
tttgtggccgtcttcacagg

SEQ ID NO: 42035 - DNA, 20 bp, Artificial Sequence
  Description of Artificial Sequence: Synthetic oligonucleotide
  Target: SCN10A; (-) strand; PAM type: YTN; PAM sequence: CTG
ggcaaaatcaaccagttctt

SEQ ID NO: 42036 - DNA, 20 bp, Artificial Sequence
  Description of Artificial Sequence: Synthetic oligonucleotide
  Target: SCN10A; (-) strand; PAM type: YTN; PAM sequence: TTC
tgggcaaaatcaaccagttc

SEQ ID NO: 42037 - DNA, 20 bp, Artificial Sequence
  Description of Artificial Sequence: Synthetic oligonucleotide
  Target: SCN10A; (-) strand; PAM type: YTN; PAM sequence: CTG
atgaccaaagtgaagaaaag

SEQ ID NO: 42038 - DNA, 20 bp, Artificial Sequence
  Description of Artificial Sequence: Synthetic oligonucleotide
  Target: SCN10A; (-) strand; PAM type: YTN; PAM sequence: CTC
aacatgatcaccatgatggt

SEQ ID NO: 42039 - DNA, 20 bp, Artificial Sequence
  Description of Artificial Sequence: Synthetic oligonucleotide
  Target: SCN10A; (-) strand; PAM type: YTN; PAM sequence: CTG
cctcaacatgatcaccatga

SEQ ID NO: 42040 - DNA, 20 bp, Artificial Sequence
  Description of Artificial Sequence: Synthetic oligonucleotide
  Target: SCN10A; (-) strand; PAM type: YTN; PAM sequence: CTC
atctgcctcaacatgatcac

SEQ ID NO: 42041 - DNA, 20 bp, Artificial Sequence
  Description of Artificial Sequence: Synthetic oligonucleotide
  Target: SCN10A; (-) strand; PAM type: YTN; PAM sequence: TTG
acatcaccatcatggtcctc

SEQ ID NO: 42042 - DNA, 20 bp, Artificial Sequence
  Description of Artificial Sequence: Synthetic oligonucleotide
  Target: SCN10A; (-) strand; PAM type: YTN; PAM sequence: TTT
gacatcaccatcatggtcct

SEQ ID NO: 42043 - DNA, 20 bp, Artificial Sequence
  Description of Artificial Sequence: Synthetic oligonucleotide
  Target: SCN10A; (-) strand; PAM type: YTN; PAM sequence: TTT
tgacatcaccatcatggtcc

SEQ ID NO: 42044 - DNA, 20 bp, Artificial Sequence
  Description of Artificial Sequence: Synthetic oligonucleotide
  Target: SCN10A; (-) strand; PAM type: YTN; PAM sequence: CTT
ttgacatcaccatcatggtc

SEQ ID NO: 42045 - DNA, 20 bp, Artificial Sequence
  Description of Artificial Sequence: Synthetic oligonucleotide
  Target: SCN10A; (-) strand; PAM type: YTN; PAM sequence: TTG
acatcgtgaccagacaagct

SEQ ID NO: 42046 - DNA, 20 bp, Artificial Sequence
  Description of Artificial Sequence: Synthetic oligonucleotide
  Target: SCN10A; (-) strand; PAM type: YTN; PAM sequence: TTT
gacatcgtgaccagacaagc

SEQ ID NO: 42047 - DNA, 20 bp, Artificial Sequence
  Description of Artificial Sequence: Synthetic oligonucleotide
  Target: SCN10A; (-) strand; PAM type: YTN; PAM sequence: CTT
tgacatcgtgaccagacaag

SEQ ID NO: 42048 - DNA, 20 bp, Artificial Sequence
  Description of Artificial Sequence: Synthetic oligonucleotide
  Target: SCN10A; (-) strand; PAM type: YTN; PAM sequence: TTG
tctttgacatcgtgaccaga

SEQ ID NO: 42049 - DNA, 20 bp, Artificial Sequence
  Description of Artificial Sequence: Synthetic oligonucleotide
  Target: SCN10A; (-) strand; PAM type: YTN; PAM sequence: TTT
gtctttgacatcgtgaccag

SEQ ID NO: 42050 - DNA, 20 bp, Artificial Sequence
  Description of Artificial Sequence: Synthetic oligonucleotide
  Target: SCN10A; (-) strand; PAM type: YTN; PAM sequence: TTT
tgtctttgacatcgtgacca

SEQ ID NO: 42051 - DNA, 20 bp, Artificial Sequence
  Description of Artificial Sequence: Synthetic oligonucleotide
  Target: SCN10A; (-) strand; PAM type: YTN; PAM sequence: TTC
cagggttttgtctttgacat

SEQ ID NO: 42052 - DNA, 20 bp, Artificial Sequence
  Description of Artificial Sequence: Synthetic oligonucleotide
  Target: SCN10A; (-) strand; PAM type: YTN; PAM sequence: CTC
agaacaagttccagggtttt

SEQ ID NO: 42053 - DNA, 20 bp, Artificial Sequence
  Description of Artificial Sequence: Synthetic oligonucleotide
  Target: SCN10A; (-) strand; PAM type: YTN; PAM sequence: TTC
tcagaacaagttccagggtt

SEQ ID NO: 42054 - DNA, 20 bp, Artificial Sequence
  Description of Artificial Sequence: Synthetic oligonucleotide
  Target: SCN10A; (-) strand; PAM type: YTN; PAM sequence: TTT
ctcagaacaagttccagggt

SEQ ID NO: 42055 - DNA, 20 bp, Artificial Sequence
  Description of Artificial Sequence: Synthetic oligonucleotide
  Target: SCN10A; (-) strand; PAM type: YTN; PAM sequence: TTT
tctcagaacaagttccaggg

SEQ ID NO: 42056 - DNA, 20 bp, Artificial Sequence
  Description of Artificial Sequence: Synthetic oligonucleotide
  Target: SCN10A; (-) strand; PAM type: YTN; PAM sequence: TTG
ttttctcagaacaagttcca

SEQ ID NO: 42057 - DNA, 20 bp, Artificial Sequence
  Description of Artificial Sequence: Synthetic oligonucleotide
  Target: SCN10A; (-) strand; PAM type: YTN; PAM sequence: CTT
gttttctcagaacaagttcc

SEQ ID NO: 42058 - DNA, 20 bp, Artificial Sequence
  Description of Artificial Sequence: Synthetic oligonucleotide
  Target: SCN10A; (-) strand; PAM type: YTN; PAM sequence: CTC
ttgttttctcagaacaagtt

SEQ ID NO: 42059 - DNA, 20 bp, Artificial Sequence
  Description of Artificial Sequence: Synthetic oligonucleotide
  Target: SCN10A; (-) strand; PAM type: YTN; PAM sequence: CTA
tctcttgttttctcagaaca

SEQ ID NO: 42060 - DNA, 20 bp, Artificial Sequence
  Description of Artificial Sequence: Synthetic oligonucleotide
  Target: SCN10A; (-) strand; PAM type: YTN; PAM sequence: CTG
atgccactatctcttgtttt

SEQ ID NO: 42061 - DNA, 20 bp, Artificial Sequence
  Description of Artificial Sequence: Synthetic oligonucleotide
  Target: SCN10A; (-) strand; PAM type: YTN; PAM sequence: CTG
gcccaaaggccctgatgcca

SEQ ID NO: 42062 - DNA, 20 bp, Artificial Sequence
  Description of Artificial Sequence: Synthetic oligonucleotide
  Target: SCN10A; (-) strand; PAM type: YTN; PAM sequence: TTG
tgctggcccaaaggccctga

SEQ ID NO: 42063 - DNA, 20 bp, Artificial Sequence
  Description of Artificial Sequence: Synthetic oligonucleotide
  Target: SCN10A; (-) strand; PAM type: YTN; PAM sequence: TTT
gtgctggcccaaaggccctg

SEQ ID NO: 42064 - DNA, 20 bp, Artificial Sequence
  Description of Artificial Sequence: Synthetic oligonucleotide
  Target: SCN10A; (-) strand; PAM type: YTN; PAM sequence: CTG
gtttgtgctggcccaaaggc

SEQ ID NO: 42065 - DNA, 20 bp, Artificial Sequence
  Description of Artificial Sequence: Synthetic oligonucleotide
  Target: SCN10A; (-) strand; PAM type: YTN; PAM sequence: CTA
cagataacacagatgcctgg

SEQ ID NO: 42066 - DNA, 20 bp, Artificial Sequence
  Description of Artificial Sequence: Synthetic oligonucleotide
  Target: SCN10A; (-) strand; PAM type: YTN; PAM sequence: CTC
atctacagataacacagatg

SEQ ID NO: 42067 - DNA, 20 bp, Artificial Sequence
  Description of Artificial Sequence: Synthetic oligonucleotide
  Target: SCN10A; (-) strand; PAM type: YTN; PAM sequence: TTA
agatgtggagtgtgatggag

SEQ ID NO: 42068 - DNA, 20 bp, Artificial Sequence
  Description of Artificial Sequence: Synthetic oligonucleotide
  Target: SCN10A; (-) strand; PAM type: YTN; PAM sequence: CTG
ttaagatgtggagtgtgatg

SEQ ID NO: 42069 - DNA, 20 bp, Artificial Sequence
  Description of Artificial Sequence: Synthetic oligonucleotide
  Target: SCN10A; (-) strand; PAM type: YTN; PAM sequence: TTC
tgttaagatgtggagtgtga

SEQ ID NO: 42070 - DNA, 20 bp, Artificial Sequence
  Description of Artificial Sequence: Synthetic oligonucleotide
  Target: SCN10A; (-) strand; PAM type: YTN; PAM sequence: CTT
ctgttaagatgtggagtgtg

SEQ ID NO: 42071 - DNA, 20 bp, Artificial Sequence
  Description of Artificial Sequence: Synthetic oligonucleotide
  Target: SCN10A; (-) strand; PAM type: YTN; PAM sequence: TTC
gcttctgttaagatgtggag

SEQ ID NO: 42072 - DNA, 20 bp, Artificial Sequence
  Description of Artificial Sequence: Synthetic oligonucleotide
  Target: SCN10A; (-) strand; PAM type: YTN; PAM sequence: TTT
cgcttctgttaagatgtgga

SEQ ID NO: 42073 - DNA, 20 bp, Artificial Sequence
  Description of Artificial Sequence: Synthetic oligonucleotide
  Target: SCN10A; (-) strand; PAM type: YTN; PAM sequence: TTG
gaagaggtaaggatagtatt

SEQ ID NO: 42074 - DNA, 20 bp, Artificial Sequence
  Description of Artificial Sequence: Synthetic oligonucleotide
  Target: SCN10A; (-) strand; PAM type: YTN; PAM sequence: TTT
ggaagaggtaaggatagtat

SEQ ID NO: 42075 - DNA, 20 bp, Artificial Sequence
  Description of Artificial Sequence: Synthetic oligonucleotide
  Target: SCN10A; (-) strand; PAM type: YTN; PAM sequence: TTT
tggaagaggtaaggatagta

SEQ ID NO: 42076 - DNA, 20 bp, Artificial Sequence
  Description of Artificial Sequence: Synthetic oligonucleotide
  Target: SCN10A; (-) strand; PAM type: YTN; PAM sequence: CTA
aaagtgaaattttggaagag

SEQ ID NO: 42077 - DNA, 20 bp, Artificial Sequence
  Description of Artificial Sequence: Synthetic oligonucleotide
  Target: SCN10A; (-) strand; PAM type: YTN; PAM sequence: CTG
gggcaatgaggtagagtcaa

SEQ ID NO: 42078 - DNA, 20 bp, Artificial Sequence
  Description of Artificial Sequence: Synthetic oligonucleotide
  Target: SCN10A; (-) strand; PAM type: YTN; PAM sequence: TTG
aactggggcaatgaggtaga

SEQ ID NO: 42079 - DNA, 20 bp, Artificial Sequence
  Description of Artificial Sequence: Synthetic oligonucleotide
  Target: SCN10A; (-) strand; PAM type: YTN; PAM sequence: CTT
gaactggggcaatgaggtag

SEQ ID NO: 42080 - DNA, 20 bp, Artificial Sequence
  Description of Artificial Sequence: Synthetic oligonucleotide
  Target: SCN10A; (-) strand; PAM type: YTN; PAM sequence: TTA
aggacttgaactggggcaat

SEQ ID NO: 42081 - DNA, 20 bp, Artificial Sequence
  Description of Artificial Sequence: Synthetic oligonucleotide
  Target: SCN10A; (-) strand; PAM type: YTN; PAM sequence: CTG
gtggcatcaaagggccagga

SEQ ID NO: 42082 - DNA, 20 bp, Artificial Sequence
  Description of Artificial Sequence: Synthetic oligonucleotide
  Target: SCN10A; (-) strand; PAM type: YTN; PAM sequence: TTG
tgaatagaggcaagggcaca

SEQ ID NO: 42083 - DNA, 20 bp, Artificial Sequence
  Description of Artificial Sequence: Synthetic oligonucleotide
  Target: SCN10A; (-) strand; PAM type: YTN; PAM sequence: TTA
gacagccaagagaggagata

SEQ ID NO: 42084 - DNA, 20 bp, Artificial Sequence
  Description of Artificial Sequence: Synthetic oligonucleotide
  Target: SCN10A; (-) strand; PAM type: YTN; PAM sequence: TTT
agacagccaagagaggagat

SEQ ID NO: 42085 - DNA, 20 bp, Artificial Sequence
  Description of Artificial Sequence: Synthetic oligonucleotide
  Target: SCN10A; (-) strand; PAM type: YTN; PAM sequence: TTG
gaatttagacagccaagaga

SEQ ID NO: 42086 - DNA, 20 bp, Artificial Sequence
  Description of Artificial Sequence: Synthetic oligonucleotide
  Target: SCN10A; (-) strand; PAM type: YTN; PAM sequence: CTG
ttggaatttagacagccaag

SEQ ID NO: 42087 - DNA, 20 bp, Artificial Sequence
  Description of Artificial Sequence: Synthetic oligonucleotide
  Target: SCN10A; (-) strand; PAM type: YTN; PAM sequence: CTC
aagactgttggaatttagac

SEQ ID NO: 42088 - DNA, 20 bp, Artificial Sequence
  Description of Artificial Sequence: Synthetic oligonucleotide
  Target: SCN10A; (-) strand; PAM type: YTN; PAM sequence: TTA
ctcaagactgttggaattta

SEQ ID NO: 42089 - DNA, 20 bp, Artificial Sequence
  Description of Artificial Sequence: Synthetic oligonucleotide
  Target: SCN10A; (-) strand; PAM type: YTN; PAM sequence: TTA
aaagagatggattactcaag

SEQ ID NO: 42090 - DNA, 20 bp, Artificial Sequence
  Description of Artificial Sequence: Synthetic oligonucleotide
  Target: SCN10A; (-) strand; PAM type: YTN; PAM sequence: CTT
aaaagagatggattactcaa

SEQ ID NO: 42091 - DNA, 20 bp, Artificial Sequence
  Description of Artificial Sequence: Synthetic oligonucleotide
  Target: SCN10A; (-) strand; PAM type: YTN; PAM sequence: CTC
catgcagtaagtggagctta

SEQ ID NO: 42092 - DNA, 20 bp, Artificial Sequence
  Description of Artificial Sequence: Synthetic oligonucleotide
  Target: SCN10A; (-) strand; PAM type: YTN; PAM sequence: CTA
agggacactccatgcagtaa

SEQ ID NO: 42093 - DNA, 20 bp, Artificial Sequence
  Description of Artificial Sequence: Synthetic oligonucleotide
  Target: SCN10A; (-) strand; PAM type: YTN; PAM sequence: TTG
tcacgtgactaagggacact

SEQ ID NO: 42094 - DNA, 20 bp, Artificial Sequence
  Description of Artificial Sequence: Synthetic oligonucleotide
  Target: SCN10A; (-) strand; PAM type: YTN; PAM sequence: CTG
aaaagtgggatccccaaagg

SEQ ID NO: 42095 - DNA, 20 bp, Artificial Sequence
  Description of Artificial Sequence: Synthetic oligonucleotide
  Target: SCN10A; (-) strand; PAM type: YTN; PAM sequence: CTG
actgaaaagtgggatcccca

SEQ ID NO: 42096 - DNA, 20 bp, Artificial Sequence
  Description of Artificial Sequence: Synthetic oligonucleotide
  Target: SCN10A; (-) strand; PAM type: YTN; PAM sequence: CTC
gaggctgactgaaaagtggg

SEQ ID NO: 42097 - DNA, 20 bp, Artificial Sequence
  Description of Artificial Sequence: Synthetic oligonucleotide
  Target: SCN10A; (-) strand; PAM type: YTN; PAM sequence: CTA
gaactcgaggctgactgaaa

SEQ ID NO: 42098 - DNA, 20 bp, Artificial Sequence
  Description of Artificial Sequence: Synthetic oligonucleotide
  Target: SCN10A; (-) strand; PAM type: YTN; PAM sequence: CTA
gtagagaagacgcatataca

SEQ ID NO: 42099 - DNA, 20 bp, Artificial Sequence
  Description of Artificial Sequence: Synthetic oligonucleotide
  Target: SCN10A; (-) strand; PAM type: YTN; PAM sequence: TTG
tctagtagagaagacgcata

SEQ ID NO: 42100 - DNA, 20 bp, Artificial Sequence
  Description of Artificial Sequence: Synthetic oligonucleotide
  Target: SCN10A; (-) strand; PAM type: YTN; PAM sequence: CTC
attgtctagtagagaagacg

SEQ ID NO: 42101 - DNA, 20 bp, Artificial Sequence
  Description of Artificial Sequence: Synthetic oligonucleotide
  Target: SCN10A; (-) strand; PAM type: YTN; PAM sequence: CTC
aaacagctcattgtctagta

SEQ ID NO: 42102 - DNA, 20 bp, Artificial Sequence
  Description of Artificial Sequence: Synthetic oligonucleotide
  Target: SCN10A; (-) strand; PAM type: YTN; PAM sequence: TTG
tcctcaaacagctcattgtc

SEQ ID NO: 42103 - DNA, 20 bp, Artificial Sequence
  Description of Artificial Sequence: Synthetic oligonucleotide
  Target: SCN10A; (-) strand; PAM type: YTN; PAM sequence: CTT
gtcctcaaacagctcattgt

SEQ ID NO: 42104 - DNA, 20 bp, Artificial Sequence
  Description of Artificial Sequence: Synthetic oligonucleotide
  Target: SCN10A; (-) strand; PAM type: YTN; PAM sequence: TTA
aggaaggtatagcccttgtc

SEQ ID NO: 42105 - DNA, 20 bp, Artificial Sequence
  Description of Artificial Sequence: Synthetic oligonucleotide
  Target: SCN10A; (-) strand; PAM type: YTN; PAM sequence: CTG
cagggaaacaaagttaagga

SEQ ID NO: 42106 - DNA, 20 bp, Artificial Sequence
  Description of Artificial Sequence: Synthetic oligonucleotide
  Target: SCN10A; (-) strand; PAM type: YTN; PAM sequence: TTG
caatgtgcagggcactgcag

SEQ ID NO: 42107 - DNA, 20 bp, Artificial Sequence
  Description of Artificial Sequence: Synthetic oligonucleotide
  Target: SCN10A; (-) strand; PAM type: YTN; PAM sequence: CTT
gcaatgtgcagggcactgca

SEQ ID NO: 42108 - DNA, 20 bp, Artificial Sequence
  Description of Artificial Sequence: Synthetic oligonucleotide
  Target: SCN10A; (-) strand; PAM type: YTN; PAM sequence: CTC
ttgcaatgtgcagggcactg

SEQ ID NO: 42109 - DNA, 20 bp, Artificial Sequence
  Description of Artificial Sequence: Synthetic oligonucleotide
  Target: SCN10A; (-) strand; PAM type: YTN; PAM sequence: TTG
aactcttgcaatgtgcaggg

SEQ ID NO: 42110 - DNA, 20 bp, Artificial Sequence
  Description of Artificial Sequence: Synthetic oligonucleotide
  Target: SCN10A; (-) strand; PAM type: YTN; PAM sequence: CTT
gaactcttgcaatgtgcagg

SEQ ID NO: 42111 - DNA, 20 bp, Artificial Sequence
  Description of Artificial Sequence: Synthetic oligonucleotide
  Target: SCN10A; (-) strand; PAM type: YTN; PAM sequence: CTC
ttgaactcttgcaatgtgca

SEQ ID NO: 42112 - DNA, 20 bp, Artificial Sequence
  Description of Artificial Sequence: Synthetic oligonucleotide
  Target: SCN10A; (-) strand; PAM type: YTN; PAM sequence: TTC
aagcagctcttgaactcttg

SEQ ID NO: 42113 - DNA, 20 bp, Artificial Sequence
  Description of Artificial Sequence: Synthetic oligonucleotide
  Target: SCN10A; (-) strand; PAM type: YTN; PAM sequence: TTT
caagcagctcttgaactctt

SEQ ID NO: 42114 - DNA, 20 bp, Artificial Sequence
  Description of Artificial Sequence: Synthetic oligonucleotide
  Target: SCN10A; (-) strand; PAM type: YTN; PAM sequence: TTA
atatttcaagcagctcttga

SEQ ID NO: 42115 - DNA, 20 bp, Artificial Sequence
  Description of Artificial Sequence: Synthetic oligonucleotide
  Target: SCN10A; (-) strand; PAM type: YTN; PAM sequence: CTC
aaattaatatttcaagcagc

SEQ ID NO: 42116 - DNA, 20 bp, Artificial Sequence
  Description of Artificial Sequence: Synthetic oligonucleotide
  Target: SCN10A; (-) strand; PAM type: YTN; PAM sequence: CTC
agcaaagtagctcaaattaa

SEQ ID NO: 42117 - DNA, 20 bp, Artificial Sequence
  Description of Artificial Sequence: Synthetic oligonucleotide
  Target: SCN10A; (-) strand; PAM type: YTN; PAM sequence: CTC
tcagcaaagtagctcaaatt

SEQ ID NO: 42118 - DNA, 20 bp, Artificial Sequence
  Description of Artificial Sequence: Synthetic oligonucleotide
  Target: SCN10A; (-) strand; PAM type: YTN; PAM sequence: TTA
ctctcagcaaagtagctcaa

SEQ ID NO: 42119 - DNA, 20 bp, Artificial Sequence
  Description of Artificial Sequence: Synthetic oligonucleotide
  Target: SCN10A; (-) strand; PAM type: YTN; PAM sequence: TTT
actctcagcaaagtagctca

SEQ ID NO: 42120 - DNA, 20 bp, Artificial Sequence
  Description of Artificial Sequence: Synthetic oligonucleotide
  Target: SCN10A; (-) strand; PAM type: YTN; PAM sequence: CTT
tactctcagcaaagtagctc

SEQ ID NO: 42121 - DNA, 20 bp, Artificial Sequence
  Description of Artificial Sequence: Synthetic oligonucleotide
  Target: SCN10A; (-) strand; PAM type: YTN; PAM sequence: TTG
actttactctcagcaaagta

SEQ ID NO: 42122 - DNA, 20 bp, Artificial Sequence
  Description of Artificial Sequence: Synthetic oligonucleotide
  Target: SCN10A; (-) strand; PAM type: YTN; PAM sequence: CTT
gactttactctcagcaaagt

SEQ ID NO: 42123 - DNA, 20 bp, Artificial Sequence
  Description of Artificial Sequence: Synthetic oligonucleotide
  Target: SCN10A; (-) strand; PAM type: YTN; PAM sequence: TTG
cacttgactttactctcagc

SEQ ID NO: 42124 - DNA, 20 bp, Artificial Sequence
  Description of Artificial Sequence: Synthetic oligonucleotide
  Target: SCN10A; (-) strand; PAM type: YTN; PAM sequence: TTT
gcacttgactttactctcag

SEQ ID NO: 42125 - DNA, 20 bp, Artificial Sequence
  Description of Artificial Sequence: Synthetic oligonucleotide
  Target: SCN10A; (-) strand; PAM type: YTN; PAM sequence: CTT
tgcacttgactttactctca

SEQ ID NO: 42126 - DNA, 20 bp, Artificial Sequence
  Description of Artificial Sequence: Synthetic oligonucleotide
  Target: SCN10A; (-) strand; PAM type: YTN; PAM sequence: TTC
ccctttgcacttgactttac

SEQ ID NO: 42127 - DNA, 20 bp, Artificial Sequence
  Description of Artificial Sequence: Synthetic oligonucleotide
  Target: SCN10A; (-) strand; PAM type: YTN; PAM sequence: TTT
cccctttgcacttgacttta

SEQ ID NO: 42128 - DNA, 20 bp, Artificial Sequence
  Description of Artificial Sequence: Synthetic oligonucleotide
  Target: SCN10A; (-) strand; PAM type: YTN; PAM sequence: TTC
caagaataagtttccccttt

SEQ ID NO: 42129 - DNA, 20 bp, Artificial Sequence
  Description of Artificial Sequence: Synthetic oligonucleotide
  Target: SCN10A; (-) strand; PAM type: YTN; PAM sequence: TTT
ccaagaataagtttcccctt

SEQ ID NO: 42130 - DNA, 20 bp, Artificial Sequence
  Description of Artificial Sequence: Synthetic oligonucleotide
  Target: SCN10A; (-) strand; PAM type: YTN; PAM sequence: TTG
cacagcaccaggaacagagg

SEQ ID NO: 42131 - DNA, 20 bp, Artificial Sequence
  Description of Artificial Sequence: Synthetic oligonucleotide
  Target: SCN10A; (-) strand; PAM type: YTN; PAM sequence: TTT
gcacagcaccaggaacagag

SEQ ID NO: 42132 - DNA, 20 bp, Artificial Sequence
  Description of Artificial Sequence: Synthetic oligonucleotide
  Target: SCN10A; (-) strand; PAM type: YTN; PAM sequence: TTA
ggcatttgcacagcaccagg

SEQ ID NO: 42133 - DNA, 20 bp, Artificial Sequence
  Description of Artificial Sequence: Synthetic oligonucleotide
  Target: SCN10A; (-) strand; PAM type: YTN; PAM sequence: CTT
aggcatttgcacagcaccag

SEQ ID NO: 42134 - DNA, 20 bp, Artificial Sequence
  Description of Artificial Sequence: Synthetic oligonucleotide
  Target: SCN10A; (-) strand; PAM type: YTN; PAM sequence: TTG
cttaggcatttgcacagcac

SEQ ID NO: 42135 - DNA, 20 bp, Artificial Sequence
  Description of Artificial Sequence: Synthetic oligonucleotide
  Target: SCN10A; (-) strand; PAM type: YTN; PAM sequence: TTT
gcttaggcatttgcacagca

SEQ ID NO: 42136 - DNA, 20 bp, Artificial Sequence
  Description of Artificial Sequence: Synthetic oligonucleotide
  Target: SCN10A; (-) strand; PAM type: YTN; PAM sequence: CTG
catttgcttaggcatttgca

SEQ ID NO: 42137 - DNA, 20 bp, Artificial Sequence
  Description of Artificial Sequence: Synthetic oligonucleotide
  Target: SCN10A; (-) strand; PAM type: YTN; PAM sequence: CTA
tacctgcatttgcttaggca

SEQ ID NO: 42138 - DNA, 20 bp, Artificial Sequence
  Description of Artificial Sequence: Synthetic oligonucleotide
  Target: SCN10A; (-) strand; PAM type: YTN; PAM sequence: CTA
cgccctatacctgcatttgc

SEQ ID NO: 42139 - DNA, 20 bp, Artificial Sequence
  Description of Artificial Sequence: Synthetic oligonucleotide
  Target: SCN10A; (-) strand; PAM type: YTN; PAM sequence: TTG
accctacgccctatacctgc

SEQ ID NO: 42140 - DNA, 20 bp, Artificial Sequence
  Description of Artificial Sequence: Synthetic oligonucleotide
  Target: SCN10A; (-) strand; PAM type: YTN; PAM sequence: CTT
gaccctacgccctatacctg

SEQ ID NO: 42141 - DNA, 20 bp, Artificial Sequence
  Description of Artificial Sequence: Synthetic oligonucleotide
  Target: SCN10A; (-) strand; PAM type: YTN; PAM sequence: TTC
caagatgcaaacaaccaaga

SEQ ID NO: 42142 - DNA, 20 bp, Artificial Sequence
  Description of Artificial Sequence: Synthetic oligonucleotide
  Target: SCN10A; (-) strand; PAM type: YTN; PAM sequence: CTT
ccaagatgcaaacaaccaag

SEQ ID NO: 42143 - DNA, 20 bp, Artificial Sequence
  Description of Artificial Sequence: Synthetic oligonucleotide
  Target: SCN10A; (-) strand; PAM type: YTN; PAM sequence: CTC
cttccaagatgcaaacaacc

SEQ ID NO: 42144 - DNA, 20 bp, Artificial Sequence
  Description of Artificial Sequence: Synthetic oligonucleotide
  Target: SCN10A; (-) strand; PAM type: YTN; PAM sequence: CTG
cctccttccaagatgcaaac

SEQ ID NO: 42145 - DNA, 20 bp, Artificial Sequence
  Description of Artificial Sequence: Synthetic oligonucleotide
  Target: SCN10A; (-) strand; PAM type: YTN; PAM sequence: CTC
tgcctccttccaagatgcaa

SEQ ID NO: 42146 - DNA, 20 bp, Artificial Sequence
  Description of Artificial Sequence: Synthetic oligonucleotide
  Target: SCN10A; (-) strand; PAM type: YTN; PAM sequence: TTA
tccaggccactctgcctcct

SEQ ID NO: 42147 - DNA, 20 bp, Artificial Sequence
  Description of Artificial Sequence: Synthetic oligonucleotide
  Target: SCN10A; (-) strand; PAM type: YTN; PAM sequence: TTG
gttatccaggccactctgcc

SEQ ID NO: 42148 - DNA, 20 bp, Artificial Sequence
  Description of Artificial Sequence: Synthetic oligonucleotide
  Target: SCN10A; (-) strand; PAM type: YTN; PAM sequence: CTT
ggttatccaggccactctgc

SEQ ID NO: 42149 - DNA, 20 bp, Artificial Sequence
  Description of Artificial Sequence: Synthetic oligonucleotide
  Target: SCN10A; (-) strand; PAM type: YTN; PAM sequence: CTC
ttggttatccaggccactct

SEQ ID NO: 42150 - DNA, 20 bp, Artificial Sequence
  Description of Artificial Sequence: Synthetic oligonucleotide
  Target: SCN10A; (-) strand; PAM type: YTN; PAM sequence: TTA
aagacaccataaaaataacc

SEQ ID NO: 42151 - DNA, 20 bp, Artificial Sequence
  Description of Artificial Sequence: Synthetic oligonucleotide
  Target: SCN10A; (-) strand; PAM type: YTN; PAM sequence: TTT
aaagacaccataaaaataac

SEQ ID NO: 42152 - DNA, 20 bp, Artificial Sequence
  Description of Artificial Sequence: Synthetic oligonucleotide
  Target: SCN10A; (-) strand; PAM type: YTN; PAM sequence: TTT
taaagacaccataaaaataa

SEQ ID NO: 42153 - DNA, 20 bp, Artificial Sequence
  Description of Artificial Sequence: Synthetic oligonucleotide
  Target: SCN10A; (-) strand; PAM type: YTN; PAM sequence: TTT
ttaaagacaccataaaaata

SEQ ID NO: 42154 - DNA, 20 bp, Artificial Sequence
  Description of Artificial Sequence: Synthetic oligonucleotide
  Target: SCN10A; (-) strand; PAM type: YTN; PAM sequence: CTT
tttaaagacaccataaaaat

SEQ ID NO: 42155 - DNA, 20 bp, Artificial Sequence
  Description of Artificial Sequence: Synthetic oligonucleotide
  Target: SCN10A; (-) strand; PAM type: YTN; PAM sequence: CTA
aaagaagagaagatcacagt

SEQ ID NO: 42156 - DNA, 20 bp, Artificial Sequence
  Description of Artificial Sequence: Synthetic oligonucleotide
  Target: SCN10A; (-) strand; PAM type: YTN; PAM sequence: TTC
acagcactaaaagaagagaa

SEQ ID NO: 42157 - DNA, 20 bp, Artificial Sequence
  Description of Artificial Sequence: Synthetic oligonucleotide
  Target: SCN10A; (-) strand; PAM type: YTN; PAM sequence: CTC
acagagcagtaagatgttca

SEQ ID NO: 42158 - DNA, 20 bp, Artificial Sequence
  Description of Artificial Sequence: Synthetic oligonucleotide
  Target: SCN10A; (-) strand; PAM type: YTN; PAM sequence: TTG
ggatcaaggactcacagagc

SEQ ID NO: 42159 - DNA, 20 bp, Artificial Sequence
  Description of Artificial Sequence: Synthetic oligonucleotide
  Target: SCN10A; (-) strand; PAM type: YTN; PAM sequence: TTG
ggagaaggtcaaagcgtggg

SEQ ID NO: 42160 - DNA, 20 bp, Artificial Sequence
  Description of Artificial Sequence: Synthetic oligonucleotide
  Target: SCN10A; (-) strand; PAM type: YTN; PAM sequence: TTT
gggagaaggtcaaagcgtgg

SEQ ID NO: 42161 - DNA, 20 bp, Artificial Sequence
  Description of Artificial Sequence: Synthetic oligonucleotide
  Target: SCN10A; (-) strand; PAM type: YTN; PAM sequence: TTT
tgggagaaggtcaaagcgtg

SEQ ID NO: 42162 - DNA, 20 bp, Artificial Sequence
  Description of Artificial Sequence: Synthetic oligonucleotide
  Target: SCN10A; (-) strand; PAM type: YTN; PAM sequence: CTC
catagaggtcaggagaagtt

SEQ ID NO: 42163 - DNA, 20 bp, Artificial Sequence
  Description of Artificial Sequence: Synthetic oligonucleotide
  Target: SCN10A; (-) strand; PAM type: YTN; PAM sequence: TTG
aatagggggagatatgtgca

SEQ ID NO: 42164 - DNA, 20 bp, Artificial Sequence
  Description of Artificial Sequence: Synthetic oligonucleotide
  Target: SCN10A; (-) strand; PAM type: YTN; PAM sequence: TTT
gaatagggggagatatgtgc

SEQ ID NO: 42165 - DNA, 20 bp, Artificial Sequence
  Description of Artificial Sequence: Synthetic oligonucleotide
  Target: SCN10A; (-) strand; PAM type: YTN; PAM sequence: CTT
tgaatagggggagatatgtg

SEQ ID NO: 42166 - DNA, 20 bp, Artificial Sequence
  Description of Artificial Sequence: Synthetic oligonucleotide
  Target: SCN10A; (-) strand; PAM type: YTN; PAM sequence: CTG
aggtacatggggtaggggag

SEQ ID NO: 42167 - DNA, 20 bp, Artificial Sequence
  Description of Artificial Sequence: Synthetic oligonucleotide
  Target: SCN10A; (-) strand; PAM type: YTN; PAM sequence: CTA
acccctgaggtacatggggt

SEQ ID NO: 42168 - DNA, 20 bp, Artificial Sequence
  Description of Artificial Sequence: Synthetic oligonucleotide
  Target: SCN10A; (-) strand; PAM type: YTN; PAM sequence: TTA
caagacacaggaagagcagt

SEQ ID NO: 42169 - DNA, 20 bp, Artificial Sequence
  Description of Artificial Sequence: Synthetic oligonucleotide
  Target: SCN10A; (-) strand; PAM type: YTN; PAM sequence: TTT
acaagacacaggaagagcag

SEQ ID NO: 42170 - DNA, 20 bp, Artificial Sequence
  Description of Artificial Sequence: Synthetic oligonucleotide
  Target: SCN10A; (-) strand; PAM type: YTN; PAM sequence: TTT
tacaagacacaggaagagca

SEQ ID NO: 42171 - DNA, 20 bp, Artificial Sequence
  Description of Artificial Sequence: Synthetic oligonucleotide
  Target: SCN10A; (-) strand; PAM type: YTN; PAM sequence: TTC
aaagcaagaaggggttttac

SEQ ID NO: 42172 - DNA, 20 bp, Artificial Sequence
  Description of Artificial Sequence: Synthetic oligonucleotide
  Target: SCN10A; (-) strand; PAM type: YTN; PAM sequence: CTT
caaagcaagaaggggtttta

SEQ ID NO: 42173 - DNA, 20 bp, Artificial Sequence
  Description of Artificial Sequence: Synthetic oligonucleotide
  Target: SCN10A; (-) strand; PAM type: YTN; PAM sequence: CTA
ggtggcaaagcttcaaagca

SEQ ID NO: 42174 - DNA, 20 bp, Artificial Sequence
  Description of Artificial Sequence: Synthetic oligonucleotide
  Target: SCN10A; (-) strand; PAM type: YTN; PAM sequence: TTG
gcaagcggcagtaatgaaga

SEQ ID NO: 42175 - DNA, 20 bp, Artificial Sequence
  Description of Artificial Sequence: Synthetic oligonucleotide
  Target: SCN10A; (-) strand; PAM type: YTN; PAM sequence: TTT
ggcaagcggcagtaatgaag

SEQ ID NO: 42176 - DNA, 20 bp, Artificial Sequence
  Description of Artificial Sequence: Synthetic oligonucleotide
  Target: SCN10A; (-) strand; PAM type: YTN; PAM sequence: CTG
aggcagagggaccaagagtt

SEQ ID NO: 42177 - DNA, 20 bp, Artificial Sequence
  Description of Artificial Sequence: Synthetic oligonucleotide
  Target: SCN10A; (-) strand; PAM type: YTN; PAM sequence: TTA
ctgaggcagagggaccaaga

SEQ ID NO: 42178 - DNA, 20 bp, Artificial Sequence
  Description of Artificial Sequence: Synthetic oligonucleotide
  Target: SCN10A; (-) strand; PAM type: YTN; PAM sequence: CTC
acccatcattactgaggcag

SEQ ID NO: 42179 - DNA, 20 bp, Artificial Sequence
  Description of Artificial Sequence: Synthetic oligonucleotide
  Target: SCN10A; (-) strand; PAM type: YTN; PAM sequence: CTA
ggataatagccaagagtggg

SEQ ID NO: 42180 - DNA, 20 bp, Artificial Sequence
  Description of Artificial Sequence: Synthetic oligonucleotide
  Target: SCN10A; (-) strand; PAM type: YTN; PAM sequence: TTG
cctaggataatagccaagag

SEQ ID NO: 42181 - DNA, 20 bp, Artificial Sequence
  Description of Artificial Sequence: Synthetic oligonucleotide
  Target: SCN10A; (-) strand; PAM type: YTN; PAM sequence: TTA
atgttgcctaggataatagc

SEQ ID NO: 42182 - DNA, 20 bp, Artificial Sequence
  Description of Artificial Sequence: Synthetic oligonucleotide
  Target: SCN10A; (-) strand; PAM type: YTN; PAM sequence: TTG
tgcaataaaccaagagacaa

SEQ ID NO: 42183 - DNA, 20 bp, Artificial Sequence
  Description of Artificial Sequence: Synthetic oligonucleotide
  Target: SCN10A; (-) strand; PAM type: YTN; PAM sequence: TTT
gtgcaataaaccaagagaca

SEQ ID NO: 42184 - DNA, 20 bp, Artificial Sequence
  Description of Artificial Sequence: Synthetic oligonucleotide
  Target: SCN10A; (-) strand; PAM type: YTN; PAM sequence: TTA
gagatttgtgcaataaacca

SEQ ID NO: 42185 - DNA, 20 bp, Artificial Sequence
  Description of Artificial Sequence: Synthetic oligonucleotide
  Target: SCN10A; (-) strand; PAM type: YTN; PAM sequence: CTA
ggtcattagagatttgtgca

SEQ ID NO: 42186 - DNA, 20 bp, Artificial Sequence
  Description of Artificial Sequence: Synthetic oligonucleotide
  Target: SCN10A; (-) strand; PAM type: YTN; PAM sequence: TTA
ggagaaactaggtcattaga

SEQ ID NO: 42187 - DNA, 20 bp, Artificial Sequence
  Description of Artificial Sequence: Synthetic oligonucleotide
  Target: SCN10A; (-) strand; PAM type: YTN; PAM sequence: TTA
agttaggagaaactaggtca

SEQ ID NO: 42188 - DNA, 20 bp, Artificial Sequence
  Description of Artificial Sequence: Synthetic oligonucleotide
  Target: SCN10A; (-) strand; PAM type: YTN; PAM sequence: TTT
aagttaggagaaactaggtc

SEQ ID NO: 42189 - DNA, 20 bp, Artificial Sequence
  Description of Artificial Sequence: Synthetic oligonucleotide
  Target: SCN10A; (-) strand; PAM type: YTN; PAM sequence: CTT
taagttaggagaaactaggt

SEQ ID NO: 42190 - DNA, 20 bp, Artificial Sequence
  Description of Artificial Sequence: Synthetic oligonucleotide
  Target: SCN10A; (-) strand; PAM type: YTN; PAM sequence: CTG
ctttaagttaggagaaacta

SEQ ID NO: 42191 - DNA, 20 bp, Artificial Sequence
  Description of Artificial Sequence: Synthetic oligonucleotide
  Target: SCN10A; (-) strand; PAM type: YTN; PAM sequence: TTC
tgctttaagttaggagaaac

SEQ ID NO: 42192 - DNA, 20 bp, Artificial Sequence
  Description of Artificial Sequence: Synthetic oligonucleotide
  Target: SCN10A; (-) strand; PAM type: YTN; PAM sequence: CTG
aaatattctgctttaagtta

SEQ ID NO: 42193 - DNA, 20 bp, Artificial Sequence
  Description of Artificial Sequence: Synthetic oligonucleotide
  Target: SCN10A; (-) strand; PAM type: YTN; PAM sequence: TTC
tgaaatattctgctttaagt

SEQ ID NO: 42194 - DNA, 20 bp, Artificial Sequence
  Description of Artificial Sequence: Synthetic oligonucleotide
  Target: SCN10A; (-) strand; PAM type: YTN; PAM sequence: TTT
ctgaaatattctgctttaag

SEQ ID NO: 42195 - DNA, 20 bp, Artificial Sequence
  Description of Artificial Sequence: Synthetic oligonucleotide
  Target: SCN10A; (-) strand; PAM type: YTN; PAM sequence: CTG
gagggagatgtaagtttctg

SEQ ID NO: 42196 - DNA, 20 bp, Artificial Sequence
  Description of Artificial Sequence: Synthetic oligonucleotide
  Target: SCN10A; (-) strand; PAM type: YTN; PAM sequence: CTA
agatggtagctggagggaga

SEQ ID NO: 42197 - DNA, 20 bp, Artificial Sequence
  Description of Artificial Sequence: Synthetic oligonucleotide
  Target: SCN10A; (-) strand; PAM type: YTN; PAM sequence: TTG
aaggtgggaagagatctaag

SEQ ID NO: 42198 - DNA, 20 bp, Artificial Sequence
  Description of Artificial Sequence: Synthetic oligonucleotide
  Target: SCN10A; (-) strand; PAM type: YTN; PAM sequence: TTT
gaaggtgggaagagatctaa

SEQ ID NO: 42199 - DNA, 20 bp, Artificial Sequence
  Description of Artificial Sequence: Synthetic oligonucleotide
  Target: SCN10A; (-) strand; PAM type: YTN; PAM sequence: CTT
tgaaggtgggaagagatcta

SEQ ID NO: 42200 - DNA, 20 bp, Artificial Sequence
  Description of Artificial Sequence: Synthetic oligonucleotide
  Target: SCN10A; (-) strand; PAM type: YTN; PAM sequence: TTG
ctttgaaggtgggaagagat

SEQ ID NO: 42201 - DNA, 20 bp, Artificial Sequence
  Description of Artificial Sequence: Synthetic oligonucleotide
  Target: SCN10A; (-) strand; PAM type: YTN; PAM sequence: TTT
gctttgaaggtgggaagaga

SEQ ID NO: 42202 - DNA, 20 bp, Artificial Sequence
  Description of Artificial Sequence: Synthetic oligonucleotide
  Target: SCN10A; (-) strand; PAM type: YTN; PAM sequence: TTT
tgctttgaaggtgggaagag

SEQ ID NO: 42203 - DNA, 20 bp, Artificial Sequence
  Description of Artificial Sequence: Synthetic oligonucleotide
  Target: SCN10A; (-) strand; PAM type: YTN; PAM sequence: TTC
aagaaattttgctttgaagg

SEQ ID NO: 42204 - DNA, 20 bp, Artificial Sequence
  Description of Artificial Sequence: Synthetic oligonucleotide
  Target: SCN10A; (-) strand; PAM type: YTN; PAM sequence: TTT
caagaaattttgctttgaag

SEQ ID NO: 42205 - DNA, 20 bp, Artificial Sequence
  Description of Artificial Sequence: Synthetic oligonucleotide
  Target: SCN10A; (-) strand; PAM type: YTN; PAM sequence: CTT
tcaagaaattttgctttgaa

SEQ ID NO: 42206 - DNA, 20 bp, Artificial Sequence
  Description of Artificial Sequence: Synthetic oligonucleotide
  Target: SCN10A; (-) strand; PAM type: YTN; PAM sequence: CTC
tttcaagaaattttgctttg

SEQ ID NO: 42207 - DNA, 20 bp, Artificial Sequence
  Description of Artificial Sequence: Synthetic oligonucleotide
  Target: SCN10A; (-) strand; PAM type: YTN; PAM sequence: TTG
tacacaactctttcaagaaa

SEQ ID NO: 42208 - DNA, 20 bp, Artificial Sequence
  Description of Artificial Sequence: Synthetic oligonucleotide
  Target: SCN10A; (-) strand; PAM type: YTN; PAM sequence: CTG
attgtacacaactctttcaa

SEQ ID NO: 42209 - DNA, 20 bp, Artificial Sequence
  Description of Artificial Sequence: Synthetic oligonucleotide
  Target: SCN10A; (-) strand; PAM type: YTN; PAM sequence: CTG
aggagtgaatgagggacact

SEQ ID NO: 42210 - DNA, 20 bp, Artificial Sequence
  Description of Artificial Sequence: Synthetic oligonucleotide
  Target: SCN10A; (-) strand; PAM type: YTN; PAM sequence: TTG
atgtgggctgaggagtgaat

SEQ ID NO: 42211 - DNA, 20 bp, Artificial Sequence
  Description of Artificial Sequence: Synthetic oligonucleotide
  Target: SCN10A; (-) strand; PAM type: YTN; PAM sequence: CTG
ttgatgtgggctgaggagtg

SEQ ID NO: 42212 - DNA, 20 bp, Artificial Sequence
  Description of Artificial Sequence: Synthetic oligonucleotide
  Target: SCN10A; (-) strand; PAM type: YTN; PAM sequence: CTC
tgttgatgtgggctgaggag

SEQ ID NO: 42213 - DNA, 20 bp, Artificial Sequence
  Description of Artificial Sequence: Synthetic oligonucleotide
  Target: SCN10A; (-) strand; PAM type: YTN; PAM sequence: CTG
tcaggatagaggcaaaagct

SEQ ID NO: 42214 - DNA, 20 bp, Artificial Sequence
  Description of Artificial Sequence: Synthetic oligonucleotide
  Target: SCN10A; (-) strand; PAM type: YTN; PAM sequence: CTC
tgtcaggatagaggcaaaag

SEQ ID NO: 42215 - DNA, 20 bp, Artificial Sequence
  Description of Artificial Sequence: Synthetic oligonucleotide
  Target: SCN10A; (-) strand; PAM type: YTN; PAM sequence: TTA
gtgagaacaatctctgtcag

SEQ ID NO: 42216 - DNA, 20 bp, Artificial Sequence
  Description of Artificial Sequence: Synthetic oligonucleotide
  Target: SCN10A; (-) strand; PAM type: YTN; PAM sequence: CTT
agtgagaacaatctctgtca

SEQ ID NO: 42217 - DNA, 20 bp, Artificial Sequence
  Description of Artificial Sequence: Synthetic oligonucleotide
  Target: SCN10A; (-) strand; PAM type: YTN; PAM sequence: TTC
atgatcttagtgagaacaat

SEQ ID NO: 42218 - DNA, 20 bp, Artificial Sequence
  Description of Artificial Sequence: Synthetic oligonucleotide
  Target: SCN10A; (-) strand; PAM type: YTN; PAM sequence: TTA
tgggaagtcattcatgatct

SEQ ID NO: 42219 - DNA, 20 bp, Artificial Sequence
  Description of Artificial Sequence: Synthetic oligonucleotide
  Target: SCN10A; (-) strand; PAM type: YTN; PAM sequence: CTA
atattatgggaagtcattca

SEQ ID NO: 42220 - DNA, 20 bp, Artificial Sequence
  Description of Artificial Sequence: Synthetic oligonucleotide
  Target: SCN10A; (-) strand; PAM type: YTN; PAM sequence: TTG
gatctaatattatgggaagt

SEQ ID NO: 42221 - DNA, 20 bp, Artificial Sequence
  Description of Artificial Sequence: Synthetic oligonucleotide
  Target: SCN10A; (-) strand; PAM type: YTN; PAM sequence: CTT
ggatctaatattatgggaag

SEQ ID NO: 42222 - DNA, 20 bp, Artificial Sequence
  Description of Artificial Sequence: Synthetic oligonucleotide
  Target: SCN10A; (-) strand; PAM type: YTN; PAM sequence: CTA
ggcaatatcagacaagcgtc

SEQ ID NO: 42223 - DNA, 20 bp, Artificial Sequence
  Description of Artificial Sequence: Synthetic oligonucleotide
  Target: SCN10A; (-) strand; PAM type: YTN; PAM sequence: TTC
aaggtagaagggtactaggc

SEQ ID NO: 42224 - DNA, 20 bp, Artificial Sequence
  Description of Artificial Sequence: Synthetic oligonucleotide
  Target: SCN10A; (-) strand; PAM type: YTN; PAM sequence: TTT
caaggtagaagggtactagg

SEQ ID NO: 42225 - DNA, 20 bp, Artificial Sequence
  Description of Artificial Sequence: Synthetic oligonucleotide
  Target: SCN10A; (-) strand; PAM type: YTN; PAM sequence: CTA
taaaagagcatcacaaatgg

SEQ ID NO: 42226 - DNA, 20 bp, Artificial Sequence
  Description of Artificial Sequence: Synthetic oligonucleotide
  Target: SCN10A; (-) strand; PAM type: YTN; PAM sequence: TTG
ggtaaaggagactataaaag

SEQ ID NO: 42227 - DNA, 20 bp, Artificial Sequence
  Description of Artificial Sequence: Synthetic oligonucleotide
  Target: SCN10A; (-) strand; PAM type: YTN; PAM sequence: CTA
aaagttgggtaaaggagact

SEQ ID NO: 42228 - DNA, 20 bp, Artificial Sequence
  Description of Artificial Sequence: Synthetic oligonucleotide
  Target: SCN10A; (-) strand; PAM type: YTN; PAM sequence: CTG
atgtctaaaagttgggtaaa

SEQ ID NO: 42229 - DNA, 20 bp, Artificial Sequence
  Description of Artificial Sequence: Synthetic oligonucleotide
  Target: SCN10A; (-) strand; PAM type: YTN; PAM sequence: CTC
tgatgtctaaaagttgggta

SEQ ID NO: 42230 - DNA, 20 bp, Artificial Sequence
  Description of Artificial Sequence: Synthetic oligonucleotide
  Target: SCN10A; (-) strand; PAM type: YTN; PAM sequence: CTC
gaagaactctgatgtctaaa

SEQ ID NO: 42231 - DNA, 20 bp, Artificial Sequence
  Description of Artificial Sequence: Synthetic oligonucleotide
  Target: SCN10A; (-) strand; PAM type: YTN; PAM sequence: CTG
agcctcgaagaactctgatg

SEQ ID NO: 42232 - DNA, 20 bp, Artificial Sequence
  Description of Artificial Sequence: Synthetic oligonucleotide
  Target: SCN10A; (-) strand; PAM type: YTN; PAM sequence: CTC
aagactgagcctcgaagaac

SEQ ID NO: 42233 - DNA, 20 bp, Artificial Sequence
  Description of Artificial Sequence: Synthetic oligonucleotide
  Target: SCN10A; (-) strand; PAM type: YTN; PAM sequence: TTG
tcaagggagaaaaaatgggg

SEQ ID NO: 42234 - DNA, 20 bp, Artificial Sequence
  Description of Artificial Sequence: Synthetic oligonucleotide
  Target: SCN10A; (-) strand; PAM type: YTN; PAM sequence: CTG
gataaattgtcaagggagaa

SEQ ID NO: 42235 - DNA, 20 bp, Artificial Sequence
  Description of Artificial Sequence: Synthetic oligonucleotide
  Target: SCN10A; (-) strand; PAM type: YTN; PAM sequence: CTG
gctggataaattgtcaaggg

SEQ ID NO: 42236 - DNA, 20 bp, Artificial Sequence
  Description of Artificial Sequence: Synthetic oligonucleotide
  Target: SCN10A; (-) strand; PAM type: YTN; PAM sequence: TTC
ctggctggataaattgtcaa

SEQ ID NO: 42237 - DNA, 20 bp, Artificial Sequence
  Description of Artificial Sequence: Synthetic oligonucleotide
  Target: SCN10A; (-) strand; PAM type: YTN; PAM sequence: TTA
attcctggctggataaattg

SEQ ID NO: 42238 - DNA, 20 bp, Artificial Sequence
  Description of Artificial Sequence: Synthetic oligonucleotide
  Target: SCN10A; (-) strand; PAM type: YTN; PAM sequence: TTG
cacatatatgttaattcctg

SEQ ID NO: 42239 - DNA, 20 bp, Artificial Sequence
  Description of Artificial Sequence: Synthetic oligonucleotide
  Target: SCN10A; (-) strand; PAM type: YTN; PAM sequence: TTG
gccaaaagttgcacatatat

SEQ ID NO: 42240 - DNA, 20 bp, Artificial Sequence
  Description of Artificial Sequence: Synthetic oligonucleotide
  Target: SCN10A; (-) strand; PAM type: YTN; PAM sequence: TTA
cagtccagtgacagaggcaa

SEQ ID NO: 42241 - DNA, 20 bp, Artificial Sequence
  Description of Artificial Sequence: Synthetic oligonucleotide
  Target: SCN10A; (-) strand; PAM type: YTN; PAM sequence: TTT
acagtccagtgacagaggca

SEQ ID NO: 42242 - DNA, 20 bp, Artificial Sequence
  Description of Artificial Sequence: Synthetic oligonucleotide
  Target: SCN10A; (-) strand; PAM type: YTN; PAM sequence: TTA
cagtttacagtccagtgaca

SEQ ID NO: 42243 - DNA, 20 bp, Artificial Sequence
  Description of Artificial Sequence: Synthetic oligonucleotide
  Target: SCN10A; (-) strand; PAM type: YTN; PAM sequence: CTT
acagtttacagtccagtgac

SEQ ID NO: 42244 - DNA, 20 bp, Artificial Sequence
  Description of Artificial Sequence: Synthetic oligonucleotide
  Target: SCN10A; (-) strand; PAM type: YTN; PAM sequence: CTC
ttacagtttacagtccagtg

SEQ ID NO: 42245 - DNA, 20 bp, Artificial Sequence
  Description of Artificial Sequence: Synthetic oligonucleotide
  Target: SCN10A; (-) strand; PAM type: YTN; PAM sequence: CTA
ctcttacagtttacagtcca

SEQ ID NO: 42246 - DNA, 20 bp, Artificial Sequence
  Description of Artificial Sequence: Synthetic oligonucleotide
  Target: SCN10A; (-) strand; PAM type: YTN; PAM sequence: TTC
ctactcttacagtttacagt

SEQ ID NO: 42247 - DNA, 20 bp, Artificial Sequence
  Description of Artificial Sequence: Synthetic oligonucleotide
  Target: SCN10A; (-) strand; PAM type: YTN; PAM sequence: TTA
gagcagtgagcaagacagac

SEQ ID NO: 42248 - DNA, 20 bp, Artificial Sequence
  Description of Artificial Sequence: Synthetic oligonucleotide
  Target: SCN10A; (-) strand; PAM type: YTN; PAM sequence: CTA
tgcagacaccagggttagag

SEQ ID NO: 42249 - DNA, 20 bp, Artificial Sequence
  Description of Artificial Sequence: Synthetic oligonucleotide
  Target: SCN10A; (-) strand; PAM type: YTN; PAM sequence: TTG
cagccaggcactatgcagac

SEQ ID NO: 42250 - DNA, 20 bp, Artificial Sequence
  Description of Artificial Sequence: Synthetic oligonucleotide
  Target: SCN10A; (-) strand; PAM type: YTN; PAM sequence: CTG
ttgcagccaggcactatgca

SEQ ID NO: 42251 - DNA, 20 bp, Artificial Sequence
  Description of Artificial Sequence: Synthetic oligonucleotide
  Target: SCN10A; (-) strand; PAM type: YTN; PAM sequence: TTG
cagagcatctgttgcagcca

SEQ ID NO: 42252 - DNA, 20 bp, Artificial Sequence
  Description of Artificial Sequence: Synthetic oligonucleotide
  Target: SCN10A; (-) strand; PAM type: YTN; PAM sequence: TTT
gcagagcatctgttgcagcc

SEQ ID NO: 42253 - DNA, 20 bp, Artificial Sequence
  Description of Artificial Sequence: Synthetic oligonucleotide
  Target: SCN10A; (-) strand; PAM type: YTN; PAM sequence: TTA
caaatttgcagagcatctgt

SEQ ID NO: 42254 - DNA, 20 bp, Artificial Sequence
  Description of Artificial Sequence: Synthetic oligonucleotide
  Target: SCN10A; (-) strand; PAM type: YTN; PAM sequence: TTT
acaaatttgcagagcatctg

SEQ ID NO: 42255 - DNA, 20 bp, Artificial Sequence
  Description of Artificial Sequence: Synthetic oligonucleotide
  Target: SCN10A; (-) strand; PAM type: YTN; PAM sequence: TTC
atttacaaatttgcagagca

SEQ ID NO: 42256 - DNA, 20 bp, Artificial Sequence
  Description of Artificial Sequence: Synthetic oligonucleotide
  Target: SCN10A; (-) strand; PAM type: YTN; PAM sequence: TTC
cattcatttacaaatttgca

SEQ ID NO: 42257 - DNA, 20 bp, Artificial Sequence
  Description of Artificial Sequence: Synthetic oligonucleotide
  Target: SCN10A; (-) strand; PAM type: YTN; PAM sequence: CTT
ccattcatttacaaatttgc

SEQ ID NO: 42258 - DNA, 20 bp, Artificial Sequence
  Description of Artificial Sequence: Synthetic oligonucleotide
  Target: SCN10A; (-) strand; PAM type: YTN; PAM sequence: CTG
tcttccattcatttacaaat

SEQ ID NO: 42259 - DNA, 20 bp, Artificial Sequence
  Description of Artificial Sequence: Synthetic oligonucleotide
  Target: SCN10A; (-) strand; PAM type: YTN; PAM sequence: TTC
tgtcttccattcatttacaa

SEQ ID NO: 42260 - DNA, 20 bp, Artificial Sequence
  Description of Artificial Sequence: Synthetic oligonucleotide
  Target: SCN10A; (-) strand; PAM type: YTN; PAM sequence: CTG
cccattctgtcttccattca

SEQ ID NO: 42261 - DNA, 20 bp, Artificial Sequence
  Description of Artificial Sequence: Synthetic oligonucleotide
  Target: SCN10A; (-) strand; PAM type: YTN; PAM sequence: CTC
agagctgcccattctgtctt

SEQ ID NO: 42262 - DNA, 20 bp, Artificial Sequence
  Description of Artificial Sequence: Synthetic oligonucleotide
  Target: SCN10A; (-) strand; PAM type: YTN; PAM sequence: TTA
actcagagctgcccattctg

SEQ ID NO: 42263 - DNA, 20 bp, Artificial Sequence
  Description of Artificial Sequence: Synthetic oligonucleotide
  Target: SCN10A; (-) strand; PAM type: YTN; PAM sequence: CTA
tggttaactcagagctgccc

SEQ ID NO: 42264 - DNA, 20 bp, Artificial Sequence
  Description of Artificial Sequence: Synthetic oligonucleotide
  Target: SCN10A; (-) strand; PAM type: YTN; PAM sequence: TTG
agctatggttaactcagagc

SEQ ID NO: 42265 - DNA, 20 bp, Artificial Sequence
  Description of Artificial Sequence: Synthetic oligonucleotide
  Target: SCN10A; (-) strand; PAM type: YTN; PAM sequence: TTT
gagctatggttaactcagag

SEQ ID NO: 42266 - DNA, 20 bp, Artificial Sequence
  Description of Artificial Sequence: Synthetic oligonucleotide
  Target: SCN10A; (-) strand; PAM type: YTN; PAM sequence: TTC
atttgagctatggttaactc

SEQ ID NO: 42267 - DNA, 20 bp, Artificial Sequence
  Description of Artificial Sequence: Synthetic oligonucleotide
  Target: SCN10A; (-) strand; PAM type: YTN; PAM sequence: TTT
catttgagctatggttaact

SEQ ID NO: 42268 - DNA, 20 bp, Artificial Sequence
  Description of Artificial Sequence: Synthetic oligonucleotide
  Target: SCN10A; (-) strand; PAM type: YTN; PAM sequence: TTT
tcatttgagctatggttaac

SEQ ID NO: 42269 - DNA, 20 bp, Artificial Sequence
  Description of Artificial Sequence: Synthetic oligonucleotide
  Target: SCN10A; (-) strand; PAM type: YTN; PAM sequence: TTA
aattttcatttgagctatgg

SEQ ID NO: 42270 - DNA, 20 bp, Artificial Sequence
  Description of Artificial Sequence: Synthetic oligonucleotide
  Target: SCN10A; (-) strand; PAM type: YTN; PAM sequence: TTT
aaattttcatttgagctatg

SEQ ID NO: 42271 - DNA, 20 bp, Artificial Sequence
  Description of Artificial Sequence: Synthetic oligonucleotide
  Target: SCN10A; (-) strand; PAM type: YTN; PAM sequence: CTT
taaattttcatttgagctat

SEQ ID NO: 42272 - DNA, 20 bp, Artificial Sequence
  Description of Artificial Sequence: Synthetic oligonucleotide
  Target: SCN10A; (-) strand; PAM type: YTN; PAM sequence: TTA
gtcaaataaagggtgacttt

SEQ ID NO: 42273 - DNA, 20 bp, Artificial Sequence
  Description of Artificial Sequence: Synthetic oligonucleotide
  Target: SCN10A; (-) strand; PAM type: YTN; PAM sequence: TTT
agtcaaataaagggtgactt

SEQ ID NO: 42274 - DNA, 20 bp, Artificial Sequence
  Description of Artificial Sequence: Synthetic oligonucleotide
  Target: SCN10A; (-) strand; PAM type: YTN; PAM sequence: TTG
aatttagtcaaataaagggt

SEQ ID NO: 42275 - DNA, 20 bp, Artificial Sequence
  Description of Artificial Sequence: Synthetic oligonucleotide
  Target: SCN10A; (-) strand; PAM type: YTN; PAM sequence: TTG
gtacagaattgaatttagtc

SEQ ID NO: 42276 - DNA, 20 bp, Artificial Sequence
  Description of Artificial Sequence: Synthetic oligonucleotide
  Target: SCN10A; (-) strand; PAM type: YTN; PAM sequence: CTT
ggtacagaattgaatttagt

SEQ ID NO: 42277 - DNA, 20 bp, Artificial Sequence
  Description of Artificial Sequence: Synthetic oligonucleotide
  Target: SCN10A; (-) strand; PAM type: YTN; PAM sequence: TTC
agtatgtacccttggtacag

SEQ ID NO: 42278 - DNA, 20 bp, Artificial Sequence
  Description of Artificial Sequence: Synthetic oligonucleotide
  Target: SCN10A; (-) strand; PAM type: YTN; PAM sequence: TTG
cacatcccatacattcagta

SEQ ID NO: 42279 - DNA, 20 bp, Artificial Sequence
  Description of Artificial Sequence: Synthetic oligonucleotide
  Target: SCN10A; (-) strand; PAM type: YTN; PAM sequence: CTT
gcacatcccatacattcagt

SEQ ID NO: 42280 - DNA, 20 bp, Artificial Sequence
  Description of Artificial Sequence: Synthetic oligonucleotide
  Target: SCN10A; (-) strand; PAM type: YTN; PAM sequence: CTC
atgcagaggcttgcacatcc

SEQ ID NO: 42281 - DNA, 20 bp, Artificial Sequence
  Description of Artificial Sequence: Synthetic oligonucleotide
  Target: SCN10A; (-) strand; PAM type: YTN; PAM sequence: CTC
atagccactcatgcagaggc

SEQ ID NO: 42282 - DNA, 20 bp, Artificial Sequence
  Description of Artificial Sequence: Synthetic oligonucleotide
  Target: SCN10A; (-) strand; PAM type: YTN; PAM sequence: CTC
cctcatagccactcatgcag

SEQ ID NO: 42283 - DNA, 20 bp, Artificial Sequence
  Description of Artificial Sequence: Synthetic oligonucleotide
  Target: SCN10A; (-) strand; PAM type: YTN; PAM sequence: TTC
ctccctcatagccactcatg

SEQ ID NO: 42284 - DNA, 20 bp, Artificial Sequence
  Description of Artificial Sequence: Synthetic oligonucleotide
  Target: SCN10A; (-) strand; PAM type: YTN; PAM sequence: CTT
cctccctcatagccactcat

SEQ ID NO: 42285 - DNA, 20 bp, Artificial Sequence
  Description of Artificial Sequence: Synthetic oligonucleotide
  Target: SCN10A; (-) strand; PAM type: YTN; PAM sequence: CTC
ttcctccctcatagccactc

SEQ ID NO: 42286 - DNA, 20 bp, Artificial Sequence
  Description of Artificial Sequence: Synthetic oligonucleotide
  Target: SCN10A; (-) strand; PAM type: YTN; PAM sequence: TTC
tcttcctccctcatagccac

SEQ ID NO: 42287 - DNA, 20 bp, Artificial Sequence
  Description of Artificial Sequence: Synthetic oligonucleotide
  Target: SCN10A; (-) strand; PAM type: YTN; PAM sequence: CTT
ctcttcctccctcatagcca

SEQ ID NO: 42288 - DNA, 20 bp, Artificial Sequence
  Description of Artificial Sequence: Synthetic oligonucleotide
  Target: SCN10A; (-) strand; PAM type: YTN; PAM sequence: TTC
ttctcttcctccctcatagc

SEQ ID NO: 42289 - DNA, 20 bp, Artificial Sequence
  Description of Artificial Sequence: Synthetic oligonucleotide
  Target: SCN10A; (-) strand; PAM type: YTN; PAM sequence: CTG
gaagggatcagacaggttct

SEQ ID NO: 42290 - DNA, 20 bp, Artificial Sequence
  Description of Artificial Sequence: Synthetic oligonucleotide
  Target: SCN10A; (-) strand; PAM type: YTN; PAM sequence: CTC
cctggaagggatcagacagg

SEQ ID NO: 42291 - DNA, 20 bp, Artificial Sequence
  Description of Artificial Sequence: Synthetic oligonucleotide
  Target: SCN10A; (-) strand; PAM type: YTN; PAM sequence: CTC
ccgtgggctccctggaaggg

SEQ ID NO: 42292 - DNA, 20 bp, Artificial Sequence
  Description of Artificial Sequence: Synthetic oligonucleotide
  Target: SCN10A; (-) strand; PAM type: YTN; PAM sequence: CTG
tgcagctcccgtgggctccc

SEQ ID NO: 42293 - DNA, 20 bp, Artificial Sequence
  Description of Artificial Sequence: Synthetic oligonucleotide
  Target: SCN10A; (-) strand; PAM type: YTN; PAM sequence: TTG
ctgtgcagctcccgtgggct

SEQ ID NO: 42294 - DNA, 20 bp, Artificial Sequence
  Description of Artificial Sequence: Synthetic oligonucleotide
  Target: SCN10A; (-) strand; PAM type: YTN; PAM sequence: CTT
gctgtgcagctcccgtgggc

SEQ ID NO: 42295 - DNA, 20 bp, Artificial Sequence
  Description of Artificial Sequence: Synthetic oligonucleotide
  Target: SCN10A; (-) strand; PAM type: YTN; PAM sequence: CTG
cttgctgtgcagctcccgtg

SEQ ID NO: 42296 - DNA, 20 bp, Artificial Sequence
  Description of Artificial Sequence: Synthetic oligonucleotide
  Target: SCN10A; (-) strand; PAM type: YTN; PAM sequence: CTC
tgcttgctgtgcagctcccg

SEQ ID NO: 42297 - DNA, 20 bp, Artificial Sequence
  Description of Artificial Sequence: Synthetic oligonucleotide
  Target: SCN10A; (-) strand; PAM type: YTN; PAM sequence: TTC
cccctctgcttgctgtgcag

SEQ ID NO: 42298 - DNA, 20 bp, Artificial Sequence
  Description of Artificial Sequence: Synthetic oligonucleotide
  Target: SCN10A; (-) strand; PAM type: YTN; PAM sequence: CTT
ccccctctgcttgctgtgca

SEQ ID NO: 42299 - DNA, 20 bp, Artificial Sequence
  Description of Artificial Sequence: Synthetic oligonucleotide
  Target: SCN10A; (-) strand; PAM type: YTN; PAM sequence: CTC
atcacagcacttccccctct

SEQ ID NO: 42300 - DNA, 20 bp, Artificial Sequence
  Description of Artificial Sequence: Synthetic oligonucleotide
  Target: SCN10A; (-) strand; PAM type: YTN; PAM sequence: CTA
acccaacaggatagcaaccc

SEQ ID NO: 42301 - DNA, 20 bp, Artificial Sequence
  Description of Artificial Sequence: Synthetic oligonucleotide
  Target: SCN10A; (-) strand; PAM type: YTN; PAM sequence: CTC
taacccaacaggatagcaac

SEQ ID NO: 42302 - DNA, 20 bp, Artificial Sequence
  Description of Artificial Sequence: Synthetic oligonucleotide
  Target: SCN10A; (-) strand; PAM type: YTN; PAM sequence: TTG
ctctaacccaacaggatagc

SEQ ID NO: 42303 - DNA, 20 bp, Artificial Sequence
  Description of Artificial Sequence: Synthetic oligonucleotide
  Target: SCN10A; (-) strand; PAM type: YTN; PAM sequence: TTT
gctctaacccaacaggatag

SEQ ID NO: 42304 - DNA, 20 bp, Artificial Sequence
  Description of Artificial Sequence: Synthetic oligonucleotide
  Target: SCN10A; (-) strand; PAM type: YTN; PAM sequence: CTT
tgctctaacccaacaggata

SEQ ID NO: 42305 - DNA, 20 bp, Artificial Sequence
  Description of Artificial Sequence: Synthetic oligonucleotide
  Target: SCN10A; (-) strand; PAM type: YTN; PAM sequence: TTC
tttgctctaacccaacagga

SEQ ID NO: 42306 - DNA, 20 bp, Artificial Sequence
  Description of Artificial Sequence: Synthetic oligonucleotide
  Target: SCN10A; (-) strand; PAM type: YTN; PAM sequence: CTG
attctttgctctaacccaac

SEQ ID NO: 42307 - DNA, 20 bp, Artificial Sequence
  Description of Artificial Sequence: Synthetic oligonucleotide
  Target: SCN10A; (-) strand; PAM type: YTN; PAM sequence: TTG
gtctgattctttgctctaac

SEQ ID NO: 42308 - DNA, 20 bp, Artificial Sequence
  Description of Artificial Sequence: Synthetic oligonucleotide
  Target: SCN10A; (-) strand; PAM type: YTN; PAM sequence: TTT
ggtctgattctttgctctaa

SEQ ID NO: 42309 - DNA, 20 bp, Artificial Sequence
  Description of Artificial Sequence: Synthetic oligonucleotide
  Target: SCN10A; (-) strand; PAM type: YTN; PAM sequence: CTT
tggtctgattctttgctcta

SEQ ID NO: 42310 - DNA, 20 bp, Artificial Sequence
  Description of Artificial Sequence: Synthetic oligonucleotide
  Target: SCN10A; (-) strand; PAM type: YTN; PAM sequence: CTG
ccatgagcaaaggccacttt

SEQ ID NO: 42311 - DNA, 20 bp, Artificial Sequence
  Description of Artificial Sequence: Synthetic oligonucleotide
  Target: SCN10A; (-) strand; PAM type: YTN; PAM sequence: TTC
tgccatgagcaaaggccact

SEQ ID NO: 42312 - DNA, 20 bp, Artificial Sequence
  Description of Artificial Sequence: Synthetic oligonucleotide
  Target: SCN10A; (-) strand; PAM type: YTN; PAM sequence: CTG
ccccaggaaagatgtgagcc

SEQ ID NO: 42313 - DNA, 20 bp, Artificial Sequence
  Description of Artificial Sequence: Synthetic oligonucleotide
  Target: SCN10A; (-) strand; PAM type: YTN; PAM sequence: CTC
ctgccccaggaaagatgtga

SEQ ID NO: 42314 - DNA, 20 bp, Artificial Sequence
  Description of Artificial Sequence: Synthetic oligonucleotide
  Target: SCN10A; (-) strand; PAM type: YTN; PAM sequence: CTC
agcaatccccctcctgcccc

SEQ ID NO: 42315 - DNA, 20 bp, Artificial Sequence
  Description of Artificial Sequence: Synthetic oligonucleotide
  Target: SCN10A; (-) strand; PAM type: YTN; PAM sequence: TTA
gtggctcagcaatccccctc

SEQ ID NO: 42316 - DNA, 20 bp, Artificial Sequence
  Description of Artificial Sequence: Synthetic oligonucleotide
  Target: SCN10A; (-) strand; PAM type: YTN; PAM sequence: TTC
agtgatgaaatggaagggat

SEQ ID NO: 42317 - DNA, 20 bp, Artificial Sequence
  Description of Artificial Sequence: Synthetic oligonucleotide
  Target: SCN10A; (-) strand; PAM type: YTN; PAM sequence: TTT
cagtgatgaaatggaaggga

SEQ ID NO: 42318 - DNA, 20 bp, Artificial Sequence
  Description of Artificial Sequence: Synthetic oligonucleotide
  Target: SCN10A; (-) strand; PAM type: YTN; PAM sequence: TTT
tcagtgatgaaatggaaggg

SEQ ID NO: 42319 - DNA, 20 bp, Artificial Sequence
  Description of Artificial Sequence: Synthetic oligonucleotide
  Target: SCN10A; (-) strand; PAM type: YTN; PAM sequence: TTC
accattttcagtgatgaaat

SEQ ID NO: 42320 - DNA, 20 bp, Artificial Sequence
  Description of Artificial Sequence: Synthetic oligonucleotide
  Target: SCN10A; (-) strand; PAM type: YTN; PAM sequence: TTT
caccattttcagtgatgaaa

SEQ ID NO: 42321 - DNA, 20 bp, Artificial Sequence
  Description of Artificial Sequence: Synthetic oligonucleotide
  Target: SCN10A; (-) strand; PAM type: YTN; PAM sequence: TTT
tcaccattttcagtgatgaa

SEQ ID NO: 42322 - DNA, 20 bp, Artificial Sequence
  Description of Artificial Sequence: Synthetic oligonucleotide
  Target: SCN10A; (-) strand; PAM type: YTN; PAM sequence: TTT
ttcaccattttcagtgatga

SEQ ID NO: 42323 - DNA, 20 bp, Artificial Sequence
  Description of Artificial Sequence: Synthetic oligonucleotide
  Target: SCN10A; (-) strand; PAM type: YTN; PAM sequence: TTT
tttcaccattttcagtgatg

SEQ ID NO: 42324 - DNA, 20 bp, Artificial Sequence
  Description of Artificial Sequence: Synthetic oligonucleotide
  Target: SCN10A; (-) strand; PAM type: YTN; PAM sequence: CTG
tattttttcaccattttcag

SEQ ID NO: 42325 - DNA, 20 bp, Artificial Sequence
  Description of Artificial Sequence: Synthetic oligonucleotide
  Target: SCN10A; (-) strand; PAM type: YTN; PAM sequence: TTA
gaagtcatgtgaccatgaat

SEQ ID NO: 42326 - DNA, 20 bp, Artificial Sequence
  Description of Artificial Sequence: Synthetic oligonucleotide
  Target: SCN10A; (-) strand; PAM type: YTN; PAM sequence: TTA
attagaagtcatgtgaccat

SEQ ID NO: 42327 - DNA, 20 bp, Artificial Sequence
  Description of Artificial Sequence: Synthetic oligonucleotide
  Target: SCN10A; (-) strand; PAM type: YTN; PAM sequence: TTT
aattagaagtcatgtgacca

SEQ ID NO: 42328 - DNA, 20 bp, Artificial Sequence
  Description of Artificial Sequence: Synthetic oligonucleotide
  Target: SCN10A; (-) strand; PAM type: YTN; PAM sequence: CTG
tttaattagaagtcatgtga

SEQ ID NO: 42329 - DNA, 20 bp, Artificial Sequence
  Description of Artificial Sequence: Synthetic oligonucleotide
  Target: SCN10A; (-) strand; PAM type: YTN; PAM sequence: CTC
tgtttaattagaagtcatgt

SEQ ID NO: 42330 - DNA, 20 bp, Artificial Sequence
  Description of Artificial Sequence: Synthetic oligonucleotide
  Target: SCN10A; (-) strand; PAM type: YTN; PAM sequence: CTG
ctctgtttaattagaagtca

SEQ ID NO: 42331 - DNA, 20 bp, Artificial Sequence
  Description of Artificial Sequence: Synthetic oligonucleotide
  Target: SCN10A; (-) strand; PAM type: YTN; PAM sequence: TTG
cctgctctgtttaattagaa

SEQ ID NO: 42332 - DNA, 20 bp, Artificial Sequence
  Description of Artificial Sequence: Synthetic oligonucleotide
  Target: SCN10A; (-) strand; PAM type: YTN; PAM sequence: TTA
acgatgccgttgcctgctct

SEQ ID NO: 42333 - DNA, 20 bp, Artificial Sequence
  Description of Artificial Sequence: Synthetic oligonucleotide
  Target: SCN10A; (-) strand; PAM type: YTN; PAM sequence: CTT
aacgatgccgttgcctgctc

SEQ ID NO: 42334 - DNA, 20 bp, Artificial Sequence
  Description of Artificial Sequence: Synthetic oligonucleotide
  Target: SCN10A; (-) strand; PAM type: YTN; PAM sequence: TTC
acacccagccacttaacgat

SEQ ID NO: 42335 - DNA, 20 bp, Artificial Sequence
  Description of Artificial Sequence: Synthetic oligonucleotide
  Target: SCN10A; (-) strand; PAM type: YTN; PAM sequence: CTT
cacacccagccacttaacga

SEQ ID NO: 42336 - DNA, 20 bp, Artificial Sequence
  Description of Artificial Sequence: Synthetic oligonucleotide
  Target: SCN10A; (-) strand; PAM type: YTN; PAM sequence: CTA
aagtcagaatatccagggca

SEQ ID NO: 42337 - DNA, 20 bp, Artificial Sequence
  Description of Artificial Sequence: Synthetic oligonucleotide
  Target: SCN10A; (-) strand; PAM type: YTN; PAM sequence: TTC
cctaaagtcagaatatccag

SEQ ID NO: 42338 - DNA, 20 bp, Artificial Sequence
  Description of Artificial Sequence: Synthetic oligonucleotide
  Target: SCN10A; (-) strand; PAM type: YTN; PAM sequence: CTC
cattccctaaagtcagaata

SEQ ID NO: 42339 - DNA, 20 bp, Artificial Sequence
  Description of Artificial Sequence: Synthetic oligonucleotide
  Target: SCN10A; (-) strand; PAM type: YTN; PAM sequence: CTA
ctccattccctaaagtcaga

SEQ ID NO: 42340 - DNA, 20 bp, Artificial Sequence
  Description of Artificial Sequence: Synthetic oligonucleotide
  Target: SCN10A; (-) strand; PAM type: YTN; PAM sequence: CTA
gcaagctactccattcccta

SEQ ID NO: 42341 - DNA, 20 bp, Artificial Sequence
  Description of Artificial Sequence: Synthetic oligonucleotide
  Target: SCN10A; (-) strand; PAM type: YTN; PAM sequence: CTA
atccaagagcagctagcaag

SEQ ID NO: 42342 - DNA, 20 bp, Artificial Sequence
  Description of Artificial Sequence: Synthetic oligonucleotide
  Target: SCN10A; (-) strand; PAM type: YTN; PAM sequence: CTG
accgtgggctaatccaagag

SEQ ID NO: 42343 - DNA, 20 bp, Artificial Sequence
  Description of Artificial Sequence: Synthetic oligonucleotide
  Target: SCN10A; (-) strand; PAM type: YTN; PAM sequence: TTG
caaaggtatgatccctgacc

SEQ ID NO: 42344 - DNA, 20 bp, Artificial Sequence
  Description of Artificial Sequence: Synthetic oligonucleotide
  Target: SCN10A; (-) strand; PAM type: YTN; PAM sequence: CTG
agagcaccaagggttgcaaa

SEQ ID NO: 42345 - DNA, 20 bp, Artificial Sequence
  Description of Artificial Sequence: Synthetic oligonucleotide
  Target: SCN10A; (-) strand; PAM type: YTN; PAM sequence: CTC
tgagagcaccaagggttgca

SEQ ID NO: 42346 - DNA, 20 bp, Artificial Sequence
  Description of Artificial Sequence: Synthetic oligonucleotide
  Target: SCN10A; (-) strand; PAM type: YTN; PAM sequence: TTC
atcgtctctgagagcaccaa

SEQ ID NO: 42347 - DNA, 20 bp, Artificial Sequence
  Description of Artificial Sequence: Synthetic oligonucleotide
  Target: SCN10A; (-) strand; PAM type: YTN; PAM sequence: CTT
catcgtctctgagagcacca

SEQ ID NO: 42348 - DNA, 20 bp, Artificial Sequence
  Description of Artificial Sequence: Synthetic oligonucleotide
  Target: SCN10A; (-) strand; PAM type: YTN; PAM sequence: CTA
gagaatatcacataatcaat

SEQ ID NO: 42349 - DNA, 20 bp, Artificial Sequence
  Description of Artificial Sequence: Synthetic oligonucleotide
  Target: SCN10A; (-) strand; PAM type: YTN; PAM sequence: CTC
tagagaatatcacataatca

SEQ ID NO: 42350 - DNA, 20 bp, Artificial Sequence
  Description of Artificial Sequence: Synthetic oligonucleotide
  Target: SCN10A; (-) strand; PAM type: YTN; PAM sequence: TTA
tagaaatataataggctcta

SEQ ID NO: 42351 - DNA, 20 bp, Artificial Sequence
  Description of Artificial Sequence: Synthetic oligonucleotide
  Target: SCN10A; (-) strand; PAM type: YTN; PAM sequence: TTT
atagaaatataataggctct

SEQ ID NO: 42352 - DNA, 20 bp, Artificial Sequence
  Description of Artificial Sequence: Synthetic oligonucleotide
  Target: SCN10A; (-) strand; PAM type: YTN; PAM sequence: CTT
tatagaaatataataggctc

SEQ ID NO: 42353 - DNA, 20 bp, Artificial Sequence
  Description of Artificial Sequence: Synthetic oligonucleotide
  Target: SCN10A; (-) strand; PAM type: YTN; PAM sequence: CTC
cactttatagaaatataata

SEQ ID NO: 42354 - DNA, 20 bp, Artificial Sequence
  Description of Artificial Sequence: Synthetic oligonucleotide
  Target: SCN10A; (-) strand; PAM type: YTN; PAM sequence: CTC
acatactccactttatagaa

SEQ ID NO: 42355 - DNA, 20 bp, Artificial Sequence
  Description of Artificial Sequence: Synthetic oligonucleotide
  Target: SCN10A; (-) strand; PAM type: YTN; PAM sequence: CTC
tcacatactccactttatag

SEQ ID NO: 42356 - DNA, 20 bp, Artificial Sequence
  Description of Artificial Sequence: Synthetic oligonucleotide
  Target: SCN10A; (-) strand; PAM type: YTN; PAM sequence: CTA
cagaaatcaataaaagcagc

SEQ ID NO: 42357 - DNA, 20 bp, Artificial Sequence
  Description of Artificial Sequence: Synthetic oligonucleotide
  Target: SCN10A; (-) strand; PAM type: YTN; PAM sequence: CTG
ctacagaaatcaataaaagc

SEQ ID NO: 42358 - DNA, 20 bp, Artificial Sequence
  Description of Artificial Sequence: Synthetic oligonucleotide
  Target: SCN10A; (-) strand; PAM type: YTN; PAM sequence: TTC
cctgctacagaaatcaataa

SEQ ID NO: 42359 - DNA, 20 bp, Artificial Sequence
  Description of Artificial Sequence: Synthetic oligonucleotide
  Target: SCN10A; (-) strand; PAM type: YTN; PAM sequence: TTA
acattccctgctacagaaat

SEQ ID NO: 42360 - DNA, 20 bp, Artificial Sequence
  Description of Artificial Sequence: Synthetic oligonucleotide
  Target: SCN10A; (-) strand; PAM type: YTN; PAM sequence: TTT
aacattccctgctacagaaa

SEQ ID NO: 42361 - DNA, 20 bp, Artificial Sequence
  Description of Artificial Sequence: Synthetic oligonucleotide
  Target: SCN10A; (-) strand; PAM type: YTN; PAM sequence: CTT
taacattccctgctacagaa

SEQ ID NO: 42362 - DNA, 20 bp, Artificial Sequence
  Description of Artificial Sequence: Synthetic oligonucleotide
  Target: SCN10A; (-) strand; PAM type: YTN; PAM sequence: TTC
tttaacattccctgctacag

SEQ ID NO: 42363 - DNA, 20 bp, Artificial Sequence
  Description of Artificial Sequence: Synthetic oligonucleotide
  Target: SCN10A; (-) strand; PAM type: YTN; PAM sequence: TTA
ttctttaacattccctgcta

SEQ ID NO: 42364 - DNA, 20 bp, Artificial Sequence
  Description of Artificial Sequence: Synthetic oligonucleotide
  Target: SCN10A; (-) strand; PAM type: YTN; PAM sequence: TTT
attctttaacattccctgct

SEQ ID NO: 42365 - DNA, 20 bp, Artificial Sequence
  Description of Artificial Sequence: Synthetic oligonucleotide
  Target: SCN10A; (-) strand; PAM type: YTN; PAM sequence: TTT
tattctttaacattccctgc

SEQ ID NO: 42366 - DNA, 20 bp, Artificial Sequence
  Description of Artificial Sequence: Synthetic oligonucleotide
  Target: SCN10A; (-) strand; PAM type: YTN; PAM sequence: CTG
ggaaattttattctttaaca

SEQ ID NO: 42367 - DNA, 20 bp, Artificial Sequence
  Description of Artificial Sequence: Synthetic oligonucleotide
  Target: SCN10A; (-) strand; PAM type: YTN; PAM sequence: TTC
cacaagactgggaaatttta

SEQ ID NO: 42368 - DNA, 20 bp, Artificial Sequence
  Description of Artificial Sequence: Synthetic oligonucleotide
  Target: SCN10A; (-) strand; PAM type: YTN; PAM sequence: TTA
aggattccacaagactggga

SEQ ID NO: 42369 - DNA, 20 bp, Artificial Sequence
  Description of Artificial Sequence: Synthetic oligonucleotide
  Target: SCN10A; (-) strand; PAM type: YTN; PAM sequence: TTC
cataggaaaagttaaggatt

SEQ ID NO: 42370 - DNA, 20 bp, Artificial Sequence
  Description of Artificial Sequence: Synthetic oligonucleotide
  Target: SCN10A; (-) strand; PAM type: YTN; PAM sequence: CTT
ccataggaaaagttaaggat

SEQ ID NO: 42371 - DNA, 20 bp, Artificial Sequence
  Description of Artificial Sequence: Synthetic oligonucleotide
  Target: SCN10A; (-) strand; PAM type: YTN; PAM sequence: TTC
ttccataggaaaagttaagg

SEQ ID NO: 42372 - DNA, 20 bp, Artificial Sequence
  Description of Artificial Sequence: Synthetic oligonucleotide
  Target: SCN10A; (-) strand; PAM type: YTN; PAM sequence: TTT
cttccataggaaaagttaag

SEQ ID NO: 42373 - DNA, 20 bp, Artificial Sequence
  Description of Artificial Sequence: Synthetic oligonucleotide
  Target: SCN10A; (-) strand; PAM type: YTN; PAM sequence: TTG
tttcttccataggaaaagtt

SEQ ID NO: 42374 - DNA, 20 bp, Artificial Sequence
  Description of Artificial Sequence: Synthetic oligonucleotide
  Target: SCN10A; (-) strand; PAM type: YTN; PAM sequence: CTT
gtttcttccataggaaaagt

SEQ ID NO: 42375 - DNA, 20 bp, Artificial Sequence
  Description of Artificial Sequence: Synthetic oligonucleotide
  Target: SCN10A; (-) strand; PAM type: YTN; PAM sequence: CTA
aatcttgtttcttccatagg

SEQ ID NO: 42376 - DNA, 20 bp, Artificial Sequence
  Description of Artificial Sequence: Synthetic oligonucleotide
  Target: SCN10A; (-) strand; PAM type: YTN; PAM sequence: CTC
taaatcttgtttcttccata

SEQ ID NO: 42377 - DNA, 20 bp, Artificial Sequence
  Description of Artificial Sequence: Synthetic oligonucleotide
  Target: SCN10A; (-) strand; PAM type: YTN; PAM sequence: CTC
aggctctaaatcttgtttct

SEQ ID NO: 42378 - DNA, 20 bp, Artificial Sequence
  Description of Artificial Sequence: Synthetic oligonucleotide
  Target: SCN10A; (-) strand; PAM type: YTN; PAM sequence: CTG
atgatgctcaggctctaaat

SEQ ID NO: 42379 - DNA, 20 bp, Artificial Sequence
  Description of Artificial Sequence: Synthetic oligonucleotide
  Target: SCN10A; (-) strand; PAM type: YTN; PAM sequence: CTC
tgatgatgctcaggctctaa

SEQ ID NO: 42380 - DNA, 20 bp, Artificial Sequence
  Description of Artificial Sequence: Synthetic oligonucleotide
  Target: SCN10A; (-) strand; PAM type: YTN; PAM sequence: CTC
acctctgatgatgctcaggc

SEQ ID NO: 42381 - DNA, 20 bp, Artificial Sequence
  Description of Artificial Sequence: Synthetic oligonucleotide
  Target: SCN10A; (-) strand; PAM type: YTN; PAM sequence: CTC
tcacctctgatgatgctcag

SEQ ID NO: 42382 - DNA, 20 bp, Artificial Sequence
  Description of Artificial Sequence: Synthetic oligonucleotide
  Target: SCN10A; (-) strand; PAM type: YTN; PAM sequence: CTC
ctctcacctctgatgatgct

SEQ ID NO: 42383 - DNA, 20 bp, Artificial Sequence
  Description of Artificial Sequence: Synthetic oligonucleotide
  Target: SCN10A; (-) strand; PAM type: YTN; PAM sequence: CTC
acacacctcctctcacctct

SEQ ID NO: 42384 - DNA, 20 bp, Artificial Sequence
  Description of Artificial Sequence: Synthetic oligonucleotide
  Target: SCN10A; (-) strand; PAM type: YTN; PAM sequence: CTG
ggaccacataggagcctcac

SEQ ID NO: 42385 - DNA, 20 bp, Artificial Sequence
  Description of Artificial Sequence: Synthetic oligonucleotide
  Target: SCN10A; (-) strand; PAM type: YTN; PAM sequence: TTA
cctgggaccacataggagcc

SEQ ID NO: 42386 - DNA, 20 bp, Artificial Sequence
  Description of Artificial Sequence: Synthetic oligonucleotide
  Target: SCN10A; (-) strand; PAM type: YTN; PAM sequence: CTT
acctgggaccacataggagc

SEQ ID NO: 42387 - DNA, 20 bp, Artificial Sequence
  Description of Artificial Sequence: Synthetic oligonucleotide
  Target: SCN10A; (-) strand; PAM type: YTN; PAM sequence: TTC
atgacagagcttacctggga

SEQ ID NO: 42388 - DNA, 20 bp, Artificial Sequence
  Description of Artificial Sequence: Synthetic oligonucleotide
  Target: SCN10A; (-) strand; PAM type: YTN; PAM sequence: TTT
catgacagagcttacctggg

SEQ ID NO: 42389 - DNA, 20 bp, Artificial Sequence
  Description of Artificial Sequence: Synthetic oligonucleotide
  Target: SCN10A; (-) strand; PAM type: YTN; PAM sequence: CTG
ccccatcagtgcatgggtgc

SEQ ID NO: 42390 - DNA, 20 bp, Artificial Sequence
  Description of Artificial Sequence: Synthetic oligonucleotide
  Target: SCN10A; (-) strand; PAM type: YTN; PAM sequence: TTC
tgccccatcagtgcatgggt

SEQ ID NO: 42391 - DNA, 20 bp, Artificial Sequence
  Description of Artificial Sequence: Synthetic oligonucleotide
  Target: SCN10A; (-) strand; PAM type: YTN; PAM sequence: TTT
ctgccccatcagtgcatggg

SEQ ID NO: 42392 - DNA, 20 bp, Artificial Sequence
  Description of Artificial Sequence: Synthetic oligonucleotide
  Target: SCN10A; (-) strand; PAM type: YTN; PAM sequence: CTG
acacaggatttctgccccat

SEQ ID NO: 42393 - DNA, 20 bp, Artificial Sequence
  Description of Artificial Sequence: Synthetic oligonucleotide
  Target: SCN10A; (-) strand; PAM type: YTN; PAM sequence: CTG
gtcataccagcaaagcactg

SEQ ID NO: 42394 - DNA, 20 bp, Artificial Sequence
  Description of Artificial Sequence: Synthetic oligonucleotide
  Target: SCN10A; (-) strand; PAM type: YTN; PAM sequence: TTA
ggagccccaaaggtcaagct

SEQ ID NO: 42395 - DNA, 20 bp, Artificial Sequence
  Description of Artificial Sequence: Synthetic oligonucleotide
  Target: SCN10A; (-) strand; PAM type: YTN; PAM sequence: CTT
aggagccccaaaggtcaagc

SEQ ID NO: 42396 - DNA, 20 bp, Artificial Sequence
  Description of Artificial Sequence: Synthetic oligonucleotide
  Target: SCN10A; (-) strand; PAM type: YTN; PAM sequence: CTC
cccttaggagccccaaaggt

SEQ ID NO: 42397 - DNA, 20 bp, Artificial Sequence
  Description of Artificial Sequence: Synthetic oligonucleotide
  Target: SCN10A; (-) strand; PAM type: YTN; PAM sequence: TTC
tccccttaggagccccaaag

SEQ ID NO: 42398 - DNA, 20 bp, Artificial Sequence
  Description of Artificial Sequence: Synthetic oligonucleotide
  Target: SCN10A; (-) strand; PAM type: YTN; PAM sequence: CTT
ctccccttaggagccccaaa

SEQ ID NO: 42399 - DNA, 20 bp, Artificial Sequence
  Description of Artificial Sequence: Synthetic oligonucleotide
  Target: SCN10A; (-) strand; PAM type: YTN; PAM sequence: CTG
gaatgtccaccttctcccct

SEQ ID NO: 42400 - DNA, 20 bp, Artificial Sequence
  Description of Artificial Sequence: Synthetic oligonucleotide
  Target: SCN10A; (-) strand; PAM type: YTN; PAM sequence: TTG
gccctggaatgtccaccttc

SEQ ID NO: 42401 - DNA, 20 bp, Artificial Sequence
  Description of Artificial Sequence: Synthetic oligonucleotide
  Target: SCN10A; (-) strand; PAM type: YTN; PAM sequence: TTA
ttggccctggaatgtccacc

SEQ ID NO: 42402 - DNA, 20 bp, Artificial Sequence
  Description of Artificial Sequence: Synthetic oligonucleotide
  Target: SCN10A; (-) strand; PAM type: YTN; PAM sequence: TTG
gccagattattggccctgga

SEQ ID NO: 42403 - DNA, 20 bp, Artificial Sequence
  Description of Artificial Sequence: Synthetic oligonucleotide
  Target: SCN10A; (-) strand; PAM type: YTN; PAM sequence: TTT
ggccagattattggccctgg

SEQ ID NO: 42404 - DNA, 20 bp, Artificial Sequence
  Description of Artificial Sequence: Synthetic oligonucleotide
  Target: SCN10A; (-) strand; PAM type: YTN; PAM sequence: TTT
tggccagattattggccctg

SEQ ID NO: 42405 - DNA, 20 bp, Artificial Sequence
  Description of Artificial Sequence: Synthetic oligonucleotide
  Target: SCN10A; (-) strand; PAM type: YTN; PAM sequence: CTT
ttggccagattattggccct

SEQ ID NO: 42406 - DNA, 20 bp, Artificial Sequence
  Description of Artificial Sequence: Synthetic oligonucleotide
  Target: SCN10A; (-) strand; PAM type: YTN; PAM sequence: TTG
cttttggccagattattggc

SEQ ID NO: 42407 - DNA, 20 bp, Artificial Sequence
  Description of Artificial Sequence: Synthetic oligonucleotide
  Target: SCN10A; (-) strand; PAM type: YTN; PAM sequence: CTT
gcttttggccagattattgg

SEQ ID NO: 42408 - DNA, 20 bp, Artificial Sequence
  Description of Artificial Sequence: Synthetic oligonucleotide
  Target: SCN10A; (-) strand; PAM type: YTN; PAM sequence: TTC
ccaggcccagcttgcttttg

SEQ ID NO: 42409 - DNA, 20 bp, Artificial Sequence
  Description of Artificial Sequence: Synthetic oligonucleotide
  Target: SCN10A; (-) strand; PAM type: YTN; PAM sequence: CTT
cccaggcccagcttgctttt

SEQ ID NO: 42410 - DNA, 20 bp, Artificial Sequence
  Description of Artificial Sequence: Synthetic oligonucleotide
  Target: SCN10A; (-) strand; PAM type: YTN; PAM sequence: TTC
ttcccaggcccagcttgctt

SEQ ID NO: 42411 - DNA, 20 bp, Artificial Sequence
  Description of Artificial Sequence: Synthetic oligonucleotide
  Target: SCN10A; (-) strand; PAM type: YTN; PAM sequence: CTT
cttcccaggcccagcttgct

SEQ ID NO: 42412 - DNA, 20 bp, Artificial Sequence
  Description of Artificial Sequence: Synthetic oligonucleotide
  Target: SCN10A; (-) strand; PAM type: YTN; PAM sequence: CTA
agacccttcttcccaggccc

SEQ ID NO: 42413 - DNA, 20 bp, Artificial Sequence
  Description of Artificial Sequence: Synthetic oligonucleotide
  Target: SCN10A; (-) strand; PAM type: YTN; PAM sequence: CTC
ccaactaagacccttcttcc

SEQ ID NO: 42414 - DNA, 20 bp, Artificial Sequence
  Description of Artificial Sequence: Synthetic oligonucleotide
  Target: SCN10A; (-) strand; PAM type: YTN; PAM sequence: TTC
ccactcccaactaagaccct

SEQ ID NO: 42415 - DNA, 20 bp, Artificial Sequence
  Description of Artificial Sequence: Synthetic oligonucleotide
  Target: SCN10A; (-) strand; PAM type: YTN; PAM sequence: CTA
gaaccaagaaagaaatccaa

SEQ ID NO: 42416 - DNA, 20 bp, Artificial Sequence
  Description of Artificial Sequence: Synthetic oligonucleotide
  Target: SCN10A; (-) strand; PAM type: YTN; PAM sequence: TTC
aaagtctagaaccaagaaag

SEQ ID NO: 42417 - DNA, 20 bp, Artificial Sequence
  Description of Artificial Sequence: Synthetic oligonucleotide
  Target: SCN10A; (-) strand; PAM type: YTN; PAM sequence: CTT
caaagtctagaaccaagaaa

SEQ ID NO: 42418 - DNA, 20 bp, Artificial Sequence
  Description of Artificial Sequence: Synthetic oligonucleotide
  Target: SCN10A; (-) strand; PAM type: YTN; PAM sequence: CTC
ttcaaagtctagaaccaaga

SEQ ID NO: 42419 - DNA, 20 bp, Artificial Sequence
  Description of Artificial Sequence: Synthetic oligonucleotide
  Target: SCN10A; (-) strand; PAM type: YTN; PAM sequence: TTC
cctcttcaaagtctagaacc

SEQ ID NO: 42420 - DNA, 20 bp, Artificial Sequence
  Description of Artificial Sequence: Synthetic oligonucleotide
  Target: SCN10A; (-) strand; PAM type: YTN; PAM sequence: CTT
ccctcttcaaagtctagaac

SEQ ID NO: 42421 - DNA, 20 bp, Artificial Sequence
  Description of Artificial Sequence: Synthetic oligonucleotide
  Target: SCN10A; (-) strand; PAM type: YTN; PAM sequence: TTG
acacccacatgcccagtggc

SEQ ID NO: 42422 - DNA, 20 bp, Artificial Sequence
  Description of Artificial Sequence: Synthetic oligonucleotide
  Target: SCN10A; (-) strand; PAM type: YTN; PAM sequence: TTT
gacacccacatgcccagtgg

SEQ ID NO: 42423 - DNA, 20 bp, Artificial Sequence
  Description of Artificial Sequence: Synthetic oligonucleotide
  Target: SCN10A; (-) strand; PAM type: YTN; PAM sequence: CTT
tgacacccacatgcccagtg

SEQ ID NO: 42424 - DNA, 20 bp, Artificial Sequence
  Description of Artificial Sequence: Synthetic oligonucleotide
  Target: SCN10A; (-) strand; PAM type: YTN; PAM sequence: CTG
accagcatccaaatggcagg

SEQ ID NO: 42425 - DNA, 20 bp, Artificial Sequence
  Description of Artificial Sequence: Synthetic oligonucleotide
  Target: SCN10A; (-) strand; PAM type: YTN; PAM sequence: CTC
ctgaccagcatccaaatggc

SEQ ID NO: 42426 - DNA, 20 bp, Artificial Sequence
  Description of Artificial Sequence: Synthetic oligonucleotide
  Target: SCN10A; (-) strand; PAM type: YTN; PAM sequence: CTA
gctcctgaccagcatccaaa

SEQ ID NO: 42427 - DNA, 20 bp, Artificial Sequence
  Description of Artificial Sequence: Synthetic oligonucleotide
  Target: SCN10A; (-) strand; PAM type: YTN; PAM sequence: TTG
gaccatcctagctcctgacc

SEQ ID NO: 42428 - DNA, 20 bp, Artificial Sequence
  Description of Artificial Sequence: Synthetic oligonucleotide
  Target: SCN10A; (-) strand; PAM type: YTN; PAM sequence: CTT
ggaccatcctagctcctgac

SEQ ID NO: 42429 - DNA, 20 bp, Artificial Sequence
  Description of Artificial Sequence: Synthetic oligonucleotide
  Target: SCN10A; (-) strand; PAM type: YTN; PAM sequence: CTC
caggacccataggtcttgga

SEQ ID NO: 42430 - DNA, 20 bp, Artificial Sequence
  Description of Artificial Sequence: Synthetic oligonucleotide
  Target: SCN10A; (-) strand; PAM type: YTN; PAM sequence: CTG
cactccaggacccataggtc

SEQ ID NO: 42431 - DNA, 20 bp, Artificial Sequence
  Description of Artificial Sequence: Synthetic oligonucleotide
  Target: SCN10A; (-) strand; PAM type: YTN; PAM sequence: CTG
cagatggctgcactccagga

SEQ ID NO: 42432 - DNA, 20 bp, Artificial Sequence
  Description of Artificial Sequence: Synthetic oligonucleotide
  Target: SCN10A; (-) strand; PAM type: YTN; PAM sequence: TTG
aagtggcagggatgccaaca

SEQ ID NO: 42433 - DNA, 20 bp, Artificial Sequence
  Description of Artificial Sequence: Synthetic oligonucleotide
  Target: SCN10A; (-) strand; PAM type: YTN; PAM sequence: TTT
gaagtggcagggatgccaac

SEQ ID NO: 42434 - DNA, 20 bp, Artificial Sequence
  Description of Artificial Sequence: Synthetic oligonucleotide
  Target: SCN10A; (-) strand; PAM type: YTN; PAM sequence: CTT
tgaagtggcagggatgccaa

SEQ ID NO: 42435 - DNA, 20 bp, Artificial Sequence
  Description of Artificial Sequence: Synthetic oligonucleotide
  Target: SCN10A; (-) strand; PAM type: YTN; PAM sequence: TTA
aacaaaactttgaagtggca

SEQ ID NO: 42436 - DNA, 20 bp, Artificial Sequence
  Description of Artificial Sequence: Synthetic oligonucleotide
  Target: SCN10A; (-) strand; PAM type: YTN; PAM sequence: TTT
aaacaaaactttgaagtggc

SEQ ID NO: 42437 - DNA, 20 bp, Artificial Sequence
  Description of Artificial Sequence: Synthetic oligonucleotide
  Target: SCN10A; (-) strand; PAM type: YTN; PAM sequence: CTA
gaacatttaaacaaaacttt

SEQ ID NO: 42438 - DNA, 20 bp, Artificial Sequence
  Description of Artificial Sequence: Synthetic oligonucleotide
  Target: SCN10A; (-) strand; PAM type: YTN; PAM sequence: CTG
aggcaaggctagaacattta

SEQ ID NO: 42439 - DNA, 20 bp, Artificial Sequence
  Description of Artificial Sequence: Synthetic oligonucleotide
  Target: SCN10A; (-) strand; PAM type: YTN; PAM sequence: TTC
gcatagctgaggcaaggcta

SEQ ID NO: 42440 - DNA, 20 bp, Artificial Sequence
  Description of Artificial Sequence: Synthetic oligonucleotide
  Target: SCN10A; (-) strand; PAM type: YTN; PAM sequence: TTT
cgcatagctgaggcaaggct

SEQ ID NO: 42441 - DNA, 20 bp, Artificial Sequence
  Description of Artificial Sequence: Synthetic oligonucleotide
  Target: SCN10A; (-) strand; PAM type: YTN; PAM sequence: CTA
atttcgcatagctgaggcaa

SEQ ID NO: 42442 - DNA, 20 bp, Artificial Sequence
  Description of Artificial Sequence: Synthetic oligonucleotide
  Target: SCN10A; (-) strand; PAM type: YTN; PAM sequence: TTC
cctaatttcgcatagctgag

SEQ ID NO: 42443 - DNA, 20 bp, Artificial Sequence
  Description of Artificial Sequence: Synthetic oligonucleotide
  Target: SCN10A; (-) strand; PAM type: YTN; PAM sequence: TTG
ttccctaatttcgcatagct

SEQ ID NO: 42444 - DNA, 20 bp, Artificial Sequence
  Description of Artificial Sequence: Synthetic oligonucleotide
  Target: SCN10A; (-) strand; PAM type: YTN; PAM sequence: TTT
gttccctaatttcgcatagc

SEQ ID NO: 42445 - DNA, 20 bp, Artificial Sequence
  Description of Artificial Sequence: Synthetic oligonucleotide
  Target: SCN10A; (-) strand; PAM type: YTN; PAM sequence: CTT
tgttccctaatttcgcatag

SEQ ID NO: 42446 - DNA, 20 bp, Artificial Sequence
  Description of Artificial Sequence: Synthetic oligonucleotide
  Target: SCN10A; (-) strand; PAM type: YTN; PAM sequence: TTC
ctttgttccctaatttcgca

SEQ ID NO: 42447 - DNA, 20 bp, Artificial Sequence
  Description of Artificial Sequence: Synthetic oligonucleotide
  Target: SCN10A; (-) strand; PAM type: YTN; PAM sequence: TTT
cctttgttccctaatttcgc

SEQ ID NO: 42448 - DNA, 20 bp, Artificial Sequence
  Description of Artificial Sequence: Synthetic oligonucleotide
  Target: SCN10A; (-) strand; PAM type: YTN; PAM sequence: CTT
tcctttgttccctaatttcg

SEQ ID NO: 42449 - DNA, 20 bp, Artificial Sequence
  Description of Artificial Sequence: Synthetic oligonucleotide
  Target: SCN10A; (-) strand; PAM type: YTN; PAM sequence: CTC
tttcctttgttccctaattt

SEQ ID NO: 42450 - DNA, 20 bp, Artificial Sequence
  Description of Artificial Sequence: Synthetic oligonucleotide
  Target: SCN10A; (-) strand; PAM type: YTN; PAM sequence: CTG
gcccaagcaaggtaaacact

SEQ ID NO: 42451 - DNA, 20 bp, Artificial Sequence
  Description of Artificial Sequence: Synthetic oligonucleotide
  Target: SCN10A; (-) strand; PAM type: YTN; PAM sequence: TTC
tggcccaagcaaggtaaaca

SEQ ID NO: 42452 - DNA, 20 bp, Artificial Sequence
  Description of Artificial Sequence: Synthetic oligonucleotide
  Target: SCN10A; (-) strand; PAM type: YTN; PAM sequence: TTA
atattctggcccaagcaagg

SEQ ID NO: 42453 - DNA, 20 bp, Artificial Sequence
  Description of Artificial Sequence: Synthetic oligonucleotide
  Target: SCN10A; (-) strand; PAM type: YTN; PAM sequence: CTT
aatattctggcccaagcaag

SEQ ID NO: 42454 - DNA, 20 bp, Artificial Sequence
  Description of Artificial Sequence: Synthetic oligonucleotide
  Target: SCN10A; (-) strand; PAM type: YTN; PAM sequence: CTC
cccttaatattctggcccaa

SEQ ID NO: 42455 - DNA, 20 bp, Artificial Sequence
  Description of Artificial Sequence: Synthetic oligonucleotide
  Target: SCN10A; (-) strand; PAM type: YTN; PAM sequence: CTC
tccccttaatattctggccc

SEQ ID NO: 42456 - DNA, 20 bp, Artificial Sequence
  Description of Artificial Sequence: Synthetic oligonucleotide
  Target: SCN10A; (-) strand; PAM type: YTN; PAM sequence: TTA
gtggaggaacgtggctctcc

SEQ ID NO: 42457 - DNA, 20 bp, Artificial Sequence
  Description of Artificial Sequence: Synthetic oligonucleotide
  Target: SCN10A; (-) strand; PAM type: YTN; PAM sequence: CTT
agtggaggaacgtggctctc

SEQ ID NO: 42458 - DNA, 20 bp, Artificial Sequence
  Description of Artificial Sequence: Synthetic oligonucleotide
  Target: SCN10A; (-) strand; PAM type: YTN; PAM sequence: CTA
gccttagtggaggaacgtgg

SEQ ID NO: 42459 - DNA, 20 bp, Artificial Sequence
  Description of Artificial Sequence: Synthetic oligonucleotide
  Target: SCN10A; (-) strand; PAM type: YTN; PAM sequence: TTG
ctagccttagtggaggaacg

SEQ ID NO: 42460 - DNA, 20 bp, Artificial Sequence
  Description of Artificial Sequence: Synthetic oligonucleotide
  Target: SCN10A; (-) strand; PAM type: YTN; PAM sequence: TTT
gctagccttagtggaggaac

SEQ ID NO: 42461 - DNA, 20 bp, Artificial Sequence
  Description of Artificial Sequence: Synthetic oligonucleotide
  Target: SCN10A; (-) strand; PAM type: YTN; PAM sequence: TTT
tgctagccttagtggaggaa

SEQ ID NO: 42462 - DNA, 20 bp, Artificial Sequence
  Description of Artificial Sequence: Synthetic oligonucleotide
  Target: SCN10A; (-) strand; PAM type: YTN; PAM sequence: CTT
ttgctagccttagtggagga

SEQ ID NO: 42463 - DNA, 20 bp, Artificial Sequence
  Description of Artificial Sequence: Synthetic oligonucleotide
  Target: SCN10A; (-) strand; PAM type: YTN; PAM sequence: CTC
aaccttttgctagccttagt

SEQ ID NO: 42464 - DNA, 20 bp, Artificial Sequence
  Description of Artificial Sequence: Synthetic oligonucleotide
  Target: SCN10A; (-) strand; PAM type: YTN; PAM sequence: CTC
tcaaccttttgctagcctta

SEQ ID NO: 42465 - DNA, 20 bp, Artificial Sequence
  Description of Artificial Sequence: Synthetic oligonucleotide
  Target: SCN10A; (-) strand; PAM type: YTN; PAM sequence: TTC
actctcaaccttttgctagc

SEQ ID NO: 42466 - DNA, 20 bp, Artificial Sequence
  Description of Artificial Sequence: Synthetic oligonucleotide
  Target: SCN10A; (-) strand; PAM type: YTN; PAM sequence: TTA
gtaattcactctcaaccttt

SEQ ID NO: 42467 - DNA, 20 bp, Artificial Sequence
  Description of Artificial Sequence: Synthetic oligonucleotide
  Target: SCN10A; (-) strand; PAM type: YTN; PAM sequence: TTG
aatggaagaagagtggatta

SEQ ID NO: 42468 - DNA, 20 bp, Artificial Sequence
  Description of Artificial Sequence: Synthetic oligonucleotide
  Target: SCN10A; (-) strand; PAM type: YTN; PAM sequence: TTT
gaatggaagaagagtggatt

SEQ ID NO: 42469 - DNA, 20 bp, Artificial Sequence
  Description of Artificial Sequence: Synthetic oligonucleotide
  Target: SCN10A; (-) strand; PAM type: YTN; PAM sequence: CTT
tgaatggaagaagagtggat

SEQ ID NO: 42470 - DNA, 20 bp, Artificial Sequence
  Description of Artificial Sequence: Synthetic oligonucleotide
  Target: SCN10A; (-) strand; PAM type: YTN; PAM sequence: CTC
catcctttgaatggaagaag

SEQ ID NO: 42471 - DNA, 20 bp, Artificial Sequence
  Description of Artificial Sequence: Synthetic oligonucleotide
  Target: SCN10A; (-) strand; PAM type: YTN; PAM sequence: TTC
tccatcctttgaatggaaga

SEQ ID NO: 42472 - DNA, 20 bp, Artificial Sequence
  Description of Artificial Sequence: Synthetic oligonucleotide
  Target: SCN10A; (-) strand; PAM type: YTN; PAM sequence: CTG
agattctccatcctttgaat

SEQ ID NO: 42473 - DNA, 20 bp, Artificial Sequence
  Description of Artificial Sequence: Synthetic oligonucleotide
  Target: SCN10A; (-) strand; PAM type: YTN; PAM sequence: TTC
ctgagattctccatcctttg

SEQ ID NO: 42474 - DNA, 20 bp, Artificial Sequence
  Description of Artificial Sequence: Synthetic oligonucleotide
  Target: SCN10A; (-) strand; PAM type: YTN; PAM sequence: CTG
ttcctgagattctccatcct

SEQ ID NO: 42475 - DNA, 20 bp, Artificial Sequence
  Description of Artificial Sequence: Synthetic oligonucleotide
  Target: SCN10A; (-) strand; PAM type: YTN; PAM sequence: TTC
tgttcctgagattctccatc

SEQ ID NO: 42476 - DNA, 20 bp, Artificial Sequence
  Description of Artificial Sequence: Synthetic oligonucleotide
  Target: SCN10A; (-) strand; PAM type: YTN; PAM sequence: CTC
ataaccaattctgttcctga

SEQ ID NO: 42477 - DNA, 20 bp, Artificial Sequence
  Description of Artificial Sequence: Synthetic oligonucleotide
  Target: SCN10A; (-) strand; PAM type: YTN; PAM sequence: CTC
cacatgtggaggggaagtga

SEQ ID NO: 42478 - DNA, 20 bp, Artificial Sequence
  Description of Artificial Sequence: Synthetic oligonucleotide
  Target: SCN10A; (-) strand; PAM type: YTN; PAM sequence: CTC
cgaggatggcacagggggag

SEQ ID NO: 42479 - DNA, 20 bp, Artificial Sequence
  Description of Artificial Sequence: Synthetic oligonucleotide
  Target: SCN10A; (-) strand; PAM type: YTN; PAM sequence: CTA
agatcctccgaggatggcac

SEQ ID NO: 42480 - DNA, 20 bp, Artificial Sequence
  Description of Artificial Sequence: Synthetic oligonucleotide
  Target: SCN10A; (-) strand; PAM type: YTN; PAM sequence: CTG
caactaagatcctccgagga

SEQ ID NO: 42481 - DNA, 20 bp, Artificial Sequence
  Description of Artificial Sequence: Synthetic oligonucleotide
  Target: SCN10A; (-) strand; PAM type: YTN; PAM sequence: TTA
agctgcaactaagatcctcc

SEQ ID NO: 42482 - DNA, 20 bp, Artificial Sequence
  Description of Artificial Sequence: Synthetic oligonucleotide
  Target: SCN10A; (-) strand; PAM type: YTN; PAM sequence: CTA
attaagctgcaactaagatc

SEQ ID NO: 42483 - DNA, 20 bp, Artificial Sequence
  Description of Artificial Sequence: Synthetic oligonucleotide
  Target: SCN10A; (-) strand; PAM type: YTN; PAM sequence: CTC
ctaattaagctgcaactaag

SEQ ID NO: 42484 - DNA, 20 bp, Artificial Sequence
  Description of Artificial Sequence: Synthetic oligonucleotide
  Target: SCN10A; (-) strand; PAM type: YTN; PAM sequence: TTC
tcctaattaagctgcaacta

SEQ ID NO: 42485 - DNA, 20 bp, Artificial Sequence
  Description of Artificial Sequence: Synthetic oligonucleotide
  Target: SCN10A; (-) strand; PAM type: YTN; PAM sequence: TTT
ctcctaattaagctgcaact

SEQ ID NO: 42486 - DNA, 20 bp, Artificial Sequence
  Description of Artificial Sequence: Synthetic oligonucleotide
  Target: SCN10A; (-) strand; PAM type: YTN; PAM sequence: CTG
caacaaaatcaccatttctc

SEQ ID NO: 42487 - DNA, 20 bp, Artificial Sequence
  Description of Artificial Sequence: Synthetic oligonucleotide
  Target: SCN10A; (-) strand; PAM type: YTN; PAM sequence: TTG
atggtcaggcaggaagacct

SEQ ID NO: 42488 - DNA, 20 bp, Artificial Sequence
  Description of Artificial Sequence: Synthetic oligonucleotide
  Target: SCN10A; (-) strand; PAM type: YTN; PAM sequence: TTC
caggcagtaaataggagtgg

SEQ ID NO: 42489 - DNA, 20 bp, Artificial Sequence
  Description of Artificial Sequence: Synthetic oligonucleotide
  Target: SCN10A; (-) strand; PAM type: YTN; PAM sequence: TTG
aaattccaggcagtaaatag

SEQ ID NO: 42490 - DNA, 20 bp, Artificial Sequence
  Description of Artificial Sequence: Synthetic oligonucleotide
  Target: SCN10A; (-) strand; PAM type: YTN; PAM sequence: CTA
atgttgaaattccaggcagt

SEQ ID NO: 42491 - DNA, 20 bp, Artificial Sequence
  Description of Artificial Sequence: Synthetic oligonucleotide
  Target: SCN10A; (-) strand; PAM type: YTN; PAM sequence: CTA
caaaggcatgaccctaatgt

SEQ ID NO: 42492 - DNA, 20 bp, Artificial Sequence
  Description of Artificial Sequence: Synthetic oligonucleotide
  Target: SCN10A; (-) strand; PAM type: YTN; PAM sequence: CTA
cctacaaaggcatgacccta

SEQ ID NO: 42493 - DNA, 20 bp, Artificial Sequence
  Description of Artificial Sequence: Synthetic oligonucleotide
  Target: SCN10A; (-) strand; PAM type: YTN; PAM sequence: CTG
gagagggcatctacctacaa

SEQ ID NO: 42494 - DNA, 20 bp, Artificial Sequence
  Description of Artificial Sequence: Synthetic oligonucleotide
  Target: SCN10A; (-) strand; PAM type: YTN; PAM sequence: TTC
aaaaagggaccctggagagg

SEQ ID NO: 42495 - DNA, 20 bp, Artificial Sequence
  Description of Artificial Sequence: Synthetic oligonucleotide
  Target: SCN10A; (-) strand; PAM type: YTN; PAM sequence: TTT
caaaaagggaccctggagag

SEQ ID NO: 42496 - DNA, 20 bp, Artificial Sequence
  Description of Artificial Sequence: Synthetic oligonucleotide
  Target: SCN10A; (-) strand; PAM type: YTN; PAM sequence: TTA
ggacaagataaatcatattt

SEQ ID NO: 42497 - DNA, 20 bp, Artificial Sequence
  Description of Artificial Sequence: Synthetic oligonucleotide
  Target: SCN10A; (-) strand; PAM type: YTN; PAM sequence: CTT
aggacaagataaatcatatt

SEQ ID NO: 42498 - DNA, 20 bp, Artificial Sequence
  Description of Artificial Sequence: Synthetic oligonucleotide
  Target: SCN10A; (-) strand; PAM type: YTN; PAM sequence: TTC
ttaggacaagataaatcata

SEQ ID NO: 42499 - DNA, 20 bp, Artificial Sequence
  Description of Artificial Sequence: Synthetic oligonucleotide
  Target: SCN10A; (-) strand; PAM type: YTN; PAM sequence: CTC
aaggaagacaacattcttag

SEQ ID NO: 42500 - DNA, 20 bp, Artificial Sequence
  Description of Artificial Sequence: Synthetic oligonucleotide
  Target: SCN10A; (-) strand; PAM type: YTN; PAM sequence: CTC
ccctcaaggaagacaacatt

SEQ ID NO: 42501 - DNA, 20 bp, Artificial Sequence
  Description of Artificial Sequence: Synthetic oligonucleotide
  Target: SCN10A; (-) strand; PAM type: YTN; PAM sequence: TTC
ctcccctcaaggaagacaac

SEQ ID NO: 42502 - DNA, 20 bp, Artificial Sequence
  Description of Artificial Sequence: Synthetic oligonucleotide
  Target: SCN10A; (-) strand; PAM type: YTN; PAM sequence: CTT
cctcccctcaaggaagacaa

SEQ ID NO: 42503 - DNA, 20 bp, Artificial Sequence
  Description of Artificial Sequence: Synthetic oligonucleotide
  Target: SCN10A; (-) strand; PAM type: YTN; PAM sequence: CTG
ccaaagaaagcttcctcccc

SEQ ID NO: 42504 - DNA, 20 bp, Artificial Sequence
  Description of Artificial Sequence: Synthetic oligonucleotide
  Target: SCN10A; (-) strand; PAM type: YTN; PAM sequence: CTG
tcatcacccaaccccatagg

SEQ ID NO: 42505 - DNA, 20 bp, Artificial Sequence
  Description of Artificial Sequence: Synthetic oligonucleotide
  Target: SCN10A; (-) strand; PAM type: YTN; PAM sequence: TTC
cctgtcatcacccaacccca

SEQ ID NO: 42506 - DNA, 20 bp, Artificial Sequence
  Description of Artificial Sequence: Synthetic oligonucleotide
  Target: SCN10A; (-) strand; PAM type: YTN; PAM sequence: CTT
ccctgtcatcacccaacccc

SEQ ID NO: 42507 - DNA, 20 bp, Artificial Sequence
  Description of Artificial Sequence: Synthetic oligonucleotide
  Target: SCN10A; (-) strand; PAM type: YTN; PAM sequence: TTC
ttccctgtcatcacccaacc

SEQ ID NO: 42508 - DNA, 20 bp, Artificial Sequence
  Description of Artificial Sequence: Synthetic oligonucleotide
  Target: SCN10A; (-) strand; PAM type: YTN; PAM sequence: CTT
cttccctgtcatcacccaac

SEQ ID NO: 42509 - DNA, 20 bp, Artificial Sequence
  Description of Artificial Sequence: Synthetic oligonucleotide
  Target: SCN10A; (-) strand; PAM type: YTN; PAM sequence: TTG
acatcccagcttcttccctg

SEQ ID NO: 42510 - DNA, 20 bp, Artificial Sequence
  Description of Artificial Sequence: Synthetic oligonucleotide
  Target: SCN10A; (-) strand; PAM type: YTN; PAM sequence: TTT
gacatcccagcttcttccct

SEQ ID NO: 42511 - DNA, 20 bp, Artificial Sequence
  Description of Artificial Sequence: Synthetic oligonucleotide
  Target: SCN10A; (-) strand; PAM type: YTN; PAM sequence: CTT
tgacatcccagcttcttccc

SEQ ID NO: 42512 - DNA, 20 bp, Artificial Sequence
  Description of Artificial Sequence: Synthetic oligonucleotide
  Target: SCN10A; (-) strand; PAM type: YTN; PAM sequence: CTC
tttgacatcccagcttcttc

SEQ ID NO: 42513 - DNA, 20 bp, Artificial Sequence
  Description of Artificial Sequence: Synthetic oligonucleotide
  Target: SCN10A; (-) strand; PAM type: YTN; PAM sequence: CTC
tctttgacatcccagcttct

SEQ ID NO: 42514 - DNA, 20 bp, Artificial Sequence
  Description of Artificial Sequence: Synthetic oligonucleotide
  Target: SCN10A; (-) strand; PAM type: YTN; PAM sequence: CTC
aatctctctttgacatccca

SEQ ID NO: 42515 - DNA, 20 bp, Artificial Sequence
  Description of Artificial Sequence: Synthetic oligonucleotide
  Target: SCN10A; (-) strand; PAM type: YTN; PAM sequence: CTA
ctcaatctctctttgacatc

SEQ ID NO: 42516 - DNA, 20 bp, Artificial Sequence
  Description of Artificial Sequence: Synthetic oligonucleotide
  Target: SCN10A; (-) strand; PAM type: YTN; PAM sequence: TTC
ccccacatactactcaatct

SEQ ID NO: 42517 - DNA, 20 bp, Artificial Sequence
  Description of Artificial Sequence: Synthetic oligonucleotide
  Target: SCN10A; (-) strand; PAM type: YTN; PAM sequence: CTT
cccccacatactactcaatc

SEQ ID NO: 42518 - DNA, 20 bp, Artificial Sequence
  Description of Artificial Sequence: Synthetic oligonucleotide
  Target: SCN10A; (-) strand; PAM type: YTN; PAM sequence: TTG
gcaccttcccccacatacta

SEQ ID NO: 42519 - DNA, 20 bp, Artificial Sequence
  Description of Artificial Sequence: Synthetic oligonucleotide
  Target: SCN10A; (-) strand; PAM type: YTN; PAM sequence: TTT
ggcaccttcccccacatact

SEQ ID NO: 42520 - DNA, 20 bp, Artificial Sequence
  Description of Artificial Sequence: Synthetic oligonucleotide
  Target: SCN10A; (-) strand; PAM type: YTN; PAM sequence: TTT
tggcaccttcccccacatac

SEQ ID NO: 42521 - DNA, 20 bp, Artificial Sequence
  Description of Artificial Sequence: Synthetic oligonucleotide
  Target: SCN10A; (-) strand; PAM type: YTN; PAM sequence: TTT
ttggcaccttcccccacata

SEQ ID NO: 42522 - DNA, 20 bp, Artificial Sequence
  Description of Artificial Sequence: Synthetic oligonucleotide
  Target: SCN10A; (-) strand; PAM type: YTN; PAM sequence: TTG
gcaaaaacatgaaagttttt

SEQ ID NO: 42523 - DNA, 20 bp, Artificial Sequence
  Description of Artificial Sequence: Synthetic oligonucleotide
  Target: SCN10A; (-) strand; PAM type: YTN; PAM sequence: CTT
ggcaaaaacatgaaagtttt

SEQ ID NO: 42524 - DNA, 20 bp, Artificial Sequence
  Description of Artificial Sequence: Synthetic oligonucleotide
  Target: SCN10A; (-) strand; PAM type: YTN; PAM sequence: CTA
gggacaacccttggcaaaaa

SEQ ID NO: 42525 - DNA, 20 bp, Artificial Sequence
  Description of Artificial Sequence: Synthetic oligonucleotide
  Target: SCN10A; (-) strand; PAM type: YTN; PAM sequence: TTG
agccagatgccaaggaggtg

SEQ ID NO: 42526 - DNA, 20 bp, Artificial Sequence
  Description of Artificial Sequence: Synthetic oligonucleotide
  Target: SCN10A; (-) strand; PAM type: YTN; PAM sequence: TTT
gagccagatgccaaggaggt

SEQ ID NO: 42527 - DNA, 20 bp, Artificial Sequence
  Description of Artificial Sequence: Synthetic oligonucleotide
  Target: SCN10A; (-) strand; PAM type: YTN; PAM sequence: TTG
aatccacatttgagccagat

SEQ ID NO: 42528 - DNA, 20 bp, Artificial Sequence
  Description of Artificial Sequence: Synthetic oligonucleotide
  Target: SCN10A; (-) strand; PAM type: YTN; PAM sequence: CTG
gagtaagattgaatccacat

SEQ ID NO: 42529 - DNA, 20 bp, Artificial Sequence
  Description of Artificial Sequence: Synthetic oligonucleotide
  Target: SCN10A; (-) strand; PAM type: YTN; PAM sequence: TTG
tggctggagtaagattgaat

SEQ ID NO: 42530 - DNA, 20 bp, Artificial Sequence
  Description of Artificial Sequence: Synthetic oligonucleotide
  Target: SCN10A; (-) strand; PAM type: YTN; PAM sequence: CTT
gtggctggagtaagattgaa

SEQ ID NO: 42531 - DNA, 20 bp, Artificial Sequence
  Description of Artificial Sequence: Synthetic oligonucleotide
  Target: SCN10A; (-) strand; PAM type: YTN; PAM sequence: TTA
cttgtggctggagtaagatt

SEQ ID NO: 42532 - DNA, 20 bp, Artificial Sequence
  Description of Artificial Sequence: Synthetic oligonucleotide
  Target: SCN10A; (-) strand; PAM type: YTN; PAM sequence: TTT
acttgtggctggagtaagat

SEQ ID NO: 42533 - DNA, 20 bp, Artificial Sequence
  Description of Artificial Sequence: Synthetic oligonucleotide
  Target: SCN10A; (-) strand; PAM type: YTN; PAM sequence: CTT
tacttgtggctggagtaaga

SEQ ID NO: 42534 - DNA, 20 bp, Artificial Sequence
  Description of Artificial Sequence: Synthetic oligonucleotide
  Target: SCN10A; (-) strand; PAM type: YTN; PAM sequence: CTG
gcctttacttgtggctggag

SEQ ID NO: 42535 - DNA, 20 bp, Artificial Sequence
  Description of Artificial Sequence: Synthetic oligonucleotide
  Target: SCN10A; (-) strand; PAM type: YTN; PAM sequence: CTG
agtccacactggcctttact

SEQ ID NO: 42536 - DNA, 20 bp, Artificial Sequence
  Description of Artificial Sequence: Synthetic oligonucleotide
  Target: SCN10A; (-) strand; PAM type: YTN; PAM sequence: CTG
agaagcaagcagctgagtcc

SEQ ID NO: 42537 - DNA, 20 bp, Artificial Sequence
  Description of Artificial Sequence: Synthetic oligonucleotide
  Target: SCN10A; (-) strand; PAM type: YTN; PAM sequence: TTA
ctgagaagcaagcagctgag

SEQ ID NO: 42538 - DNA, 20 bp, Artificial Sequence
  Description of Artificial Sequence: Synthetic oligonucleotide
  Target: SCN10A; (-) strand; PAM type: YTN; PAM sequence: CTT
actgagaagcaagcagctga

SEQ ID NO: 42539 - DNA, 20 bp, Artificial Sequence
  Description of Artificial Sequence: Synthetic oligonucleotide
  Target: SCN10A; (-) strand; PAM type: YTN; PAM sequence: CTA
agacttactgagaagcaagc

SEQ ID NO: 42540 - DNA, 20 bp, Artificial Sequence
  Description of Artificial Sequence: Synthetic oligonucleotide
  Target: SCN10A; (-) strand; PAM type: YTN; PAM sequence: TTC
aagtcatgggtaatgagagg

SEQ ID NO: 42541 - DNA, 20 bp, Artificial Sequence
  Description of Artificial Sequence: Synthetic oligonucleotide
  Target: SCN10A; (-) strand; PAM type: YTN; PAM sequence: CTG
agtcccaaccacattcaagt

SEQ ID NO: 42542 - DNA, 20 bp, Artificial Sequence
  Description of Artificial Sequence: Synthetic oligonucleotide
  Target: SCN10A; (-) strand; PAM type: YTN; PAM sequence: TTA
ggtgaaaggctgagtcccaa

SEQ ID NO: 42543 - DNA, 20 bp, Artificial Sequence
  Description of Artificial Sequence: Synthetic oligonucleotide
  Target: SCN10A; (-) strand; PAM type: YTN; PAM sequence: TTA
aaattaggtgaaaggctgag

SEQ ID NO: 42544 - DNA, 20 bp, Artificial Sequence
  Description of Artificial Sequence: Synthetic oligonucleotide
  Target: SCN10A; (-) strand; PAM type: YTN; PAM sequence: CTC
aaaattaaaattaggtgaaa

SEQ ID NO: 42545 - DNA, 20 bp, Artificial Sequence
  Description of Artificial Sequence: Synthetic oligonucleotide
  Target: SCN10A; (-) strand; PAM type: YTN; PAM sequence: TTC
agtggagaggagcaggctca

SEQ ID NO: 42546 - DNA, 20 bp, Artificial Sequence
  Description of Artificial Sequence: Synthetic oligonucleotide
  Target: SCN10A; (-) strand; PAM type: YTN; PAM sequence: CTC
catcaacaagttcagtggag

SEQ ID NO: 42547 - DNA, 20 bp, Artificial Sequence
  Description of Artificial Sequence: Synthetic oligonucleotide
  Target: SCN10A; (-) strand; PAM type: YTN; PAM sequence: TTG
agtatccctccatcaacaag

SEQ ID NO: 42548 - DNA, 20 bp, Artificial Sequence
  Description of Artificial Sequence: Synthetic oligonucleotide
  Target: SCN10A; (-) strand; PAM type: YTN; PAM sequence: CTC
attgagtatccctccatcaa

SEQ ID NO: 42549 - DNA, 20 bp, Artificial Sequence
  Description of Artificial Sequence: Synthetic oligonucleotide
  Target: SCN10A; (-) strand; PAM type: YTN; PAM sequence: TTA
ggctcattgagtatccctcc

SEQ ID NO: 42550 - DNA, 20 bp, Artificial Sequence
  Description of Artificial Sequence: Synthetic oligonucleotide
  Target: SCN10A; (-) strand; PAM type: YTN; PAM sequence: CTT
aggctcattgagtatccctc

SEQ ID NO: 42551 - DNA, 20 bp, Artificial Sequence
  Description of Artificial Sequence: Synthetic oligonucleotide
  Target: SCN10A; (-) strand; PAM type: YTN; PAM sequence: CTG
agcaaaagtccttaggctca

SEQ ID NO: 42552 - DNA, 20 bp, Artificial Sequence
  Description of Artificial Sequence: Synthetic oligonucleotide
  Target: SCN10A; (-) strand; PAM type: YTN; PAM sequence: TTG
agtgaacctgagcaaaagtc

SEQ ID NO: 42553 - DNA, 20 bp, Artificial Sequence
  Description of Artificial Sequence: Synthetic oligonucleotide
  Target: SCN10A; (-) strand; PAM type: YTN; PAM sequence: TTT
gagtgaacctgagcaaaagt

SEQ ID NO: 42554 - DNA, 20 bp, Artificial Sequence
  Description of Artificial Sequence: Synthetic oligonucleotide
  Target: SCN10A; (-) strand; PAM type: YTN; PAM sequence: CTG
gatttgagtgaacctgagca

SEQ ID NO: 42555 - DNA, 20 bp, Artificial Sequence
  Description of Artificial Sequence: Synthetic oligonucleotide
  Target: SCN10A; (-) strand; PAM type: YTN; PAM sequence: CTA
aatcacccatacaatcaaga

SEQ ID NO: 42556 - DNA, 20 bp, Artificial Sequence
  Description of Artificial Sequence: Synthetic oligonucleotide
  Target: SCN10A; (-) strand; PAM type: YTN; PAM sequence: TTC
ctaaatcacccatacaatca

SEQ ID NO: 42557 - DNA, 20 bp, Artificial Sequence
  Description of Artificial Sequence: Synthetic oligonucleotide
  Target: SCN10A; (-) strand; PAM type: YTN; PAM sequence: CTT
cctaaatcacccatacaatc

SEQ ID NO: 42558 - DNA, 20 bp, Artificial Sequence
  Description of Artificial Sequence: Synthetic oligonucleotide
  Target: SCN10A; (-) strand; PAM type: YTN; PAM sequence: TTC
ttcctaaatcacccatacaa

SEQ ID NO: 42559 - DNA, 20 bp, Artificial Sequence
  Description of Artificial Sequence: Synthetic oligonucleotide
  Target: SCN10A; (-) strand; PAM type: YTN; PAM sequence: TTT
cttcctaaatcacccataca

SEQ ID NO: 42560 - DNA, 20 bp, Artificial Sequence
  Description of Artificial Sequence: Synthetic oligonucleotide
  Target: SCN10A; (-) strand; PAM type: YTN; PAM sequence: CTT
tcttcctaaatcacccatac

SEQ ID NO: 42561 - DNA, 20 bp, Artificial Sequence
  Description of Artificial Sequence: Synthetic oligonucleotide
  Target: SCN10A; (-) strand; PAM type: YTN; PAM sequence: CTG
taggggcacagctttcttcc

SEQ ID NO: 42562 - DNA, 20 bp, Artificial Sequence
  Description of Artificial Sequence: Synthetic oligonucleotide
  Target: SCN10A; (-) strand; PAM type: YTN; PAM sequence: CTC
tgtaggggcacagctttctt

SEQ ID NO: 42563 - DNA, 20 bp, Artificial Sequence
  Description of Artificial Sequence: Synthetic oligonucleotide
  Target: SCN10A; (-) strand; PAM type: YTN; PAM sequence: TTC
agacctctgtaggggcacag

SEQ ID NO: 42564 - DNA, 20 bp, Artificial Sequence
  Description of Artificial Sequence: Synthetic oligonucleotide
  Target: SCN10A; (-) strand; PAM type: YTN; PAM sequence: TTA
caatggggagtggggagtga

SEQ ID NO: 42565 - DNA, 20 bp, Artificial Sequence
  Description of Artificial Sequence: Synthetic oligonucleotide
  Target: SCN10A; (-) strand; PAM type: YTN; PAM sequence: CTG
ataagaagtattacaatggg

SEQ ID NO: 42566 - DNA, 20 bp, Artificial Sequence
  Description of Artificial Sequence: Synthetic oligonucleotide
  Target: SCN10A; (-) strand; PAM type: YTN; PAM sequence: TTC
tgataagaagtattacaatg

SEQ ID NO: 42567 - DNA, 20 bp, Artificial Sequence
  Description of Artificial Sequence: Synthetic oligonucleotide
  Target: SCN10A; (-) strand; PAM type: YTN; PAM sequence: CTA
gattctgataagaagtatta

SEQ ID NO: 42568 - DNA, 20 bp, Artificial Sequence
  Description of Artificial Sequence: Synthetic oligonucleotide
  Target: SCN10A; (-) strand; PAM type: YTN; PAM sequence: CTA
gtctagattctgataagaag

SEQ ID NO: 42569 - DNA, 20 bp, Artificial Sequence
  Description of Artificial Sequence: Synthetic oligonucleotide
  Target: SCN10A; (-) strand; PAM type: YTN; PAM sequence: TTA
ctagtctagattctgataag

SEQ ID NO: 42570 - DNA, 20 bp, Artificial Sequence
  Description of Artificial Sequence: Synthetic oligonucleotide
  Target: SCN10A; (-) strand; PAM type: YTN; PAM sequence: TTA
ttactagtctagattctgat

SEQ ID NO: 42571 - DNA, 20 bp, Artificial Sequence
  Description of Artificial Sequence: Synthetic oligonucleotide
  Target: SCN10A; (-) strand; PAM type: YTN; PAM sequence: TTT
attactagtctagattctga

SEQ ID NO: 42572 - DNA, 20 bp, Artificial Sequence
  Description of Artificial Sequence: Synthetic oligonucleotide
  Target: SCN10A; (-) strand; PAM type: YTN; PAM sequence: TTG
aaatagtggtcatgaattta

SEQ ID NO: 42573 - DNA, 20 bp, Artificial Sequence
  Description of Artificial Sequence: Synthetic oligonucleotide
  Target: SCN10A; (-) strand; PAM type: YTN; PAM sequence: TTT
gaaatagtggtcatgaattt

SEQ ID NO: 42574 - DNA, 20 bp, Artificial Sequence
  Description of Artificial Sequence: Synthetic oligonucleotide
  Target: SCN10A; (-) strand; PAM type: YTN; PAM sequence: TTT
tgaaatagtggtcatgaatt

SEQ ID NO: 42575 - DNA, 20 bp, Artificial Sequence
  Description of Artificial Sequence: Synthetic oligonucleotide
  Target: SCN10A; (-) strand; PAM type: YTN; PAM sequence: CTG
tattttgaaatagtggtcat

SEQ ID NO: 42576 - DNA, 20 bp, Artificial Sequence
  Description of Artificial Sequence: Synthetic oligonucleotide
  Target: SCN10A; (-) strand; PAM type: YTN; PAM sequence: TTG
acactgtattttgaaatagt

SEQ ID NO: 42577 - DNA, 20 bp, Artificial Sequence
  Description of Artificial Sequence: Synthetic oligonucleotide
  Target: SCN10A; (-) strand; PAM type: YTN; PAM sequence: TTT
gacactgtattttgaaatag

SEQ ID NO: 42578 - DNA, 20 bp, Artificial Sequence
  Description of Artificial Sequence: Synthetic oligonucleotide
  Target: SCN10A; (-) strand; PAM type: YTN; PAM sequence: TTT
tgacactgtattttgaaata

SEQ ID NO: 42579 - DNA, 20 bp, Artificial Sequence
  Description of Artificial Sequence: Synthetic oligonucleotide
  Target: SCN10A; (-) strand; PAM type: YTN; PAM sequence: CTT
ttgacactgtattttgaaat

SEQ ID NO: 42580 - DNA, 20 bp, Artificial Sequence
  Description of Artificial Sequence: Synthetic oligonucleotide
  Target: SCN10A; (-) strand; PAM type: YTN; PAM sequence: TTA
caagagaaaaaagtgatgac

SEQ ID NO: 42581 - DNA, 20 bp, Artificial Sequence
  Description of Artificial Sequence: Synthetic oligonucleotide
  Target: SCN10A; (-) strand; PAM type: YTN; PAM sequence: TTT
acaagagaaaaaagtgatga

SEQ ID NO: 42582 - DNA, 20 bp, Artificial Sequence
  Description of Artificial Sequence: Synthetic oligonucleotide
  Target: SCN10A; (-) strand; PAM type: YTN; PAM sequence: TTG
tcagaacaaagtgaaaaaca

SEQ ID NO: 42583 - DNA, 20 bp, Artificial Sequence
  Description of Artificial Sequence: Synthetic oligonucleotide
  Target: SCN10A; (-) strand; PAM type: YTN; PAM sequence: TTT
gtcagaacaaagtgaaaaac

SEQ ID NO: 42584 - DNA, 20 bp, Artificial Sequence
  Description of Artificial Sequence: Synthetic oligonucleotide
  Target: SCN10A; (-) strand; PAM type: YTN; PAM sequence: CTT
tgtcagaacaaagtgaaaaa

SEQ ID NO: 42585 - DNA, 20 bp, Artificial Sequence
  Description of Artificial Sequence: Synthetic oligonucleotide
  Target: SCN10A; (-) strand; PAM type: YTN; PAM sequence: TTC
aaactttgtcagaacaaagt

SEQ ID NO: 42586 - DNA, 20 bp, Artificial Sequence
  Description of Artificial Sequence: Synthetic oligonucleotide
  Target: SCN10A; (-) strand; PAM type: YTN; PAM sequence: CTT
caaactttgtcagaacaaag

SEQ ID NO: 42587 - DNA, 20 bp, Artificial Sequence
  Description of Artificial Sequence: Synthetic oligonucleotide
  Target: SCN10A; (-) strand; PAM type: YTN; PAM sequence: TTA
cttcaaactttgtcagaaca

SEQ ID NO: 42588 - DNA, 20 bp, Artificial Sequence
  Description of Artificial Sequence: Synthetic oligonucleotide
  Target: SCN10A; (-) strand; PAM type: YTN; PAM sequence: TTT
acttcaaactttgtcagaac

SEQ ID NO: 42589 - DNA, 20 bp, Artificial Sequence
  Description of Artificial Sequence: Synthetic oligonucleotide
  Target: SCN10A; (-) strand; PAM type: YTN; PAM sequence: TTG
cataatttacttcaaacttt

SEQ ID NO: 42590 - DNA, 20 bp, Artificial Sequence
  Description of Artificial Sequence: Synthetic oligonucleotide
  Target: SCN10A; (-) strand; PAM type: YTN; PAM sequence: TTT
gcataatttacttcaaactt

SEQ ID NO: 42591 - DNA, 20 bp, Artificial Sequence
  Description of Artificial Sequence: Synthetic oligonucleotide
  Target: SCN10A; (-) strand; PAM type: YTN; PAM sequence: TTA
aatcaaggtataggatttgc

SEQ ID NO: 42592 - DNA, 20 bp, Artificial Sequence
  Description of Artificial Sequence: Synthetic oligonucleotide
  Target: SCN10A; (-) strand; PAM type: YTN; PAM sequence: TTT
aaatcaaggtataggatttg

SEQ ID NO: 42593 - DNA, 20 bp, Artificial Sequence
  Description of Artificial Sequence: Synthetic oligonucleotide
  Target: SCN10A; (-) strand; PAM type: YTN; PAM sequence: TTT
taaatcaaggtataggattt

SEQ ID NO: 42594 - DNA, 20 bp, Artificial Sequence
  Description of Artificial Sequence: Synthetic oligonucleotide
  Target: SCN10A; (-) strand; PAM type: YTN; PAM sequence: TTT
ttaaatcaaggtataggatt

SEQ ID NO: 42595 - DNA, 20 bp, Artificial Sequence
  Description of Artificial Sequence: Synthetic oligonucleotide
  Target: SCN10A; (-) strand; PAM type: YTN; PAM sequence: TTT
tttaaatcaaggtataggat

SEQ ID NO: 42596 - DNA, 20 bp, Artificial Sequence
  Description of Artificial Sequence: Synthetic oligonucleotide
  Target: SCN10A; (-) strand; PAM type: YTN; PAM sequence: TTT
ttttaaatcaaggtatagga

SEQ ID NO: 42597 - DNA, 20 bp, Artificial Sequence
  Description of Artificial Sequence: Synthetic oligonucleotide
  Target: SCN10A; (-) strand; PAM type: YTN; PAM sequence: TTA
gatttttttaaatcaaggta

SEQ ID NO: 42598 - DNA, 20 bp, Artificial Sequence
  Description of Artificial Sequence: Synthetic oligonucleotide
  Target: SCN10A; (-) strand; PAM type: YTN; PAM sequence: CTA
ttagatttttttaaatcaag

SEQ ID NO: 42599 - DNA, 20 bp, Artificial Sequence
  Description of Artificial Sequence: Synthetic oligonucleotide
  Target: SCN10A; (-) strand; PAM type: YTN; PAM sequence: TTA
gccaagctattagatttttt

SEQ ID NO: 42600 - DNA, 20 bp, Artificial Sequence
  Description of Artificial Sequence: Synthetic oligonucleotide
  Target: SCN10A; (-) strand; PAM type: YTN; PAM sequence: CTG
ttagccaagctattagattt

SEQ ID NO: 42601 - DNA, 20 bp, Artificial Sequence
  Description of Artificial Sequence: Synthetic oligonucleotide
  Target: SCN10A; (-) strand; PAM type: YTN; PAM sequence: TTC
tgttagccaagctattagat

SEQ ID NO: 42602 - DNA, 20 bp, Artificial Sequence
  Description of Artificial Sequence: Synthetic oligonucleotide
  Target: SCN10A; (-) strand; PAM type: YTN; PAM sequence: TTA
tggagacatgcattctgtta

SEQ ID NO: 42603 - DNA, 20 bp, Artificial Sequence
  Description of Artificial Sequence: Synthetic oligonucleotide
  Target: SCN10A; (-) strand; PAM type: YTN; PAM sequence: CTA
aatgaattatggagacatgc

SEQ ID NO: 42604 - DNA, 20 bp, Artificial Sequence
  Description of Artificial Sequence: Synthetic oligonucleotide
  Target: SCN10A; (-) strand; PAM type: YTN; PAM sequence: TTC
cctaaatgaattatggagac

SEQ ID NO: 42605 - DNA, 20 bp, Artificial Sequence
  Description of Artificial Sequence: Synthetic oligonucleotide
  Target: SCN10A; (-) strand; PAM type: YTN; PAM sequence: TTT
ccctaaatgaattatggaga

SEQ ID NO: 42606 - DNA, 20 bp, Artificial Sequence
  Description of Artificial Sequence: Synthetic oligonucleotide
  Target: SCN10A; (-) strand; PAM type: YTN; PAM sequence: CTT
tccctaaatgaattatggag

SEQ ID NO: 42607 - DNA, 20 bp, Artificial Sequence
  Description of Artificial Sequence: Synthetic oligonucleotide
  Target: SCN10A; (-) strand; PAM type: YTN; PAM sequence: TTA
acaaaggaacaagcctttcc

SEQ ID NO: 42608 - DNA, 20 bp, Artificial Sequence
  Description of Artificial Sequence: Synthetic oligonucleotide
  Target: SCN10A; (-) strand; PAM type: YTN; PAM sequence: TTT
aacaaaggaacaagcctttc

SEQ ID NO: 42609 - DNA, 20 bp, Artificial Sequence
  Description of Artificial Sequence: Synthetic oligonucleotide
  Target: SCN10A; (-) strand; PAM type: YTN; PAM sequence: TTC
cccacacaagggaaaagtcc

SEQ ID NO: 42610 - DNA, 20 bp, Artificial Sequence
  Description of Artificial Sequence: Synthetic oligonucleotide
  Target: SCN10A; (-) strand; PAM type: YTN; PAM sequence: CTT
ccccacacaagggaaaagtc

SEQ ID NO: 42611 - DNA, 20 bp, Artificial Sequence
  Description of Artificial Sequence: Synthetic oligonucleotide
  Target: SCN10A; (-) strand; PAM type: YTN; PAM sequence: TTA
gcccttccccacacaaggga

SEQ ID NO: 42612 - DNA, 20 bp, Artificial Sequence
  Description of Artificial Sequence: Synthetic oligonucleotide
  Target: SCN10A; (-) strand; PAM type: YTN; PAM sequence: TTC
attagcccttccccacacaa

SEQ ID NO: 42613 - DNA, 20 bp, Artificial Sequence
  Description of Artificial Sequence: Synthetic oligonucleotide
  Target: SCN10A; (-) strand; PAM type: YTN; PAM sequence: TTT
cattagcccttccccacaca

SEQ ID NO: 42614 - DNA, 20 bp, Artificial Sequence
  Description of Artificial Sequence: Synthetic oligonucleotide
  Target: SCN10A; (-) strand; PAM type: YTN; PAM sequence: CTG
atgacacaatttcattagcc

SEQ ID NO: 42615 - DNA, 20 bp, Artificial Sequence
  Description of Artificial Sequence: Synthetic oligonucleotide
  Target: SCN10A; (-) strand; PAM type: YTN; PAM sequence: TTG
ctgatgacacaatttcatta

SEQ ID NO: 42616 - DNA, 20 bp, Artificial Sequence
  Description of Artificial Sequence: Synthetic oligonucleotide
  Target: SCN10A; (-) strand; PAM type: YTN; PAM sequence: TTA
gtgaagaaaatcacaggtat

SEQ ID NO: 42617 - DNA, 20 bp, Artificial Sequence
  Description of Artificial Sequence: Synthetic oligonucleotide
  Target: SCN10A; (-) strand; PAM type: YTN; PAM sequence: CTA
agatgcagcattagtgaaga

SEQ ID NO: 42618 - DNA, 20 bp, Artificial Sequence
  Description of Artificial Sequence: Synthetic oligonucleotide
  Target: SCN10A; (-) strand; PAM type: YTN; PAM sequence: CTG
tggctaagatgcagcattag

SEQ ID NO: 42619 - DNA, 20 bp, Artificial Sequence
  Description of Artificial Sequence: Synthetic oligonucleotide
  Target: SCN10A; (-) strand; PAM type: YTN; PAM sequence: TTC
tgtggctaagatgcagcatt

SEQ ID NO: 42620 - DNA, 20 bp, Artificial Sequence
  Description of Artificial Sequence: Synthetic oligonucleotide
  Target: SCN10A; (-) strand; PAM type: YTN; PAM sequence: TTT
ctgtggctaagatgcagcat

SEQ ID NO: 42621 - DNA, 20 bp, Artificial Sequence
  Description of Artificial Sequence: Synthetic oligonucleotide
  Target: SCN10A; (-) strand; PAM type: YTN; PAM sequence: CTT
tctgtggctaagatgcagca

SEQ ID NO: 42622 - DNA, 20 bp, Artificial Sequence
  Description of Artificial Sequence: Synthetic oligonucleotide
  Target: SCN10A; (-) strand; PAM type: YTN; PAM sequence: CTA
cataaactttctgtggctaa

SEQ ID NO: 42623 - DNA, 20 bp, Artificial Sequence
  Description of Artificial Sequence: Synthetic oligonucleotide
  Target: SCN10A; (-) strand; PAM type: YTN; PAM sequence: TTC
tacataaactttctgtggct

SEQ ID NO: 42624 - DNA, 20 bp, Artificial Sequence
  Description of Artificial Sequence: Synthetic oligonucleotide
  Target: SCN10A; (-) strand; PAM type: YTN; PAM sequence: CTT
ctacataaactttctgtggc

SEQ ID NO: 42625 - DNA, 20 bp, Artificial Sequence
  Description of Artificial Sequence: Synthetic oligonucleotide
  Target: SCN10A; (-) strand; PAM type: YTN; PAM sequence: CTG
tgtccttctacataaacttt

SEQ ID NO: 42626 - DNA, 20 bp, Artificial Sequence
  Description of Artificial Sequence: Synthetic oligonucleotide
  Target: SCN10A; (-) strand; PAM type: YTN; PAM sequence: TTG
gccctgtgtccttctacata

SEQ ID NO: 42627 - DNA, 20 bp, Artificial Sequence
  Description of Artificial Sequence: Synthetic oligonucleotide
  Target: SCN10A; (-) strand; PAM type: YTN; PAM sequence: CTC
cagtgaatggaattggccct

SEQ ID NO: 42628 - DNA, 20 bp, Artificial Sequence
  Description of Artificial Sequence: Synthetic oligonucleotide
  Target: SCN10A; (-) strand; PAM type: YTN; PAM sequence: CTG
agccatccactccagtgaat

SEQ ID NO: 42629 - DNA, 20 bp, Artificial Sequence
  Description of Artificial Sequence: Synthetic oligonucleotide
  Target: SCN10A; (-) strand; PAM type: YTN; PAM sequence: TTC
tgagccatccactccagtga

SEQ ID NO: 42630 - DNA, 20 bp, Artificial Sequence
  Description of Artificial Sequence: Synthetic oligonucleotide
  Target: SCN10A; (-) strand; PAM type: YTN; PAM sequence: TTT
ctgagccatccactccagtg

SEQ ID NO: 42631 - DNA, 20 bp, Artificial Sequence
  Description of Artificial Sequence: Synthetic oligonucleotide
  Target: SCN10A; (-) strand; PAM type: YTN; PAM sequence: TTC
aaagaatttctgagccatcc

SEQ ID NO: 42632 - DNA, 20 bp, Artificial Sequence
  Description of Artificial Sequence: Synthetic oligonucleotide
  Target: SCN10A; (-) strand; PAM type: YTN; PAM sequence: CTT
caaagaatttctgagccatc

SEQ ID NO: 42633 - DNA, 20 bp, Artificial Sequence
  Description of Artificial Sequence: Synthetic oligonucleotide
  Target: SCN10A; (-) strand; PAM type: YTN; PAM sequence: TTG
atcgtcttcaaagaatttct

SEQ ID NO: 42634 - DNA, 20 bp, Artificial Sequence
  Description of Artificial Sequence: Synthetic oligonucleotide
  Target: SCN10A; (-) strand; PAM type: YTN; PAM sequence: TTG
ttgatcgtcttcaaagaatt

SEQ ID NO: 42635 - DNA, 20 bp, Artificial Sequence
  Description of Artificial Sequence: Synthetic oligonucleotide
  Target: SCN10A; (-) strand; PAM type: YTN; PAM sequence: TTA
ttgttgatcgtcttcaaaga

SEQ ID NO: 42636 - DNA, 20 bp, Artificial Sequence
  Description of Artificial Sequence: Synthetic oligonucleotide
  Target: SCN10A; (-) strand; PAM type: YTN; PAM sequence: TTG
atgtgtcagaaattattgtt

SEQ ID NO: 42637 - DNA, 20 bp, Artificial Sequence
  Description of Artificial Sequence: Synthetic oligonucleotide
  Target: SCN10A; (-) strand; PAM type: YTN; PAM sequence: TTG
ggggtgaagatgttgatgtg

SEQ ID NO: 42638 - DNA, 20 bp, Artificial Sequence
  Description of Artificial Sequence: Synthetic oligonucleotide
  Target: SCN10A; (-) strand; PAM type: YTN; PAM sequence: TTT
gggggtgaagatgttgatgt

SEQ ID NO: 42639 - DNA, 20 bp, Artificial Sequence
  Description of Artificial Sequence: Synthetic oligonucleotide
  Target: SCN10A; (-) strand; PAM type: YTN; PAM sequence: TTG
ggaatggatgaacaggtttg

SEQ ID NO: 42640 - DNA, 20 bp, Artificial Sequence
  Description of Artificial Sequence: Synthetic oligonucleotide
  Target: SCN10A; (-) strand; PAM type: YTN; PAM sequence: TTT
gggaatggatgaacaggttt

SEQ ID NO: 42641 - DNA, 20 bp, Artificial Sequence
  Description of Artificial Sequence: Synthetic oligonucleotide
  Target: SCN10A; (-) strand; PAM type: YTN; PAM sequence: TTT
tgggaatggatgaacaggtt

SEQ ID NO: 42642 - DNA, 20 bp, Artificial Sequence
  Description of Artificial Sequence: Synthetic oligonucleotide
  Target: SCN10A; (-) strand; PAM type: YTN; PAM sequence: TTT
ttgggaatggatgaacaggt

SEQ ID NO: 42643 - DNA, 20 bp, Artificial Sequence
  Description of Artificial Sequence: Synthetic oligonucleotide
  Target: SCN10A; (-) strand; PAM type: YTN; PAM sequence: TTT
tttgggaatggatgaacagg

SEQ ID NO: 42644 - DNA, 20 bp, Artificial Sequence
  Description of Artificial Sequence: Synthetic oligonucleotide
  Target: SCN10A; (-) strand; PAM type: YTN; PAM sequence: CTT
ttttgggaatggatgaacag

SEQ ID NO: 42645 - DNA, 20 bp, Artificial Sequence
  Description of Artificial Sequence: Synthetic oligonucleotide
  Target: SCN10A; (-) strand; PAM type: YTN; PAM sequence: CTA
agatagcacttttttgggaa

SEQ ID NO: 42646 - DNA, 20 bp, Artificial Sequence
  Description of Artificial Sequence: Synthetic oligonucleotide
  Target: SCN10A; (-) strand; PAM type: YTN; PAM sequence: CTG
agaggccctaagatagcact

SEQ ID NO: 42647 - DNA, 20 bp, Artificial Sequence
  Description of Artificial Sequence: Synthetic oligonucleotide
  Target: SCN10A; (-) strand; PAM type: YTN; PAM sequence: CTC
tgagaggccctaagatagca

SEQ ID NO: 42648 - DNA, 20 bp, Artificial Sequence
  Description of Artificial Sequence: Synthetic oligonucleotide
  Target: SCN10A; (-) strand; PAM type: YTN; PAM sequence: CTG
ccagaagatagaaaacatca

SEQ ID NO: 42649 - DNA, 20 bp, Artificial Sequence
  Description of Artificial Sequence: Synthetic oligonucleotide
  Target: SCN10A; (-) strand; PAM type: YTN; PAM sequence: TTC
tgccagaagatagaaaacat

SEQ ID NO: 42650 - DNA, 20 bp, Artificial Sequence
  Description of Artificial Sequence: Synthetic oligonucleotide
  Target: SCN10A; (-) strand; PAM type: YTN; PAM sequence: CTT
ctgccagaagatagaaaaca

SEQ ID NO: 42651 - DNA, 20 bp, Artificial Sequence
  Description of Artificial Sequence: Synthetic oligonucleotide
  Target: SCN10A; (-) strand; PAM type: YTN; PAM sequence: CTC
agtcttctgccagaagatag

SEQ ID NO: 42652 - DNA, 20 bp, Artificial Sequence
  Description of Artificial Sequence: Synthetic oligonucleotide
  Target: SCN10A; (-) strand; PAM type: YTN; PAM sequence: TTC
tcagtcttctgccagaagat

SEQ ID NO: 42653 - DNA, 20 bp, Artificial Sequence
  Description of Artificial Sequence: Synthetic oligonucleotide
  Target: SCN10A; (-) strand; PAM type: YTN; PAM sequence: CTT
ctcagtcttctgccagaaga

SEQ ID NO: 42654 - DNA, 20 bp, Artificial Sequence
  Description of Artificial Sequence: Synthetic oligonucleotide
  Target: SCN10A; (-) strand; PAM type: YTN; PAM sequence: TTC
ttctcagtcttctgccagaa

SEQ ID NO: 42655 - DNA, 20 bp, Artificial Sequence
  Description of Artificial Sequence: Synthetic oligonucleotide
  Target: SCN10A; (-) strand; PAM type: YTN; PAM sequence: CTA
agttcttctcagtcttctgc

SEQ ID NO: 42656 - DNA, 20 bp, Artificial Sequence
  Description of Artificial Sequence: Synthetic oligonucleotide
  Target: SCN10A; (-) strand; PAM type: YTN; PAM sequence: CTA
cccataccacacatgatatc

SEQ ID NO: 42657 - DNA, 20 bp, Artificial Sequence
  Description of Artificial Sequence: Synthetic oligonucleotide
  Target: SCN10A; (-) strand; PAM type: YTN; PAM sequence: TTA
aatgtactacccataccaca

SEQ ID NO: 42658 - DNA, 20 bp, Artificial Sequence
  Description of Artificial Sequence: Synthetic oligonucleotide
  Target: SCN10A; (-) strand; PAM type: YTN; PAM sequence: CTC
cattaaatgtactacccata

SEQ ID NO: 42659 - DNA, 20 bp, Artificial Sequence
  Description of Artificial Sequence: Synthetic oligonucleotide
  Target: SCN10A; (-) strand; PAM type: YTN; PAM sequence: TTC
ctccattaaatgtactaccc

SEQ ID NO: 42660 - DNA, 20 bp, Artificial Sequence
  Description of Artificial Sequence: Synthetic oligonucleotide
  Target: SCN10A; (-) strand; PAM type: YTN; PAM sequence: TTG
cgttcctccattaaatgtac

SEQ ID NO: 42661 - DNA, 20 bp, Artificial Sequence
  Description of Artificial Sequence: Synthetic oligonucleotide
  Target: SCN10A; (-) strand; PAM type: YTN; PAM sequence: TTT
gcgttcctccattaaatgta

SEQ ID NO: 42662 - DNA, 20 bp, Artificial Sequence
  Description of Artificial Sequence: Synthetic oligonucleotide
  Target: SCN10A; (-) strand; PAM type: YTN; PAM sequence: CTT
tgcgttcctccattaaatgt

SEQ ID NO: 42663 - DNA, 20 bp, Artificial Sequence
  Description of Artificial Sequence: Synthetic oligonucleotide
  Target: SCN10A; (-) strand; PAM type: YTN; PAM sequence: CTC
aagagacatggctttgcgtt

SEQ ID NO: 42664 - DNA, 20 bp, Artificial Sequence
  Description of Artificial Sequence: Synthetic oligonucleotide
  Target: SCN10A; (-) strand; PAM type: YTN; PAM sequence: TTC
ataaagatctcaagagacat

SEQ ID NO: 42665 - DNA, 20 bp, Artificial Sequence
  Description of Artificial Sequence: Synthetic oligonucleotide
  Target: SCN10A; (-) strand; PAM type: YTN; PAM sequence: TTT
cataaagatctcaagagaca

SEQ ID NO: 42666 - DNA, 20 bp, Artificial Sequence
  Description of Artificial Sequence: Synthetic oligonucleotide
  Target: SCN10A; (-) strand; PAM type: YTN; PAM sequence: TTT
tcataaagatctcaagagac

SEQ ID NO: 42667 - DNA, 20 bp, Artificial Sequence
  Description of Artificial Sequence: Synthetic oligonucleotide
  Target: SCN10A; (-) strand; PAM type: YTN; PAM sequence: TTT
ttcataaagatctcaagaga

SEQ ID NO: 42668 - DNA, 20 bp, Artificial Sequence
  Description of Artificial Sequence: Synthetic oligonucleotide
  Target: SCN10A; (-) strand; PAM type: YTN; PAM sequence: TTT
tttcataaagatctcaagag

SEQ ID NO: 42669 - DNA, 20 bp, Artificial Sequence
  Description of Artificial Sequence: Synthetic oligonucleotide
  Target: SCN10A; (-) strand; PAM type: YTN; PAM sequence: CTT
ttttcataaagatctcaaga

SEQ ID NO: 42670 - DNA, 20 bp, Artificial Sequence
  Description of Artificial Sequence: Synthetic oligonucleotide
  Target: SCN10A; (-) strand; PAM type: YTN; PAM sequence: CTC
cttttttcataaagatctca

SEQ ID NO: 42671 - DNA, 20 bp, Artificial Sequence
  Description of Artificial Sequence: Synthetic oligonucleotide
  Target: SCN10A; (-) strand; PAM type: YTN; PAM sequence: TTC
actccttttttcataaagat

SEQ ID NO: 42672 - DNA, 20 bp, Artificial Sequence
  Description of Artificial Sequence: Synthetic oligonucleotide
  Target: SCN10A; (-) strand; PAM type: YTN; PAM sequence: TTT
cactccttttttcataaaga

SEQ ID NO: 42673 - DNA, 20 bp, Artificial Sequence
  Description of Artificial Sequence: Synthetic oligonucleotide
  Target: SCN10A; (-) strand; PAM type: YTN; PAM sequence: CTA
gtttcactccttttttcata

SEQ ID NO: 42674 - DNA, 20 bp, Artificial Sequence
  Description of Artificial Sequence: Synthetic oligonucleotide
  Target: SCN10A; (-) strand; PAM type: YTN; PAM sequence: CTC
tagtttcactccttttttca

SEQ ID NO: 42675 - DNA, 20 bp, Artificial Sequence
  Description of Artificial Sequence: Synthetic oligonucleotide
  Target: SCN10A; (-) strand; PAM type: YTN; PAM sequence: TTA
gggccagactctagtttcac

SEQ ID NO: 42676 - DNA, 20 bp, Artificial Sequence
  Description of Artificial Sequence: Synthetic oligonucleotide
  Target: SCN10A; (-) strand; PAM type: YTN; PAM sequence: TTG
ggcaaaaattagggccagac

SEQ ID NO: 42677 - DNA, 20 bp, Artificial Sequence
  Description of Artificial Sequence: Synthetic oligonucleotide
  Target: SCN10A; (-) strand; PAM type: YTN; PAM sequence: TTA
aagattgggcaaaaattagg

SEQ ID NO: 42678 - DNA, 20 bp, Artificial Sequence
  Description of Artificial Sequence: Synthetic oligonucleotide
  Target: SCN10A; (-) strand; PAM type: YTN; PAM sequence: TTT
aaagattgggcaaaaattag

SEQ ID NO: 42679 - DNA, 20 bp, Artificial Sequence
  Description of Artificial Sequence: Synthetic oligonucleotide
  Target: SCN10A; (-) strand; PAM type: YTN; PAM sequence: CTC
gagtttaaagattgggcaaa

SEQ ID NO: 42680 - DNA, 20 bp, Artificial Sequence
  Description of Artificial Sequence: Synthetic oligonucleotide
  Target: SCN10A; (-) strand; PAM type: YTN; PAM sequence: TTA
tcccactcgagtttaaagat

SEQ ID NO: 42681 - DNA, 20 bp, Artificial Sequence
  Description of Artificial Sequence: Synthetic oligonucleotide
  Target: SCN10A; (-) strand; PAM type: YTN; PAM sequence: CTG
tcaggatccaagatgcagtc

SEQ ID NO: 42682 - DNA, 20 bp, Artificial Sequence
  Description of Artificial Sequence: Synthetic oligonucleotide
  Target: SCN10A; (-) strand; PAM type: YTN; PAM sequence: CTC
ccctgtcaggatccaagatg

SEQ ID NO: 42683 - DNA, 20 bp, Artificial Sequence
  Description of Artificial Sequence: Synthetic oligonucleotide
  Target: SCN10A; (-) strand; PAM type: YTN; PAM sequence: CTA
caggtatagagaggaaatga

SEQ ID NO: 42684 - DNA, 20 bp, Artificial Sequence
  Description of Artificial Sequence: Synthetic oligonucleotide
  Target: SCN10A; (-) strand; PAM type: YTN; PAM sequence: CTA
ccccacgcctacaggtatag

SEQ ID NO: 42685 - DNA, 20 bp, Artificial Sequence
  Description of Artificial Sequence: Synthetic oligonucleotide
  Target: SCN10A; (-) strand; PAM type: YTN; PAM sequence: TTC
taccccacgcctacaggtat

SEQ ID NO: 42686 - DNA, 20 bp, Artificial Sequence
  Description of Artificial Sequence: Synthetic oligonucleotide
  Target: SCN10A; (-) strand; PAM type: YTN; PAM sequence: CTA
tattctaccccacgcctaca

SEQ ID NO: 42687 - DNA, 20 bp, Artificial Sequence
  Description of Artificial Sequence: Synthetic oligonucleotide
  Target: SCN10A; (-) strand; PAM type: YTN; PAM sequence: CTC
cagtatcaccctatattcta

SEQ ID NO: 42688 - DNA, 20 bp, Artificial Sequence
  Description of Artificial Sequence: Synthetic oligonucleotide
  Target: SCN10A; (-) strand; PAM type: YTN; PAM sequence: CTA
ggtcgcagtagatctccagt

SEQ ID NO: 42689 - DNA, 20 bp, Artificial Sequence
  Description of Artificial Sequence: Synthetic oligonucleotide
  Target: SCN10A; (-) strand; PAM type: YTN; PAM sequence: TTA
tgtatcatggtctaggtcgc

SEQ ID NO: 42690 - DNA, 20 bp, Artificial Sequence
  Description of Artificial Sequence: Synthetic oligonucleotide
  Target: SCN10A; (-) strand; PAM type: YTN; PAM sequence: TTG
tgtggttatgtatcatggtc

SEQ ID NO: 42691 - DNA, 20 bp, Artificial Sequence
  Description of Artificial Sequence: Synthetic oligonucleotide
  Target: SCN10A; (-) strand; PAM type: YTN; PAM sequence: CTT
gtgtggttatgtatcatggt

SEQ ID NO: 42692 - DNA, 20 bp, Artificial Sequence
  Description of Artificial Sequence: Synthetic oligonucleotide
  Target: SCN10A; (-) strand; PAM type: YTN; PAM sequence: TTA
aacttgtgtggttatgtatc

SEQ ID NO: 42693 - DNA, 20 bp, Artificial Sequence
  Description of Artificial Sequence: Synthetic oligonucleotide
  Target: SCN10A; (-) strand; PAM type: YTN; PAM sequence: TTA
gaacccagggattaaacttg

SEQ ID NO: 42694 - DNA, 20 bp, Artificial Sequence
  Description of Artificial Sequence: Synthetic oligonucleotide
  Target: SCN10A; (-) strand; PAM type: YTN; PAM sequence: CTA
agtgacagtaagggtagtta

SEQ ID NO: 42695 - DNA, 20 bp, Artificial Sequence
  Description of Artificial Sequence: Synthetic oligonucleotide
  Target: SCN10A; (-) strand; PAM type: YTN; PAM sequence: TTA
agctaagtgacagtaagggt

SEQ ID NO: 42696 - DNA, 20 bp, Artificial Sequence
  Description of Artificial Sequence: Synthetic oligonucleotide
  Target: SCN10A; (-) strand; PAM type: YTN; PAM sequence: TTG
gaggcaggttaagctaagtg

SEQ ID NO: 42697 - DNA, 20 bp, Artificial Sequence
  Description of Artificial Sequence: Synthetic oligonucleotide
  Target: SCN10A; (-) strand; PAM type: YTN; PAM sequence: TTC
aagtacaggattggaggcag

SEQ ID NO: 42698 - DNA, 20 bp, Artificial Sequence
  Description of Artificial Sequence: Synthetic oligonucleotide
  Target: SCN10A; (-) strand; PAM type: YTN; PAM sequence: TTA
gagttcaagtacaggattgg

SEQ ID NO: 42699 - DNA, 20 bp, Artificial Sequence
  Description of Artificial Sequence: Synthetic oligonucleotide
  Target: SCN10A; (-) strand; PAM type: YTN; PAM sequence: TTT
agagttcaagtacaggattg

SEQ ID NO: 42700 - DNA, 20 bp, Artificial Sequence
  Description of Artificial Sequence: Synthetic oligonucleotide
  Target: SCN10A; (-) strand; PAM type: YTN; PAM sequence: TTT
tagagttcaagtacaggatt

SEQ ID NO: 42701 - DNA, 20 bp, Artificial Sequence
  Description of Artificial Sequence: Synthetic oligonucleotide
  Target: SCN10A; (-) strand; PAM type: YTN; PAM sequence: CTC
caacagttttagagttcaag

SEQ ID NO: 42702 - DNA, 20 bp, Artificial Sequence
  Description of Artificial Sequence: Synthetic oligonucleotide
  Target: SCN10A; (-) strand; PAM type: YTN; PAM sequence: TTC
tccaacagttttagagttca

SEQ ID NO: 42703 - DNA, 20 bp, Artificial Sequence
  Description of Artificial Sequence: Synthetic oligonucleotide
  Target: SCN10A; (-) strand; PAM type: YTN; PAM sequence: TTT
ctccaacagttttagagttc

SEQ ID NO: 42704 - DNA, 20 bp, Artificial Sequence
  Description of Artificial Sequence: Synthetic oligonucleotide
  Target: SCN10A; (-) strand; PAM type: YTN; PAM sequence: CTG
agtttctccaacagttttag

SEQ ID NO: 42705 - DNA, 20 bp, Artificial Sequence
  Description of Artificial Sequence: Synthetic oligonucleotide
  Target: SCN10A; (-) strand; PAM type: YTN; PAM sequence: TTG
ggggaagcactgagtttctc

SEQ ID NO: 42706 - DNA, 20 bp, Artificial Sequence
  Description of Artificial Sequence: Synthetic oligonucleotide
  Target: SCN10A; (-) strand; PAM type: YTN; PAM sequence: CTG
ttgggggaagcactgagttt

SEQ ID NO: 42707 - DNA, 20 bp, Artificial Sequence
  Description of Artificial Sequence: Synthetic oligonucleotide
  Target: SCN10A; (-) strand; PAM type: YTN; PAM sequence: TTG
aaatgaatctgttgggggaa

SEQ ID NO: 42708 - DNA, 20 bp, Artificial Sequence
  Description of Artificial Sequence: Synthetic oligonucleotide
  Target: SCN10A; (-) strand; PAM type: YTN; PAM sequence: TTT
gaaatgaatctgttggggga

SEQ ID NO: 42709 - DNA, 20 bp, Artificial Sequence
  Description of Artificial Sequence: Synthetic oligonucleotide
  Target: SCN10A; (-) strand; PAM type: YTN; PAM sequence: CTA
tttgaaatgaatctgttggg

SEQ ID NO: 42710 - DNA, 20 bp, Artificial Sequence
  Description of Artificial Sequence: Synthetic oligonucleotide
  Target: SCN10A; (-) strand; PAM type: YTN; PAM sequence: TTA
cagctatttgaaatgaatct

SEQ ID NO: 42711 - DNA, 20 bp, Artificial Sequence
  Description of Artificial Sequence: Synthetic oligonucleotide
  Target: SCN10A; (-) strand; PAM type: YTN; PAM sequence: TTT
acagctatttgaaatgaatc

SEQ ID NO: 42712 - DNA, 20 bp, Artificial Sequence
  Description of Artificial Sequence: Synthetic oligonucleotide
  Target: SCN10A; (-) strand; PAM type: YTN; PAM sequence: TTT
tacagctatttgaaatgaat

SEQ ID NO: 42713 - DNA, 20 bp, Artificial Sequence
  Description of Artificial Sequence: Synthetic oligonucleotide
  Target: SCN10A; (-) strand; PAM type: YTN; PAM sequence: CTT
ttacagctatttgaaatgaa

SEQ ID NO: 42714 - DNA, 20 bp, Artificial Sequence
  Description of Artificial Sequence: Synthetic oligonucleotide
  Target: SCN10A; (-) strand; PAM type: YTN; PAM sequence: CTG
gagtaaacataccttttaca

SEQ ID NO: 42715 - DNA, 20 bp, Artificial Sequence
  Description of Artificial Sequence: Synthetic oligonucleotide
  Target: SCN10A; (-) strand; PAM type: YTN; PAM sequence: TTC
tggagtaaacatacctttta

SEQ ID NO: 42716 - DNA, 20 bp, Artificial Sequence
  Description of Artificial Sequence: Synthetic oligonucleotide
  Target: SCN10A; (-) strand; PAM type: YTN; PAM sequence: CTT
ctggagtaaacatacctttt

SEQ ID NO: 42717 - DNA, 20 bp, Artificial Sequence
  Description of Artificial Sequence: Synthetic oligonucleotide
  Target: SCN10A; (-) strand; PAM type: YTN; PAM sequence: CTG
gtcttctggagtaaacatac

SEQ ID NO: 42718 - DNA, 20 bp, Artificial Sequence
  Description of Artificial Sequence: Synthetic oligonucleotide
  Target: SCN10A; (-) strand; PAM type: YTN; PAM sequence: CTC
tggtcttctggagtaaacat

SEQ ID NO: 42719 - DNA, 20 bp, Artificial Sequence
  Description of Artificial Sequence: Synthetic oligonucleotide
  Target: SCN10A; (-) strand; PAM type: YTN; PAM sequence: TTC
aaaagaagcaactctggtct

SEQ ID NO: 42720 - DNA, 20 bp, Artificial Sequence
  Description of Artificial Sequence: Synthetic oligonucleotide
  Target: SCN10A; (-) strand; PAM type: YTN; PAM sequence: CTA
ggcccaaggaatgagaagtt

SEQ ID NO: 42721 - DNA, 20 bp, Artificial Sequence
  Description of Artificial Sequence: Synthetic oligonucleotide
  Target: SCN10A; (-) strand; PAM type: YTN; PAM sequence: TTC
ctaggcccaaggaatgagaa

SEQ ID NO: 42722 - DNA, 20 bp, Artificial Sequence
  Description of Artificial Sequence: Synthetic oligonucleotide
  Target: SCN10A; (-) strand; PAM type: YTN; PAM sequence: TTG
ggatgagggtgatgagggtt

SEQ ID NO: 42723 - DNA, 20 bp, Artificial Sequence
  Description of Artificial Sequence: Synthetic oligonucleotide
  Target: SCN10A; (-) strand; PAM type: YTN; PAM sequence: TTG
acgttgggatgagggtgatg

SEQ ID NO: 42724 - DNA, 20 bp, Artificial Sequence
  Description of Artificial Sequence: Synthetic oligonucleotide
  Target: SCN10A; (-) strand; PAM type: YTN; PAM sequence: CTG
ggttgacgttgggatgaggg

SEQ ID NO: 42725 - DNA, 20 bp, Artificial Sequence
  Description of Artificial Sequence: Synthetic oligonucleotide
  Target: SCN10A; (-) strand; PAM type: YTN; PAM sequence: TTA
tggaagagaagatctgggtt

SEQ ID NO: 42726 - DNA, 20 bp, Artificial Sequence
  Description of Artificial Sequence: Synthetic oligonucleotide
  Target: SCN10A; (-) strand; PAM type: YTN; PAM sequence: TTT
atggaagagaagatctgggt

SEQ ID NO: 42727 - DNA, 20 bp, Artificial Sequence
  Description of Artificial Sequence: Synthetic oligonucleotide
  Target: SCN10A; (-) strand; PAM type: YTN; PAM sequence: CTG
tttatggaagagaagatctg

SEQ ID NO: 42728 - DNA, 20 bp, Artificial Sequence
  Description of Artificial Sequence: Synthetic oligonucleotide
  Target: SCN10A; (-) strand; PAM type: YTN; PAM sequence: CTG
agggagtgctgtttatggaa

SEQ ID NO: 42729 - DNA, 20 bp, Artificial Sequence
  Description of Artificial Sequence: Synthetic oligonucleotide
  Target: SCN10A; (-) strand; PAM type: YTN; PAM sequence: CTG
tgtcaggcaggggcctgagg

SEQ ID NO: 42730 - DNA, 20 bp, Artificial Sequence
  Description of Artificial Sequence: Synthetic oligonucleotide
  Target: SCN10A; (-) strand; PAM type: YTN; PAM sequence: CTA
tgcctgtgtcaggcaggggc

SEQ ID NO: 42731 - DNA, 20 bp, Artificial Sequence
  Description of Artificial Sequence: Synthetic oligonucleotide
  Target: SCN10A; (-) strand; PAM type: YTN; PAM sequence: CTG
tgaatccaacatgacagtct

SEQ ID NO: 42732 - DNA, 20 bp, Artificial Sequence
  Description of Artificial Sequence: Synthetic oligonucleotide
  Target: SCN10A; (-) strand; PAM type: YTN; PAM sequence: CTG
tctgtgaatccaacatgaca

SEQ ID NO: 42733 - DNA, 20 bp, Artificial Sequence
  Description of Artificial Sequence: Synthetic oligonucleotide
  Target: SCN10A; (-) strand; PAM type: YTN; PAM sequence: CTA
gcacagcctgtctgtgaatc

SEQ ID NO: 42734 - DNA, 20 bp, Artificial Sequence
  Description of Artificial Sequence: Synthetic oligonucleotide
  Target: SCN10A; (-) strand; PAM type: YTN; PAM sequence: CTC
tagcacagcctgtctgtgaa

SEQ ID NO: 42735 - DNA, 20 bp, Artificial Sequence
  Description of Artificial Sequence: Synthetic oligonucleotide
  Target: SCN10A; (-) strand; PAM type: YTN; PAM sequence: TTC
ctctagcacagcctgtctgt

SEQ ID NO: 42736 - DNA, 20 bp, Artificial Sequence
  Description of Artificial Sequence: Synthetic oligonucleotide
  Target: SCN10A; (-) strand; PAM type: YTN; PAM sequence: TTT
cctctagcacagcctgtctg

SEQ ID NO: 42737 - DNA, 20 bp, Artificial Sequence
  Description of Artificial Sequence: Synthetic oligonucleotide
  Target: SCN10A; (-) strand; PAM type: YTN; PAM sequence: CTG
gtgagccccagaggtttcct

SEQ ID NO: 42738 - DNA, 20 bp, Artificial Sequence
  Description of Artificial Sequence: Synthetic oligonucleotide
  Target: SCN10A; (-) strand; PAM type: YTN; PAM sequence: CTC
caagaagccccagaagccca

SEQ ID NO: 42739 - DNA, 20 bp, Artificial Sequence
  Description of Artificial Sequence: Synthetic oligonucleotide
  Target: SCN10A; (-) strand; PAM type: YTN; PAM sequence: TTG
ggctccaagaagccccagaa

SEQ ID NO: 42740 - DNA, 20 bp, Artificial Sequence
  Description of Artificial Sequence: Synthetic oligonucleotide
  Target: SCN10A; (-) strand; PAM type: YTN; PAM sequence: CTA
caatgccatgaagaagttgg

SEQ ID NO: 42741 - DNA, 20 bp, Artificial Sequence
  Description of Artificial Sequence: Synthetic oligonucleotide
  Target: SCN10A; (-) strand; PAM type: YTN; PAM sequence: TTC
atgacagaggagcagaagaa

SEQ ID NO: 42742 - DNA, 20 bp, Artificial Sequence
  Description of Artificial Sequence: Synthetic oligonucleotide
  Target: SCN10A; (-) strand; PAM type: YTN; PAM sequence: CTT
catgacagaggagcagaaga

SEQ ID NO: 42743 - DNA, 20 bp, Artificial Sequence
  Description of Artificial Sequence: Synthetic oligonucleotide
  Target: SCN10A; (-) strand; PAM type: YTN; PAM sequence: TTA
gggggccaggacatcttcat

SEQ ID NO: 42744 - DNA, 20 bp, Artificial Sequence
  Description of Artificial Sequence: Synthetic oligonucleotide
  Target: SCN10A; (-) strand; PAM type: YTN; PAM sequence: CTT
agggggccaggacatcttca

SEQ ID NO: 42745 - DNA, 20 bp, Artificial Sequence
  Description of Artificial Sequence: Synthetic oligonucleotide
  Target: SCN10A; (-) strand; PAM type: YTN; PAM sequence: CTG
cacttagggggccaggacat

SEQ ID NO: 42746 - DNA, 20 bp, Artificial Sequence
  Description of Artificial Sequence: Synthetic oligonucleotide
  Target: SCN10A; (-) strand; PAM type: YTN; PAM sequence: CTC
tgcacttagggggccaggac

SEQ ID NO: 42747 - DNA, 20 bp, Artificial Sequence
  Description of Artificial Sequence: Synthetic oligonucleotide
  Target: SCN10A; (-) strand; PAM type: YTN; PAM sequence: CTC
tctgcacttagggggccagg

SEQ ID NO: 42748 - DNA, 20 bp, Artificial Sequence
  Description of Artificial Sequence: Synthetic oligonucleotide
  Target: SCN10A; (-) strand; PAM type: YTN; PAM sequence: TTA
gtaacagtgtggccctctct

SEQ ID NO: 42749 - DNA, 20 bp, Artificial Sequence
  Description of Artificial Sequence: Synthetic oligonucleotide
  Target: SCN10A; (-) strand; PAM type: YTN; PAM sequence: TTT
agtaacagtgtggccctctc

SEQ ID NO: 42750 - DNA, 20 bp, Artificial Sequence
  Description of Artificial Sequence: Synthetic oligonucleotide
  Target: SCN10A; (-) strand; PAM type: YTN; PAM sequence: CTT
tagtaacagtgtggccctct

SEQ ID NO: 42751 - DNA, 20 bp, Artificial Sequence
  Description of Artificial Sequence: Synthetic oligonucleotide
  Target: SCN10A; (-) strand; PAM type: YTN; PAM sequence: TTG
ctttagtaacagtgtggccc

SEQ ID NO: 42752 - DNA, 20 bp, Artificial Sequence
  Description of Artificial Sequence: Synthetic oligonucleotide
  Target: SCN10A; (-) strand; PAM type: YTN; PAM sequence: CTT
gctttagtaacagtgtggcc

SEQ ID NO: 42753 - DNA, 20 bp, Artificial Sequence
  Description of Artificial Sequence: Synthetic oligonucleotide
  Target: SCN10A; (-) strand; PAM type: YTN; PAM sequence: CTC
ttgctttagtaacagtgtgg

SEQ ID NO: 42754 - DNA, 20 bp, Artificial Sequence
  Description of Artificial Sequence: Synthetic oligonucleotide
  Target: SCN10A; (-) strand; PAM type: YTN; PAM sequence: TTC
ctcttgctttagtaacagtg

SEQ ID NO: 42755 - DNA, 20 bp, Artificial Sequence
  Description of Artificial Sequence: Synthetic oligonucleotide
  Target: SCN10A; (-) strand; PAM type: YTN; PAM sequence: TTG
gtatccgtagggggttcctc

SEQ ID NO: 42756 - DNA, 20 bp, Artificial Sequence
  Description of Artificial Sequence: Synthetic oligonucleotide
  Target: SCN10A; (-) strand; PAM type: YTN; PAM sequence: TTT
ggtatccgtagggggttcct

SEQ ID NO: 42757 - DNA, 20 bp, Artificial Sequence
  Description of Artificial Sequence: Synthetic oligonucleotide
  Target: SCN10A; (-) strand; PAM type: YTN; PAM sequence: TTT
tggtatccgtagggggttcc

SEQ ID NO: 42758 - DNA, 20 bp, Artificial Sequence
  Description of Artificial Sequence: Synthetic oligonucleotide
  Target: SCN10A; (-) strand; PAM type: YTN; PAM sequence: CTG
attttggtatccgtaggggg

SEQ ID NO: 42759 - DNA, 20 bp, Artificial Sequence
  Description of Artificial Sequence: Synthetic oligonucleotide
  Target: SCN10A; (-) strand; PAM type: YTN; PAM sequence: TTC
tgattttggtatccgtaggg

SEQ ID NO: 42760 - DNA, 20 bp, Artificial Sequence
  Description of Artificial Sequence: Synthetic oligonucleotide
  Target: SCN10A; (-) strand; PAM type: YTN; PAM sequence: CTG
ttctgattttggtatccgta

SEQ ID NO: 42761 - DNA, 20 bp, Artificial Sequence
  Description of Artificial Sequence: Synthetic oligonucleotide
  Target: SCN10A; (-) strand; PAM type: YTN; PAM sequence: CTG
cctgttctgattttggtatc

SEQ ID NO: 42762 - DNA, 20 bp, Artificial Sequence
  Description of Artificial Sequence: Synthetic oligonucleotide
  Target: SCN10A; (-) strand; PAM type: YTN; PAM sequence: CTC
ctgcctgttctgattttggt

SEQ ID NO: 42763 - DNA, 20 bp, Artificial Sequence
  Description of Artificial Sequence: Synthetic oligonucleotide
  Target: SCN10A; (-) strand; PAM type: YTN; PAM sequence: CTC
tcctgcctgttctgattttg

SEQ ID NO: 42764 - DNA, 20 bp, Artificial Sequence
  Description of Artificial Sequence: Synthetic oligonucleotide
  Target: SCN10A; (-) strand; PAM type: YTN; PAM sequence: TTC
tctcctgcctgttctgattt

SEQ ID NO: 42765 - DNA, 20 bp, Artificial Sequence
  Description of Artificial Sequence: Synthetic oligonucleotide
  Target: SCN10A; (-) strand; PAM type: YTN; PAM sequence: TTT
ctctcctgcctgttctgatt

SEQ ID NO: 42766 - DNA, 20 bp, Artificial Sequence
  Description of Artificial Sequence: Synthetic oligonucleotide
  Target: SCN10A; (-) strand; PAM type: YTN; PAM sequence: CTT
tctctcctgcctgttctgat

SEQ ID NO: 42767 - DNA, 20 bp, Artificial Sequence
  Description of Artificial Sequence: Synthetic oligonucleotide
  Target: SCN10A; (-) strand; PAM type: YTN; PAM sequence: TTG
atatgatcctttctctcctg

SEQ ID NO: 42768 - DNA, 20 bp, Artificial Sequence
  Description of Artificial Sequence: Synthetic oligonucleotide
  Target: SCN10A; (-) strand; PAM type: YTN; PAM sequence: CTG
cagaggaggggagaaggttg

SEQ ID NO: 42769 - DNA, 20 bp, Artificial Sequence
  Description of Artificial Sequence: Synthetic oligonucleotide
  Target: SCN10A; (-) strand; PAM type: YTN; PAM sequence: CTA
tctgcagaggaggggagaag

SEQ ID NO: 42770 - DNA, 20 bp, Artificial Sequence
  Description of Artificial Sequence: Synthetic oligonucleotide
  Target: SCN10A; (-) strand; PAM type: YTN; PAM sequence: TTG
tctatctgcagaggagggga

SEQ ID NO: 42771 - DNA, 20 bp, Artificial Sequence
  Description of Artificial Sequence: Synthetic oligonucleotide
  Target: SCN10A; (-) strand; PAM type: YTN; PAM sequence: TTT
gtctatctgcagaggagggg

SEQ ID NO: 42772 - DNA, 20 bp, Artificial Sequence
  Description of Artificial Sequence: Synthetic oligonucleotide
  Target: SCN10A; (-) strand; PAM type: YTN; PAM sequence: TTG
gtttgtctatctgcagagga

SEQ ID NO: 42773 - DNA, 20 bp, Artificial Sequence
  Description of Artificial Sequence: Synthetic oligonucleotide
  Target: SCN10A; (-) strand; PAM type: YTN; PAM sequence: CTT
ggtttgtctatctgcagagg

SEQ ID NO: 42774 - DNA, 20 bp, Artificial Sequence
  Description of Artificial Sequence: Synthetic oligonucleotide
  Target: SCN10A; (-) strand; PAM type: YTN; PAM sequence: CTG
ggcttggtttgtctatctgc

SEQ ID NO: 42775 - DNA, 20 bp, Artificial Sequence
  Description of Artificial Sequence: Synthetic oligonucleotide
  Target: SCN10A; (-) strand; PAM type: YTN; PAM sequence: TTG
atgctgggcttggtttgtct

SEQ ID NO: 42776 - DNA, 20 bp, Artificial Sequence
  Description of Artificial Sequence: Synthetic oligonucleotide
  Target: SCN10A; (-) strand; PAM type: YTN; PAM sequence: CTT
gatgctgggcttggtttgtc

SEQ ID NO: 42777 - DNA, 20 bp, Artificial Sequence
  Description of Artificial Sequence: Synthetic oligonucleotide
  Target: SCN10A; (-) strand; PAM type: YTN; PAM sequence: CTC
cttgatgctgggcttggttt

SEQ ID NO: 42778 - DNA, 20 bp, Artificial Sequence
  Description of Artificial Sequence: Synthetic oligonucleotide
  Target: SCN10A; (-) strand; PAM type: YTN; PAM sequence: CTG
gatgtggcaagacactcctt

SEQ ID NO: 42779 - DNA, 20 bp, Artificial Sequence
  Description of Artificial Sequence: Synthetic oligonucleotide
  Target: SCN10A; (-) strand; PAM type: YTN; PAM sequence: TTC
cgacactggatgtggcaaga

SEQ ID NO: 42780 - DNA, 20 bp, Artificial Sequence
  Description of Artificial Sequence: Synthetic oligonucleotide
  Target: SCN10A; (-) strand; PAM type: YTN; PAM sequence: CTC
agtcccaccgttccgacact

SEQ ID NO: 42781 - DNA, 20 bp, Artificial Sequence
  Description of Artificial Sequence: Synthetic oligonucleotide
  Target: SCN10A; (-) strand; PAM type: YTN; PAM sequence: TTA
gagacccaggcagggagtca

SEQ ID NO: 42782 - DNA, 20 bp, Artificial Sequence
  Description of Artificial Sequence: Synthetic oligonucleotide
  Target: SCN10A; (-) strand; PAM type: YTN; PAM sequence: TTT
agagacccaggcagggagtc

SEQ ID NO: 42783 - DNA, 20 bp, Artificial Sequence
  Description of Artificial Sequence: Synthetic oligonucleotide
  Target: SCN10A; (-) strand; PAM type: YTN; PAM sequence: CTT
tagagacccaggcagggagt

SEQ ID NO: 42784 - DNA, 20 bp, Artificial Sequence
  Description of Artificial Sequence: Synthetic oligonucleotide
  Target: SCN10A; (-) strand; PAM type: YTN; PAM sequence: TTG
ctttagagacccaggcaggg

SEQ ID NO: 42785 - DNA, 20 bp, Artificial Sequence
  Description of Artificial Sequence: Synthetic oligonucleotide
  Target: SCN10A; (-) strand; PAM type: YTN; PAM sequence: TTT
gctttagagacccaggcagg

SEQ ID NO: 42786 - DNA, 20 bp, Artificial Sequence
  Description of Artificial Sequence: Synthetic oligonucleotide
  Target: SCN10A; (-) strand; PAM type: YTN; PAM sequence: CTT
tgctttagagacccaggcag

SEQ ID NO: 42787 - DNA, 20 bp, Artificial Sequence
  Description of Artificial Sequence: Synthetic oligonucleotide
  Target: SCN10A; (-) strand; PAM type: YTN; PAM sequence: CTG
gctttgctttagagacccag

SEQ ID NO: 42788 - DNA, 20 bp, Artificial Sequence
  Description of Artificial Sequence: Synthetic oligonucleotide
  Target: SCN10A; (-) strand; PAM type: YTN; PAM sequence: CTG
gagaacagaaactggctttg

SEQ ID NO: 42789 - DNA, 20 bp, Artificial Sequence
  Description of Artificial Sequence: Synthetic oligonucleotide
  Target: SCN10A; (-) strand; PAM type: YTN; PAM sequence: CTG
gatccctggagaacagaaac

SEQ ID NO: 42790 - DNA, 20 bp, Artificial Sequence
  Description of Artificial Sequence: Synthetic oligonucleotide
  Target: SCN10A; (-) strand; PAM type: YTN; PAM sequence: CTC
tggatccctggagaacagaa

SEQ ID NO: 42791 - DNA, 20 bp, Artificial Sequence
  Description of Artificial Sequence: Synthetic oligonucleotide
  Target: SCN10A; (-) strand; PAM type: YTN; PAM sequence: TTA
tccagcatctctggatccct

SEQ ID NO: 42792 - DNA, 20 bp, Artificial Sequence
  Description of Artificial Sequence: Synthetic oligonucleotide
  Target: SCN10A; (-) strand; PAM type: YTN; PAM sequence: TTT
atccagcatctctggatccc

SEQ ID NO: 42793 - DNA, 20 bp, Artificial Sequence
  Description of Artificial Sequence: Synthetic oligonucleotide
  Target: SCN10A; (-) strand; PAM type: YTN; PAM sequence: CTT
tatccagcatctctggatcc

SEQ ID NO: 42794 - DNA, 20 bp, Artificial Sequence
  Description of Artificial Sequence: Synthetic oligonucleotide
  Target: SCN10A; (-) strand; PAM type: YTN; PAM sequence: CTC
cccaccctttatccagcatc

SEQ ID NO: 42795 - DNA, 20 bp, Artificial Sequence
  Description of Artificial Sequence: Synthetic oligonucleotide
  Target: SCN10A; (-) strand; PAM type: YTN; PAM sequence: TTA
ccaaccctccccacccttta

SEQ ID NO: 42796 - DNA, 20 bp, Artificial Sequence
  Description of Artificial Sequence: Synthetic oligonucleotide
  Target: SCN10A; (-) strand; PAM type: YTN; PAM sequence: TTT
accaaccctccccacccttt

SEQ ID NO: 42797 - DNA, 20 bp, Artificial Sequence
  Description of Artificial Sequence: Synthetic oligonucleotide
  Target: SCN10A; (-) strand; PAM type: YTN; PAM sequence: CTG
tttaccaaccctccccaccc

SEQ ID NO: 42798 - DNA, 20 bp, Artificial Sequence
  Description of Artificial Sequence: Synthetic oligonucleotide
  Target: SCN10A; (-) strand; PAM type: YTN; PAM sequence: TTG
agtcctgtttaccaaccctc

SEQ ID NO: 42799 - DNA, 20 bp, Artificial Sequence
  Description of Artificial Sequence: Synthetic oligonucleotide
  Target: SCN10A; (-) strand; PAM type: YTN; PAM sequence: CTT
gagtcctgtttaccaaccct

SEQ ID NO: 42800 - DNA, 20 bp, Artificial Sequence
  Description of Artificial Sequence: Synthetic oligonucleotide
  Target: SCN10A; (-) strand; PAM type: YTN; PAM sequence: CTC
cttgagtcctgtttaccaac

SEQ ID NO: 42801 - DNA, 20 bp, Artificial Sequence
  Description of Artificial Sequence: Synthetic oligonucleotide
  Target: SCN10A; (-) strand; PAM type: YTN; PAM sequence: TTC
tccttgagtcctgtttacca

SEQ ID NO: 42802 - DNA, 20 bp, Artificial Sequence
  Description of Artificial Sequence: Synthetic oligonucleotide
  Target: SCN10A; (-) strand; PAM type: YTN; PAM sequence: CTT
ctccttgagtcctgtttacc

SEQ ID NO: 42803 - DNA, 20 bp, Artificial Sequence
  Description of Artificial Sequence: Synthetic oligonucleotide
  Target: SCN10A; (-) strand; PAM type: YTN; PAM sequence: TTG
aaccaacatgtaccttctcc

SEQ ID NO: 42804 - DNA, 20 bp, Artificial Sequence
  Description of Artificial Sequence: Synthetic oligonucleotide
  Target: SCN10A; (-) strand; PAM type: YTN; PAM sequence: TTT
gaaccaacatgtaccttctc

SEQ ID NO: 42805 - DNA, 20 bp, Artificial Sequence
  Description of Artificial Sequence: Synthetic oligonucleotide
  Target: SCN10A; (-) strand; PAM type: YTN; PAM sequence: CTC
agatttgaaccaacatgtac

SEQ ID NO: 42806 - DNA, 20 bp, Artificial Sequence
  Description of Artificial Sequence: Synthetic oligonucleotide
  Target: SCN10A; (-) strand; PAM type: YTN; PAM sequence: CTA
gatccaaggctcagatttga

SEQ ID NO: 42807 - DNA, 20 bp, Artificial Sequence
  Description of Artificial Sequence: Synthetic oligonucleotide
  Target: SCN10A; (-) strand; PAM type: YTN; PAM sequence: CTG
gaatgaacaggctagatcca

SEQ ID NO: 42808 - DNA, 20 bp, Artificial Sequence
  Description of Artificial Sequence: Synthetic oligonucleotide
  Target: SCN10A; (-) strand; PAM type: YTN; PAM sequence: TTA
ctggaatgaacaggctagat

SEQ ID NO: 42809 - DNA, 20 bp, Artificial Sequence
  Description of Artificial Sequence: Synthetic oligonucleotide
  Target: SCN10A; (-) strand; PAM type: YTN; PAM sequence: TTT
actggaatgaacaggctaga

SEQ ID NO: 42810 - DNA, 20 bp, Artificial Sequence
  Description of Artificial Sequence: Synthetic oligonucleotide
  Target: SCN10A; (-) strand; PAM type: YTN; PAM sequence: TTT
tactggaatgaacaggctag

SEQ ID NO: 42811 - DNA, 20 bp, Artificial Sequence
  Description of Artificial Sequence: Synthetic oligonucleotide
  Target: SCN10A; (-) strand; PAM type: YTN; PAM sequence: CTA
gaagcccaaagaattttact

SEQ ID NO: 42812 - DNA, 20 bp, Artificial Sequence
  Description of Artificial Sequence: Synthetic oligonucleotide
  Target: SCN10A; (-) strand; PAM type: YTN; PAM sequence: CTC
tagaagcccaaagaatttta

SEQ ID NO: 42813 - DNA, 20 bp, Artificial Sequence
  Description of Artificial Sequence: Synthetic oligonucleotide
  Target: SCN10A; (-) strand; PAM type: YTN; PAM sequence: CTG
tgactctagaagcccaaaga

SEQ ID NO: 42814 - DNA, 20 bp, Artificial Sequence
  Description of Artificial Sequence: Synthetic oligonucleotide
  Target: SCN10A; (-) strand; PAM type: YTN; PAM sequence: CTG
ggagggactgtgactctaga

SEQ ID NO: 42815 - DNA, 20 bp, Artificial Sequence
  Description of Artificial Sequence: Synthetic oligonucleotide
  Target: SCN10A; (-) strand; PAM type: YTN; PAM sequence: TTG
ccccctgggagggactgtga

SEQ ID NO: 42816 - DNA, 20 bp, Artificial Sequence
  Description of Artificial Sequence: Synthetic oligonucleotide
  Target: SCN10A; (-) strand; PAM type: YTN; PAM sequence: CTT
gccccctgggagggactgtg

SEQ ID NO: 42817 - DNA, 20 bp, Artificial Sequence
  Description of Artificial Sequence: Synthetic oligonucleotide
  Target: SCN10A; (-) strand; PAM type: YTN; PAM sequence: CTC
ttgccccctgggagggactg

SEQ ID NO: 42818 - DNA, 20 bp, Artificial Sequence
  Description of Artificial Sequence: Synthetic oligonucleotide
  Target: SCN10A; (-) strand; PAM type: YTN; PAM sequence: CTC
aggaaatctcttgccccctg

SEQ ID NO: 42819 - DNA, 20 bp, Artificial Sequence
  Description of Artificial Sequence: Synthetic oligonucleotide
  Target: SCN10A; (-) strand; PAM type: YTN; PAM sequence: TTC
aaggtcctcaggaaatctct

SEQ ID NO: 42820 - DNA, 20 bp, Artificial Sequence
  Description of Artificial Sequence: Synthetic oligonucleotide
  Target: SCN10A; (-) strand; PAM type: YTN; PAM sequence: CTT
caaggtcctcaggaaatctc

SEQ ID NO: 42821 - DNA, 20 bp, Artificial Sequence
  Description of Artificial Sequence: Synthetic oligonucleotide
  Target: SCN10A; (-) strand; PAM type: YTN; PAM sequence: TTG
cttcaaggtcctcaggaaat

SEQ ID NO: 42822 - DNA, 20 bp, Artificial Sequence
  Description of Artificial Sequence: Synthetic oligonucleotide
  Target: SCN10A; (-) strand; PAM type: YTN; PAM sequence: TTT
gcttcaaggtcctcaggaaa

SEQ ID NO: 42823 - DNA, 20 bp, Artificial Sequence
  Description of Artificial Sequence: Synthetic oligonucleotide
  Target: SCN10A; (-) strand; PAM type: YTN; PAM sequence: CTT
tgcttcaaggtcctcaggaa

SEQ ID NO: 42824 - DNA, 20 bp, Artificial Sequence
  Description of Artificial Sequence: Synthetic oligonucleotide
  Target: SCN10A; (-) strand; PAM type: YTN; PAM sequence: CTC
ccagagtctttgcttcaagg

SEQ ID NO: 42825 - DNA, 20 bp, Artificial Sequence
  Description of Artificial Sequence: Synthetic oligonucleotide
  Target: SCN10A; (-) strand; PAM type: YTN; PAM sequence: CTG
tccctcccagagtctttgct

SEQ ID NO: 42826 - DNA, 20 bp, Artificial Sequence
  Description of Artificial Sequence: Synthetic oligonucleotide
  Target: SCN10A; (-) strand; PAM type: YTN; PAM sequence: TTC
tgtccctcccagagtctttg

SEQ ID NO: 42827 - DNA, 20 bp, Artificial Sequence
  Description of Artificial Sequence: Synthetic oligonucleotide
  Target: SCN10A; (-) strand; PAM type: YTN; PAM sequence: CTT
ctgtccctcccagagtcttt

SEQ ID NO: 42828 - DNA, 20 bp, Artificial Sequence
  Description of Artificial Sequence: Synthetic oligonucleotide
  Target: SCN10A; (-) strand; PAM type: YTN; PAM sequence: TTG
agggcttctgtccctcccag

SEQ ID NO: 42829 - DNA, 20 bp, Artificial Sequence
  Description of Artificial Sequence: Synthetic oligonucleotide
  Target: SCN10A; (-) strand; PAM type: YTN; PAM sequence: TTT
gagggcttctgtccctccca

SEQ ID NO: 42830 - DNA, 20 bp, Artificial Sequence
  Description of Artificial Sequence: Synthetic oligonucleotide
  Target: SCN10A; (-) strand; PAM type: YTN; PAM sequence: CTC
cagaaaagatttgagggctt

SEQ ID NO: 42831 - DNA, 20 bp, Artificial Sequence
  Description of Artificial Sequence: Synthetic oligonucleotide
  Target: SCN10A; (-) strand; PAM type: YTN; PAM sequence: CTC
tccagaaaagatttgagggc

SEQ ID NO: 42832 - DNA, 20 bp, Artificial Sequence
  Description of Artificial Sequence: Synthetic oligonucleotide
  Target: SCN10A; (-) strand; PAM type: YTN; PAM sequence: CTC
ctctccagaaaagatttgag

SEQ ID NO: 42833 - DNA, 20 bp, Artificial Sequence
  Description of Artificial Sequence: Synthetic oligonucleotide
  Target: SCN10A; (-) strand; PAM type: YTN; PAM sequence: CTC
ctcctctccagaaaagattt

SEQ ID NO: 42834 - DNA, 20 bp, Artificial Sequence
  Description of Artificial Sequence: Synthetic oligonucleotide
  Target: SCN10A; (-) strand; PAM type: YTN; PAM sequence: CTC
atctcctcctctccagaaaa

SEQ ID NO: 42835 - DNA, 20 bp, Artificial Sequence
  Description of Artificial Sequence: Synthetic oligonucleotide
  Target: SCN10A; (-) strand; PAM type: YTN; PAM sequence: TTG
tcctcatctcctcctctcca

SEQ ID NO: 42836 - DNA, 20 bp, Artificial Sequence
  Description of Artificial Sequence: Synthetic oligonucleotide
  Target: SCN10A; (-) strand; PAM type: YTN; PAM sequence: CTG
agaccaaggacccaaggata

SEQ ID NO: 42837 - DNA, 20 bp, Artificial Sequence
  Description of Artificial Sequence: Synthetic oligonucleotide
  Target: SCN10A; (-) strand; PAM type: YTN; PAM sequence: CTC
tgagaccaaggacccaagga

SEQ ID NO: 42838 - DNA, 20 bp, Artificial Sequence
  Description of Artificial Sequence: Synthetic oligonucleotide
  Target: SCN10A; (-) strand; PAM type: YTN; PAM sequence: CTC
aagagaaccagaggtccctc

SEQ ID NO: 42839 - DNA, 20 bp, Artificial Sequence
  Description of Artificial Sequence: Synthetic oligonucleotide
  Target: SCN10A; (-) strand; PAM type: YTN; PAM sequence: CTG
gcagggcctcaagagaacca

SEQ ID NO: 42840 - DNA, 20 bp, Artificial Sequence
  Description of Artificial Sequence: Synthetic oligonucleotide
  Target: SCN10A; (-) strand; PAM type: YTN; PAM sequence: CTG
taacagcagagggcagtgtg

SEQ ID NO: 42841 - DNA, 20 bp, Artificial Sequence
  Description of Artificial Sequence: Synthetic oligonucleotide
  Target: SCN10A; (-) strand; PAM type: YTN; PAM sequence: CTG
gcactgtaacagcagagggc

SEQ ID NO: 42842 - DNA, 20 bp, Artificial Sequence
  Description of Artificial Sequence: Synthetic oligonucleotide
  Target: SCN10A; (-) strand; PAM type: YTN; PAM sequence: TTC
tggcactgtaacagcagagg

SEQ ID NO: 42843 - DNA, 20 bp, Artificial Sequence
  Description of Artificial Sequence: Synthetic oligonucleotide
  Target: SCN10A; (-) strand; PAM type: YTN; PAM sequence: TTT
ctggcactgtaacagcagag

SEQ ID NO: 42844 - DNA, 20 bp, Artificial Sequence
  Description of Artificial Sequence: Synthetic oligonucleotide
  Target: SCN10A; (-) strand; PAM type: YTN; PAM sequence: TTG
gtgcagtttctggcactgta

SEQ ID NO: 42845 - DNA, 20 bp, Artificial Sequence
  Description of Artificial Sequence: Synthetic oligonucleotide
  Target: SCN10A; (-) strand; PAM type: YTN; PAM sequence: TTC
gttggtgcagtttctggcac

SEQ ID NO: 42846 - DNA, 20 bp, Artificial Sequence
  Description of Artificial Sequence: Synthetic oligonucleotide
  Target: SCN10A; (-) strand; PAM type: YTN; PAM sequence: CTT
cgttggtgcagtttctggca

SEQ ID NO: 42847 - DNA, 20 bp, Artificial Sequence
  Description of Artificial Sequence: Synthetic oligonucleotide
  Target: SCN10A; (-) strand; PAM type: YTN; PAM sequence: CTA
agggaggaaaacatcttcgt

SEQ ID NO: 42848 - DNA, 20 bp, Artificial Sequence
  Description of Artificial Sequence: Synthetic oligonucleotide
  Target: SCN10A; (-) strand; PAM type: YTN; PAM sequence: CTA
atacccaatcctaagggagg

SEQ ID NO: 42849 - DNA, 20 bp, Artificial Sequence
  Description of Artificial Sequence: Synthetic oligonucleotide
  Target: SCN10A; (-) strand; PAM type: YTN; PAM sequence: CTA
aagaaaaactaatacccaat

SEQ ID NO: 42850 - DNA, 20 bp, Artificial Sequence
  Description of Artificial Sequence: Synthetic oligonucleotide
  Target: SCN10A; (-) strand; PAM type: YTN; PAM sequence: TTG
aatgaagaaaatccaaaggg

SEQ ID NO: 42851 - DNA, 20 bp, Artificial Sequence
  Description of Artificial Sequence: Synthetic oligonucleotide
  Target: SCN10A; (-) strand; PAM type: YTN; PAM sequence: TTT
gaatgaagaaaatccaaagg

SEQ ID NO: 42852 - DNA, 20 bp, Artificial Sequence
  Description of Artificial Sequence: Synthetic oligonucleotide
  Target: SCN10A; (-) strand; PAM type: YTN; PAM sequence: CTA
aaggtgagagtttgaatgaa

SEQ ID NO: 42853 - DNA, 20 bp, Artificial Sequence
  Description of Artificial Sequence: Synthetic oligonucleotide
  Target: SCN10A; (-) strand; PAM type: YTN; PAM sequence: TTA
tgtcaggaagctaaaggtga

SEQ ID NO: 42854 - DNA, 20 bp, Artificial Sequence
  Description of Artificial Sequence: Synthetic oligonucleotide
  Target: SCN10A; (-) strand; PAM type: YTN; PAM sequence: TTC
aaattatgtcaggaagctaa

SEQ ID NO: 42855 - DNA, 20 bp, Artificial Sequence
  Description of Artificial Sequence: Synthetic oligonucleotide
  Target: SCN10A; (-) strand; PAM type: YTN; PAM sequence: TTT
caaattatgtcaggaagcta

SEQ ID NO: 42856 - DNA, 20 bp, Artificial Sequence
  Description of Artificial Sequence: Synthetic oligonucleotide
  Target: SCN10A; (-) strand; PAM type: YTN; PAM sequence: CTT
tcaaattatgtcaggaagct

SEQ ID NO: 42857 - DNA, 20 bp, Artificial Sequence
  Description of Artificial Sequence: Synthetic oligonucleotide
  Target: SCN10A; (-) strand; PAM type: YTN; PAM sequence: TTA
aaataggtggctttcaaatt

SEQ ID NO: 42858 - DNA, 20 bp, Artificial Sequence
  Description of Artificial Sequence: Synthetic oligonucleotide
  Target: SCN10A; (-) strand; PAM type: YTN; PAM sequence: TTA
ttaaaataggtggctttcaa

SEQ ID NO: 42859 - DNA, 20 bp, Artificial Sequence
  Description of Artificial Sequence: Synthetic oligonucleotide
  Target: SCN10A; (-) strand; PAM type: YTN; PAM sequence: TTA
cataaacatgttattaaaat

SEQ ID NO: 42860 - DNA, 20 bp, Artificial Sequence
  Description of Artificial Sequence: Synthetic oligonucleotide
  Target: SCN10A; (-) strand; PAM type: YTN; PAM sequence: CTT
acataaacatgttattaaaa

SEQ ID NO: 42861 - DNA, 20 bp, Artificial Sequence
  Description of Artificial Sequence: Synthetic oligonucleotide
  Target: SCN10A; (-) strand; PAM type: YTN; PAM sequence: CTA
acttacataaacatgttatt

SEQ ID NO: 42862 - DNA, 20 bp, Artificial Sequence
  Description of Artificial Sequence: Synthetic oligonucleotide
  Target: SCN10A; (-) strand; PAM type: YTN; PAM sequence: TTG
cagggactaacttacataaa

SEQ ID NO: 42863 - DNA, 20 bp, Artificial Sequence
  Description of Artificial Sequence: Synthetic oligonucleotide
  Target: SCN10A; (-) strand; PAM type: YTN; PAM sequence: TTT
gcagggactaacttacataa

SEQ ID NO: 42864 - DNA, 20 bp, Artificial Sequence
  Description of Artificial Sequence: Synthetic oligonucleotide
  Target: SCN10A; (-) strand; PAM type: YTN; PAM sequence: TTC
ccagcatttgcagggactaa

SEQ ID NO: 42865 - DNA, 20 bp, Artificial Sequence
  Description of Artificial Sequence: Synthetic oligonucleotide
  Target: SCN10A; (-) strand; PAM type: YTN; PAM sequence: TTT
cccagcatttgcagggacta

SEQ ID NO: 42866 - DNA, 20 bp, Artificial Sequence
  Description of Artificial Sequence: Synthetic oligonucleotide
  Target: SCN10A; (-) strand; PAM type: YTN; PAM sequence: CTC
agcccagtttcccagcattt

SEQ ID NO: 42867 - DNA, 20 bp, Artificial Sequence
  Description of Artificial Sequence: Synthetic oligonucleotide
  Target: SCN10A; (-) strand; PAM type: YTN; PAM sequence: TTC
cacagatctcagcccagttt

SEQ ID NO: 42868 - DNA, 20 bp, Artificial Sequence
  Description of Artificial Sequence: Synthetic oligonucleotide
  Target: SCN10A; (-) strand; PAM type: YTN; PAM sequence: TTC
aaattccacagatctcagcc

SEQ ID NO: 42869 - DNA, 20 bp, Artificial Sequence
  Description of Artificial Sequence: Synthetic oligonucleotide
  Target: SCN10A; (-) strand; PAM type: YTN; PAM sequence: TTT
caaattccacagatctcagc

SEQ ID NO: 42870 - DNA, 20 bp, Artificial Sequence
  Description of Artificial Sequence: Synthetic oligonucleotide
  Target: SCN10A; (-) strand; PAM type: YTN; PAM sequence: CTT
tcaaattccacagatctcag

SEQ ID NO: 42871 - DNA, 20 bp, Artificial Sequence
  Description of Artificial Sequence: Synthetic oligonucleotide
  Target: SCN10A; (-) strand; PAM type: YTN; PAM sequence: CTC
ctttcaaattccacagatct

SEQ ID NO: 42872 - DNA, 20 bp, Artificial Sequence
  Description of Artificial Sequence: Synthetic oligonucleotide
  Target: SCN10A; (-) strand; PAM type: YTN; PAM sequence: CTC
agatctcctttcaaattcca

SEQ ID NO: 42873 - DNA, 20 bp, Artificial Sequence
  Description of Artificial Sequence: Synthetic oligonucleotide
  Target: SCN10A; (-) strand; PAM type: YTN; PAM sequence: TTC
tcagatctcctttcaaattc

SEQ ID NO: 42874 - DNA, 20 bp, Artificial Sequence
  Description of Artificial Sequence: Synthetic oligonucleotide
  Target: SCN10A; (-) strand; PAM type: YTN; PAM sequence: CTT
ctcagatctcctttcaaatt

SEQ ID NO: 42875 - DNA, 20 bp, Artificial Sequence
  Description of Artificial Sequence: Synthetic oligonucleotide
  Target: SCN10A; (-) strand; PAM type: YTN; PAM sequence: TTG
tgtccacagatcttctcaga

SEQ ID NO: 42876 - DNA, 20 bp, Artificial Sequence
  Description of Artificial Sequence: Synthetic oligonucleotide
  Target: SCN10A; (-) strand; PAM type: YTN; PAM sequence: TTT
gtgtccacagatcttctcag

SEQ ID NO: 42877 - DNA, 20 bp, Artificial Sequence
  Description of Artificial Sequence: Synthetic oligonucleotide
  Target: SCN10A; (-) strand; PAM type: YTN; PAM sequence: CTT
tgtgtccacagatcttctca

SEQ ID NO: 42878 - DNA, 20 bp, Artificial Sequence
  Description of Artificial Sequence: Synthetic oligonucleotide
  Target: SCN10A; (-) strand; PAM type: YTN; PAM sequence: CTC
ccaggaagccctttgtgtcc

SEQ ID NO: 42879 - DNA, 20 bp, Artificial Sequence
  Description of Artificial Sequence: Synthetic oligonucleotide
  Target: SCN10A; (-) strand; PAM type: YTN; PAM sequence: CTC
cccccataaagatggtcctc

SEQ ID NO: 42880 - DNA, 20 bp, Artificial Sequence
  Description of Artificial Sequence: Synthetic oligonucleotide
  Target: SCN10A; (-) strand; PAM type: YTN; PAM sequence: CTC
tccccccataaagatggtcc

SEQ ID NO: 42881 - DNA, 20 bp, Artificial Sequence
  Description of Artificial Sequence: Synthetic oligonucleotide
  Target: SCN10A; (-) strand; PAM type: YTN; PAM sequence: TTC
tctccccccataaagatggt

SEQ ID NO: 42882 - DNA, 20 bp, Artificial Sequence
  Description of Artificial Sequence: Synthetic oligonucleotide
  Target: SCN10A; (-) strand; PAM type: YTN; PAM sequence: CTT
ctctccccccataaagatgg

SEQ ID NO: 42883 - DNA, 20 bp, Artificial Sequence
  Description of Artificial Sequence: Synthetic oligonucleotide
  Target: SCN10A; (-) strand; PAM type: YTN; PAM sequence: TTC
cttctctccccccataaaga

SEQ ID NO: 42884 - DNA, 20 bp, Artificial Sequence
  Description of Artificial Sequence: Synthetic oligonucleotide
  Target: SCN10A; (-) strand; PAM type: YTN; PAM sequence: TTT
ccttctctccccccataaag

SEQ ID NO: 42885 - DNA, 20 bp, Artificial Sequence
  Description of Artificial Sequence: Synthetic oligonucleotide
  Target: SCN10A; (-) strand; PAM type: YTN; PAM sequence: CTT
tccttctctccccccataaa

SEQ ID NO: 42886 - DNA, 20 bp, Artificial Sequence
  Description of Artificial Sequence: Synthetic oligonucleotide
  Target: SCN10A; (-) strand; PAM type: YTN; PAM sequence: TTG
ccctttccttctctcccccc

SEQ ID NO: 42887 - DNA, 20 bp, Artificial Sequence
  Description of Artificial Sequence: Synthetic oligonucleotide
  Target: SCN10A; (-) strand; PAM type: YTN; PAM sequence: CTT
gccctttccttctctccccc

SEQ ID NO: 42888 - DNA, 20 bp, Artificial Sequence
  Description of Artificial Sequence: Synthetic oligonucleotide
  Target: SCN10A; (-) strand; PAM type: YTN; PAM sequence: CTG
cccttgccctttccttctct

SEQ ID NO: 42889 - DNA, 20 bp, Artificial Sequence
  Description of Artificial Sequence: Synthetic oligonucleotide
  Target: SCN10A; (-) strand; PAM type: YTN; PAM sequence: CTA
cccactgcccttgccctttc

SEQ ID NO: 42890 - DNA, 20 bp, Artificial Sequence
  Description of Artificial Sequence: Synthetic oligonucleotide
  Target: SCN10A; (-) strand; PAM type: YTN; PAM sequence: CTC
acctacccactgcccttgcc

SEQ ID NO: 42891 - DNA, 20 bp, Artificial Sequence
  Description of Artificial Sequence: Synthetic oligonucleotide
  Target: SCN10A; (-) strand; PAM type: YTN; PAM sequence: CTG
gagctcacctacccactgcc

SEQ ID NO: 42892 - DNA, 20 bp, Artificial Sequence
  Description of Artificial Sequence: Synthetic oligonucleotide
  Target: SCN10A; (-) strand; PAM type: YTN; PAM sequence: CTC
acctggagctcacctaccca

SEQ ID NO: 42893 - DNA, 20 bp, Artificial Sequence
  Description of Artificial Sequence: Synthetic oligonucleotide
  Target: SCN10A; (-) strand; PAM type: YTN; PAM sequence: CTC
agcatgacctcacctggagc

SEQ ID NO: 42894 - DNA, 20 bp, Artificial Sequence
  Description of Artificial Sequence: Synthetic oligonucleotide
  Target: SCN10A; (-) strand; PAM type: YTN; PAM sequence: TTC
tcagcatgacctcacctgga

SEQ ID NO: 42895 - DNA, 20 bp, Artificial Sequence
  Description of Artificial Sequence: Synthetic oligonucleotide
  Target: SCN10A; (-) strand; PAM type: YTN; PAM sequence: TTG
gtcagagttctcagcatgac

SEQ ID NO: 42896 - DNA, 20 bp, Artificial Sequence
  Description of Artificial Sequence: Synthetic oligonucleotide
  Target: SCN10A; (-) strand; PAM type: YTN; PAM sequence: CTT
ggtcagagttctcagcatga

SEQ ID NO: 42897 - DNA, 20 bp, Artificial Sequence
  Description of Artificial Sequence: Synthetic oligonucleotide
  Target: SCN10A; (-) strand; PAM type: YTN; PAM sequence: CTG
aatccttggtcagagttctc

SEQ ID NO: 42898 - DNA, 20 bp, Artificial Sequence
  Description of Artificial Sequence: Synthetic oligonucleotide
  Target: SCN10A; (-) strand; PAM type: YTN; PAM sequence: CTA
ctgaatccttggtcagagtt

SEQ ID NO: 42899 - DNA, 20 bp, Artificial Sequence
  Description of Artificial Sequence: Synthetic oligonucleotide
  Target: SCN10A; (-) strand; PAM type: YTN; PAM sequence: CTG
catctactgaatccttggtc

SEQ ID NO: 42900 - DNA, 20 bp, Artificial Sequence
  Description of Artificial Sequence: Synthetic oligonucleotide
  Target: SCN10A; (-) strand; PAM type: YTN; PAM sequence: CTG
agaaactgcatctactgaat

SEQ ID NO: 42901 - DNA, 20 bp, Artificial Sequence
  Description of Artificial Sequence: Synthetic oligonucleotide
  Target: SCN10A; (-) strand; PAM type: YTN; PAM sequence: CTG
gggtcactgagaaactgcat

SEQ ID NO: 42902 - DNA, 20 bp, Artificial Sequence
  Description of Artificial Sequence: Synthetic oligonucleotide
  Target: SCN10A; (-) strand; PAM type: YTN; PAM sequence: CTA
gtgaccaggctggggtcact

SEQ ID NO: 42903 - DNA, 20 bp, Artificial Sequence
  Description of Artificial Sequence: Synthetic oligonucleotide
  Target: SCN10A; (-) strand; PAM type: YTN; PAM sequence: TTA
ggtaacggaaggagatgagc

SEQ ID NO: 42904 - DNA, 20 bp, Artificial Sequence
  Description of Artificial Sequence: Synthetic oligonucleotide
  Target: SCN10A; (-) strand; PAM type: YTN; PAM sequence: TTA
cagagggagatattaggtaa

SEQ ID NO: 42905 - DNA, 20 bp, Artificial Sequence
  Description of Artificial Sequence: Synthetic oligonucleotide
  Target: SCN10A; (-) strand; PAM type: YTN; PAM sequence: CTG
aggtcaagaaacagattaca

SEQ ID NO: 42906 - DNA, 20 bp, Artificial Sequence
  Description of Artificial Sequence: Synthetic oligonucleotide
  Target: SCN10A; (-) strand; PAM type: YTN; PAM sequence: TTA
cagatgagaaaactgaggtc

SEQ ID NO: 42907 - DNA, 20 bp, Artificial Sequence
  Description of Artificial Sequence: Synthetic oligonucleotide
  Target: SCN10A; (-) strand; PAM type: YTN; PAM sequence: TTT
acagatgagaaaactgaggt

SEQ ID NO: 42908 - DNA, 20 bp, Artificial Sequence
  Description of Artificial Sequence: Synthetic oligonucleotide
  Target: SCN10A; (-) strand; PAM type: YTN; PAM sequence: TTT
tacagatgagaaaactgagg

SEQ ID NO: 42909 - DNA, 20 bp, Artificial Sequence
  Description of Artificial Sequence: Synthetic oligonucleotide
  Target: SCN10A; (-) strand; PAM type: YTN; PAM sequence: CTC
attttacagatgagaaaact

SEQ ID NO: 42910 - DNA, 20 bp, Artificial Sequence
  Description of Artificial Sequence: Synthetic oligonucleotide
  Target: SCN10A; (-) strand; PAM type: YTN; PAM sequence: CTC
tcattttacagatgagaaaa

SEQ ID NO: 42911 - DNA, 20 bp, Artificial Sequence
  Description of Artificial Sequence: Synthetic oligonucleotide
  Target: SCN10A; (-) strand; PAM type: YTN; PAM sequence: TTC
tctcattttacagatgagaa

SEQ ID NO: 42912 - DNA, 20 bp, Artificial Sequence
  Description of Artificial Sequence: Synthetic oligonucleotide
  Target: SCN10A; (-) strand; PAM type: YTN; PAM sequence: TTT
ctctcattttacagatgaga

SEQ ID NO: 42913 - DNA, 20 bp, Artificial Sequence
  Description of Artificial Sequence: Synthetic oligonucleotide
  Target: SCN10A; (-) strand; PAM type: YTN; PAM sequence: TTG
aagcaatcatttctctcatt

SEQ ID NO: 42914 - DNA, 20 bp, Artificial Sequence
  Description of Artificial Sequence: Synthetic oligonucleotide
  Target: SCN10A; (-) strand; PAM type: YTN; PAM sequence: TTA
ttgaagcaatcatttctctc

SEQ ID NO: 42915 - DNA, 20 bp, Artificial Sequence
  Description of Artificial Sequence: Synthetic oligonucleotide
  Target: SCN10A; (-) strand; PAM type: YTN; PAM sequence: TTG
agattattgaagcaatcatt

SEQ ID NO: 42916 - DNA, 20 bp, Artificial Sequence
  Description of Artificial Sequence: Synthetic oligonucleotide
  Target: SCN10A; (-) strand; PAM type: YTN; PAM sequence: TTT
gagattattgaagcaatcat

SEQ ID NO: 42917 - DNA, 20 bp, Artificial Sequence
  Description of Artificial Sequence: Synthetic oligonucleotide
  Target: SCN10A; (-) strand; PAM type: YTN; PAM sequence: CTG
gggaggtttgagattattga

SEQ ID NO: 42918 - DNA, 20 bp, Artificial Sequence
  Description of Artificial Sequence: Synthetic oligonucleotide
  Target: SCN10A; (-) strand; PAM type: YTN; PAM sequence: TTA
gtaccctggggaggtttgag

SEQ ID NO: 42919 - DNA, 20 bp, Artificial Sequence
  Description of Artificial Sequence: Synthetic oligonucleotide
  Target: SCN10A; (-) strand; PAM type: YTN; PAM sequence: TTT
agtaccctggggaggtttga

SEQ ID NO: 42920 - DNA, 20 bp, Artificial Sequence
  Description of Artificial Sequence: Synthetic oligonucleotide
  Target: SCN10A; (-) strand; PAM type: YTN; PAM sequence: CTA
tttagtaccctggggaggtt

SEQ ID NO: 42921 - DNA, 20 bp, Artificial Sequence
  Description of Artificial Sequence: Synthetic oligonucleotide
  Target: SCN10A; (-) strand; PAM type: YTN; PAM sequence: CTG
ggacaagacagtgctattta

SEQ ID NO: 42922 - DNA, 20 bp, Artificial Sequence
  Description of Artificial Sequence: Synthetic oligonucleotide
  Target: SCN10A; (-) strand; PAM type: YTN; PAM sequence: CTG
agcataagaagaggacagga

SEQ ID NO: 42923 - DNA, 20 bp, Artificial Sequence
  Description of Artificial Sequence: Synthetic oligonucleotide
  Target: SCN10A; (-) strand; PAM type: YTN; PAM sequence: TTC
tgagcataagaagaggacag

SEQ ID NO: 42924 - DNA, 20 bp, Artificial Sequence
  Description of Artificial Sequence: Synthetic oligonucleotide
  Target: SCN10A; (-) strand; PAM type: YTN; PAM sequence: TTG
cccagggttctgagcataag

SEQ ID NO: 42925 - DNA, 20 bp, Artificial Sequence
  Description of Artificial Sequence: Synthetic oligonucleotide
  Target: SCN10A; (-) strand; PAM type: YTN; PAM sequence: CTT
gcccagggttctgagcataa

SEQ ID NO: 42926 - DNA, 20 bp, Artificial Sequence
  Description of Artificial Sequence: Synthetic oligonucleotide
  Target: SCN10A; (-) strand; PAM type: YTN; PAM sequence: TTA
caggaaatccttgcccaggg

SEQ ID NO: 42927 - DNA, 20 bp, Artificial Sequence
  Description of Artificial Sequence: Synthetic oligonucleotide
  Target: SCN10A; (-) strand; PAM type: YTN; PAM sequence: CTT
acaggaaatccttgcccagg

SEQ ID NO: 42928 - DNA, 20 bp, Artificial Sequence
  Description of Artificial Sequence: Synthetic oligonucleotide
  Target: SCN10A; (-) strand; PAM type: YTN; PAM sequence: TTC
cacttacaggaaatccttgc

SEQ ID NO: 42929 - DNA, 20 bp, Artificial Sequence
  Description of Artificial Sequence: Synthetic oligonucleotide
  Target: SCN10A; (-) strand; PAM type: YTN; PAM sequence: CTA
gggcaggcattccacttaca

SEQ ID NO: 42930 - DNA, 20 bp, Artificial Sequence
  Description of Artificial Sequence: Synthetic oligonucleotide
  Target: SCN10A; (-) strand; PAM type: YTN; PAM sequence: CTA
ctagggcaggcattccactt

SEQ ID NO: 42931 - DNA, 20 bp, Artificial Sequence
  Description of Artificial Sequence: Synthetic oligonucleotide
  Target: SCN10A; (-) strand; PAM type: YTN; PAM sequence: TTA
aaatatatacctactagggc

SEQ ID NO: 42932 - DNA, 20 bp, Artificial Sequence
  Description of Artificial Sequence: Synthetic oligonucleotide
  Target: SCN10A; (-) strand; PAM type: YTN; PAM sequence: TTT
aaaatatatacctactaggg

SEQ ID NO: 42933 - DNA, 20 bp, Artificial Sequence
  Description of Artificial Sequence: Synthetic oligonucleotide
  Target: SCN10A; (-) strand; PAM type: YTN; PAM sequence: TTA
acaatttaaaatatatacct

SEQ ID NO: 42934 - DNA, 20 bp, Artificial Sequence
  Description of Artificial Sequence: Synthetic oligonucleotide
  Target: SCN10A; (-) strand; PAM type: YTN; PAM sequence: CTA
ttaacaatttaaaatatata

SEQ ID NO: 42935 - DNA, 20 bp, Artificial Sequence
  Description of Artificial Sequence: Synthetic oligonucleotide
  Target: SCN10A; (-) strand; PAM type: YTN; PAM sequence: TTG
ctattaacaatttaaaatat

SEQ ID NO: 42936 - DNA, 20 bp, Artificial Sequence
  Description of Artificial Sequence: Synthetic oligonucleotide
  Target: SCN10A; (-) strand; PAM type: YTN; PAM sequence: CTG
ttgctattaacaatttaaaa

SEQ ID NO: 42937 - DNA, 20 bp, Artificial Sequence
  Description of Artificial Sequence: Synthetic oligonucleotide
  Target: SCN10A; (-) strand; PAM type: YTN; PAM sequence: CTC
aagagcaccagatgctgttg

SEQ ID NO: 42938 - DNA, 20 bp, Artificial Sequence
  Description of Artificial Sequence: Synthetic oligonucleotide
  Target: SCN10A; (-) strand; PAM type: YTN; PAM sequence: CTG
gcagcgcctcaagagcacca

SEQ ID NO: 42939 - DNA, 20 bp, Artificial Sequence
  Description of Artificial Sequence: Synthetic oligonucleotide
  Target: SCN10A; (-) strand; PAM type: YTN; PAM sequence: CTG
taacagcagaggggagtgtg

SEQ ID NO: 42940 - DNA, 20 bp, Artificial Sequence
  Description of Artificial Sequence: Synthetic oligonucleotide
  Target: SCN10A; (-) strand; PAM type: YTN; PAM sequence: CTG
gcactgtaacagcagagggg

SEQ ID NO: 42941 - DNA, 20 bp, Artificial Sequence
  Description of Artificial Sequence: Synthetic oligonucleotide
  Target: SCN10A; (-) strand; PAM type: YTN; PAM sequence: TTC
tggcactgtaacagcagagg

SEQ ID NO: 42942 - DNA, 20 bp, Artificial Sequence
  Description of Artificial Sequence: Synthetic oligonucleotide
  Target: SCN10A; (-) strand; PAM type: YTN; PAM sequence: TTT
ctggcactgtaacagcagag

SEQ ID NO: 42943 - DNA, 20 bp, Artificial Sequence
  Description of Artificial Sequence: Synthetic oligonucleotide
  Target: SCN10A; (-) strand; PAM type: YTN; PAM sequence: TTG
gtggtgcagtttctggcact

SEQ ID NO: 42944 - DNA, 20 bp, Artificial Sequence
  Description of Artificial Sequence: Synthetic oligonucleotide
  Target: SCN10A; (-) strand; PAM type: YTN; PAM sequence: TTT
ggtggtgcagtttctggcac

SEQ ID NO: 42945 - DNA, 20 bp, Artificial Sequence
  Description of Artificial Sequence: Synthetic oligonucleotide
  Target: SCN10A; (-) strand; PAM type: YTN; PAM sequence: CTT
tggtggtgcagtttctggca

SEQ ID NO: 42946 - DNA, 20 bp, Artificial Sequence
  Description of Artificial Sequence: Synthetic oligonucleotide
  Target: SCN10A; (-) strand; PAM type: YTN; PAM sequence: CTG
agcataagacaactttggtg

SEQ ID NO: 42947 - DNA, 20 bp, Artificial Sequence
  Description of Artificial Sequence: Synthetic oligonucleotide
  Target: SCN10A; (-) strand; PAM type: YTN; PAM sequence: CTG
aacaaagatcactgagcata

SEQ ID NO: 42948 - DNA, 20 bp, Artificial Sequence
  Description of Artificial Sequence: Synthetic oligonucleotide
  Target: SCN10A; (-) strand; PAM type: YTN; PAM sequence: TTG
tggtgaggggtaaacaaaat

SEQ ID NO: 42949 - DNA, 20 bp, Artificial Sequence
  Description of Artificial Sequence: Synthetic oligonucleotide
  Target: SCN10A; (-) strand; PAM type: YTN; PAM sequence: CTG
gattgtggtgaggggtaaac

SEQ ID NO: 42950 - DNA, 20 bp, Artificial Sequence
  Description of Artificial Sequence: Synthetic oligonucleotide
  Target: SCN10A; (-) strand; PAM type: YTN; PAM sequence: CTC
tggattgtggtgaggggtaa

SEQ ID NO: 42951 - DNA, 20 bp, Artificial Sequence
  Description of Artificial Sequence: Synthetic oligonucleotide
  Target: SCN10A; (-) strand; PAM type: YTN; PAM sequence: CTC
tctggattgtggtgaggggt

SEQ ID NO: 42952 - DNA, 20 bp, Artificial Sequence
  Description of Artificial Sequence: Synthetic oligonucleotide
  Target: SCN10A; (-) strand; PAM type: YTN; PAM sequence: CTA
ctctctggattgtggtgagg

SEQ ID NO: 42953 - DNA, 20 bp, Artificial Sequence
  Description of Artificial Sequence: Synthetic oligonucleotide
  Target: SCN10A; (-) strand; PAM type: YTN; PAM sequence: CTA
ataatacctactctctggat

SEQ ID NO: 42954 - DNA, 20 bp, Artificial Sequence
  Description of Artificial Sequence: Synthetic oligonucleotide
  Target: SCN10A; (-) strand; PAM type: YTN; PAM sequence: TTC
aatggggctaataataccta

SEQ ID NO: 42955 - DNA, 20 bp, Artificial Sequence
  Description of Artificial Sequence: Synthetic oligonucleotide
  Target: SCN10A; (-) strand; PAM type: YTN; PAM sequence: TTC
attcaatggggctaataata

SEQ ID NO: 42956 - DNA, 20 bp, Artificial Sequence
  Description of Artificial Sequence: Synthetic oligonucleotide
  Target: SCN10A; (-) strand; PAM type: YTN; PAM sequence: CTC
attcattcaatggggctaat

SEQ ID NO: 42957 - DNA, 20 bp, Artificial Sequence
  Description of Artificial Sequence: Synthetic oligonucleotide
  Target: SCN10A; (-) strand; PAM type: YTN; PAM sequence: TTC
tcattcattcaatggggcta

SEQ ID NO: 42958 - DNA, 20 bp, Artificial Sequence
  Description of Artificial Sequence: Synthetic oligonucleotide
  Target: SCN10A; (-) strand; PAM type: YTN; PAM sequence: TTT
ctcattcattcaatggggct

SEQ ID NO: 42959 - DNA, 20 bp, Artificial Sequence
  Description of Artificial Sequence: Synthetic oligonucleotide
  Target: SCN10A; (-) strand; PAM type: YTN; PAM sequence: TTT
tctcattcattcaatggggc

SEQ ID NO: 42960 - DNA, 20 bp, Artificial Sequence
  Description of Artificial Sequence: Synthetic oligonucleotide
  Target: SCN10A; (-) strand; PAM type: YTN; PAM sequence: CTC
agttttctcattcattcaat

SEQ ID NO: 42961 - DNA, 20 bp, Artificial Sequence
  Description of Artificial Sequence: Synthetic oligonucleotide
  Target: SCN10A; (-) strand; PAM type: YTN; PAM sequence: CTG
agtctcagttttctcattca

SEQ ID NO: 42962 - DNA, 20 bp, Artificial Sequence
  Description of Artificial Sequence: Synthetic oligonucleotide
  Target: SCN10A; (-) strand; PAM type: YTN; PAM sequence: CTC
tgagtctcagttttctcatt

SEQ ID NO: 42963 - DNA, 20 bp, Artificial Sequence
  Description of Artificial Sequence: Synthetic oligonucleotide
  Target: SCN10A; (-) strand; PAM type: YTN; PAM sequence: TTA
aacccctctgagtctcagtt

SEQ ID NO: 42964 - DNA, 20 bp, Artificial Sequence
  Description of Artificial Sequence: Synthetic oligonucleotide
  Target: SCN10A; (-) strand; PAM type: YTN; PAM sequence: TTT
aaacccctctgagtctcagt

SEQ ID NO: 42965 - DNA, 20 bp, Artificial Sequence
  Description of Artificial Sequence: Synthetic oligonucleotide
  Target: SCN10A; (-) strand; PAM type: YTN; PAM sequence: TTT
taaacccctctgagtctcag

SEQ ID NO: 42966 - DNA, 20 bp, Artificial Sequence
  Description of Artificial Sequence: Synthetic oligonucleotide
  Target: SCN10A; (-) strand; PAM type: YTN; PAM sequence: CTG
gcaatattttaaacccctct

SEQ ID NO: 42967 - DNA, 20 bp, Artificial Sequence
  Description of Artificial Sequence: Synthetic oligonucleotide
  Target: SCN10A; (-) strand; PAM type: YTN; PAM sequence: CTC
atgctggcaatattttaaac

SEQ ID NO: 42968 - DNA, 20 bp, Artificial Sequence
  Description of Artificial Sequence: Synthetic oligonucleotide
  Target: SCN10A; (-) strand; PAM type: YTN; PAM sequence: TTG
tggatggctcatgctggcaa

SEQ ID NO: 42969 - DNA, 20 bp, Artificial Sequence
  Description of Artificial Sequence: Synthetic oligonucleotide
  Target: SCN10A; (-) strand; PAM type: YTN; PAM sequence: CTT
gtggatggctcatgctggca

SEQ ID NO: 42970 - DNA, 20 bp, Artificial Sequence
  Description of Artificial Sequence: Synthetic oligonucleotide
  Target: SCN10A; (-) strand; PAM type: YTN; PAM sequence: CTA
cttgtggatggctcatgctg

SEQ ID NO: 42971 - DNA, 20 bp, Artificial Sequence
  Description of Artificial Sequence: Synthetic oligonucleotide
  Target: SCN10A; (-) strand; PAM type: YTN; PAM sequence: CTC
aactacttgtggatggctca

SEQ ID NO: 42972 - DNA, 20 bp, Artificial Sequence
  Description of Artificial Sequence: Synthetic oligonucleotide
  Target: SCN10A; (-) strand; PAM type: YTN; PAM sequence: CTG
actcaactacttgtggatgg

SEQ ID NO: 42973 - DNA, 20 bp, Artificial Sequence
  Description of Artificial Sequence: Synthetic oligonucleotide
  Target: SCN10A; (-) strand; PAM type: YTN; PAM sequence: TTC
ctgactcaactacttgtgga

SEQ ID NO: 42974 - DNA, 20 bp, Artificial Sequence
  Description of Artificial Sequence: Synthetic oligonucleotide
  Target: SCN10A; (-) strand; PAM type: YTN; PAM sequence: TTG
cattcctgactcaactactt

SEQ ID NO: 42975 - DNA, 20 bp, Artificial Sequence
  Description of Artificial Sequence: Synthetic oligonucleotide
  Target: SCN10A; (-) strand; PAM type: YTN; PAM sequence: TTT
gcattcctgactcaactact

SEQ ID NO: 42976 - DNA, 20 bp, Artificial Sequence
  Description of Artificial Sequence: Synthetic oligonucleotide
  Target: SCN10A; (-) strand; PAM type: YTN; PAM sequence: CTG
ggtttgcattcctgactcaa

SEQ ID NO: 42977 - DNA, 20 bp, Artificial Sequence
  Description of Artificial Sequence: Synthetic oligonucleotide
  Target: SCN10A; (-) strand; PAM type: YTN; PAM sequence: CTA
catggataagtcacagagta

SEQ ID NO: 42978 - DNA, 20 bp, Artificial Sequence
  Description of Artificial Sequence: Synthetic oligonucleotide
  Target: SCN10A; (-) strand; PAM type: YTN; PAM sequence: CTG
agatcccgagagaaaagggg

SEQ ID NO: 42979 - DNA, 20 bp, Artificial Sequence
  Description of Artificial Sequence: Synthetic oligonucleotide
  Target: SCN10A; (-) strand; PAM type: YTN; PAM sequence: TTG
cgtaactgagatcccgagag

SEQ ID NO: 42980 - DNA, 20 bp, Artificial Sequence
  Description of Artificial Sequence: Synthetic oligonucleotide
  Target: SCN10A; (-) strand; PAM type: YTN; PAM sequence: TTT
gcgtaactgagatcccgaga

SEQ ID NO: 42981 - DNA, 20 bp, Artificial Sequence
  Description of Artificial Sequence: Synthetic oligonucleotide
  Target: SCN10A; (-) strand; PAM type: YTN; PAM sequence: CTA
gatttgcgtaactgagatcc

SEQ ID NO: 42982 - DNA, 20 bp, Artificial Sequence
  Description of Artificial Sequence: Synthetic oligonucleotide
  Target: SCN10A; (-) strand; PAM type: YTN; PAM sequence: TTC
tagatttgcgtaactgagat

SEQ ID NO: 42983 - DNA, 20 bp, Artificial Sequence
  Description of Artificial Sequence: Synthetic oligonucleotide
  Target: SCN10A; (-) strand; PAM type: YTN; PAM sequence: CTG
ttctagatttgcgtaactga

SEQ ID NO: 42984 - DNA, 20 bp, Artificial Sequence
  Description of Artificial Sequence: Synthetic oligonucleotide
  Target: SCN10A; (-) strand; PAM type: YTN; PAM sequence: CTG
aggtagataggcgctgttct

SEQ ID NO: 42985 - DNA, 20 bp, Artificial Sequence
  Description of Artificial Sequence: Synthetic oligonucleotide
  Target: SCN10A; (-) strand; PAM type: YTN; PAM sequence: TTC
catacccctgaggtagatag

SEQ ID NO: 42986 - DNA, 20 bp, Artificial Sequence
  Description of Artificial Sequence: Synthetic oligonucleotide
  Target: SCN10A; (-) strand; PAM type: YTN; PAM sequence: CTT
ccatacccctgaggtagata

SEQ ID NO: 42987 - DNA, 20 bp, Artificial Sequence
  Description of Artificial Sequence: Synthetic oligonucleotide
  Target: SCN10A; (-) strand; PAM type: YTN; PAM sequence: TTA
atgccttccatacccctgag

SEQ ID NO: 42988 - DNA, 20 bp, Artificial Sequence
  Description of Artificial Sequence: Synthetic oligonucleotide
  Target: SCN10A; (-) strand; PAM type: YTN; PAM sequence: TTT
aatgccttccatacccctga

SEQ ID NO: 42989 - DNA, 20 bp, Artificial Sequence
  Description of Artificial Sequence: Synthetic oligonucleotide
  Target: SCN10A; (-) strand; PAM type: YTN; PAM sequence: TTC
atttaatgccttccataccc

SEQ ID NO: 42990 - DNA, 20 bp, Artificial Sequence
  Description of Artificial Sequence: Synthetic oligonucleotide
  Target: SCN10A; (-) strand; PAM type: YTN; PAM sequence: TTT
catttaatgccttccatacc

SEQ ID NO: 42991 - DNA, 20 bp, Artificial Sequence
  Description of Artificial Sequence: Synthetic oligonucleotide
  Target: SCN10A; (-) strand; PAM type: YTN; PAM sequence: CTT
tcatttaatgccttccatac

SEQ ID NO: 42992 - DNA, 20 bp, Artificial Sequence
  Description of Artificial Sequence: Synthetic oligonucleotide
  Target: SCN10A; (-) strand; PAM type: YTN; PAM sequence: TTA
tcctttcatttaatgccttc

SEQ ID NO: 42993 - DNA, 20 bp, Artificial Sequence
  Description of Artificial Sequence: Synthetic oligonucleotide
  Target: SCN10A; (-) strand; PAM type: YTN; PAM sequence: CTA
ttatcctttcatttaatgcc

SEQ ID NO: 42994 - DNA, 20 bp, Artificial Sequence
  Description of Artificial Sequence: Synthetic oligonucleotide
  Target: SCN10A; (-) strand; PAM type: YTN; PAM sequence: TTC
ctattatcctttcatttaat

SEQ ID NO: 42995 - DNA, 20 bp, Artificial Sequence
  Description of Artificial Sequence: Synthetic oligonucleotide
  Target: SCN10A; (-) strand; PAM type: YTN; PAM sequence: TTT
cctattatcctttcatttaa

SEQ ID NO: 42996 - DNA, 20 bp, Artificial Sequence
  Description of Artificial Sequence: Synthetic oligonucleotide
  Target: SCN10A; (-) strand; PAM type: YTN; PAM sequence: TTT
tcctattatcctttcattta

SEQ ID NO: 42997 - DNA, 20 bp, Artificial Sequence
  Description of Artificial Sequence: Synthetic oligonucleotide
  Target: SCN10A; (-) strand; PAM type: YTN; PAM sequence: TTA
taagaaaatgtcagggcaat

SEQ ID NO: 42998 - DNA, 20 bp, Artificial Sequence
  Description of Artificial Sequence: Synthetic oligonucleotide
  Target: SCN10A; (-) strand; PAM type: YTN; PAM sequence: TTT
ataagaaaatgtcagggcaa

SEQ ID NO: 42999 - DNA, 20 bp, Artificial Sequence
  Description of Artificial Sequence: Synthetic oligonucleotide
  Target: SCN10A; (-) strand; PAM type: YTN; PAM sequence: CTC
atgtttataagaaaatgtca

SEQ ID NO: 43000 - DNA, 20 bp, Artificial Sequence
  Description of Artificial Sequence: Synthetic oligonucleotide
  Target: SCN10A; (-) strand; PAM type: YTN; PAM sequence: CTC
tcatgtttataagaaaatgt

SEQ ID NO: 43001 - DNA, 20 bp, Artificial Sequence
  Description of Artificial Sequence: Synthetic oligonucleotide
  Target: SCN10A; (-) strand; PAM type: YTN; PAM sequence: TTA
ataggaatcgaatcccagat

SEQ ID NO: 43002 - DNA, 20 bp, Artificial Sequence
  Description of Artificial Sequence: Synthetic oligonucleotide
  Target: SCN10A; (-) strand; PAM type: YTN; PAM sequence: CTG
attaataggaatcgaatccc

SEQ ID NO: 43003 - DNA, 20 bp, Artificial Sequence
  Description of Artificial Sequence: Synthetic oligonucleotide
  Target: SCN10A; (-) strand; PAM type: YTN; PAM sequence: CTC
tgattaataggaatcgaatc

SEQ ID NO: 43004 - DNA, 20 bp, Artificial Sequence
  Description of Artificial Sequence: Synthetic oligonucleotide
  Target: SCN10A; (-) strand; PAM type: YTN; PAM sequence: CTC
caagggtgccgactctgatt

SEQ ID NO: 43005 - DNA, 20 bp, Artificial Sequence
  Description of Artificial Sequence: Synthetic oligonucleotide
  Target: SCN10A; (-) strand; PAM type: YTN; PAM sequence: TTG
tgcctccaagggtgccgact

SEQ ID NO: 43006 - DNA, 20 bp, Artificial Sequence
  Description of Artificial Sequence: Synthetic oligonucleotide
  Target: SCN10A; (-) strand; PAM type: YTN; PAM sequence: CTT
gtgcctccaagggtgccgac

SEQ ID NO: 43007 - DNA, 20 bp, Artificial Sequence
  Description of Artificial Sequence: Synthetic oligonucleotide
  Target: SCN10A; (-) strand; PAM type: YTN; PAM sequence: TTG
ggatggggaggaaggcttgt

SEQ ID NO: 43008 - DNA, 20 bp, Artificial Sequence
  Description of Artificial Sequence: Synthetic oligonucleotide
  Target: SCN10A; (-) strand; PAM type: YTN; PAM sequence: CTT
gggatggggaggaaggcttg

SEQ ID NO: 43009 - DNA, 20 bp, Artificial Sequence
  Description of Artificial Sequence: Synthetic oligonucleotide
  Target: SCN10A; (-) strand; PAM type: YTN; PAM sequence: CTC
cttgggatggggaggaaggc

SEQ ID NO: 43010 - DNA, 20 bp, Artificial Sequence
  Description of Artificial Sequence: Synthetic oligonucleotide
  Target: SCN10A; (-) strand; PAM type: YTN; PAM sequence: CTG
gcagaatcccaaccctcctt

SEQ ID NO: 43011 - DNA, 20 bp, Artificial Sequence
  Description of Artificial Sequence: Synthetic oligonucleotide
  Target: SCN10A; (-) strand; PAM type: YTN; PAM sequence: CTC
aggaaaggccatggcccagc

SEQ ID NO: 43012 - DNA, 20 bp, Artificial Sequence
  Description of Artificial Sequence: Synthetic oligonucleotide
  Target: SCN10A; (-) strand; PAM type: YTN; PAM sequence: CTG
agtcagggcacctcaggaaa

SEQ ID NO: 43013 - DNA, 20 bp, Artificial Sequence
  Description of Artificial Sequence: Synthetic oligonucleotide
  Target: SCN10A; (-) strand; PAM type: YTN; PAM sequence: TTG
ggggatatgatccccacaaa

SEQ ID NO: 43014 - DNA, 20 bp, Artificial Sequence
  Description of Artificial Sequence: Synthetic oligonucleotide
  Target: SCN10A; (-) strand; PAM type: YTN; PAM sequence: CTG
ttgggggatatgatccccac

SEQ ID NO: 43015 - DNA, 20 bp, Artificial Sequence
  Description of Artificial Sequence: Synthetic oligonucleotide
  Target: SCN10A; (-) strand; PAM type: YTN; PAM sequence: CTG
acctgttgggggatatgatc

SEQ ID NO: 43016 - DNA, 20 bp, Artificial Sequence
  Description of Artificial Sequence: Synthetic oligonucleotide
  Target: SCN10A; (-) strand; PAM type: YTN; PAM sequence: TTG
ctgacctgttgggggatatg

SEQ ID NO: 43017 - DNA, 20 bp, Artificial Sequence
  Description of Artificial Sequence: Synthetic oligonucleotide
  Target: SCN10A; (-) strand; PAM type: YTN; PAM sequence: CTT
gctgacctgttgggggatat

SEQ ID NO: 43018 - DNA, 20 bp, Artificial Sequence
  Description of Artificial Sequence: Synthetic oligonucleotide
  Target: SCN10A; (-) strand; PAM type: YTN; PAM sequence: CTA
gaacttgctgacctgttggg

SEQ ID NO: 43019 - DNA, 20 bp, Artificial Sequence
  Description of Artificial Sequence: Synthetic oligonucleotide
  Target: SCN10A; (-) strand; PAM type: YTN; PAM sequence: CTG
ggagaatacaagcagggaaa

SEQ ID NO: 43020 - DNA, 20 bp, Artificial Sequence
  Description of Artificial Sequence: Synthetic oligonucleotide
  Target: SCN10A; (-) strand; PAM type: YTN; PAM sequence: TTC
caagtgagccctgggagaat

SEQ ID NO: 43021 - DNA, 20 bp, Artificial Sequence
  Description of Artificial Sequence: Synthetic oligonucleotide
  Target: SCN10A; (-) strand; PAM type: YTN; PAM sequence: TTA
gatgtgttccaagtgagccc

SEQ ID NO: 43022 - DNA, 20 bp, Artificial Sequence
  Description of Artificial Sequence: Synthetic oligonucleotide
  Target: SCN10A; (-) strand; PAM type: YTN; PAM sequence: CTG
gaaccaggtgtgttagatgt

SEQ ID NO: 43023 - DNA, 20 bp, Artificial Sequence
  Description of Artificial Sequence: Synthetic oligonucleotide
  Target: SCN10A; (-) strand; PAM type: YTN; PAM sequence: TTC
ccaactggaaccaggtgtgt

SEQ ID NO: 43024 - DNA, 20 bp, Artificial Sequence
  Description of Artificial Sequence: Synthetic oligonucleotide
  Target: SCN10A; (-) strand; PAM type: YTN; PAM sequence: CTT
cccaactggaaccaggtgtg

SEQ ID NO: 43025 - DNA, 20 bp, Artificial Sequence
  Description of Artificial Sequence: Synthetic oligonucleotide
  Target: SCN10A; (-) strand; PAM type: YTN; PAM sequence: TTG
gtcttcccaactggaaccag

SEQ ID NO: 43026 - DNA, 20 bp, Artificial Sequence
  Description of Artificial Sequence: Synthetic oligonucleotide
  Target: SCN10A; (-) strand; PAM type: YTN; PAM sequence: CTT
ggtcttcccaactggaacca

SEQ ID NO: 43027 - DNA, 20 bp, Artificial Sequence
  Description of Artificial Sequence: Synthetic oligonucleotide
  Target: SCN10A; (-) strand; PAM type: YTN; PAM sequence: CTC
aaagggatcttggtcttccc

SEQ ID NO: 43028 - DNA, 20 bp, Artificial Sequence
  Description of Artificial Sequence: Synthetic oligonucleotide
  Target: SCN10A; (-) strand; PAM type: YTN; PAM sequence: TTC
acatctcaaagggatcttgg

SEQ ID NO: 43029 - DNA, 20 bp, Artificial Sequence
  Description of Artificial Sequence: Synthetic oligonucleotide
  Target: SCN10A; (-) strand; PAM type: YTN; PAM sequence: CTC
aggattcacatctcaaaggg

SEQ ID NO: 43030 - DNA, 20 bp, Artificial Sequence
  Description of Artificial Sequence: Synthetic oligonucleotide
  Target: SCN10A; (-) strand; PAM type: YTN; PAM sequence: CTC
actcaggattcacatctcaa

SEQ ID NO: 43031 - DNA, 20 bp, Artificial Sequence
  Description of Artificial Sequence: Synthetic oligonucleotide
  Target: SCN10A; (-) strand; PAM type: YTN; PAM sequence: CTA
acatcctcactcaggattca

SEQ ID NO: 43032 - DNA, 20 bp, Artificial Sequence
  Description of Artificial Sequence: Synthetic oligonucleotide
  Target: SCN10A; (-) strand; PAM type: YTN; PAM sequence: CTG
tcagcaatgccccactaaca

SEQ ID NO: 43033 - DNA, 20 bp, Artificial Sequence
  Description of Artificial Sequence: Synthetic oligonucleotide
  Target: SCN10A; (-) strand; PAM type: YTN; PAM sequence: CTC
tgtcagcaatgccccactaa

SEQ ID NO: 43034 - DNA, 20 bp, Artificial Sequence
  Description of Artificial Sequence: Synthetic oligonucleotide
  Target: SCN10A; (-) strand; PAM type: YTN; PAM sequence: CTC
tctgtcagcaatgccccact

SEQ ID NO: 43035 - DNA, 20 bp, Artificial Sequence
  Description of Artificial Sequence: Synthetic oligonucleotide
  Target: SCN10A; (-) strand; PAM type: YTN; PAM sequence: TTC
tctctgtcagcaatgcccca

SEQ ID NO: 43036 - DNA, 20 bp, Artificial Sequence
  Description of Artificial Sequence: Synthetic oligonucleotide
  Target: SCN10A; (-) strand; PAM type: YTN; PAM sequence: TTT
ctctctgtcagcaatgcccc

SEQ ID NO: 43037 - DNA, 20 bp, Artificial Sequence
  Description of Artificial Sequence: Synthetic oligonucleotide
  Target: SCN10A; (-) strand; PAM type: YTN; PAM sequence: TTG
catttctctctgtcagcaat

SEQ ID NO: 43038 - DNA, 20 bp, Artificial Sequence
  Description of Artificial Sequence: Synthetic oligonucleotide
  Target: SCN10A; (-) strand; PAM type: YTN; PAM sequence: TTG
caggaagagttgcatttctc

SEQ ID NO: 43039 - DNA, 20 bp, Artificial Sequence
  Description of Artificial Sequence: Synthetic oligonucleotide
  Target: SCN10A; (-) strand; PAM type: YTN; PAM sequence: CTG
ttgcaggaagagttgcattt

SEQ ID NO: 43040 - DNA, 20 bp, Artificial Sequence
  Description of Artificial Sequence: Synthetic oligonucleotide
  Target: SCN10A; (-) strand; PAM type: YTN; PAM sequence: TTG
ctgttgcaggaagagttgca

SEQ ID NO: 43041 - DNA, 20 bp, Artificial Sequence
  Description of Artificial Sequence: Synthetic oligonucleotide
  Target: SCN10A; (-) strand; PAM type: YTN; PAM sequence: CTG
tgattgctgttgcaggaaga

SEQ ID NO: 43042 - DNA, 20 bp, Artificial Sequence
  Description of Artificial Sequence: Synthetic oligonucleotide
  Target: SCN10A; (-) strand; PAM type: YTN; PAM sequence: TTG
ccctgtgattgctgttgcag

SEQ ID NO: 43043 - DNA, 20 bp, Artificial Sequence
  Description of Artificial Sequence: Synthetic oligonucleotide
  Target: SCN10A; (-) strand; PAM type: YTN; PAM sequence: CTT
gccctgtgattgctgttgca

SEQ ID NO: 43044 - DNA, 20 bp, Artificial Sequence
  Description of Artificial Sequence: Synthetic oligonucleotide
  Target: SCN10A; (-) strand; PAM type: YTN; PAM sequence: CTA
acccttgccctgtgattgct

SEQ ID NO: 43045 - DNA, 20 bp, Artificial Sequence
  Description of Artificial Sequence: Synthetic oligonucleotide
  Target: SCN10A; (-) strand; PAM type: YTN; PAM sequence: TTA
atatcagtgctaacccttgc

SEQ ID NO: 43046 - DNA, 20 bp, Artificial Sequence
  Description of Artificial Sequence: Synthetic oligonucleotide
  Target: SCN10A; (-) strand; PAM type: YTN; PAM sequence: TTT
aatatcagtgctaacccttg

SEQ ID NO: 43047 - DNA, 20 bp, Artificial Sequence
  Description of Artificial Sequence: Synthetic oligonucleotide
  Target: SCN10A; (-) strand; PAM type: YTN; PAM sequence: CTT
taatatcagtgctaaccctt

SEQ ID NO: 43048 - DNA, 20 bp, Artificial Sequence
  Description of Artificial Sequence: Synthetic oligonucleotide
  Target: SCN10A; (-) strand; PAM type: YTN; PAM sequence: CTC
acagcccatcactttaatat

SEQ ID NO: 43049 - DNA, 20 bp, Artificial Sequence
  Description of Artificial Sequence: Synthetic oligonucleotide
  Target: SCN10A; (-) strand; PAM type: YTN; PAM sequence: CTA
ctcacagcccatcactttaa

SEQ ID NO: 43050 - DNA, 20 bp, Artificial Sequence
  Description of Artificial Sequence: Synthetic oligonucleotide
  Target: SCN10A; (-) strand; PAM type: YTN; PAM sequence: CTG
acaaaagccaacactactca

SEQ ID NO: 43051 - DNA, 20 bp, Artificial Sequence
  Description of Artificial Sequence: Synthetic oligonucleotide
  Target: SCN10A; (-) strand; PAM type: YTN; PAM sequence: CTC
ctgacaaaagccaacactac

SEQ ID NO: 43052 - DNA, 20 bp, Artificial Sequence
  Description of Artificial Sequence: Synthetic oligonucleotide
  Target: SCN10A; (-) strand; PAM type: YTN; PAM sequence: CTG
gcctcctgacaaaagccaac

SEQ ID NO: 43053 - DNA, 20 bp, Artificial Sequence
  Description of Artificial Sequence: Synthetic oligonucleotide
  Target: SCN10A; (-) strand; PAM type: YTN; PAM sequence: CTC
tggcctcctgacaaaagcca

SEQ ID NO: 43054 - DNA, 20 bp, Artificial Sequence
  Description of Artificial Sequence: Synthetic oligonucleotide
  Target: SCN10A; (-) strand; PAM type: YTN; PAM sequence: CTG
cccagctctggcctcctgac

SEQ ID NO: 43055 - DNA, 20 bp, Artificial Sequence
  Description of Artificial Sequence: Synthetic oligonucleotide
  Target: SCN10A; (-) strand; PAM type: YTN; PAM sequence: TTC
cctgcccagctctggcctcc

SEQ ID NO: 43056 - DNA, 20 bp, Artificial Sequence
  Description of Artificial Sequence: Synthetic oligonucleotide
  Target: SCN10A; (-) strand; PAM type: YTN; PAM sequence: CTG
ttccctgcccagctctggcc

SEQ ID NO: 43057 - DNA, 20 bp, Artificial Sequence
  Description of Artificial Sequence: Synthetic oligonucleotide
  Target: SCN10A; (-) strand; PAM type: YTN; PAM sequence: TTC
ctgttccctgcccagctctg

SEQ ID NO: 43058 - DNA, 20 bp, Artificial Sequence
  Description of Artificial Sequence: Synthetic oligonucleotide
  Target: SCN10A; (-) strand; PAM type: YTN; PAM sequence: TTT
cctgttccctgcccagctct

SEQ ID NO: 43059 - DNA, 20 bp, Artificial Sequence
  Description of Artificial Sequence: Synthetic oligonucleotide
  Target: SCN10A; (-) strand; PAM type: YTN; PAM sequence: TTA
tatttcctgttccctgccca

SEQ ID NO: 43060 - DNA, 20 bp, Artificial Sequence
  Description of Artificial Sequence: Synthetic oligonucleotide
  Target: SCN10A; (-) strand; PAM type: YTN; PAM sequence: CTT
atatttcctgttccctgccc

SEQ ID NO: 43061 - DNA, 20 bp, Artificial Sequence
  Description of Artificial Sequence: Synthetic oligonucleotide
  Target: SCN10A; (-) strand; PAM type: YTN; PAM sequence: CTG
tagtggtaagccttatattt

SEQ ID NO: 43062 - DNA, 20 bp, Artificial Sequence
  Description of Artificial Sequence: Synthetic oligonucleotide
  Target: SCN10A; (-) strand; PAM type: YTN; PAM sequence: CTG
ctgtagtggtaagccttata

SEQ ID NO: 43063 - DNA, 20 bp, Artificial Sequence
  Description of Artificial Sequence: Synthetic oligonucleotide
  Target: SCN10A; (-) strand; PAM type: YTN; PAM sequence: TTC
tgctgtagtggtaagcctta

SEQ ID NO: 43064 - DNA, 20 bp, Artificial Sequence
  Description of Artificial Sequence: Synthetic oligonucleotide
  Target: SCN10A; (-) strand; PAM type: YTN; PAM sequence: TTT
ctgctgtagtggtaagcctt

SEQ ID NO: 43065 - DNA, 20 bp, Artificial Sequence
  Description of Artificial Sequence: Synthetic oligonucleotide
  Target: SCN10A; (-) strand; PAM type: YTN; PAM sequence: CTG
gtttctgctgtagtggtaag

SEQ ID NO: 43066 - DNA, 20 bp, Artificial Sequence
  Description of Artificial Sequence: Synthetic oligonucleotide
  Target: SCN10A; (-) strand; PAM type: YTN; PAM sequence: TTC
tggtttctgctgtagtggta

SEQ ID NO: 43067 - DNA, 20 bp, Artificial Sequence
  Description of Artificial Sequence: Synthetic oligonucleotide
  Target: SCN10A; (-) strand; PAM type: YTN; PAM sequence: TTT
ctggtttctgctgtagtggt

SEQ ID NO: 43068 - DNA, 20 bp, Artificial Sequence
  Description of Artificial Sequence: Synthetic oligonucleotide
  Target: SCN10A; (-) strand; PAM type: YTN; PAM sequence: CTC
aggagtttctggtttctgct

SEQ ID NO: 43069 - DNA, 20 bp, Artificial Sequence
  Description of Artificial Sequence: Synthetic oligonucleotide
  Target: SCN10A; (-) strand; PAM type: YTN; PAM sequence: TTC
aatcaacagaaaaaaaagat

SEQ ID NO: 43070 - DNA, 20 bp, Artificial Sequence
  Description of Artificial Sequence: Synthetic oligonucleotide
  Target: SCN10A; (-) strand; PAM type: YTN; PAM sequence: CTT
caatcaacagaaaaaaaaga

SEQ ID NO: 43071 - DNA, 20 bp, Artificial Sequence
  Description of Artificial Sequence: Synthetic oligonucleotide
  Target: SCN10A; (-) strand; PAM type: YTN; PAM sequence: TTG
acaacttcaatcaacagaaa

SEQ ID NO: 43072 - DNA, 20 bp, Artificial Sequence
  Description of Artificial Sequence: Synthetic oligonucleotide
  Target: SCN10A; (-) strand; PAM type: YTN; PAM sequence: TTG
gggtcataattgacaacttc

SEQ ID NO: 43073 - DNA, 20 bp, Artificial Sequence
  Description of Artificial Sequence: Synthetic oligonucleotide
  Target: SCN10A; (-) strand; PAM type: YTN; PAM sequence: TTG
ttggggtcataattgacaac

SEQ ID NO: 43074 - DNA, 20 bp, Artificial Sequence
  Description of Artificial Sequence: Synthetic oligonucleotide
  Target: SCN10A; (-) strand; PAM type: YTN; PAM sequence: TTT
gttggggtcataattgacaa

SEQ ID NO: 43075 - DNA, 20 bp, Artificial Sequence
  Description of Artificial Sequence: Synthetic oligonucleotide
  Target: SCN10A; (-) strand; PAM type: YTN; PAM sequence: CTT
tgttggggtcataattgaca

SEQ ID NO: 43076 - DNA, 20 bp, Artificial Sequence
  Description of Artificial Sequence: Synthetic oligonucleotide
  Target: SCN10A; (-) strand; PAM type: YTN; PAM sequence: CTC
tttgttggggtcataattga

SEQ ID NO: 43077 - DNA, 20 bp, Artificial Sequence
  Description of Artificial Sequence: Synthetic oligonucleotide
  Target: SCN10A; (-) strand; PAM type: YTN; PAM sequence: CTG
aatctctttgttggggtcat

SEQ ID NO: 43078 - DNA, 20 bp, Artificial Sequence
  Description of Artificial Sequence: Synthetic oligonucleotide
  Target: SCN10A; (-) strand; PAM type: YTN; PAM sequence: TTC
acactgaatctctttgttgg

SEQ ID NO: 43079 - DNA, 20 bp, Artificial Sequence
  Description of Artificial Sequence: Synthetic oligonucleotide
  Target: SCN10A; (-) strand; PAM type: YTN; PAM sequence: CTT
cacactgaatctctttgttg

SEQ ID NO: 43080 - DNA, 20 bp, Artificial Sequence
  Description of Artificial Sequence: Synthetic oligonucleotide
  Target: SCN10A; (-) strand; PAM type: YTN; PAM sequence: TTC
ttcacactgaatctctttgt

SEQ ID NO: 43081 - DNA, 20 bp, Artificial Sequence
  Description of Artificial Sequence: Synthetic oligonucleotide
  Target: SCN10A; (-) strand; PAM type: YTN; PAM sequence: CTT
cttcacactgaatctctttg

SEQ ID NO: 43082 - DNA, 20 bp, Artificial Sequence
  Description of Artificial Sequence: Synthetic oligonucleotide
  Target: SCN10A; (-) strand; PAM type: YTN; PAM sequence: TTG
gaggcttcttcacactgaat

SEQ ID NO: 43083 - DNA, 20 bp, Artificial Sequence
  Description of Artificial Sequence: Synthetic oligonucleotide
  Target: SCN10A; (-) strand; PAM type: YTN; PAM sequence: TTT
ggaggcttcttcacactgaa

SEQ ID NO: 43084 - DNA, 20 bp, Artificial Sequence
  Description of Artificial Sequence: Synthetic oligonucleotide
  Target: SCN10A; (-) strand; PAM type: YTN; PAM sequence: TTT
tggaggcttcttcacactga

SEQ ID NO: 43085 - DNA, 20 bp, Artificial Sequence
  Description of Artificial Sequence: Synthetic oligonucleotide
  Target: SCN10A; (-) strand; PAM type: YTN; PAM sequence: TTT
ttggaggcttcttcacactg

SEQ ID NO: 43086 - DNA, 20 bp, Artificial Sequence
  Description of Artificial Sequence: Synthetic oligonucleotide
  Target: SCN10A; (-) strand; PAM type: YTN; PAM sequence: TTC
atcatttttggaggcttctt

SEQ ID NO: 43087 - DNA, 20 bp, Artificial Sequence
  Description of Artificial Sequence: Synthetic oligonucleotide
  Target: SCN10A; (-) strand; PAM type: YTN; PAM sequence: CTT
catcatttttggaggcttct

SEQ ID NO: 43088 - DNA, 20 bp, Artificial Sequence
  Description of Artificial Sequence: Synthetic oligonucleotide
  Target: SCN10A; (-) strand; PAM type: YTN; PAM sequence: TTG
tcatcttcatcatttttgga

SEQ ID NO: 43089 - DNA, 20 bp, Artificial Sequence
  Description of Artificial Sequence: Synthetic oligonucleotide
  Target: SCN10A; (-) strand; PAM type: YTN; PAM sequence: TTT
gtcatcttcatcatttttgg

SEQ ID NO: 43090 - DNA, 20 bp, Artificial Sequence
  Description of Artificial Sequence: Synthetic oligonucleotide
  Target: SCN10A; (-) strand; PAM type: YTN; PAM sequence: CTT
tgtcatcttcatcatttttg

SEQ ID NO: 43091 - DNA, 20 bp, Artificial Sequence
  Description of Artificial Sequence: Synthetic oligonucleotide
  Target: SCN10A; (-) strand; PAM type: YTN; PAM sequence: TTG
tactttgtcatcttcatcat

SEQ ID NO: 43092 - DNA, 20 bp, Artificial Sequence
  Description of Artificial Sequence: Synthetic oligonucleotide
  Target: SCN10A; (-) strand; PAM type: YTN; PAM sequence: TTT
gtactttgtcatcttcatca

SEQ ID NO: 43093 - DNA, 20 bp, Artificial Sequence
  Description of Artificial Sequence: Synthetic oligonucleotide
  Target: SCN10A; (-) strand; PAM type: YTN; PAM sequence: CTG
gtcacaggtcaacatgcaac

SEQ ID NO: 43094 - DNA, 20 bp, Artificial Sequence
  Description of Artificial Sequence: Synthetic oligonucleotide
  Target: SCN10A; (-) strand; PAM type: YTN; PAM sequence: TTG
tctggtcacaggtcaacatg

SEQ ID NO: 43095 - DNA, 20 bp, Artificial Sequence
  Description of Artificial Sequence: Synthetic oligonucleotide
  Target: SCN10A; (-) strand; PAM type: YTN; PAM sequence: CTT
gtctggtcacaggtcaacat

SEQ ID NO: 43096 - DNA, 20 bp, Artificial Sequence
  Description of Artificial Sequence: Synthetic oligonucleotide
  Target: SCN10A; (-) strand; PAM type: YTN; PAM sequence: CTC
ccttgtctggtcacaggtca

SEQ ID NO: 43097 - DNA, 20 bp, Artificial Sequence
  Description of Artificial Sequence: Synthetic oligonucleotide
  Target: SCN10A; (-) strand; PAM type: YTN; PAM sequence: CTC
tcccttgtctggtcacaggt

SEQ ID NO: 43098 - DNA, 20 bp, Artificial Sequence
  Description of Artificial Sequence: Synthetic oligonucleotide
  Target: SCN10A; (-) strand; PAM type: YTN; PAM sequence: TTC
ccactctcccttgtctggtc

SEQ ID NO: 43099 - DNA, 20 bp, Artificial Sequence
  Description of Artificial Sequence: Synthetic oligonucleotide
  Target: SCN10A; (-) strand; PAM type: YTN; PAM sequence: CTT
cccactctcccttgtctggt

SEQ ID NO: 43100 - DNA, 20 bp, Artificial Sequence
  Description of Artificial Sequence: Synthetic oligonucleotide
  Target: SCN10A; (-) strand; PAM type: YTN; PAM sequence: CTC
cttcccactctcccttgtct

SEQ ID NO: 43101 - DNA, 20 bp, Artificial Sequence
  Description of Artificial Sequence: Synthetic oligonucleotide
  Target: SCN10A; (-) strand; PAM type: YTN; PAM sequence: CTA
agacacccaccctccttccc

SEQ ID NO: 43102 - DNA, 20 bp, Artificial Sequence
  Description of Artificial Sequence: Synthetic oligonucleotide
  Target: SCN10A; (-) strand; PAM type: YTN; PAM sequence: CTG
aactaagacacccaccctcc

SEQ ID NO: 43103 - DNA, 20 bp, Artificial Sequence
  Description of Artificial Sequence: Synthetic oligonucleotide
  Target: SCN10A; (-) strand; PAM type: YTN; PAM sequence: TTC
agagtgaacctgaactaaga

SEQ ID NO: 43104 - DNA, 20 bp, Artificial Sequence
  Description of Artificial Sequence: Synthetic oligonucleotide
  Target: SCN10A; (-) strand; PAM type: YTN; PAM sequence: TTT
cagagtgaacctgaactaag

SEQ ID NO: 43105 - DNA, 20 bp, Artificial Sequence
  Description of Artificial Sequence: Synthetic oligonucleotide
  Target: SCN10A; (-) strand; PAM type: YTN; PAM sequence: CTT
tcagagtgaacctgaactaa

SEQ ID NO: 43106 - DNA, 20 bp, Artificial Sequence
  Description of Artificial Sequence: Synthetic oligonucleotide
  Target: SCN10A; (-) strand; PAM type: YTN; PAM sequence: TTG
gctttcagagtgaacctgaa

SEQ ID NO: 43107 - DNA, 20 bp, Artificial Sequence
  Description of Artificial Sequence: Synthetic oligonucleotide
  Target: SCN10A; (-) strand; PAM type: YTN; PAM sequence: CTT
ggctttcagagtgaacctga

SEQ ID NO: 43108 - DNA, 20 bp, Artificial Sequence
  Description of Artificial Sequence: Synthetic oligonucleotide
  Target: SCN10A; (-) strand; PAM type: YTN; PAM sequence: TTA
ggcttggctttcagagtgaa

SEQ ID NO: 43109 - DNA, 20 bp, Artificial Sequence
  Description of Artificial Sequence: Synthetic oligonucleotide
  Target: SCN10A; (-) strand; PAM type: YTN; PAM sequence: CTT
aggcttggctttcagagtga

SEQ ID NO: 43110 - DNA, 20 bp, Artificial Sequence
  Description of Artificial Sequence: Synthetic oligonucleotide
  Target: SCN10A; (-) strand; PAM type: YTN; PAM sequence: CTG
cacccaggtccatgtcttag

SEQ ID NO: 43111 - DNA, 20 bp, Artificial Sequence
  Description of Artificial Sequence: Synthetic oligonucleotide
  Target: SCN10A; (-) strand; PAM type: YTN; PAM sequence: CTC
ccagataaatcacctgcacc

SEQ ID NO: 43112 - DNA, 20 bp, Artificial Sequence
  Description of Artificial Sequence: Synthetic oligonucleotide
  Target: SCN10A; (-) strand; PAM type: YTN; PAM sequence: TTG
gatcacctcccagataaatc

SEQ ID NO: 43113 - DNA, 20 bp, Artificial Sequence
  Description of Artificial Sequence: Synthetic oligonucleotide
  Target: SCN10A; (-) strand; PAM type: YTN; PAM sequence: CTT
ggatcacctcccagataaat

SEQ ID NO: 43114 - DNA, 20 bp, Artificial Sequence
  Description of Artificial Sequence: Synthetic oligonucleotide
  Target: SCN10A; (-) strand; PAM type: YTN; PAM sequence: TTC
cttggatcacctcccagata

SEQ ID NO: 43115 - DNA, 20 bp, Artificial Sequence
  Description of Artificial Sequence: Synthetic oligonucleotide
  Target: SCN10A; (-) strand; PAM type: YTN; PAM sequence: CTT
ccttggatcacctcccagat

SEQ ID NO: 43116 - DNA, 20 bp, Artificial Sequence
  Description of Artificial Sequence: Synthetic oligonucleotide
  Target: SCN10A; (-) strand; PAM type: YTN; PAM sequence: CTG
cttccttggatcacctccca

SEQ ID NO: 43117 - DNA, 20 bp, Artificial Sequence
  Description of Artificial Sequence: Synthetic oligonucleotide
  Target: SCN10A; (-) strand; PAM type: YTN; PAM sequence: TTC
ctgcttccttggatcacctc

SEQ ID NO: 43118 - DNA, 20 bp, Artificial Sequence
  Description of Artificial Sequence: Synthetic oligonucleotide
  Target: SCN10A; (-) strand; PAM type: YTN; PAM sequence: CTC
attcctgcttccttggatca

SEQ ID NO: 43119 - DNA, 20 bp, Artificial Sequence
  Description of Artificial Sequence: Synthetic oligonucleotide
  Target: SCN10A; (-) strand; PAM type: YTN; PAM sequence: CTC
cctcattcctgcttccttgg

SEQ ID NO: 43120 - DNA, 20 bp, Artificial Sequence
  Description of Artificial Sequence: Synthetic oligonucleotide
  Target: SCN10A; (-) strand; PAM type: YTN; PAM sequence: TTC
cccactccctcattcctgct

SEQ ID NO: 43121 - DNA, 20 bp, Artificial Sequence
  Description of Artificial Sequence: Synthetic oligonucleotide
  Target: SCN10A; (-) strand; PAM type: YTN; PAM sequence: CTT
ccccactccctcattcctgc

SEQ ID NO: 43122 - DNA, 20 bp, Artificial Sequence
  Description of Artificial Sequence: Synthetic oligonucleotide
  Target: SCN10A; (-) strand; PAM type: YTN; PAM sequence: TTC
ttccccactccctcattcct

SEQ ID NO: 43123 - DNA, 20 bp, Artificial Sequence
  Description of Artificial Sequence: Synthetic oligonucleotide
  Target: SCN10A; (-) strand; PAM type: YTN; PAM sequence: TTA
ttcttccccactccctcatt

SEQ ID NO: 43124 - DNA, 20 bp, Artificial Sequence
  Description of Artificial Sequence: Synthetic oligonucleotide
  Target: SCN10A; (-) strand; PAM type: YTN; PAM sequence: CTT
attcttccccactccctcat

SEQ ID NO: 43125 - DNA, 20 bp, Artificial Sequence
  Description of Artificial Sequence: Synthetic oligonucleotide
  Target: SCN10A; (-) strand; PAM type: YTN; PAM sequence: TTC
ccgcttattcttccccactc

SEQ ID NO: 43126 - DNA, 20 bp, Artificial Sequence
  Description of Artificial Sequence: Synthetic oligonucleotide
  Target: SCN10A; (-) strand; PAM type: YTN; PAM sequence: CTC
ccattcccgcttattcttcc

SEQ ID NO: 43127 - DNA, 20 bp, Artificial Sequence
  Description of Artificial Sequence: Synthetic oligonucleotide
  Target: SCN10A; (-) strand; PAM type: YTN; PAM sequence: TTC
tcccattcccgcttattctt

SEQ ID NO: 43128 - DNA, 20 bp, Artificial Sequence
  Description of Artificial Sequence: Synthetic oligonucleotide
  Target: SCN10A; (-) strand; PAM type: YTN; PAM sequence: CTT
ctcccattcccgcttattct

SEQ ID NO: 43129 - DNA, 20 bp, Artificial Sequence
  Description of Artificial Sequence: Synthetic oligonucleotide
  Target: SCN10A; (-) strand; PAM type: YTN; PAM sequence: CTC
ttctcccattcccgcttatt

SEQ ID NO: 43130 - DNA, 20 bp, Artificial Sequence
  Description of Artificial Sequence: Synthetic oligonucleotide
  Target: SCN10A; (-) strand; PAM type: YTN; PAM sequence: TTC
acaggctcttctcccattcc

SEQ ID NO: 43131 - DNA, 20 bp, Artificial Sequence
  Description of Artificial Sequence: Synthetic oligonucleotide
  Target: SCN10A; (-) strand; PAM type: YTN; PAM sequence: CTT
cacaggctcttctcccattc

SEQ ID NO: 43132 - DNA, 20 bp, Artificial Sequence
  Description of Artificial Sequence: Synthetic oligonucleotide
  Target: SCN10A; (-) strand; PAM type: YTN; PAM sequence: CTC
ttcacaggctcttctcccat

SEQ ID NO: 43133 - DNA, 20 bp, Artificial Sequence
  Description of Artificial Sequence: Synthetic oligonucleotide
  Target: SCN10A; (-) strand; PAM type: YTN; PAM sequence: TTA
acaacatcctcttcacaggc

SEQ ID NO: 43134 - DNA, 20 bp, Artificial Sequence
  Description of Artificial Sequence: Synthetic oligonucleotide
  Target: SCN10A; (-) strand; PAM type: YTN; PAM sequence: CTT
aacaacatcctcttcacagg

SEQ ID NO: 43135 - DNA, 20 bp, Artificial Sequence
  Description of Artificial Sequence: Synthetic oligonucleotide
  Target: SCN10A; (-) strand; PAM type: YTN; PAM sequence: CTG
cttaacaacatcctcttcac

SEQ ID NO: 43136 - DNA, 20 bp, Artificial Sequence
  Description of Artificial Sequence: Synthetic oligonucleotide
  Target: SCN10A; (-) strand; PAM type: YTN; PAM sequence: TTG
cccacaatgatgccctgctt

SEQ ID NO: 43137 - DNA, 20 bp, Artificial Sequence
  Description of Artificial Sequence: Synthetic oligonucleotide
  Target: SCN10A; (-) strand; PAM type: YTN; PAM sequence: TTC
agttgcccacaatgatgccc

SEQ ID NO: 43138 - DNA, 20 bp, Artificial Sequence
  Description of Artificial Sequence: Synthetic oligonucleotide
  Target: SCN10A; (-) strand; PAM type: YTN; PAM sequence: CTT
cagttgcccacaatgatgcc

SEQ ID NO: 43139 - DNA, 20 bp, Artificial Sequence
  Description of Artificial Sequence: Synthetic oligonucleotide
  Target: SCN10A; (-) strand; PAM type: YTN; PAM sequence: TTG
cgcttcagttgcccacaatg

SEQ ID NO: 43140 - DNA, 20 bp, Artificial Sequence
  Description of Artificial Sequence: Synthetic oligonucleotide
  Target: SCN10A; (-) strand; PAM type: YTN; PAM sequence: CTC
agaggaccccagtaggattg

SEQ ID NO: 43141 - DNA, 20 bp, Artificial Sequence
  Description of Artificial Sequence: Synthetic oligonucleotide
  Target: SCN10A; (-) strand; PAM type: YTN; PAM sequence: TTA
ctcagaggaccccagtagga

SEQ ID NO: 43142 - DNA, 20 bp, Artificial Sequence
  Description of Artificial Sequence: Synthetic oligonucleotide
  Target: SCN10A; (-) strand; PAM type: YTN; PAM sequence: CTA
cacagttactcagaggaccc

SEQ ID NO: 43143 - DNA, 20 bp, Artificial Sequence
  Description of Artificial Sequence: Synthetic oligonucleotide
  Target: SCN10A; (-) strand; PAM type: YTN; PAM sequence: CTC
tacacagttactcagaggac

SEQ ID NO: 43144 - DNA, 20 bp, Artificial Sequence
  Description of Artificial Sequence: Synthetic oligonucleotide
  Target: SCN10A; (-) strand; PAM type: YTN; PAM sequence: CTG
catgtgctctacacagttac

SEQ ID NO: 43145 - DNA, 20 bp, Artificial Sequence
  Description of Artificial Sequence: Synthetic oligonucleotide
  Target: SCN10A; (-) strand; PAM type: YTN; PAM sequence: TTG
gtgatataatcctgcatgtg

SEQ ID NO: 43146 - DNA, 20 bp, Artificial Sequence
  Description of Artificial Sequence: Synthetic oligonucleotide
  Target: SCN10A; (-) strand; PAM type: YTN; PAM sequence: CTT
ggtgatataatcctgcatgt

SEQ ID NO: 43147 - DNA, 20 bp, Artificial Sequence
  Description of Artificial Sequence: Synthetic oligonucleotide
  Target: SCN10A; (-) strand; PAM type: YTN; PAM sequence: CTG
tcccttggtgatataatcct

SEQ ID NO: 43148 - DNA, 20 bp, Artificial Sequence
  Description of Artificial Sequence: Synthetic oligonucleotide
  Target: SCN10A; (-) strand; PAM type: YTN; PAM sequence: TTC
cctgtcccttggtgatataa

SEQ ID NO: 43149 - DNA, 20 bp, Artificial Sequence
  Description of Artificial Sequence: Synthetic oligonucleotide
  Target: SCN10A; (-) strand; PAM type: YTN; PAM sequence: TTT
ccctgtcccttggtgatata

SEQ ID NO: 43150 - DNA, 20 bp, Artificial Sequence
  Description of Artificial Sequence: Synthetic oligonucleotide
  Target: SCN10A; (-) strand; PAM type: YTN; PAM sequence: CTC
cagtttccctgtcccttggt

SEQ ID NO: 43151 - DNA, 20 bp, Artificial Sequence
  Description of Artificial Sequence: Synthetic oligonucleotide
  Target: SCN10A; (-) strand; PAM type: YTN; PAM sequence: CTG
aggataaatactccagtttc

SEQ ID NO: 43152 - DNA, 20 bp, Artificial Sequence
  Description of Artificial Sequence: Synthetic oligonucleotide
  Target: SCN10A; (-) strand; PAM type: YTN; PAM sequence: TTG
ggagtctgaggataaatact

SEQ ID NO: 43153 - DNA, 20 bp, Artificial Sequence
  Description of Artificial Sequence: Synthetic oligonucleotide
  Target: SCN10A; (-) strand; PAM type: YTN; PAM sequence: TTT
gggagtctgaggataaatac

SEQ ID NO: 43154 - DNA, 20 bp, Artificial Sequence
  Description of Artificial Sequence: Synthetic oligonucleotide
  Target: SCN10A; (-) strand; PAM type: YTN; PAM sequence: TTT
tgggagtctgaggataaata

SEQ ID NO: 43155 - DNA, 20 bp, Artificial Sequence
  Description of Artificial Sequence: Synthetic oligonucleotide
  Target: SCN10A; (-) strand; PAM type: YTN; PAM sequence: TTA
ccaataagttttgggagtct

SEQ ID NO: 43156 - DNA, 20 bp, Artificial Sequence
  Description of Artificial Sequence: Synthetic oligonucleotide
  Target: SCN10A; (-) strand; PAM type: YTN; PAM sequence: CTT
accaataagttttgggagtc

SEQ ID NO: 43157 - DNA, 20 bp, Artificial Sequence
  Description of Artificial Sequence: Synthetic oligonucleotide
  Target: SCN10A; (-) strand; PAM type: YTN; PAM sequence: CTA
ggggcaacccttaccaataa

SEQ ID NO: 43158 - DNA, 20 bp, Artificial Sequence
  Description of Artificial Sequence: Synthetic oligonucleotide
  Target: SCN10A; (-) strand; PAM type: YTN; PAM sequence: TTA
atgtccctaggggcaaccct

SEQ ID NO: 43159 - DNA, 20 bp, Artificial Sequence
  Description of Artificial Sequence: Synthetic oligonucleotide
  Target: SCN10A; (-) strand; PAM type: YTN; PAM sequence: TTT
aatgtccctaggggcaaccc

SEQ ID NO: 43160 - DNA, 20 bp, Artificial Sequence
  Description of Artificial Sequence: Synthetic oligonucleotide
  Target: SCN10A; (-) strand; PAM type: YTN; PAM sequence: CTC
ccccaagtaccagggattta

SEQ ID NO: 43161 - DNA, 20 bp, Artificial Sequence
  Description of Artificial Sequence: Synthetic oligonucleotide
  Target: SCN10A; (-) strand; PAM type: YTN; PAM sequence: TTC
tcccccaagtaccagggatt

SEQ ID NO: 43162 - DNA, 20 bp, Artificial Sequence
  Description of Artificial Sequence: Synthetic oligonucleotide
  Target: SCN10A; (-) strand; PAM type: YTN; PAM sequence: CTT
ctcccccaagtaccagggat

SEQ ID NO: 43163 - DNA, 20 bp, Artificial Sequence
  Description of Artificial Sequence: Synthetic oligonucleotide
  Target: SCN10A; (-) strand; PAM type: YTN; PAM sequence: TTG
tgcagcaacttctcccccaa

SEQ ID NO: 43164 - DNA, 20 bp, Artificial Sequence
  Description of Artificial Sequence: Synthetic oligonucleotide
  Target: SCN10A; (-) strand; PAM type: YTN; PAM sequence: CTT
gtgcagcaacttctccccca

SEQ ID NO: 43165 - DNA, 20 bp, Artificial Sequence
  Description of Artificial Sequence: Synthetic oligonucleotide
  Target: SCN10A; (-) strand; PAM type: YTN; PAM sequence: TTA
ggagcttgtgcagcaacttc

SEQ ID NO: 43166 - DNA, 20 bp, Artificial Sequence
  Description of Artificial Sequence: Synthetic oligonucleotide
  Target: SCN10A; (-) strand; PAM type: YTN; PAM sequence: CTT
aggagcttgtgcagcaactt

SEQ ID NO: 43167 - DNA, 20 bp, Artificial Sequence
  Description of Artificial Sequence: Synthetic oligonucleotide
  Target: SCN10A; (-) strand; PAM type: YTN; PAM sequence: CTC
cagggcttaggagcttgtgc

SEQ ID NO: 43168 - DNA, 20 bp, Artificial Sequence
  Description of Artificial Sequence: Synthetic oligonucleotide
  Target: SCN10A; (-) strand; PAM type: YTN; PAM sequence: CTG
tataaagactccagggctta

SEQ ID NO: 43169 - DNA, 20 bp, Artificial Sequence
  Description of Artificial Sequence: Synthetic oligonucleotide
  Target: SCN10A; (-) strand; PAM type: YTN; PAM sequence: CTC
tgtataaagactccagggct

SEQ ID NO: 43170 - DNA, 20 bp, Artificial Sequence
  Description of Artificial Sequence: Synthetic oligonucleotide
  Target: SCN10A; (-) strand; PAM type: YTN; PAM sequence: TTC
tctgtataaagactccaggg

SEQ ID NO: 43171 - DNA, 20 bp, Artificial Sequence
  Description of Artificial Sequence: Synthetic oligonucleotide
  Target: SCN10A; (-) strand; PAM type: YTN; PAM sequence: CTG
attctctgtataaagactcc

SEQ ID NO: 43172 - DNA, 20 bp, Artificial Sequence
  Description of Artificial Sequence: Synthetic oligonucleotide
  Target: SCN10A; (-) strand; PAM type: YTN; PAM sequence: TTC
tgattctctgtataaagact

SEQ ID NO: 43173 - DNA, 20 bp, Artificial Sequence
  Description of Artificial Sequence: Synthetic oligonucleotide
  Target: SCN10A; (-) strand; PAM type: YTN; PAM sequence: CTT
ctgattctctgtataaagac

SEQ ID NO: 43174 - DNA, 20 bp, Artificial Sequence
  Description of Artificial Sequence: Synthetic oligonucleotide
  Target: SCN10A; (-) strand; PAM type: YTN; PAM sequence: CTG
cacttctgattctctgtata

SEQ ID NO: 43175 - DNA, 20 bp, Artificial Sequence
  Description of Artificial Sequence: Synthetic oligonucleotide
  Target: SCN10A; (-) strand; PAM type: YTN; PAM sequence: CTG
caggctgcacttctgattct

SEQ ID NO: 43176 - DNA, 20 bp, Artificial Sequence
  Description of Artificial Sequence: Synthetic oligonucleotide
  Target: SCN10A; (-) strand; PAM type: YTN; PAM sequence: TTC
acctgcaggctgcacttctg

SEQ ID NO: 43177 - DNA, 20 bp, Artificial Sequence
  Description of Artificial Sequence: Synthetic oligonucleotide
  Target: SCN10A; (-) strand; PAM type: YTN; PAM sequence: TTT
cacctgcaggctgcacttct

SEQ ID NO: 43178 - DNA, 20 bp, Artificial Sequence
  Description of Artificial Sequence: Synthetic oligonucleotide
  Target: SCN10A; (-) strand; PAM type: YTN; PAM sequence: CTG
atttcacctgcaggctgcac

SEQ ID NO: 43179 - DNA, 20 bp, Artificial Sequence
  Description of Artificial Sequence: Synthetic oligonucleotide
  Target: SCN10A; (-) strand; PAM type: YTN; PAM sequence: TTC
tgatttcacctgcaggctgc

SEQ ID NO: 43180 - DNA, 20 bp, Artificial Sequence
  Description of Artificial Sequence: Synthetic oligonucleotide
  Target: SCN10A; (-) strand; PAM type: YTN; PAM sequence: CTT
ctgatttcacctgcaggctg

SEQ ID NO: 43181 - DNA, 20 bp, Artificial Sequence
  Description of Artificial Sequence: Synthetic oligonucleotide
  Target: SCN10A; (-) strand; PAM type: YTN; PAM sequence: TTA
gcccacttctgatttcacct

SEQ ID NO: 43182 - DNA, 20 bp, Artificial Sequence
  Description of Artificial Sequence: Synthetic oligonucleotide
  Target: SCN10A; (-) strand; PAM type: YTN; PAM sequence: CTT
agcccacttctgatttcacc

SEQ ID NO: 43183 - DNA, 20 bp, Artificial Sequence
  Description of Artificial Sequence: Synthetic oligonucleotide
  Target: SCN10A; (-) strand; PAM type: YTN; PAM sequence: TTC
ccttagcccacttctgattt

SEQ ID NO: 43184 - DNA, 20 bp, Artificial Sequence
  Description of Artificial Sequence: Synthetic oligonucleotide
  Target: SCN10A; (-) strand; PAM type: YTN; PAM sequence: CTT
cccttagcccacttctgatt

SEQ ID NO: 43185 - DNA, 20 bp, Artificial Sequence
  Description of Artificial Sequence: Synthetic oligonucleotide
  Target: SCN10A; (-) strand; PAM type: YTN; PAM sequence: CTC
ttcccttagcccacttctga

SEQ ID NO: 43186 - DNA, 20 bp, Artificial Sequence
  Description of Artificial Sequence: Synthetic oligonucleotide
  Target: SCN10A; (-) strand; PAM type: YTN; PAM sequence: CTG
ccacctcttcccttagccca

SEQ ID NO: 43187 - DNA, 20 bp, Artificial Sequence
  Description of Artificial Sequence: Synthetic oligonucleotide
  Target: SCN10A; (-) strand; PAM type: YTN; PAM sequence: TTC
cctgccacctcttcccttag

SEQ ID NO: 43188 - DNA, 20 bp, Artificial Sequence
  Description of Artificial Sequence: Synthetic oligonucleotide
  Target: SCN10A; (-) strand; PAM type: YTN; PAM sequence: CTG
tcaattccctgccacctctt

SEQ ID NO: 43189 - DNA, 20 bp, Artificial Sequence
  Description of Artificial Sequence: Synthetic oligonucleotide
  Target: SCN10A; (-) strand; PAM type: YTN; PAM sequence: CTG
tggcaggcactgtcaattcc

SEQ ID NO: 43190 - DNA, 20 bp, Artificial Sequence
  Description of Artificial Sequence: Synthetic oligonucleotide
  Target: SCN10A; (-) strand; PAM type: YTN; PAM sequence: CTG
ctgtggcaggcactgtcaat

SEQ ID NO: 43191 - DNA, 20 bp, Artificial Sequence
  Description of Artificial Sequence: Synthetic oligonucleotide
  Target: SCN10A; (-) strand; PAM type: YTN; PAM sequence: TTC
ctgctgtggcaggcactgtc

SEQ ID NO: 43192 - DNA, 20 bp, Artificial Sequence
  Description of Artificial Sequence: Synthetic oligonucleotide
  Target: SCN10A; (-) strand; PAM type: YTN; PAM sequence: CTT
cctgctgtggcaggcactgt

SEQ ID NO: 43193 - DNA, 20 bp, Artificial Sequence
  Description of Artificial Sequence: Synthetic oligonucleotide
  Target: SCN10A; (-) strand; PAM type: YTN; PAM sequence: TTG
gggaatgaccacttcctgct

SEQ ID NO: 43194 - DNA, 20 bp, Artificial Sequence
  Description of Artificial Sequence: Synthetic oligonucleotide
  Target: SCN10A; (-) strand; PAM type: YTN; PAM sequence: CTA
ttggggaatgaccacttcct

SEQ ID NO: 43195 - DNA, 20 bp, Artificial Sequence
  Description of Artificial Sequence: Synthetic oligonucleotide
  Target: SCN10A; (-) strand; PAM type: YTN; PAM sequence: CTG
gggagacactattggggaat

SEQ ID NO: 43196 - DNA, 20 bp, Artificial Sequence
  Description of Artificial Sequence: Synthetic oligonucleotide
  Target: SCN10A; (-) strand; PAM type: YTN; PAM sequence: CTC
aaaaaaaaagaaaagaaaag

SEQ ID NO: 43197 - DNA, 20 bp, Artificial Sequence
  Description of Artificial Sequence: Synthetic oligonucleotide
  Target: SCN10A; (-) strand; PAM type: YTN; PAM sequence: CTC
aatctcaaaaaaaaagaaaa

SEQ ID NO: 43198 - DNA, 20 bp, Artificial Sequence
  Description of Artificial Sequence: Synthetic oligonucleotide
  Target: SCN10A; (-) strand; PAM type: YTN; PAM sequence: TTG
ggcgagacagcgagactcaa

SEQ ID NO: 43199 - DNA, 20 bp, Artificial Sequence
  Description of Artificial Sequence: Synthetic oligonucleotide
  Target: SCN10A; (-) strand; PAM type: YTN; PAM sequence: CTT
gggcgagacagcgagactca

SEQ ID NO: 43200 - DNA, 20 bp, Artificial Sequence
  Description of Artificial Sequence: Synthetic oligonucleotide
  Target: SCN10A; (-) strand; PAM type: YTN; PAM sequence: CTC
cagcttgggcgagacagcga

SEQ ID NO: 43201 - DNA, 20 bp, Artificial Sequence
  Description of Artificial Sequence: Synthetic oligonucleotide
  Target: SCN10A; (-) strand; PAM type: YTN; PAM sequence: CTG
cactccagcttgggcgagac

SEQ ID NO: 43202 - DNA, 20 bp, Artificial Sequence
  Description of Artificial Sequence: Synthetic oligonucleotide
  Target: SCN10A; (-) strand; PAM type: YTN; PAM sequence: TTG
cgtcactgcactccagcttg

SEQ ID NO: 43203 - DNA, 20 bp, Artificial Sequence
  Description of Artificial Sequence: Synthetic oligonucleotide
  Target: SCN10A; (-) strand; PAM type: YTN; PAM sequence: CTG
agattgcgtcactgcactcc

SEQ ID NO: 43204 - DNA, 20 bp, Artificial Sequence
  Description of Artificial Sequence: Synthetic oligonucleotide
  Target: SCN10A; (-) strand; PAM type: YTN; PAM sequence: TTG
cagtgagctgagattgcgtc

SEQ ID NO: 43205 - DNA, 20 bp, Artificial Sequence
  Description of Artificial Sequence: Synthetic oligonucleotide
  Target: SCN10A; (-) strand; PAM type: YTN; PAM sequence: TTG
aacccgggaggcagaagttg

SEQ ID NO: 43206 - DNA, 20 bp, Artificial Sequence
  Description of Artificial Sequence: Synthetic oligonucleotide
  Target: SCN10A; (-) strand; PAM type: YTN; PAM sequence: CTT
gaacccgggaggcagaagtt

SEQ ID NO: 43207 - DNA, 20 bp, Artificial Sequence
  Description of Artificial Sequence: Synthetic oligonucleotide
  Target: SCN10A; (-) strand; PAM type: YTN; PAM sequence: CTC
ttgaacccgggaggcagaag

SEQ ID NO: 43208 - DNA, 20 bp, Artificial Sequence
  Description of Artificial Sequence: Synthetic oligonucleotide
  Target: SCN10A; (-) strand; PAM type: YTN; PAM sequence: CTG
agacaggagaatctcttgaa

SEQ ID NO: 43209 - DNA, 20 bp, Artificial Sequence
  Description of Artificial Sequence: Synthetic oligonucleotide
  Target: SCN10A; (-) strand; PAM type: YTN; PAM sequence: CTC
gggagactgagacaggagaa

SEQ ID NO: 43210 - DNA, 20 bp, Artificial Sequence
  Description of Artificial Sequence: Synthetic oligonucleotide
  Target: SCN10A; (-) strand; PAM type: YTN; PAM sequence: CTG
ctcgggagactgagacagga

SEQ ID NO: 43211 - DNA, 20 bp, Artificial Sequence
  Description of Artificial Sequence: Synthetic oligonucleotide
  Target: SCN10A; (-) strand; PAM type: YTN; PAM sequence: CTG
tagtcccagctgctcgggag

SEQ ID NO: 43212 - DNA, 20 bp, Artificial Sequence
  Description of Artificial Sequence: Synthetic oligonucleotide
  Target: SCN10A; (-) strand; PAM type: YTN; PAM sequence: TTG
tgcctgtagtcccagctgct

SEQ ID NO: 43213 - DNA, 20 bp, Artificial Sequence
  Description of Artificial Sequence: Synthetic oligonucleotide
  Target: SCN10A; (-) strand; PAM type: YTN; PAM sequence: CTT
gtgcctgtagtcccagctgc

SEQ ID NO: 43214 - DNA, 20 bp, Artificial Sequence
  Description of Artificial Sequence: Synthetic oligonucleotide
  Target: SCN10A; (-) strand; PAM type: YTN; PAM sequence: TTA
gcagggcatggcggcttgtg

SEQ ID NO: 43215 - DNA, 20 bp, Artificial Sequence
  Description of Artificial Sequence: Synthetic oligonucleotide
  Target: SCN10A; (-) strand; PAM type: YTN; PAM sequence: CTA
aaatatgaaagaaattagca

SEQ ID NO: 43216 - DNA, 20 bp, Artificial Sequence
  Description of Artificial Sequence: Synthetic oligonucleotide
  Target: SCN10A; (-) strand; PAM type: YTN; PAM sequence: CTA
ctaaaatatgaaagaaatta

SEQ ID NO: 43217 - DNA, 20 bp, Artificial Sequence
  Description of Artificial Sequence: Synthetic oligonucleotide
  Target: SCN10A; (-) strand; PAM type: YTN; PAM sequence: CTC
tactaaaatatgaaagaaat

SEQ ID NO: 43218 - DNA, 20 bp, Artificial Sequence
  Description of Artificial Sequence: Synthetic oligonucleotide
  Target: SCN10A; (-) strand; PAM type: YTN; PAM sequence: CTG
ggcaatacggtgaaacccca

SEQ ID NO: 43219 - DNA, 20 bp, Artificial Sequence
  Description of Artificial Sequence: Synthetic oligonucleotide
  Target: SCN10A; (-) strand; PAM type: YTN; PAM sequence: CTC
aggagaccagcctgggcaat

SEQ ID NO: 43220 - DNA, 20 bp, Artificial Sequence
  Description of Artificial Sequence: Synthetic oligonucleotide
  Target: SCN10A; (-) strand; PAM type: YTN; PAM sequence: CTG
agctcaggagaccagcctgg

SEQ ID NO: 43221 - DNA, 20 bp, Artificial Sequence
  Description of Artificial Sequence: Synthetic oligonucleotide
  Target: SCN10A; (-) strand; PAM type: YTN; PAM sequence: TTG
cctgagctcaggagaccagc

SEQ ID NO: 43222 - DNA, 20 bp, Artificial Sequence
  Description of Artificial Sequence: Synthetic oligonucleotide
  Target: SCN10A; (-) strand; PAM type: YTN; PAM sequence: TTG
ggaggccgaggtgggcagat

SEQ ID NO: 43223 - DNA, 20 bp, Artificial Sequence
  Description of Artificial Sequence: Synthetic oligonucleotide
  Target: SCN10A; (-) strand; PAM type: YTN; PAM sequence: TTT
gggaggccgaggtgggcaga

SEQ ID NO: 43224 - DNA, 20 bp, Artificial Sequence
  Description of Artificial Sequence: Synthetic oligonucleotide
  Target: SCN10A; (-) strand; PAM type: YTN; PAM sequence: CTT
tgggaggccgaggtgggcag

SEQ ID NO: 43225 - DNA, 20 bp, Artificial Sequence
  Description of Artificial Sequence: Synthetic oligonucleotide
  Target: SCN10A; (-) strand; PAM type: YTN; PAM sequence: CTA
gcactttgggaggccgaggt

SEQ ID NO: 43226 - DNA, 20 bp, Artificial Sequence
  Description of Artificial Sequence: Synthetic oligonucleotide
  Target: SCN10A; (-) strand; PAM type: YTN; PAM sequence: CTG
taatcctagcactttgggag

SEQ ID NO: 43227 - DNA, 20 bp, Artificial Sequence
  Description of Artificial Sequence: Synthetic oligonucleotide
  Target: SCN10A; (-) strand; PAM type: YTN; PAM sequence: TTC
atgcctgtaatcctagcact

SEQ ID NO: 43228 - DNA, 20 bp, Artificial Sequence
  Description of Artificial Sequence: Synthetic oligonucleotide
  Target: SCN10A; (-) strand; PAM type: YTN; PAM sequence: CTA
tcataaaacccaggatgggc

SEQ ID NO: 43229 - DNA, 20 bp, Artificial Sequence
  Description of Artificial Sequence: Synthetic oligonucleotide
  Target: SCN10A; (-) strand; PAM type: YTN; PAM sequence: CTC
aggaactatcataaaaccca

SEQ ID NO: 43230 - DNA, 20 bp, Artificial Sequence
  Description of Artificial Sequence: Synthetic oligonucleotide
  Target: SCN10A; (-) strand; PAM type: YTN; PAM sequence: CTA
aatcaaggtgcatagggagg

SEQ ID NO: 43231 - DNA, 20 bp, Artificial Sequence
  Description of Artificial Sequence: Synthetic oligonucleotide
  Target: SCN10A; (-) strand; PAM type: YTN; PAM sequence: CTG
gacaagggtgggagcaaagc

SEQ ID NO: 43232 - DNA, 20 bp, Artificial Sequence
  Description of Artificial Sequence: Synthetic oligonucleotide
  Target: SCN10A; (-) strand; PAM type: YTN; PAM sequence: CTC
cctggacaagggtgggagca

SEQ ID NO: 43233 - DNA, 20 bp, Artificial Sequence
  Description of Artificial Sequence: Synthetic oligonucleotide
  Target: SCN10A; (-) strand; PAM type: YTN; PAM sequence: TTC
atgtgagccactccctggac

SEQ ID NO: 43234 - DNA, 20 bp, Artificial Sequence
  Description of Artificial Sequence: Synthetic oligonucleotide
  Target: SCN10A; (-) strand; PAM type: YTN; PAM sequence: CTA
agagacagttcatgtgagcc

SEQ ID NO: 43235 - DNA, 20 bp, Artificial Sequence
  Description of Artificial Sequence: Synthetic oligonucleotide
  Target: SCN10A; (-) strand; PAM type: YTN; PAM sequence: CTC
taagagacagttcatgtgag

SEQ ID NO: 43236 - DNA, 20 bp, Artificial Sequence
  Description of Artificial Sequence: Synthetic oligonucleotide
  Target: SCN10A; (-) strand; PAM type: YTN; PAM sequence: TTG
aggaaagcatcagataacct

SEQ ID NO: 43237 - DNA, 20 bp, Artificial Sequence
  Description of Artificial Sequence: Synthetic oligonucleotide
  Target: SCN10A; (-) strand; PAM type: YTN; PAM sequence: CTG
ttgaggaaagcatcagataa

SEQ ID NO: 43238 - DNA, 20 bp, Artificial Sequence
  Description of Artificial Sequence: Synthetic oligonucleotide
  Target: SCN10A; (-) strand; PAM type: YTN; PAM sequence: TTC
actgttgaggaaagcatcag

SEQ ID NO: 43239 - DNA, 20 bp, Artificial Sequence
  Description of Artificial Sequence: Synthetic oligonucleotide
  Target: SCN10A; (-) strand; PAM type: YTN; PAM sequence: CTG
ttcactgttgaggaaagcat

SEQ ID NO: 43240 - DNA, 20 bp, Artificial Sequence
  Description of Artificial Sequence: Synthetic oligonucleotide
  Target: SCN10A; (-) strand; PAM type: YTN; PAM sequence: CTC
tgttcactgttgaggaaagc

SEQ ID NO: 43241 - DNA, 20 bp, Artificial Sequence
  Description of Artificial Sequence: Synthetic oligonucleotide
  Target: SCN10A; (-) strand; PAM type: YTN; PAM sequence: TTC
ctctgttcactgttgaggaa

SEQ ID NO: 43242 - DNA, 20 bp, Artificial Sequence
  Description of Artificial Sequence: Synthetic oligonucleotide
  Target: SCN10A; (-) strand; PAM type: YTN; PAM sequence: TTT
cctctgttcactgttgagga

SEQ ID NO: 43243 - DNA, 20 bp, Artificial Sequence
  Description of Artificial Sequence: Synthetic oligonucleotide
  Target: SCN10A; (-) strand; PAM type: YTN; PAM sequence: TTT
tcctctgttcactgttgagg

SEQ ID NO: 43244 - DNA, 20 bp, Artificial Sequence
  Description of Artificial Sequence: Synthetic oligonucleotide
  Target: SCN10A; (-) strand; PAM type: YTN; PAM sequence: CTC
gaggttttcctctgttcact

SEQ ID NO: 43245 - DNA, 20 bp, Artificial Sequence
  Description of Artificial Sequence: Synthetic oligonucleotide
  Target: SCN10A; (-) strand; PAM type: YTN; PAM sequence: TTC
tcgaggttttcctctgttca

SEQ ID NO: 43246 - DNA, 20 bp, Artificial Sequence
  Description of Artificial Sequence: Synthetic oligonucleotide
  Target: SCN10A; (-) strand; PAM type: YTN; PAM sequence: CTT
ctcgaggttttcctctgttc

SEQ ID NO: 43247 - DNA, 20 bp, Artificial Sequence
  Description of Artificial Sequence: Synthetic oligonucleotide
  Target: SCN10A; (-) strand; PAM type: YTN; PAM sequence: CTC
cccaggcttctcgaggtttt

SEQ ID NO: 43248 - DNA, 20 bp, Artificial Sequence
  Description of Artificial Sequence: Synthetic oligonucleotide
  Target: SCN10A; (-) strand; PAM type: YTN; PAM sequence: CTA
cactccccaggcttctcgag

SEQ ID NO: 43249 - DNA, 20 bp, Artificial Sequence
  Description of Artificial Sequence: Synthetic oligonucleotide
  Target: SCN10A; (-) strand; PAM type: YTN; PAM sequence: TTC
atctacactccccaggcttc

SEQ ID NO: 43250 - DNA, 20 bp, Artificial Sequence
  Description of Artificial Sequence: Synthetic oligonucleotide
  Target: SCN10A; (-) strand; PAM type: YTN; PAM sequence: TTT
catctacactccccaggctt

SEQ ID NO: 43251 - DNA, 20 bp, Artificial Sequence
  Description of Artificial Sequence: Synthetic oligonucleotide
  Target: SCN10A; (-) strand; PAM type: YTN; PAM sequence: CTT
tcatctacactccccaggct

SEQ ID NO: 43252 - DNA, 20 bp, Artificial Sequence
  Description of Artificial Sequence: Synthetic oligonucleotide
  Target: SCN10A; (-) strand; PAM type: YTN; PAM sequence: TTC
cccctttcatctacactccc

SEQ ID NO: 43253 - DNA, 20 bp, Artificial Sequence
  Description of Artificial Sequence: Synthetic oligonucleotide
  Target: SCN10A; (-) strand; PAM type: YTN; PAM sequence: TTT
ccccctttcatctacactcc

SEQ ID NO: 43254 - DNA, 20 bp, Artificial Sequence
  Description of Artificial Sequence: Synthetic oligonucleotide
  Target: SCN10A; (-) strand; PAM type: YTN; PAM sequence: CTT
tccccctttcatctacactc

SEQ ID NO: 43255 - DNA, 20 bp, Artificial Sequence
  Description of Artificial Sequence: Synthetic oligonucleotide
  Target: SCN10A; (-) strand; PAM type: YTN; PAM sequence: TTC
agccaccgaggctttccccc

SEQ ID NO: 43256 - DNA, 20 bp, Artificial Sequence
  Description of Artificial Sequence: Synthetic oligonucleotide
  Target: SCN10A; (-) strand; PAM type: YTN; PAM sequence: TTT
cagccaccgaggctttcccc

SEQ ID NO: 43257 - DNA, 20 bp, Artificial Sequence
  Description of Artificial Sequence: Synthetic oligonucleotide
  Target: SCN10A; (-) strand; PAM type: YTN; PAM sequence: TTG
agtgtttcagccaccgaggc

SEQ ID NO: 43258 - DNA, 20 bp, Artificial Sequence
  Description of Artificial Sequence: Synthetic oligonucleotide
  Target: SCN10A; (-) strand; PAM type: YTN; PAM sequence: CTG
ttgagtgtttcagccaccga

SEQ ID NO: 43259 - DNA, 20 bp, Artificial Sequence
  Description of Artificial Sequence: Synthetic oligonucleotide
  Target: SCN10A; (-) strand; PAM type: YTN; PAM sequence: CTC
tgttgagtgtttcagccacc

SEQ ID NO: 43260 - DNA, 20 bp, Artificial Sequence
  Description of Artificial Sequence: Synthetic oligonucleotide
  Target: SCN10A; (-) strand; PAM type: YTN; PAM sequence: CTC
tctgttgagtgtttcagcca

SEQ ID NO: 43261 - DNA, 20 bp, Artificial Sequence
  Description of Artificial Sequence: Synthetic oligonucleotide
  Target: SCN10A; (-) strand; PAM type: YTN; PAM sequence: CTG
gctctctgttgagtgtttca

SEQ ID NO: 43262 - DNA, 20 bp, Artificial Sequence
  Description of Artificial Sequence: Synthetic oligonucleotide
  Target: SCN10A; (-) strand; PAM type: YTN; PAM sequence: TTG
cagcagtgtccagctggctc

SEQ ID NO: 43263 - DNA, 20 bp, Artificial Sequence
  Description of Artificial Sequence: Synthetic oligonucleotide
  Target: SCN10A; (-) strand; PAM type: YTN; PAM sequence: CTT
gcagcagtgtccagctggct

SEQ ID NO: 43264 - DNA, 20 bp, Artificial Sequence
  Description of Artificial Sequence: Synthetic oligonucleotide
  Target: SCN10A; (-) strand; PAM type: YTN; PAM sequence: CTC
cttgcagcagtgtccagctg

SEQ ID NO: 43265 - DNA, 20 bp, Artificial Sequence
  Description of Artificial Sequence: Synthetic oligonucleotide
  Target: SCN10A; (-) strand; PAM type: YTN; PAM sequence: CTG
tccctccttgcagcagtgtc

SEQ ID NO: 43266 - DNA, 20 bp, Artificial Sequence
  Description of Artificial Sequence: Synthetic oligonucleotide
  Target: SCN10A; (-) strand; PAM type: YTN; PAM sequence: CTC
acactgtccctccttgcagc

SEQ ID NO: 43267 - DNA, 20 bp, Artificial Sequence
  Description of Artificial Sequence: Synthetic oligonucleotide
  Target: SCN10A; (-) strand; PAM type: YTN; PAM sequence: CTG
gaagaggcgatcacccagca

SEQ ID NO: 43268 - DNA, 20 bp, Artificial Sequence
  Description of Artificial Sequence: Synthetic oligonucleotide
  Target: SCN10A; (-) strand; PAM type: YTN; PAM sequence: CTG
gtactggaagaggcgatcac

SEQ ID NO: 43269 - DNA, 20 bp, Artificial Sequence
  Description of Artificial Sequence: Synthetic oligonucleotide
  Target: SCN10A; (-) strand; PAM type: YTN; PAM sequence: TTG
aaatgaagtgacgatgaccc

SEQ ID NO: 43270 - DNA, 20 bp, Artificial Sequence
  Description of Artificial Sequence: Synthetic oligonucleotide
  Target: SCN10A; (-) strand; PAM type: YTN; PAM sequence: TTT
gaaatgaagtgacgatgacc

SEQ ID NO: 43271 - DNA, 20 bp, Artificial Sequence
  Description of Artificial Sequence: Synthetic oligonucleotide
  Target: SCN10A; (-) strand; PAM type: YTN; PAM sequence: CTG
catttgaaatgaagtgacga

SEQ ID NO: 43272 - DNA, 20 bp, Artificial Sequence
  Description of Artificial Sequence: Synthetic oligonucleotide
  Target: SCN10A; (-) strand; PAM type: YTN; PAM sequence: CTA
cccatatcagtctgcatttg

SEQ ID NO: 43273 - DNA, 20 bp, Artificial Sequence
  Description of Artificial Sequence: Synthetic oligonucleotide
  Target: SCN10A; (-) strand; PAM type: YTN; PAM sequence: TTC
tacccatatcagtctgcatt

SEQ ID NO: 43274 - DNA, 20 bp, Artificial Sequence
  Description of Artificial Sequence: Synthetic oligonucleotide
  Target: SCN10A; (-) strand; PAM type: YTN; PAM sequence: CTG
tgcattctacccatatcagt

SEQ ID NO: 43275 - DNA, 20 bp, Artificial Sequence
  Description of Artificial Sequence: Synthetic oligonucleotide
  Target: SCN10A; (-) strand; PAM type: YTN; PAM sequence: CTC
tgtgcattctacccatatca

SEQ ID NO: 43276 - DNA, 20 bp, Artificial Sequence
  Description of Artificial Sequence: Synthetic oligonucleotide
  Target: SCN10A; (-) strand; PAM type: YTN; PAM sequence: TTC
ccctctgtgcattctaccca

SEQ ID NO: 43277 - DNA, 20 bp, Artificial Sequence
  Description of Artificial Sequence: Synthetic oligonucleotide
  Target: SCN10A; (-) strand; PAM type: YTN; PAM sequence: CTT
cccctctgtgcattctaccc

SEQ ID NO: 43278 - DNA, 20 bp, Artificial Sequence
  Description of Artificial Sequence: Synthetic oligonucleotide
  Target: SCN10A; (-) strand; PAM type: YTN; PAM sequence: CTA
cagccttcccctctgtgcat

SEQ ID NO: 43279 - DNA, 20 bp, Artificial Sequence
  Description of Artificial Sequence: Synthetic oligonucleotide
  Target: SCN10A; (-) strand; PAM type: YTN; PAM sequence: CTG
tccctacagccttcccctct

SEQ ID NO: 43280 - DNA, 20 bp, Artificial Sequence
  Description of Artificial Sequence: Synthetic oligonucleotide
  Target: SCN10A; (-) strand; PAM type: YTN; PAM sequence: CTC
agcccactgtccctacagcc

SEQ ID NO: 43281 - DNA, 20 bp, Artificial Sequence
  Description of Artificial Sequence: Synthetic oligonucleotide
  Target: SCN10A; (-) strand; PAM type: YTN; PAM sequence: TTC
ccgggaggtgagtctcagcc

SEQ ID NO: 43282 - DNA, 20 bp, Artificial Sequence
  Description of Artificial Sequence: Synthetic oligonucleotide
  Target: SCN10A; (-) strand; PAM type: YTN; PAM sequence: TTG
attcccgggaggtgagtctc

SEQ ID NO: 43283 - DNA, 20 bp, Artificial Sequence
  Description of Artificial Sequence: Synthetic oligonucleotide
  Target: SCN10A; (-) strand; PAM type: YTN; PAM sequence: CTG
ttgattcccgggaggtgagt

SEQ ID NO: 43284 - DNA, 20 bp, Artificial Sequence
  Description of Artificial Sequence: Synthetic oligonucleotide
  Target: SCN10A; (-) strand; PAM type: YTN; PAM sequence: TTA
tgtatgcagctgttgattcc

SEQ ID NO: 43285 - DNA, 20 bp, Artificial Sequence
  Description of Artificial Sequence: Synthetic oligonucleotide
  Target: SCN10A; (-) strand; PAM type: YTN; PAM sequence: CTG
gatggacattatgtatgcag

SEQ ID NO: 43286 - DNA, 20 bp, Artificial Sequence
  Description of Artificial Sequence: Synthetic oligonucleotide
  Target: SCN10A; (-) strand; PAM type: YTN; PAM sequence: TTA
aaggctggatggacattatg

SEQ ID NO: 43287 - DNA, 20 bp, Artificial Sequence
  Description of Artificial Sequence: Synthetic oligonucleotide
  Target: SCN10A; (-) strand; PAM type: YTN; PAM sequence: TTT
aaaggctggatggacattat

SEQ ID NO: 43288 - DNA, 20 bp, Artificial Sequence
  Description of Artificial Sequence: Synthetic oligonucleotide
  Target: SCN10A; (-) strand; PAM type: YTN; PAM sequence: CTT
taaaggctggatggacatta

SEQ ID NO: 43289 - DNA, 20 bp, Artificial Sequence
  Description of Artificial Sequence: Synthetic oligonucleotide
  Target: SCN10A; (-) strand; PAM type: YTN; PAM sequence: CTC
caggcaacctttaaaggctg

SEQ ID NO: 43290 - DNA, 20 bp, Artificial Sequence
  Description of Artificial Sequence: Synthetic oligonucleotide
  Target: SCN10A; (-) strand; PAM type: YTN; PAM sequence: TTG
tctccaggcaacctttaaag

SEQ ID NO: 43291 - DNA, 20 bp, Artificial Sequence
  Description of Artificial Sequence: Synthetic oligonucleotide
  Target: SCN10A; (-) strand; PAM type: YTN; PAM sequence: CTT
gtctccaggcaacctttaaa

SEQ ID NO: 43292 - DNA, 20 bp, Artificial Sequence
  Description of Artificial Sequence: Synthetic oligonucleotide
  Target: SCN10A; (-) strand; PAM type: YTN; PAM sequence: CTC
cttgtctccaggcaaccttt

SEQ ID NO: 43293 - DNA, 20 bp, Artificial Sequence
  Description of Artificial Sequence: Synthetic oligonucleotide
  Target: SCN10A; (-) strand; PAM type: YTN; PAM sequence: CTG
ctccttgtctccaggcaacc

SEQ ID NO: 43294 - DNA, 20 bp, Artificial Sequence
  Description of Artificial Sequence: Synthetic oligonucleotide
  Target: SCN10A; (-) strand; PAM type: YTN; PAM sequence: CTC
tgctccttgtctccaggcaa

SEQ ID NO: 43295 - DNA, 20 bp, Artificial Sequence
  Description of Artificial Sequence: Synthetic oligonucleotide
  Target: SCN10A; (-) strand; PAM type: YTN; PAM sequence: CTG
agtggcctctgctccttgtc

SEQ ID NO: 43296 - DNA, 20 bp, Artificial Sequence
  Description of Artificial Sequence: Synthetic oligonucleotide
  Target: SCN10A; (-) strand; PAM type: YTN; PAM sequence: TTG
ggaagggtccagtatagatg

SEQ ID NO: 43297 - DNA, 20 bp, Artificial Sequence
  Description of Artificial Sequence: Synthetic oligonucleotide
  Target: SCN10A; (-) strand; PAM type: YTN; PAM sequence: CTT
gggaagggtccagtatagat

SEQ ID NO: 43298 - DNA, 20 bp, Artificial Sequence
  Description of Artificial Sequence: Synthetic oligonucleotide
  Target: SCN10A; (-) strand; PAM type: YTN; PAM sequence: CTG
ggccaccatggcttgggaag

SEQ ID NO: 43299 - DNA, 20 bp, Artificial Sequence
  Description of Artificial Sequence: Synthetic oligonucleotide
  Target: SCN10A; (-) strand; PAM type: YTN; PAM sequence: CTC
actgggccaccatggcttgg

SEQ ID NO: 43300 - DNA, 20 bp, Artificial Sequence
  Description of Artificial Sequence: Synthetic oligonucleotide
  Target: SCN10A; (-) strand; PAM type: YTN; PAM sequence: CTC
tcactgggccaccatggctt

SEQ ID NO: 43301 - DNA, 20 bp, Artificial Sequence
  Description of Artificial Sequence: Synthetic oligonucleotide
  Target: SCN10A; (-) strand; PAM type: YTN; PAM sequence: CTC
tctcactgggccaccatggc

SEQ ID NO: 43302 - DNA, 20 bp, Artificial Sequence
  Description of Artificial Sequence: Synthetic oligonucleotide
  Target: SCN10A; (-) strand; PAM type: YTN; PAM sequence: CTC
ctctctcactgggccaccat

SEQ ID NO: 43303 - DNA, 20 bp, Artificial Sequence
  Description of Artificial Sequence: Synthetic oligonucleotide
  Target: SCN10A; (-) strand; PAM type: YTN; PAM sequence: CTC
tcctctctcactgggccacc

SEQ ID NO: 43304 - DNA, 20 bp, Artificial Sequence
  Description of Artificial Sequence: Synthetic oligonucleotide
  Target: SCN10A; (-) strand; PAM type: YTN; PAM sequence: CTC
tctcctctctcactgggcca

SEQ ID NO: 43305 - DNA, 20 bp, Artificial Sequence
  Description of Artificial Sequence: Synthetic oligonucleotide
  Target: SCN10A; (-) strand; PAM type: YTN; PAM sequence: TTC
caacacaggactctctcctc

SEQ ID NO: 43306 - DNA, 20 bp, Artificial Sequence
  Description of Artificial Sequence: Synthetic oligonucleotide
  Target: SCN10A; (-) strand; PAM type: YTN; PAM sequence: TTT
ccaacacaggactctctcct

SEQ ID NO: 43307 - DNA, 20 bp, Artificial Sequence
  Description of Artificial Sequence: Synthetic oligonucleotide
  Target: SCN10A; (-) strand; PAM type: YTN; PAM sequence: CTT
tccaacacaggactctctcc

SEQ ID NO: 43308 - DNA, 20 bp, Artificial Sequence
  Description of Artificial Sequence: Synthetic oligonucleotide
  Target: SCN10A; (-) strand; PAM type: YTN; PAM sequence: CTG
cacaagccctttccaacaca

SEQ ID NO: 43309 - DNA, 20 bp, Artificial Sequence
  Description of Artificial Sequence: Synthetic oligonucleotide
  Target: SCN10A; (-) strand; PAM type: YTN; PAM sequence: TTC
tgcacaagccctttccaaca

SEQ ID NO: 43310 - DNA, 20 bp, Artificial Sequence
  Description of Artificial Sequence: Synthetic oligonucleotide
  Target: SCN10A; (-) strand; PAM type: YTN; PAM sequence: TTT
ctgcacaagccctttccaac

SEQ ID NO: 43311 - DNA, 20 bp, Artificial Sequence
  Description of Artificial Sequence: Synthetic oligonucleotide
  Target: SCN10A; (-) strand; PAM type: YTN; PAM sequence: CTT
tctgcacaagccctttccaa

SEQ ID NO: 43312 - DNA, 20 bp, Artificial Sequence
  Description of Artificial Sequence: Synthetic oligonucleotide
  Target: SCN10A; (-) strand; PAM type: YTN; PAM sequence: TTC
tttctgcacaagccctttcc

SEQ ID NO: 43313 - DNA, 20 bp, Artificial Sequence
  Description of Artificial Sequence: Synthetic oligonucleotide
  Target: SCN10A; (-) strand; PAM type: YTN; PAM sequence: TTC
attctttctgcacaagccct

SEQ ID NO: 43314 - DNA, 20 bp, Artificial Sequence
  Description of Artificial Sequence: Synthetic oligonucleotide
  Target: SCN10A; (-) strand; PAM type: YTN; PAM sequence: TTT
cattctttctgcacaagccc

SEQ ID NO: 43315 - DNA, 20 bp, Artificial Sequence
  Description of Artificial Sequence: Synthetic oligonucleotide
  Target: SCN10A; (-) strand; PAM type: YTN; PAM sequence: CTT
tcattctttctgcacaagcc

SEQ ID NO: 43316 - DNA, 20 bp, Artificial Sequence
  Description of Artificial Sequence: Synthetic oligonucleotide
  Target: SCN10A; (-) strand; PAM type: YTN; PAM sequence: TTC
ctttcattctttctgcacaa

SEQ ID NO: 43317 - DNA, 20 bp, Artificial Sequence
  Description of Artificial Sequence: Synthetic oligonucleotide
  Target: SCN10A; (-) strand; PAM type: YTN; PAM sequence: TTT
cctttcattctttctgcaca

SEQ ID NO: 43318 - DNA, 20 bp, Artificial Sequence
  Description of Artificial Sequence: Synthetic oligonucleotide
  Target: SCN10A; (-) strand; PAM type: YTN; PAM sequence: TTT
tcctttcattctttctgcac

SEQ ID NO: 43319 - DNA, 20 bp, Artificial Sequence
  Description of Artificial Sequence: Synthetic oligonucleotide
  Target: SCN10A; (-) strand; PAM type: YTN; PAM sequence: CTT
ttcctttcattctttctgca

SEQ ID NO: 43320 - DNA, 20 bp, Artificial Sequence
  Description of Artificial Sequence: Synthetic oligonucleotide
  Target: SCN10A; (-) strand; PAM type: YTN; PAM sequence: TTA
gtcaagtaacccaagggaac

SEQ ID NO: 43321 - DNA, 20 bp, Artificial Sequence
  Description of Artificial Sequence: Synthetic oligonucleotide
  Target: SCN10A; (-) strand; PAM type: YTN; PAM sequence: TTA
aatcatcatatgagattagt

SEQ ID NO: 43322 - DNA, 20 bp, Artificial Sequence
  Description of Artificial Sequence: Synthetic oligonucleotide
  Target: SCN10A; (-) strand; PAM type: YTN; PAM sequence: TTT
aaatcatcatatgagattag

SEQ ID NO: 43323 - DNA, 20 bp, Artificial Sequence
  Description of Artificial Sequence: Synthetic oligonucleotide
  Target: SCN10A; (-) strand; PAM type: YTN; PAM sequence: CTT
taaatcatcatatgagatta

SEQ ID NO: 43324 - DNA, 20 bp, Artificial Sequence
  Description of Artificial Sequence: Synthetic oligonucleotide
  Target: SCN10A; (-) strand; PAM type: YTN; PAM sequence: TTA
ctttaaatcatcatatgaga

SEQ ID NO: 43325 - DNA, 20 bp, Artificial Sequence
  Description of Artificial Sequence: Synthetic oligonucleotide
  Target: SCN10A; (-) strand; PAM type: YTN; PAM sequence: TTA
aacagccacatgtgggatta

SEQ ID NO: 43326 - DNA, 20 bp, Artificial Sequence
  Description of Artificial Sequence: Synthetic oligonucleotide
  Target: SCN10A; (-) strand; PAM type: YTN; PAM sequence: CTT
aaacagccacatgtgggatt

SEQ ID NO: 43327 - DNA, 20 bp, Artificial Sequence
  Description of Artificial Sequence: Synthetic oligonucleotide
  Target: SCN10A; (-) strand; PAM type: YTN; PAM sequence: TTC
ttaaacagccacatgtggga

SEQ ID NO: 43328 - DNA, 20 bp, Artificial Sequence
  Description of Artificial Sequence: Synthetic oligonucleotide
  Target: SCN10A; (-) strand; PAM type: YTN; PAM sequence: CTA
ttcttaaacagccacatgtg

SEQ ID NO: 43329 - DNA, 20 bp, Artificial Sequence
  Description of Artificial Sequence: Synthetic oligonucleotide
  Target: SCN10A; (-) strand; PAM type: YTN; PAM sequence: CTC
tattcttaaacagccacatg

SEQ ID NO: 43330 - DNA, 20 bp, Artificial Sequence
  Description of Artificial Sequence: Synthetic oligonucleotide
  Target: SCN10A; (-) strand; PAM type: YTN; PAM sequence: CTA
ctctattcttaaacagccac

SEQ ID NO: 43331 - DNA, 20 bp, Artificial Sequence
  Description of Artificial Sequence: Synthetic oligonucleotide
  Target: SCN10A; (-) strand; PAM type: YTN; PAM sequence: TTA
atgctactctattcttaaac

SEQ ID NO: 43332 - DNA, 20 bp, Artificial Sequence
  Description of Artificial Sequence: Synthetic oligonucleotide
  Target: SCN10A; (-) strand; PAM type: YTN; PAM sequence: TTT
aatgctactctattcttaaa

SEQ ID NO: 43333 - DNA, 20 bp, Artificial Sequence
  Description of Artificial Sequence: Synthetic oligonucleotide
  Target: SCN10A; (-) strand; PAM type: YTN; PAM sequence: CTT
taatgctactctattcttaa

SEQ ID NO: 43334 - DNA, 20 bp, Artificial Sequence
  Description of Artificial Sequence: Synthetic oligonucleotide
  Target: SCN10A; (-) strand; PAM type: YTN; PAM sequence: CTG
tgtctttaatgctactctat

SEQ ID NO: 43335 - DNA, 20 bp, Artificial Sequence
  Description of Artificial Sequence: Synthetic oligonucleotide
  Target: SCN10A; (-) strand; PAM type: YTN; PAM sequence: CTC
tgtgtctttaatgctactct

SEQ ID NO: 43336 - DNA, 20 bp, Artificial Sequence
  Description of Artificial Sequence: Synthetic oligonucleotide
  Target: SCN10A; (-) strand; PAM type: YTN; PAM sequence: CTG
aaaggctctgtgtctttaat

SEQ ID NO: 43337 - DNA, 20 bp, Artificial Sequence
  Description of Artificial Sequence: Synthetic oligonucleotide
  Target: SCN10A; (-) strand; PAM type: YTN; PAM sequence: TTC
tgaaaggctctgtgtcttta

SEQ ID NO: 43338 - DNA, 20 bp, Artificial Sequence
  Description of Artificial Sequence: Synthetic oligonucleotide
  Target: SCN10A; (-) strand; PAM type: YTN; PAM sequence: CTA
cattctgaaaggctctgtgt

SEQ ID NO: 43339 - DNA, 20 bp, Artificial Sequence
  Description of Artificial Sequence: Synthetic oligonucleotide
  Target: SCN10A; (-) strand; PAM type: YTN; PAM sequence: CTC
agtccatactacattctgaa

SEQ ID NO: 43340 - DNA, 20 bp, Artificial Sequence
  Description of Artificial Sequence: Synthetic oligonucleotide
  Target: SCN10A; (-) strand; PAM type: YTN; PAM sequence: CTC
agtcctcagtccatactaca

SEQ ID NO: 43341 - DNA, 20 bp, Artificial Sequence
  Description of Artificial Sequence: Synthetic oligonucleotide
  Target: SCN10A; (-) strand; PAM type: YTN; PAM sequence: CTA
gacactcagtcctcagtcca

SEQ ID NO: 43342 - DNA, 20 bp, Artificial Sequence
  Description of Artificial Sequence: Synthetic oligonucleotide
  Target: SCN10A; (-) strand; PAM type: YTN; PAM sequence: CTA
gaaccagacacctagacact

SEQ ID NO: 43343 - DNA, 20 bp, Artificial Sequence
  Description of Artificial Sequence: Synthetic oligonucleotide
  Target: SCN10A; (-) strand; PAM type: YTN; PAM sequence: TTG
gcactagaaccagacaccta

SEQ ID NO: 43344 - DNA, 20 bp, Artificial Sequence
  Description of Artificial Sequence: Synthetic oligonucleotide
  Target: SCN10A; (-) strand; PAM type: YTN; PAM sequence: TTG
tagcaattggcactagaacc

SEQ ID NO: 43345 - DNA, 20 bp, Artificial Sequence
  Description of Artificial Sequence: Synthetic oligonucleotide
  Target: SCN10A; (-) strand; PAM type: YTN; PAM sequence: CTT
gtagcaattggcactagaac

SEQ ID NO: 43346 - DNA, 20 bp, Artificial Sequence
  Description of Artificial Sequence: Synthetic oligonucleotide
  Target: SCN10A; (-) strand; PAM type: YTN; PAM sequence: TTA
ggcaagtgcacagagcagac

SEQ ID NO: 43347 - DNA, 20 bp, Artificial Sequence
  Description of Artificial Sequence: Synthetic oligonucleotide
  Target: SCN10A; (-) strand; PAM type: YTN; PAM sequence: CTT
aggcaagtgcacagagcaga

SEQ ID NO: 43348 - DNA, 20 bp, Artificial Sequence
  Description of Artificial Sequence: Synthetic oligonucleotide
  Target: SCN10A; (-) strand; PAM type: YTN; PAM sequence: CTG
agaggggaaaccttaggcaa

SEQ ID NO: 43349 - DNA, 20 bp, Artificial Sequence
  Description of Artificial Sequence: Synthetic oligonucleotide
  Target: SCN10A; (-) strand; PAM type: YTN; PAM sequence: CTG
agaaaatggcagccctgaga

SEQ ID NO: 43350 - DNA, 20 bp, Artificial Sequence
  Description of Artificial Sequence: Synthetic oligonucleotide
  Target: SCN10A; (-) strand; PAM type: YTN; PAM sequence: TTA
catcatgtgcataaggtggg

SEQ ID NO: 43351 - DNA, 20 bp, Artificial Sequence
  Description of Artificial Sequence: Synthetic oligonucleotide
  Target: SCN10A; (-) strand; PAM type: YTN; PAM sequence: CTT
acatcatgtgcataaggtgg

SEQ ID NO: 43352 - DNA, 20 bp, Artificial Sequence
  Description of Artificial Sequence: Synthetic oligonucleotide
  Target: SCN10A; (-) strand; PAM type: YTN; PAM sequence: TTC
ttacatcatgtgcataaggt

SEQ ID NO: 43353 - DNA, 20 bp, Artificial Sequence
  Description of Artificial Sequence: Synthetic oligonucleotide
  Target: SCN10A; (-) strand; PAM type: YTN; PAM sequence: CTG
gaagatataccattcttaca

SEQ ID NO: 43354 - DNA, 20 bp, Artificial Sequence
  Description of Artificial Sequence: Synthetic oligonucleotide
  Target: SCN10A; (-) strand; PAM type: YTN; PAM sequence: CTC
catctggaagatataccatt

SEQ ID NO: 43355 - DNA, 20 bp, Artificial Sequence
  Description of Artificial Sequence: Synthetic oligonucleotide
  Target: SCN10A; (-) strand; PAM type: YTN; PAM sequence: TTC
tccatctggaagatatacca

SEQ ID NO: 43356 - DNA, 20 bp, Artificial Sequence
  Description of Artificial Sequence: Synthetic oligonucleotide
  Target: SCN10A; (-) strand; PAM type: YTN; PAM sequence: CTT
ctccatctggaagatatacc

SEQ ID NO: 43357 - DNA, 20 bp, Artificial Sequence
  Description of Artificial Sequence: Synthetic oligonucleotide
  Target: SCN10A; (-) strand; PAM type: YTN; PAM sequence: CTC
aacttctccatctggaagat

SEQ ID NO: 43358 - DNA, 20 bp, Artificial Sequence
  Description of Artificial Sequence: Synthetic oligonucleotide
  Target: SCN10A; (-) strand; PAM type: YTN; PAM sequence: TTC
tcaacttctccatctggaag

SEQ ID NO: 43359 - DNA, 20 bp, Artificial Sequence
  Description of Artificial Sequence: Synthetic oligonucleotide
  Target: SCN10A; (-) strand; PAM type: YTN; PAM sequence: CTA
ttctcaacttctccatctgg

SEQ ID NO: 43360 - DNA, 20 bp, Artificial Sequence
  Description of Artificial Sequence: Synthetic oligonucleotide
  Target: SCN10A; (-) strand; PAM type: YTN; PAM sequence: TTC
tattctcaacttctccatct

SEQ ID NO: 43361 - DNA, 20 bp, Artificial Sequence
  Description of Artificial Sequence: Synthetic oligonucleotide
  Target: SCN10A; (-) strand; PAM type: YTN; PAM sequence: CTT
ctattctcaacttctccatc

SEQ ID NO: 43362 - DNA, 20 bp, Artificial Sequence
  Description of Artificial Sequence: Synthetic oligonucleotide
  Target: SCN10A; (-) strand; PAM type: YTN; PAM sequence: CTG
aaggcaggaacatggaggtc

SEQ ID NO: 43363 - DNA, 20 bp, Artificial Sequence
  Description of Artificial Sequence: Synthetic oligonucleotide
  Target: SCN10A; (-) strand; PAM type: YTN; PAM sequence: CTA
aagctgaaggcaggaacatg

SEQ ID NO: 43364 - DNA, 20 bp, Artificial Sequence
  Description of Artificial Sequence: Synthetic oligonucleotide
  Target: SCN10A; (-) strand; PAM type: YTN; PAM sequence: CTC
aagaatgctaaagctgaagg

SEQ ID NO: 43365 - DNA, 20 bp, Artificial Sequence
  Description of Artificial Sequence: Synthetic oligonucleotide
  Target: SCN10A; (-) strand; PAM type: YTN; PAM sequence: CTA
gacctcaagaatgctaaagc

SEQ ID NO: 43366 - DNA, 20 bp, Artificial Sequence
  Description of Artificial Sequence: Synthetic oligonucleotide
  Target: SCN10A; (-) strand; PAM type: YTN; PAM sequence: TTC
tagacctcaagaatgctaaa

SEQ ID NO: 43367 - DNA, 20 bp, Artificial Sequence
  Description of Artificial Sequence: Synthetic oligonucleotide
  Target: SCN10A; (-) strand; PAM type: YTN; PAM sequence: TTT
ctagacctcaagaatgctaa

SEQ ID NO: 43368 - DNA, 20 bp, Artificial Sequence
  Description of Artificial Sequence: Synthetic oligonucleotide
  Target: SCN10A; (-) strand; PAM type: YTN; PAM sequence: CTG
gaaggcacacccagtttcta

SEQ ID NO: 43369 - DNA, 20 bp, Artificial Sequence
  Description of Artificial Sequence: Synthetic oligonucleotide
  Target: SCN10A; (-) strand; PAM type: YTN; PAM sequence: CTG
aacatgctggaaggcacacc

SEQ ID NO: 43370 - DNA, 20 bp, Artificial Sequence
  Description of Artificial Sequence: Synthetic oligonucleotide
  Target: SCN10A; (-) strand; PAM type: YTN; PAM sequence: CTC
tgaacatgctggaaggcaca

SEQ ID NO: 43371 - DNA, 20 bp, Artificial Sequence
  Description of Artificial Sequence: Synthetic oligonucleotide
  Target: SCN10A; (-) strand; PAM type: YTN; PAM sequence: TTG
catgctctgaacatgctgga

SEQ ID NO: 43372 - DNA, 20 bp, Artificial Sequence
  Description of Artificial Sequence: Synthetic oligonucleotide
  Target: SCN10A; (-) strand; PAM type: YTN; PAM sequence: CTT
gcatgctctgaacatgctgg

SEQ ID NO: 43373 - DNA, 20 bp, Artificial Sequence
  Description of Artificial Sequence: Synthetic oligonucleotide
  Target: SCN10A; (-) strand; PAM type: YTN; PAM sequence: CTA
agatgtcttgcatgctctga

SEQ ID NO: 43374 - DNA, 20 bp, Artificial Sequence
  Description of Artificial Sequence: Synthetic oligonucleotide
  Target: SCN10A; (-) strand; PAM type: YTN; PAM sequence: CTA
ggagtgtaagaactaagatg

SEQ ID NO: 43375 - DNA, 20 bp, Artificial Sequence
  Description of Artificial Sequence: Synthetic oligonucleotide
  Target: SCN10A; (-) strand; PAM type: YTN; PAM sequence: CTG
taacaggcctaggagtgtaa

SEQ ID NO: 43376 - DNA, 20 bp, Artificial Sequence
  Description of Artificial Sequence: Synthetic oligonucleotide
  Target: SCN10A; (-) strand; PAM type: YTN; PAM sequence: TTA
agtgctgtaacaggcctagg

SEQ ID NO: 43377 - DNA, 20 bp, Artificial Sequence
  Description of Artificial Sequence: Synthetic oligonucleotide
  Target: SCN10A; (-) strand; PAM type: YTN; PAM sequence: CTC
attaagtgctgtaacaggcc

SEQ ID NO: 43378 - DNA, 20 bp, Artificial Sequence
  Description of Artificial Sequence: Synthetic oligonucleotide
  Target: SCN10A; (-) strand; PAM type: YTN; PAM sequence: TTA
aaacagctcattaagtgctg

SEQ ID NO: 43379 - DNA, 20 bp, Artificial Sequence
  Description of Artificial Sequence: Synthetic oligonucleotide
  Target: SCN10A; (-) strand; PAM type: YTN; PAM sequence: CTA
ataggtgaattaaaacagct

SEQ ID NO: 43380 - DNA, 20 bp, Artificial Sequence
  Description of Artificial Sequence: Synthetic oligonucleotide
  Target: SCN10A; (-) strand; PAM type: YTN; PAM sequence: CTG
tatgagaaacagactaatag

SEQ ID NO: 43381 - DNA, 20 bp, Artificial Sequence
  Description of Artificial Sequence: Synthetic oligonucleotide
  Target: SCN10A; (-) strand; PAM type: YTN; PAM sequence: CTG
atgctgtatgagaaacagac

SEQ ID NO: 43382 - DNA, 20 bp, Artificial Sequence
  Description of Artificial Sequence: Synthetic oligonucleotide
  Target: SCN10A; (-) strand; PAM type: YTN; PAM sequence: TTG
gacactgatgctgtatgaga

SEQ ID NO: 43383 - DNA, 20 bp, Artificial Sequence
  Description of Artificial Sequence: Synthetic oligonucleotide
  Target: SCN10A; (-) strand; PAM type: YTN; PAM sequence: CTT
ggacactgatgctgtatgag

SEQ ID NO: 43384 - DNA, 20 bp, Artificial Sequence
  Description of Artificial Sequence: Synthetic oligonucleotide
  Target: SCN10A; (-) strand; PAM type: YTN; PAM sequence: CTG
ggcttggacactgatgctgt

SEQ ID NO: 43385 - DNA, 20 bp, Artificial Sequence
  Description of Artificial Sequence: Synthetic oligonucleotide
  Target: SCN10A; (-) strand; PAM type: YTN; PAM sequence: CTG
ggagatacagtcagaactgg

SEQ ID NO: 43386 - DNA, 20 bp, Artificial Sequence
  Description of Artificial Sequence: Synthetic oligonucleotide
  Target: SCN10A; (-) strand; PAM type: YTN; PAM sequence: CTC
agccctgggagatacagtca

SEQ ID NO: 43387 - DNA, 20 bp, Artificial Sequence
  Description of Artificial Sequence: Synthetic oligonucleotide
  Target: SCN10A; (-) strand; PAM type: YTN; PAM sequence: CTA
ctcagccctgggagatacag

SEQ ID NO: 43388 - DNA, 20 bp, Artificial Sequence
  Description of Artificial Sequence: Synthetic oligonucleotide
  Target: SCN10A; (-) strand; PAM type: YTN; PAM sequence: CTG
gtatgccaggcatggtacta

SEQ ID NO: 43389 - DNA, 20 bp, Artificial Sequence
  Description of Artificial Sequence: Synthetic oligonucleotide
  Target: SCN10A; (-) strand; PAM type: YTN; PAM sequence: CTC
tggtatgccaggcatggtac

SEQ ID NO: 43390 - DNA, 20 bp, Artificial Sequence
  Description of Artificial Sequence: Synthetic oligonucleotide
  Target: SCN10A; (-) strand; PAM type: YTN; PAM sequence: CTG
agtagctctggtatgccagg

SEQ ID NO: 43391 - DNA, 20 bp, Artificial Sequence
  Description of Artificial Sequence: Synthetic oligonucleotide
  Target: SCN10A; (-) strand; PAM type: YTN; PAM sequence: CTC
tgagtagctctggtatgcca

SEQ ID NO: 43392 - DNA, 20 bp, Artificial Sequence
  Description of Artificial Sequence: Synthetic oligonucleotide
  Target: SCN10A; (-) strand; PAM type: YTN; PAM sequence: TTC
aacaaataatctctgagtag

SEQ ID NO: 43393 - DNA, 20 bp, Artificial Sequence
  Description of Artificial Sequence: Synthetic oligonucleotide
  Target: SCN10A; (-) strand; PAM type: YTN; PAM sequence: TTA
ttcaacaaataatctctgag

SEQ ID NO: 43394 - DNA, 20 bp, Artificial Sequence
  Description of Artificial Sequence: Synthetic oligonucleotide
  Target: SCN10A; (-) strand; PAM type: YTN; PAM sequence: TTT
attcaacaaataatctctga

SEQ ID NO: 43395 - DNA, 20 bp, Artificial Sequence
  Description of Artificial Sequence: Synthetic oligonucleotide
  Target: SCN10A; (-) strand; PAM type: YTN; PAM sequence: TTG
catttattcaacaaataatc

SEQ ID NO: 43396 - DNA, 20 bp, Artificial Sequence
  Description of Artificial Sequence: Synthetic oligonucleotide
  Target: SCN10A; (-) strand; PAM type: YTN; PAM sequence: CTT
gcatttattcaacaaataat

SEQ ID NO: 43397 - DNA, 20 bp, Artificial Sequence
  Description of Artificial Sequence: Synthetic oligonucleotide
  Target: SCN10A; (-) strand; PAM type: YTN; PAM sequence: TTC
ttgcatttattcaacaaata

SEQ ID NO: 43398 - DNA, 20 bp, Artificial Sequence
  Description of Artificial Sequence: Synthetic oligonucleotide
  Target: SCN10A; (-) strand; PAM type: YTN; PAM sequence: TTG
gttcttgcatttattcaaca

SEQ ID NO: 43399 - DNA, 20 bp, Artificial Sequence
  Description of Artificial Sequence: Synthetic oligonucleotide
  Target: SCN10A; (-) strand; PAM type: YTN; PAM sequence: TTC
caccattggttcttgcattt

SEQ ID NO: 43400 - DNA, 20 bp, Artificial Sequence
  Description of Artificial Sequence: Synthetic oligonucleotide
  Target: SCN10A; (-) strand; PAM type: YTN; PAM sequence: CTA
cattccaccattggttcttg

SEQ ID NO: 43401 - DNA, 20 bp, Artificial Sequence
  Description of Artificial Sequence: Synthetic oligonucleotide
  Target: SCN10A; (-) strand; PAM type: YTN; PAM sequence: TTG
agtgtctacattccaccatt

SEQ ID NO: 43402 - DNA, 20 bp, Artificial Sequence
  Description of Artificial Sequence: Synthetic oligonucleotide
  Target: SCN10A; (-) strand; PAM type: YTN; PAM sequence: CTT
gagtgtctacattccaccat

SEQ ID NO: 43403 - DNA, 20 bp, Artificial Sequence
  Description of Artificial Sequence: Synthetic oligonucleotide
  Target: SCN10A; (-) strand; PAM type: YTN; PAM sequence: CTC
ttgagtgtctacattccacc

SEQ ID NO: 43404 - DNA, 20 bp, Artificial Sequence
  Description of Artificial Sequence: Synthetic oligonucleotide
  Target: SCN10A; (-) strand; PAM type: YTN; PAM sequence: TTA
ctcttgagtgtctacattcc

SEQ ID NO: 43405 - DNA, 20 bp, Artificial Sequence
  Description of Artificial Sequence: Synthetic oligonucleotide
  Target: SCN10A; (-) strand; PAM type: YTN; PAM sequence: TTG
tcatgcagttactcttgagt

SEQ ID NO: 43406 - DNA, 20 bp, Artificial Sequence
  Description of Artificial Sequence: Synthetic oligonucleotide
  Target: SCN10A; (-) strand; PAM type: YTN; PAM sequence: TTT
gtcatgcagttactcttgag

SEQ ID NO: 43407 - DNA, 20 bp, Artificial Sequence
  Description of Artificial Sequence: Synthetic oligonucleotide
  Target: SCN10A; (-) strand; PAM type: YTN; PAM sequence: TTA
tacatttgtcatgcagttac

SEQ ID NO: 43408 - DNA, 20 bp, Artificial Sequence
  Description of Artificial Sequence: Synthetic oligonucleotide
  Target: SCN10A; (-) strand; PAM type: YTN; PAM sequence: CTT
atacatttgtcatgcagtta

SEQ ID NO: 43409 - DNA, 20 bp, Artificial Sequence
  Description of Artificial Sequence: Synthetic oligonucleotide
  Target: SCN10A; (-) strand; PAM type: YTN; PAM sequence: TTA
cttatacatttgtcatgcag

SEQ ID NO: 43410 - DNA, 20 bp, Artificial Sequence
  Description of Artificial Sequence: Synthetic oligonucleotide
  Target: SCN10A; (-) strand; PAM type: YTN; PAM sequence: TTA
atacaattacttatacattt

SEQ ID NO: 43411 - DNA, 20 bp, Artificial Sequence
  Description of Artificial Sequence: Synthetic oligonucleotide
  Target: SCN10A; (-) strand; PAM type: YTN; PAM sequence: TTC
aagtgttaatacaattactt

SEQ ID NO: 43412 - DNA, 20 bp, Artificial Sequence
  Description of Artificial Sequence: Synthetic oligonucleotide
  Target: SCN10A; (-) strand; PAM type: YTN; PAM sequence: TTC
attcaagtgttaatacaatt

SEQ ID NO: 43413 - DNA, 20 bp, Artificial Sequence
  Description of Artificial Sequence: Synthetic oligonucleotide
  Target: SCN10A; (-) strand; PAM type: YTN; PAM sequence: CTG
ttcattcaagtgttaataca

SEQ ID NO: 43414 - DNA, 20 bp, Artificial Sequence
  Description of Artificial Sequence: Synthetic oligonucleotide
  Target: SCN10A; (-) strand; PAM type: YTN; PAM sequence: CTC
tgttcattcaagtgttaata

SEQ ID NO: 43415 - DNA, 20 bp, Artificial Sequence
  Description of Artificial Sequence: Synthetic oligonucleotide
  Target: SCN10A; (-) strand; PAM type: YTN; PAM sequence: TTC
agtcctctgttcattcaagt

SEQ ID NO: 43416 - DNA, 20 bp, Artificial Sequence
  Description of Artificial Sequence: Synthetic oligonucleotide
  Target: SCN10A; (-) strand; PAM type: YTN; PAM sequence: TTC
attcagtcctctgttcattc

SEQ ID NO: 43417 - DNA, 20 bp, Artificial Sequence
  Description of Artificial Sequence: Synthetic oligonucleotide
  Target: SCN10A; (-) strand; PAM type: YTN; PAM sequence: CTG
ttcattcagtcctctgttca

SEQ ID NO: 43418 - DNA, 20 bp, Artificial Sequence
  Description of Artificial Sequence: Synthetic oligonucleotide
  Target: SCN10A; (-) strand; PAM type: YTN; PAM sequence: CTA
cctgttcattcagtcctctg

SEQ ID NO: 43419 - DNA, 20 bp, Artificial Sequence
  Description of Artificial Sequence: Synthetic oligonucleotide
  Target: SCN10A; (-) strand; PAM type: YTN; PAM sequence: TTC
atctacctgttcattcagtc

SEQ ID NO: 43420 - DNA, 20 bp, Artificial Sequence
  Description of Artificial Sequence: Synthetic oligonucleotide
  Target: SCN10A; (-) strand; PAM type: YTN; PAM sequence: CTT
catctacctgttcattcagt

SEQ ID NO: 43421 - DNA, 20 bp, Artificial Sequence
  Description of Artificial Sequence: Synthetic oligonucleotide
  Target: SCN10A; (-) strand; PAM type: YTN; PAM sequence: TTG
ccttcatctacctgttcatt

SEQ ID NO: 43422 - DNA, 20 bp, Artificial Sequence
  Description of Artificial Sequence: Synthetic oligonucleotide
  Target: SCN10A; (-) strand; PAM type: YTN; PAM sequence: CTT
gccttcatctacctgttcat

SEQ ID NO: 43423 - DNA, 20 bp, Artificial Sequence
  Description of Artificial Sequence: Synthetic oligonucleotide
  Target: SCN10A; (-) strand; PAM type: YTN; PAM sequence: TTC
ttgccttcatctacctgttc

SEQ ID NO: 43424 - DNA, 20 bp, Artificial Sequence
  Description of Artificial Sequence: Synthetic oligonucleotide
  Target: SCN10A; (-) strand; PAM type: YTN; PAM sequence: TTT
cttgccttcatctacctgtt

SEQ ID NO: 43425 - DNA, 20 bp, Artificial Sequence
  Description of Artificial Sequence: Synthetic oligonucleotide
  Target: SCN10A; (-) strand; PAM type: YTN; PAM sequence: CTC
atttcttgccttcatctacc

SEQ ID NO: 43426 - DNA, 20 bp, Artificial Sequence
  Description of Artificial Sequence: Synthetic oligonucleotide
  Target: SCN10A; (-) strand; PAM type: YTN; PAM sequence: TTC
atcatccagtcaatcactca

SEQ ID NO: 43427 - DNA, 20 bp, Artificial Sequence
  Description of Artificial Sequence: Synthetic oligonucleotide
  Target: SCN10A; (-) strand; PAM type: YTN; PAM sequence: TTT
catcatccagtcaatcactc

SEQ ID NO: 43428 - DNA, 20 bp, Artificial Sequence
  Description of Artificial Sequence: Synthetic oligonucleotide
  Target: SCN10A; (-) strand; PAM type: YTN; PAM sequence: CTT
tcatcatccagtcaatcact

SEQ ID NO: 43429 - DNA, 20 bp, Artificial Sequence
  Description of Artificial Sequence: Synthetic oligonucleotide
  Target: SCN10A; (-) strand; PAM type: YTN; PAM sequence: TTC
tttcatcatccagtcaatca

SEQ ID NO: 43430 - DNA, 20 bp, Artificial Sequence
  Description of Artificial Sequence: Synthetic oligonucleotide
  Target: SCN10A; (-) strand; PAM type: YTN; PAM sequence: TTT
ctttcatcatccagtcaatc

SEQ ID NO: 43431 - DNA, 20 bp, Artificial Sequence
  Description of Artificial Sequence: Synthetic oligonucleotide
  Target: SCN10A; (-) strand; PAM type: YTN; PAM sequence: CTT
tctttcatcatccagtcaat

SEQ ID NO: 43432 - DNA, 20 bp, Artificial Sequence
  Description of Artificial Sequence: Synthetic oligonucleotide
  Target: SCN10A; (-) strand; PAM type: YTN; PAM sequence: TTC
tttctttcatcatccagtca

SEQ ID NO: 43433 - DNA, 20 bp, Artificial Sequence
  Description of Artificial Sequence: Synthetic oligonucleotide
  Target: SCN10A; (-) strand; PAM type: YTN; PAM sequence: TTT
ctttctttcatcatccagtc

SEQ ID NO: 43434 - DNA, 20 bp, Artificial Sequence
  Description of Artificial Sequence: Synthetic oligonucleotide
  Target: SCN10A; (-) strand; PAM type: YTN; PAM sequence: CTT
tctttctttcatcatccagt

SEQ ID NO: 43435 - DNA, 20 bp, Artificial Sequence
  Description of Artificial Sequence: Synthetic oligonucleotide
  Target: SCN10A; (-) strand; PAM type: YTN; PAM sequence: CTG
tctttctttctttcatcatc

SEQ ID NO: 43436 - DNA, 20 bp, Artificial Sequence
  Description of Artificial Sequence: Synthetic oligonucleotide
  Target: SCN10A; (-) strand; PAM type: YTN; PAM sequence: TTC
atcctgtctttctttctttc

SEQ ID NO: 43437 - DNA, 20 bp, Artificial Sequence
  Description of Artificial Sequence: Synthetic oligonucleotide
  Target: SCN10A; (-) strand; PAM type: YTN; PAM sequence: TTG
gtgataatgacagtcaaaca

SEQ ID NO: 43438 - DNA, 20 bp, Artificial Sequence
  Description of Artificial Sequence: Synthetic oligonucleotide
  Target: SCN10A; (-) strand; PAM type: YTN; PAM sequence: TTG
taatgatatataatgttggt

SEQ ID NO: 43439 - DNA, 20 bp, Artificial Sequence
  Description of Artificial Sequence: Synthetic oligonucleotide
  Target: SCN10A; (-) strand; PAM type: YTN; PAM sequence: CTA
ttgtaatgatatataatgtt

SEQ ID NO: 43440 - DNA, 20 bp, Artificial Sequence
  Description of Artificial Sequence: Synthetic oligonucleotide
  Target: SCN10A; (-) strand; PAM type: YTN; PAM sequence: TTA
ggtctattgtaatgatatat

SEQ ID NO: 43441 - DNA, 20 bp, Artificial Sequence
  Description of Artificial Sequence: Synthetic oligonucleotide
  Target: SCN10A; (-) strand; PAM type: YTN; PAM sequence: CTC
attaggtctattgtaatgat

SEQ ID NO: 43442 - DNA, 20 bp, Artificial Sequence
  Description of Artificial Sequence: Synthetic oligonucleotide
  Target: SCN10A; (-) strand; PAM type: YTN; PAM sequence: TTA
tgtctcattaggtctattgt

SEQ ID NO: 43443 - DNA, 20 bp, Artificial Sequence
  Description of Artificial Sequence: Synthetic oligonucleotide
  Target: SCN10A; (-) strand; PAM type: YTN; PAM sequence: CTA
aatggtaataaattatgtct

SEQ ID NO: 43444 - DNA, 20 bp, Artificial Sequence
  Description of Artificial Sequence: Synthetic oligonucleotide
  Target: SCN10A; (-) strand; PAM type: YTN; PAM sequence: TTC
ctaaatggtaataaattatg

SEQ ID NO: 43445 - DNA, 20 bp, Artificial Sequence
  Description of Artificial Sequence: Synthetic oligonucleotide
  Target: SCN10A; (-) strand; PAM type: YTN; PAM sequence: TTT
cctaaatggtaataaattat

SEQ ID NO: 43446 - DNA, 20 bp, Artificial Sequence
  Description of Artificial Sequence: Synthetic oligonucleotide
  Target: SCN10A; (-) strand; PAM type: YTN; PAM sequence: TTC
acatcatttcctaaatggta

SEQ ID NO: 43447 - DNA, 20 bp, Artificial Sequence
  Description of Artificial Sequence: Synthetic oligonucleotide
  Target: SCN10A; (-) strand; PAM type: YTN; PAM sequence: CTT
cacatcatttcctaaatggt

SEQ ID NO: 43448 - DNA, 20 bp, Artificial Sequence
  Description of Artificial Sequence: Synthetic oligonucleotide
  Target: SCN10A; (-) strand; PAM type: YTN; PAM sequence: TTC
aacttcacatcatttcctaa

SEQ ID NO: 43449 - DNA, 20 bp, Artificial Sequence
  Description of Artificial Sequence: Synthetic oligonucleotide
  Target: SCN10A; (-) strand; PAM type: YTN; PAM sequence: CTT
caacttcacatcatttccta

SEQ ID NO: 43450 - DNA, 20 bp, Artificial Sequence
  Description of Artificial Sequence: Synthetic oligonucleotide
  Target: SCN10A; (-) strand; PAM type: YTN; PAM sequence: TTC
agtcttcaacttcacatcat

SEQ ID NO: 43451 - DNA, 20 bp, Artificial Sequence
  Description of Artificial Sequence: Synthetic oligonucleotide
  Target: SCN10A; (-) strand; PAM type: YTN; PAM sequence: CTG
tacaaaatagacacggcata

SEQ ID NO: 43452 - DNA, 20 bp, Artificial Sequence
  Description of Artificial Sequence: Synthetic oligonucleotide
  Target: SCN10A; (-) strand; PAM type: YTN; PAM sequence: TTA
aaacacagaacctgtacaaa

SEQ ID NO: 43453 - DNA, 20 bp, Artificial Sequence
  Description of Artificial Sequence: Synthetic oligonucleotide
  Target: SCN10A; (-) strand; PAM type: YTN; PAM sequence: TTA
tcaggtggtgagttaaaaca

SEQ ID NO: 43454 - DNA, 20 bp, Artificial Sequence
  Description of Artificial Sequence: Synthetic oligonucleotide
  Target: SCN10A; (-) strand; PAM type: YTN; PAM sequence: CTG
ccatgggattatcaggtggt

SEQ ID NO: 43455 - DNA, 20 bp, Artificial Sequence
  Description of Artificial Sequence: Synthetic oligonucleotide
  Target: SCN10A; (-) strand; PAM type: YTN; PAM sequence: CTA
gtagaatagcataaagggat

SEQ ID NO: 43456 - DNA, 20 bp, Artificial Sequence
  Description of Artificial Sequence: Synthetic oligonucleotide
  Target: SCN10A; (-) strand; PAM type: YTN; PAM sequence: TTA
cacaagtgtgggctagtaga

SEQ ID NO: 43457 - DNA, 20 bp, Artificial Sequence
  Description of Artificial Sequence: Synthetic oligonucleotide
  Target: SCN10A; (-) strand; PAM type: YTN; PAM sequence: CTA
gtgaatatgatatcacagtg

SEQ ID NO: 43458 - DNA, 20 bp, Artificial Sequence
  Description of Artificial Sequence: Synthetic oligonucleotide
  Target: SCN10A; (-) strand; PAM type: YTN; PAM sequence: TTC
ctagtgaatatgatatcaca

SEQ ID NO: 43459 - DNA, 20 bp, Artificial Sequence
  Description of Artificial Sequence: Synthetic oligonucleotide
  Target: SCN10A; (-) strand; PAM type: YTN; PAM sequence: CTT
cctagtgaatatgatatcac

SEQ ID NO: 43460 - DNA, 20 bp, Artificial Sequence
  Description of Artificial Sequence: Synthetic oligonucleotide
  Target: SCN10A; (-) strand; PAM type: YTN; PAM sequence: CTA
gagggccttcctagtgaata

SEQ ID NO: 43461 - DNA, 20 bp, Artificial Sequence
  Description of Artificial Sequence: Synthetic oligonucleotide
  Target: SCN10A; (-) strand; PAM type: YTN; PAM sequence: CTA
caccatgaggctagagggcc

SEQ ID NO: 43462 - DNA, 20 bp, Artificial Sequence
  Description of Artificial Sequence: Synthetic oligonucleotide
  Target: SCN10A; (-) strand; PAM type: YTN; PAM sequence: CTA
cagactacaccatgaggcta

SEQ ID NO: 43463 - DNA, 20 bp, Artificial Sequence
  Description of Artificial Sequence: Synthetic oligonucleotide
  Target: SCN10A; (-) strand; PAM type: YTN; PAM sequence: TTC
ctacagactacaccatgagg

SEQ ID NO: 43464 - DNA, 20 bp, Artificial Sequence
  Description of Artificial Sequence: Synthetic oligonucleotide
  Target: SCN10A; (-) strand; PAM type: YTN; PAM sequence: CTA
ttcctacagactacaccatg

SEQ ID NO: 43465 - DNA, 20 bp, Artificial Sequence
  Description of Artificial Sequence: Synthetic oligonucleotide
  Target: SCN10A; (-) strand; PAM type: YTN; PAM sequence: CTC
tattcctacagactacacca

SEQ ID NO: 43466 - DNA, 20 bp, Artificial Sequence
  Description of Artificial Sequence: Synthetic oligonucleotide
  Target: SCN10A; (-) strand; PAM type: YTN; PAM sequence: TTC
tctattcctacagactacac

SEQ ID NO: 43467 - DNA, 20 bp, Artificial Sequence
  Description of Artificial Sequence: Synthetic oligonucleotide
  Target: SCN10A; (-) strand; PAM type: YTN; PAM sequence: CTG
aggtcattctctattcctac

SEQ ID NO: 43468 - DNA, 20 bp, Artificial Sequence
  Description of Artificial Sequence: Synthetic oligonucleotide
  Target: SCN10A; (-) strand; PAM type: YTN; PAM sequence: CTC
agtgtgaactgaggtcattc

SEQ ID NO: 43469 - DNA, 20 bp, Artificial Sequence
  Description of Artificial Sequence: Synthetic oligonucleotide
  Target: SCN10A; (-) strand; PAM type: YTN; PAM sequence: TTG
caaggagtagcactcagtgt

SEQ ID NO: 43470 - DNA, 20 bp, Artificial Sequence
  Description of Artificial Sequence: Synthetic oligonucleotide
  Target: SCN10A; (-) strand; PAM type: YTN; PAM sequence: TTT
gcaaggagtagcactcagtg

SEQ ID NO: 43471 - DNA, 20 bp, Artificial Sequence
  Description of Artificial Sequence: Synthetic oligonucleotide
  Target: SCN10A; (-) strand; PAM type: YTN; PAM sequence: CTT
tgcaaggagtagcactcagt

SEQ ID NO: 43472 - DNA, 20 bp, Artificial Sequence
  Description of Artificial Sequence: Synthetic oligonucleotide
  Target: SCN10A; (-) strand; PAM type: YTN; PAM sequence: CTA
tgtggggactttgcaaggag

SEQ ID NO: 43473 - DNA, 20 bp, Artificial Sequence
  Description of Artificial Sequence: Synthetic oligonucleotide
  Target: SCN10A; (-) strand; PAM type: YTN; PAM sequence: TTC
ccagaagatgctatgtgggg

SEQ ID NO: 43474 - DNA, 20 bp, Artificial Sequence
  Description of Artificial Sequence: Synthetic oligonucleotide
  Target: SCN10A; (-) strand; PAM type: YTN; PAM sequence: CTA
ggttcccagaagatgctatg

SEQ ID NO: 43475 - DNA, 20 bp, Artificial Sequence
  Description of Artificial Sequence: Synthetic oligonucleotide
  Target: SCN10A; (-) strand; PAM type: YTN; PAM sequence: CTC
aataaaatggagagtctagg

SEQ ID NO: 43476 - DNA, 20 bp, Artificial Sequence
  Description of Artificial Sequence: Synthetic oligonucleotide
  Target: SCN10A; (-) strand; PAM type: YTN; PAM sequence: TTG
gccgctcaataaaatggaga

SEQ ID NO: 43477 - DNA, 20 bp, Artificial Sequence
  Description of Artificial Sequence: Synthetic oligonucleotide
  Target: SCN10A; (-) strand; PAM type: YTN; PAM sequence: TTT
ggccgctcaataaaatggag

SEQ ID NO: 43478 - DNA, 20 bp, Artificial Sequence
  Description of Artificial Sequence: Synthetic oligonucleotide
  Target: SCN10A; (-) strand; PAM type: YTN; PAM sequence: CTT
tggccgctcaataaaatgga

SEQ ID NO: 43479 - DNA, 20 bp, Artificial Sequence
  Description of Artificial Sequence: Synthetic oligonucleotide
  Target: SCN10A; (-) strand; PAM type: YTN; PAM sequence: TTG
ctttggccgctcaataaaat

SEQ ID NO: 43480 - DNA, 20 bp, Artificial Sequence
  Description of Artificial Sequence: Synthetic oligonucleotide
  Target: SCN10A; (-) strand; PAM type: YTN; PAM sequence: CTT
gctttggccgctcaataaaa

SEQ ID NO: 43481 - DNA, 20 bp, Artificial Sequence
  Description of Artificial Sequence: Synthetic oligonucleotide
  Target: SCN10A; (-) strand; PAM type: YTN; PAM sequence: CTC
ttgctttggccgctcaataa

SEQ ID NO: 43482 - DNA, 20 bp, Artificial Sequence
  Description of Artificial Sequence: Synthetic oligonucleotide
  Target: SCN10A; (-) strand; PAM type: YTN; PAM sequence: CTG
caggtggtgagtcaaccatg

SEQ ID NO: 43483 - DNA, 20 bp, Artificial Sequence
  Description of Artificial Sequence: Synthetic oligonucleotide
  Target: SCN10A; (-) strand; PAM type: YTN; PAM sequence: TTC
tgcaggtggtgagtcaacca

SEQ ID NO: 43484 - DNA, 20 bp, Artificial Sequence
  Description of Artificial Sequence: Synthetic oligonucleotide
  Target: SCN10A; (-) strand; PAM type: YTN; PAM sequence: CTT
ctgcaggtggtgagtcaacc

SEQ ID NO: 43485 - DNA, 20 bp, Artificial Sequence
  Description of Artificial Sequence: Synthetic oligonucleotide
  Target: SCN10A; (-) strand; PAM type: YTN; PAM sequence: TTG
cacttctgcaggtggtgagt

SEQ ID NO: 43486 - DNA, 20 bp, Artificial Sequence
  Description of Artificial Sequence: Synthetic oligonucleotide
  Target: SCN10A; (-) strand; PAM type: YTN; PAM sequence: CTT
gcacttctgcaggtggtgag

SEQ ID NO: 43487 - DNA, 20 bp, Artificial Sequence
  Description of Artificial Sequence: Synthetic oligonucleotide
  Target: SCN10A; (-) strand; PAM type: YTN; PAM sequence: TTA
ccttgcacttctgcaggtgg

SEQ ID NO: 43488 - DNA, 20 bp, Artificial Sequence
  Description of Artificial Sequence: Synthetic oligonucleotide
  Target: SCN10A; (-) strand; PAM type: YTN; PAM sequence: TTG
caatgggttaccttgcactt

SEQ ID NO: 43489 - DNA, 20 bp, Artificial Sequence
  Description of Artificial Sequence: Synthetic oligonucleotide
  Target: SCN10A; (-) strand; PAM type: YTN; PAM sequence: TTG
ataatgttgcaatgggttac

SEQ ID NO: 43490 - DNA, 20 bp, Artificial Sequence
  Description of Artificial Sequence: Synthetic oligonucleotide
  Target: SCN10A; (-) strand; PAM type: YTN; PAM sequence: TTT
gataatgttgcaatgggtta

SEQ ID NO: 43491 - DNA, 20 bp, Artificial Sequence
  Description of Artificial Sequence: Synthetic oligonucleotide
  Target: SCN10A; (-) strand; PAM type: YTN; PAM sequence: CTT
tgataatgttgcaatgggtt

SEQ ID NO: 43492 - DNA, 20 bp, Artificial Sequence
  Description of Artificial Sequence: Synthetic oligonucleotide
  Target: SCN10A; (-) strand; PAM type: YTN; PAM sequence: CTG
ggtcaatgtgaaagtcaact

SEQ ID NO: 43493 - DNA, 20 bp, Artificial Sequence
  Description of Artificial Sequence: Synthetic oligonucleotide
  Target: SCN10A; (-) strand; PAM type: YTN; PAM sequence: TTC
tgggtcaatgtgaaagtcaa

SEQ ID NO: 43494 - DNA, 20 bp, Artificial Sequence
  Description of Artificial Sequence: Synthetic oligonucleotide
  Target: SCN10A; (-) strand; PAM type: YTN; PAM sequence: CTT
ctgggtcaatgtgaaagtca

SEQ ID NO: 43495 - DNA, 20 bp, Artificial Sequence
  Description of Artificial Sequence: Synthetic oligonucleotide
  Target: SCN10A; (-) strand; PAM type: YTN; PAM sequence: TTC
ttctgggtcaatgtgaaagt

SEQ ID NO: 43496 - DNA, 20 bp, Artificial Sequence
  Description of Artificial Sequence: Synthetic oligonucleotide
  Target: SCN10A; (-) strand; PAM type: YTN; PAM sequence: CTT
cttctgggtcaatgtgaaag

SEQ ID NO: 43497 - DNA, 20 bp, Artificial Sequence
  Description of Artificial Sequence: Synthetic oligonucleotide
  Target: SCN10A; (-) strand; PAM type: YTN; PAM sequence: CTG
gcagcttcttctgggtcaat

SEQ ID NO: 43498 - DNA, 20 bp, Artificial Sequence
  Description of Artificial Sequence: Synthetic oligonucleotide
  Target: SCN10A; (-) strand; PAM type: YTN; PAM sequence: CTC
cactggcagcttcttctggg

SEQ ID NO: 43499 - DNA, 20 bp, Artificial Sequence
  Description of Artificial Sequence: Synthetic oligonucleotide
  Target: SCN10A; (-) strand; PAM type: YTN; PAM sequence: TTC
aaaactccactggcagcttc

SEQ ID NO: 43500 - DNA, 20 bp, Artificial Sequence
  Description of Artificial Sequence: Synthetic oligonucleotide
  Target: SCN10A; (-) strand; PAM type: YTN; PAM sequence: CTG
caagattcaaaactccactg

SEQ ID NO: 43501 - DNA, 20 bp, Artificial Sequence
  Description of Artificial Sequence: Synthetic oligonucleotide
  Target: SCN10A; (-) strand; PAM type: YTN; PAM sequence: CTG
actgcaagattcaaaactcc

SEQ ID NO: 43502 - DNA, 20 bp, Artificial Sequence
  Description of Artificial Sequence: Synthetic oligonucleotide
  Target: SCN10A; (-) strand; PAM type: YTN; PAM sequence: TTG
tgaataacaagtctgactgc

SEQ ID NO: 43503 - DNA, 20 bp, Artificial Sequence
  Description of Artificial Sequence: Synthetic oligonucleotide
  Target: SCN10A; (-) strand; PAM type: YTN; PAM sequence: TTG
tcgattgtgaataacaagtc

SEQ ID NO: 43504 - DNA, 20 bp, Artificial Sequence
  Description of Artificial Sequence: Synthetic oligonucleotide
  Target: SCN10A; (-) strand; PAM type: YTN; PAM sequence: TTT
gtcgattgtgaataacaagt

SEQ ID NO: 43505 - DNA, 20 bp, Artificial Sequence
  Description of Artificial Sequence: Synthetic oligonucleotide
  Target: SCN10A; (-) strand; PAM type: YTN; PAM sequence: CTT
tgtcgattgtgaataacaag

SEQ ID NO: 43506 - DNA, 20 bp, Artificial Sequence
  Description of Artificial Sequence: Synthetic oligonucleotide
  Target: SCN10A; (-) strand; PAM type: YTN; PAM sequence: TTG
tacctttgtcgattgtgaat

SEQ ID NO: 43507 - DNA, 20 bp, Artificial Sequence
  Description of Artificial Sequence: Synthetic oligonucleotide
  Target: SCN10A; (-) strand; PAM type: YTN; PAM sequence: CTT
gtacctttgtcgattgtgaa

SEQ ID NO: 43508 - DNA, 20 bp, Artificial Sequence
  Description of Artificial Sequence: Synthetic oligonucleotide
  Target: SCN10A; (-) strand; PAM type: YTN; PAM sequence: TTC
ccttgtacctttgtcgattg

SEQ ID NO: 43509 - DNA, 20 bp, Artificial Sequence
  Description of Artificial Sequence: Synthetic oligonucleotide
  Target: SCN10A; (-) strand; PAM type: YTN; PAM sequence: TTT
cccttgtacctttgtcgatt

SEQ ID NO: 43510 - DNA, 20 bp, Artificial Sequence
  Description of Artificial Sequence: Synthetic oligonucleotide
  Target: SCN10A; (-) strand; PAM type: YTN; PAM sequence: TTT
tcccttgtacctttgtcgat

SEQ ID NO: 43511 - DNA, 20 bp, Artificial Sequence
  Description of Artificial Sequence: Synthetic oligonucleotide
  Target: SCN10A; (-) strand; PAM type: YTN; PAM sequence: CTA
taccgatggagagttttccc

SEQ ID NO: 43512 - DNA, 20 bp, Artificial Sequence
  Description of Artificial Sequence: Synthetic oligonucleotide
  Target: SCN10A; (-) strand; PAM type: YTN; PAM sequence: TTG
gaggtgcatcaactataccg

SEQ ID NO: 43513 - DNA, 20 bp, Artificial Sequence
  Description of Artificial Sequence: Synthetic oligonucleotide
  Target: SCN10A; (-) strand; PAM type: YTN; PAM sequence: TTT
ggaggtgcatcaactatacc

SEQ ID NO: 43514 - DNA, 20 bp, Artificial Sequence
  Description of Artificial Sequence: Synthetic oligonucleotide
  Target: SCN10A; (-) strand; PAM type: YTN; PAM sequence: TTT
tggaggtgcatcaactatac

SEQ ID NO: 43515 - DNA, 20 bp, Artificial Sequence
  Description of Artificial Sequence: Synthetic oligonucleotide
  Target: SCN10A; (-) strand; PAM type: YTN; PAM sequence: TTC
gcagggaagttttggaggtg

SEQ ID NO: 43516 - DNA, 20 bp, Artificial Sequence
  Description of Artificial Sequence: Synthetic oligonucleotide
  Target: SCN10A; (-) strand; PAM type: YTN; PAM sequence: CTT
cgcagggaagttttggaggt

SEQ ID NO: 43517 - DNA, 20 bp, Artificial Sequence
  Description of Artificial Sequence: Synthetic oligonucleotide
  Target: SCN10A; (-) strand; PAM type: YTN; PAM sequence: CTC
ttcgcagggaagttttggag

SEQ ID NO: 43518 - DNA, 20 bp, Artificial Sequence
  Description of Artificial Sequence: Synthetic oligonucleotide
  Target: SCN10A; (-) strand; PAM type: YTN; PAM sequence: TTC
agcatcatgggtgtgaacct

SEQ ID NO: 43519 - DNA, 20 bp, Artificial Sequence
  Description of Artificial Sequence: Synthetic oligonucleotide
  Target: SCN10A; (-) strand; PAM type: YTN; PAM sequence: CTT
cagcatcatgggtgtgaacc

SEQ ID NO: 43520 - DNA, 20 bp, Artificial Sequence
  Description of Artificial Sequence: Synthetic oligonucleotide
  Target: SCN10A; (-) strand; PAM type: YTN; PAM sequence: CTC
atcttcagcatcatgggtgt

SEQ ID NO: 43521 - DNA, 20 bp, Artificial Sequence
  Description of Artificial Sequence: Synthetic oligonucleotide
  Target: SCN10A; (-) strand; PAM type: YTN; PAM sequence: CTG
gctcatcttcagcatcatgg

SEQ ID NO: 43522 - DNA, 20 bp, Artificial Sequence
  Description of Artificial Sequence: Synthetic oligonucleotide
  Target: SCN10A; (-) strand; PAM type: YTN; PAM sequence: TTC
tggctcatcttcagcatcat

SEQ ID NO: 43523 - DNA, 20 bp, Artificial Sequence
  Description of Artificial Sequence: Synthetic oligonucleotide
  Target: SCN10A; (-) strand; PAM type: YTN; PAM sequence: CTT
ctggctcatcttcagcatca

SEQ ID NO: 43524 - DNA, 20 bp, Artificial Sequence
  Description of Artificial Sequence: Synthetic oligonucleotide
  Target: SCN10A; (-) strand; PAM type: YTN; PAM sequence: CTC
atcttctggctcatcttcag

SEQ ID NO: 43525 - DNA, 20 bp, Artificial Sequence
  Description of Artificial Sequence: Synthetic oligonucleotide
  Target: SCN10A; (-) strand; PAM type: YTN; PAM sequence: CTG
cctcatcttctggctcatct

SEQ ID NO: 43526 - DNA, 20 bp, Artificial Sequence
  Description of Artificial Sequence: Synthetic oligonucleotide
  Target: SCN10A; (-) strand; PAM type: YTN; PAM sequence: CTC
gtctgcctcatcttctggct

SEQ ID NO: 43527 - DNA, 20 bp, Artificial Sequence
  Description of Artificial Sequence: Synthetic oligonucleotide
  Target: SCN10A; (-) strand; PAM type: YTN; PAM sequence: CTC
ctcgtctgcctcatcttctg

SEQ ID NO: 43528 - DNA, 20 bp, Artificial Sequence
  Description of Artificial Sequence: Synthetic oligonucleotide
  Target: SCN10A; (-) strand; PAM type: YTN; PAM sequence: CTG
gtgggcgccatcccatccat

SEQ ID NO: 43529 - DNA, 20 bp, Artificial Sequence
  Description of Artificial Sequence: Synthetic oligonucleotide
  Target: SCN10A; (-) strand; PAM type: YTN; PAM sequence: CTC
ccaccaggtggtggtggatg

SEQ ID NO: 43530 - DNA, 20 bp, Artificial Sequence
  Description of Artificial Sequence: Synthetic oligonucleotide
  Target: SCN10A; (-) strand; PAM type: YTN; PAM sequence: CTA
tctcccaccaggtggtggtg

SEQ ID NO: 43531 - DNA, 20 bp, Artificial Sequence
  Description of Artificial Sequence: Synthetic oligonucleotide
  Target: SCN10A; (-) strand; PAM type: YTN; PAM sequence: CTC
tatctcccaccaggtggtgg

SEQ ID NO: 43532 - DNA, 20 bp, Artificial Sequence
  Description of Artificial Sequence: Synthetic oligonucleotide
  Target: SCN10A; (-) strand; PAM type: YTN; PAM sequence: TTC
tctatctcccaccaggtggt

SEQ ID NO: 43533 - DNA, 20 bp, Artificial Sequence
  Description of Artificial Sequence: Synthetic oligonucleotide
  Target: SCN10A; (-) strand; PAM type: YTN; PAM sequence: TTT
ctctatctcccaccaggtgg

SEQ ID NO: 43534 - DNA, 20 bp, Artificial Sequence
  Description of Artificial Sequence: Synthetic oligonucleotide
  Target: SCN10A; (-) strand; PAM type: YTN; PAM sequence: CTT
tctctatctcccaccaggtg

SEQ ID NO: 43535 - DNA, 20 bp, Artificial Sequence
  Description of Artificial Sequence: Synthetic oligonucleotide
  Target: SCN10A; (-) strand; PAM type: YTN; PAM sequence: TTC
caggtctttctctatctccc

SEQ ID NO: 43536 - DNA, 20 bp, Artificial Sequence
  Description of Artificial Sequence: Synthetic oligonucleotide
  Target: SCN10A; (-) strand; PAM type: YTN; PAM sequence: TTG
ggaggttccaggtctttctc

SEQ ID NO: 43537 - DNA, 20 bp, Artificial Sequence
  Description of Artificial Sequence: Synthetic oligonucleotide
  Target: SCN10A; (-) strand; PAM type: YTN; PAM sequence: CTG
aatgagtatagaaagagata

SEQ ID NO: 43538 - DNA, 20 bp, Artificial Sequence
  Description of Artificial Sequence: Synthetic oligonucleotide
  Target: SCN10A; (-) strand; PAM type: YTN; PAM sequence: CTC
atgaagcagcctgaatgagt

SEQ ID NO: 43539 - DNA, 20 bp, Artificial Sequence
  Description of Artificial Sequence: Synthetic oligonucleotide
  Target: SCN10A; (-) strand; PAM type: YTN; PAM sequence: CTG
gctcatgaagcagcctgaat

SEQ ID NO: 43540 - DNA, 20 bp, Artificial Sequence
  Description of Artificial Sequence: Synthetic oligonucleotide
  Target: SCN10A; (-) strand; PAM type: YTN; PAM sequence: TTC
caaaggccactggctcatga

SEQ ID NO: 43541 - DNA, 20 bp, Artificial Sequence
  Description of Artificial Sequence: Synthetic oligonucleotide
  Target: SCN10A; (-) strand; PAM type: YTN; PAM sequence: CTT
ccaaaggccactggctcatg

SEQ ID NO: 43542 - DNA, 20 bp, Artificial Sequence
  Description of Artificial Sequence: Synthetic oligonucleotide
  Target: SCN10A; (-) strand; PAM type: YTN; PAM sequence: TTC
ttccaaaggccactggctca

SEQ ID NO: 43543 - DNA, 20 bp, Artificial Sequence
  Description of Artificial Sequence: Synthetic oligonucleotide
  Target: SCN10A; (-) strand; PAM type: YTN; PAM sequence: CTT
cttccaaaggccactggctc

SEQ ID NO: 43544 - DNA, 20 bp, Artificial Sequence
  Description of Artificial Sequence: Synthetic oligonucleotide
  Target: SCN10A; (-) strand; PAM type: YTN; PAM sequence: TTG
cttcttccaaaggccactgg

SEQ ID NO: 43545 - DNA, 20 bp, Artificial Sequence
  Description of Artificial Sequence: Synthetic oligonucleotide
  Target: SCN10A; (-) strand; PAM type: YTN; PAM sequence: CTT
gcttcttccaaaggccactg

SEQ ID NO: 43546 - DNA, 20 bp, Artificial Sequence
  Description of Artificial Sequence: Synthetic oligonucleotide
  Target: SCN10A; (-) strand; PAM type: YTN; PAM sequence: CTC
ttgcttcttccaaaggccac

SEQ ID NO: 43547 - DNA, 20 bp, Artificial Sequence
  Description of Artificial Sequence: Synthetic oligonucleotide
  Target: SCN10A; (-) strand; PAM type: YTN; PAM sequence: TTC
tcttgcttcttccaaaggcc

SEQ ID NO: 43548 - DNA, 20 bp, Artificial Sequence
  Description of Artificial Sequence: Synthetic oligonucleotide
  Target: SCN10A; (-) strand; PAM type: YTN; PAM sequence: CTT
ctcttgcttcttccaaaggc

SEQ ID NO: 43549 - DNA, 20 bp, Artificial Sequence
  Description of Artificial Sequence: Synthetic oligonucleotide
  Target: SCN10A; (-) strand; PAM type: YTN; PAM sequence: TTA
acccacttctcttgcttctt

SEQ ID NO: 43550 - DNA, 20 bp, Artificial Sequence
  Description of Artificial Sequence: Synthetic oligonucleotide
  Target: SCN10A; (-) strand; PAM type: YTN; PAM sequence: CTA
attaacccacttctcttgct

SEQ ID NO: 43551 - DNA, 20 bp, Artificial Sequence
  Description of Artificial Sequence: Synthetic oligonucleotide
  Target: SCN10A; (-) strand; PAM type: YTN; PAM sequence: TTG
cactaattaacccacttctc

SEQ ID NO: 43552 - DNA, 20 bp, Artificial Sequence
  Description of Artificial Sequence: Synthetic oligonucleotide
  Target: SCN10A; (-) strand; PAM type: YTN; PAM sequence: TTA
ttgcactaattaacccactt

SEQ ID NO: 43553 - DNA, 20 bp, Artificial Sequence
  Description of Artificial Sequence: Synthetic oligonucleotide
  Target: SCN10A; (-) strand; PAM type: YTN; PAM sequence: CTG
aattattgcactaattaacc

SEQ ID NO: 43554 - DNA, 20 bp, Artificial Sequence
  Description of Artificial Sequence: Synthetic oligonucleotide
  Target: SCN10A; (-) strand; PAM type: YTN; PAM sequence: CTG
agtctgaattattgcactaa

SEQ ID NO: 43555 - DNA, 20 bp, Artificial Sequence
  Description of Artificial Sequence: Synthetic oligonucleotide
  Target: SCN10A; (-) strand; PAM type: YTN; PAM sequence: TTC
tgagtctgaattattgcact

SEQ ID NO: 43556 - DNA, 20 bp, Artificial Sequence
  Description of Artificial Sequence: Synthetic oligonucleotide
  Target: SCN10A; (-) strand; PAM type: YTN; PAM sequence: CTT
ctgagtctgaattattgcac

SEQ ID NO: 43557 - DNA, 20 bp, Artificial Sequence
  Description of Artificial Sequence: Synthetic oligonucleotide
  Target: SCN10A; (-) strand; PAM type: YTN; PAM sequence: CTC
agtcttctgagtctgaatta

SEQ ID NO: 43558 - DNA, 20 bp, Artificial Sequence
  Description of Artificial Sequence: Synthetic oligonucleotide
  Target: SCN10A; (-) strand; PAM type: YTN; PAM sequence: CTC
tcagtcttctgagtctgaat

SEQ ID NO: 43559 - DNA, 20 bp, Artificial Sequence
  Description of Artificial Sequence: Synthetic oligonucleotide
  Target: SCN10A; (-) strand; PAM type: YTN; PAM sequence: CTG
cccaatgtctctcagtcttc

SEQ ID NO: 43560 - DNA, 20 bp, Artificial Sequence
  Description of Artificial Sequence: Synthetic oligonucleotide
  Target: SCN10A; (-) strand; PAM type: YTN; PAM sequence: TTC
agctgcccaatgtctctcag

SEQ ID NO: 43561 - DNA, 20 bp, Artificial Sequence
  Description of Artificial Sequence: Synthetic oligonucleotide
  Target: SCN10A; (-) strand; PAM type: YTN; PAM sequence: CTT
cagctgcccaatgtctctca

SEQ ID NO: 43562 - DNA, 20 bp, Artificial Sequence
  Description of Artificial Sequence: Synthetic oligonucleotide
  Target: SCN10A; (-) strand; PAM type: YTN; PAM sequence: CTA
aatccatcttcagctgccca

SEQ ID NO: 43563 - DNA, 20 bp, Artificial Sequence
  Description of Artificial Sequence: Synthetic oligonucleotide
  Target: SCN10A; (-) strand; PAM type: YTN; PAM sequence: TTA
agggaagaaggtctaaatcc

SEQ ID NO: 43564 - DNA, 20 bp, Artificial Sequence
  Description of Artificial Sequence: Synthetic oligonucleotide
  Target: SCN10A; (-) strand; PAM type: YTN; PAM sequence: CTG
aatgaggttaagggaagaag

SEQ ID NO: 43565 - DNA, 20 bp, Artificial Sequence
  Description of Artificial Sequence: Synthetic oligonucleotide
  Target: SCN10A; (-) strand; PAM type: YTN; PAM sequence: CTG
caacccaccctgaatgaggt

SEQ ID NO: 43566 - DNA, 20 bp, Artificial Sequence
  Description of Artificial Sequence: Synthetic oligonucleotide
  Target: SCN10A; (-) strand; PAM type: YTN; PAM sequence: CTC
actgcaacccaccctgaatg

SEQ ID NO: 43567 - DNA, 20 bp, Artificial Sequence
  Description of Artificial Sequence: Synthetic oligonucleotide
  Target: SCN10A; (-) strand; PAM type: YTN; PAM sequence: TTC
tcactgcaacccaccctgaa

SEQ ID NO: 43568 - DNA, 20 bp, Artificial Sequence
  Description of Artificial Sequence: Synthetic oligonucleotide
  Target: SCN10A; (-) strand; PAM type: YTN; PAM sequence: CTT
ctcactgcaacccaccctga

SEQ ID NO: 43569 - DNA, 20 bp, Artificial Sequence
  Description of Artificial Sequence: Synthetic oligonucleotide
  Target: SCN10A; (-) strand; PAM type: YTN; PAM sequence: CTC
atccatcttctcactgcaac

SEQ ID NO: 43570 - DNA, 20 bp, Artificial Sequence
  Description of Artificial Sequence: Synthetic oligonucleotide
  Target: SCN10A; (-) strand; PAM type: YTN; PAM sequence: TTG
taaactcatccatcttctca

SEQ ID NO: 43571 - DNA, 20 bp, Artificial Sequence
  Description of Artificial Sequence: Synthetic oligonucleotide
  Target: SCN10A; (-) strand; PAM type: YTN; PAM sequence: CTT
gtaaactcatccatcttctc

SEQ ID NO: 43572 - DNA, 20 bp, Artificial Sequence
  Description of Artificial Sequence: Synthetic oligonucleotide
  Target: SCN10A; (-) strand; PAM type: YTN; PAM sequence: CTA
aatgagtgcagtatgcttgt

SEQ ID NO: 43573 - DNA, 20 bp, Artificial Sequence
  Description of Artificial Sequence: Synthetic oligonucleotide
  Target: SCN10A; (-) strand; PAM type: YTN; PAM sequence: TTC
taaatgagtgcagtatgctt

SEQ ID NO: 43574 - DNA, 20 bp, Artificial Sequence
  Description of Artificial Sequence: Synthetic oligonucleotide
  Target: SCN10A; (-) strand; PAM type: YTN; PAM sequence: CTT
ctaaatgagtgcagtatgct

SEQ ID NO: 43575 - DNA, 20 bp, Artificial Sequence
  Description of Artificial Sequence: Synthetic oligonucleotide
  Target: SCN10A; (-) strand; PAM type: YTN; PAM sequence: CTC
acacttctaaatgagtgcag

SEQ ID NO: 43576 - DNA, 20 bp, Artificial Sequence
  Description of Artificial Sequence: Synthetic oligonucleotide
  Target: SCN10A; (-) strand; PAM type: YTN; PAM sequence: CTG
tatgtgcaagtataatacac

SEQ ID NO: 43577 - DNA, 20 bp, Artificial Sequence
  Description of Artificial Sequence: Synthetic oligonucleotide
  Target: SCN10A; (-) strand; PAM type: YTN; PAM sequence: CTA
gaagtctgtatgtgcaagta

SEQ ID NO: 43578 - DNA, 20 bp, Artificial Sequence
  Description of Artificial Sequence: Synthetic oligonucleotide
  Target: SCN10A; (-) strand; PAM type: YTN; PAM sequence: TTC
tagaagtctgtatgtgcaag

SEQ ID NO: 43579 - DNA, 20 bp, Artificial Sequence
  Description of Artificial Sequence: Synthetic oligonucleotide
  Target: SCN10A; (-) strand; PAM type: YTN; PAM sequence: TTA
aggagaataagtcaaggttc

SEQ ID NO: 43580 - DNA, 20 bp, Artificial Sequence
  Description of Artificial Sequence: Synthetic oligonucleotide
  Target: SCN10A; (-) strand; PAM type: YTN; PAM sequence: TTT
aaggagaataagtcaaggtt

SEQ ID NO: 43581 - DNA, 20 bp, Artificial Sequence
  Description of Artificial Sequence: Synthetic oligonucleotide
  Target: SCN10A; (-) strand; PAM type: YTN; PAM sequence: TTA
tgtatggtatttaaggagaa

SEQ ID NO: 43582 - DNA, 20 bp, Artificial Sequence
  Description of Artificial Sequence: Synthetic oligonucleotide
  Target: SCN10A; (-) strand; PAM type: YTN; PAM sequence: TTT
atgtatggtatttaaggaga

SEQ ID NO: 43583 - DNA, 20 bp, Artificial Sequence
  Description of Artificial Sequence: Synthetic oligonucleotide
  Target: SCN10A; (-) strand; PAM type: YTN; PAM sequence: TTT
tatgtatggtatttaaggag

SEQ ID NO: 43584 - DNA, 20 bp, Artificial Sequence
  Description of Artificial Sequence: Synthetic oligonucleotide
  Target: SCN10A; (-) strand; PAM type: YTN; PAM sequence: TTG
tgttttatgtatggtattta

SEQ ID NO: 43585 - DNA, 20 bp, Artificial Sequence
  Description of Artificial Sequence: Synthetic oligonucleotide
  Target: SCN10A; (-) strand; PAM type: YTN; PAM sequence: TTT
gtgttttatgtatggtattt

SEQ ID NO: 43586 - DNA, 20 bp, Artificial Sequence
  Description of Artificial Sequence: Synthetic oligonucleotide
  Target: SCN10A; (-) strand; PAM type: YTN; PAM sequence: TTG
tgtttgtgttttatgtatgg

SEQ ID NO: 43587 - DNA, 20 bp, Artificial Sequence
  Description of Artificial Sequence: Synthetic oligonucleotide
  Target: SCN10A; (-) strand; PAM type: YTN; PAM sequence: TTA
aattgtgtttgtgttttatg

SEQ ID NO: 43588 - DNA, 20 bp, Artificial Sequence
  Description of Artificial Sequence: Synthetic oligonucleotide
  Target: SCN10A; (-) strand; PAM type: YTN; PAM sequence: TTT
aaattgtgtttgtgttttat

SEQ ID NO: 43589 - DNA, 20 bp, Artificial Sequence
  Description of Artificial Sequence: Synthetic oligonucleotide
  Target: SCN10A; (-) strand; PAM type: YTN; PAM sequence: TTG
tatttaaattgtgtttgtgt

SEQ ID NO: 43590 - DNA, 20 bp, Artificial Sequence
  Description of Artificial Sequence: Synthetic oligonucleotide
  Target: SCN10A; (-) strand; PAM type: YTN; PAM sequence: TTA
aattgtatttaaattgtgtt

SEQ ID NO: 43591 - DNA, 20 bp, Artificial Sequence
  Description of Artificial Sequence: Synthetic oligonucleotide
  Target: SCN10A; (-) strand; PAM type: YTN; PAM sequence: TTT
aaattgtatttaaattgtgt

SEQ ID NO: 43592 - DNA, 20 bp, Artificial Sequence
  Description of Artificial Sequence: Synthetic oligonucleotide
  Target: SCN10A; (-) strand; PAM type: YTN; PAM sequence: CTT
taaattgtatttaaattgtg

SEQ ID NO: 43593 - DNA, 20 bp, Artificial Sequence
  Description of Artificial Sequence: Synthetic oligonucleotide
  Target: SCN10A; (-) strand; PAM type: YTN; PAM sequence: TTG
accacggcatactttaaatt

SEQ ID NO: 43594 - DNA, 20 bp, Artificial Sequence
  Description of Artificial Sequence: Synthetic oligonucleotide
  Target: SCN10A; (-) strand; PAM type: YTN; PAM sequence: CTT
gaccacggcatactttaaat

SEQ ID NO: 43595 - DNA, 20 bp, Artificial Sequence
  Description of Artificial Sequence: Synthetic oligonucleotide
  Target: SCN10A; (-) strand; PAM type: YTN; PAM sequence: TTC
ttgaccacggcatactttaa

SEQ ID NO: 43596 - DNA, 20 bp, Artificial Sequence
  Description of Artificial Sequence: Synthetic oligonucleotide
  Target: SCN10A; (-) strand; PAM type: YTN; PAM sequence: CTG
gttcttgaccacggcatact

SEQ ID NO: 43597 - DNA, 20 bp, Artificial Sequence
  Description of Artificial Sequence: Synthetic oligonucleotide
  Target: SCN10A; (-) strand; PAM type: YTN; PAM sequence: TTC
actggttcttgaccacggca

SEQ ID NO: 43598 - DNA, 20 bp, Artificial Sequence
  Description of Artificial Sequence: Synthetic oligonucleotide
  Target: SCN10A; (-) strand; PAM type: YTN; PAM sequence: TTT
cactggttcttgaccacggc

SEQ ID NO: 43599 - DNA, 20 bp, Artificial Sequence
  Description of Artificial Sequence: Synthetic oligonucleotide
  Target: SCN10A; (-) strand; PAM type: YTN; PAM sequence: TTT
tcactggttcttgaccacgg

SEQ ID NO: 43600 - DNA, 20 bp, Artificial Sequence
  Description of Artificial Sequence: Synthetic oligonucleotide
  Target: SCN10A; (-) strand; PAM type: YTN; PAM sequence: TTA
ggttttcactggttcttgac

SEQ ID NO: 43601 - DNA, 20 bp, Artificial Sequence
  Description of Artificial Sequence: Synthetic oligonucleotide
  Target: SCN10A; (-) strand; PAM type: YTN; PAM sequence: TTT
aggttttcactggttcttga

SEQ ID NO: 43602 - DNA, 20 bp, Artificial Sequence
  Description of Artificial Sequence: Synthetic oligonucleotide
  Target: SCN10A; (-) strand; PAM type: YTN; PAM sequence: TTG
tgaatatggatttaggtttt

SEQ ID NO: 43603 - DNA, 20 bp, Artificial Sequence
  Description of Artificial Sequence: Synthetic oligonucleotide
  Target: SCN10A; (-) strand; PAM type: YTN; PAM sequence: TTT
gtgaatatggatttaggttt

SEQ ID NO: 43604 - DNA, 20 bp, Artificial Sequence
  Description of Artificial Sequence: Synthetic oligonucleotide
  Target: SCN10A; (-) strand; PAM type: YTN; PAM sequence: TTT
tgtgaatatggatttaggtt

SEQ ID NO: 43605 - DNA, 20 bp, Artificial Sequence
  Description of Artificial Sequence: Synthetic oligonucleotide
  Target: SCN10A; (-) strand; PAM type: YTN; PAM sequence: CTA
ttttgtgaatatggatttag

SEQ ID NO: 43606 - DNA, 20 bp, Artificial Sequence
  Description of Artificial Sequence: Synthetic oligonucleotide
  Target: SCN10A; (-) strand; PAM type: YTN; PAM sequence: TTA
caaataagctattttgtgaa

SEQ ID NO: 43607 - DNA, 20 bp, Artificial Sequence
  Description of Artificial Sequence: Synthetic oligonucleotide
  Target: SCN10A; (-) strand; PAM type: YTN; PAM sequence: TTT
acaaataagctattttgtga

SEQ ID NO: 43608 - DNA, 20 bp, Artificial Sequence
  Description of Artificial Sequence: Synthetic oligonucleotide
  Target: SCN10A; (-) strand; PAM type: YTN; PAM sequence: TTA
tttacaaataagctattttg

SEQ ID NO: 43609 - DNA, 20 bp, Artificial Sequence
  Description of Artificial Sequence: Synthetic oligonucleotide
  Target: SCN10A; (-) strand; PAM type: YTN; PAM sequence: CTT
atttacaaataagctatttt

SEQ ID NO: 43610 - DNA, 20 bp, Artificial Sequence
  Description of Artificial Sequence: Synthetic oligonucleotide
  Target: SCN10A; (-) strand; PAM type: YTN; PAM sequence: TTG
cttatttacaaataagctat

SEQ ID NO: 43611 - DNA, 20 bp, Artificial Sequence
  Description of Artificial Sequence: Synthetic oligonucleotide
  Target: SCN10A; (-) strand; PAM type: YTN; PAM sequence: TTT
gcttatttacaaataagcta

SEQ ID NO: 43612 - DNA, 20 bp, Artificial Sequence
  Description of Artificial Sequence: Synthetic oligonucleotide
  Target: SCN10A; (-) strand; PAM type: YTN; PAM sequence: CTC
atttgcttatttacaaataa

SEQ ID NO: 43613 - DNA, 20 bp, Artificial Sequence
  Description of Artificial Sequence: Synthetic oligonucleotide
  Target: SCN10A; (-) strand; PAM type: YTN; PAM sequence: TTC
tcatttgcttatttacaaat

SEQ ID NO: 43614 - DNA, 20 bp, Artificial Sequence
  Description of Artificial Sequence: Synthetic oligonucleotide
  Target: SCN10A; (-) strand; PAM type: YTN; PAM sequence: CTA
atagattctcatttgcttat

SEQ ID NO: 43615 - DNA, 20 bp, Artificial Sequence
  Description of Artificial Sequence: Synthetic oligonucleotide
  Target: SCN10A; (-) strand; PAM type: YTN; PAM sequence: TTG
tatctaatagattctcattt

SEQ ID NO: 43616 - DNA, 20 bp, Artificial Sequence
  Description of Artificial Sequence: Synthetic oligonucleotide
  Target: SCN10A; (-) strand; PAM type: YTN; PAM sequence: TTT
gtatctaatagattctcatt

SEQ ID NO: 43617 - DNA, 20 bp, Artificial Sequence
  Description of Artificial Sequence: Synthetic oligonucleotide
  Target: SCN10A; (-) strand; PAM type: YTN; PAM sequence: TTT
tgtatctaatagattctcat

SEQ ID NO: 43618 - DNA, 20 bp, Artificial Sequence
  Description of Artificial Sequence: Synthetic oligonucleotide
  Target: SCN10A; (-) strand; PAM type: YTN; PAM sequence: CTA
ttttgtatctaatagattct

SEQ ID NO: 43619 - DNA, 20 bp, Artificial Sequence
  Description of Artificial Sequence: Synthetic oligonucleotide
  Target: SCN10A; (-) strand; PAM type: YTN; PAM sequence: TTC
tattttgtatctaatagatt

SEQ ID NO: 43620 - DNA, 20 bp, Artificial Sequence
  Description of Artificial Sequence: Synthetic oligonucleotide
  Target: SCN10A; (-) strand; PAM type: YTN; PAM sequence: TTA
ttctattttgtatctaatag

SEQ ID NO: 43621 - DNA, 20 bp, Artificial Sequence
  Description of Artificial Sequence: Synthetic oligonucleotide
  Target: SCN10A; (-) strand; PAM type: YTN; PAM sequence: TTT
attctattttgtatctaata

SEQ ID NO: 43622 - DNA, 20 bp, Artificial Sequence
  Description of Artificial Sequence: Synthetic oligonucleotide
  Target: SCN10A; (-) strand; PAM type: YTN; PAM sequence: TTG
aaatttattctattttgtat

SEQ ID NO: 43623 - DNA, 20 bp, Artificial Sequence
  Description of Artificial Sequence: Synthetic oligonucleotide
  Target: SCN10A; (-) strand; PAM type: YTN; PAM sequence: TTT
gaaatttattctattttgta

SEQ ID NO: 43624 - DNA, 20 bp, Artificial Sequence
  Description of Artificial Sequence: Synthetic oligonucleotide
  Target: SCN10A; (-) strand; PAM type: YTN; PAM sequence: TTG
aaatagtttgaaatttattc

SEQ ID NO: 43625 - DNA, 20 bp, Artificial Sequence
  Description of Artificial Sequence: Synthetic oligonucleotide
  Target: SCN10A; (-) strand; PAM type: YTN; PAM sequence: CTA
ggacccgaagattgaaatag

SEQ ID NO: 43626 - DNA, 20 bp, Artificial Sequence
  Description of Artificial Sequence: Synthetic oligonucleotide
  Target: SCN10A; (-) strand; PAM type: YTN; PAM sequence: TTA
caaacactaggacccgaaga

SEQ ID NO: 43627 - DNA, 20 bp, Artificial Sequence
  Description of Artificial Sequence: Synthetic oligonucleotide
  Target: SCN10A; (-) strand; PAM type: YTN; PAM sequence: TTT
acaaacactaggacccgaag

SEQ ID NO: 43628 - DNA, 20 bp, Artificial Sequence
  Description of Artificial Sequence: Synthetic oligonucleotide
  Target: SCN10A; (-) strand; PAM type: YTN; PAM sequence: CTT
tacaaacactaggacccgaa

SEQ ID NO: 43629 - DNA, 20 bp, Artificial Sequence
  Description of Artificial Sequence: Synthetic oligonucleotide
  Target: SCN10A; (-) strand; PAM type: YTN; PAM sequence: TTG
tacctttacaaacactagga

SEQ ID NO: 43630 - DNA, 20 bp, Artificial Sequence
  Description of Artificial Sequence: Synthetic oligonucleotide
  Target: SCN10A; (-) strand; PAM type: YTN; PAM sequence: CTT
gtacctttacaaacactagg

SEQ ID NO: 43631 - DNA, 20 bp, Artificial Sequence
  Description of Artificial Sequence: Synthetic oligonucleotide
  Target: SCN10A; (-) strand; PAM type: YTN; PAM sequence: TTA
acttgtacctttacaaacac

SEQ ID NO: 43632 - DNA, 20 bp, Artificial Sequence
  Description of Artificial Sequence: Synthetic oligonucleotide
  Target: SCN10A; (-) strand; PAM type: YTN; PAM sequence: TTG
aaattaacttgtacctttac

SEQ ID NO: 43633 - DNA, 20 bp, Artificial Sequence
  Description of Artificial Sequence: Synthetic oligonucleotide
  Target: SCN10A; (-) strand; PAM type: YTN; PAM sequence: TTT
gaaattaacttgtaccttta

SEQ ID NO: 43634 - DNA, 20 bp, Artificial Sequence
  Description of Artificial Sequence: Synthetic oligonucleotide
  Target: SCN10A; (-) strand; PAM type: YTN; PAM sequence: TTT
tgaaattaacttgtaccttt

SEQ ID NO: 43635 - DNA, 20 bp, Artificial Sequence
  Description of Artificial Sequence: Synthetic oligonucleotide
  Target: SCN10A; (-) strand; PAM type: YTN; PAM sequence: CTT
ttgaaattaacttgtacctt

SEQ ID NO: 43636 - DNA, 20 bp, Artificial Sequence
  Description of Artificial Sequence: Synthetic oligonucleotide
  Target: SCN10A; (-) strand; PAM type: YTN; PAM sequence: TTC
aaaaacaaaagtgggctttt

SEQ ID NO: 43637 - DNA, 20 bp, Artificial Sequence
  Description of Artificial Sequence: Synthetic oligonucleotide
  Target: SCN10A; (-) strand; PAM type: YTN; PAM sequence: CTT
caaaaacaaaagtgggcttt

SEQ ID NO: 43638 - DNA, 20 bp, Artificial Sequence
  Description of Artificial Sequence: Synthetic oligonucleotide
  Target: SCN10A; (-) strand; PAM type: YTN; PAM sequence: CTG
gaagtagtcatcatagcttc

SEQ ID NO: 43639 - DNA, 20 bp, Artificial Sequence
  Description of Artificial Sequence: Synthetic oligonucleotide
  Target: SCN10A; (-) strand; PAM type: YTN; PAM sequence: TTG
gctggaagtagtcatcatag

SEQ ID NO: 43640 - DNA, 20 bp, Artificial Sequence
  Description of Artificial Sequence: Synthetic oligonucleotide
  Target: SCN10A; (-) strand; PAM type: YTN; PAM sequence: CTA
tcattggctggaagtagtca

SEQ ID NO: 43641 - DNA, 20 bp, Artificial Sequence
  Description of Artificial Sequence: Synthetic oligonucleotide
  Target: SCN10A; (-) strand; PAM type: YTN; PAM sequence: CTC
cactatcattggctggaagt

SEQ ID NO: 43642 - DNA, 20 bp, Artificial Sequence
  Description of Artificial Sequence: Synthetic oligonucleotide
  Target: SCN10A; (-) strand; PAM type: YTN; PAM sequence: TTG
ctccactatcattggctgga

SEQ ID NO: 43643 - DNA, 20 bp, Artificial Sequence
  Description of Artificial Sequence: Synthetic oligonucleotide
  Target: SCN10A; (-) strand; PAM type: YTN; PAM sequence: TTT
gctccactatcattggctgg

SEQ ID NO: 43644 - DNA, 20 bp, Artificial Sequence
  Description of Artificial Sequence: Synthetic oligonucleotide
  Target: SCN10A; (-) strand; PAM type: YTN; PAM sequence: CTT
tgctccactatcattggctg

SEQ ID NO: 43645 - DNA, 20 bp, Artificial Sequence
  Description of Artificial Sequence: Synthetic oligonucleotide
  Target: SCN10A; (-) strand; PAM type: YTN; PAM sequence: TTG
ctttgctccactatcattgg

SEQ ID NO: 43646 - DNA, 20 bp, Artificial Sequence
  Description of Artificial Sequence: Synthetic oligonucleotide
  Target: SCN10A; (-) strand; PAM type: YTN; PAM sequence: TTT
gctttgctccactatcattg

SEQ ID NO: 43647 - DNA, 20 bp, Artificial Sequence
  Description of Artificial Sequence: Synthetic oligonucleotide
  Target: SCN10A; (-) strand; PAM type: YTN; PAM sequence: TTT
tgctttgctccactatcatt

SEQ ID NO: 43648 - DNA, 20 bp, Artificial Sequence
  Description of Artificial Sequence: Synthetic oligonucleotide
  Target: SCN10A; (-) strand; PAM type: YTN; PAM sequence: CTC
cccagcagaaagtaaggttt

SEQ ID NO: 43649 - DNA, 20 bp, Artificial Sequence
  Description of Artificial Sequence: Synthetic oligonucleotide
  Target: SCN10A; (-) strand; PAM type: YTN; PAM sequence: TTA
caaatggctccccagcagaa

SEQ ID NO: 43650 - DNA, 20 bp, Artificial Sequence
  Description of Artificial Sequence: Synthetic oligonucleotide
  Target: SCN10A; (-) strand; PAM type: YTN; PAM sequence: CTC
ataattacaaatggctcccc

SEQ ID NO: 43651 - DNA, 20 bp, Artificial Sequence
  Description of Artificial Sequence: Synthetic oligonucleotide
  Target: SCN10A; (-) strand; PAM type: YTN; PAM sequence: TTC
ctcataattacaaatggctc

SEQ ID NO: 43652 - DNA, 20 bp, Artificial Sequence
  Description of Artificial Sequence: Synthetic oligonucleotide
  Target: SCN10A; (-) strand; PAM type: YTN; PAM sequence: CTT
cctcataattacaaatggct

SEQ ID NO: 43653 - DNA, 20 bp, Artificial Sequence
  Description of Artificial Sequence: Synthetic oligonucleotide
  Target: SCN10A; (-) strand; PAM type: YTN; PAM sequence: CTC
ttcctcataattacaaatgg

SEQ ID NO: 43654 - DNA, 20 bp, Artificial Sequence
  Description of Artificial Sequence: Synthetic oligonucleotide
  Target: SCN10A; (-) strand; PAM type: YTN; PAM sequence: TTG
acacccacctcttcctcata

SEQ ID NO: 43655 - DNA, 20 bp, Artificial Sequence
  Description of Artificial Sequence: Synthetic oligonucleotide
  Target: SCN10A; (-) strand; PAM type: YTN; PAM sequence: CTG
attgacacccacctcttcct

SEQ ID NO: 43656 - DNA, 20 bp, Artificial Sequence
  Description of Artificial Sequence: Synthetic oligonucleotide
  Target: SCN10A; (-) strand; PAM type: YTN; PAM sequence: TTG
ctgattgacacccacctctt

SEQ ID NO: 43657 - DNA, 20 bp, Artificial Sequence
  Description of Artificial Sequence: Synthetic oligonucleotide
  Target: SCN10A; (-) strand; PAM type: YTN; PAM sequence: TTA
gagattgctgattgacaccc

SEQ ID NO: 43658 - DNA, 20 bp, Artificial Sequence
  Description of Artificial Sequence: Synthetic oligonucleotide
  Target: SCN10A; (-) strand; PAM type: YTN; PAM sequence: CTT
agagattgctgattgacacc

SEQ ID NO: 43659 - DNA, 20 bp, Artificial Sequence
  Description of Artificial Sequence: Synthetic oligonucleotide
  Target: SCN10A; (-) strand; PAM type: YTN; PAM sequence: TTG
tcttagagattgctgattga

SEQ ID NO: 43660 - DNA, 20 bp, Artificial Sequence
  Description of Artificial Sequence: Synthetic oligonucleotide
  Target: SCN10A; (-) strand; PAM type: YTN; PAM sequence: CTT
gtcttagagattgctgattg

SEQ ID NO: 43661 - DNA, 20 bp, Artificial Sequence
  Description of Artificial Sequence: Synthetic oligonucleotide
  Target: SCN10A; (-) strand; PAM type: YTN; PAM sequence: CTC
acagccagagccttgtctta

SEQ ID NO: 43662 - DNA, 20 bp, Artificial Sequence
  Description of Artificial Sequence: Synthetic oligonucleotide
  Target: SCN10A; (-) strand; PAM type: YTN; PAM sequence: CTC
cgtcaggacagaatgctcac

SEQ ID NO: 43663 - DNA, 20 bp, Artificial Sequence
  Description of Artificial Sequence: Synthetic oligonucleotide
  Target: SCN10A; (-) strand; PAM type: YTN; PAM sequence: CTG
cctccgtcaggacagaatgc

SEQ ID NO: 43664 - DNA, 20 bp, Artificial Sequence
  Description of Artificial Sequence: Synthetic oligonucleotide
  Target: SCN10A; (-) strand; PAM type: YTN; PAM sequence: CTA
actgcctccgtcaggacaga

SEQ ID NO: 43665 - DNA, 20 bp, Artificial Sequence
  Description of Artificial Sequence: Synthetic oligonucleotide
  Target: SCN10A; (-) strand; PAM type: YTN; PAM sequence: TTG
ccctaactgcctccgtcagg

SEQ ID NO: 43666 - DNA, 20 bp, Artificial Sequence
  Description of Artificial Sequence: Synthetic oligonucleotide
  Target: SCN10A; (-) strand; PAM type: YTN; PAM sequence: CTT
gccctaactgcctccgtcag

SEQ ID NO: 43667 - DNA, 20 bp, Artificial Sequence
  Description of Artificial Sequence: Synthetic oligonucleotide
  Target: SCN10A; (-) strand; PAM type: YTN; PAM sequence: CTC
caccttgccctaactgcctc

SEQ ID NO: 43668 - DNA, 20 bp, Artificial Sequence
  Description of Artificial Sequence: Synthetic oligonucleotide
  Target: SCN10A; (-) strand; PAM type: YTN; PAM sequence: CTG
tcagcctccaccttgcccta

SEQ ID NO: 43669 - DNA, 20 bp, Artificial Sequence
  Description of Artificial Sequence: Synthetic oligonucleotide
  Target: SCN10A; (-) strand; PAM type: YTN; PAM sequence: TTA
tccaccactgtcagcctcca

SEQ ID NO: 43670 - DNA, 20 bp, Artificial Sequence
  Description of Artificial Sequence: Synthetic oligonucleotide
  Target: SCN10A; (-) strand; PAM type: YTN; PAM sequence: CTT
atccaccactgtcagcctcc

SEQ ID NO: 43671 - DNA, 20 bp, Artificial Sequence
  Description of Artificial Sequence: Synthetic oligonucleotide
  Target: SCN10A; (-) strand; PAM type: YTN; PAM sequence: TTC
cttatccaccactgtcagcc

SEQ ID NO: 43672 - DNA, 20 bp, Artificial Sequence
  Description of Artificial Sequence: Synthetic oligonucleotide
  Target: SCN10A; (-) strand; PAM type: YTN; PAM sequence: TTT
ccttatccaccactgtcagc

SEQ ID NO: 43673 - DNA, 20 bp, Artificial Sequence
  Description of Artificial Sequence: Synthetic oligonucleotide
  Target: SCN10A; (-) strand; PAM type: YTN; PAM sequence: CTT
tccttatccaccactgtcag

SEQ ID NO: 43674 - DNA, 20 bp, Artificial Sequence
  Description of Artificial Sequence: Synthetic oligonucleotide
  Target: SCN10A; (-) strand; PAM type: YTN; PAM sequence: TTC
catccacccctttccttatc

SEQ ID NO: 43675 - DNA, 20 bp, Artificial Sequence
  Description of Artificial Sequence: Synthetic oligonucleotide
  Target: SCN10A; (-) strand; PAM type: YTN; PAM sequence: CTT
ccatccacccctttccttat

SEQ ID NO: 43676 - DNA, 20 bp, Artificial Sequence
  Description of Artificial Sequence: Synthetic oligonucleotide
  Target: SCN10A; (-) strand; PAM type: YTN; PAM sequence: TTC
ccttccatccacccctttcc

SEQ ID NO: 43677 - DNA, 20 bp, Artificial Sequence
  Description of Artificial Sequence: Synthetic oligonucleotide
  Target: SCN10A; (-) strand; PAM type: YTN; PAM sequence: TTT
cccttccatccacccctttc

SEQ ID NO: 43678 - DNA, 20 bp, Artificial Sequence
  Description of Artificial Sequence: Synthetic oligonucleotide
  Target: SCN10A; (-) strand; PAM type: YTN; PAM sequence: TTT
tcccttccatccaccccttt

SEQ ID NO: 43679 - DNA, 20 bp, Artificial Sequence
  Description of Artificial Sequence: Synthetic oligonucleotide
  Target: SCN10A; (-) strand; PAM type: YTN; PAM sequence: TTT
ttcccttccatccacccctt

SEQ ID NO: 43680 - DNA, 20 bp, Artificial Sequence
  Description of Artificial Sequence: Synthetic oligonucleotide
  Target: SCN10A; (-) strand; PAM type: YTN; PAM sequence: CTG
taaatttttcccttccatcc

SEQ ID NO: 43681 - DNA, 20 bp, Artificial Sequence
  Description of Artificial Sequence: Synthetic oligonucleotide
  Target: SCN10A; (-) strand; PAM type: YTN; PAM sequence: TTA
atgcaatcatcaggtcctgt

SEQ ID NO: 43682 - DNA, 20 bp, Artificial Sequence
  Description of Artificial Sequence: Synthetic oligonucleotide
  Target: SCN10A; (-) strand; PAM type: YTN; PAM sequence: CTT
aatgcaatcatcaggtcctg

SEQ ID NO: 43683 - DNA, 20 bp, Artificial Sequence
  Description of Artificial Sequence: Synthetic oligonucleotide
  Target: SCN10A; (-) strand; PAM type: YTN; PAM sequence: CTA
cttaatgcaatcatcaggtc

SEQ ID NO: 43684 - DNA, 20 bp, Artificial Sequence
  Description of Artificial Sequence: Synthetic oligonucleotide
  Target: SCN10A; (-) strand; PAM type: YTN; PAM sequence: CTC
ctacttaatgcaatcatcag

SEQ ID NO: 43685 - DNA, 20 bp, Artificial Sequence
  Description of Artificial Sequence: Synthetic oligonucleotide
  Target: SCN10A; (-) strand; PAM type: YTN; PAM sequence: CTC
tcctacttaatgcaatcatc

SEQ ID NO: 43686 - DNA, 20 bp, Artificial Sequence
  Description of Artificial Sequence: Synthetic oligonucleotide
  Target: SCN10A; (-) strand; PAM type: YTN; PAM sequence: TTC
tctcctacttaatgcaatca

SEQ ID NO: 43687 - DNA, 20 bp, Artificial Sequence
  Description of Artificial Sequence: Synthetic oligonucleotide
  Target: SCN10A; (-) strand; PAM type: YTN; PAM sequence: CTT
ctctcctacttaatgcaatc

SEQ ID NO: 43688 - DNA, 20 bp, Artificial Sequence
  Description of Artificial Sequence: Synthetic oligonucleotide
  Target: SCN10A; (-) strand; PAM type: YTN; PAM sequence: TTC
ttctctcctacttaatgcaa

SEQ ID NO: 43689 - DNA, 20 bp, Artificial Sequence
  Description of Artificial Sequence: Synthetic oligonucleotide
  Target: SCN10A; (-) strand; PAM type: YTN; PAM sequence: CTT
cttctctcctacttaatgca

SEQ ID NO: 43690 - DNA, 20 bp, Artificial Sequence
  Description of Artificial Sequence: Synthetic oligonucleotide
  Target: SCN10A; (-) strand; PAM type: YTN; PAM sequence: CTG
gaatgcttcttctctcctac

SEQ ID NO: 43691 - DNA, 20 bp, Artificial Sequence
  Description of Artificial Sequence: Synthetic oligonucleotide
  Target: SCN10A; (-) strand; PAM type: YTN; PAM sequence: CTG
ccacccactggaatgcttct

SEQ ID NO: 43692 - DNA, 20 bp, Artificial Sequence
  Description of Artificial Sequence: Synthetic oligonucleotide
  Target: SCN10A; (-) strand; PAM type: YTN; PAM sequence: CTC
agctgccacccactggaatg

SEQ ID NO: 43693 - DNA, 20 bp, Artificial Sequence
  Description of Artificial Sequence: Synthetic oligonucleotide
  Target: SCN10A; (-) strand; PAM type: YTN; PAM sequence: TTA
cctcagctgccacccactgg

SEQ ID NO: 43694 - DNA, 20 bp, Artificial Sequence
  Description of Artificial Sequence: Synthetic oligonucleotide
  Target: SCN10A; (-) strand; PAM type: YTN; PAM sequence: CTC
attacctcagctgccaccca

SEQ ID NO: 43695 - DNA, 20 bp, Artificial Sequence
  Description of Artificial Sequence: Synthetic oligonucleotide
  Target: SCN10A; (-) strand; PAM type: YTN; PAM sequence: CTC
catgagtgacatcatcagct

SEQ ID NO: 43696 - DNA, 20 bp, Artificial Sequence
  Description of Artificial Sequence: Synthetic oligonucleotide
  Target: SCN10A; (-) strand; PAM type: YTN; PAM sequence: CTA
atactccatgagtgacatca

SEQ ID NO: 43697 - DNA, 20 bp, Artificial Sequence
  Description of Artificial Sequence: Synthetic oligonucleotide
  Target: SCN10A; (-) strand; PAM type: YTN; PAM sequence: CTC
taatactccatgagtgacat

SEQ ID NO: 43698 - DNA, 20 bp, Artificial Sequence
  Description of Artificial Sequence: Synthetic oligonucleotide
  Target: SCN10A; (-) strand; PAM type: YTN; PAM sequence: TTC
ctctaatactccatgagtga

SEQ ID NO: 43699 - DNA, 20 bp, Artificial Sequence
  Description of Artificial Sequence: Synthetic oligonucleotide
  Target: SCN10A; (-) strand; PAM type: YTN; PAM sequence: TTT
cctctaatactccatgagtg

SEQ ID NO: 43700 - DNA, 20 bp, Artificial Sequence
  Description of Artificial Sequence: Synthetic oligonucleotide
  Target: SCN10A; (-) strand; PAM type: YTN; PAM sequence: CTT
tcctctaatactccatgagt

SEQ ID NO: 43701 - DNA, 20 bp, Artificial Sequence
  Description of Artificial Sequence: Synthetic oligonucleotide
  Target: SCN10A; (-) strand; PAM type: YTN; PAM sequence: TTC
catgacaaatgagtctttcc

SEQ ID NO: 43702 - DNA, 20 bp, Artificial Sequence
  Description of Artificial Sequence: Synthetic oligonucleotide
  Target: SCN10A; (-) strand; PAM type: YTN; PAM sequence: TTT
ccatgacaaatgagtctttc

SEQ ID NO: 43703 - DNA, 20 bp, Artificial Sequence
  Description of Artificial Sequence: Synthetic oligonucleotide
  Target: SCN10A; (-) strand; PAM type: YTN; PAM sequence: CTT
tccatgacaaatgagtcttt

SEQ ID NO: 43704 - DNA, 20 bp, Artificial Sequence
  Description of Artificial Sequence: Synthetic oligonucleotide
  Target: SCN10A; (-) strand; PAM type: YTN; PAM sequence: CTG
tctttccatgacaaatgagt

SEQ ID NO: 43705 - DNA, 20 bp, Artificial Sequence
  Description of Artificial Sequence: Synthetic oligonucleotide
  Target: SCN10A; (-) strand; PAM type: YTN; PAM sequence: CTC
tgtctttccatgacaaatga

SEQ ID NO: 43706 - DNA, 20 bp, Artificial Sequence
  Description of Artificial Sequence: Synthetic oligonucleotide
  Target: SCN10A; (-) strand; PAM type: YTN; PAM sequence: TTC
tctgtctttccatgacaaat

SEQ ID NO: 43707 - DNA, 20 bp, Artificial Sequence
  Description of Artificial Sequence: Synthetic oligonucleotide
  Target: SCN10A; (-) strand; PAM type: YTN; PAM sequence: CTC
cagaacatcccaagttctct

SEQ ID NO: 43708 - DNA, 20 bp, Artificial Sequence
  Description of Artificial Sequence: Synthetic oligonucleotide
  Target: SCN10A; (-) strand; PAM type: YTN; PAM sequence: TTG
ccaacatctccagaacatcc

SEQ ID NO: 43709 - DNA, 20 bp, Artificial Sequence
  Description of Artificial Sequence: Synthetic oligonucleotide
  Target: SCN10A; (-) strand; PAM type: YTN; PAM sequence: TTA
ttgccaacatctccagaaca

SEQ ID NO: 43710 - DNA, 20 bp, Artificial Sequence
  Description of Artificial Sequence: Synthetic oligonucleotide
  Target: SCN10A; (-) strand; PAM type: YTN; PAM sequence: CTT
attgccaacatctccagaac

SEQ ID NO: 43711 - DNA, 20 bp, Artificial Sequence
  Description of Artificial Sequence: Synthetic oligonucleotide
  Target: SCN10A; (-) strand; PAM type: YTN; PAM sequence: CTC
ttattgccaacatctccaga

SEQ ID NO: 43712 - DNA, 20 bp, Artificial Sequence
  Description of Artificial Sequence: Synthetic oligonucleotide
  Target: SCN10A; (-) strand; PAM type: YTN; PAM sequence: CTG
cctcttattgccaacatctc

SEQ ID NO: 43713 - DNA, 20 bp, Artificial Sequence
  Description of Artificial Sequence: Synthetic oligonucleotide
  Target: SCN10A; (-) strand; PAM type: YTN; PAM sequence: CTC
tgcctcttattgccaacatc

SEQ ID NO: 43714 - DNA, 20 bp, Artificial Sequence
  Description of Artificial Sequence: Synthetic oligonucleotide
  Target: SCN10A; (-) strand; PAM type: YTN; PAM sequence: CTC
aatcacccaactctgcctct

SEQ ID NO: 43715 - DNA, 20 bp, Artificial Sequence
  Description of Artificial Sequence: Synthetic oligonucleotide
  Target: SCN10A; (-) strand; PAM type: YTN; PAM sequence: TTA
tctcaatcacccaactctgc

SEQ ID NO: 43716 - DNA, 20 bp, Artificial Sequence
  Description of Artificial Sequence: Synthetic oligonucleotide
  Target: SCN10A; (-) strand; PAM type: YTN; PAM sequence: CTA
ttatctcaatcacccaactc

SEQ ID NO: 43717 - DNA, 20 bp, Artificial Sequence
  Description of Artificial Sequence: Synthetic oligonucleotide
  Target: SCN10A; (-) strand; PAM type: YTN; PAM sequence: CTC
cacaagcatctattatctca

SEQ ID NO: 43718 - DNA, 20 bp, Artificial Sequence
  Description of Artificial Sequence: Synthetic oligonucleotide
  Target: SCN10A; (-) strand; PAM type: YTN; PAM sequence: CTG
aatcatcgctccacaagcat

SEQ ID NO: 43719 - DNA, 20 bp, Artificial Sequence
  Description of Artificial Sequence: Synthetic oligonucleotide
  Target: SCN10A; (-) strand; PAM type: YTN; PAM sequence: TTA
gtgaagtaatcctgaatcat

SEQ ID NO: 43720 - DNA, 20 bp, Artificial Sequence
  Description of Artificial Sequence: Synthetic oligonucleotide
  Target: SCN10A; (-) strand; PAM type: YTN; PAM sequence: CTT
agtgaagtaatcctgaatca

SEQ ID NO: 43721 - DNA, 20 bp, Artificial Sequence
  Description of Artificial Sequence: Synthetic oligonucleotide
  Target: SCN10A; (-) strand; PAM type: YTN; PAM sequence: CTC
ttagtgaagtaatcctgaat

SEQ ID NO: 43722 - DNA, 20 bp, Artificial Sequence
  Description of Artificial Sequence: Synthetic oligonucleotide
  Target: SCN10A; (-) strand; PAM type: YTN; PAM sequence: TTG
ctcttagtgaagtaatcctg

SEQ ID NO: 43723 - DNA, 20 bp, Artificial Sequence
  Description of Artificial Sequence: Synthetic oligonucleotide
  Target: SCN10A; (-) strand; PAM type: YTN; PAM sequence: TTT
gctcttagtgaagtaatcct

SEQ ID NO: 43724 - DNA, 20 bp, Artificial Sequence
  Description of Artificial Sequence: Synthetic oligonucleotide
  Target: SCN10A; (-) strand; PAM type: YTN; PAM sequence: CTT
tgctcttagtgaagtaatcc

SEQ ID NO: 43725 - DNA, 20 bp, Artificial Sequence
  Description of Artificial Sequence: Synthetic oligonucleotide
  Target: SCN10A; (-) strand; PAM type: YTN; PAM sequence: CTC
accccctttgctcttagtga

SEQ ID NO: 43726 - DNA, 20 bp, Artificial Sequence
  Description of Artificial Sequence: Synthetic oligonucleotide
  Target: SCN10A; (-) strand; PAM type: YTN; PAM sequence: TTA
cagccaccaggacccagacc

SEQ ID NO: 43727 - DNA, 20 bp, Artificial Sequence
  Description of Artificial Sequence: Synthetic oligonucleotide
  Target: SCN10A; (-) strand; PAM type: YTN; PAM sequence: TTG
tcacccataaatattacagc

SEQ ID NO: 43728 - DNA, 20 bp, Artificial Sequence
  Description of Artificial Sequence: Synthetic oligonucleotide
  Target: SCN10A; (-) strand; PAM type: YTN; PAM sequence: CTT
gtcacccataaatattacag

SEQ ID NO: 43729 - DNA, 20 bp, Artificial Sequence
  Description of Artificial Sequence: Synthetic oligonucleotide
  Target: SCN10A; (-) strand; PAM type: YTN; PAM sequence: TTC
ccttgtcacccataaatatt

SEQ ID NO: 43730 - DNA, 20 bp, Artificial Sequence
  Description of Artificial Sequence: Synthetic oligonucleotide
  Target: SCN10A; (-) strand; PAM type: YTN; PAM sequence: CTT
cccttgtcacccataaatat

SEQ ID NO: 43731 - DNA, 20 bp, Artificial Sequence
  Description of Artificial Sequence: Synthetic oligonucleotide
  Target: SCN10A; (-) strand; PAM type: YTN; PAM sequence: TTG
tgggcccatcttcccttgtc

SEQ ID NO: 43732 - DNA, 20 bp, Artificial Sequence
  Description of Artificial Sequence: Synthetic oligonucleotide
  Target: SCN10A; (-) strand; PAM type: YTN; PAM sequence: TTT
gtgggcccatcttcccttgt

SEQ ID NO: 43733 - DNA, 20 bp, Artificial Sequence
  Description of Artificial Sequence: Synthetic oligonucleotide
  Target: SCN10A; (-) strand; PAM type: YTN; PAM sequence: TTT
tgtgggcccatcttcccttg

SEQ ID NO: 43734 - DNA, 20 bp, Artificial Sequence
  Description of Artificial Sequence: Synthetic oligonucleotide
  Target: SCN10A; (-) strand; PAM type: YTN; PAM sequence: TTT
ttgtgggcccatcttccctt

SEQ ID NO: 43735 - DNA, 20 bp, Artificial Sequence
  Description of Artificial Sequence: Synthetic oligonucleotide
  Target: SCN10A; (-) strand; PAM type: YTN; PAM sequence: CTT
tttgtgggcccatcttccct

SEQ ID NO: 43736 - DNA, 20 bp, Artificial Sequence
  Description of Artificial Sequence: Synthetic oligonucleotide
  Target: SCN10A; (-) strand; PAM type: YTN; PAM sequence: TTC
aagtctttttgtgggcccat

SEQ ID NO: 43737 - DNA, 20 bp, Artificial Sequence
  Description of Artificial Sequence: Synthetic oligonucleotide
  Target: SCN10A; (-) strand; PAM type: YTN; PAM sequence: TTT
caagtctttttgtgggccca

SEQ ID NO: 43738 - DNA, 20 bp, Artificial Sequence
  Description of Artificial Sequence: Synthetic oligonucleotide
  Target: SCN10A; (-) strand; PAM type: YTN; PAM sequence: CTT
tcaagtctttttgtgggccc

SEQ ID NO: 43739 - DNA, 20 bp, Artificial Sequence
  Description of Artificial Sequence: Synthetic oligonucleotide
  Target: SCN10A; (-) strand; PAM type: YTN; PAM sequence: CTC
tttcaagtctttttgtgggc

SEQ ID NO: 43740 - DNA, 20 bp, Artificial Sequence
  Description of Artificial Sequence: Synthetic oligonucleotide
  Target: SCN10A; (-) strand; PAM type: YTN; PAM sequence: TTC
tctttcaagtctttttgtgg

SEQ ID NO: 43741 - DNA, 20 bp, Artificial Sequence
  Description of Artificial Sequence: Synthetic oligonucleotide
  Target: SCN10A; (-) strand; PAM type: YTN; PAM sequence: TTA
gttctctttcaagtcttttt

SEQ ID NO: 43742 - DNA, 20 bp, Artificial Sequence
  Description of Artificial Sequence: Synthetic oligonucleotide
  Target: SCN10A; (-) strand; PAM type: YTN; PAM sequence: CTT
agttctctttcaagtctttt

SEQ ID NO: 43743 - DNA, 20 bp, Artificial Sequence
  Description of Artificial Sequence: Synthetic oligonucleotide
  Target: SCN10A; (-) strand; PAM type: YTN; PAM sequence: CTC
ttagttctctttcaagtctt

SEQ ID NO: 43744 - DNA, 20 bp, Artificial Sequence
  Description of Artificial Sequence: Synthetic oligonucleotide
  Target: SCN10A; (-) strand; PAM type: YTN; PAM sequence: CTC
tcttagttctctttcaagtc

SEQ ID NO: 43745 - DNA, 20 bp, Artificial Sequence
  Description of Artificial Sequence: Synthetic oligonucleotide
  Target: SCN10A; (-) strand; PAM type: YTN; PAM sequence: CTA
actctcttagttctctttca

SEQ ID NO: 43746 - DNA, 20 bp, Artificial Sequence
  Description of Artificial Sequence: Synthetic oligonucleotide
  Target: SCN10A; (-) strand; PAM type: YTN; PAM sequence: CTG
catgtcctaactctcttagt

SEQ ID NO: 43747 - DNA, 20 bp, Artificial Sequence
  Description of Artificial Sequence: Synthetic oligonucleotide
  Target: SCN10A; (-) strand; PAM type: YTN; PAM sequence: TTG
gtggtgctgcatgtcctaac

SEQ ID NO: 43748 - DNA, 20 bp, Artificial Sequence
  Description of Artificial Sequence: Synthetic oligonucleotide
  Target: SCN10A; (-) strand; PAM type: YTN; PAM sequence: TTT
ggtggtgctgcatgtcctaa

SEQ ID NO: 43749 - DNA, 20 bp, Artificial Sequence
  Description of Artificial Sequence: Synthetic oligonucleotide
  Target: SCN10A; (-) strand; PAM type: YTN; PAM sequence: CTT
tggtggtgctgcatgtccta

SEQ ID NO: 43750 - DNA, 20 bp, Artificial Sequence
  Description of Artificial Sequence: Synthetic oligonucleotide
  Target: SCN10A; (-) strand; PAM type: YTN; PAM sequence: CTG
actttggtggtgctgcatgt

SEQ ID NO: 43751 - DNA, 20 bp, Artificial Sequence
  Description of Artificial Sequence: Synthetic oligonucleotide
  Target: SCN10A; (-) strand; PAM type: YTN; PAM sequence: CTC
tgactttggtggtgctgcat

SEQ ID NO: 43752 - DNA, 20 bp, Artificial Sequence
  Description of Artificial Sequence: Synthetic oligonucleotide
  Target: SCN10A; (-) strand; PAM type: YTN; PAM sequence: CTG
ctctgactttggtggtgctg

SEQ ID NO: 43753 - DNA, 20 bp, Artificial Sequence
  Description of Artificial Sequence: Synthetic oligonucleotide
  Target: SCN10A; (-) strand; PAM type: YTN; PAM sequence: TTC
ctgctctgactttggtggtg

SEQ ID NO: 43754 - DNA, 20 bp, Artificial Sequence
  Description of Artificial Sequence: Synthetic oligonucleotide
  Target: SCN10A; (-) strand; PAM type: YTN; PAM sequence: CTT
cctgctctgactttggtggt

SEQ ID NO: 43755 - DNA, 20 bp, Artificial Sequence
  Description of Artificial Sequence: Synthetic oligonucleotide
  Target: SCN10A; (-) strand; PAM type: YTN; PAM sequence: TTC
acttcctgctctgactttgg

SEQ ID NO: 43756 - DNA, 20 bp, Artificial Sequence
  Description of Artificial Sequence: Synthetic oligonucleotide
  Target: SCN10A; (-) strand; PAM type: YTN; PAM sequence: CTT
cacttcctgctctgactttg

SEQ ID NO: 43757 - DNA, 20 bp, Artificial Sequence
  Description of Artificial Sequence: Synthetic oligonucleotide
  Target: SCN10A; (-) strand; PAM type: YTN; PAM sequence: CTG
agtcttcacttcctgctctg

SEQ ID NO: 43758 - DNA, 20 bp, Artificial Sequence
  Description of Artificial Sequence: Synthetic oligonucleotide
  Target: SCN10A; (-) strand; PAM type: YTN; PAM sequence: CTC
tgagtcttcacttcctgctc

SEQ ID NO: 43759 - DNA, 20 bp, Artificial Sequence
  Description of Artificial Sequence: Synthetic oligonucleotide
  Target: SCN10A; (-) strand; PAM type: YTN; PAM sequence: CTC
caaaggtaggctctgagtct

SEQ ID NO: 43760 - DNA, 20 bp, Artificial Sequence
  Description of Artificial Sequence: Synthetic oligonucleotide
  Target: SCN10A; (-) strand; PAM type: YTN; PAM sequence: CTC
cggggccccacctccaaagg

SEQ ID NO: 43761 - DNA, 20 bp, Artificial Sequence
  Description of Artificial Sequence: Synthetic oligonucleotide
  Target: SCN10A; (-) strand; PAM type: YTN; PAM sequence: CTG
agctccggggccccacctcc

SEQ ID NO: 43762 - DNA, 20 bp, Artificial Sequence
  Description of Artificial Sequence: Synthetic oligonucleotide
  Target: SCN10A; (-) strand; PAM type: YTN; PAM sequence: CTC
catcccaccaaccctgagct

SEQ ID NO: 43763 - DNA, 20 bp, Artificial Sequence
  Description of Artificial Sequence: Synthetic oligonucleotide
  Target: SCN10A; (-) strand; PAM type: YTN; PAM sequence: TTA
tgccctccatcccaccaacc

SEQ ID NO: 43764 - DNA, 20 bp, Artificial Sequence
  Description of Artificial Sequence: Synthetic oligonucleotide
  Target: SCN10A; (-) strand; PAM type: YTN; PAM sequence: TTT
atgccctccatcccaccaac

SEQ ID NO: 43765 - DNA, 20 bp, Artificial Sequence
  Description of Artificial Sequence: Synthetic oligonucleotide
  Target: SCN10A; (-) strand; PAM type: YTN; PAM sequence: CTT
tatgccctccatcccaccaa

SEQ ID NO: 43766 - DNA, 20 bp, Artificial Sequence
  Description of Artificial Sequence: Synthetic oligonucleotide
  Target: SCN10A; (-) strand; PAM type: YTN; PAM sequence: TTC
cccctttatgccctccatcc

SEQ ID NO: 43767 - DNA, 20 bp, Artificial Sequence
  Description of Artificial Sequence: Synthetic oligonucleotide
  Target: SCN10A; (-) strand; PAM type: YTN; PAM sequence: CTT
ccccctttatgccctccatc

SEQ ID NO: 43768 - DNA, 20 bp, Artificial Sequence
  Description of Artificial Sequence: Synthetic oligonucleotide
  Target: SCN10A; (-) strand; PAM type: YTN; PAM sequence: TTG
gtaacccttccccctttatg

SEQ ID NO: 43769 - DNA, 20 bp, Artificial Sequence
  Description of Artificial Sequence: Synthetic oligonucleotide
  Target: SCN10A; (-) strand; PAM type: YTN; PAM sequence: TTT
ggtaacccttccccctttat

SEQ ID NO: 43770 - DNA, 20 bp, Artificial Sequence
  Description of Artificial Sequence: Synthetic oligonucleotide
  Target: SCN10A; (-) strand; PAM type: YTN; PAM sequence: TTT
tggtaacccttcccccttta

SEQ ID NO: 43771 - DNA, 20 bp, Artificial Sequence
  Description of Artificial Sequence: Synthetic oligonucleotide
  Target: SCN10A; (-) strand; PAM type: YTN; PAM sequence: CTG
caggttttggtaacccttcc

SEQ ID NO: 43772 - DNA, 20 bp, Artificial Sequence
  Description of Artificial Sequence: Synthetic oligonucleotide
  Target: SCN10A; (-) strand; PAM type: YTN; PAM sequence: CTG
gtctgcaggttttggtaacc

SEQ ID NO: 43773 - DNA, 20 bp, Artificial Sequence
  Description of Artificial Sequence: Synthetic oligonucleotide
  Target: SCN10A; (-) strand; PAM type: YTN; PAM sequence: CTC
tggtctgcaggttttggtaa

SEQ ID NO: 43774 - DNA, 20 bp, Artificial Sequence
  Description of Artificial Sequence: Synthetic oligonucleotide
  Target: SCN10A; (-) strand; PAM type: YTN; PAM sequence: TTC
tctggtctgcaggttttggt

SEQ ID NO: 43775 - DNA, 20 bp, Artificial Sequence
  Description of Artificial Sequence: Synthetic oligonucleotide
  Target: SCN10A; (-) strand; PAM type: YTN; PAM sequence: CTT
ctctggtctgcaggttttgg

SEQ ID NO: 43776 - DNA, 20 bp, Artificial Sequence
  Description of Artificial Sequence: Synthetic oligonucleotide
  Target: SCN10A; (-) strand; PAM type: YTN; PAM sequence: CTC
aaaaaacaaacaaaaaactt

SEQ ID NO: 43777 - DNA, 20 bp, Artificial Sequence
  Description of Artificial Sequence: Synthetic oligonucleotide
  Target: SCN10A; (-) strand; PAM type: YTN; PAM sequence: CTC
cgcctcaaaaaacaaacaaa

SEQ ID NO: 43778 - DNA, 20 bp, Artificial Sequence
  Description of Artificial Sequence: Synthetic oligonucleotide
  Target: SCN10A; (-) strand; PAM type: YTN; PAM sequence: CTG
ggtgacagagcgagactccg

SEQ ID NO: 43779 - DNA, 20 bp, Artificial Sequence
  Description of Artificial Sequence: Synthetic oligonucleotide
  Target: SCN10A; (-) strand; PAM type: YTN; PAM sequence: CTC
cagcctgggtgacagagcga

SEQ ID NO: 43780 - DNA, 20 bp, Artificial Sequence
  Description of Artificial Sequence: Synthetic oligonucleotide
  Target: SCN10A; (-) strand; PAM type: YTN; PAM sequence: TTA
tactccagcctgggtgacag

SEQ ID NO: 43781 - DNA, 20 bp, Artificial Sequence
  Description of Artificial Sequence: Synthetic oligonucleotide
  Target: SCN10A; (-) strand; PAM type: YTN; PAM sequence: TTG
tgccattatactccagcctg

SEQ ID NO: 43782 - DNA, 20 bp, Artificial Sequence
  Description of Artificial Sequence: Synthetic oligonucleotide
  Target: SCN10A; (-) strand; PAM type: YTN; PAM sequence: CTA
ccaccacgaggtgtggtggt

SEQ ID NO: 43783 - DNA, 20 bp, Artificial Sequence
  Description of Artificial Sequence: Synthetic oligonucleotide
  Target: SCN10A; (-) strand; PAM type: YTN; PAM sequence: CTA
aaagtacaaaaatcactacc

SEQ ID NO: 43784 - DNA, 20 bp, Artificial Sequence
  Description of Artificial Sequence: Synthetic oligonucleotide
  Target: SCN10A; (-) strand; PAM type: YTN; PAM sequence: CTG
ctaaaagtacaaaaatcact

SEQ ID NO: 43785 - DNA, 20 bp, Artificial Sequence
  Description of Artificial Sequence: Synthetic oligonucleotide
  Target: SCN10A; (-) strand; PAM type: YTN; PAM sequence: CTC
tgctaaaagtacaaaaatca

SEQ ID NO: 43786 - DNA, 20 bp, Artificial Sequence
  Description of Artificial Sequence: Synthetic oligonucleotide
  Target: SCN10A; (-) strand; PAM type: YTN; PAM sequence: CTG
tctctgctaaaagtacaaaa

SEQ ID NO: 43787 - DNA, 20 bp, Artificial Sequence
  Description of Artificial Sequence: Synthetic oligonucleotide
  Target: SCN10A; (-) strand; PAM type: YTN; PAM sequence: CTG
gccaacatgccgaaaccctg

SEQ ID NO: 43788 - DNA, 20 bp, Artificial Sequence
  Description of Artificial Sequence: Synthetic oligonucleotide
  Target: SCN10A; (-) strand; PAM type: YTN; PAM sequence: TTC
aaaaccaccctggccaacat

SEQ ID NO: 43789 - DNA, 20 bp, Artificial Sequence
  Description of Artificial Sequence: Synthetic oligonucleotide
  Target: SCN10A; (-) strand; PAM type: YTN; PAM sequence: TTA
ggagttcaaaaccaccctgg

SEQ ID NO: 43790 - DNA, 20 bp, Artificial Sequence
  Description of Artificial Sequence: Synthetic oligonucleotide
  Target: SCN10A; (-) strand; PAM type: YTN; PAM sequence: CTG
aggttaggagttcaaaacca

SEQ ID NO: 43791 - DNA, 20 bp, Artificial Sequence
  Description of Artificial Sequence: Synthetic oligonucleotide
  Target: SCN10A; (-) strand; PAM type: YTN; PAM sequence: CTG
aggcgggcggatcacctgag

SEQ ID NO: 43792 - DNA, 20 bp, Artificial Sequence
  Description of Artificial Sequence: Synthetic oligonucleotide
  Target: SCN10A; (-) strand; PAM type: YTN; PAM sequence: TTG
ggaggctgaggcgggcggat

SEQ ID NO: 43793 - DNA, 20 bp, Artificial Sequence
  Description of Artificial Sequence: Synthetic oligonucleotide
  Target: SCN10A; (-) strand; PAM type: YTN; PAM sequence: TTT
gggaggctgaggcgggcgga

SEQ ID NO: 43794 - DNA, 20 bp, Artificial Sequence
  Description of Artificial Sequence: Synthetic oligonucleotide
  Target: SCN10A; (-) strand; PAM type: YTN; PAM sequence: CTT
tgggaggctgaggcgggcgg

SEQ ID NO: 43795 - DNA, 20 bp, Artificial Sequence
  Description of Artificial Sequence: Synthetic oligonucleotide
  Target: SCN10A; (-) strand; PAM type: YTN; PAM sequence: CTG
taatcccagcactttgggag

SEQ ID NO: 43796 - DNA, 20 bp, Artificial Sequence
  Description of Artificial Sequence: Synthetic oligonucleotide
  Target: SCN10A; (-) strand; PAM type: YTN; PAM sequence: TTC
atgcctgtaatcccagcact

SEQ ID NO: 43797 - DNA, 20 bp, Artificial Sequence
  Description of Artificial Sequence: Synthetic oligonucleotide
  Target: SCN10A; (-) strand; PAM type: YTN; PAM sequence: CTG
gccaggcacggtggttcatg

SEQ ID NO: 43798 - DNA, 20 bp, Artificial Sequence
  Description of Artificial Sequence: Synthetic oligonucleotide
  Target: SCN10A; (-) strand; PAM type: YTN; PAM sequence: CTC
atctggccaggcacggtggt

SEQ ID NO: 43799 - DNA, 20 bp, Artificial Sequence
  Description of Artificial Sequence: Synthetic oligonucleotide
  Target: SCN10A; (-) strand; PAM type: YTN; PAM sequence: CTC
tcatctggccaggcacggtg

SEQ ID NO: 43800 - DNA, 20 bp, Artificial Sequence
  Description of Artificial Sequence: Synthetic oligonucleotide
  Target: SCN10A; (-) strand; PAM type: YTN; PAM sequence: TTC
tctcatctggccaggcacgg

SEQ ID NO: 43801 - DNA, 20 bp, Artificial Sequence
  Description of Artificial Sequence: Synthetic oligonucleotide
  Target: SCN10A; (-) strand; PAM type: YTN; PAM sequence: CTT
ctctcatctggccaggcacg

SEQ ID NO: 43802 - DNA, 20 bp, Artificial Sequence
  Description of Artificial Sequence: Synthetic oligonucleotide
  Target: SCN10A; (-) strand; PAM type: YTN; PAM sequence: CTC
aaaacttctctcatctggcc

SEQ ID NO: 43803 - DNA, 20 bp, Artificial Sequence
  Description of Artificial Sequence: Synthetic oligonucleotide
  Target: SCN10A; (-) strand; PAM type: YTN; PAM sequence: CTG
atctcaaaacttctctcatc

SEQ ID NO: 43804 - DNA, 20 bp, Artificial Sequence
  Description of Artificial Sequence: Synthetic oligonucleotide
  Target: SCN10A; (-) strand; PAM type: YTN; PAM sequence: TTG
aaggcatgcgggtaagtctg

SEQ ID NO: 43805 - DNA, 20 bp, Artificial Sequence
  Description of Artificial Sequence: Synthetic oligonucleotide
  Target: SCN10A; (-) strand; PAM type: YTN; PAM sequence: TTT
gaaggcatgcgggtaagtct

SEQ ID NO: 43806 - DNA, 20 bp, Artificial Sequence
  Description of Artificial Sequence: Synthetic oligonucleotide
  Target: SCN10A; (-) strand; PAM type: YTN; PAM sequence: CTC
gatttgaaggcatgcgggta

SEQ ID NO: 43807 - DNA, 20 bp, Artificial Sequence
  Description of Artificial Sequence: Synthetic oligonucleotide
  Target: SCN10A; (-) strand; PAM type: YTN; PAM sequence: TTC
tcgatttgaaggcatgcggg

SEQ ID NO: 43808 - DNA, 20 bp, Artificial Sequence
  Description of Artificial Sequence: Synthetic oligonucleotide
  Target: SCN10A; (-) strand; PAM type: YTN; PAM sequence: TTT
ctcgatttgaaggcatgcgg

SEQ ID NO: 43809 - DNA, 20 bp, Artificial Sequence
  Description of Artificial Sequence: Synthetic oligonucleotide
  Target: SCN10A; (-) strand; PAM type: YTN; PAM sequence: CTT
tctcgatttgaaggcatgcg

SEQ ID NO: 43810 - DNA, 20 bp, Artificial Sequence
  Description of Artificial Sequence: Synthetic oligonucleotide
  Target: SCN10A; (-) strand; PAM type: YTN; PAM sequence: CTC
tttctcgatttgaaggcatg

SEQ ID NO: 43811 - DNA, 20 bp, Artificial Sequence
  Description of Artificial Sequence: Synthetic oligonucleotide
  Target: SCN10A; (-) strand; PAM type: YTN; PAM sequence: CTG
cgggctctttctcgatttga

SEQ ID NO: 43812 - DNA, 20 bp, Artificial Sequence
  Description of Artificial Sequence: Synthetic oligonucleotide
  Target: SCN10A; (-) strand; PAM type: YTN; PAM sequence: CTG
cggccactgcgggctctttc

SEQ ID NO: 43813 - DNA, 20 bp, Artificial Sequence
  Description of Artificial Sequence: Synthetic oligonucleotide
  Target: SCN10A; (-) strand; PAM type: YTN; PAM sequence: CTC
tgcggccactgcgggctctt

SEQ ID NO: 43814 - DNA, 20 bp, Artificial Sequence
  Description of Artificial Sequence: Synthetic oligonucleotide
  Target: SCN10A; (-) strand; PAM type: YTN; PAM sequence: TTC
gcgctctgcggccactgcgg

SEQ ID NO: 43815 - DNA, 20 bp, Artificial Sequence
  Description of Artificial Sequence: Synthetic oligonucleotide
  Target: SCN10A; (-) strand; PAM type: YTN; PAM sequence: CTT
cgcgctctgcggccactgcg

SEQ ID NO: 43816 - DNA, 20 bp, Artificial Sequence
  Description of Artificial Sequence: Synthetic oligonucleotide
  Target: SCN10A; (-) strand; PAM type: YTN; PAM sequence: TTC
gaacccttcgcgctctgcgg

SEQ ID NO: 43817 - DNA, 20 bp, Artificial Sequence
  Description of Artificial Sequence: Synthetic oligonucleotide
  Target: SCN10A; (-) strand; PAM type: YTN; PAM sequence: CTT
cgaacccttcgcgctctgcg

SEQ ID NO: 43818 - DNA, 20 bp, Artificial Sequence
  Description of Artificial Sequence: Synthetic oligonucleotide
  Target: SCN10A; (-) strand; PAM type: YTN; PAM sequence: CTC
ccatcaaagcccttcgaacc

SEQ ID NO: 43819 - DNA, 20 bp, Artificial Sequence
  Description of Artificial Sequence: Synthetic oligonucleotide
  Target: SCN10A; (-) strand; PAM type: YTN; PAM sequence: CTG
aagtggctcccatcaaagcc

SEQ ID NO: 43820 - DNA, 20 bp, Artificial Sequence
  Description of Artificial Sequence: Synthetic oligonucleotide
  Target: SCN10A; (-) strand; PAM type: YTN; PAM sequence: TTC
tgaagtggctcccatcaaag

SEQ ID NO: 43821 - DNA, 20 bp, Artificial Sequence
  Description of Artificial Sequence: Synthetic oligonucleotide
  Target: SCN10A; (-) strand; PAM type: YTN; PAM sequence: CTG
gaatattctgaagtggctcc

SEQ ID NO: 43822 - DNA, 20 bp, Artificial Sequence
  Description of Artificial Sequence: Synthetic oligonucleotide
  Target: SCN10A; (-) strand; PAM type: YTN; PAM sequence: TTC
tggaatattctgaagtggct

SEQ ID NO: 43823 - DNA, 20 bp, Artificial Sequence
  Description of Artificial Sequence: Synthetic oligonucleotide
  Target: SCN10A; (-) strand; PAM type: YTN; PAM sequence: CTC
acagcgaagattctggaata

SEQ ID NO: 43824 - DNA, 20 bp, Artificial Sequence
  Description of Artificial Sequence: Synthetic oligonucleotide
  Target: SCN10A; (-) strand; PAM type: YTN; PAM sequence: CTG
ataagtctcacagcgaagat

SEQ ID NO: 43825 - DNA, 20 bp, Artificial Sequence
  Description of Artificial Sequence: Synthetic oligonucleotide
  Target: SCN10A; (-) strand; PAM type: YTN; PAM sequence: CTC
actgataagtctcacagcga

SEQ ID NO: 43826 - DNA, 20 bp, Artificial Sequence
  Description of Artificial Sequence: Synthetic oligonucleotide
  Target: SCN10A; (-) strand; PAM type: YTN; PAM sequence: CTC
agatctcactgataagtctc

SEQ ID NO: 43827 - DNA, 20 bp, Artificial Sequence
  Description of Artificial Sequence: Synthetic oligonucleotide
  Target: SCN10A; (-) strand; PAM type: YTN; PAM sequence: CTG
cactcagatctcactgataa

SEQ ID NO: 43828 - DNA, 20 bp, Artificial Sequence
  Description of Artificial Sequence: Synthetic oligonucleotide
  Target: SCN10A; (-) strand; PAM type: YTN; PAM sequence: CTC
ctgcactcagatctcactga

SEQ ID NO: 43829 - DNA, 20 bp, Artificial Sequence
  Description of Artificial Sequence: Synthetic oligonucleotide
  Target: SCN10A; (-) strand; PAM type: YTN; PAM sequence: CTC
tcctgcactcagatctcact

SEQ ID NO: 43830 - DNA, 20 bp, Artificial Sequence
  Description of Artificial Sequence: Synthetic oligonucleotide
  Target: SCN10A; (-) strand; PAM type: YTN; PAM sequence: CTG
ccctctcctgcactcagatc

SEQ ID NO: 43831 - DNA, 20 bp, Artificial Sequence
  Description of Artificial Sequence: Synthetic oligonucleotide
  Target: SCN10A; (-) strand; PAM type: YTN; PAM sequence: TTC
tgccctctcctgcactcaga

SEQ ID NO: 43832 - DNA, 20 bp, Artificial Sequence
  Description of Artificial Sequence: Synthetic oligonucleotide
  Target: SCN10A; (-) strand; PAM type: YTN; PAM sequence: TTT
ctgccctctcctgcactcag

SEQ ID NO: 43833 - DNA, 20 bp, Artificial Sequence
  Description of Artificial Sequence: Synthetic oligonucleotide
  Target: SCN10A; (-) strand; PAM type: YTN; PAM sequence: CTA
gagtgatgtttctgccctct

SEQ ID NO: 43834 - DNA, 20 bp, Artificial Sequence
  Description of Artificial Sequence: Synthetic oligonucleotide
  Target: SCN10A; (-) strand; PAM type: YTN; PAM sequence: CTG
gaaacctagagtgatgtttc

SEQ ID NO: 43835 - DNA, 20 bp, Artificial Sequence
  Description of Artificial Sequence: Synthetic oligonucleotide
  Target: SCN10A; (-) strand; PAM type: YTN; PAM sequence: TTC
tggaaacctagagtgatgtt

SEQ ID NO: 43836 - DNA, 20 bp, Artificial Sequence
  Description of Artificial Sequence: Synthetic oligonucleotide
  Target: SCN10A; (-) strand; PAM type: YTN; PAM sequence: TTT
ctggaaacctagagtgatgt

SEQ ID NO: 43837 - DNA, 20 bp, Artificial Sequence
  Description of Artificial Sequence: Synthetic oligonucleotide
  Target: SCN10A; (-) strand; PAM type: YTN; PAM sequence: CTT
tctggaaacctagagtgatg

SEQ ID NO: 43838 - DNA, 20 bp, Artificial Sequence
  Description of Artificial Sequence: Synthetic oligonucleotide
  Target: SCN10A; (-) strand; PAM type: YTN; PAM sequence: CTG
cctttctggaaacctagagt

SEQ ID NO: 43839 - DNA, 20 bp, Artificial Sequence
  Description of Artificial Sequence: Synthetic oligonucleotide
  Target: SCN10A; (-) strand; PAM type: YTN; PAM sequence: TTC
cacgaggactgcctttctgg

SEQ ID NO: 43840 - DNA, 20 bp, Artificial Sequence
  Description of Artificial Sequence: Synthetic oligonucleotide
  Target: SCN10A; (-) strand; PAM type: YTN; PAM sequence: CTT
ccacgaggactgcctttctg

SEQ ID NO: 43841 - DNA, 20 bp, Artificial Sequence
  Description of Artificial Sequence: Synthetic oligonucleotide
  Target: SCN10A; (-) strand; PAM type: YTN; PAM sequence: CTC
cttccacgaggactgccttt

SEQ ID NO: 43842 - DNA, 20 bp, Artificial Sequence
  Description of Artificial Sequence: Synthetic oligonucleotide
  Target: SCN10A; (-) strand; PAM type: YTN; PAM sequence: CTG
tctccttccacgaggactgc

SEQ ID NO: 43843 - DNA, 20 bp, Artificial Sequence
  Description of Artificial Sequence: Synthetic oligonucleotide
  Target: SCN10A; (-) strand; PAM type: YTN; PAM sequence: TTC
ctgtctccttccacgaggac

SEQ ID NO: 43844 - DNA, 20 bp, Artificial Sequence
  Description of Artificial Sequence: Synthetic oligonucleotide
  Target: SCN10A; (-) strand; PAM type: YTN; PAM sequence: CTG
ggcagggagttcctgtctcc

SEQ ID NO: 43845 - DNA, 20 bp, Artificial Sequence
  Description of Artificial Sequence: Synthetic oligonucleotide
  Target: SCN10A; (-) strand; PAM type: YTN; PAM sequence: TTA
gacgtgtaggaatgggaggc

SEQ ID NO: 43846 - DNA, 20 bp, Artificial Sequence
  Description of Artificial Sequence: Synthetic oligonucleotide
  Target: SCN10A; (-) strand; PAM type: YTN; PAM sequence: CTT
agacgtgtaggaatgggagg

SEQ ID NO: 43847 - DNA, 20 bp, Artificial Sequence
  Description of Artificial Sequence: Synthetic oligonucleotide
  Target: SCN10A; (-) strand; PAM type: YTN; PAM sequence: CTA
ggatgatggcttagacgtgt

SEQ ID NO: 43848 - DNA, 20 bp, Artificial Sequence
  Description of Artificial Sequence: Synthetic oligonucleotide
  Target: SCN10A; (-) strand; PAM type: YTN; PAM sequence: TTC
cgaataaggtgggagctagg

SEQ ID NO: 43849 - DNA, 20 bp, Artificial Sequence
  Description of Artificial Sequence: Synthetic oligonucleotide
  Target: SCN10A; (-) strand; PAM type: YTN; PAM sequence: TTG
gagttccgaataaggtggga

SEQ ID NO: 43850 - DNA, 20 bp, Artificial Sequence
  Description of Artificial Sequence: Synthetic oligonucleotide
  Target: SCN10A; (-) strand; PAM type: YTN; PAM sequence: CTC
attggagttccgaataaggt

SEQ ID NO: 43851 - DNA, 20 bp, Artificial Sequence
  Description of Artificial Sequence: Synthetic oligonucleotide
  Target: SCN10A; (-) strand; PAM type: YTN; PAM sequence: CTC
tcattggagttccgaataag

SEQ ID NO: 43852 - DNA, 20 bp, Artificial Sequence
  Description of Artificial Sequence: Synthetic oligonucleotide
  Target: SCN10A; (-) strand; PAM type: YTN; PAM sequence: CTA
gacctctcattggagttccg

SEQ ID NO: 43853 - DNA, 20 bp, Artificial Sequence
  Description of Artificial Sequence: Synthetic oligonucleotide
  Target: SCN10A; (-) strand; PAM type: YTN; PAM sequence: TTC
tagacctctcattggagttc

SEQ ID NO: 43854 - DNA, 20 bp, Artificial Sequence
  Description of Artificial Sequence: Synthetic oligonucleotide
  Target: SCN10A; (-) strand; PAM type: YTN; PAM sequence: TTT
ctagacctctcattggagtt

SEQ ID NO: 43855 - DNA, 20 bp, Artificial Sequence
  Description of Artificial Sequence: Synthetic oligonucleotide
  Target: SCN10A; (-) strand; PAM type: YTN; PAM sequence: CTT
tctagacctctcattggagt

SEQ ID NO: 43856 - DNA, 20 bp, Artificial Sequence
  Description of Artificial Sequence: Synthetic oligonucleotide
  Target: SCN10A; (-) strand; PAM type: YTN; PAM sequence: CTC
tttctagacctctcattgga

SEQ ID NO: 43857 - DNA, 20 bp, Artificial Sequence
  Description of Artificial Sequence: Synthetic oligonucleotide
  Target: SCN10A; (-) strand; PAM type: YTN; PAM sequence: TTA
ataaaagggaagagacaaaa

SEQ ID NO: 43858 - DNA, 20 bp, Artificial Sequence
  Description of Artificial Sequence: Synthetic oligonucleotide
  Target: SCN10A; (-) strand; PAM type: YTN; PAM sequence: TTT
aataaaagggaagagacaaa

SEQ ID NO: 43859 - DNA, 20 bp, Artificial Sequence
  Description of Artificial Sequence: Synthetic oligonucleotide
  Target: SCN10A; (-) strand; PAM type: YTN; PAM sequence: TTT
taataaaagggaagagacaa

SEQ ID NO: 43860 - DNA, 20 bp, Artificial Sequence
  Description of Artificial Sequence: Synthetic oligonucleotide
  Target: SCN10A; (-) strand; PAM type: YTN; PAM sequence: TTT
ttaataaaagggaagagaca

SEQ ID NO: 43861 - DNA, 20 bp, Artificial Sequence
  Description of Artificial Sequence: Synthetic oligonucleotide
  Target: SCN10A; (-) strand; PAM type: YTN; PAM sequence: TTA
agagagtggtgaataaaatt

SEQ ID NO: 43862 - DNA, 20 bp, Artificial Sequence
  Description of Artificial Sequence: Synthetic oligonucleotide
  Target: SCN10A; (-) strand; PAM type: YTN; PAM sequence: TTT
aagagagtggtgaataaaat

SEQ ID NO: 43863 - DNA, 20 bp, Artificial Sequence
  Description of Artificial Sequence: Synthetic oligonucleotide
  Target: SCN10A; (-) strand; PAM type: YTN; PAM sequence: TTG
tttaagagagtggtgaataa

SEQ ID NO: 43864 - DNA, 20 bp, Artificial Sequence
  Description of Artificial Sequence: Synthetic oligonucleotide
  Target: SCN10A; (-) strand; PAM type: YTN; PAM sequence: TTG
cccagattgtttaagagagt

SEQ ID NO: 43865 - DNA, 20 bp, Artificial Sequence
  Description of Artificial Sequence: Synthetic oligonucleotide
  Target: SCN10A; (-) strand; PAM type: YTN; PAM sequence: CTT
gcccagattgtttaagagag

SEQ ID NO: 43866 - DNA, 20 bp, Artificial Sequence
  Description of Artificial Sequence: Synthetic oligonucleotide
  Target: SCN10A; (-) strand; PAM type: YTN; PAM sequence: TTC
ttgcccagattgtttaagag

SEQ ID NO: 43867 - DNA, 20 bp, Artificial Sequence
  Description of Artificial Sequence: Synthetic oligonucleotide
  Target: SCN10A; (-) strand; PAM type: YTN; PAM sequence: TTT
cttgcccagattgtttaaga

SEQ ID NO: 43868 - DNA, 20 bp, Artificial Sequence
  Description of Artificial Sequence: Synthetic oligonucleotide
  Target: SCN10A; (-) strand; PAM type: YTN; PAM sequence: TTT
tcttgcccagattgtttaag

SEQ ID NO: 43869 - DNA, 20 bp, Artificial Sequence
  Description of Artificial Sequence: Synthetic oligonucleotide
  Target: SCN10A; (-) strand; PAM type: YTN; PAM sequence: TTT
ttcttgcccagattgtttaa

SEQ ID NO: 43870 - DNA, 20 bp, Artificial Sequence
  Description of Artificial Sequence: Synthetic oligonucleotide
  Target: SCN10A; (-) strand; PAM type: YTN; PAM sequence: CTG
agtttttcttgcccagattg

SEQ ID NO: 43871 - DNA, 20 bp, Artificial Sequence
  Description of Artificial Sequence: Synthetic oligonucleotide
  Target: SCN10A; (-) strand; PAM type: YTN; PAM sequence: TTA
gagactgagtttttcttgcc

SEQ ID NO: 43872 - DNA, 20 bp, Artificial Sequence
  Description of Artificial Sequence: Synthetic oligonucleotide
  Target: SCN10A; (-) strand; PAM type: YTN; PAM sequence: TTG
gtgatgttagagactgagtt

SEQ ID NO: 43873 - DNA, 20 bp, Artificial Sequence
  Description of Artificial Sequence: Synthetic oligonucleotide
  Target: SCN10A; (-) strand; PAM type: YTN; PAM sequence: CTA
cgtaccagaggttggtgatg

SEQ ID NO: 43874 - DNA, 20 bp, Artificial Sequence
  Description of Artificial Sequence: Synthetic oligonucleotide
  Target: SCN10A; (-) strand; PAM type: YTN; PAM sequence: TTG
gccacctacgtaccagaggt

SEQ ID NO: 43875 - DNA, 20 bp, Artificial Sequence
  Description of Artificial Sequence: Synthetic oligonucleotide
  Target: SCN10A; (-) strand; PAM type: YTN; PAM sequence: CTT
ggccacctacgtaccagagg

SEQ ID NO: 43876 - DNA, 20 bp, Artificial Sequence
  Description of Artificial Sequence: Synthetic oligonucleotide
  Target: SCN10A; (-) strand; PAM type: YTN; PAM sequence: CTG
gaagcttggccacctacgta

SEQ ID NO: 43877 - DNA, 20 bp, Artificial Sequence
  Description of Artificial Sequence: Synthetic oligonucleotide
  Target: SCN10A; (-) strand; PAM type: YTN; PAM sequence: TTA
atacactggaagcttggcca

SEQ ID NO: 43878 - DNA, 20 bp, Artificial Sequence
  Description of Artificial Sequence: Synthetic oligonucleotide
  Target: SCN10A; (-) strand; PAM type: YTN; PAM sequence: TTT
aatacactggaagcttggcc

SEQ ID NO: 43879 - DNA, 20 bp, Artificial Sequence
  Description of Artificial Sequence: Synthetic oligonucleotide
  Target: SCN10A; (-) strand; PAM type: YTN; PAM sequence: TTG
atttaatacactggaagctt

SEQ ID NO: 43880 - DNA, 20 bp, Artificial Sequence
  Description of Artificial Sequence: Synthetic oligonucleotide
  Target: SCN10A; (-) strand; PAM type: YTN; PAM sequence: CTA
gaaggaaaaggaagagttga

SEQ ID NO: 43881 - DNA, 20 bp, Artificial Sequence
  Description of Artificial Sequence: Synthetic oligonucleotide
  Target: SCN10A; (-) strand; PAM type: YTN; PAM sequence: CTG
cccctagaaggaaaaggaag

SEQ ID NO: 43882 - DNA, 20 bp, Artificial Sequence
  Description of Artificial Sequence: Synthetic oligonucleotide
  Target: SCN10A; (-) strand; PAM type: YTN; PAM sequence: CTG
ctgcccctagaaggaaaagg

SEQ ID NO: 43883 - DNA, 20 bp, Artificial Sequence
  Description of Artificial Sequence: Synthetic oligonucleotide
  Target: SCN10A; (-) strand; PAM type: YTN; PAM sequence: CTG
actgctgcccctagaaggaa

SEQ ID NO: 43884 - DNA, 20 bp, Artificial Sequence
  Description of Artificial Sequence: Synthetic oligonucleotide
  Target: SCN10A; (-) strand; PAM type: YTN; PAM sequence: TTG
aggcctgactgctgccccta

SEQ ID NO: 43885 - DNA, 20 bp, Artificial Sequence
  Description of Artificial Sequence: Synthetic oligonucleotide
  Target: SCN10A; (-) strand; PAM type: YTN; PAM sequence: TTG
ttgaggcctgactgctgccc

SEQ ID NO: 43886 - DNA, 20 bp, Artificial Sequence
  Description of Artificial Sequence: Synthetic oligonucleotide
  Target: SCN10A; (-) strand; PAM type: YTN; PAM sequence: TTC
aaggttgttgaggcctgact

SEQ ID NO: 43887 - DNA, 20 bp, Artificial Sequence
  Description of Artificial Sequence: Synthetic oligonucleotide
  Target: SCN10A; (-) strand; PAM type: YTN; PAM sequence: TTT
caaggttgttgaggcctgac

SEQ ID NO: 43888 - DNA, 20 bp, Artificial Sequence
  Description of Artificial Sequence: Synthetic oligonucleotide
  Target: SCN10A; (-) strand; PAM type: YTN; PAM sequence: CTG
aaaatcagtttcaaggttgt

SEQ ID NO: 43889 - DNA, 20 bp, Artificial Sequence
  Description of Artificial Sequence: Synthetic oligonucleotide
  Target: SCN10A; (-) strand; PAM type: YTN; PAM sequence: CTC
tgaaaatcagtttcaaggtt

SEQ ID NO: 43890 - DNA, 20 bp, Artificial Sequence
  Description of Artificial Sequence: Synthetic oligonucleotide
  Target: SCN10A; (-) strand; PAM type: YTN; PAM sequence: CTC
caagtctctgaaaatcagtt

SEQ ID NO: 43891 - DNA, 20 bp, Artificial Sequence
  Description of Artificial Sequence: Synthetic oligonucleotide
  Target: SCN10A; (-) strand; PAM type: YTN; PAM sequence: CTA
ggagggaacatcatgtctcc

SEQ ID NO: 43892 - DNA, 20 bp, Artificial Sequence
  Description of Artificial Sequence: Synthetic oligonucleotide
  Target: SCN10A; (-) strand; PAM type: YTN; PAM sequence: CTC
agcatagcccctaggaggga

SEQ ID NO: 43893 - DNA, 20 bp, Artificial Sequence
  Description of Artificial Sequence: Synthetic oligonucleotide
  Target: SCN10A; (-) strand; PAM type: YTN; PAM sequence: CTC
tcagcatagcccctaggagg

SEQ ID NO: 43894 - DNA, 20 bp, Artificial Sequence
  Description of Artificial Sequence: Synthetic oligonucleotide
  Target: SCN10A; (-) strand; PAM type: YTN; PAM sequence: CTC
agaatagactctcagcatag

SEQ ID NO: 43895 - DNA, 20 bp, Artificial Sequence
  Description of Artificial Sequence: Synthetic oligonucleotide
  Target: SCN10A; (-) strand; PAM type: YTN; PAM sequence: TTC
ctcagaatagactctcagca

SEQ ID NO: 43896 - DNA, 20 bp, Artificial Sequence
  Description of Artificial Sequence: Synthetic oligonucleotide
  Target: SCN10A; (-) strand; PAM type: YTN; PAM sequence: CTA
tattcctcagaatagactct

SEQ ID NO: 43897 - DNA, 20 bp, Artificial Sequence
  Description of Artificial Sequence: Synthetic oligonucleotide
  Target: SCN10A; (-) strand; PAM type: YTN; PAM sequence: TTA
ctatattcctcagaatagac

SEQ ID NO: 43898 - DNA, 20 bp, Artificial Sequence
  Description of Artificial Sequence: Synthetic oligonucleotide
  Target: SCN10A; (-) strand; PAM type: YTN; PAM sequence: TTC
agattactatattcctcaga

SEQ ID NO: 43899 - DNA, 20 bp, Artificial Sequence
  Description of Artificial Sequence: Synthetic oligonucleotide
  Target: SCN10A; (-) strand; PAM type: YTN; PAM sequence: CTG
agcaaatataattcagatta

SEQ ID NO: 43900 - DNA, 20 bp, Artificial Sequence
  Description of Artificial Sequence: Synthetic oligonucleotide
  Target: SCN10A; (-) strand; PAM type: YTN; PAM sequence: CTC
tgagcaaatataattcagat

SEQ ID NO: 43901 - DNA, 20 bp, Artificial Sequence
  Description of Artificial Sequence: Synthetic oligonucleotide
  Target: SCN10A; (-) strand; PAM type: YTN; PAM sequence: TTC
tctgagcaaatataattcag

SEQ ID NO: 43902 - DNA, 20 bp, Artificial Sequence
  Description of Artificial Sequence: Synthetic oligonucleotide
  Target: SCN10A; (-) strand; PAM type: YTN; PAM sequence: CTT
ctctgagcaaatataattca

SEQ ID NO: 43903 - DNA, 20 bp, Artificial Sequence
  Description of Artificial Sequence: Synthetic oligonucleotide
  Target: SCN10A; (-) strand; PAM type: YTN; PAM sequence: TTC
caccccacttctctgagcaa

SEQ ID NO: 43904 - DNA, 20 bp, Artificial Sequence
  Description of Artificial Sequence: Synthetic oligonucleotide
  Target: SCN10A; (-) strand; PAM type: YTN; PAM sequence: TTT
ccaccccacttctctgagca

SEQ ID NO: 43905 - DNA, 20 bp, Artificial Sequence
  Description of Artificial Sequence: Synthetic oligonucleotide
  Target: SCN10A; (-) strand; PAM type: YTN; PAM sequence: CTT
tccaccccacttctctgagc

SEQ ID NO: 43906 - DNA, 20 bp, Artificial Sequence
  Description of Artificial Sequence: Synthetic oligonucleotide
  Target: SCN10A; (-) strand; PAM type: YTN; PAM sequence: TTC
tttccaccccacttctctga

SEQ ID NO: 43907 - DNA, 20 bp, Artificial Sequence
  Description of Artificial Sequence: Synthetic oligonucleotide
  Target: SCN10A; (-) strand; PAM type: YTN; PAM sequence: CTA
ttctttccaccccacttctc

SEQ ID NO: 43908 - DNA, 20 bp, Artificial Sequence
  Description of Artificial Sequence: Synthetic oligonucleotide
  Target: SCN10A; (-) strand; PAM type: YTN; PAM sequence: TTA
gaccccacccaaaccactat

SEQ ID NO: 43909 - DNA, 20 bp, Artificial Sequence
  Description of Artificial Sequence: Synthetic oligonucleotide
  Target: SCN10A; (-) strand; PAM type: YTN; PAM sequence: TTC
aaatgggaattagaccccac

SEQ ID NO: 43910 - DNA, 20 bp, Artificial Sequence
  Description of Artificial Sequence: Synthetic oligonucleotide
  Target: SCN10A; (-) strand; PAM type: YTN; PAM sequence: CTC
acaaaaaatcagggttcaaa

SEQ ID NO: 43911 - DNA, 20 bp, Artificial Sequence
  Description of Artificial Sequence: Synthetic oligonucleotide
  Target: SCN10A; (-) strand; PAM type: YTN; PAM sequence: CTA
acccaagctcacaaaaaatc

SEQ ID NO: 43912 - DNA, 20 bp, Artificial Sequence
  Description of Artificial Sequence: Synthetic oligonucleotide
  Target: SCN10A; (-) strand; PAM type: YTN; PAM sequence: CTA
gccaggcactaacccaagct

SEQ ID NO: 43913 - DNA, 20 bp, Artificial Sequence
  Description of Artificial Sequence: Synthetic oligonucleotide
  Target: SCN10A; (-) strand; PAM type: YTN; PAM sequence: CTG
gactagccaggcactaaccc

SEQ ID NO: 43914 - DNA, 20 bp, Artificial Sequence
  Description of Artificial Sequence: Synthetic oligonucleotide
  Target: SCN10A; (-) strand; PAM type: YTN; PAM sequence: TTA
caaagggtgaaagtaccctg

SEQ ID NO: 43915 - DNA, 20 bp, Artificial Sequence
  Description of Artificial Sequence: Synthetic oligonucleotide
  Target: SCN10A; (-) strand; PAM type: YTN; PAM sequence: TTT
acaaagggtgaaagtaccct

SEQ ID NO: 43916 - DNA, 20 bp, Artificial Sequence
  Description of Artificial Sequence: Synthetic oligonucleotide
  Target: SCN10A; (-) strand; PAM type: YTN; PAM sequence: TTT
tacaaagggtgaaagtaccc

SEQ ID NO: 43917 - DNA, 20 bp, Artificial Sequence
  Description of Artificial Sequence: Synthetic oligonucleotide
  Target: SCN10A; (-) strand; PAM type: YTN; PAM sequence: TTC
attttacaaagggtgaaagt

SEQ ID NO: 43918 - DNA, 20 bp, Artificial Sequence
  Description of Artificial Sequence: Synthetic oligonucleotide
  Target: SCN10A; (-) strand; PAM type: YTN; PAM sequence: TTT
cattttacaaagggtgaaag

SEQ ID NO: 43919 - DNA, 20 bp, Artificial Sequence
  Description of Artificial Sequence: Synthetic oligonucleotide
  Target: SCN10A; (-) strand; PAM type: YTN; PAM sequence: TTT
tcattttacaaagggtgaaa

SEQ ID NO: 43920 - DNA, 20 bp, Artificial Sequence
  Description of Artificial Sequence: Synthetic oligonucleotide
  Target: SCN10A; (-) strand; PAM type: YTN; PAM sequence: TTT
ttcattttacaaagggtgaa

SEQ ID NO: 43921 - DNA, 20 bp, Artificial Sequence
  Description of Artificial Sequence: Synthetic oligonucleotide
  Target: SCN10A; (-) strand; PAM type: YTN; PAM sequence: CTT
tttcattttacaaagggtga

SEQ ID NO: 43922 - DNA, 20 bp, Artificial Sequence
  Description of Artificial Sequence: Synthetic oligonucleotide
  Target: SCN10A; (-) strand; PAM type: YTN; PAM sequence: CTG
actttttcattttacaaagg

SEQ ID NO: 43923 - DNA, 20 bp, Artificial Sequence
  Description of Artificial Sequence: Synthetic oligonucleotide
  Target: SCN10A; (-) strand; PAM type: YTN; PAM sequence: TTA
gtctgactttttcattttac

SEQ ID NO: 43924 - DNA, 20 bp, Artificial Sequence
  Description of Artificial Sequence: Synthetic oligonucleotide
  Target: SCN10A; (-) strand; PAM type: YTN; PAM sequence: CTT
agtctgactttttcatttta

SEQ ID NO: 43925 - DNA, 20 bp, Artificial Sequence
  Description of Artificial Sequence: Synthetic oligonucleotide
  Target: SCN10A; (-) strand; PAM type: YTN; PAM sequence: CTC
ttagtctgactttttcattt

SEQ ID NO: 43926 - DNA, 20 bp, Artificial Sequence
  Description of Artificial Sequence: Synthetic oligonucleotide
  Target: SCN10A; (-) strand; PAM type: YTN; PAM sequence: TTC
tcttagtctgactttttcat

SEQ ID NO: 43927 - DNA, 20 bp, Artificial Sequence
  Description of Artificial Sequence: Synthetic oligonucleotide
  Target: SCN10A; (-) strand; PAM type: YTN; PAM sequence: TTG
gaattctcttagtctgactt

SEQ ID NO: 43928 - DNA, 20 bp, Artificial Sequence
  Description of Artificial Sequence: Synthetic oligonucleotide
  Target: SCN10A; (-) strand; PAM type: YTN; PAM sequence: TTT
ggaattctcttagtctgact

SEQ ID NO: 43929 - DNA, 20 bp, Artificial Sequence
  Description of Artificial Sequence: Synthetic oligonucleotide
  Target: SCN10A; (-) strand; PAM type: YTN; PAM sequence: CTT
tggaattctcttagtctgac

SEQ ID NO: 43930 - DNA, 20 bp, Artificial Sequence
  Description of Artificial Sequence: Synthetic oligonucleotide
  Target: SCN10A; (-) strand; PAM type: YTN; PAM sequence: CTA
tcagaactttggaattctct

SEQ ID NO: 43931 - DNA, 20 bp, Artificial Sequence
  Description of Artificial Sequence: Synthetic oligonucleotide
  Target: SCN10A; (-) strand; PAM type: YTN; PAM sequence: CTG
cagagctatcagaactttgg

SEQ ID NO: 43932 - DNA, 20 bp, Artificial Sequence
  Description of Artificial Sequence: Synthetic oligonucleotide
  Target: SCN10A; (-) strand; PAM type: YTN; PAM sequence: TTG
aagaactgcagagctatcag

SEQ ID NO: 43933 - DNA, 20 bp, Artificial Sequence
  Description of Artificial Sequence: Synthetic oligonucleotide
  Target: SCN10A; (-) strand; PAM type: YTN; PAM sequence: TTT
gaagaactgcagagctatca

SEQ ID NO: 43934 - DNA, 20 bp, Artificial Sequence
  Description of Artificial Sequence: Synthetic oligonucleotide
  Target: SCN10A; (-) strand; PAM type: YTN; PAM sequence: TTT
tgaagaactgcagagctatc

SEQ ID NO: 43935 - DNA, 20 bp, Artificial Sequence
  Description of Artificial Sequence: Synthetic oligonucleotide
  Target: SCN10A; (-) strand; PAM type: YTN; PAM sequence: TTT
ttgaagaactgcagagctat

SEQ ID NO: 43936 - DNA, 20 bp, Artificial Sequence
  Description of Artificial Sequence: Synthetic oligonucleotide
  Target: SCN10A; (-) strand; PAM type: YTN; PAM sequence: CTT
tttgaagaactgcagagcta

SEQ ID NO: 43937 - DNA, 20 bp, Artificial Sequence
  Description of Artificial Sequence: Synthetic oligonucleotide
  Target: SCN10A; (-) strand; PAM type: YTN; PAM sequence: CTC
atggacccataccagaaact

SEQ ID NO: 43938 - DNA, 20 bp, Artificial Sequence
  Description of Artificial Sequence: Synthetic oligonucleotide
  Target: SCN10A; (-) strand; PAM type: YTN; PAM sequence: CTA
gatctcatggacccatacca

SEQ ID NO: 43939 - DNA, 20 bp, Artificial Sequence
  Description of Artificial Sequence: Synthetic oligonucleotide
  Target: SCN10A; (-) strand; PAM type: YTN; PAM sequence: TTG
aagctagatctcatggaccc

SEQ ID NO: 43940 - DNA, 20 bp, Artificial Sequence
  Description of Artificial Sequence: Synthetic oligonucleotide
  Target: SCN10A; (-) strand; PAM type: YTN; PAM sequence: CTA
ttgaagctagatctcatgga

SEQ ID NO: 43941 - DNA, 20 bp, Artificial Sequence
  Description of Artificial Sequence: Synthetic oligonucleotide
  Target: SCN10A; (-) strand; PAM type: YTN; PAM sequence: CTC
agatatctattgaagctaga

SEQ ID NO: 43942 - DNA, 20 bp, Artificial Sequence
  Description of Artificial Sequence: Synthetic oligonucleotide
  Target: SCN10A; (-) strand; PAM type: YTN; PAM sequence: TTA
tatctcagatatctattgaa

SEQ ID NO: 43943 - DNA, 20 bp, Artificial Sequence
  Description of Artificial Sequence: Synthetic oligonucleotide
  Target: SCN10A; (-) strand; PAM type: YTN; PAM sequence: CTC
acaagtcagtcattatatct

SEQ ID NO: 43944 - DNA, 20 bp, Artificial Sequence
  Description of Artificial Sequence: Synthetic oligonucleotide
  Target: SCN10A; (-) strand; PAM type: YTN; PAM sequence: CTG
acagaccaaaaggggctcac

SEQ ID NO: 43945 - DNA, 20 bp, Artificial Sequence
  Description of Artificial Sequence: Synthetic oligonucleotide
  Target: SCN10A; (-) strand; PAM type: YTN; PAM sequence: TTA
aagaaaactgacagaccaaa

SEQ ID NO: 43946 - DNA, 20 bp, Artificial Sequence
  Description of Artificial Sequence: Synthetic oligonucleotide
  Target: SCN10A; (-) strand; PAM type: YTN; PAM sequence: CTT
aaagaaaactgacagaccaa

SEQ ID NO: 43947 - DNA, 20 bp, Artificial Sequence
  Description of Artificial Sequence: Synthetic oligonucleotide
  Target: SCN10A; (-) strand; PAM type: YTN; PAM sequence: TTG
gaccaccacttaaagaaaac

SEQ ID NO: 43948 - DNA, 20 bp, Artificial Sequence
  Description of Artificial Sequence: Synthetic oligonucleotide
  Target: SCN10A; (-) strand; PAM type: YTN; PAM sequence: TTT
ggaccaccacttaaagaaaa

SEQ ID NO: 43949 - DNA, 20 bp, Artificial Sequence
  Description of Artificial Sequence: Synthetic oligonucleotide
  Target: SCN10A; (-) strand; PAM type: YTN; PAM sequence: CTT
tggaccaccacttaaagaaa

SEQ ID NO: 43950 - DNA, 20 bp, Artificial Sequence
  Description of Artificial Sequence: Synthetic oligonucleotide
  Target: SCN10A; (-) strand; PAM type: YTN; PAM sequence: TTG
cagtctttggaccaccactt

SEQ ID NO: 43951 - DNA, 20 bp, Artificial Sequence
  Description of Artificial Sequence: Synthetic oligonucleotide
  Target: SCN10A; (-) strand; PAM type: YTN; PAM sequence: TTT
gcagtctttggaccaccact

SEQ ID NO: 43952 - DNA, 20 bp, Artificial Sequence
  Description of Artificial Sequence: Synthetic oligonucleotide
  Target: SCN10A; (-) strand; PAM type: YTN; PAM sequence: CTT
tgcagtctttggaccaccac

SEQ ID NO: 43953 - DNA, 20 bp, Artificial Sequence
  Description of Artificial Sequence: Synthetic oligonucleotide
  Target: SCN10A; (-) strand; PAM type: YTN; PAM sequence: CTG
tcctttgcagtctttggacc

SEQ ID NO: 43954 - DNA, 20 bp, Artificial Sequence
  Description of Artificial Sequence: Synthetic oligonucleotide
  Target: SCN10A; (-) strand; PAM type: YTN; PAM sequence: TTC
tgtcctttgcagtctttgga

SEQ ID NO: 43955 - DNA, 20 bp, Artificial Sequence
  Description of Artificial Sequence: Synthetic oligonucleotide
  Target: SCN10A; (-) strand; PAM type: YTN; PAM sequence: TTT
ctgtcctttgcagtctttgg

SEQ ID NO: 43956 - DNA, 20 bp, Artificial Sequence
  Description of Artificial Sequence: Synthetic oligonucleotide
  Target: SCN10A; (-) strand; PAM type: YTN; PAM sequence: TTC
atgtaagtttctgtcctttg

SEQ ID NO: 43957 - DNA, 20 bp, Artificial Sequence
  Description of Artificial Sequence: Synthetic oligonucleotide
  Target: SCN10A; (-) strand; PAM type: YTN; PAM sequence: TTT
catgtaagtttctgtccttt

SEQ ID NO: 43958 - DNA, 20 bp, Artificial Sequence
  Description of Artificial Sequence: Synthetic oligonucleotide
  Target: SCN10A; (-) strand; PAM type: YTN; PAM sequence: TTT
tcatgtaagtttctgtcctt

SEQ ID NO: 43959 - DNA, 20 bp, Artificial Sequence
  Description of Artificial Sequence: Synthetic oligonucleotide
  Target: SCN10A; (-) strand; PAM type: YTN; PAM sequence: TTT
ttcatgtaagtttctgtcct

SEQ ID NO: 43960 - DNA, 20 bp, Artificial Sequence
  Description of Artificial Sequence: Synthetic oligonucleotide
  Target: SCN10A; (-) strand; PAM type: YTN; PAM sequence: TTT
tttcatgtaagtttctgtcc

SEQ ID NO: 43961 - DNA, 20 bp, Artificial Sequence
  Description of Artificial Sequence: Synthetic oligonucleotide
  Target: SCN10A; (-) strand; PAM type: YTN; PAM sequence: CTT
ttttcatgtaagtttctgtc

SEQ ID NO: 43962 - DNA, 20 bp, Artificial Sequence
  Description of Artificial Sequence: Synthetic oligonucleotide
  Target: SCN10A; (-) strand; PAM type: YTN; PAM sequence: CTA
gcaggggaacttttttcatg

SEQ ID NO: 43963 - DNA, 20 bp, Artificial Sequence
  Description of Artificial Sequence: Synthetic oligonucleotide
  Target: SCN10A; (-) strand; PAM type: YTN; PAM sequence: TTC
ctagcaggggaacttttttc

SEQ ID NO: 43964 - DNA, 20 bp, Artificial Sequence
  Description of Artificial Sequence: Synthetic oligonucleotide
  Target: SCN10A; (-) strand; PAM type: YTN; PAM sequence: TTC
aaagttcctagcaggggaac

SEQ ID NO: 43965 - DNA, 20 bp, Artificial Sequence
  Description of Artificial Sequence: Synthetic oligonucleotide
  Target: SCN10A; (-) strand; PAM type: YTN; PAM sequence: CTT
caaagttcctagcaggggaa

SEQ ID NO: 43966 - DNA, 20 bp, Artificial Sequence
  Description of Artificial Sequence: Synthetic oligonucleotide
  Target: SCN10A; (-) strand; PAM type: YTN; PAM sequence: CTG
gcaccttcaaagttcctagc

SEQ ID NO: 43967 - DNA, 20 bp, Artificial Sequence
  Description of Artificial Sequence: Synthetic oligonucleotide
  Target: SCN10A; (-) strand; PAM type: YTN; PAM sequence: CTC
cctggcaccttcaaagttcc

SEQ ID NO: 43968 - DNA, 20 bp, Artificial Sequence
  Description of Artificial Sequence: Synthetic oligonucleotide
  Target: SCN10A; (-) strand; PAM type: YTN; PAM sequence: CTA
tgacatctccctggcacctt

SEQ ID NO: 43969 - DNA, 20 bp, Artificial Sequence
  Description of Artificial Sequence: Synthetic oligonucleotide
  Target: SCN10A; (-) strand; PAM type: YTN; PAM sequence: CTC
acaggacagggtcatagccc

SEQ ID NO: 43970 - DNA, 20 bp, Artificial Sequence
  Description of Artificial Sequence: Synthetic oligonucleotide
  Target: SCN10A; (-) strand; PAM type: YTN; PAM sequence: CTA
agatctcacaggacagggtc

SEQ ID NO: 43971 - DNA, 20 bp, Artificial Sequence
  Description of Artificial Sequence: Synthetic oligonucleotide
  Target: SCN10A; (-) strand; PAM type: YTN; PAM sequence: CTG
tggtgtggctaagatctcac

SEQ ID NO: 43972 - DNA, 20 bp, Artificial Sequence
  Description of Artificial Sequence: Synthetic oligonucleotide
  Target: SCN10A; (-) strand; PAM type: YTN; PAM sequence: TTC
agcccaccatctgtggtgtg

SEQ ID NO: 43973 - DNA, 20 bp, Artificial Sequence
  Description of Artificial Sequence: Synthetic oligonucleotide
  Target: SCN10A; (-) strand; PAM type: YTN; PAM sequence: CTG
aattcagcccaccatctgtg

SEQ ID NO: 43974 - DNA, 20 bp, Artificial Sequence
  Description of Artificial Sequence: Synthetic oligonucleotide
  Target: SCN10A; (-) strand; PAM type: YTN; PAM sequence: CTG
agcctgaattcagcccacca

SEQ ID NO: 43975 - DNA, 20 bp, Artificial Sequence
  Description of Artificial Sequence: Synthetic oligonucleotide
  Target: SCN10A; (-) strand; PAM type: YTN; PAM sequence: CTG
ccaggataagctgagcctga

SEQ ID NO: 43976 - DNA, 20 bp, Artificial Sequence
  Description of Artificial Sequence: Synthetic oligonucleotide
  Target: SCN10A; (-) strand; PAM type: YTN; PAM sequence: CTA
actgccaggataagctgagc

SEQ ID NO: 43977 - DNA, 20 bp, Artificial Sequence
  Description of Artificial Sequence: Synthetic oligonucleotide
  Target: SCN10A; (-) strand; PAM type: YTN; PAM sequence: CTG
tgtgcatcccacctaactgc

SEQ ID NO: 43978 - DNA, 20 bp, Artificial Sequence
  Description of Artificial Sequence: Synthetic oligonucleotide
  Target: SCN10A; (-) strand; PAM type: YTN; PAM sequence: CTC
ctgtgtgcatcccacctaac

SEQ ID NO: 43979 - DNA, 20 bp, Artificial Sequence
  Description of Artificial Sequence: Synthetic oligonucleotide
  Target: SCN10A; (-) strand; PAM type: YTN; PAM sequence: CTG
aagctcctgtgtgcatccca

SEQ ID NO: 43980 - DNA, 20 bp, Artificial Sequence
  Description of Artificial Sequence: Synthetic oligonucleotide
  Target: SCN10A; (-) strand; PAM type: YTN; PAM sequence: TTC
tgaagctcctgtgtgcatcc

SEQ ID NO: 43981 - DNA, 20 bp, Artificial Sequence
  Description of Artificial Sequence: Synthetic oligonucleotide
  Target: SCN10A; (-) strand; PAM type: YTN; PAM sequence: TTT
ctgaagctcctgtgtgcatc

SEQ ID NO: 43982 - DNA, 20 bp, Artificial Sequence
  Description of Artificial Sequence: Synthetic oligonucleotide
  Target: SCN10A; (-) strand; PAM type: YTN; PAM sequence: TTT
tctgaagctcctgtgtgcat

SEQ ID NO: 43983 - DNA, 20 bp, Artificial Sequence
  Description of Artificial Sequence: Synthetic oligonucleotide
  Target: SCN10A; (-) strand; PAM type: YTN; PAM sequence: CTT
ttctgaagctcctgtgtgca

SEQ ID NO: 43984 - DNA, 20 bp, Artificial Sequence
  Description of Artificial Sequence: Synthetic oligonucleotide
  Target: SCN10A; (-) strand; PAM type: YTN; PAM sequence: TTC
ttttctgaagctcctgtgtg

SEQ ID NO: 43985 - DNA, 20 bp, Artificial Sequence
  Description of Artificial Sequence: Synthetic oligonucleotide
  Target: SCN10A; (-) strand; PAM type: YTN; PAM sequence: CTT
cttttctgaagctcctgtgt

SEQ ID NO: 43986 - DNA, 20 bp, Artificial Sequence
  Description of Artificial Sequence: Synthetic oligonucleotide
  Target: SCN10A; (-) strand; PAM type: YTN; PAM sequence: CTC
aagtataaagcccttctttt

SEQ ID NO: 43987 - DNA, 20 bp, Artificial Sequence
  Description of Artificial Sequence: Synthetic oligonucleotide
  Target: SCN10A; (-) strand; PAM type: YTN; PAM sequence: CTG
ccactcaagtataaagccct

SEQ ID NO: 43988 - DNA, 20 bp, Artificial Sequence
  Description of Artificial Sequence: Synthetic oligonucleotide
  Target: SCN10A; (-) strand; PAM type: YTN; PAM sequence: CTC
tgccactcaagtataaagcc

SEQ ID NO: 43989 - DNA, 20 bp, Artificial Sequence
  Description of Artificial Sequence: Synthetic oligonucleotide
  Target: SCN10A; (-) strand; PAM type: YTN; PAM sequence: TTG
gggctctgccactcaagtat

SEQ ID NO: 43990 - DNA, 20 bp, Artificial Sequence
  Description of Artificial Sequence: Synthetic oligonucleotide
  Target: SCN10A; (-) strand; PAM type: YTN; PAM sequence: CTT
ggggctctgccactcaagta

SEQ ID NO: 43991 - DNA, 20 bp, Artificial Sequence
  Description of Artificial Sequence: Synthetic oligonucleotide
  Target: SCN10A; (-) strand; PAM type: YTN; PAM sequence: TTG
cttggggctctgccactcaa

SEQ ID NO: 43992 - DNA, 20 bp, Artificial Sequence
  Description of Artificial Sequence: Synthetic oligonucleotide
  Target: SCN10A; (-) strand; PAM type: YTN; PAM sequence: CTC
atccaaagaatggacattgc

SEQ ID NO: 43993 - DNA, 20 bp, Artificial Sequence
  Description of Artificial Sequence: Synthetic oligonucleotide
  Target: SCN10A; (-) strand; PAM type: YTN; PAM sequence: CTG
gtgcaataagccactcatcc

SEQ ID NO: 43994 - DNA, 20 bp, Artificial Sequence
  Description of Artificial Sequence: Synthetic oligonucleotide
  Target: SCN10A; (-) strand; PAM type: YTN; PAM sequence: TTG
tcctggtgcaataagccact

SEQ ID NO: 43995 - DNA, 20 bp, Artificial Sequence
  Description of Artificial Sequence: Synthetic oligonucleotide
  Target: SCN10A; (-) strand; PAM type: YTN; PAM sequence: TTT
gtcctggtgcaataagccac

SEQ ID NO: 43996 - DNA, 20 bp, Artificial Sequence
  Description of Artificial Sequence: Synthetic oligonucleotide
  Target: SCN10A; (-) strand; PAM type: YTN; PAM sequence: CTT
tgtcctggtgcaataagcca

SEQ ID NO: 43997 - DNA, 20 bp, Artificial Sequence
  Description of Artificial Sequence: Synthetic oligonucleotide
  Target: SCN10A; (-) strand; PAM type: YTN; PAM sequence: TTC
tttgtcctggtgcaataagc

SEQ ID NO: 43998 - DNA, 20 bp, Artificial Sequence
  Description of Artificial Sequence: Synthetic oligonucleotide
  Target: SCN10A; (-) strand; PAM type: YTN; PAM sequence: TTC
cggttctttgtcctggtgca

SEQ ID NO: 43999 - DNA, 20 bp, Artificial Sequence
  Description of Artificial Sequence: Synthetic oligonucleotide
  Target: SCN10A; (-) strand; PAM type: YTN; PAM sequence: TTC
cattccggttctttgtcctg

SEQ ID NO: 44000 - DNA, 20 bp, Artificial Sequence
  Description of Artificial Sequence: Synthetic oligonucleotide
  Target: SCN10A; (-) strand; PAM type: YTN; PAM sequence: CTT
ccattccggttctttgtcct

SEQ ID NO: 44001 - DNA, 20 bp, Artificial Sequence
  Description of Artificial Sequence: Synthetic oligonucleotide
  Target: SCN10A; (-) strand; PAM type: YTN; PAM sequence: TTG
catgaatgaaggaagagggt

SEQ ID NO: 44002 - DNA, 20 bp, Artificial Sequence
  Description of Artificial Sequence: Synthetic oligonucleotide
  Target: SCN10A; (-) strand; PAM type: YTN; PAM sequence: CTT
gcatgaatgaaggaagaggg

SEQ ID NO: 44003 - DNA, 20 bp, Artificial Sequence
  Description of Artificial Sequence: Synthetic oligonucleotide
  Target: SCN10A; (-) strand; PAM type: YTN; PAM sequence: CTG
gagccttgcatgaatgaagg

SEQ ID NO: 44004 - DNA, 20 bp, Artificial Sequence
  Description of Artificial Sequence: Synthetic oligonucleotide
  Target: SCN10A; (-) strand; PAM type: YTN; PAM sequence: CTG
atgtctggagccttgcatga

SEQ ID NO: 44005 - DNA, 20 bp, Artificial Sequence
  Description of Artificial Sequence: Synthetic oligonucleotide
  Target: SCN10A; (-) strand; PAM type: YTN; PAM sequence: CTG
ctgatgtctggagccttgca

SEQ ID NO: 44006 - DNA, 20 bp, Artificial Sequence
  Description of Artificial Sequence: Synthetic oligonucleotide
  Target: SCN10A; (-) strand; PAM type: YTN; PAM sequence: CTC
acctgctgatgtctggagcc

SEQ ID NO: 44007 - DNA, 20 bp, Artificial Sequence
  Description of Artificial Sequence: Synthetic oligonucleotide
  Target: SCN10A; (-) strand; PAM type: YTN; PAM sequence: CTG
ggtctcacctgctgatgtct

SEQ ID NO: 44008 - DNA, 20 bp, Artificial Sequence
  Description of Artificial Sequence: Synthetic oligonucleotide
  Target: SCN10A; (-) strand; PAM type: YTN; PAM sequence: CTC
atgcacccaggcagctgggt

SEQ ID NO: 44009 - DNA, 20 bp, Artificial Sequence
  Description of Artificial Sequence: Synthetic oligonucleotide
  Target: SCN10A; (-) strand; PAM type: YTN; PAM sequence: CTA
ccctcatgcacccaggcagc

SEQ ID NO: 44010 - DNA, 20 bp, Artificial Sequence
  Description of Artificial Sequence: Synthetic oligonucleotide
  Target: SCN10A; (-) strand; PAM type: YTN; PAM sequence: CTC
cctaccctcatgcacccagg

SEQ ID NO: 44011 - DNA, 20 bp, Artificial Sequence
  Description of Artificial Sequence: Synthetic oligonucleotide
  Target: SCN10A; (-) strand; PAM type: YTN; PAM sequence: CTG
gccccaaacctccctaccct

SEQ ID NO: 44012 - DNA, 20 bp, Artificial Sequence
  Description of Artificial Sequence: Synthetic oligonucleotide
  Target: SCN10A; (-) strand; PAM type: YTN; PAM sequence: TTC
agcatggaactggccccaaa

SEQ ID NO: 44013 - DNA, 20 bp, Artificial Sequence
  Description of Artificial Sequence: Synthetic oligonucleotide
  Target: SCN10A; (-) strand; PAM type: YTN; PAM sequence: CTG
aatagggttcagcatggaac

SEQ ID NO: 44014 - DNA, 20 bp, Artificial Sequence
  Description of Artificial Sequence: Synthetic oligonucleotide
  Target: SCN10A; (-) strand; PAM type: YTN; PAM sequence: CTG
agcaaaagactgaatagggt

SEQ ID NO: 44015 - DNA, 20 bp, Artificial Sequence
  Description of Artificial Sequence: Synthetic oligonucleotide
  Target: SCN10A; (-) strand; PAM type: YTN; PAM sequence: TTC
ccagggggctgagcaaaaga

SEQ ID NO: 44016 - DNA, 20 bp, Artificial Sequence
  Description of Artificial Sequence: Synthetic oligonucleotide
  Target: SCN10A; (-) strand; PAM type: YTN; PAM sequence: CTT
cccagggggctgagcaaaag

SEQ ID NO: 44017 - DNA, 20 bp, Artificial Sequence
  Description of Artificial Sequence: Synthetic oligonucleotide
  Target: SCN10A; (-) strand; PAM type: YTN; PAM sequence: TTA
tccatgtgaggcagacttcc

SEQ ID NO: 44018 - DNA, 20 bp, Artificial Sequence
  Description of Artificial Sequence: Synthetic oligonucleotide
  Target: SCN10A; (-) strand; PAM type: YTN; PAM sequence: CTG
cagattatccatgtgaggca

SEQ ID NO: 44019 - DNA, 20 bp, Artificial Sequence
  Description of Artificial Sequence: Synthetic oligonucleotide
  Target: SCN10A; (-) strand; PAM type: YTN; PAM sequence: CTG
ccccagctgcagattatcca

SEQ ID NO: 44020 - DNA, 20 bp, Artificial Sequence
  Description of Artificial Sequence: Synthetic oligonucleotide
  Target: SCN10A; (-) strand; PAM type: YTN; PAM sequence: CTG
tctgccccagctgcagatta

SEQ ID NO: 44021 - DNA, 20 bp, Artificial Sequence
  Description of Artificial Sequence: Synthetic oligonucleotide
  Target: SCN10A; (-) strand; PAM type: YTN; PAM sequence: CTG
gagaggcacagcacctgtct

SEQ ID NO: 44022 - DNA, 20 bp, Artificial Sequence
  Description of Artificial Sequence: Synthetic oligonucleotide
  Target: SCN10A; (-) strand; PAM type: YTN; PAM sequence: TTG
ctggagaggcacagcacctg

SEQ ID NO: 44023 - DNA, 20 bp, Artificial Sequence
  Description of Artificial Sequence: Synthetic oligonucleotide
  Target: SCN10A; (-) strand; PAM type: YTN; PAM sequence: TTT
gctggagaggcacagcacct

SEQ ID NO: 44024 - DNA, 20 bp, Artificial Sequence
  Description of Artificial Sequence: Synthetic oligonucleotide
  Target: SCN10A; (-) strand; PAM type: YTN; PAM sequence: CTT
tgctggagaggcacagcacc

SEQ ID NO: 44025 - DNA, 20 bp, Artificial Sequence
  Description of Artificial Sequence: Synthetic oligonucleotide
  Target: SCN10A; (-) strand; PAM type: YTN; PAM sequence: TTG
ggtggacagactttgctgga

SEQ ID NO: 44026 - DNA, 20 bp, Artificial Sequence
  Description of Artificial Sequence: Synthetic oligonucleotide
  Target: SCN10A; (-) strand; PAM type: YTN; PAM sequence: CTT
gggtggacagactttgctgg

SEQ ID NO: 44027 - DNA, 20 bp, Artificial Sequence
  Description of Artificial Sequence: Synthetic oligonucleotide
  Target: SCN10A; (-) strand; PAM type: YTN; PAM sequence: CTG
agcagtgggaatggaggtgg

SEQ ID NO: 44028 - DNA, 20 bp, Artificial Sequence
  Description of Artificial Sequence: Synthetic oligonucleotide
  Target: SCN10A; (-) strand; PAM type: YTN; PAM sequence: CTA
gtgggctgagcagtgggaat

SEQ ID NO: 44029 - DNA, 20 bp, Artificial Sequence
  Description of Artificial Sequence: Synthetic oligonucleotide
  Target: SCN10A; (-) strand; PAM type: YTN; PAM sequence: TTG
ggaggctagtgggctgagca

SEQ ID NO: 44030 - DNA, 20 bp, Artificial Sequence
  Description of Artificial Sequence: Synthetic oligonucleotide
  Target: SCN10A; (-) strand; PAM type: YTN; PAM sequence: CTT
gggaggctagtgggctgagc

SEQ ID NO: 44031 - DNA, 20 bp, Artificial Sequence
  Description of Artificial Sequence: Synthetic oligonucleotide
  Target: SCN10A; (-) strand; PAM type: YTN; PAM sequence: CTA
cttgggaggctagtgggctg

SEQ ID NO: 44032 - DNA, 20 bp, Artificial Sequence
  Description of Artificial Sequence: Synthetic oligonucleotide
  Target: SCN10A; (-) strand; PAM type: YTN; PAM sequence: CTG
gagactacttgggaggctag

SEQ ID NO: 44033 - DNA, 20 bp, Artificial Sequence
  Description of Artificial Sequence: Synthetic oligonucleotide
  Target: SCN10A; (-) strand; PAM type: YTN; PAM sequence: CTA
gggcctggagactacttggg

SEQ ID NO: 44034 - DNA, 20 bp, Artificial Sequence
  Description of Artificial Sequence: Synthetic oligonucleotide
  Target: SCN10A; (-) strand; PAM type: YTN; PAM sequence: TTG
cagtggagaatagatgcatg

SEQ ID NO: 44035 - DNA, 20 bp, Artificial Sequence
  Description of Artificial Sequence: Synthetic oligonucleotide
  Target: SCN10A; (-) strand; PAM type: YTN; PAM sequence: TTT
gcagtggagaatagatgcat

SEQ ID NO: 44036 - DNA, 20 bp, Artificial Sequence
  Description of Artificial Sequence: Synthetic oligonucleotide
  Target: SCN10A; (-) strand; PAM type: YTN; PAM sequence: TTG
ggagtaagagaaagacatga

SEQ ID NO: 44037 - DNA, 20 bp, Artificial Sequence
  Description of Artificial Sequence: Synthetic oligonucleotide
  Target: SCN10A; (-) strand; PAM type: YTN; PAM sequence: TTT
gggagtaagagaaagacatg

SEQ ID NO: 44038 - DNA, 20 bp, Artificial Sequence
  Description of Artificial Sequence: Synthetic oligonucleotide
  Target: SCN10A; (-) strand; PAM type: YTN; PAM sequence: CTG
agggtgataaagtaccagtg

SEQ ID NO: 44039 - DNA, 20 bp, Artificial Sequence
  Description of Artificial Sequence: Synthetic oligonucleotide
  Target: SCN10A; (-) strand; PAM type: YTN; PAM sequence: TTA
tcctgagggtgataaagtac

SEQ ID NO: 44040 - DNA, 20 bp, Artificial Sequence
  Description of Artificial Sequence: Synthetic oligonucleotide
  Target: SCN10A; (-) strand; PAM type: YTN; PAM sequence: TTT
atcctgagggtgataaagta

SEQ ID NO: 44041 - DNA, 20 bp, Artificial Sequence
  Description of Artificial Sequence: Synthetic oligonucleotide
  Target: SCN10A; (-) strand; PAM type: YTN; PAM sequence: CTA
cagagtatggagtttatcct

SEQ ID NO: 44042 - DNA, 20 bp, Artificial Sequence
  Description of Artificial Sequence: Synthetic oligonucleotide
  Target: SCN10A; (-) strand; PAM type: YTN; PAM sequence: TTG
tgaccatatgacacaggcta

SEQ ID NO: 44043 - DNA, 20 bp, Artificial Sequence
  Description of Artificial Sequence: Synthetic oligonucleotide
  Target: SCN10A; (-) strand; PAM type: YTN; PAM sequence: CTG
gaaaagtaggttgtgaccat

SEQ ID NO: 44044 - DNA, 20 bp, Artificial Sequence
  Description of Artificial Sequence: Synthetic oligonucleotide
  Target: SCN10A; (-) strand; PAM type: YTN; PAM sequence: TTG
ggtagaatgtgtgggtgaaa

SEQ ID NO: 44045 - DNA, 20 bp, Artificial Sequence
  Description of Artificial Sequence: Synthetic oligonucleotide
  Target: SCN10A; (-) strand; PAM type: YTN; PAM sequence: TTT
gggtagaatgtgtgggtgaa

SEQ ID NO: 44046 - DNA, 20 bp, Artificial Sequence
  Description of Artificial Sequence: Synthetic oligonucleotide
  Target: SCN10A; (-) strand; PAM type: YTN; PAM sequence: TTG
atttgggtagaatgtgtggg

SEQ ID NO: 44047 - DNA, 20 bp, Artificial Sequence
  Description of Artificial Sequence: Synthetic oligonucleotide
  Target: SCN10A; (-) strand; PAM type: YTN; PAM sequence: TTT
gatttgggtagaatgtgtgg

SEQ ID NO: 44048 - DNA, 20 bp, Artificial Sequence
  Description of Artificial Sequence: Synthetic oligonucleotide
  Target: SCN10A; (-) strand; PAM type: YTN; PAM sequence: CTC
agggaacaatttgatttggg

SEQ ID NO: 44049 - DNA, 20 bp, Artificial Sequence
  Description of Artificial Sequence: Synthetic oligonucleotide
  Target: SCN10A; (-) strand; PAM type: YTN; PAM sequence: TTG
aacaaaggcacagacacaag

SEQ ID NO: 44050 - DNA, 20 bp, Artificial Sequence
  Description of Artificial Sequence: Synthetic oligonucleotide
  Target: SCN10A; (-) strand; PAM type: YTN; PAM sequence: CTT
gaacaaaggcacagacacaa

SEQ ID NO: 44051 - DNA, 20 bp, Artificial Sequence
  Description of Artificial Sequence: Synthetic oligonucleotide
  Target: SCN10A; (-) strand; PAM type: YTN; PAM sequence: CTG
accttgaacaaaggcacaga

SEQ ID NO: 44052 - DNA, 20 bp, Artificial Sequence
  Description of Artificial Sequence: Synthetic oligonucleotide
  Target: SCN10A; (-) strand; PAM type: YTN; PAM sequence: CTA
aaggctgaccttgaacaaag

SEQ ID NO: 44053 - DNA, 20 bp, Artificial Sequence
  Description of Artificial Sequence: Synthetic oligonucleotide
  Target: SCN10A; (-) strand; PAM type: YTN; PAM sequence: TTA
gctaaaggctgaccttgaac

SEQ ID NO: 44054 - DNA, 20 bp, Artificial Sequence
  Description of Artificial Sequence: Synthetic oligonucleotide
  Target: SCN10A; (-) strand; PAM type: YTN; PAM sequence: CTT
agctaaaggctgaccttgaa

SEQ ID NO: 44055 - DNA, 20 bp, Artificial Sequence
  Description of Artificial Sequence: Synthetic oligonucleotide
  Target: SCN10A; (-) strand; PAM type: YTN; PAM sequence: CTG
gggaaggcccgtcttagcta

SEQ ID NO: 44056 - DNA, 20 bp, Artificial Sequence
  Description of Artificial Sequence: Synthetic oligonucleotide
  Target: SCN10A; (-) strand; PAM type: YTN; PAM sequence: CTG
cgagaggactggggaaggcc

SEQ ID NO: 44057 - DNA, 20 bp, Artificial Sequence
  Description of Artificial Sequence: Synthetic oligonucleotide
  Target: SCN10A; (-) strand; PAM type: YTN; PAM sequence: TTA
gatgtggggcatagaaatga

SEQ ID NO: 44058 - DNA, 20 bp, Artificial Sequence
  Description of Artificial Sequence: Synthetic oligonucleotide
  Target: SCN10A; (-) strand; PAM type: YTN; PAM sequence: CTA
tgggaggtggcattagatgt

SEQ ID NO: 44059 - DNA, 20 bp, Artificial Sequence
  Description of Artificial Sequence: Synthetic oligonucleotide
  Target: SCN10A; (-) strand; PAM type: YTN; PAM sequence: TTC
ctatgggaggtggcattaga

SEQ ID NO: 44060 - DNA, 20 bp, Artificial Sequence
  Description of Artificial Sequence: Synthetic oligonucleotide
  Target: SCN10A; (-) strand; PAM type: YTN; PAM sequence: CTT
cctatgggaggtggcattag

SEQ ID NO: 44061 - DNA, 20 bp, Artificial Sequence
  Description of Artificial Sequence: Synthetic oligonucleotide
  Target: SCN10A; (-) strand; PAM type: YTN; PAM sequence: TTC
ttcctatgggaggtggcatt

SEQ ID NO: 44062 - DNA, 20 bp, Artificial Sequence
  Description of Artificial Sequence: Synthetic oligonucleotide
  Target: SCN10A; (-) strand; PAM type: YTN; PAM sequence: TTG
agaattcttcctatgggagg

SEQ ID NO: 44063 - DNA, 20 bp, Artificial Sequence
  Description of Artificial Sequence: Synthetic oligonucleotide
  Target: SCN10A; (-) strand; PAM type: YTN; PAM sequence: TTG
gggtggggtggttgagaatt

SEQ ID NO: 44064 - DNA, 20 bp, Artificial Sequence
  Description of Artificial Sequence: Synthetic oligonucleotide
  Target: SCN10A; (-) strand; PAM type: YTN; PAM sequence: CTT
ggggtggggtggttgagaat

SEQ ID NO: 44065 - DNA, 20 bp, Artificial Sequence
  Description of Artificial Sequence: Synthetic oligonucleotide
  Target: SCN10A; (-) strand; PAM type: YTN; PAM sequence: CTC
ttggggtggggtggttgaga

SEQ ID NO: 44066 - DNA, 20 bp, Artificial Sequence
  Description of Artificial Sequence: Synthetic oligonucleotide
  Target: SCN10A; (-) strand; PAM type: YTN; PAM sequence: TTC
cactcttggggtggggtggt

SEQ ID NO: 44067 - DNA, 20 bp, Artificial Sequence
  Description of Artificial Sequence: Synthetic oligonucleotide
  Target: SCN10A; (-) strand; PAM type: YTN; PAM sequence: CTT
ccactcttggggtggggtgg

SEQ ID NO: 44068 - DNA, 20 bp, Artificial Sequence
  Description of Artificial Sequence: Synthetic oligonucleotide
  Target: SCN10A; (-) strand; PAM type: YTN; PAM sequence: TTC
ttccactcttggggtggggt

SEQ ID NO: 44069 - DNA, 20 bp, Artificial Sequence
  Description of Artificial Sequence: Synthetic oligonucleotide
  Target: SCN10A; (-) strand; PAM type: YTN; PAM sequence: CTT
cttccactcttggggtgggg

SEQ ID NO: 44070 - DNA, 20 bp, Artificial Sequence
  Description of Artificial Sequence: Synthetic oligonucleotide
  Target: SCN10A; (-) strand; PAM type: YTN; PAM sequence: TTG
gagacacagagacatgagcc

SEQ ID NO: 44071 - DNA, 20 bp, Artificial Sequence
  Description of Artificial Sequence: Synthetic oligonucleotide
  Target: SCN10A; (-) strand; PAM type: YTN; PAM sequence: CTT
ggagacacagagacatgagc

SEQ ID NO: 44072 - DNA, 20 bp, Artificial Sequence
  Description of Artificial Sequence: Synthetic oligonucleotide
  Target: SCN10A; (-) strand; PAM type: YTN; PAM sequence: TTA
gtatcttggagacacagaga

SEQ ID NO: 44073 - DNA, 20 bp, Artificial Sequence
  Description of Artificial Sequence: Synthetic oligonucleotide
  Target: SCN10A; (-) strand; PAM type: YTN; PAM sequence: CTG
ggggcaattagtatcttgga

SEQ ID NO: 44074 - DNA, 20 bp, Artificial Sequence
  Description of Artificial Sequence: Synthetic oligonucleotide
  Target: SCN10A; (-) strand; PAM type: YTN; PAM sequence: CTG
ctgggggcaattagtatctt

SEQ ID NO: 44075 - DNA, 20 bp, Artificial Sequence
  Description of Artificial Sequence: Synthetic oligonucleotide
  Target: SCN10A; (-) strand; PAM type: YTN; PAM sequence: TTG
agcactgctgggggcaatta

SEQ ID NO: 44076 - DNA, 20 bp, Artificial Sequence
  Description of Artificial Sequence: Synthetic oligonucleotide
  Target: SCN10A; (-) strand; PAM type: YTN; PAM sequence: TTA
taagggtgaatgtgttgagc

SEQ ID NO: 44077 - DNA, 20 bp, Artificial Sequence
  Description of Artificial Sequence: Synthetic oligonucleotide
  Target: SCN10A; (-) strand; PAM type: YTN; PAM sequence: TTC
agcagacaagacacacatgg

SEQ ID NO: 44078 - DNA, 20 bp, Artificial Sequence
  Description of Artificial Sequence: Synthetic oligonucleotide
  Target: SCN10A; (-) strand; PAM type: YTN; PAM sequence: TTT
cagcagacaagacacacatg

SEQ ID NO: 44079 - DNA, 20 bp, Artificial Sequence
  Description of Artificial Sequence: Synthetic oligonucleotide
  Target: SCN10A; (-) strand; PAM type: YTN; PAM sequence: CTT
tcagcagacaagacacacat

SEQ ID NO: 44080 - DNA, 20 bp, Artificial Sequence
  Description of Artificial Sequence: Synthetic oligonucleotide
  Target: SCN10A; (-) strand; PAM type: YTN; PAM sequence: TTA
gtctttcagcagacaagaca

SEQ ID NO: 44081 - DNA, 20 bp, Artificial Sequence
  Description of Artificial Sequence: Synthetic oligonucleotide
  Target: SCN10A; (-) strand; PAM type: YTN; PAM sequence: TTT
agtctttcagcagacaagac

SEQ ID NO: 44082 - DNA, 20 bp, Artificial Sequence
  Description of Artificial Sequence: Synthetic oligonucleotide
  Target: SCN10A; (-) strand; PAM type: YTN; PAM sequence: CTT
tagtctttcagcagacaaga

SEQ ID NO: 44083 - DNA, 20 bp, Artificial Sequence
  Description of Artificial Sequence: Synthetic oligonucleotide
  Target: SCN10A; (-) strand; PAM type: YTN; PAM sequence: TTA
cactttagtctttcagcaga

SEQ ID NO: 44084 - DNA, 20 bp, Artificial Sequence
  Description of Artificial Sequence: Synthetic oligonucleotide
  Target: SCN10A; (-) strand; PAM type: YTN; PAM sequence: CTT
acactttagtctttcagcag

SEQ ID NO: 44085 - DNA, 20 bp, Artificial Sequence
  Description of Artificial Sequence: Synthetic oligonucleotide
  Target: SCN10A; (-) strand; PAM type: YTN; PAM sequence: CTC
caggatcttacactttagtc

SEQ ID NO: 44086 - DNA, 20 bp, Artificial Sequence
  Description of Artificial Sequence: Synthetic oligonucleotide
  Target: SCN10A; (-) strand; PAM type: YTN; PAM sequence: CTA
tctccaggatcttacacttt

SEQ ID NO: 44087 - DNA, 20 bp, Artificial Sequence
  Description of Artificial Sequence: Synthetic oligonucleotide
  Target: SCN10A; (-) strand; PAM type: YTN; PAM sequence: CTC
actatctccaggatcttaca

SEQ ID NO: 44088 - DNA, 20 bp, Artificial Sequence
  Description of Artificial Sequence: Synthetic oligonucleotide
  Target: SCN10A; (-) strand; PAM type: YTN; PAM sequence: TTG
taagaaacagaagcacagaa

SEQ ID NO: 44089 - DNA, 20 bp, Artificial Sequence
  Description of Artificial Sequence: Synthetic oligonucleotide
  Target: SCN10A; (-) strand; PAM type: YTN; PAM sequence: TTT
gtaagaaacagaagcacaga

SEQ ID NO: 44090 - DNA, 20 bp, Artificial Sequence
  Description of Artificial Sequence: Synthetic oligonucleotide
  Target: SCN10A; (-) strand; PAM type: YTN; PAM sequence: CTT
tgtaagaaacagaagcacag

SEQ ID NO: 44091 - DNA, 20 bp, Artificial Sequence
  Description of Artificial Sequence: Synthetic oligonucleotide
  Target: SCN10A; (-) strand; PAM type: YTN; PAM sequence: TTA
tgaagtgctttgtaagaaac

SEQ ID NO: 44092 - DNA, 20 bp, Artificial Sequence
  Description of Artificial Sequence: Synthetic oligonucleotide
  Target: SCN10A; (-) strand; PAM type: YTN; PAM sequence: CTT
atgaagtgctttgtaagaaa

SEQ ID NO: 44093 - DNA, 20 bp, Artificial Sequence
  Description of Artificial Sequence: Synthetic oligonucleotide
  Target: SCN10A; (-) strand; PAM type: YTN; PAM sequence: TTG
tcttatgaagtgctttgtaa

SEQ ID NO: 44094 - DNA, 20 bp, Artificial Sequence
  Description of Artificial Sequence: Synthetic oligonucleotide
  Target: SCN10A; (-) strand; PAM type: YTN; PAM sequence: TTG
aatacaggattgtcttatga

SEQ ID NO: 44095 - DNA, 20 bp, Artificial Sequence
  Description of Artificial Sequence: Synthetic oligonucleotide
  Target: SCN10A; (-) strand; PAM type: YTN; PAM sequence: CTA
ttgaatacaggattgtctta

SEQ ID NO: 44096 - DNA, 20 bp, Artificial Sequence
  Description of Artificial Sequence: Synthetic oligonucleotide
  Target: SCN10A; (-) strand; PAM type: YTN; PAM sequence: CTA
actattgaatacaggattgt

SEQ ID NO: 44097 - DNA, 20 bp, Artificial Sequence
  Description of Artificial Sequence: Synthetic oligonucleotide
  Target: SCN10A; (-) strand; PAM type: YTN; PAM sequence: CTA
tacatctaactattgaatac

SEQ ID NO: 44098 - DNA, 20 bp, Artificial Sequence
  Description of Artificial Sequence: Synthetic oligonucleotide
  Target: SCN10A; (-) strand; PAM type: YTN; PAM sequence: TTG
ctatacatctaactattgaa

SEQ ID NO: 44099 - DNA, 20 bp, Artificial Sequence
  Description of Artificial Sequence: Synthetic oligonucleotide
  Target: SCN10A; (-) strand; PAM type: YTN; PAM sequence: TTT
gctatacatctaactattga

SEQ ID NO: 44100 - DNA, 20 bp, Artificial Sequence
  Description of Artificial Sequence: Synthetic oligonucleotide
  Target: SCN10A; (-) strand; PAM type: YTN; PAM sequence: TTC
catttgctatacatctaact

SEQ ID NO: 44101 - DNA, 20 bp, Artificial Sequence
  Description of Artificial Sequence: Synthetic oligonucleotide
  Target: SCN10A; (-) strand; PAM type: YTN; PAM sequence: CTT
ccatttgctatacatctaac

SEQ ID NO: 44102 - DNA, 20 bp, Artificial Sequence
  Description of Artificial Sequence: Synthetic oligonucleotide
  Target: SCN10A; (-) strand; PAM type: YTN; PAM sequence: TTC
ttccatttgctatacatcta

SEQ ID NO: 44103 - DNA, 20 bp, Artificial Sequence
  Description of Artificial Sequence: Synthetic oligonucleotide
  Target: SCN10A; (-) strand; PAM type: YTN; PAM sequence: TTT
cttccatttgctatacatct

SEQ ID NO: 44104 - DNA, 20 bp, Artificial Sequence
  Description of Artificial Sequence: Synthetic oligonucleotide
  Target: SCN10A; (-) strand; PAM type: YTN; PAM sequence: TTT
tcttccatttgctatacatc

SEQ ID NO: 44105 - DNA, 20 bp, Artificial Sequence
  Description of Artificial Sequence: Synthetic oligonucleotide
  Target: SCN10A; (-) strand; PAM type: YTN; PAM sequence: TTT
ttcttccatttgctatacat

SEQ ID NO: 44106 - DNA, 20 bp, Artificial Sequence
  Description of Artificial Sequence: Synthetic oligonucleotide
  Target: SCN10A; (-) strand; PAM type: YTN; PAM sequence: CTA
tttttcttccatttgctata

SEQ ID NO: 44107 - DNA, 20 bp, Artificial Sequence
  Description of Artificial Sequence: Synthetic oligonucleotide
  Target: SCN10A; (-) strand; PAM type: YTN; PAM sequence: CTA
gccatcccaatgatcctatt

SEQ ID NO: 44108 - DNA, 20 bp, Artificial Sequence
  Description of Artificial Sequence: Synthetic oligonucleotide
  Target: SCN10A; (-) strand; PAM type: YTN; PAM sequence: TTC
tagccatcccaatgatccta

SEQ ID NO: 44109 - DNA, 20 bp, Artificial Sequence
  Description of Artificial Sequence: Synthetic oligonucleotide
  Target: SCN10A; (-) strand; PAM type: YTN; PAM sequence: CTT
ctagccatcccaatgatcct

SEQ ID NO: 44110 - DNA, 20 bp, Artificial Sequence
  Description of Artificial Sequence: Synthetic oligonucleotide
  Target: SCN10A; (-) strand; PAM type: YTN; PAM sequence: TTC
cttctagccatcccaatgat

SEQ ID NO: 44111 - DNA, 20 bp, Artificial Sequence
  Description of Artificial Sequence: Synthetic oligonucleotide
  Target: SCN10A; (-) strand; PAM type: YTN; PAM sequence: TTT
ccttctagccatcccaatga

SEQ ID NO: 44112 - DNA, 20 bp, Artificial Sequence
  Description of Artificial Sequence: Synthetic oligonucleotide
  Target: SCN10A; (-) strand; PAM type: YTN; PAM sequence: CTT
tccttctagccatcccaatg

SEQ ID NO: 44113 - DNA, 20 bp, Artificial Sequence
  Description of Artificial Sequence: Synthetic oligonucleotide
  Target: SCN10A; (-) strand; PAM type: YTN; PAM sequence: TTC
tttccttctagccatcccaa

SEQ ID NO: 44114 - DNA, 20 bp, Artificial Sequence
  Description of Artificial Sequence: Synthetic oligonucleotide
  Target: SCN10A; (-) strand; PAM type: YTN; PAM sequence: TTT
ctttccttctagccatccca

SEQ ID NO: 44115 - DNA, 20 bp, Artificial Sequence
  Description of Artificial Sequence: Synthetic oligonucleotide
  Target: SCN10A; (-) strand; PAM type: YTN; PAM sequence: CTT
tctttccttctagccatccc

SEQ ID NO: 44116 - DNA, 20 bp, Artificial Sequence
  Description of Artificial Sequence: Synthetic oligonucleotide
  Target: SCN10A; (-) strand; PAM type: YTN; PAM sequence: TTC
tttctttccttctagccatc

SEQ ID NO: 44117 - DNA, 20 bp, Artificial Sequence
  Description of Artificial Sequence: Synthetic oligonucleotide
  Target: SCN10A; (-) strand; PAM type: YTN; PAM sequence: TTT
ctttctttccttctagccat

SEQ ID NO: 44118 - DNA, 20 bp, Artificial Sequence
  Description of Artificial Sequence: Synthetic oligonucleotide
  Target: SCN10A; (-) strand; PAM type: YTN; PAM sequence: CTT
tctttctttccttctagcca

SEQ ID NO: 44119 - DNA, 20 bp, Artificial Sequence
  Description of Artificial Sequence: Synthetic oligonucleotide
  Target: SCN10A; (-) strand; PAM type: YTN; PAM sequence: TTC
tttctttctttccttctagc

SEQ ID NO: 44120 - DNA, 20 bp, Artificial Sequence
  Description of Artificial Sequence: Synthetic oligonucleotide
  Target: SCN10A; (-) strand; PAM type: YTN; PAM sequence: CTT
ctttctttctttccttctag

SEQ ID NO: 44121 - DNA, 20 bp, Artificial Sequence
  Description of Artificial Sequence: Synthetic oligonucleotide
  Target: SCN10A; (-) strand; PAM type: YTN; PAM sequence: CTG
tacttctttctttctttcct

SEQ ID NO: 44122 - DNA, 20 bp, Artificial Sequence
  Description of Artificial Sequence: Synthetic oligonucleotide
  Target: SCN10A; (-) strand; PAM type: YTN; PAM sequence: TTC
atccagctgtacttctttct

SEQ ID NO: 44123 - DNA, 20 bp, Artificial Sequence
  Description of Artificial Sequence: Synthetic oligonucleotide
  Target: SCN10A; (-) strand; PAM type: YTN; PAM sequence: TTT
catccagctgtacttctttc

SEQ ID NO: 44124 - DNA, 20 bp, Artificial Sequence
  Description of Artificial Sequence: Synthetic oligonucleotide
  Target: SCN10A; (-) strand; PAM type: YTN; PAM sequence: TTT
tcatccagctgtacttcttt

SEQ ID NO: 44125 - DNA, 20 bp, Artificial Sequence
  Description of Artificial Sequence: Synthetic oligonucleotide
  Target: SCN10A; (-) strand; PAM type: YTN; PAM sequence: CTT
ttcatccagctgtacttctt

SEQ ID NO: 44126 - DNA, 20 bp, Artificial Sequence
  Description of Artificial Sequence: Synthetic oligonucleotide
  Target: SCN10A; (-) strand; PAM type: YTN; PAM sequence: TTC
aacttttcatccagctgtac

SEQ ID NO: 44127 - DNA, 20 bp, Artificial Sequence
  Description of Artificial Sequence: Synthetic oligonucleotide
  Target: SCN10A; (-) strand; PAM type: YTN; PAM sequence: CTT
caacttttcatccagctgta

SEQ ID NO: 44128 - DNA, 20 bp, Artificial Sequence
  Description of Artificial Sequence: Synthetic oligonucleotide
  Target: SCN10A; (-) strand; PAM type: YTN; PAM sequence: CTA
tgcaatcacccttcaacttt

SEQ ID NO: 44129 - DNA, 20 bp, Artificial Sequence
  Description of Artificial Sequence: Synthetic oligonucleotide
  Target: SCN10A; (-) strand; PAM type: YTN; PAM sequence: CTC
tatgcaatcacccttcaact

SEQ ID NO: 44130 - DNA, 20 bp, Artificial Sequence
  Description of Artificial Sequence: Synthetic oligonucleotide
  Target: SCN10A; (-) strand; PAM type: YTN; PAM sequence: TTC
atccctctatgcaatcaccc

SEQ ID NO: 44131 - DNA, 20 bp, Artificial Sequence
  Description of Artificial Sequence: Synthetic oligonucleotide
  Target: SCN10A; (-) strand; PAM type: YTN; PAM sequence: TTA
attcatccctctatgcaatc

SEQ ID NO: 44132 - DNA, 20 bp, Artificial Sequence
  Description of Artificial Sequence: Synthetic oligonucleotide
  Target: SCN10A; (-) strand; PAM type: YTN; PAM sequence: TTT
aattcatccctctatgcaat

SEQ ID NO: 44133 - DNA, 20 bp, Artificial Sequence
  Description of Artificial Sequence: Synthetic oligonucleotide
  Target: SCN10A; (-) strand; PAM type: YTN; PAM sequence: CTT
taattcatccctctatgcaa

SEQ ID NO: 44134 - DNA, 20 bp, Artificial Sequence
  Description of Artificial Sequence: Synthetic oligonucleotide
  Target: SCN10A; (-) strand; PAM type: YTN; PAM sequence: TTG
tatcctttaattcatccctc

SEQ ID NO: 44135 - DNA, 20 bp, Artificial Sequence
  Description of Artificial Sequence: Synthetic oligonucleotide
  Target: SCN10A; (-) strand; PAM type: YTN; PAM sequence: TTA
tcattgtatcctttaattca

SEQ ID NO: 44136 - DNA, 20 bp, Artificial Sequence
  Description of Artificial Sequence: Synthetic oligonucleotide
  Target: SCN10A; (-) strand; PAM type: YTN; PAM sequence: TTT
atcattgtatcctttaattc

SEQ ID NO: 44137 - DNA, 20 bp, Artificial Sequence
  Description of Artificial Sequence: Synthetic oligonucleotide
  Target: SCN10A; (-) strand; PAM type: YTN; PAM sequence: CTA
tttatcattgtatcctttaa

SEQ ID NO: 44138 - DNA, 20 bp, Artificial Sequence
  Description of Artificial Sequence: Synthetic oligonucleotide
  Target: SCN10A; (-) strand; PAM type: YTN; PAM sequence: CTA
tcctatttatcattgtatcc

SEQ ID NO: 44139 - DNA, 20 bp, Artificial Sequence
  Description of Artificial Sequence: Synthetic oligonucleotide
  Target: SCN10A; (-) strand; PAM type: YTN; PAM sequence: TTA
aatctatcctatttatcatt

SEQ ID NO: 44140 - DNA, 20 bp, Artificial Sequence
  Description of Artificial Sequence: Synthetic oligonucleotide
  Target: SCN10A; (-) strand; PAM type: YTN; PAM sequence: TTA
tacattaaatctatcctatt

SEQ ID NO: 44141 - DNA, 20 bp, Artificial Sequence
  Description of Artificial Sequence: Synthetic oligonucleotide
  Target: SCN10A; (-) strand; PAM type: YTN; PAM sequence: TTC
atgttatacattaaatctat

SEQ ID NO: 44142 - DNA, 20 bp, Artificial Sequence
  Description of Artificial Sequence: Synthetic oligonucleotide
  Target: SCN10A; (-) strand; PAM type: YTN; PAM sequence: CTA
tagtattcatgttatacatt

SEQ ID NO: 44143 - DNA, 20 bp, Artificial Sequence
  Description of Artificial Sequence: Synthetic oligonucleotide
  Target: SCN10A; (-) strand; PAM type: YTN; PAM sequence: TTA
actatagtattcatgttata

SEQ ID NO: 44144 - DNA, 20 bp, Artificial Sequence
  Description of Artificial Sequence: Synthetic oligonucleotide
  Target: SCN10A; (-) strand; PAM type: YTN; PAM sequence: TTA
ttaactatagtattcatgtt

SEQ ID NO: 44145 - DNA, 20 bp, Artificial Sequence
  Description of Artificial Sequence: Synthetic oligonucleotide
  Target: SCN10A; (-) strand; PAM type: YTN; PAM sequence: CTA
ttattaactatagtattcat

SEQ ID NO: 44146 - DNA, 20 bp, Artificial Sequence
  Description of Artificial Sequence: Synthetic oligonucleotide
  Target: SCN10A; (-) strand; PAM type: YTN; PAM sequence: CTG
aaaacaatatgctattatta

SEQ ID NO: 44147 - DNA, 20 bp, Artificial Sequence
  Description of Artificial Sequence: Synthetic oligonucleotide
  Target: SCN10A; (-) strand; PAM type: YTN; PAM sequence: CTC
agcgagcaaaaatactgaaa

SEQ ID NO: 44148 - DNA, 20 bp, Artificial Sequence
  Description of Artificial Sequence: Synthetic oligonucleotide
  Target: SCN10A; (-) strand; PAM type: YTN; PAM sequence: TTA
ctcagcgagcaaaaatactg

SEQ ID NO: 44149 - DNA, 20 bp, Artificial Sequence
  Description of Artificial Sequence: Synthetic oligonucleotide
  Target: SCN10A; (-) strand; PAM type: YTN; PAM sequence: CTA
taattactcagcgagcaaaa

SEQ ID NO: 44150 - DNA, 20 bp, Artificial Sequence
  Description of Artificial Sequence: Synthetic oligonucleotide
  Target: SCN10A; (-) strand; PAM type: YTN; PAM sequence: CTG
tggcaagagcagctataatt

SEQ ID NO: 44151 - DNA, 20 bp, Artificial Sequence
  Description of Artificial Sequence: Synthetic oligonucleotide
  Target: SCN10A; (-) strand; PAM type: YTN; PAM sequence: CTC
cccctgtggcaagagcagct

SEQ ID NO: 44152 - DNA, 20 bp, Artificial Sequence
  Description of Artificial Sequence: Synthetic oligonucleotide
  Target: SCN10A; (-) strand; PAM type: YTN; PAM sequence: TTC
tccccctgtggcaagagcag

SEQ ID NO: 44153 - DNA, 20 bp, Artificial Sequence
  Description of Artificial Sequence: Synthetic oligonucleotide
  Target: SCN10A; (-) strand; PAM type: YTN; PAM sequence: TTT
ctccccctgtggcaagagca

SEQ ID NO: 44154 - DNA, 20 bp, Artificial Sequence
  Description of Artificial Sequence: Synthetic oligonucleotide
  Target: SCN10A; (-) strand; PAM type: YTN; PAM sequence: TTA
cccatttctccccctgtggc

SEQ ID NO: 44155 - DNA, 20 bp, Artificial Sequence
  Description of Artificial Sequence: Synthetic oligonucleotide
  Target: SCN10A; (-) strand; PAM type: YTN; PAM sequence: CTC
acatagttacccatttctcc

SEQ ID NO: 44156 - DNA, 20 bp, Artificial Sequence
  Description of Artificial Sequence: Synthetic oligonucleotide
  Target: SCN10A; (-) strand; PAM type: YTN; PAM sequence: TTA
acatatccatcatctcacat

SEQ ID NO: 44157 - DNA, 20 bp, Artificial Sequence
  Description of Artificial Sequence: Synthetic oligonucleotide
  Target: SCN10A; (-) strand; PAM type: YTN; PAM sequence: CTA
tagtggaacatattaacata

SEQ ID NO: 44158 - DNA, 20 bp, Artificial Sequence
  Description of Artificial Sequence: Synthetic oligonucleotide
  Target: SCN10A; (-) strand; PAM type: YTN; PAM sequence: TTA
ctatagtggaacatattaac

SEQ ID NO: 44159 - DNA, 20 bp, Artificial Sequence
  Description of Artificial Sequence: Synthetic oligonucleotide
  Target: SCN10A; (-) strand; PAM type: YTN; PAM sequence: TTA
taagatatatatatatataa

SEQ ID NO: 44160 - DNA, 20 bp, Artificial Sequence
  Description of Artificial Sequence: Synthetic oligonucleotide
  Target: SCN10A; (-) strand; PAM type: YTN; PAM sequence: TTA
agggatacaaaatgatgtta

SEQ ID NO: 44161 - DNA, 20 bp, Artificial Sequence
  Description of Artificial Sequence: Synthetic oligonucleotide
  Target: SCN10A; (-) strand; PAM type: YTN; PAM sequence: TTT
aagggatacaaaatgatgtt

SEQ ID NO: 44162 - DNA, 20 bp, Artificial Sequence
  Description of Artificial Sequence: Synthetic oligonucleotide
  Target: SCN10A; (-) strand; PAM type: YTN; PAM sequence: TTT
taagggatacaaaatgatgt

SEQ ID NO: 44163 - DNA, 20 bp, Artificial Sequence
  Description of Artificial Sequence: Synthetic oligonucleotide
  Target: SCN10A; (-) strand; PAM type: YTN; PAM sequence: TTT
ttaagggatacaaaatgatg

SEQ ID NO: 44164 - DNA, 20 bp, Artificial Sequence
  Description of Artificial Sequence: Synthetic oligonucleotide
  Target: SCN10A; (-) strand; PAM type: YTN; PAM sequence: TTG
ggtggggacacagccaaacc

SEQ ID NO: 44165 - DNA, 20 bp, Artificial Sequence
  Description of Artificial Sequence: Synthetic oligonucleotide
  Target: SCN10A; (-) strand; PAM type: YTN; PAM sequence: TTT
gggtggggacacagccaaac

SEQ ID NO: 44166 - DNA, 20 bp, Artificial Sequence
  Description of Artificial Sequence: Synthetic oligonucleotide
  Target: SCN10A; (-) strand; PAM type: YTN; PAM sequence: TTC
aagataagatttgggtgggg

SEQ ID NO: 44167 - DNA, 20 bp, Artificial Sequence
  Description of Artificial Sequence: Synthetic oligonucleotide
  Target: SCN10A; (-) strand; PAM type: YTN; PAM sequence: CTC
ccacaacacatgggaattca

SEQ ID NO: 44168 - DNA, 20 bp, Artificial Sequence
  Description of Artificial Sequence: Synthetic oligonucleotide
  Target: SCN10A; (-) strand; PAM type: YTN; PAM sequence: CTC
ccctcccacaacacatggga

SEQ ID NO: 44169 - DNA, 20 bp, Artificial Sequence
  Description of Artificial Sequence: Synthetic oligonucleotide
  Target: SCN10A; (-) strand; PAM type: YTN; PAM sequence: CTC
ccacagggtccctcccctcc

SEQ ID NO: 44170 - DNA, 20 bp, Artificial Sequence
  Description of Artificial Sequence: Synthetic oligonucleotide
  Target: SCN10A; (-) strand; PAM type: YTN; PAM sequence: TTA
cctcccacagggtccctccc

SEQ ID NO: 44171 - DNA, 20 bp, Artificial Sequence
  Description of Artificial Sequence: Synthetic oligonucleotide
  Target: SCN10A; (-) strand; PAM type: YTN; PAM sequence: CTT
acctcccacagggtccctcc

SEQ ID NO: 44172 - DNA, 20 bp, Artificial Sequence
  Description of Artificial Sequence: Synthetic oligonucleotide
  Target: SCN10A; (-) strand; PAM type: YTN; PAM sequence: TTC
acttacctcccacagggtcc

SEQ ID NO: 44173 - DNA, 20 bp, Artificial Sequence
  Description of Artificial Sequence: Synthetic oligonucleotide
  Target: SCN10A; (-) strand; PAM type: YTN; PAM sequence: CTC
ccatgattcacttacctccc

SEQ ID NO: 44174 - DNA, 20 bp, Artificial Sequence
  Description of Artificial Sequence: Synthetic oligonucleotide
  Target: SCN10A; (-) strand; PAM type: YTN; PAM sequence: CTG
ctcccatgattcacttacct

SEQ ID NO: 44175 - DNA, 20 bp, Artificial Sequence
  Description of Artificial Sequence: Synthetic oligonucleotide
  Target: SCN10A; (-) strand; PAM type: YTN; PAM sequence: CTA
tcatgagaacagcatgggaa

SEQ ID NO: 44176 - DNA, 20 bp, Artificial Sequence
  Description of Artificial Sequence: Synthetic oligonucleotide
  Target: SCN10A; (-) strand; PAM type: YTN; PAM sequence: TTC
actatcatgagaacagcatg

SEQ ID NO: 44177 - DNA, 20 bp, Artificial Sequence
  Description of Artificial Sequence: Synthetic oligonucleotide
  Target: SCN10A; (-) strand; PAM type: YTN; PAM sequence: TTA
ttcactatcatgagaacagc

SEQ ID NO: 44178 - DNA, 20 bp, Artificial Sequence
  Description of Artificial Sequence: Synthetic oligonucleotide
  Target: SCN10A; (-) strand; PAM type: YTN; PAM sequence: CTT
attcactatcatgagaacag

SEQ ID NO: 44179 - DNA, 20 bp, Artificial Sequence
  Description of Artificial Sequence: Synthetic oligonucleotide
  Target: SCN10A; (-) strand; PAM type: YTN; PAM sequence: CTC
atgaaacttattcactatca

SEQ ID NO: 44180 - DNA, 20 bp, Artificial Sequence
  Description of Artificial Sequence: Synthetic oligonucleotide
  Target: SCN10A; (-) strand; PAM type: YTN; PAM sequence: TTA
taataccgtcacatctcatg

SEQ ID NO: 44181 - DNA, 20 bp, Artificial Sequence
  Description of Artificial Sequence: Synthetic oligonucleotide
  Target: SCN10A; (-) strand; PAM type: YTN; PAM sequence: CTT
ataataccgtcacatctcat

SEQ ID NO: 44182 - DNA, 20 bp, Artificial Sequence
  Description of Artificial Sequence: Synthetic oligonucleotide
  Target: SCN10A; (-) strand; PAM type: YTN; PAM sequence: CTC
ccccttataataccgtcaca

SEQ ID NO: 44183 - DNA, 20 bp, Artificial Sequence
  Description of Artificial Sequence: Synthetic oligonucleotide
  Target: SCN10A; (-) strand; PAM type: YTN; PAM sequence: TTG
ggcagggaaactccccctta

SEQ ID NO: 44184 - DNA, 20 bp, Artificial Sequence
  Description of Artificial Sequence: Synthetic oligonucleotide
  Target: SCN10A; (-) strand; PAM type: YTN; PAM sequence: TTA
tgtggatggcagcaggcaaa

SEQ ID NO: 44185 - DNA, 20 bp, Artificial Sequence
  Description of Artificial Sequence: Synthetic oligonucleotide
  Target: SCN10A; (-) strand; PAM type: YTN; PAM sequence: CTT
atgtggatggcagcaggcaa

SEQ ID NO: 44186 - DNA, 20 bp, Artificial Sequence
  Description of Artificial Sequence: Synthetic oligonucleotide
  Target: SCN10A; (-) strand; PAM type: YTN; PAM sequence: TTA
caatcatggcaaaaggaaag

SEQ ID NO: 44187 - DNA, 20 bp, Artificial Sequence
  Description of Artificial Sequence: Synthetic oligonucleotide
  Target: SCN10A; (-) strand; PAM type: YTN; PAM sequence: CTT
acaatcatggcaaaaggaaa

SEQ ID NO: 44188 - DNA, 20 bp, Artificial Sequence
  Description of Artificial Sequence: Synthetic oligonucleotide
  Target: SCN10A; (-) strand; PAM type: YTN; PAM sequence: CTG
gggaagccttacaatcatgg

SEQ ID NO: 44189 - DNA, 20 bp, Artificial Sequence
  Description of Artificial Sequence: Synthetic oligonucleotide
  Target: SCN10A; (-) strand; PAM type: YTN; PAM sequence: TTC
acatggctggggaagcctta

SEQ ID NO: 44190 - DNA, 20 bp, Artificial Sequence
  Description of Artificial Sequence: Synthetic oligonucleotide
  Target: SCN10A; (-) strand; PAM type: YTN; PAM sequence: CTT
cacatggctggggaagcctt

SEQ ID NO: 44191 - DNA, 20 bp, Artificial Sequence
  Description of Artificial Sequence: Synthetic oligonucleotide
  Target: SCN10A; (-) strand; PAM type: YTN; PAM sequence: TTA
cagcttcacatggctgggga

SEQ ID NO: 44192 - DNA, 20 bp, Artificial Sequence
  Description of Artificial Sequence: Synthetic oligonucleotide
  Target: SCN10A; (-) strand; PAM type: YTN; PAM sequence: CTT
acagcttcacatggctgggg

SEQ ID NO: 44193 - DNA, 20 bp, Artificial Sequence
  Description of Artificial Sequence: Synthetic oligonucleotide
  Target: SCN10A; (-) strand; PAM type: YTN; PAM sequence: TTG
gacttacagcttcacatggc

SEQ ID NO: 44194 - DNA, 20 bp, Artificial Sequence
  Description of Artificial Sequence: Synthetic oligonucleotide
  Target: SCN10A; (-) strand; PAM type: YTN; PAM sequence: TTA
attggacttacagcttcaca

SEQ ID NO: 44195 - DNA, 20 bp, Artificial Sequence
  Description of Artificial Sequence: Synthetic oligonucleotide
  Target: SCN10A; (-) strand; PAM type: YTN; PAM sequence: TTT
aattggacttacagcttcac

SEQ ID NO: 44196 - DNA, 20 bp, Artificial Sequence
  Description of Artificial Sequence: Synthetic oligonucleotide
  Target: SCN10A; (-) strand; PAM type: YTN; PAM sequence: TTA
taaaagaaagaggtttaatt

SEQ ID NO: 44197 - DNA, 20 bp, Artificial Sequence
  Description of Artificial Sequence: Synthetic oligonucleotide
  Target: SCN10A; (-) strand; PAM type: YTN; PAM sequence: TTT
ataaaagaaagaggtttaat

SEQ ID NO: 44198 - DNA, 20 bp, Artificial Sequence
  Description of Artificial Sequence: Synthetic oligonucleotide
  Target: SCN10A; (-) strand; PAM type: YTN; PAM sequence: CTG
ggcaatttataaaagaaaga

SEQ ID NO: 44199 - DNA, 20 bp, Artificial Sequence
  Description of Artificial Sequence: Synthetic oligonucleotide
  Target: SCN10A; (-) strand; PAM type: YTN; PAM sequence: CTA
agactgggcaatttataaaa

SEQ ID NO: 44200 - DNA, 20 bp, Artificial Sequence
  Description of Artificial Sequence: Synthetic oligonucleotide
  Target: SCN10A; (-) strand; PAM type: YTN; PAM sequence: CTG
ataaagacatacctaagact

SEQ ID NO: 44201 - DNA, 20 bp, Artificial Sequence
  Description of Artificial Sequence: Synthetic oligonucleotide
  Target: SCN10A; (-) strand; PAM type: YTN; PAM sequence: CTG
ctgataaagacatacctaag

SEQ ID NO: 44202 - DNA, 20 bp, Artificial Sequence
  Description of Artificial Sequence: Synthetic oligonucleotide
  Target: SCN10A; (-) strand; PAM type: YTN; PAM sequence: TTC
atgctgctgataaagacata

SEQ ID NO: 44203 - DNA, 20 bp, Artificial Sequence
  Description of Artificial Sequence: Synthetic oligonucleotide
  Target: SCN10A; (-) strand; PAM type: YTN; PAM sequence: TTT
catgctgctgataaagacat

SEQ ID NO: 44204 - DNA, 20 bp, Artificial Sequence
  Description of Artificial Sequence: Synthetic oligonucleotide
  Target: SCN10A; (-) strand; PAM type: YTN; PAM sequence: TTT
tcatgctgctgataaagaca

SEQ ID NO: 44205 - DNA, 20 bp, Artificial Sequence
  Description of Artificial Sequence: Synthetic oligonucleotide
  Target: SCN10A; (-) strand; PAM type: YTN; PAM sequence: CTA
ttttcatgctgctgataaag

SEQ ID NO: 44206 - DNA, 20 bp, Artificial Sequence
  Description of Artificial Sequence: Synthetic oligonucleotide
  Target: SCN10A; (-) strand; PAM type: YTN; PAM sequence: TTA
gtctattttcatgctgctga

SEQ ID NO: 44207 - DNA, 20 bp, Artificial Sequence
  Description of Artificial Sequence: Synthetic oligonucleotide
  Target: SCN10A; (-) strand; PAM type: YTN; PAM sequence: TTG
tattagtctattttcatgct

SEQ ID NO: 44208 - DNA, 20 bp, Artificial Sequence
  Description of Artificial Sequence: Synthetic oligonucleotide
  Target: SCN10A; (-) strand; PAM type: YTN; PAM sequence: TTT
gtattagtctattttcatgc

SEQ ID NO: 44209 - DNA, 20 bp, Artificial Sequence
  Description of Artificial Sequence: Synthetic oligonucleotide
  Target: SCN10A; (-) strand; PAM type: YTN; PAM sequence: TTG
tatatatttgtattagtcta

SEQ ID NO: 44210 - DNA, 20 bp, Artificial Sequence
  Description of Artificial Sequence: Synthetic oligonucleotide
  Target: SCN10A; (-) strand; PAM type: YTN; PAM sequence: TTA
ttgtatatatttgtattagt

SEQ ID NO: 44211 - DNA, 20 bp, Artificial Sequence
  Description of Artificial Sequence: Synthetic oligonucleotide
  Target: SCN10A; (-) strand; PAM type: YTN; PAM sequence: TTT
attgtatatatttgtattag

SEQ ID NO: 44212 - DNA, 20 bp, Artificial Sequence
  Description of Artificial Sequence: Synthetic oligonucleotide
  Target: SCN10A; (-) strand; PAM type: YTN; PAM sequence: TTT
tattgtatatatttgtatta

SEQ ID NO: 44213 - DNA, 20 bp, Artificial Sequence
  Description of Artificial Sequence: Synthetic oligonucleotide
  Target: SCN10A; (-) strand; PAM type: YTN; PAM sequence: TTA
aaaaatatattttattgtat

SEQ ID NO: 44214 - DNA, 20 bp, Artificial Sequence
  Description of Artificial Sequence: Synthetic oligonucleotide
  Target: SCN10A; (-) strand; PAM type: YTN; PAM sequence: TTT
aaaaaatatattttattgta

SEQ ID NO: 44215 - DNA, 20 bp, Artificial Sequence
  Description of Artificial Sequence: Synthetic oligonucleotide
  Target: SCN10A; (-) strand; PAM type: YTN; PAM sequence: TTT
taaaaaatatattttattgt

SEQ ID NO: 44216 - DNA, 20 bp, Artificial Sequence
  Description of Artificial Sequence: Synthetic oligonucleotide
  Target: SCN10A; (-) strand; PAM type: YTN; PAM sequence: TTA
aaattttaaaaaatatattt

SEQ ID NO: 44217 - DNA, 20 bp, Artificial Sequence
  Description of Artificial Sequence: Synthetic oligonucleotide
  Target: SCN10A; (-) strand; PAM type: YTN; PAM sequence: TTT
aaaattttaaaaaatatatt

SEQ ID NO: 44218 - DNA, 20 bp, Artificial Sequence
  Description of Artificial Sequence: Synthetic oligonucleotide
  Target: SCN10A; (-) strand; PAM type: YTN; PAM sequence: TTT
taaaattttaaaaaatatat

SEQ ID NO: 44219 - DNA, 20 bp, Artificial Sequence
  Description of Artificial Sequence: Synthetic oligonucleotide
  Target: SCN10A; (-) strand; PAM type: YTN; PAM sequence: CTT
ttaaaattttaaaaaatata

SEQ ID NO: 44220 - DNA, 20 bp, Artificial Sequence
  Description of Artificial Sequence: Synthetic oligonucleotide
  Target: SCN10A; (-) strand; PAM type: YTN; PAM sequence: TTA
tcttttaaaattttaaaaaa

SEQ ID NO: 44221 - DNA, 20 bp, Artificial Sequence
  Description of Artificial Sequence: Synthetic oligonucleotide
  Target: SCN10A; (-) strand; PAM type: YTN; PAM sequence: CTG
ttatcttttaaaattttaaa

SEQ ID NO: 44222 - DNA, 20 bp, Artificial Sequence
  Description of Artificial Sequence: Synthetic oligonucleotide
  Target: SCN10A; (-) strand; PAM type: YTN; PAM sequence: TTG
tgtctgttatcttttaaaat

SEQ ID NO: 44223 - DNA, 20 bp, Artificial Sequence
  Description of Artificial Sequence: Synthetic oligonucleotide
  Target: SCN10A; (-) strand; PAM type: YTN; PAM sequence: TTT
gtgtctgttatcttttaaaa

SEQ ID NO: 44224 - DNA, 20 bp, Artificial Sequence
  Description of Artificial Sequence: Synthetic oligonucleotide
  Target: SCN10A; (-) strand; PAM type: YTN; PAM sequence: TTT
tgtgtctgttatcttttaaa

SEQ ID NO: 44225 - DNA, 20 bp, Artificial Sequence
  Description of Artificial Sequence: Synthetic oligonucleotide
  Target: SCN10A; (-) strand; PAM type: YTN; PAM sequence: TTT
ttgtgtctgttatcttttaa

SEQ ID NO: 44226 - DNA, 20 bp, Artificial Sequence
  Description of Artificial Sequence: Synthetic oligonucleotide
  Target: SCN10A; (-) strand; PAM type: YTN; PAM sequence: CTT
tttgtgtctgttatctttta

SEQ ID NO: 44227 - DNA, 20 bp, Artificial Sequence
  Description of Artificial Sequence: Synthetic oligonucleotide
  Target: SCN10A; (-) strand; PAM type: YTN; PAM sequence: CTA
tccatctttttgtgtctgtt

SEQ ID NO: 44228 - DNA, 20 bp, Artificial Sequence
  Description of Artificial Sequence: Synthetic oligonucleotide
  Target: SCN10A; (-) strand; PAM type: YTN; PAM sequence: CTA
tcctatccatctttttgtgt

SEQ ID NO: 44229 - DNA, 20 bp, Artificial Sequence
  Description of Artificial Sequence: Synthetic oligonucleotide
  Target: SCN10A; (-) strand; PAM type: YTN; PAM sequence: CTA
tctatcctatccatcttttt

SEQ ID NO: 44230 - DNA, 20 bp, Artificial Sequence
  Description of Artificial Sequence: Synthetic oligonucleotide
  Target: SCN10A; (-) strand; PAM type: YTN; PAM sequence: TTC
aactatctatcctatccatc

SEQ ID NO: 44231 - DNA, 20 bp, Artificial Sequence
  Description of Artificial Sequence: Synthetic oligonucleotide
  Target: SCN10A; (-) strand; PAM type: YTN; PAM sequence: TTC
cattcaactatctatcctat

SEQ ID NO: 44232 - DNA, 20 bp, Artificial Sequence
  Description of Artificial Sequence: Synthetic oligonucleotide
  Target: SCN10A; (-) strand; PAM type: YTN; PAM sequence: CTT
ccattcaactatctatccta

SEQ ID NO: 44233 - DNA, 20 bp, Artificial Sequence
  Description of Artificial Sequence: Synthetic oligonucleotide
  Target: SCN10A; (-) strand; PAM type: YTN; PAM sequence: CTC
ccatccttccattcaactat

SEQ ID NO: 44234 - DNA, 20 bp, Artificial Sequence
  Description of Artificial Sequence: Synthetic oligonucleotide
  Target: SCN10A; (-) strand; PAM type: YTN; PAM sequence: TTC
tcccatccttccattcaact

SEQ ID NO: 44235 - DNA, 20 bp, Artificial Sequence
  Description of Artificial Sequence: Synthetic oligonucleotide
  Target: SCN10A; (-) strand; PAM type: YTN; PAM sequence: TTT
ctcccatccttccattcaac

SEQ ID NO: 44236 - DNA, 20 bp, Artificial Sequence
  Description of Artificial Sequence: Synthetic oligonucleotide
  Target: SCN10A; (-) strand; PAM type: YTN; PAM sequence: TTG
tttctcccatccttccattc

SEQ ID NO: 44237 - DNA, 20 bp, Artificial Sequence
  Description of Artificial Sequence: Synthetic oligonucleotide
  Target: SCN10A; (-) strand; PAM type: YTN; PAM sequence: TTT
gtttctcccatccttccatt

SEQ ID NO: 44238 - DNA, 20 bp, Artificial Sequence
  Description of Artificial Sequence: Synthetic oligonucleotide
  Target: SCN10A; (-) strand; PAM type: YTN; PAM sequence: TTG
tttgtttctcccatccttcc

SEQ ID NO: 44239 - DNA, 20 bp, Artificial Sequence
  Description of Artificial Sequence: Synthetic oligonucleotide
  Target: SCN10A; (-) strand; PAM type: YTN; PAM sequence: CTT
gtttgtttctcccatccttc

SEQ ID NO: 44240 - DNA, 20 bp, Artificial Sequence
  Description of Artificial Sequence: Synthetic oligonucleotide
  Target: SCN10A; (-) strand; PAM type: YTN; PAM sequence: TTC
ttgtttgtttctcccatcct

SEQ ID NO: 44241 - DNA, 20 bp, Artificial Sequence
  Description of Artificial Sequence: Synthetic oligonucleotide
  Target: SCN10A; (-) strand; PAM type: YTN; PAM sequence: TTT
cttgtttgtttctcccatcc

SEQ ID NO: 44242 - DNA, 20 bp, Artificial Sequence
  Description of Artificial Sequence: Synthetic oligonucleotide
  Target: SCN10A; (-) strand; PAM type: YTN; PAM sequence: CTT
tcttgtttgtttctcccatc

SEQ ID NO: 44243 - DNA, 20 bp, Artificial Sequence
  Description of Artificial Sequence: Synthetic oligonucleotide
  Target: SCN10A; (-) strand; PAM type: YTN; PAM sequence: TTC
ctttcttgtttgtttctccc

SEQ ID NO: 44244 - DNA, 20 bp, Artificial Sequence
  Description of Artificial Sequence: Synthetic oligonucleotide
  Target: SCN10A; (-) strand; PAM type: YTN; PAM sequence: TTT
cctttcttgtttgtttctcc

SEQ ID NO: 44245 - DNA, 20 bp, Artificial Sequence
  Description of Artificial Sequence: Synthetic oligonucleotide
  Target: SCN10A; (-) strand; PAM type: YTN; PAM sequence: TTT
tcctttcttgtttgtttctc

SEQ ID NO: 44246 - DNA, 20 bp, Artificial Sequence
  Description of Artificial Sequence: Synthetic oligonucleotide
  Target: SCN10A; (-) strand; PAM type: YTN; PAM sequence: CTT
ttcctttcttgtttgtttct

SEQ ID NO: 44247 - DNA, 20 bp, Artificial Sequence
  Description of Artificial Sequence: Synthetic oligonucleotide
  Target: SCN10A; (-) strand; PAM type: YTN; PAM sequence: TTC
atacttttcctttcttgttt

SEQ ID NO: 44248 - DNA, 20 bp, Artificial Sequence
  Description of Artificial Sequence: Synthetic oligonucleotide
  Target: SCN10A; (-) strand; PAM type: YTN; PAM sequence: TTT
catacttttcctttcttgtt

SEQ ID NO: 44249 - DNA, 20 bp, Artificial Sequence
  Description of Artificial Sequence: Synthetic oligonucleotide
  Target: SCN10A; (-) strand; PAM type: YTN; PAM sequence: CTT
tcatacttttcctttcttgt

SEQ ID NO: 44250 - DNA, 20 bp, Artificial Sequence
  Description of Artificial Sequence: Synthetic oligonucleotide
  Target: SCN10A; (-) strand; PAM type: YTN; PAM sequence: CTG
ctttcatacttttcctttct

SEQ ID NO: 44251 - DNA, 20 bp, Artificial Sequence
  Description of Artificial Sequence: Synthetic oligonucleotide
  Target: SCN10A; (-) strand; PAM type: YTN; PAM sequence: TTC
cctgctttcatacttttcct

SEQ ID NO: 44252 - DNA, 20 bp, Artificial Sequence
  Description of Artificial Sequence: Synthetic oligonucleotide
  Target: SCN10A; (-) strand; PAM type: YTN; PAM sequence: CTA
ttccctgctttcatactttt

SEQ ID NO: 44253 - DNA, 20 bp, Artificial Sequence
  Description of Artificial Sequence: Synthetic oligonucleotide
  Target: SCN10A; (-) strand; PAM type: YTN; PAM sequence: TTC
actattccctgctttcatac

SEQ ID NO: 44254 - DNA, 20 bp, Artificial Sequence
  Description of Artificial Sequence: Synthetic oligonucleotide
  Target: SCN10A; (-) strand; PAM type: YTN; PAM sequence: CTA
tccattcactattccctgct

SEQ ID NO: 44255 - DNA, 20 bp, Artificial Sequence
  Description of Artificial Sequence: Synthetic oligonucleotide
  Target: SCN10A; (-) strand; PAM type: YTN; PAM sequence: CTC
atctatccattcactattcc

SEQ ID NO: 44256 - DNA, 20 bp, Artificial Sequence
  Description of Artificial Sequence: Synthetic oligonucleotide
  Target: SCN10A; (-) strand; PAM type: YTN; PAM sequence: CTA
tctcatctatccattcacta

SEQ ID NO: 44257 - DNA, 20 bp, Artificial Sequence
  Description of Artificial Sequence: Synthetic oligonucleotide
  Target: SCN10A; (-) strand; PAM type: YTN; PAM sequence: TTA
tccacctatctcatctatcc

SEQ ID NO: 44258 - DNA, 20 bp, Artificial Sequence
  Description of Artificial Sequence: Synthetic oligonucleotide
  Target: SCN10A; (-) strand; PAM type: YTN; PAM sequence: CTT
atccacctatctcatctatc

SEQ ID NO: 44259 - DNA, 20 bp, Artificial Sequence
  Description of Artificial Sequence: Synthetic oligonucleotide
  Target: SCN10A; (-) strand; PAM type: YTN; PAM sequence: CTC
ttatccacctatctcatcta

SEQ ID NO: 44260 - DNA, 20 bp, Artificial Sequence
  Description of Artificial Sequence: Synthetic oligonucleotide
  Target: SCN10A; (-) strand; PAM type: YTN; PAM sequence: TTC
tcttatccacctatctcatc

SEQ ID NO: 44261 - DNA, 20 bp, Artificial Sequence
  Description of Artificial Sequence: Synthetic oligonucleotide
  Target: SCN10A; (-) strand; PAM type: YTN; PAM sequence: CTT
ctcttatccacctatctcat

SEQ ID NO: 44262 - DNA, 20 bp, Artificial Sequence
  Description of Artificial Sequence: Synthetic oligonucleotide
  Target: SCN10A; (-) strand; PAM type: YTN; PAM sequence: TTA
cccagccatccatccttctc

SEQ ID NO: 44263 - DNA, 20 bp, Artificial Sequence
  Description of Artificial Sequence: Synthetic oligonucleotide
  Target: SCN10A; (-) strand; PAM type: YTN; PAM sequence: TTT
acccagccatccatccttct

SEQ ID NO: 44264 - DNA, 20 bp, Artificial Sequence
  Description of Artificial Sequence: Synthetic oligonucleotide
  Target: SCN10A; (-) strand; PAM type: YTN; PAM sequence: TTT
tacccagccatccatccttc

SEQ ID NO: 44265 - DNA, 20 bp, Artificial Sequence
  Description of Artificial Sequence: Synthetic oligonucleotide
  Target: SCN10A; (-) strand; PAM type: YTN; PAM sequence: TTA
gtcattttacccagccatcc

SEQ ID NO: 44266 - DNA, 20 bp, Artificial Sequence
  Description of Artificial Sequence: Synthetic oligonucleotide
  Target: SCN10A; (-) strand; PAM type: YTN; PAM sequence: TTC
atgcattagtcattttaccc

SEQ ID NO: 44267 - DNA, 20 bp, Artificial Sequence
  Description of Artificial Sequence: Synthetic oligonucleotide
  Target: SCN10A; (-) strand; PAM type: YTN; PAM sequence: TTC
cattcatgcattagtcattt

SEQ ID NO: 44268 - DNA, 20 bp, Artificial Sequence
  Description of Artificial Sequence: Synthetic oligonucleotide
  Target: SCN10A; (-) strand; PAM type: YTN; PAM sequence: TTT
ccattcatgcattagtcatt

SEQ ID NO: 44269 - DNA, 20 bp, Artificial Sequence
  Description of Artificial Sequence: Synthetic oligonucleotide
  Target: SCN10A; (-) strand; PAM type: YTN; PAM sequence: CTT
tccattcatgcattagtcat

SEQ ID NO: 44270 - DNA, 20 bp, Artificial Sequence
  Description of Artificial Sequence: Synthetic oligonucleotide
  Target: SCN10A; (-) strand; PAM type: YTN; PAM sequence: CTC
cccatctttccattcatgca

SEQ ID NO: 44271 - DNA, 20 bp, Artificial Sequence
  Description of Artificial Sequence: Synthetic oligonucleotide
  Target: SCN10A; (-) strand; PAM type: YTN; PAM sequence: CTG
tccagctccccatctttcca

SEQ ID NO: 44272 - DNA, 20 bp, Artificial Sequence
  Description of Artificial Sequence: Synthetic oligonucleotide
  Target: SCN10A; (-) strand; PAM type: YTN; PAM sequence: TTC
tgtccagctccccatctttc

SEQ ID NO: 44273 - DNA, 20 bp, Artificial Sequence
  Description of Artificial Sequence: Synthetic oligonucleotide
  Target: SCN10A; (-) strand; PAM type: YTN; PAM sequence: CTA
ttctgtccagctccccatct

SEQ ID NO: 44274 - DNA, 20 bp, Artificial Sequence
  Description of Artificial Sequence: Synthetic oligonucleotide
  Target: SCN10A; (-) strand; PAM type: YTN; PAM sequence: TTC
atctattctgtccagctccc

SEQ ID NO: 44275 - DNA, 20 bp, Artificial Sequence
  Description of Artificial Sequence: Synthetic oligonucleotide
  Target: SCN10A; (-) strand; PAM type: YTN; PAM sequence: TTC
cattcatctattctgtccag

SEQ ID NO: 44276 - DNA, 20 bp, Artificial Sequence
  Description of Artificial Sequence: Synthetic oligonucleotide
  Target: SCN10A; (-) strand; PAM type: YTN; PAM sequence: TTA
ttccattcatctattctgtc

SEQ ID NO: 44277 - DNA, 20 bp, Artificial Sequence
  Description of Artificial Sequence: Synthetic oligonucleotide
  Target: SCN10A; (-) strand; PAM type: YTN; PAM sequence: TTT
attccattcatctattctgt

SEQ ID NO: 44278 - DNA, 20 bp, Artificial Sequence
  Description of Artificial Sequence: Synthetic oligonucleotide
  Target: SCN10A; (-) strand; PAM type: YTN; PAM sequence: CTA
atttattccattcatctatt

SEQ ID NO: 44279 - DNA, 20 bp, Artificial Sequence
  Description of Artificial Sequence: Synthetic oligonucleotide
  Target: SCN10A; (-) strand; PAM type: YTN; PAM sequence: TTC
actaatttattccattcatc

SEQ ID NO: 44280 - DNA, 20 bp, Artificial Sequence
  Description of Artificial Sequence: Synthetic oligonucleotide
  Target: SCN10A; (-) strand; PAM type: YTN; PAM sequence: TTC
cagtcattcactaatttatt

SEQ ID NO: 44281 - DNA, 20 bp, Artificial Sequence
  Description of Artificial Sequence: Synthetic oligonucleotide
  Target: SCN10A; (-) strand; PAM type: YTN; PAM sequence: CTT
ccagtcattcactaatttat

SEQ ID NO: 44282 - DNA, 20 bp, Artificial Sequence
  Description of Artificial Sequence: Synthetic oligonucleotide
  Target: SCN10A; (-) strand; PAM type: YTN; PAM sequence: CTA
tcaaccttccagtcattcac

SEQ ID NO: 44283 - DNA, 20 bp, Artificial Sequence
  Description of Artificial Sequence: Synthetic oligonucleotide
  Target: SCN10A; (-) strand; PAM type: YTN; PAM sequence: TTC
atccatcctatcaaccttcc

SEQ ID NO: 44284 - DNA, 20 bp, Artificial Sequence
  Description of Artificial Sequence: Synthetic oligonucleotide
  Target: SCN10A; (-) strand; PAM type: YTN; PAM sequence: TTC
atcatccattcatccatcct

SEQ ID NO: 44285 - DNA, 20 bp, Artificial Sequence
  Description of Artificial Sequence: Synthetic oligonucleotide
  Target: SCN10A; (-) strand; PAM type: YTN; PAM sequence: TTC
cattcatcatccattcatcc

SEQ ID NO: 44286 - DNA, 20 bp, Artificial Sequence
  Description of Artificial Sequence: Synthetic oligonucleotide
  Target: SCN10A; (-) strand; PAM type: YTN; PAM sequence: CTT
ccattcatcatccattcatc

SEQ ID NO: 44287 - DNA, 20 bp, Artificial Sequence
  Description of Artificial Sequence: Synthetic oligonucleotide
  Target: SCN10A; (-) strand; PAM type: YTN; PAM sequence: TTC
ccttccattcatcatccatt

SEQ ID NO: 44288 - DNA, 20 bp, Artificial Sequence
  Description of Artificial Sequence: Synthetic oligonucleotide
  Target: SCN10A; (-) strand; PAM type: YTN; PAM sequence: TTT
cccttccattcatcatccat

SEQ ID NO: 44289 - DNA, 20 bp, Artificial Sequence
  Description of Artificial Sequence: Synthetic oligonucleotide
  Target: SCN10A; (-) strand; PAM type: YTN; PAM sequence: CTT
tcccttccattcatcatcca

SEQ ID NO: 44290 - DNA, 20 bp, Artificial Sequence
  Description of Artificial Sequence: Synthetic oligonucleotide
  Target: SCN10A; (-) strand; PAM type: YTN; PAM sequence: TTC
atccctttcccttccattca

SEQ ID NO: 44291 - DNA, 20 bp, Artificial Sequence
  Description of Artificial Sequence: Synthetic oligonucleotide
  Target: SCN10A; (-) strand; PAM type: YTN; PAM sequence: TTC
attcatccctttcccttcca

SEQ ID NO: 44292 - DNA, 20 bp, Artificial Sequence
  Description of Artificial Sequence: Synthetic oligonucleotide
  Target: SCN10A; (-) strand; PAM type: YTN; PAM sequence: CTG
ttcattcatccctttccctt

SEQ ID NO: 44293 - DNA, 20 bp, Artificial Sequence
  Description of Artificial Sequence: Synthetic oligonucleotide
  Target: SCN10A; (-) strand; PAM type: YTN; PAM sequence: TTA
tctgttcattcatccctttc

SEQ ID NO: 44294 - DNA, 20 bp, Artificial Sequence
  Description of Artificial Sequence: Synthetic oligonucleotide
  Target: SCN10A; (-) strand; PAM type: YTN; PAM sequence: CTT
atctgttcattcatcccttt

SEQ ID NO: 44295 - DNA, 20 bp, Artificial Sequence
  Description of Artificial Sequence: Synthetic oligonucleotide
  Target: SCN10A; (-) strand; PAM type: YTN; PAM sequence: TTC
cacttatctgttcattcatc

SEQ ID NO: 44296 - DNA, 20 bp, Artificial Sequence
  Description of Artificial Sequence: Synthetic oligonucleotide
  Target: SCN10A; (-) strand; PAM type: YTN; PAM sequence: CTT
ccacttatctgttcattcat

SEQ ID NO: 44297 - DNA, 20 bp, Artificial Sequence
  Description of Artificial Sequence: Synthetic oligonucleotide
  Target: SCN10A; (-) strand; PAM type: YTN; PAM sequence: TTC
ttccacttatctgttcattc

SEQ ID NO: 44298 - DNA, 20 bp, Artificial Sequence
  Description of Artificial Sequence: Synthetic oligonucleotide
  Target: SCN10A; (-) strand; PAM type: YTN; PAM sequence: TTT
cttccacttatctgttcatt

SEQ ID NO: 44299 - DNA, 20 bp, Artificial Sequence
  Description of Artificial Sequence: Synthetic oligonucleotide
  Target: SCN10A; (-) strand; PAM type: YTN; PAM sequence: CTT
tcttccacttatctgttcat

SEQ ID NO: 44300 - DNA, 20 bp, Artificial Sequence
  Description of Artificial Sequence: Synthetic oligonucleotide
  Target: SCN10A; (-) strand; PAM type: YTN; PAM sequence: TTC
ctttcttccacttatctgtt

SEQ ID NO: 44301 - DNA, 20 bp, Artificial Sequence
  Description of Artificial Sequence: Synthetic oligonucleotide
  Target: SCN10A; (-) strand; PAM type: YTN; PAM sequence: CTT
cctttcttccacttatctgt

SEQ ID NO: 44302 - DNA, 20 bp, Artificial Sequence
  Description of Artificial Sequence: Synthetic oligonucleotide
  Target: SCN10A; (-) strand; PAM type: YTN; PAM sequence: TTC
ttcctttcttccacttatct

SEQ ID NO: 44303 - DNA, 20 bp, Artificial Sequence
  Description of Artificial Sequence: Synthetic oligonucleotide
  Target: SCN10A; (-) strand; PAM type: YTN; PAM sequence: CTA
ttcttcctttcttccactta

SEQ ID NO: 44304 - DNA, 20 bp, Artificial Sequence
  Description of Artificial Sequence: Synthetic oligonucleotide
  Target: SCN10A; (-) strand; PAM type: YTN; PAM sequence: CTA
tccatctattcttcctttct

SEQ ID NO: 44305 - DNA, 20 bp, Artificial Sequence
  Description of Artificial Sequence: Synthetic oligonucleotide
  Target: SCN10A; (-) strand; PAM type: YTN; PAM sequence: TTC
aacctatccatctattcttc

SEQ ID NO: 44306 - DNA, 20 bp, Artificial Sequence
  Description of Artificial Sequence: Synthetic oligonucleotide
  Target: SCN10A; (-) strand; PAM type: YTN; PAM sequence: TTT
caacctatccatctattctt

SEQ ID NO: 44307 - DNA, 20 bp, Artificial Sequence
  Description of Artificial Sequence: Synthetic oligonucleotide
  Target: SCN10A; (-) strand; PAM type: YTN; PAM sequence: TTG
tttcaacctatccatctatt

SEQ ID NO: 44308 - DNA, 20 bp, Artificial Sequence
  Description of Artificial Sequence: Synthetic oligonucleotide
  Target: SCN10A; (-) strand; PAM type: YTN; PAM sequence: CTT
gtttcaacctatccatctat

SEQ ID NO: 44309 - DNA, 20 bp, Artificial Sequence
  Description of Artificial Sequence: Synthetic oligonucleotide
  Target: SCN10A; (-) strand; PAM type: YTN; PAM sequence: TTC
ttgtttcaacctatccatct

SEQ ID NO: 44310 - DNA, 20 bp, Artificial Sequence
  Description of Artificial Sequence: Synthetic oligonucleotide
  Target: SCN10A; (-) strand; PAM type: YTN; PAM sequence: TTC
cattcttgtttcaacctatc

SEQ ID NO: 44311 - DNA, 20 bp, Artificial Sequence
  Description of Artificial Sequence: Synthetic oligonucleotide
  Target: SCN10A; (-) strand; PAM type: YTN; PAM sequence: TTT
ccattcttgtttcaacctat

SEQ ID NO: 44312 - DNA, 20 bp, Artificial Sequence
  Description of Artificial Sequence: Synthetic oligonucleotide
  Target: SCN10A; (-) strand; PAM type: YTN; PAM sequence: CTT
tccattcttgtttcaaccta

SEQ ID NO: 44313 - DNA, 20 bp, Artificial Sequence
  Description of Artificial Sequence: Synthetic oligonucleotide
  Target: SCN10A; (-) strand; PAM type: YTN; PAM sequence: CTA
tctttccattcttgtttcaa

SEQ ID NO: 44314 - DNA, 20 bp, Artificial Sequence
  Description of Artificial Sequence: Synthetic oligonucleotide
  Target: SCN10A; (-) strand; PAM type: YTN; PAM sequence: TTC
tatctttccattcttgtttc

SEQ ID NO: 44315 - DNA, 20 bp, Artificial Sequence
  Description of Artificial Sequence: Synthetic oligonucleotide
  Target: SCN10A; (-) strand; PAM type: YTN; PAM sequence: CTT
ctatctttccattcttgttt

SEQ ID NO: 44316 - DNA, 20 bp, Artificial Sequence
  Description of Artificial Sequence: Synthetic oligonucleotide
  Target: SCN10A; (-) strand; PAM type: YTN; PAM sequence: TTC
ttctatctttccattcttgt

SEQ ID NO: 44317 - DNA, 20 bp, Artificial Sequence
  Description of Artificial Sequence: Synthetic oligonucleotide
  Target: SCN10A; (-) strand; PAM type: YTN; PAM sequence: CTC
attcttctatctttccattc

SEQ ID NO: 44318 - DNA, 20 bp, Artificial Sequence
  Description of Artificial Sequence: Synthetic oligonucleotide
  Target: SCN10A; (-) strand; PAM type: YTN; PAM sequence: CTA
tccactcattcttctatctt

SEQ ID NO: 44319 - DNA, 20 bp, Artificial Sequence
  Description of Artificial Sequence: Synthetic oligonucleotide
  Target: SCN10A; (-) strand; PAM type: YTN; PAM sequence: TTC
tatccactcattcttctatc

SEQ ID NO: 44320 - DNA, 20 bp, Artificial Sequence
  Description of Artificial Sequence: Synthetic oligonucleotide
  Target: SCN10A; (-) strand; PAM type: YTN; PAM sequence: CTT
ctatccactcattcttctat

SEQ ID NO: 44321 - DNA, 20 bp, Artificial Sequence
  Description of Artificial Sequence: Synthetic oligonucleotide
  Target: SCN10A; (-) strand; PAM type: YTN; PAM sequence: CTC
atccttctatccactcattc

SEQ ID NO: 44322 - DNA, 20 bp, Artificial Sequence
  Description of Artificial Sequence: Synthetic oligonucleotide
  Target: SCN10A; (-) strand; PAM type: YTN; PAM sequence: CTC
actcatccttctatccactc

SEQ ID NO: 44323 - DNA, 20 bp, Artificial Sequence
  Description of Artificial Sequence: Synthetic oligonucleotide
  Target: SCN10A; (-) strand; PAM type: YTN; PAM sequence: CTA
ctcactcatccttctatcca

SEQ ID NO: 44324 - DNA, 20 bp, Artificial Sequence
  Description of Artificial Sequence: Synthetic oligonucleotide
  Target: SCN10A; (-) strand; PAM type: YTN; PAM sequence: TTC
tactcactcatccttctatc

SEQ ID NO: 44325 - DNA, 20 bp, Artificial Sequence
  Description of Artificial Sequence: Synthetic oligonucleotide
  Target: SCN10A; (-) strand; PAM type: YTN; PAM sequence: CTT
ctactcactcatccttctat

SEQ ID NO: 44326 - DNA, 20 bp, Artificial Sequence
  Description of Artificial Sequence: Synthetic oligonucleotide
  Target: SCN10A; (-) strand; PAM type: YTN; PAM sequence: TTC
catccaagcatgcttctact

SEQ ID NO: 44327 - DNA, 20 bp, Artificial Sequence
  Description of Artificial Sequence: Synthetic oligonucleotide
  Target: SCN10A; (-) strand; PAM type: YTN; PAM sequence: CTT
ccatccaagcatgcttctac

SEQ ID NO: 44328 - DNA, 20 bp, Artificial Sequence
  Description of Artificial Sequence: Synthetic oligonucleotide
  Target: SCN10A; (-) strand; PAM type: YTN; PAM sequence: TTC
acgcatcttccatccaagca

SEQ ID NO: 44329 - DNA, 20 bp, Artificial Sequence
  Description of Artificial Sequence: Synthetic oligonucleotide
  Target: SCN10A; (-) strand; PAM type: YTN; PAM sequence: CTC
attcacgcatcttccatcca

SEQ ID NO: 44330 - DNA, 20 bp, Artificial Sequence
  Description of Artificial Sequence: Synthetic oligonucleotide
  Target: SCN10A; (-) strand; PAM type: YTN; PAM sequence: TTC
actcattcacgcatcttcca

SEQ ID NO: 44331 - DNA, 20 bp, Artificial Sequence
  Description of Artificial Sequence: Synthetic oligonucleotide
  Target: SCN10A; (-) strand; PAM type: YTN; PAM sequence: CTG
ttcactcattcacgcatctt

SEQ ID NO: 44332 - DNA, 20 bp, Artificial Sequence
  Description of Artificial Sequence: Synthetic oligonucleotide
  Target: SCN10A; (-) strand; PAM type: YTN; PAM sequence: TTC
tgttcactcattcacgcatc

SEQ ID NO: 44333 - DNA, 20 bp, Artificial Sequence
  Description of Artificial Sequence: Synthetic oligonucleotide
  Target: SCN10A; (-) strand; PAM type: YTN; PAM sequence: CTA
acattctgttcactcattca

SEQ ID NO: 44334 - DNA, 20 bp, Artificial Sequence
  Description of Artificial Sequence: Synthetic oligonucleotide
  Target: SCN10A; (-) strand; PAM type: YTN; PAM sequence: CTG
tccaatcatctaacattctg

SEQ ID NO: 44335 - DNA, 20 bp, Artificial Sequence
  Description of Artificial Sequence: Synthetic oligonucleotide
  Target: SCN10A; (-) strand; PAM type: YTN; PAM sequence: CTA
tccaactgtccaatcatcta

SEQ ID NO: 44336 - DNA, 20 bp, Artificial Sequence
  Description of Artificial Sequence: Synthetic oligonucleotide
  Target: SCN10A; (-) strand; PAM type: YTN; PAM sequence: TTC
tatccaactgtccaatcatc

SEQ ID NO: 44337 - DNA, 20 bp, Artificial Sequence
  Description of Artificial Sequence: Synthetic oligonucleotide
  Target: SCN10A; (-) strand; PAM type: YTN; PAM sequence: CTT
ctatccaactgtccaatcat

SEQ ID NO: 44338 - DNA, 20 bp, Artificial Sequence
  Description of Artificial Sequence: Synthetic oligonucleotide
  Target: SCN10A; (-) strand; PAM type: YTN; PAM sequence: TTC
ttctatccaactgtccaatc

SEQ ID NO: 44339 - DNA, 20 bp, Artificial Sequence
  Description of Artificial Sequence: Synthetic oligonucleotide
  Target: SCN10A; (-) strand; PAM type: YTN; PAM sequence: TTC
attcttctatccaactgtcc

SEQ ID NO: 44340 - DNA, 20 bp, Artificial Sequence
  Description of Artificial Sequence: Synthetic oligonucleotide
  Target: SCN10A; (-) strand; PAM type: YTN; PAM sequence: TTG
attcattcttctatccaact

SEQ ID NO: 44341 - DNA, 20 bp, Artificial Sequence
  Description of Artificial Sequence: Synthetic oligonucleotide
  Target: SCN10A; (-) strand; PAM type: YTN; PAM sequence: TTT
gattcattcttctatccaac

SEQ ID NO: 44342 - DNA, 20 bp, Artificial Sequence
  Description of Artificial Sequence: Synthetic oligonucleotide
  Target: SCN10A; (-) strand; PAM type: YTN; PAM sequence: TTT
tgattcattcttctatccaa

SEQ ID NO: 44343 - DNA, 20 bp, Artificial Sequence
  Description of Artificial Sequence: Synthetic oligonucleotide
  Target: SCN10A; (-) strand; PAM type: YTN; PAM sequence: CTT
ttgattcattcttctatcca

SEQ ID NO: 44344 - DNA, 20 bp, Artificial Sequence
  Description of Artificial Sequence: Synthetic oligonucleotide
  Target: SCN10A; (-) strand; PAM type: YTN; PAM sequence: CTA
tcttttgattcattcttcta

SEQ ID NO: 44345 - DNA, 20 bp, Artificial Sequence
  Description of Artificial Sequence: Synthetic oligonucleotide
  Target: SCN10A; (-) strand; PAM type: YTN; PAM sequence: TTC
tatcttttgattcattcttc

SEQ ID NO: 44346 - DNA, 20 bp, Artificial Sequence
  Description of Artificial Sequence: Synthetic oligonucleotide
  Target: SCN10A; (-) strand; PAM type: YTN; PAM sequence: TTT
ctatcttttgattcattctt

SEQ ID NO: 44347 - DNA, 20 bp, Artificial Sequence
  Description of Artificial Sequence: Synthetic oligonucleotide
  Target: SCN10A; (-) strand; PAM type: YTN; PAM sequence: CTT
tctatcttttgattcattct

SEQ ID NO: 44348 - DNA, 20 bp, Artificial Sequence
  Description of Artificial Sequence: Synthetic oligonucleotide
  Target: SCN10A; (-) strand; PAM type: YTN; PAM sequence: TTA
tatctttctatcttttgatt

SEQ ID NO: 44349 - DNA, 20 bp, Artificial Sequence
  Description of Artificial Sequence: Synthetic oligonucleotide
  Target: SCN10A; (-) strand; PAM type: YTN; PAM sequence: CTT
atatctttctatcttttgat

SEQ ID NO: 44350 - DNA, 20 bp, Artificial Sequence
  Description of Artificial Sequence: Synthetic oligonucleotide
  Target: SCN10A; (-) strand; PAM type: YTN; PAM sequence: TTA
acccttatatctttctatct

SEQ ID NO: 44351 - DNA, 20 bp, Artificial Sequence
  Description of Artificial Sequence: Synthetic oligonucleotide
  Target: SCN10A; (-) strand; PAM type: YTN; PAM sequence: CTT
aacccttatatctttctatc

SEQ ID NO: 44352 - DNA, 20 bp, Artificial Sequence
  Description of Artificial Sequence: Synthetic oligonucleotide
  Target: SCN10A; (-) strand; PAM type: YTN; PAM sequence: TTC
atcatccttaacccttatat

SEQ ID NO: 44353 - DNA, 20 bp, Artificial Sequence
  Description of Artificial Sequence: Synthetic oligonucleotide
  Target: SCN10A; (-) strand; PAM type: YTN; PAM sequence: CTA
ttcatcatccttaaccctta

SEQ ID NO: 44354 - DNA, 20 bp, Artificial Sequence
  Description of Artificial Sequence: Synthetic oligonucleotide
  Target: SCN10A; (-) strand; PAM type: YTN; PAM sequence: TTC
catctattcatcatccttaa

SEQ ID NO: 44355 - DNA, 20 bp, Artificial Sequence
  Description of Artificial Sequence: Synthetic oligonucleotide
  Target: SCN10A; (-) strand; PAM type: YTN; PAM sequence: CTT
ccatctattcatcatcctta

SEQ ID NO: 44356 - DNA, 20 bp, Artificial Sequence
  Description of Artificial Sequence: Synthetic oligonucleotide
  Target: SCN10A; (-) strand; PAM type: YTN; PAM sequence: TTC
cttccatctattcatcatcc

SEQ ID NO: 44357 - DNA, 20 bp, Artificial Sequence
  Description of Artificial Sequence: Synthetic oligonucleotide
  Target: SCN10A; (-) strand; PAM type: YTN; PAM sequence: CTT
ccttccatctattcatcatc

SEQ ID NO: 44358 - DNA, 20 bp, Artificial Sequence
  Description of Artificial Sequence: Synthetic oligonucleotide
  Target: SCN10A; (-) strand; PAM type: YTN; PAM sequence: CTA
aacttccttccatctattca

SEQ ID NO: 44359 - DNA, 20 bp, Artificial Sequence
  Description of Artificial Sequence: Synthetic oligonucleotide
  Target: SCN10A; (-) strand; PAM type: YTN; PAM sequence: TTC
taaacttccttccatctatt

SEQ ID NO: 44360 - DNA, 20 bp, Artificial Sequence
  Description of Artificial Sequence: Synthetic oligonucleotide
  Target: SCN10A; (-) strand; PAM type: YTN; PAM sequence: TTA
ttctaaacttccttccatct

SEQ ID NO: 44361 - DNA, 20 bp, Artificial Sequence
  Description of Artificial Sequence: Synthetic oligonucleotide
  Target: SCN10A; (-) strand; PAM type: YTN; PAM sequence: TTT
attctaaacttccttccatc

SEQ ID NO: 44362 - DNA, 20 bp, Artificial Sequence
  Description of Artificial Sequence: Synthetic oligonucleotide
  Target: SCN10A; (-) strand; PAM type: YTN; PAM sequence: TTT
tattctaaacttccttccat

SEQ ID NO: 44363 - DNA, 20 bp, Artificial Sequence
  Description of Artificial Sequence: Synthetic oligonucleotide
  Target: SCN10A; (-) strand; PAM type: YTN; PAM sequence: CTT
ttattctaaacttccttcca

SEQ ID NO: 44364 - DNA, 20 bp, Artificial Sequence
  Description of Artificial Sequence: Synthetic oligonucleotide
  Target: SCN10A; (-) strand; PAM type: YTN; PAM sequence: CTG
cccaatcttttattctaaac

SEQ ID NO: 44365 - DNA, 20 bp, Artificial Sequence
  Description of Artificial Sequence: Synthetic oligonucleotide
  Target: SCN10A; (-) strand; PAM type: YTN; PAM sequence: TTC
tgcccaatcttttattctaa

SEQ ID NO: 44366 - DNA, 20 bp, Artificial Sequence
  Description of Artificial Sequence: Synthetic oligonucleotide
  Target: SCN10A; (-) strand; PAM type: YTN; PAM sequence: CTT
ctgcccaatcttttattcta

SEQ ID NO: 44367 - DNA, 20 bp, Artificial Sequence
  Description of Artificial Sequence: Synthetic oligonucleotide
  Target: SCN10A; (-) strand; PAM type: YTN; PAM sequence: CTC
ttctgcccaatcttttattc

SEQ ID NO: 44368 - DNA, 20 bp, Artificial Sequence
  Description of Artificial Sequence: Synthetic oligonucleotide
  Target: SCN10A; (-) strand; PAM type: YTN; PAM sequence: TTC
tcttctgcccaatcttttat

SEQ ID NO: 44369 - DNA, 20 bp, Artificial Sequence
  Description of Artificial Sequence: Synthetic oligonucleotide
  Target: SCN10A; (-) strand; PAM type: YTN; PAM sequence: CTT
ctcttctgcccaatctttta

SEQ ID NO: 44370 - DNA, 20 bp, Artificial Sequence
  Description of Artificial Sequence: Synthetic oligonucleotide
  Target: SCN10A; (-) strand; PAM type: YTN; PAM sequence: CTC
ttctcttctgcccaatcttt

SEQ ID NO: 44371 - DNA, 20 bp, Artificial Sequence
  Description of Artificial Sequence: Synthetic oligonucleotide
  Target: SCN10A; (-) strand; PAM type: YTN; PAM sequence: TTC
cctcttctcttctgcccaat

SEQ ID NO: 44372 - DNA, 20 bp, Artificial Sequence
  Description of Artificial Sequence: Synthetic oligonucleotide
  Target: SCN10A; (-) strand; PAM type: YTN; PAM sequence: TTT
ccctcttctcttctgcccaa

SEQ ID NO: 44373 - DNA, 20 bp, Artificial Sequence
  Description of Artificial Sequence: Synthetic oligonucleotide
  Target: SCN10A; (-) strand; PAM type: YTN; PAM sequence: CTT
tccctcttctcttctgccca

SEQ ID NO: 44374 - DNA, 20 bp, Artificial Sequence
  Description of Artificial Sequence: Synthetic oligonucleotide
  Target: SCN10A; (-) strand; PAM type: YTN; PAM sequence: TTC
tttccctcttctcttctgcc

SEQ ID NO: 44375 - DNA, 20 bp, Artificial Sequence
  Description of Artificial Sequence: Synthetic oligonucleotide
  Target: SCN10A; (-) strand; PAM type: YTN; PAM sequence: CTT
ctttccctcttctcttctgc

SEQ ID NO: 44376 - DNA, 20 bp, Artificial Sequence
  Description of Artificial Sequence: Synthetic oligonucleotide
  Target: SCN10A; (-) strand; PAM type: YTN; PAM sequence: TTC
ttctttccctcttctcttct

SEQ ID NO: 44377 - DNA, 20 bp, Artificial Sequence
  Description of Artificial Sequence: Synthetic oligonucleotide
  Target: SCN10A; (-) strand; PAM type: YTN; PAM sequence: TTC
ccattcttctttccctcttc

SEQ ID NO: 44378 - DNA, 20 bp, Artificial Sequence
  Description of Artificial Sequence: Synthetic oligonucleotide
  Target: SCN10A; (-) strand; PAM type: YTN; PAM sequence: TTC
catccatccattcccattct

SEQ ID NO: 44379 - DNA, 20 bp, Artificial Sequence
  Description of Artificial Sequence: Synthetic oligonucleotide
  Target: SCN10A; (-) strand; PAM type: YTN; PAM sequence: CTT
ccatccatccattcccattc

SEQ ID NO: 44380 - DNA, 20 bp, Artificial Sequence
  Description of Artificial Sequence: Synthetic oligonucleotide
  Target: SCN10A; (-) strand; PAM type: YTN; PAM sequence: CTC
cccttccatccatccattcc

SEQ ID NO: 44381 - DNA, 20 bp, Artificial Sequence
  Description of Artificial Sequence: Synthetic oligonucleotide
  Target: SCN10A; (-) strand; PAM type: YTN; PAM sequence: TTC
atcagtcctccccttccatc

SEQ ID NO: 44382 - DNA, 20 bp, Artificial Sequence
  Description of Artificial Sequence: Synthetic oligonucleotide
  Target: SCN10A; (-) strand; PAM type: YTN; PAM sequence: CTT
catcagtcctccccttccat

SEQ ID NO: 44383 - DNA, 20 bp, Artificial Sequence
  Description of Artificial Sequence: Synthetic oligonucleotide
  Target: SCN10A; (-) strand; PAM type: YTN; PAM sequence: CTG
tacatcttcatcagtcctcc

SEQ ID NO: 44384 - DNA, 20 bp, Artificial Sequence
  Description of Artificial Sequence: Synthetic oligonucleotide
  Target: SCN10A; (-) strand; PAM type: YTN; PAM sequence: TTC
cagctgtacatcttcatcag

SEQ ID NO: 44385 - DNA, 20 bp, Artificial Sequence
  Description of Artificial Sequence: Synthetic oligonucleotide
  Target: SCN10A; (-) strand; PAM type: YTN; PAM sequence: CTT
ccagctgtacatcttcatca

SEQ ID NO: 44386 - DNA, 20 bp, Artificial Sequence
  Description of Artificial Sequence: Synthetic oligonucleotide
  Target: SCN10A; (-) strand; PAM type: YTN; PAM sequence: TTC
ttccagctgtacatcttcat

SEQ ID NO: 44387 - DNA, 20 bp, Artificial Sequence
  Description of Artificial Sequence: Synthetic oligonucleotide
  Target: SCN10A; (-) strand; PAM type: YTN; PAM sequence: TTT
cttccagctgtacatcttca

SEQ ID NO: 44388 - DNA, 20 bp, Artificial Sequence
  Description of Artificial Sequence: Synthetic oligonucleotide
  Target: SCN10A; (-) strand; PAM type: YTN; PAM sequence: TTA
tttcttccagctgtacatct

SEQ ID NO: 44389 - DNA, 20 bp, Artificial Sequence
  Description of Artificial Sequence: Synthetic oligonucleotide
  Target: SCN10A; (-) strand; PAM type: YTN; PAM sequence: TTT
atttcttccagctgtacatc

SEQ ID NO: 44390 - DNA, 20 bp, Artificial Sequence
  Description of Artificial Sequence: Synthetic oligonucleotide
  Target: SCN10A; (-) strand; PAM type: YTN; PAM sequence: CTT
tatttcttccagctgtacat

SEQ ID NO: 44391 - DNA, 20 bp, Artificial Sequence
  Description of Artificial Sequence: Synthetic oligonucleotide
  Target: SCN10A; (-) strand; PAM type: YTN; PAM sequence: CTC
ccaaacatccatccatcttt

SEQ ID NO: 44392 - DNA, 20 bp, Artificial Sequence
  Description of Artificial Sequence: Synthetic oligonucleotide
  Target: SCN10A; (-) strand; PAM type: YTN; PAM sequence: TTC
ctcccaaacatccatccatc

SEQ ID NO: 44393 - DNA, 20 bp, Artificial Sequence
  Description of Artificial Sequence: Synthetic oligonucleotide
  Target: SCN10A; (-) strand; PAM type: YTN; PAM sequence: CTT
cctcccaaacatccatccat

SEQ ID NO: 44394 - DNA, 20 bp, Artificial Sequence
  Description of Artificial Sequence: Synthetic oligonucleotide
  Target: SCN10A; (-) strand; PAM type: YTN; PAM sequence: TTC
cttcctcccaaacatccatc

SEQ ID NO: 44395 - DNA, 20 bp, Artificial Sequence
  Description of Artificial Sequence: Synthetic oligonucleotide
  Target: SCN10A; (-) strand; PAM type: YTN; PAM sequence: TTT
ccttcctcccaaacatccat

SEQ ID NO: 44396 - DNA, 20 bp, Artificial Sequence
  Description of Artificial Sequence: Synthetic oligonucleotide
  Target: SCN10A; (-) strand; PAM type: YTN; PAM sequence: TTT
tccttcctcccaaacatcca

SEQ ID NO: 44397 - DNA, 20 bp, Artificial Sequence
  Description of Artificial Sequence: Synthetic oligonucleotide
  Target: SCN10A; (-) strand; PAM type: YTN; PAM sequence: TTT
ttccttcctcccaaacatcc

SEQ ID NO: 44398 - DNA, 20 bp, Artificial Sequence
  Description of Artificial Sequence: Synthetic oligonucleotide
  Target: SCN10A; (-) strand; PAM type: YTN; PAM sequence: CTT
tttccttcctcccaaacatc

SEQ ID NO: 44399 - DNA, 20 bp, Artificial Sequence
  Description of Artificial Sequence: Synthetic oligonucleotide
  Target: SCN10A; (-) strand; PAM type: YTN; PAM sequence: TTC
ctttttccttcctcccaaac

SEQ ID NO: 44400 - DNA, 20 bp, Artificial Sequence
  Description of Artificial Sequence: Synthetic oligonucleotide
  Target: SCN10A; (-) strand; PAM type: YTN; PAM sequence: CTT
cctttttccttcctcccaaa

SEQ ID NO: 44401 - DNA, 20 bp, Artificial Sequence
  Description of Artificial Sequence: Synthetic oligonucleotide
  Target: SCN10A; (-) strand; PAM type: YTN; PAM sequence: TTC
agtcttcctttttccttcct

SEQ ID NO: 44402 - DNA, 20 bp, Artificial Sequence
  Description of Artificial Sequence: Synthetic oligonucleotide
  Target: SCN10A; (-) strand; PAM type: YTN; PAM sequence: TTG
tatccaaccattcagtcttc

SEQ ID NO: 44403 - DNA, 20 bp, Artificial Sequence
  Description of Artificial Sequence: Synthetic oligonucleotide
  Target: SCN10A; (-) strand; PAM type: YTN; PAM sequence: TTT
gtatccaaccattcagtctt

SEQ ID NO: 44404 - DNA, 20 bp, Artificial Sequence
  Description of Artificial Sequence: Synthetic oligonucleotide
  Target: SCN10A; (-) strand; PAM type: YTN; PAM sequence: TTT
tgtatccaaccattcagtct

SEQ ID NO: 44405 - DNA, 20 bp, Artificial Sequence
  Description of Artificial Sequence: Synthetic oligonucleotide
  Target: SCN10A; (-) strand; PAM type: YTN; PAM sequence: CTT
ttgtatccaaccattcagtc

SEQ ID NO: 44406 - DNA, 20 bp, Artificial Sequence
  Description of Artificial Sequence: Synthetic oligonucleotide
  Target: SCN10A; (-) strand; PAM type: YTN; PAM sequence: TTC
accttttgtatccaaccatt

SEQ ID NO: 44407 - DNA, 20 bp, Artificial Sequence
  Description of Artificial Sequence: Synthetic oligonucleotide
  Target: SCN10A; (-) strand; PAM type: YTN; PAM sequence: TTT
caccttttgtatccaaccat

SEQ ID NO: 44408 - DNA, 20 bp, Artificial Sequence
  Description of Artificial Sequence: Synthetic oligonucleotide
  Target: SCN10A; (-) strand; PAM type: YTN; PAM sequence: TTC
catacatttcaccttttgta

SEQ ID NO: 44409 - DNA, 20 bp, Artificial Sequence
  Description of Artificial Sequence: Synthetic oligonucleotide
  Target: SCN10A; (-) strand; PAM type: YTN; PAM sequence: CTT
ccatacatttcaccttttgt

SEQ ID NO: 44410 - DNA, 20 bp, Artificial Sequence
  Description of Artificial Sequence: Synthetic oligonucleotide
  Target: SCN10A; (-) strand; PAM type: YTN; PAM sequence: TTC
cttccatacatttcaccttt

SEQ ID NO: 44411 - DNA, 20 bp, Artificial Sequence
  Description of Artificial Sequence: Synthetic oligonucleotide
  Target: SCN10A; (-) strand; PAM type: YTN; PAM sequence: CTT
ccttccatacatttcacctt

SEQ ID NO: 44412 - DNA, 20 bp, Artificial Sequence
  Description of Artificial Sequence: Synthetic oligonucleotide
  Target: SCN10A; (-) strand; PAM type: YTN; PAM sequence: TTC
caaccatccatccttccttc

SEQ ID NO: 44413 - DNA, 20 bp, Artificial Sequence
  Description of Artificial Sequence: Synthetic oligonucleotide
  Target: SCN10A; (-) strand; PAM type: YTN; PAM sequence: CTT
ccaaccatccatccttcctt

SEQ ID NO: 44414 - DNA, 20 bp, Artificial Sequence
  Description of Artificial Sequence: Synthetic oligonucleotide
  Target: SCN10A; (-) strand; PAM type: YTN; PAM sequence: TTC
cttccaaccatccatccttc

SEQ ID NO: 44415 - DNA, 20 bp, Artificial Sequence
  Description of Artificial Sequence: Synthetic oligonucleotide
  Target: SCN10A; (-) strand; PAM type: YTN; PAM sequence: CTT
ccttccaaccatccatcctt

SEQ ID NO: 44416 - DNA, 20 bp, Artificial Sequence
  Description of Artificial Sequence: Synthetic oligonucleotide
  Target: SCN10A; (-) strand; PAM type: YTN; PAM sequence: TTC
ttccttccaaccatccatcc

SEQ ID NO: 44417 - DNA, 20 bp, Artificial Sequence
  Description of Artificial Sequence: Synthetic oligonucleotide
  Target: SCN10A; (-) strand; PAM type: YTN; PAM sequence: CTG
attcttccttccaaccatcc

SEQ ID NO: 44418 - DNA, 20 bp, Artificial Sequence
  Description of Artificial Sequence: Synthetic oligonucleotide
  Target: SCN10A; (-) strand; PAM type: YTN; PAM sequence: CTA
ctgattcttccttccaacca

SEQ ID NO: 44419 - DNA, 20 bp, Artificial Sequence
  Description of Artificial Sequence: Synthetic oligonucleotide
  Target: SCN10A; (-) strand; PAM type: YTN; PAM sequence: TTC
ctactgattcttccttccaa

SEQ ID NO: 44420 - DNA, 20 bp, Artificial Sequence
  Description of Artificial Sequence: Synthetic oligonucleotide
  Target: SCN10A; (-) strand; PAM type: YTN; PAM sequence: CTT
cctactgattcttccttcca

SEQ ID NO: 44421 - DNA, 20 bp, Artificial Sequence
  Description of Artificial Sequence: Synthetic oligonucleotide
  Target: SCN10A; (-) strand; PAM type: YTN; PAM sequence: TTC
atccatcttcctactgattc

SEQ ID NO: 44422 - DNA, 20 bp, Artificial Sequence
  Description of Artificial Sequence: Synthetic oligonucleotide
  Target: SCN10A; (-) strand; PAM type: YTN; PAM sequence: TTT
catccatcttcctactgatt

SEQ ID NO: 44423 - DNA, 20 bp, Artificial Sequence
  Description of Artificial Sequence: Synthetic oligonucleotide
  Target: SCN10A; (-) strand; PAM type: YTN; PAM sequence: CTC
atttcatccatcttcctact

SEQ ID NO: 44424 - DNA, 20 bp, Artificial Sequence
  Description of Artificial Sequence: Synthetic oligonucleotide
  Target: SCN10A; (-) strand; PAM type: YTN; PAM sequence: TTA
aacggtcatgcactcatttc

SEQ ID NO: 44425 - DNA, 20 bp, Artificial Sequence
  Description of Artificial Sequence: Synthetic oligonucleotide
  Target: SCN10A; (-) strand; PAM type: YTN; PAM sequence: CTT
aaacggtcatgcactcattt

SEQ ID NO: 44426 - DNA, 20 bp, Artificial Sequence
  Description of Artificial Sequence: Synthetic oligonucleotide
  Target: SCN10A; (-) strand; PAM type: YTN; PAM sequence: CTA
atcaccttaaacggtcatgc

SEQ ID NO: 44427 - DNA, 20 bp, Artificial Sequence
  Description of Artificial Sequence: Synthetic oligonucleotide
  Target: SCN10A; (-) strand; PAM type: YTN; PAM sequence: CTC
agtcctaatcaccttaaacg

SEQ ID NO: 44428 - DNA, 20 bp, Artificial Sequence
  Description of Artificial Sequence: Synthetic oligonucleotide
  Target: SCN10A; (-) strand; PAM type: YTN; PAM sequence: CTC
accagtctcagtcctaatca

SEQ ID NO: 44429 - DNA, 20 bp, Artificial Sequence
  Description of Artificial Sequence: Synthetic oligonucleotide
  Target: SCN10A; (-) strand; PAM type: YTN; PAM sequence: TTG
atctcaccagtctcagtcct

SEQ ID NO: 44430 - DNA, 20 bp, Artificial Sequence
  Description of Artificial Sequence: Synthetic oligonucleotide
  Target: SCN10A; (-) strand; PAM type: YTN; PAM sequence: TTA
tgttgatctcaccagtctca

SEQ ID NO: 44431 - DNA, 20 bp, Artificial Sequence
  Description of Artificial Sequence: Synthetic oligonucleotide
  Target: SCN10A; (-) strand; PAM type: YTN; PAM sequence: CTT
atgttgatctcaccagtctc

SEQ ID NO: 44432 - DNA, 20 bp, Artificial Sequence
  Description of Artificial Sequence: Synthetic oligonucleotide
  Target: SCN10A; (-) strand; PAM type: YTN; PAM sequence: CTG
cttatgttgatctcaccagt

SEQ ID NO: 44433 - DNA, 20 bp, Artificial Sequence
  Description of Artificial Sequence: Synthetic oligonucleotide
  Target: SCN10A; (-) strand; PAM type: YTN; PAM sequence: CTC
ctgcttatgttgatctcacc

SEQ ID NO: 44434 - DNA, 20 bp, Artificial Sequence
  Description of Artificial Sequence: Synthetic oligonucleotide
  Target: SCN10A; (-) strand; PAM type: YTN; PAM sequence: TTG
ggggcacagtcactcctgct

SEQ ID NO: 44435 - DNA, 20 bp, Artificial Sequence
  Description of Artificial Sequence: Synthetic oligonucleotide
  Target: SCN10A; (-) strand; PAM type: YTN; PAM sequence: TTT
gggggcacagtcactcctgc

SEQ ID NO: 44436 - DNA, 20 bp, Artificial Sequence
  Description of Artificial Sequence: Synthetic oligonucleotide
  Target: SCN10A; (-) strand; PAM type: YTN; PAM sequence: CTT
tgggggcacagtcactcctg

SEQ ID NO: 44437 - DNA, 20 bp, Artificial Sequence
  Description of Artificial Sequence: Synthetic oligonucleotide
  Target: SCN10A; (-) strand; PAM type: YTN; PAM sequence: TTC
cggtgtcccacccctttggg

SEQ ID NO: 44438 - DNA, 20 bp, Artificial Sequence
  Description of Artificial Sequence: Synthetic oligonucleotide
  Target: SCN10A; (-) strand; PAM type: YTN; PAM sequence: TTA
ttccggtgtcccaccccttt

SEQ ID NO: 44439 - DNA, 20 bp, Artificial Sequence
  Description of Artificial Sequence: Synthetic oligonucleotide
  Target: SCN10A; (-) strand; PAM type: YTN; PAM sequence: TTT
attccggtgtcccacccctt

SEQ ID NO: 44440 - DNA, 20 bp, Artificial Sequence
  Description of Artificial Sequence: Synthetic oligonucleotide
  Target: SCN10A; (-) strand; PAM type: YTN; PAM sequence: TTA
tttattccggtgtcccaccc

SEQ ID NO: 44441 - DNA, 20 bp, Artificial Sequence
  Description of Artificial Sequence: Synthetic oligonucleotide
  Target: SCN10A; (-) strand; PAM type: YTN; PAM sequence: TTC
ataaatgaaaggaaaattat

SEQ ID NO: 44442 - DNA, 20 bp, Artificial Sequence
  Description of Artificial Sequence: Synthetic oligonucleotide
  Target: SCN10A; (-) strand; PAM type: YTN; PAM sequence: TTA
ttcataaatgaaaggaaaat

SEQ ID NO: 44443 - DNA, 20 bp, Artificial Sequence
  Description of Artificial Sequence: Synthetic oligonucleotide
  Target: SCN10A; (-) strand; PAM type: YTN; PAM sequence: CTG
tgcatatgaaataattattc

SEQ ID NO: 44444 - DNA, 20 bp, Artificial Sequence
  Description of Artificial Sequence: Synthetic oligonucleotide
  Target: SCN10A; (-) strand; PAM type: YTN; PAM sequence: TTC
tgtgcatatgaaataattat

SEQ ID NO: 44445 - DNA, 20 bp, Artificial Sequence
  Description of Artificial Sequence: Synthetic oligonucleotide
  Target: SCN10A; (-) strand; PAM type: YTN; PAM sequence: CTG
agtcatgggtgataattctg

SEQ ID NO: 44446 - DNA, 20 bp, Artificial Sequence
  Description of Artificial Sequence: Synthetic oligonucleotide
  Target: SCN10A; (-) strand; PAM type: YTN; PAM sequence: CTG
aaatctgagtcatgggtgat

SEQ ID NO: 44447 - DNA, 20 bp, Artificial Sequence
  Description of Artificial Sequence: Synthetic oligonucleotide
  Target: SCN10A; (-) strand; PAM type: YTN; PAM sequence: CTG
tgaggcctgaaatctgagtc

SEQ ID NO: 44448 - DNA, 20 bp, Artificial Sequence
  Description of Artificial Sequence: Synthetic oligonucleotide
  Target: SCN10A; (-) strand; PAM type: YTN; PAM sequence: TTA
gctgtgaggcctgaaatctg

SEQ ID NO: 44449 - DNA, 20 bp, Artificial Sequence
  Description of Artificial Sequence: Synthetic oligonucleotide
  Target: SCN10A; (-) strand; PAM type: YTN; PAM sequence: CTG
taccacaaggattagctgtg

SEQ ID NO: 44450 - DNA, 20 bp, Artificial Sequence
  Description of Artificial Sequence: Synthetic oligonucleotide
  Target: SCN10A; (-) strand; PAM type: YTN; PAM sequence: TTC
aggccactgtaccacaagga

SEQ ID NO: 44451 - DNA, 20 bp, Artificial Sequence
  Description of Artificial Sequence: Synthetic oligonucleotide
  Target: SCN10A; (-) strand; PAM type: YTN; PAM sequence: CTT
caggccactgtaccacaagg

SEQ ID NO: 44452 - DNA, 20 bp, Artificial Sequence
  Description of Artificial Sequence: Synthetic oligonucleotide
  Target: SCN10A; (-) strand; PAM type: YTN; PAM sequence: CTA
gcagcttcaggccactgtac

SEQ ID NO: 44453 - DNA, 20 bp, Artificial Sequence
  Description of Artificial Sequence: Synthetic oligonucleotide
  Target: SCN10A; (-) strand; PAM type: YTN; PAM sequence: CTG
atgccaatgcactagcagct

SEQ ID NO: 44454 - DNA, 20 bp, Artificial Sequence
  Description of Artificial Sequence: Synthetic oligonucleotide
  Target: SCN10A; (-) strand; PAM type: YTN; PAM sequence: TTC
cctgatgccaatgcactagc

SEQ ID NO: 44455 - DNA, 20 bp, Artificial Sequence
  Description of Artificial Sequence: Synthetic oligonucleotide
  Target: SCN10A; (-) strand; PAM type: YTN; PAM sequence: CTT
ccctgatgccaatgcactag

SEQ ID NO: 44456 - DNA, 20 bp, Artificial Sequence
  Description of Artificial Sequence: Synthetic oligonucleotide
  Target: SCN10A; (-) strand; PAM type: YTN; PAM sequence: TTC
ttccctgatgccaatgcact

SEQ ID NO: 44457 - DNA, 20 bp, Artificial Sequence
  Description of Artificial Sequence: Synthetic oligonucleotide
  Target: SCN10A; (-) strand; PAM type: YTN; PAM sequence: CTT
cttccctgatgccaatgcac

SEQ ID NO: 44458 - DNA, 20 bp, Artificial Sequence
  Description of Artificial Sequence: Synthetic oligonucleotide
  Target: SCN10A; (-) strand; PAM type: YTN; PAM sequence: CTC
ttcttccctgatgccaatgc

SEQ ID NO: 44459 - DNA, 20 bp, Artificial Sequence
  Description of Artificial Sequence: Synthetic oligonucleotide
  Target: SCN10A; (-) strand; PAM type: YTN; PAM sequence: TTC
tcttcttccctgatgccaat

SEQ ID NO: 44460 - DNA, 20 bp, Artificial Sequence
  Description of Artificial Sequence: Synthetic oligonucleotide
  Target: SCN10A; (-) strand; PAM type: YTN; PAM sequence: TTC
aattctcttcttccctgatg

SEQ ID NO: 44461 - DNA, 20 bp, Artificial Sequence
  Description of Artificial Sequence: Synthetic oligonucleotide
  Target: SCN10A; (-) strand; PAM type: YTN; PAM sequence: CTG
tgcattcaattctcttcttc

SEQ ID NO: 44462 - DNA, 20 bp, Artificial Sequence
  Description of Artificial Sequence: Synthetic oligonucleotide
  Target: SCN10A; (-) strand; PAM type: YTN; PAM sequence: CTC
catagcaggcctgtgcattc

SEQ ID NO: 44463 - DNA, 20 bp, Artificial Sequence
  Description of Artificial Sequence: Synthetic oligonucleotide
  Target: SCN10A; (-) strand; PAM type: YTN; PAM sequence: CTG
gcaggtcctccatagcaggc

SEQ ID NO: 44464 - DNA, 20 bp, Artificial Sequence
  Description of Artificial Sequence: Synthetic oligonucleotide
  Target: SCN10A; (-) strand; PAM type: YTN; PAM sequence: CTG
tgctggcaggtcctccatag

SEQ ID NO: 44465 - DNA, 20 bp, Artificial Sequence
  Description of Artificial Sequence: Synthetic oligonucleotide
  Target: SCN10A; (-) strand; PAM type: YTN; PAM sequence: CTC
ctgtgctggcaggtcctcca

SEQ ID NO: 44466 - DNA, 20 bp, Artificial Sequence
  Description of Artificial Sequence: Synthetic oligonucleotide
  Target: SCN10A; (-) strand; PAM type: YTN; PAM sequence: CTG
tccagcctcctgtgctggca

SEQ ID NO: 44467 - DNA, 20 bp, Artificial Sequence
  Description of Artificial Sequence: Synthetic oligonucleotide
  Target: SCN10A; (-) strand; PAM type: YTN; PAM sequence: TTC
tgtccagcctcctgtgctgg

SEQ ID NO: 44468 - DNA, 20 bp, Artificial Sequence
  Description of Artificial Sequence: Synthetic oligonucleotide
  Target: SCN10A; (-) strand; PAM type: YTN; PAM sequence: TTC
agcacagaacattctgtcca

SEQ ID NO: 44469 - DNA, 20 bp, Artificial Sequence
  Description of Artificial Sequence: Synthetic oligonucleotide
  Target: SCN10A; (-) strand; PAM type: YTN; PAM sequence: CTG
gatgaggttcagcacagaac

SEQ ID NO: 44470 - DNA, 20 bp, Artificial Sequence
  Description of Artificial Sequence: Synthetic oligonucleotide
  Target: SCN10A; (-) strand; PAM type: YTN; PAM sequence: CTG
aagctggatgaggttcagca

SEQ ID NO: 44471 - DNA, 20 bp, Artificial Sequence
  Description of Artificial Sequence: Synthetic oligonucleotide
  Target: SCN10A; (-) strand; PAM type: YTN; PAM sequence: CTC
ctgaagctggatgaggttca

SEQ ID NO: 44472 - DNA, 20 bp, Artificial Sequence
  Description of Artificial Sequence: Synthetic oligonucleotide
  Target: SCN10A; (-) strand; PAM type: YTN; PAM sequence: TTG
cctcctgaagctggatgagg

SEQ ID NO: 44473 - DNA, 20 bp, Artificial Sequence
  Description of Artificial Sequence: Synthetic oligonucleotide
  Target: SCN10A; (-) strand; PAM type: YTN; PAM sequence: CTT
gcctcctgaagctggatgag

SEQ ID NO: 44474 - DNA, 20 bp, Artificial Sequence
  Description of Artificial Sequence: Synthetic oligonucleotide
  Target: SCN10A; (-) strand; PAM type: YTN; PAM sequence: TTG
gtgcttgcctcctgaagctg

SEQ ID NO: 44475 - DNA, 20 bp, Artificial Sequence
  Description of Artificial Sequence: Synthetic oligonucleotide
  Target: SCN10A; (-) strand; PAM type: YTN; PAM sequence: TTT
ggtgcttgcctcctgaagct

SEQ ID NO: 44476 - DNA, 20 bp, Artificial Sequence
  Description of Artificial Sequence: Synthetic oligonucleotide
  Target: SCN10A; (-) strand; PAM type: YTN; PAM sequence: CTG
tatttggtgcttgcctcctg

SEQ ID NO: 44477 - DNA, 20 bp, Artificial Sequence
  Description of Artificial Sequence: Synthetic oligonucleotide
  Target: SCN10A; (-) strand; PAM type: YTN; PAM sequence: CTG
cccagcagaggtgtcaggaa

SEQ ID NO: 44478 - DNA, 20 bp, Artificial Sequence
  Description of Artificial Sequence: Synthetic oligonucleotide
  Target: SCN10A; (-) strand; PAM type: YTN; PAM sequence: CTG
ccagcagcaaggtctgccca

SEQ ID NO: 44479 - DNA, 20 bp, Artificial Sequence
  Description of Artificial Sequence: Synthetic oligonucleotide
  Target: SCN10A; (-) strand; PAM type: YTN; PAM sequence: CTC
aagcagctgccagcagcaag

SEQ ID NO: 44480 - DNA, 20 bp, Artificial Sequence
  Description of Artificial Sequence: Synthetic oligonucleotide
  Target: SCN10A; (-) strand; PAM type: YTN; PAM sequence: CTG
ccccactcaagcagctgcca

SEQ ID NO: 44481 - DNA, 20 bp, Artificial Sequence
  Description of Artificial Sequence: Synthetic oligonucleotide
  Target: SCN10A; (-) strand; PAM type: YTN; PAM sequence: CTG
cctgccccactcaagcagct

SEQ ID NO: 44482 - DNA, 20 bp, Artificial Sequence
  Description of Artificial Sequence: Synthetic oligonucleotide
  Target: SCN10A; (-) strand; PAM type: YTN; PAM sequence: CTC
tgcctgccccactcaagcag

SEQ ID NO: 44483 - DNA, 20 bp, Artificial Sequence
  Description of Artificial Sequence: Synthetic oligonucleotide
  Target: SCN10A; (-) strand; PAM type: YTN; PAM sequence: TTG
gtctctgcctgccccactca

SEQ ID NO: 44484 - DNA, 20 bp, Artificial Sequence
  Description of Artificial Sequence: Synthetic oligonucleotide
  Target: SCN10A; (-) strand; PAM type: YTN; PAM sequence: CTG
tgttggtctctgcctgcccc

SEQ ID NO: 44485 - DNA, 20 bp, Artificial Sequence
  Description of Artificial Sequence: Synthetic oligonucleotide
  Target: SCN10A; (-) strand; PAM type: YTN; PAM sequence: CTG
caagcagggtgaggcatgtg

SEQ ID NO: 44486 - DNA, 20 bp, Artificial Sequence
  Description of Artificial Sequence: Synthetic oligonucleotide
  Target: SCN10A; (-) strand; PAM type: YTN; PAM sequence: TTC
tgcaagcagggtgaggcatg

SEQ ID NO: 44487 - DNA, 20 bp, Artificial Sequence
  Description of Artificial Sequence: Synthetic oligonucleotide
  Target: SCN10A; (-) strand; PAM type: YTN; PAM sequence: TTT
ctgcaagcagggtgaggcat

SEQ ID NO: 44488 - DNA, 20 bp, Artificial Sequence
  Description of Artificial Sequence: Synthetic oligonucleotide
  Target: SCN10A; (-) strand; PAM type: YTN; PAM sequence: CTG
agggtttctgcaagcagggt

SEQ ID NO: 44489 - DNA, 20 bp, Artificial Sequence
  Description of Artificial Sequence: Synthetic oligonucleotide
  Target: SCN10A; (-) strand; PAM type: YTN; PAM sequence: CTG
ccgcatagctgagggtttct

SEQ ID NO: 44490 - DNA, 20 bp, Artificial Sequence
  Description of Artificial Sequence: Synthetic oligonucleotide
  Target: SCN10A; (-) strand; PAM type: YTN; PAM sequence: TTC
actgccgcatagctgagggt

SEQ ID NO: 44491 - DNA, 20 bp, Artificial Sequence
  Description of Artificial Sequence: Synthetic oligonucleotide
  Target: SCN10A; (-) strand; PAM type: YTN; PAM sequence: CTG
ttcactgccgcatagctgag

SEQ ID NO: 44492 - DNA, 20 bp, Artificial Sequence
  Description of Artificial Sequence: Synthetic oligonucleotide
  Target: SCN10A; (-) strand; PAM type: YTN; PAM sequence: TTA
tctgttcactgccgcatagc

SEQ ID NO: 44493 - DNA, 20 bp, Artificial Sequence
  Description of Artificial Sequence: Synthetic oligonucleotide
  Target: SCN10A; (-) strand; PAM type: YTN; PAM sequence: CTG
agttatctgttcactgccgc

SEQ ID NO: 44494 - DNA, 20 bp, Artificial Sequence
  Description of Artificial Sequence: Synthetic oligonucleotide
  Target: SCN10A; (-) strand; PAM type: YTN; PAM sequence: TTA
actgagttatctgttcactg

SEQ ID NO: 44495 - DNA, 20 bp, Artificial Sequence
  Description of Artificial Sequence: Synthetic oligonucleotide
  Target: SCN10A; (-) strand; PAM type: YTN; PAM sequence: TTG
cagcatggttaactgagtta

SEQ ID NO: 44496 - DNA, 20 bp, Artificial Sequence
  Description of Artificial Sequence: Synthetic oligonucleotide
  Target: SCN10A; (-) strand; PAM type: YTN; PAM sequence: TTT
gcagcatggttaactgagtt

SEQ ID NO: 44497 - DNA, 20 bp, Artificial Sequence
  Description of Artificial Sequence: Synthetic oligonucleotide
  Target: SCN10A; (-) strand; PAM type: YTN; PAM sequence: CTT
tgcagcatggttaactgagt

SEQ ID NO: 44498 - DNA, 20 bp, Artificial Sequence
  Description of Artificial Sequence: Synthetic oligonucleotide
  Target: SCN10A; (-) strand; PAM type: YTN; PAM sequence: TTG
ctttgcagcatggttaactg

SEQ ID NO: 44499 - DNA, 20 bp, Artificial Sequence
  Description of Artificial Sequence: Synthetic oligonucleotide
  Target: SCN10A; (-) strand; PAM type: YTN; PAM sequence: TTT
gctttgcagcatggttaact

SEQ ID NO: 44500 - DNA, 20 bp, Artificial Sequence
  Description of Artificial Sequence: Synthetic oligonucleotide
  Target: SCN10A; (-) strand; PAM type: YTN; PAM sequence: CTT
tgctttgcagcatggttaac

SEQ ID NO: 44501 - DNA, 20 bp, Artificial Sequence
  Description of Artificial Sequence: Synthetic oligonucleotide
  Target: SCN10A; (-) strand; PAM type: YTN; PAM sequence: TTC
tttgctttgcagcatggtta

SEQ ID NO: 44502 - DNA, 20 bp, Artificial Sequence
  Description of Artificial Sequence: Synthetic oligonucleotide
  Target: SCN10A; (-) strand; PAM type: YTN; PAM sequence: CTT
ctttgctttgcagcatggtt

SEQ ID NO: 44503 - DNA, 20 bp, Artificial Sequence
  Description of Artificial Sequence: Synthetic oligonucleotide
  Target: SCN10A; (-) strand; PAM type: YTN; PAM sequence: CTA
ccttctttgctttgcagcat

SEQ ID NO: 44504 - DNA, 20 bp, Artificial Sequence
  Description of Artificial Sequence: Synthetic oligonucleotide
  Target: SCN10A; (-) strand; PAM type: YTN; PAM sequence: CTA
ggccactaccttctttgctt

SEQ ID NO: 44505 - DNA, 20 bp, Artificial Sequence
  Description of Artificial Sequence: Synthetic oligonucleotide
  Target: SCN10A; (-) strand; PAM type: YTN; PAM sequence: CTG
tctaggccactaccttcttt

SEQ ID NO: 44506 - DNA, 20 bp, Artificial Sequence
  Description of Artificial Sequence: Synthetic oligonucleotide
  Target: SCN10A; (-) strand; PAM type: YTN; PAM sequence: CTA
tcactgtctaggccactacc

SEQ ID NO: 44507 - DNA, 20 bp, Artificial Sequence
  Description of Artificial Sequence: Synthetic oligonucleotide
  Target: SCN10A; (-) strand; PAM type: YTN; PAM sequence: TTG
cactatcactgtctaggcca

SEQ ID NO: 44508 - DNA, 20 bp, Artificial Sequence
  Description of Artificial Sequence: Synthetic oligonucleotide
  Target: SCN10A; (-) strand; PAM type: YTN; PAM sequence: TTA
accaccacattgcactatca

SEQ ID NO: 44509 - DNA, 20 bp, Artificial Sequence
  Description of Artificial Sequence: Synthetic oligonucleotide
  Target: SCN10A; (-) strand; PAM type: YTN; PAM sequence: CTT
aaccaccacattgcactatc

SEQ ID NO: 44510 - DNA, 20 bp, Artificial Sequence
  Description of Artificial Sequence: Synthetic oligonucleotide
  Target: SCN10A; (-) strand; PAM type: YTN; PAM sequence: CTC
atcttaaccaccacattgca

SEQ ID NO: 44511 - DNA, 20 bp, Artificial Sequence
  Description of Artificial Sequence: Synthetic oligonucleotide
  Target: SCN10A; (-) strand; PAM type: YTN; PAM sequence: TTC
ctcatcttaaccaccacatt

SEQ ID NO: 44512 - DNA, 20 bp, Artificial Sequence
  Description of Artificial Sequence: Synthetic oligonucleotide
  Target: SCN10A; (-) strand; PAM type: YTN; PAM sequence: CTT
cctcatcttaaccaccacat

SEQ ID NO: 44513 - DNA, 20 bp, Artificial Sequence
  Description of Artificial Sequence: Synthetic oligonucleotide
  Target: SCN10A; (-) strand; PAM type: YTN; PAM sequence: CTC
ttcctcatcttaaccaccac

SEQ ID NO: 44514 - DNA, 20 bp, Artificial Sequence
  Description of Artificial Sequence: Synthetic oligonucleotide
  Target: SCN10A; (-) strand; PAM type: YTN; PAM sequence: CTC
agtcatctcttcctcatctt

SEQ ID NO: 44515 - DNA, 20 bp, Artificial Sequence
  Description of Artificial Sequence: Synthetic oligonucleotide
  Target: SCN10A; (-) strand; PAM type: YTN; PAM sequence: TTC
ctcagtcatctcttcctcat

SEQ ID NO: 44516 - DNA, 20 bp, Artificial Sequence
  Description of Artificial Sequence: Synthetic oligonucleotide
  Target: SCN10A; (-) strand; PAM type: YTN; PAM sequence: CTC
acacatcagacatgtgattc

SEQ ID NO: 44517 - DNA, 20 bp, Artificial Sequence
  Description of Artificial Sequence: Synthetic oligonucleotide
  Target: SCN10A; (-) strand; PAM type: YTN; PAM sequence: TTC
tcacacatcagacatgtgat

SEQ ID NO: 44518 - DNA, 20 bp, Artificial Sequence
  Description of Artificial Sequence: Synthetic oligonucleotide
  Target: SCN10A; (-) strand; PAM type: YTN; PAM sequence: CTT
ctcacacatcagacatgtga

SEQ ID NO: 44519 - DNA, 20 bp, Artificial Sequence
  Description of Artificial Sequence: Synthetic oligonucleotide
  Target: SCN10A; (-) strand; PAM type: YTN; PAM sequence: CTG
tgtgcttctcacacatcaga

SEQ ID NO: 44520 - DNA, 20 bp, Artificial Sequence
  Description of Artificial Sequence: Synthetic oligonucleotide
  Target: SCN10A; (-) strand; PAM type: YTN; PAM sequence: TTG
actgtgtgcttctcacacat

SEQ ID NO: 44521 - DNA, 20 bp, Artificial Sequence
  Description of Artificial Sequence: Synthetic oligonucleotide
  Target: SCN10A; (-) strand; PAM type: YTN; PAM sequence: TTA
gagaattgactgtgtgcttc

SEQ ID NO: 44522 - DNA, 20 bp, Artificial Sequence
  Description of Artificial Sequence: Synthetic oligonucleotide
  Target: SCN10A; (-) strand; PAM type: YTN; PAM sequence: CTG
cattagagaattgactgtgt

SEQ ID NO: 44523 - DNA, 20 bp, Artificial Sequence
  Description of Artificial Sequence: Synthetic oligonucleotide
  Target: SCN10A; (-) strand; PAM type: YTN; PAM sequence: CTG
tggccagtaatccctgcatt

SEQ ID NO: 44524 - DNA, 20 bp, Artificial Sequence
  Description of Artificial Sequence: Synthetic oligonucleotide
  Target: SCN10A; (-) strand; PAM type: YTN; PAM sequence: CTC
atggtaacctgtggccagta

SEQ ID NO: 44525 - DNA, 20 bp, Artificial Sequence
  Description of Artificial Sequence: Synthetic oligonucleotide
  Target: SCN10A; (-) strand; PAM type: YTN; PAM sequence: TTC
acactcatggtaacctgtgg

SEQ ID NO: 44526 - DNA, 20 bp, Artificial Sequence
  Description of Artificial Sequence: Synthetic oligonucleotide
  Target: SCN10A; (-) strand; PAM type: YTN; PAM sequence: TTC
atgtgttcacactcatggta

SEQ ID NO: 44527 - DNA, 20 bp, Artificial Sequence
  Description of Artificial Sequence: Synthetic oligonucleotide
  Target: SCN10A; (-) strand; PAM type: YTN; PAM sequence: CTG
gagttcatgtgttcacactc

SEQ ID NO: 44528 - DNA, 20 bp, Artificial Sequence
  Description of Artificial Sequence: Synthetic oligonucleotide
  Target: SCN10A; (-) strand; PAM type: YTN; PAM sequence: TTG
gagaggtaatgagctggagt

SEQ ID NO: 44529 - DNA, 20 bp, Artificial Sequence
  Description of Artificial Sequence: Synthetic oligonucleotide
  Target: SCN10A; (-) strand; PAM type: YTN; PAM sequence: TTT
ggagaggtaatgagctggag

SEQ ID NO: 44530 - DNA, 20 bp, Artificial Sequence
  Description of Artificial Sequence: Synthetic oligonucleotide
  Target: SCN10A; (-) strand; PAM type: YTN; PAM sequence: TTG
aaaagaacagagggcgcatt

SEQ ID NO: 44531 - DNA, 20 bp, Artificial Sequence
  Description of Artificial Sequence: Synthetic oligonucleotide
  Target: SCN10A; (-) strand; PAM type: YTN; PAM sequence: CTC
cccagtggcattgaaaagaa

SEQ ID NO: 44532 - DNA, 20 bp, Artificial Sequence
  Description of Artificial Sequence: Synthetic oligonucleotide
  Target: SCN10A; (-) strand; PAM type: YTN; PAM sequence: CTC
ctccccagtggcattgaaaa

SEQ ID NO: 44533 - DNA, 20 bp, Artificial Sequence
  Description of Artificial Sequence: Synthetic oligonucleotide
  Target: SCN10A; (-) strand; PAM type: YTN; PAM sequence: CTG
cctcctccccagtggcattg

SEQ ID NO: 44534 - DNA, 20 bp, Artificial Sequence
  Description of Artificial Sequence: Synthetic oligonucleotide
  Target: SCN10A; (-) strand; PAM type: YTN; PAM sequence: CTG
ctgcctcctccccagtggca

SEQ ID NO: 44535 - DNA, 20 bp, Artificial Sequence
  Description of Artificial Sequence: Synthetic oligonucleotide
  Target: SCN10A; (-) strand; PAM type: YTN; PAM sequence: TTA
tactgctgcctcctccccag

SEQ ID NO: 44536 - DNA, 20 bp, Artificial Sequence
  Description of Artificial Sequence: Synthetic oligonucleotide
  Target: SCN10A; (-) strand; PAM type: YTN; PAM sequence: CTT
atactgctgcctcctcccca

SEQ ID NO: 44537 - DNA, 20 bp, Artificial Sequence
  Description of Artificial Sequence: Synthetic oligonucleotide
  Target: SCN10A; (-) strand; PAM type: YTN; PAM sequence: CTG
agcttatactgctgcctcct

SEQ ID NO: 44538 - DNA, 20 bp, Artificial Sequence
  Description of Artificial Sequence: Synthetic oligonucleotide
  Target: SCN10A; (-) strand; PAM type: YTN; PAM sequence: TTA
gaaccactgagcttatactg

SEQ ID NO: 44539 - DNA, 20 bp, Artificial Sequence
  Description of Artificial Sequence: Synthetic oligonucleotide
  Target: SCN10A; (-) strand; PAM type: YTN; PAM sequence: CTT
agaaccactgagcttatact

SEQ ID NO: 44540 - DNA, 20 bp, Artificial Sequence
  Description of Artificial Sequence: Synthetic oligonucleotide
  Target: SCN10A; (-) strand; PAM type: YTN; PAM sequence: TTC
caaggtgcagccatggctta

SEQ ID NO: 44541 - DNA, 20 bp, Artificial Sequence
  Description of Artificial Sequence: Synthetic oligonucleotide
  Target: SCN10A; (-) strand; PAM type: YTN; PAM sequence: TTT
ccaaggtgcagccatggctt

SEQ ID NO: 44542 - DNA, 20 bp, Artificial Sequence
  Description of Artificial Sequence: Synthetic oligonucleotide
  Target: SCN10A; (-) strand; PAM type: YTN; PAM sequence: CTC
ccaggcatttccaaggtgca

SEQ ID NO: 44543 - DNA, 20 bp, Artificial Sequence
  Description of Artificial Sequence: Synthetic oligonucleotide
  Target: SCN10A; (-) strand; PAM type: YTN; PAM sequence: TTA
taaatgctcccaggcatttc

SEQ ID NO: 44544 - DNA, 20 bp, Artificial Sequence
  Description of Artificial Sequence: Synthetic oligonucleotide
  Target: SCN10A; (-) strand; PAM type: YTN; PAM sequence: TTT
ataaatgctcccaggcattt

SEQ ID NO: 44545 - DNA, 20 bp, Artificial Sequence
  Description of Artificial Sequence: Synthetic oligonucleotide
  Target: SCN10A; (-) strand; PAM type: YTN; PAM sequence: TTT
tataaatgctcccaggcatt

SEQ ID NO: 44546 - DNA, 20 bp, Artificial Sequence
  Description of Artificial Sequence: Synthetic oligonucleotide
  Target: SCN10A; (-) strand; PAM type: YTN; PAM sequence: CTG
tattttataaatgctcccag

SEQ ID NO: 44547 - DNA, 20 bp, Artificial Sequence
  Description of Artificial Sequence: Synthetic oligonucleotide
  Target: SCN10A; (-) strand; PAM type: YTN; PAM sequence: TTG
ggtggtgcccaggcacctgt

SEQ ID NO: 44548 - DNA, 20 bp, Artificial Sequence
  Description of Artificial Sequence: Synthetic oligonucleotide
  Target: SCN10A; (-) strand; PAM type: YTN; PAM sequence: CTT
gggtggtgcccaggcacctg

SEQ ID NO: 44549 - DNA, 20 bp, Artificial Sequence
  Description of Artificial Sequence: Synthetic oligonucleotide
  Target: SCN10A; (-) strand; PAM type: YTN; PAM sequence: TTG
gtcttgggtggtgcccaggc

SEQ ID NO: 44550 - DNA, 20 bp, Artificial Sequence
  Description of Artificial Sequence: Synthetic oligonucleotide
  Target: SCN10A; (-) strand; PAM type: YTN; PAM sequence: TTA
ttggtcttgggtggtgccca

SEQ ID NO: 44551 - DNA, 20 bp, Artificial Sequence
  Description of Artificial Sequence: Synthetic oligonucleotide
  Target: SCN10A; (-) strand; PAM type: YTN; PAM sequence: CTT
attggtcttgggtggtgccc

SEQ ID NO: 44552 - DNA, 20 bp, Artificial Sequence
  Description of Artificial Sequence: Synthetic oligonucleotide
  Target: SCN10A; (-) strand; PAM type: YTN; PAM sequence: CTG
atcttattggtcttgggtgg

SEQ ID NO: 44553 - DNA, 20 bp, Artificial Sequence
  Description of Artificial Sequence: Synthetic oligonucleotide
  Target: SCN10A; (-) strand; PAM type: YTN; PAM sequence: TTC
tgatcttattggtcttgggt

SEQ ID NO: 44554 - DNA, 20 bp, Artificial Sequence
  Description of Artificial Sequence: Synthetic oligonucleotide
  Target: SCN10A; (-) strand; PAM type: YTN; PAM sequence: CTA
ccccagagattctgatctta

SEQ ID NO: 44555 - DNA, 20 bp, Artificial Sequence
  Description of Artificial Sequence: Synthetic oligonucleotide
  Target: SCN10A; (-) strand; PAM type: YTN; PAM sequence: CTA
tgaaatatgcagtgaccgac

SEQ ID NO: 44556 - DNA, 20 bp, Artificial Sequence
  Description of Artificial Sequence: Synthetic oligonucleotide
  Target: SCN10A; (-) strand; PAM type: YTN; PAM sequence: CTG
gggagctatgaaatatgcag

SEQ ID NO: 44557 - DNA, 20 bp, Artificial Sequence
  Description of Artificial Sequence: Synthetic oligonucleotide
  Target: SCN10A; (-) strand; PAM type: YTN; PAM sequence: TTG
agaatcacctggggagctat

SEQ ID NO: 44558 - DNA, 20 bp, Artificial Sequence
  Description of Artificial Sequence: Synthetic oligonucleotide
  Target: SCN10A; (-) strand; PAM type: YTN; PAM sequence: CTT
gagaatcacctggggagcta

SEQ ID NO: 44559 - DNA, 20 bp, Artificial Sequence
  Description of Artificial Sequence: Synthetic oligonucleotide
  Target: SCN10A; (-) strand; PAM type: YTN; PAM sequence: CTG
cacttgagaatcacctgggg

SEQ ID NO: 44560 - DNA, 20 bp, Artificial Sequence
  Description of Artificial Sequence: Synthetic oligonucleotide
  Target: SCN10A; (-) strand; PAM type: YTN; PAM sequence: CTG
gctgcacttgagaatcacct

SEQ ID NO: 44561 - DNA, 20 bp, Artificial Sequence
  Description of Artificial Sequence: Synthetic oligonucleotide
  Target: SCN10A; (-) strand; PAM type: YTN; PAM sequence: CTC
acacctggctgcacttgaga

SEQ ID NO: 44562 - DNA, 20 bp, Artificial Sequence
  Description of Artificial Sequence: Synthetic oligonucleotide
  Target: SCN10A; (-) strand; PAM type: YTN; PAM sequence: CTG
tggtcctcacacctggctgc

SEQ ID NO: 44563 - DNA, 20 bp, Artificial Sequence
  Description of Artificial Sequence: Synthetic oligonucleotide
  Target: SCN10A; (-) strand; PAM type: YTN; PAM sequence: TTC
tgtggtcctcacacctggct

SEQ ID NO: 44564 - DNA, 20 bp, Artificial Sequence
  Description of Artificial Sequence: Synthetic oligonucleotide
  Target: SCN10A; (-) strand; PAM type: YTN; PAM sequence: CTG
cggttctgtggtcctcacac

SEQ ID NO: 44565 - DNA, 20 bp, Artificial Sequence
  Description of Artificial Sequence: Synthetic oligonucleotide
  Target: SCN10A; (-) strand; PAM type: YTN; PAM sequence: TTC
ccacctgcggttctgtggtc

SEQ ID NO: 44566 - DNA, 20 bp, Artificial Sequence
  Description of Artificial Sequence: Synthetic oligonucleotide
  Target: SCN10A; (-) strand; PAM type: YTN; PAM sequence: CTT
cccacctgcggttctgtggt

SEQ ID NO: 44567 - DNA, 20 bp, Artificial Sequence
  Description of Artificial Sequence: Synthetic oligonucleotide
  Target: SCN10A; (-) strand; PAM type: YTN; PAM sequence: CTG
tgagcacagagaatcttccc

SEQ ID NO: 44568 - DNA, 20 bp, Artificial Sequence
  Description of Artificial Sequence: Synthetic oligonucleotide
  Target: SCN10A; (-) strand; PAM type: YTN; PAM sequence: TTG
gggagccatgaactgtgagc

SEQ ID NO: 44569 - DNA, 20 bp, Artificial Sequence
  Description of Artificial Sequence: Synthetic oligonucleotide
  Target: SCN10A; (-) strand; PAM type: YTN; PAM sequence: CTT
ggggagccatgaactgtgag

SEQ ID NO: 44570 - DNA, 20 bp, Artificial Sequence
  Description of Artificial Sequence: Synthetic oligonucleotide
  Target: SCN10A; (-) strand; PAM type: YTN; PAM sequence: CTG
gaccttggggagccatgaac

SEQ ID NO: 44571 - DNA, 20 bp, Artificial Sequence
  Description of Artificial Sequence: Synthetic oligonucleotide
  Target: SCN10A; (-) strand; PAM type: YTN; PAM sequence: TTC
tggaccttggggagccatga

SEQ ID NO: 44572 - DNA, 20 bp, Artificial Sequence
  Description of Artificial Sequence: Synthetic oligonucleotide
  Target: SCN10A; (-) strand; PAM type: YTN; PAM sequence: CTT
ctggaccttggggagccatg

SEQ ID NO: 44573 - DNA, 20 bp, Artificial Sequence
  Description of Artificial Sequence: Synthetic oligonucleotide
  Target: SCN10A; (-) strand; PAM type: YTN; PAM sequence: CTG
catccatagatgggtcttct

SEQ ID NO: 44574 - DNA, 20 bp, Artificial Sequence
  Description of Artificial Sequence: Synthetic oligonucleotide
  Target: SCN10A; (-) strand; PAM type: YTN; PAM sequence: TTA
tggccctgcatccatagatg

SEQ ID NO: 44575 - DNA, 20 bp, Artificial Sequence
  Description of Artificial Sequence: Synthetic oligonucleotide
  Target: SCN10A; (-) strand; PAM type: YTN; PAM sequence: CTT
atggccctgcatccatagat

SEQ ID NO: 44576 - DNA, 20 bp, Artificial Sequence
  Description of Artificial Sequence: Synthetic oligonucleotide
  Target: SCN10A; (-) strand; PAM type: YTN; PAM sequence: CTC
agaggtcttatggccctgca

SEQ ID NO: 44577 - DNA, 20 bp, Artificial Sequence
  Description of Artificial Sequence: Synthetic oligonucleotide
  Target: SCN10A; (-) strand; PAM type: YTN; PAM sequence: CTC
tcagaggtcttatggccctg

SEQ ID NO: 44578 - DNA, 20 bp, Artificial Sequence
  Description of Artificial Sequence: Synthetic oligonucleotide
  Target: SCN10A; (-) strand; PAM type: YTN; PAM sequence: TTA
catccaaagtgagatgacac

SEQ ID NO: 44579 - DNA, 20 bp, Artificial Sequence
  Description of Artificial Sequence: Synthetic oligonucleotide
  Target: SCN10A; (-) strand; PAM type: YTN; PAM sequence: TTT
acatccaaagtgagatgaca

SEQ ID NO: 44580 - DNA, 20 bp, Artificial Sequence
  Description of Artificial Sequence: Synthetic oligonucleotide
  Target: SCN10A; (-) strand; PAM type: YTN; PAM sequence: TTT
tacatccaaagtgagatgac

SEQ ID NO: 44581 - DNA, 20 bp, Artificial Sequence
  Description of Artificial Sequence: Synthetic oligonucleotide
  Target: SCN10A; (-) strand; PAM type: YTN; PAM sequence: TTT
ttacatccaaagtgagatga

SEQ ID NO: 44582 - DNA, 20 bp, Artificial Sequence
  Description of Artificial Sequence: Synthetic oligonucleotide
  Target: SCN10A; (-) strand; PAM type: YTN; PAM sequence: CTG
catttttacatccaaagtga

SEQ ID NO: 44583 - DNA, 20 bp, Artificial Sequence
  Description of Artificial Sequence: Synthetic oligonucleotide
  Target: SCN10A; (-) strand; PAM type: YTN; PAM sequence: CTC
tgcatttttacatccaaagt

SEQ ID NO: 44584 - DNA, 20 bp, Artificial Sequence
  Description of Artificial Sequence: Synthetic oligonucleotide
  Target: SCN10A; (-) strand; PAM type: YTN; PAM sequence: CTG
caatcctctgcatttttaca

SEQ ID NO: 44585 - DNA, 20 bp, Artificial Sequence
  Description of Artificial Sequence: Synthetic oligonucleotide
  Target: SCN10A; (-) strand; PAM type: YTN; PAM sequence: TTC
agaaagatccctgcaatcct

SEQ ID NO: 44586 - DNA, 20 bp, Artificial Sequence
  Description of Artificial Sequence: Synthetic oligonucleotide
  Target: SCN10A; (-) strand; PAM type: YTN; PAM sequence: CTC
cattcagaaagatccctgca

SEQ ID NO: 44587 - DNA, 20 bp, Artificial Sequence
  Description of Artificial Sequence: Synthetic oligonucleotide
  Target: SCN10A; (-) strand; PAM type: YTN; PAM sequence: TTA
ggtctccattcagaaagatc

SEQ ID NO: 44588 - DNA, 20 bp, Artificial Sequence
  Description of Artificial Sequence: Synthetic oligonucleotide
  Target: SCN10A; (-) strand; PAM type: YTN; PAM sequence: TTA
ttaggtctccattcagaaag

SEQ ID NO: 44589 - DNA, 20 bp, Artificial Sequence
  Description of Artificial Sequence: Synthetic oligonucleotide
  Target: SCN10A; (-) strand; PAM type: YTN; PAM sequence: TTA
ggtgagttattaggtctcca

SEQ ID NO: 44590 - DNA, 20 bp, Artificial Sequence
  Description of Artificial Sequence: Synthetic oligonucleotide
  Target: SCN10A; (-) strand; PAM type: YTN; PAM sequence: CTG
ttaggtgagttattaggtct

SEQ ID NO: 44591 - DNA, 20 bp, Artificial Sequence
  Description of Artificial Sequence: Synthetic oligonucleotide
  Target: SCN10A; (-) strand; PAM type: YTN; PAM sequence: CTG
tgacacaatagtgactgtta

SEQ ID NO: 44592 - DNA, 20 bp, Artificial Sequence
  Description of Artificial Sequence: Synthetic oligonucleotide
  Target: SCN10A; (-) strand; PAM type: YTN; PAM sequence: CTG
acacccatgagtggtaaagt

SEQ ID NO: 44593 - DNA, 20 bp, Artificial Sequence
  Description of Artificial Sequence: Synthetic oligonucleotide
  Target: SCN10A; (-) strand; PAM type: YTN; PAM sequence: CTG
agaatagccctgacacccat

SEQ ID NO: 44594 - DNA, 20 bp, Artificial Sequence
  Description of Artificial Sequence: Synthetic oligonucleotide
  Target: SCN10A; (-) strand; PAM type: YTN; PAM sequence: TTA
gtgaggagtctgagaatagc

SEQ ID NO: 44595 - DNA, 20 bp, Artificial Sequence
  Description of Artificial Sequence: Synthetic oligonucleotide
  Target: SCN10A; (-) strand; PAM type: YTN; PAM sequence: TTT
agtgaggagtctgagaatag

SEQ ID NO: 44596 - DNA, 20 bp, Artificial Sequence
  Description of Artificial Sequence: Synthetic oligonucleotide
  Target: SCN10A; (-) strand; PAM type: YTN; PAM sequence: TTG
agcatttagtgaggagtctg

SEQ ID NO: 44597 - DNA, 20 bp, Artificial Sequence
  Description of Artificial Sequence: Synthetic oligonucleotide
  Target: SCN10A; (-) strand; PAM type: YTN; PAM sequence: TTT
gagcatttagtgaggagtct

SEQ ID NO: 44598 - DNA, 20 bp, Artificial Sequence
  Description of Artificial Sequence: Synthetic oligonucleotide
  Target: SCN10A; (-) strand; PAM type: YTN; PAM sequence: TTT
tgagcatttagtgaggagtc

SEQ ID NO: 44599 - DNA, 20 bp, Artificial Sequence
  Description of Artificial Sequence: Synthetic oligonucleotide
  Target: SCN10A; (-) strand; PAM type: YTN; PAM sequence: CTC
caaagaaaagttttgagcat

SEQ ID NO: 44600 - DNA, 20 bp, Artificial Sequence
  Description of Artificial Sequence: Synthetic oligonucleotide
  Target: SCN10A; (-) strand; PAM type: YTN; PAM sequence: CTA
ctccaaagaaaagttttgag

SEQ ID NO: 44601 - DNA, 20 bp, Artificial Sequence
  Description of Artificial Sequence: Synthetic oligonucleotide
  Target: SCN10A; (-) strand; PAM type: YTN; PAM sequence: CTC
aagggctactccaaagaaaa

SEQ ID NO: 44602 - DNA, 20 bp, Artificial Sequence
  Description of Artificial Sequence: Synthetic oligonucleotide
  Target: SCN10A; (-) strand; PAM type: YTN; PAM sequence: CTG
gccctcaagggctactccaa

SEQ ID NO: 44603 - DNA, 20 bp, Artificial Sequence
  Description of Artificial Sequence: Synthetic oligonucleotide
  Target: SCN10A; (-) strand; PAM type: YTN; PAM sequence: CTC
agagacctggccctcaaggg

SEQ ID NO: 44604 - DNA, 20 bp, Artificial Sequence
  Description of Artificial Sequence: Synthetic oligonucleotide
  Target: SCN10A; (-) strand; PAM type: YTN; PAM sequence: CTA
gggcaaaggaagctcagaga

SEQ ID NO: 44605 - DNA, 20 bp, Artificial Sequence
  Description of Artificial Sequence: Synthetic oligonucleotide
  Target: SCN10A; (-) strand; PAM type: YTN; PAM sequence: CTA
cagctagggcaaaggaagct

SEQ ID NO: 44606 - DNA, 20 bp, Artificial Sequence
  Description of Artificial Sequence: Synthetic oligonucleotide
  Target: SCN10A; (-) strand; PAM type: YTN; PAM sequence: CTG
gctacagctagggcaaagga

SEQ ID NO: 44607 - DNA, 20 bp, Artificial Sequence
  Description of Artificial Sequence: Synthetic oligonucleotide
  Target: SCN10A; (-) strand; PAM type: YTN; PAM sequence: CTC
ctggctacagctagggcaaa

SEQ ID NO: 44608 - DNA, 20 bp, Artificial Sequence
  Description of Artificial Sequence: Synthetic oligonucleotide
  Target: SCN10A; (-) strand; PAM type: YTN; PAM sequence: CTG
actcctggctacagctaggg

SEQ ID NO: 44609 - DNA, 20 bp, Artificial Sequence
  Description of Artificial Sequence: Synthetic oligonucleotide
  Target: SCN10A; (-) strand; PAM type: YTN; PAM sequence: CTC
tgactcctggctacagctag

SEQ ID NO: 44610 - DNA, 20 bp, Artificial Sequence
  Description of Artificial Sequence: Synthetic oligonucleotide
  Target: SCN10A; (-) strand; PAM type: YTN; PAM sequence: CTC
ccctctgactcctggctaca

SEQ ID NO: 44611 - DNA, 20 bp, Artificial Sequence
  Description of Artificial Sequence: Synthetic oligonucleotide
  Target: SCN10A; (-) strand; PAM type: YTN; PAM sequence: TTG
gggtcctcccctctgactcc

SEQ ID NO: 44612 - DNA, 20 bp, Artificial Sequence
  Description of Artificial Sequence: Synthetic oligonucleotide
  Target: SCN10A; (-) strand; PAM type: YTN; PAM sequence: TTT
ggggtcctcccctctgactc

SEQ ID NO: 44613 - DNA, 20 bp, Artificial Sequence
  Description of Artificial Sequence: Synthetic oligonucleotide
  Target: SCN10A; (-) strand; PAM type: YTN; PAM sequence: CTC
agtgggaacacgtggggttt

SEQ ID NO: 44614 - DNA, 20 bp, Artificial Sequence
  Description of Artificial Sequence: Synthetic oligonucleotide
  Target: SCN10A; (-) strand; PAM type: YTN; PAM sequence: TTG
tgaatgtgagtggctcagtg

SEQ ID NO: 44615 - DNA, 20 bp, Artificial Sequence
  Description of Artificial Sequence: Synthetic oligonucleotide
  Target: SCN10A; (-) strand; PAM type: YTN; PAM sequence: CTC
attgtgaatgtgagtggctc

SEQ ID NO: 44616 - DNA, 20 bp, Artificial Sequence
  Description of Artificial Sequence: Synthetic oligonucleotide
  Target: SCN10A; (-) strand; PAM type: YTN; PAM sequence: TTC
ctcattgtgaatgtgagtgg

SEQ ID NO: 44617 - DNA, 20 bp, Artificial Sequence
  Description of Artificial Sequence: Synthetic oligonucleotide
  Target: SCN10A; (-) strand; PAM type: YTN; PAM sequence: CTT
cctcattgtgaatgtgagtg

SEQ ID NO: 44618 - DNA, 20 bp, Artificial Sequence
  Description of Artificial Sequence: Synthetic oligonucleotide
  Target: SCN10A; (-) strand; PAM type: YTN; PAM sequence: CTG
gacttcctcattgtgaatgt

SEQ ID NO: 44619 - DNA, 20 bp, Artificial Sequence
  Description of Artificial Sequence: Synthetic oligonucleotide
  Target: SCN10A; (-) strand; PAM type: YTN; PAM sequence: CTG
gctggacttcctcattgtga

SEQ ID NO: 44620 - DNA, 20 bp, Artificial Sequence
  Description of Artificial Sequence: Synthetic oligonucleotide
  Target: SCN10A; (-) strand; PAM type: YTN; PAM sequence: CTG
gtgctggctggacttcctca

SEQ ID NO: 44621 - DNA, 20 bp, Artificial Sequence
  Description of Artificial Sequence: Synthetic oligonucleotide
  Target: SCN10A; (-) strand; PAM type: YTN; PAM sequence: TTC
accaatgcctggtgctggct

SEQ ID NO: 44622 - DNA, 20 bp, Artificial Sequence
  Description of Artificial Sequence: Synthetic oligonucleotide
  Target: SCN10A; (-) strand; PAM type: YTN; PAM sequence: CTT
caccaatgcctggtgctggc

SEQ ID NO: 44623 - DNA, 20 bp, Artificial Sequence
  Description of Artificial Sequence: Synthetic oligonucleotide
  Target: SCN10A; (-) strand; PAM type: YTN; PAM sequence: TTC
aaaaagtacttcaccaatgc

SEQ ID NO: 44624 - DNA, 20 bp, Artificial Sequence
  Description of Artificial Sequence: Synthetic oligonucleotide
  Target: SCN10A; (-) strand; PAM type: YTN; PAM sequence: CTT
caaaaagtacttcaccaatg

SEQ ID NO: 44625 - DNA, 20 bp, Artificial Sequence
  Description of Artificial Sequence: Synthetic oligonucleotide
  Target: SCN10A; (-) strand; PAM type: YTN; PAM sequence: CTA
tggcttcaaaaagtacttca

SEQ ID NO: 44626 - DNA, 20 bp, Artificial Sequence
  Description of Artificial Sequence: Synthetic oligonucleotide
  Target: SCN10A; (-) strand; PAM type: YTN; PAM sequence: TTA
agtgggtggcctatggcttc

SEQ ID NO: 44627 - DNA, 20 bp, Artificial Sequence
  Description of Artificial Sequence: Synthetic oligonucleotide
  Target: SCN10A; (-) strand; PAM type: YTN; PAM sequence: CTT
aagtgggtggcctatggctt

SEQ ID NO: 44628 - DNA, 20 bp, Artificial Sequence
  Description of Artificial Sequence: Synthetic oligonucleotide
  Target: SCN10A; (-) strand; PAM type: YTN; PAM sequence: CTG
cttaagtgggtggcctatgg

SEQ ID NO: 44629 - DNA, 20 bp, Artificial Sequence
  Description of Artificial Sequence: Synthetic oligonucleotide
  Target: SCN10A; (-) strand; PAM type: YTN; PAM sequence: TTC
gagatgctgcttaagtgggt

SEQ ID NO: 44630 - DNA, 20 bp, Artificial Sequence
  Description of Artificial Sequence: Synthetic oligonucleotide
  Target: SCN10A; (-) strand; PAM type: YTN; PAM sequence: TTG
tgttcgagatgctgcttaag

SEQ ID NO: 44631 - DNA, 20 bp, Artificial Sequence
  Description of Artificial Sequence: Synthetic oligonucleotide
  Target: SCN10A; (-) strand; PAM type: YTN; PAM sequence: TTT
gtgttcgagatgctgcttaa

SEQ ID NO: 44632 - DNA, 20 bp, Artificial Sequence
  Description of Artificial Sequence: Synthetic oligonucleotide
  Target: SCN10A; (-) strand; PAM type: YTN; PAM sequence: CTT
tgtgttcgagatgctgctta

SEQ ID NO: 44633 - DNA, 20 bp, Artificial Sequence
  Description of Artificial Sequence: Synthetic oligonucleotide
  Target: SCN10A; (-) strand; PAM type: YTN; PAM sequence: TTA
tctttgtgttcgagatgctg

SEQ ID NO: 44634 - DNA, 20 bp, Artificial Sequence
  Description of Artificial Sequence: Synthetic oligonucleotide
  Target: SCN10A; (-) strand; PAM type: YTN; PAM sequence: TTT
atctttgtgttcgagatgct

SEQ ID NO: 44635 - DNA, 20 bp, Artificial Sequence
  Description of Artificial Sequence: Synthetic oligonucleotide
  Target: SCN10A; (-) strand; PAM type: YTN; PAM sequence: CTT
tatctttgtgttcgagatgc

SEQ ID NO: 44636 - DNA, 20 bp, Artificial Sequence
  Description of Artificial Sequence: Synthetic oligonucleotide
  Target: SCN10A; (-) strand; PAM type: YTN; PAM sequence: TTC
acctttatctttgtgttcga

SEQ ID NO: 44637 - DNA, 20 bp, Artificial Sequence
  Description of Artificial Sequence: Synthetic oligonucleotide
  Target: SCN10A; (-) strand; PAM type: YTN; PAM sequence: CTT
cacctttatctttgtgttcg

SEQ ID NO: 44638 - DNA, 20 bp, Artificial Sequence
  Description of Artificial Sequence: Synthetic oligonucleotide
  Target: SCN10A; (-) strand; PAM type: YTN; PAM sequence: CTG
acagggtcttcacctttatc

SEQ ID NO: 44639 - DNA, 20 bp, Artificial Sequence
  Description of Artificial Sequence: Synthetic oligonucleotide
  Target: SCN10A; (-) strand; PAM type: YTN; PAM sequence: CTG
gagtacactgacagggtctt

SEQ ID NO: 44640 - DNA, 20 bp, Artificial Sequence
  Description of Artificial Sequence: Synthetic oligonucleotide
  Target: SCN10A; (-) strand; PAM type: YTN; PAM sequence: TTG
ctggagtacactgacagggt

SEQ ID NO: 44641 - DNA, 20 bp, Artificial Sequence
  Description of Artificial Sequence: Synthetic oligonucleotide
  Target: SCN10A; (-) strand; PAM type: YTN; PAM sequence: TTT
gctggagtacactgacaggg

SEQ ID NO: 44642 - DNA, 20 bp, Artificial Sequence
  Description of Artificial Sequence: Synthetic oligonucleotide
  Target: SCN10A; (-) strand; PAM type: YTN; PAM sequence: CTT
tgctggagtacactgacagg

SEQ ID NO: 44643 - DNA, 20 bp, Artificial Sequence
  Description of Artificial Sequence: Synthetic oligonucleotide
  Target: SCN10A; (-) strand; PAM type: YTN; PAM sequence: CTG
gaccagaagcccacggtgaa

SEQ ID NO: 44644 - DNA, 20 bp, Artificial Sequence
  Description of Artificial Sequence: Synthetic oligonucleotide
  Target: SCN10A; (-) strand; PAM type: YTN; PAM sequence: TTA
cctggaccagaagcccacgg

SEQ ID NO: 44645 - DNA, 20 bp, Artificial Sequence
  Description of Artificial Sequence: Synthetic oligonucleotide
  Target: SCN10A; (-) strand; PAM type: YTN; PAM sequence: CTA
ttacctggaccagaagccca

SEQ ID NO: 44646 - DNA, 20 bp, Artificial Sequence
  Description of Artificial Sequence: Synthetic oligonucleotide
  Target: SCN10A; (-) strand; PAM type: YTN; PAM sequence: TTG
aagactattacctggaccag

SEQ ID NO: 44647 - DNA, 20 bp, Artificial Sequence
  Description of Artificial Sequence: Synthetic oligonucleotide
  Target: SCN10A; (-) strand; PAM type: YTN; PAM sequence: TTT
gaagactattacctggacca

SEQ ID NO: 44648 - DNA, 20 bp, Artificial Sequence
  Description of Artificial Sequence: Synthetic oligonucleotide
  Target: SCN10A; (-) strand; PAM type: YTN; PAM sequence: CTT
tgaagactattacctggacc

SEQ ID NO: 44649 - DNA, 20 bp, Artificial Sequence
  Description of Artificial Sequence: Synthetic oligonucleotide
  Target: SCN10A; (-) strand; PAM type: YTN; PAM sequence: TTC
caggcctttgaagactatta

SEQ ID NO: 44650 - DNA, 20 bp, Artificial Sequence
  Description of Artificial Sequence: Synthetic oligonucleotide
  Target: SCN10A; (-) strand; PAM type: YTN; PAM sequence: CTT
ccaggcctttgaagactatt

SEQ ID NO: 44651 - DNA, 20 bp, Artificial Sequence
  Description of Artificial Sequence: Synthetic oligonucleotide
  Target: SCN10A; (-) strand; PAM type: YTN; PAM sequence: TTC
cttccaggcctttgaagact

SEQ ID NO: 44652 - DNA, 20 bp, Artificial Sequence
  Description of Artificial Sequence: Synthetic oligonucleotide
  Target: SCN10A; (-) strand; PAM type: YTN; PAM sequence: CTT
ccttccaggcctttgaagac

SEQ ID NO: 44653 - DNA, 20 bp, Artificial Sequence
  Description of Artificial Sequence: Synthetic oligonucleotide
  Target: SCN10A; (-) strand; PAM type: YTN; PAM sequence: TTC
ttccttccaggcctttgaag

SEQ ID NO: 44654 - DNA, 20 bp, Artificial Sequence
  Description of Artificial Sequence: Synthetic oligonucleotide
  Target: SCN10A; (-) strand; PAM type: YTN; PAM sequence: TTT
cttccttccaggcctttgaa

SEQ ID NO: 44655 - DNA, 20 bp, Artificial Sequence
  Description of Artificial Sequence: Synthetic oligonucleotide
  Target: SCN10A; (-) strand; PAM type: YTN; PAM sequence: CTT
tcttccttccaggcctttga

SEQ ID NO: 44656 - DNA, 20 bp, Artificial Sequence
  Description of Artificial Sequence: Synthetic oligonucleotide
  Target: SCN10A; (-) strand; PAM type: YTN; PAM sequence: CTG
catcctttcttccttccagg

SEQ ID NO: 44657 - DNA, 20 bp, Artificial Sequence
  Description of Artificial Sequence: Synthetic oligonucleotide
  Target: SCN10A; (-) strand; PAM type: YTN; PAM sequence: TTC
tgcatcctttcttccttcca

SEQ ID NO: 44658 - DNA, 20 bp, Artificial Sequence
  Description of Artificial Sequence: Synthetic oligonucleotide
  Target: SCN10A; (-) strand; PAM type: YTN; PAM sequence: CTG
ccattctgcatcctttcttc

SEQ ID NO: 44659 - DNA, 20 bp, Artificial Sequence
  Description of Artificial Sequence: Synthetic oligonucleotide
  Target: SCN10A; (-) strand; PAM type: YTN; PAM sequence: CTG
tgggtccaggcagcctgcca

SEQ ID NO: 44660 - DNA, 20 bp, Artificial Sequence
  Description of Artificial Sequence: Synthetic oligonucleotide
  Target: SCN10A; (-) strand; PAM type: YTN; PAM sequence: CTG
ggccccagtgctgtgggtcc

SEQ ID NO: 44661 - DNA, 20 bp, Artificial Sequence
  Description of Artificial Sequence: Synthetic oligonucleotide
  Target: SCN10A; (-) strand; PAM type: YTN; PAM sequence: CTA
tcagtctgggccccagtgct

SEQ ID NO: 44662 - DNA, 20 bp, Artificial Sequence
  Description of Artificial Sequence: Synthetic oligonucleotide
  Target: SCN10A; (-) strand; PAM type: YTN; PAM sequence: TTC
cctatcagtctgggccccag

SEQ ID NO: 44663 - DNA, 20 bp, Artificial Sequence
  Description of Artificial Sequence: Synthetic oligonucleotide
  Target: SCN10A; (-) strand; PAM type: YTN; PAM sequence: CTT
ccctatcagtctgggcccca

SEQ ID NO: 44664 - DNA, 20 bp, Artificial Sequence
  Description of Artificial Sequence: Synthetic oligonucleotide
  Target: SCN10A; (-) strand; PAM type: YTN; PAM sequence: CTG
ggtccttccctatcagtctg

SEQ ID NO: 44665 - DNA, 20 bp, Artificial Sequence
  Description of Artificial Sequence: Synthetic oligonucleotide
  Target: SCN10A; (-) strand; PAM type: YTN; PAM sequence: CTG
gctgggtccttccctatcag

SEQ ID NO: 44666 - DNA, 20 bp, Artificial Sequence
  Description of Artificial Sequence: Synthetic oligonucleotide
  Target: SCN10A; (-) strand; PAM type: YTN; PAM sequence: CTG
tggtcagggctggctgggtc

SEQ ID NO: 44667 - DNA, 20 bp, Artificial Sequence
  Description of Artificial Sequence: Synthetic oligonucleotide
  Target: SCN10A; (-) strand; PAM type: YTN; PAM sequence: TTC
cagggactgtggtcagggct

SEQ ID NO: 44668 - DNA, 20 bp, Artificial Sequence
  Description of Artificial Sequence: Synthetic oligonucleotide
  Target: SCN10A; (-) strand; PAM type: YTN; PAM sequence: CTT
ccagggactgtggtcagggc

SEQ ID NO: 44669 - DNA, 20 bp, Artificial Sequence
  Description of Artificial Sequence: Synthetic oligonucleotide
  Target: SCN10A; (-) strand; PAM type: YTN; PAM sequence: CTA
ccaaatccccttccagggac

SEQ ID NO: 44670 - DNA, 20 bp, Artificial Sequence
  Description of Artificial Sequence: Synthetic oligonucleotide
  Target: SCN10A; (-) strand; PAM type: YTN; PAM sequence: CTG
actaccaaatccccttccag

SEQ ID NO: 44671 - DNA, 20 bp, Artificial Sequence
  Description of Artificial Sequence: Synthetic oligonucleotide
  Target: SCN10A; (-) strand; PAM type: YTN; PAM sequence: CTG
gcaagctgactaccaaatcc

SEQ ID NO: 44672 - DNA, 20 bp, Artificial Sequence
  Description of Artificial Sequence: Synthetic oligonucleotide
  Target: SCN10A; (-) strand; PAM type: YTN; PAM sequence: CTA
ctggcaagctgactaccaaa

SEQ ID NO: 44673 - DNA, 20 bp, Artificial Sequence
  Description of Artificial Sequence: Synthetic oligonucleotide
  Target: SCN10A; (-) strand; PAM type: YTN; PAM sequence: CTC
cccacagcaaacaaaatgct

SEQ ID NO: 44674 - DNA, 20 bp, Artificial Sequence
  Description of Artificial Sequence: Synthetic oligonucleotide
  Target: SCN10A; (-) strand; PAM type: YTN; PAM sequence: TTA
cctccccacagcaaacaaaa

SEQ ID NO: 44675 - DNA, 20 bp, Artificial Sequence
  Description of Artificial Sequence: Synthetic oligonucleotide
  Target: SCN10A; (-) strand; PAM type: YTN; PAM sequence: TTT
acctccccacagcaaacaaa

SEQ ID NO: 44676 - DNA, 20 bp, Artificial Sequence
  Description of Artificial Sequence: Synthetic oligonucleotide
  Target: SCN10A; (-) strand; PAM type: YTN; PAM sequence: CTT
tacctccccacagcaaacaa

SEQ ID NO: 44677 - DNA, 20 bp, Artificial Sequence
  Description of Artificial Sequence: Synthetic oligonucleotide
  Target: SCN10A; (-) strand; PAM type: YTN; PAM sequence: CTA
tcccactttacctccccaca

SEQ ID NO: 44678 - DNA, 20 bp, Artificial Sequence
  Description of Artificial Sequence: Synthetic oligonucleotide
  Target: SCN10A; (-) strand; PAM type: YTN; PAM sequence: CTC
cactatcccactttacctcc

SEQ ID NO: 44679 - DNA, 20 bp, Artificial Sequence
  Description of Artificial Sequence: Synthetic oligonucleotide
  Target: SCN10A; (-) strand; PAM type: YTN; PAM sequence: CTC
ctccactatcccactttacc

SEQ ID NO: 44680 - DNA, 20 bp, Artificial Sequence
  Description of Artificial Sequence: Synthetic oligonucleotide
  Target: SCN10A; (-) strand; PAM type: YTN; PAM sequence: CTC
acagtacctcctccactatc

SEQ ID NO: 44681 - DNA, 20 bp, Artificial Sequence
  Description of Artificial Sequence: Synthetic oligonucleotide
  Target: SCN10A; (-) strand; PAM type: YTN; PAM sequence: TTG
gatctcacagtacctcctcc

SEQ ID NO: 44682 - DNA, 20 bp, Artificial Sequence
  Description of Artificial Sequence: Synthetic oligonucleotide
  Target: SCN10A; (-) strand; PAM type: YTN; PAM sequence: TTT
ggatctcacagtacctcctc

SEQ ID NO: 44683 - DNA, 20 bp, Artificial Sequence
  Description of Artificial Sequence: Synthetic oligonucleotide
  Target: SCN10A; (-) strand; PAM type: YTN; PAM sequence: CTT
tggatctcacagtacctcct

SEQ ID NO: 44684 - DNA, 20 bp, Artificial Sequence
  Description of Artificial Sequence: Synthetic oligonucleotide
  Target: SCN10A; (-) strand; PAM type: YTN; PAM sequence: CTG
aagaagtcatgctttggatc

SEQ ID NO: 44685 - DNA, 20 bp, Artificial Sequence
  Description of Artificial Sequence: Synthetic oligonucleotide
  Target: SCN10A; (-) strand; PAM type: YTN; PAM sequence: TTG
gccctgaagaagtcatgctt

SEQ ID NO: 44686 - DNA, 20 bp, Artificial Sequence
  Description of Artificial Sequence: Synthetic oligonucleotide
  Target: SCN10A; (-) strand; PAM type: YTN; PAM sequence: TTG
tccccattggccctgaagaa

SEQ ID NO: 44687 - DNA, 20 bp, Artificial Sequence
  Description of Artificial Sequence: Synthetic oligonucleotide
  Target: SCN10A; (-) strand; PAM type: YTN; PAM sequence: TTT
gtccccattggccctgaaga

SEQ ID NO: 44688 - DNA, 20 bp, Artificial Sequence
  Description of Artificial Sequence: Synthetic oligonucleotide
  Target: SCN10A; (-) strand; PAM type: YTN; PAM sequence: CTG
tttgtccccattggccctga

SEQ ID NO: 44689 - DNA, 20 bp, Artificial Sequence
  Description of Artificial Sequence: Synthetic oligonucleotide
  Target: SCN10A; (-) strand; PAM type: YTN; PAM sequence: CTG
caagtatcagcagggctgtt

SEQ ID NO: 44690 - DNA, 20 bp, Artificial Sequence
  Description of Artificial Sequence: Synthetic oligonucleotide
  Target: SCN10A; (-) strand; PAM type: YTN; PAM sequence: TTC
agcatccctgcaagtatcag

SEQ ID NO: 44691 - DNA, 20 bp, Artificial Sequence
  Description of Artificial Sequence: Synthetic oligonucleotide
  Target: SCN10A; (-) strand; PAM type: YTN; PAM sequence: TTG
cattcagcatccctgcaagt

SEQ ID NO: 44692 - DNA, 20 bp, Artificial Sequence
  Description of Artificial Sequence: Synthetic oligonucleotide
  Target: SCN10A; (-) strand; PAM type: YTN; PAM sequence: CTT
gcattcagcatccctgcaag

SEQ ID NO: 44693 - DNA, 20 bp, Artificial Sequence
  Description of Artificial Sequence: Synthetic oligonucleotide
  Target: SCN10A; (-) strand; PAM type: YTN; PAM sequence: CTC
ccttgcattcagcatccctg

SEQ ID NO: 44694 - DNA, 20 bp, Artificial Sequence
  Description of Artificial Sequence: Synthetic oligonucleotide
  Target: SCN10A; (-) strand; PAM type: YTN; PAM sequence: TTC
tcccttgcattcagcatccc

SEQ ID NO: 44695 - DNA, 20 bp, Artificial Sequence
  Description of Artificial Sequence: Synthetic oligonucleotide
  Target: SCN10A; (-) strand; PAM type: YTN; PAM sequence: TTT
ctcccttgcattcagcatcc

SEQ ID NO: 44696 - DNA, 20 bp, Artificial Sequence
  Description of Artificial Sequence: Synthetic oligonucleotide
  Target: SCN10A; (-) strand; PAM type: YTN; PAM sequence: CTT
tctcccttgcattcagcatc

SEQ ID NO: 44697 - DNA, 20 bp, Artificial Sequence
  Description of Artificial Sequence: Synthetic oligonucleotide
  Target: SCN10A; (-) strand; PAM type: YTN; PAM sequence: TTC
tttctcccttgcattcagca

SEQ ID NO: 44698 - DNA, 20 bp, Artificial Sequence
  Description of Artificial Sequence: Synthetic oligonucleotide
  Target: SCN10A; (-) strand; PAM type: YTN; PAM sequence: TTT
ctttctcccttgcattcagc

SEQ ID NO: 44699 - DNA, 20 bp, Artificial Sequence
  Description of Artificial Sequence: Synthetic oligonucleotide
  Target: SCN10A; (-) strand; PAM type: YTN; PAM sequence: TTT
tctttctcccttgcattcag

SEQ ID NO: 44700 - DNA, 20 bp, Artificial Sequence
  Description of Artificial Sequence: Synthetic oligonucleotide
  Target: SCN10A; (-) strand; PAM type: YTN; PAM sequence: TTG
agaaggttttctttctccct

SEQ ID NO: 44701 - DNA, 20 bp, Artificial Sequence
  Description of Artificial Sequence: Synthetic oligonucleotide
  Target: SCN10A; (-) strand; PAM type: YTN; PAM sequence: TTT
gagaaggttttctttctccc

SEQ ID NO: 44702 - DNA, 20 bp, Artificial Sequence
  Description of Artificial Sequence: Synthetic oligonucleotide
  Target: SCN10A; (-) strand; PAM type: YTN; PAM sequence: TTC
caaaatccaatttgagaagg

SEQ ID NO: 44703 - DNA, 20 bp, Artificial Sequence
  Description of Artificial Sequence: Synthetic oligonucleotide
  Target: SCN10A; (-) strand; PAM type: YTN; PAM sequence: CTT
ccaaaatccaatttgagaag

SEQ ID NO: 44704 - DNA, 20 bp, Artificial Sequence
  Description of Artificial Sequence: Synthetic oligonucleotide
  Target: SCN10A; (-) strand; PAM type: YTN; PAM sequence: TTC
acttccaaaatccaatttga

SEQ ID NO: 44705 - DNA, 20 bp, Artificial Sequence
  Description of Artificial Sequence: Synthetic oligonucleotide
  Target: SCN10A; (-) strand; PAM type: YTN; PAM sequence: TTG
gttcacttccaaaatccaat

SEQ ID NO: 44706 - DNA, 20 bp, Artificial Sequence
  Description of Artificial Sequence: Synthetic oligonucleotide
  Target: SCN10A; (-) strand; PAM type: YTN; PAM sequence: TTT
ggttcacttccaaaatccaa

SEQ ID NO: 44707 - DNA, 20 bp, Artificial Sequence
  Description of Artificial Sequence: Synthetic oligonucleotide
  Target: SCN10A; (-) strand; PAM type: YTN; PAM sequence: CTT
tggttcacttccaaaatcca

SEQ ID NO: 44708 - DNA, 20 bp, Artificial Sequence
  Description of Artificial Sequence: Synthetic oligonucleotide
  Target: SCN10A; (-) strand; PAM type: YTN; PAM sequence: TTA
gcatccctttggttcacttc

SEQ ID NO: 44709 - DNA, 20 bp, Artificial Sequence
  Description of Artificial Sequence: Synthetic oligonucleotide
  Target: SCN10A; (-) strand; PAM type: YTN; PAM sequence: CTG
ttagcatccctttggttcac

SEQ ID NO: 44710 - DNA, 20 bp, Artificial Sequence
  Description of Artificial Sequence: Synthetic oligonucleotide
  Target: SCN10A; (-) strand; PAM type: YTN; PAM sequence: TTA
aacaaagtcactgttagcat

SEQ ID NO: 44711 - DNA, 20 bp, Artificial Sequence
  Description of Artificial Sequence: Synthetic oligonucleotide
  Target: SCN10A; (-) strand; PAM type: YTN; PAM sequence: TTT
aaacaaagtcactgttagca

SEQ ID NO: 44712 - DNA, 20 bp, Artificial Sequence
  Description of Artificial Sequence: Synthetic oligonucleotide
  Target: SCN10A; (-) strand; PAM type: YTN; PAM sequence: TTT
taaacaaagtcactgttagc

SEQ ID NO: 44713 - DNA, 20 bp, Artificial Sequence
  Description of Artificial Sequence: Synthetic oligonucleotide
  Target: SCN10A; (-) strand; PAM type: YTN; PAM sequence: TTT
ttaaacaaagtcactgttag

SEQ ID NO: 44714 - DNA, 20 bp, Artificial Sequence
  Description of Artificial Sequence: Synthetic oligonucleotide
  Target: SCN10A; (-) strand; PAM type: YTN; PAM sequence: TTA
tttttaaacaaagtcactgt

SEQ ID NO: 44715 - DNA, 20 bp, Artificial Sequence
  Description of Artificial Sequence: Synthetic oligonucleotide
  Target: SCN10A; (-) strand; PAM type: YTN; PAM sequence: TTT
atttttaaacaaagtcactg

SEQ ID NO: 44716 - DNA, 20 bp, Artificial Sequence
  Description of Artificial Sequence: Synthetic oligonucleotide
  Target: SCN10A; (-) strand; PAM type: YTN; PAM sequence: TTT
tatttttaaacaaagtcact

SEQ ID NO: 44717 - DNA, 20 bp, Artificial Sequence
  Description of Artificial Sequence: Synthetic oligonucleotide
  Target: SCN10A; (-) strand; PAM type: YTN; PAM sequence: CTT
ttatttttaaacaaagtcac

SEQ ID NO: 44718 - DNA, 20 bp, Artificial Sequence
  Description of Artificial Sequence: Synthetic oligonucleotide
  Target: SCN10A; (-) strand; PAM type: YTN; PAM sequence: TTG
atgcttttatttttaaacaa

SEQ ID NO: 44719 - DNA, 20 bp, Artificial Sequence
  Description of Artificial Sequence: Synthetic oligonucleotide
  Target: SCN10A; (-) strand; PAM type: YTN; PAM sequence: CTG
tgaacatccgttgatgcttt

SEQ ID NO: 44720 - DNA, 20 bp, Artificial Sequence
  Description of Artificial Sequence: Synthetic oligonucleotide
  Target: SCN10A; (-) strand; PAM type: YTN; PAM sequence: CTG
cctgtgaacatccgttgatg

SEQ ID NO: 44721 - DNA, 20 bp, Artificial Sequence
  Description of Artificial Sequence: Synthetic oligonucleotide
  Target: SCN10A; (-) strand; PAM type: YTN; PAM sequence: TTG
taaactgcctgtgaacatcc

SEQ ID NO: 44722 - DNA, 20 bp, Artificial Sequence
  Description of Artificial Sequence: Synthetic oligonucleotide
  Target: SCN10A; (-) strand; PAM type: YTN; PAM sequence: TTT
gtaaactgcctgtgaacatc

SEQ ID NO: 44723 - DNA, 20 bp, Artificial Sequence
  Description of Artificial Sequence: Synthetic oligonucleotide
  Target: SCN10A; (-) strand; PAM type: YTN; PAM sequence: TTT
tgtaaactgcctgtgaacat

SEQ ID NO: 44724 - DNA, 20 bp, Artificial Sequence
  Description of Artificial Sequence: Synthetic oligonucleotide
  Target: SCN10A; (-) strand; PAM type: YTN; PAM sequence: TTT
ttgtaaactgcctgtgaaca

SEQ ID NO: 44725 - DNA, 20 bp, Artificial Sequence
  Description of Artificial Sequence: Synthetic oligonucleotide
  Target: SCN10A; (-) strand; PAM type: YTN; PAM sequence: TTC
atttttgtaaactgcctgtg

SEQ ID NO: 44726 - DNA, 20 bp, Artificial Sequence
  Description of Artificial Sequence: Synthetic oligonucleotide
  Target: SCN10A; (-) strand; PAM type: YTN; PAM sequence: TTT
catttttgtaaactgcctgt

SEQ ID NO: 44727 - DNA, 20 bp, Artificial Sequence
  Description of Artificial Sequence: Synthetic oligonucleotide
  Target: SCN10A; (-) strand; PAM type: YTN; PAM sequence: CTT
tcatttttgtaaactgcctg

SEQ ID NO: 44728 - DNA, 20 bp, Artificial Sequence
  Description of Artificial Sequence: Synthetic oligonucleotide
  Target: SCN10A; (-) strand; PAM type: YTN; PAM sequence: TTA
ctttcatttttgtaaactgc

SEQ ID NO: 44729 - DNA, 20 bp, Artificial Sequence
  Description of Artificial Sequence: Synthetic oligonucleotide
  Target: SCN10A; (-) strand; PAM type: YTN; PAM sequence: CTT
actttcatttttgtaaactg

SEQ ID NO: 44730 - DNA, 20 bp, Artificial Sequence
  Description of Artificial Sequence: Synthetic oligonucleotide
  Target: SCN10A; (-) strand; PAM type: YTN; PAM sequence: TTC
ttactttcatttttgtaaac

SEQ ID NO: 44731 - DNA, 20 bp, Artificial Sequence
  Description of Artificial Sequence: Synthetic oligonucleotide
  Target: SCN10A; (-) strand; PAM type: YTN; PAM sequence: TTG
gcgattcttactttcatttt

SEQ ID NO: 44732 - DNA, 20 bp, Artificial Sequence
  Description of Artificial Sequence: Synthetic oligonucleotide
  Target: SCN10A; (-) strand; PAM type: YTN; PAM sequence: TTC
agaggtgtgttggcgattct

SEQ ID NO: 44733 - DNA, 20 bp, Artificial Sequence
  Description of Artificial Sequence: Synthetic oligonucleotide
  Target: SCN10A; (-) strand; PAM type: YTN; PAM sequence: TTT
cagaggtgtgttggcgattc

SEQ ID NO: 44734 - DNA, 20 bp, Artificial Sequence
  Description of Artificial Sequence: Synthetic oligonucleotide
  Target: SCN10A; (-) strand; PAM type: YTN; PAM sequence: TTT
tcagaggtgtgttggcgatt

SEQ ID NO: 44735 - DNA, 20 bp, Artificial Sequence
  Description of Artificial Sequence: Synthetic oligonucleotide
  Target: SCN10A; (-) strand; PAM type: YTN; PAM sequence: TTT
ttcagaggtgtgttggcgat

SEQ ID NO: 44736 - DNA, 20 bp, Artificial Sequence
  Description of Artificial Sequence: Synthetic oligonucleotide
  Target: SCN10A; (-) strand; PAM type: YTN; PAM sequence: CTT
tttcagaggtgtgttggcga

SEQ ID NO: 44737 - DNA, 20 bp, Artificial Sequence
  Description of Artificial Sequence: Synthetic oligonucleotide
  Target: SCN10A; (-) strand; PAM type: YTN; PAM sequence: TTC
tttttcagaggtgtgttggc

SEQ ID NO: 44738 - DNA, 20 bp, Artificial Sequence
  Description of Artificial Sequence: Synthetic oligonucleotide
  Target: SCN10A; (-) strand; PAM type: YTN; PAM sequence: TTA
ccagtgagatagaacattct

SEQ ID NO: 44739 - DNA, 20 bp, Artificial Sequence
  Description of Artificial Sequence: Synthetic oligonucleotide
  Target: SCN10A; (-) strand; PAM type: YTN; PAM sequence: TTG
attaccagtgagatagaaca

SEQ ID NO: 44740 - DNA, 20 bp, Artificial Sequence
  Description of Artificial Sequence: Synthetic oligonucleotide
  Target: SCN10A; (-) strand; PAM type: YTN; PAM sequence: CTT
gattaccagtgagatagaac

SEQ ID NO: 44741 - DNA, 20 bp, Artificial Sequence
  Description of Artificial Sequence: Synthetic oligonucleotide
  Target: SCN10A; (-) strand; PAM type: YTN; PAM sequence: TTC
cttgattaccagtgagatag

SEQ ID NO: 44742 - DNA, 20 bp, Artificial Sequence
  Description of Artificial Sequence: Synthetic oligonucleotide
  Target: SCN10A; (-) strand; PAM type: YTN; PAM sequence: TTT
ccttgattaccagtgagata

SEQ ID NO: 44743 - DNA, 20 bp, Artificial Sequence
  Description of Artificial Sequence: Synthetic oligonucleotide
  Target: SCN10A; (-) strand; PAM type: YTN; PAM sequence: TTG
aatttccttgattaccagtg

SEQ ID NO: 44744 - DNA, 20 bp, Artificial Sequence
  Description of Artificial Sequence: Synthetic oligonucleotide
  Target: SCN10A; (-) strand; PAM type: YTN; PAM sequence: TTT
gaatttccttgattaccagt

SEQ ID NO: 44745 - DNA, 20 bp, Artificial Sequence
  Description of Artificial Sequence: Synthetic oligonucleotide
  Target: SCN10A; (-) strand; PAM type: YTN; PAM sequence: TTA
atttgaatttccttgattac

SEQ ID NO: 44746 - DNA, 20 bp, Artificial Sequence
  Description of Artificial Sequence: Synthetic oligonucleotide
  Target: SCN10A; (-) strand; PAM type: YTN; PAM sequence: TTT
aatttgaatttccttgatta

SEQ ID NO: 44747 - DNA, 20 bp, Artificial Sequence
  Description of Artificial Sequence: Synthetic oligonucleotide
  Target: SCN10A; (-) strand; PAM type: YTN; PAM sequence: TTT
taatttgaatttccttgatt

SEQ ID NO: 44748 - DNA, 20 bp, Artificial Sequence
  Description of Artificial Sequence: Synthetic oligonucleotide
  Target: SCN10A; (-) strand; PAM type: YTN; PAM sequence: CTT
ttaatttgaatttccttgat

SEQ ID NO: 44749 - DNA, 20 bp, Artificial Sequence
  Description of Artificial Sequence: Synthetic oligonucleotide
  Target: SCN10A; (-) strand; PAM type: YTN; PAM sequence: TTC
ttttaatttgaatttccttg

SEQ ID NO: 44750 - DNA, 20 bp, Artificial Sequence
  Description of Artificial Sequence: Synthetic oligonucleotide
  Target: SCN10A; (-) strand; PAM type: YTN; PAM sequence: CTT
cttttaatttgaatttcctt

SEQ ID NO: 44751 - DNA, 20 bp, Artificial Sequence
  Description of Artificial Sequence: Synthetic oligonucleotide
  Target: SCN10A; (-) strand; PAM type: YTN; PAM sequence: CTG
ataaaagaaaaacagcatct

SEQ ID NO: 44752 - DNA, 20 bp, Artificial Sequence
  Description of Artificial Sequence: Synthetic oligonucleotide
  Target: SCN10A; (-) strand; PAM type: YTN; PAM sequence: CTC
caccagtctgataaaagaaa

SEQ ID NO: 44753 - DNA, 20 bp, Artificial Sequence
  Description of Artificial Sequence: Synthetic oligonucleotide
  Target: SCN10A; (-) strand; PAM type: YTN; PAM sequence: TTC
catctccaccagtctgataa

SEQ ID NO: 44754 - DNA, 20 bp, Artificial Sequence
  Description of Artificial Sequence: Synthetic oligonucleotide
  Target: SCN10A; (-) strand; PAM type: YTN; PAM sequence: TTT
ccatctccaccagtctgata

SEQ ID NO: 44755 - DNA, 20 bp, Artificial Sequence
  Description of Artificial Sequence: Synthetic oligonucleotide
  Target: SCN10A; (-) strand; PAM type: YTN; PAM sequence: TTT
tccatctccaccagtctgat

SEQ ID NO: 44756 - DNA, 20 bp, Artificial Sequence
  Description of Artificial Sequence: Synthetic oligonucleotide
  Target: SCN10A; (-) strand; PAM type: YTN; PAM sequence: CTT
ttccatctccaccagtctga

SEQ ID NO: 44757 - DNA, 20 bp, Artificial Sequence
  Description of Artificial Sequence: Synthetic oligonucleotide
  Target: SCN10A; (-) strand; PAM type: YTN; PAM sequence: TTC
ttttccatctccaccagtct

SEQ ID NO: 44758 - DNA, 20 bp, Artificial Sequence
  Description of Artificial Sequence: Synthetic oligonucleotide
  Target: SCN10A; (-) strand; PAM type: YTN; PAM sequence: CTA
ttcttttccatctccaccag

SEQ ID NO: 44759 - DNA, 20 bp, Artificial Sequence
  Description of Artificial Sequence: Synthetic oligonucleotide
  Target: SCN10A; (-) strand; PAM type: YTN; PAM sequence: TTC
ccctattcttttccatctcc

SEQ ID NO: 44760 - DNA, 20 bp, Artificial Sequence
  Description of Artificial Sequence: Synthetic oligonucleotide
  Target: SCN10A; (-) strand; PAM type: YTN; PAM sequence: TTT
cccctattcttttccatctc

SEQ ID NO: 44761 - DNA, 20 bp, Artificial Sequence
  Description of Artificial Sequence: Synthetic oligonucleotide
  Target: SCN10A; (-) strand; PAM type: YTN; PAM sequence: CTA
gggtttcccctattcttttc

SEQ ID NO: 44762 - DNA, 20 bp, Artificial Sequence
  Description of Artificial Sequence: Synthetic oligonucleotide
  Target: SCN10A; (-) strand; PAM type: YTN; PAM sequence: CTC
aaaaaaaaaaaaaaaaaaaa

SEQ ID NO: 44763 - DNA, 20 bp, Artificial Sequence
  Description of Artificial Sequence: Synthetic oligonucleotide
  Target: SCN10A; (-) strand; PAM type: YTN; PAM sequence: CTC
cgtctcaaaaaaaaaaaaaa

SEQ ID NO: 44764 - DNA, 20 bp, Artificial Sequence
  Description of Artificial Sequence: Synthetic oligonucleotide
  Target: SCN10A; (-) strand; PAM type: YTN; PAM sequence: CTG
ggcgacagagcgagactccg

SEQ ID NO: 44765 - DNA, 20 bp, Artificial Sequence
  Description of Artificial Sequence: Synthetic oligonucleotide
  Target: SCN10A; (-) strand; PAM type: YTN; PAM sequence: CTC
cagcctgggcgacagagcga

SEQ ID NO: 44766 - DNA, 20 bp, Artificial Sequence
  Description of Artificial Sequence: Synthetic oligonucleotide
  Target: SCN10A; (-) strand; PAM type: YTN; PAM sequence: CTG
cactccagcctgggcgacag

SEQ ID NO: 44767 - DNA, 20 bp, Artificial Sequence
  Description of Artificial Sequence: Synthetic oligonucleotide
  Target: SCN10A; (-) strand; PAM type: YTN; PAM sequence: CTA
ctgcactccagcctgggcga

SEQ ID NO: 44768 - DNA, 20 bp, Artificial Sequence
  Description of Artificial Sequence: Synthetic oligonucleotide
  Target: SCN10A; (-) strand; PAM type: YTN; PAM sequence: TTG
cagtgagccgagatcccgct

SEQ ID NO: 44769 - DNA, 20 bp, Artificial Sequence
  Description of Artificial Sequence: Synthetic oligonucleotide
  Target: SCN10A; (-) strand; PAM type: YTN; PAM sequence: CTT
gcagtgagccgagatcccgc

SEQ ID NO: 44770 - DNA, 20 bp, Artificial Sequence
  Description of Artificial Sequence: Synthetic oligonucleotide
  Target: SCN10A; (-) strand; PAM type: YTN; PAM sequence: CTG
ggaggcagagcttgcagtga

SEQ ID NO: 44771 - DNA, 20 bp, Artificial Sequence
  Description of Artificial Sequence: Synthetic oligonucleotide
  Target: SCN10A; (-) strand; PAM type: YTN; PAM sequence: CTG
aggcaggagaatggcgtgaa

SEQ ID NO: 44772 - DNA, 20 bp, Artificial Sequence
  Description of Artificial Sequence: Synthetic oligonucleotide
  Target: SCN10A; (-) strand; PAM type: YTN; PAM sequence: TTG
ggaggctgaggcaggagaat

SEQ ID NO: 44773 - DNA, 20 bp, Artificial Sequence
  Description of Artificial Sequence: Synthetic oligonucleotide
  Target: SCN10A; (-) strand; PAM type: YTN; PAM sequence: CTT
gggaggctgaggcaggagaa

SEQ ID NO: 44774 - DNA, 20 bp, Artificial Sequence
  Description of Artificial Sequence: Synthetic oligonucleotide
  Target: SCN10A; (-) strand; PAM type: YTN; PAM sequence: CTA
cttgggaggctgaggcagga

SEQ ID NO: 44775 - DNA, 20 bp, Artificial Sequence
  Description of Artificial Sequence: Synthetic oligonucleotide
  Target: SCN10A; (-) strand; PAM type: YTN; PAM sequence: CTG
tagtcccagctacttgggag

SEQ ID NO: 44776 - DNA, 20 bp, Artificial Sequence
  Description of Artificial Sequence: Synthetic oligonucleotide
  Target: SCN10A; (-) strand; PAM type: YTN; PAM sequence: TTA
gccgggcgtagtggcgggcg

SEQ ID NO: 44777 - DNA, 20 bp, Artificial Sequence
  Description of Artificial Sequence: Synthetic oligonucleotide
  Target: SCN10A; (-) strand; PAM type: YTN; PAM sequence: CTA
aaaatacaaaaaattagccg

SEQ ID NO: 44778 - DNA, 20 bp, Artificial Sequence
  Description of Artificial Sequence: Synthetic oligonucleotide
  Target: SCN10A; (-) strand; PAM type: YTN; PAM sequence: CTA
ctaaaaatacaaaaaattag

SEQ ID NO: 44779 - DNA, 20 bp, Artificial Sequence
  Description of Artificial Sequence: Synthetic oligonucleotide
  Target: SCN10A; (-) strand; PAM type: YTN; PAM sequence: CTC
tactaaaaatacaaaaaatt

SEQ ID NO: 44780 - DNA, 20 bp, Artificial Sequence
  Description of Artificial Sequence: Synthetic oligonucleotide
  Target: SCN10A; (-) strand; PAM type: YTN; PAM sequence: CTA
aaacggtgaaaccccgtctc

SEQ ID NO: 44781 - DNA, 20 bp, Artificial Sequence
  Description of Artificial Sequence: Synthetic oligonucleotide
  Target: SCN10A; (-) strand; PAM type: YTN; PAM sequence: CTG
aggcgggcggatcatgaggt

SEQ ID NO: 44782 - DNA, 20 bp, Artificial Sequence
  Description of Artificial Sequence: Synthetic oligonucleotide
  Target: SCN10A; (-) strand; PAM type: YTN; PAM sequence: TTG
ggaggctgaggcgggcggat

SEQ ID NO: 44783 - DNA, 20 bp, Artificial Sequence
  Description of Artificial Sequence: Synthetic oligonucleotide
  Target: SCN10A; (-) strand; PAM type: YTN; PAM sequence: TTT
gggaggctgaggcgggcgga

SEQ ID NO: 44784 - DNA, 20 bp, Artificial Sequence
  Description of Artificial Sequence: Synthetic oligonucleotide
  Target: SCN10A; (-) strand; PAM type: YTN; PAM sequence: CTT
tgggaggctgaggcgggcgg

SEQ ID NO: 44785 - DNA, 20 bp, Artificial Sequence
  Description of Artificial Sequence: Synthetic oligonucleotide
  Target: SCN10A; (-) strand; PAM type: YTN; PAM sequence: CTG
taatcccagcactttgggag

SEQ ID NO: 44786 - DNA, 20 bp, Artificial Sequence
  Description of Artificial Sequence: Synthetic oligonucleotide
  Target: SCN10A; (-) strand; PAM type: YTN; PAM sequence: CTC
acgcctgtaatcccagcact

SEQ ID NO: 44787 - DNA, 20 bp, Artificial Sequence
  Description of Artificial Sequence: Synthetic oligonucleotide
  Target: SCN10A; (-) strand; PAM type: YTN; PAM sequence: TTG
taagagtggccgggcgcggt

SEQ ID NO: 44788 - DNA, 20 bp, Artificial Sequence
  Description of Artificial Sequence: Synthetic oligonucleotide
  Target: SCN10A; (-) strand; PAM type: YTN; PAM sequence: CTT
gtaagagtggccgggcgcgg

SEQ ID NO: 44789 - DNA, 20 bp, Artificial Sequence
  Description of Artificial Sequence: Synthetic oligonucleotide
  Target: SCN10A; (-) strand; PAM type: YTN; PAM sequence: CTG
ccagtcacttgtaagagtgg

SEQ ID NO: 44790 - DNA, 20 bp, Artificial Sequence
  Description of Artificial Sequence: Synthetic oligonucleotide
  Target: SCN10A; (-) strand; PAM type: YTN; PAM sequence: CTC
ctgccagtcacttgtaagag

SEQ ID NO: 44791 - DNA, 20 bp, Artificial Sequence
  Description of Artificial Sequence: Synthetic oligonucleotide
  Target: SCN10A; (-) strand; PAM type: YTN; PAM sequence: TTC
actcctgccagtcacttgta

SEQ ID NO: 44792 - DNA, 20 bp, Artificial Sequence
  Description of Artificial Sequence: Synthetic oligonucleotide
  Target: SCN10A; (-) strand; PAM type: YTN; PAM sequence: TTT
cactcctgccagtcacttgt

SEQ ID NO: 44793 - DNA, 20 bp, Artificial Sequence
  Description of Artificial Sequence: Synthetic oligonucleotide
  Target: SCN10A; (-) strand; PAM type: YTN; PAM sequence: TTT
tcactcctgccagtcacttg

SEQ ID NO: 44794 - DNA, 20 bp, Artificial Sequence
  Description of Artificial Sequence: Synthetic oligonucleotide
  Target: SCN10A; (-) strand; PAM type: YTN; PAM sequence: CTG
gccaggttttcactcctgcc

SEQ ID NO: 44795 - DNA, 20 bp, Artificial Sequence
  Description of Artificial Sequence: Synthetic oligonucleotide
  Target: SCN10A; (-) strand; PAM type: YTN; PAM sequence: TTC
acacaggactggccaggttt

SEQ ID NO: 44796 - DNA, 20 bp, Artificial Sequence
  Description of Artificial Sequence: Synthetic oligonucleotide
  Target: SCN10A; (-) strand; PAM type: YTN; PAM sequence: CTT
cacacaggactggccaggtt

SEQ ID NO: 44797 - DNA, 20 bp, Artificial Sequence
  Description of Artificial Sequence: Synthetic oligonucleotide
  Target: SCN10A; (-) strand; PAM type: YTN; PAM sequence: TTG
gcttcacacaggactggcca

SEQ ID NO: 44798 - DNA, 20 bp, Artificial Sequence
  Description of Artificial Sequence: Synthetic oligonucleotide
  Target: SCN10A; (-) strand; PAM type: YTN; PAM sequence: TTT
ggcttcacacaggactggcc

SEQ ID NO: 44799 - DNA, 20 bp, Artificial Sequence
  Description of Artificial Sequence: Synthetic oligonucleotide
  Target: SCN10A; (-) strand; PAM type: YTN; PAM sequence: TTG
ccaatttggcttcacacagg

SEQ ID NO: 44800 - DNA, 20 bp, Artificial Sequence
  Description of Artificial Sequence: Synthetic oligonucleotide
  Target: SCN10A; (-) strand; PAM type: YTN; PAM sequence: CTG
agtcacattgccaatttggc

SEQ ID NO: 44801 - DNA, 20 bp, Artificial Sequence
  Description of Artificial Sequence: Synthetic oligonucleotide
  Target: SCN10A; (-) strand; PAM type: YTN; PAM sequence: CTC
tgagtcacattgccaatttg

SEQ ID NO: 44802 - DNA, 20 bp, Artificial Sequence
  Description of Artificial Sequence: Synthetic oligonucleotide
  Target: SCN10A; (-) strand; PAM type: YTN; PAM sequence: CTG
aaacctctgagtcacattgc

SEQ ID NO: 44803 - DNA, 20 bp, Artificial Sequence
  Description of Artificial Sequence: Synthetic oligonucleotide
  Target: SCN10A; (-) strand; PAM type: YTN; PAM sequence: TTC
ctgaaacctctgagtcacat

SEQ ID NO: 44804 - DNA, 20 bp, Artificial Sequence
  Description of Artificial Sequence: Synthetic oligonucleotide
  Target: SCN10A; (-) strand; PAM type: YTN; PAM sequence: CTA
ggttcctgaaacctctgagt

SEQ ID NO: 44805 - DNA, 20 bp, Artificial Sequence
  Description of Artificial Sequence: Synthetic oligonucleotide
  Target: SCN10A; (-) strand; PAM type: YTN; PAM sequence: TTG
ctaggttcctgaaacctctg

SEQ ID NO: 44806 - DNA, 20 bp, Artificial Sequence
  Description of Artificial Sequence: Synthetic oligonucleotide
  Target: SCN10A; (-) strand; PAM type: YTN; PAM sequence: TTG
aaggaggaattgctaggttc

SEQ ID NO: 44807 - DNA, 20 bp, Artificial Sequence
  Description of Artificial Sequence: Synthetic oligonucleotide
  Target: SCN10A; (-) strand; PAM type: YTN; PAM sequence: CTT
gaaggaggaattgctaggtt

SEQ ID NO: 44808 - DNA, 20 bp, Artificial Sequence
  Description of Artificial Sequence: Synthetic oligonucleotide
  Target: SCN10A; (-) strand; PAM type: YTN; PAM sequence: TTA
gtgcttgaaggaggaattgc

SEQ ID NO: 44809 - DNA, 20 bp, Artificial Sequence
  Description of Artificial Sequence: Synthetic oligonucleotide
  Target: SCN10A; (-) strand; PAM type: YTN; PAM sequence: TTA
ggattagtgcttgaaggagg

SEQ ID NO: 44810 - DNA, 20 bp, Artificial Sequence
  Description of Artificial Sequence: Synthetic oligonucleotide
  Target: SCN10A; (-) strand; PAM type: YTN; PAM sequence: CTT
aggattagtgcttgaaggag

SEQ ID NO: 44811 - DNA, 20 bp, Artificial Sequence
  Description of Artificial Sequence: Synthetic oligonucleotide
  Target: SCN10A; (-) strand; PAM type: YTN; PAM sequence: CTC
cagtgtccttaggattagtg

SEQ ID NO: 44812 - DNA, 20 bp, Artificial Sequence
  Description of Artificial Sequence: Synthetic oligonucleotide
  Target: SCN10A; (-) strand; PAM type: YTN; PAM sequence: CTG
agtgggcaccaacagcctcc

SEQ ID NO: 44813 - DNA, 20 bp, Artificial Sequence
  Description of Artificial Sequence: Synthetic oligonucleotide
  Target: SCN10A; (-) strand; PAM type: YTN; PAM sequence: TTA
aagaggacctgagtgggcac

SEQ ID NO: 44814 - DNA, 20 bp, Artificial Sequence
  Description of Artificial Sequence: Synthetic oligonucleotide
  Target: SCN10A; (-) strand; PAM type: YTN; PAM sequence: CTT
aaagaggacctgagtgggca

SEQ ID NO: 44815 - DNA, 20 bp, Artificial Sequence
  Description of Artificial Sequence: Synthetic oligonucleotide
  Target: SCN10A; (-) strand; PAM type: YTN; PAM sequence: CTG
gccccttaaagaggacctga

SEQ ID NO: 44816 - DNA, 20 bp, Artificial Sequence
  Description of Artificial Sequence: Synthetic oligonucleotide
  Target: SCN10A; (-) strand; PAM type: YTN; PAM sequence: CTC
ccagcagatgaaggataggg

SEQ ID NO: 44817 - DNA, 20 bp, Artificial Sequence
  Description of Artificial Sequence: Synthetic oligonucleotide
  Target: SCN10A; (-) strand; PAM type: YTN; PAM sequence: TTA
gcagccgacactcccagcag

SEQ ID NO: 44818 - DNA, 20 bp, Artificial Sequence
  Description of Artificial Sequence: Synthetic oligonucleotide
  Target: SCN10A; (-) strand; PAM type: YTN; PAM sequence: CTA
ttagcagccgacactcccag

SEQ ID NO: 44819 - DNA, 20 bp, Artificial Sequence
  Description of Artificial Sequence: Synthetic oligonucleotide
  Target: SCN10A; (-) strand; PAM type: YTN; PAM sequence: CTG
catccatgaactattagcag

SEQ ID NO: 44820 - DNA, 20 bp, Artificial Sequence
  Description of Artificial Sequence: Synthetic oligonucleotide
  Target: SCN10A; (-) strand; PAM type: YTN; PAM sequence: CTC
cagcccagcgaagccatcag

SEQ ID NO: 44821 - DNA, 20 bp, Artificial Sequence
  Description of Artificial Sequence: Synthetic oligonucleotide
  Target: SCN10A; (-) strand; PAM type: YTN; PAM sequence: TTC
ctccagcccagcgaagccat

SEQ ID NO: 44822 - DNA, 20 bp, Artificial Sequence
  Description of Artificial Sequence: Synthetic oligonucleotide
  Target: SCN10A; (-) strand; PAM type: YTN; PAM sequence: TTT
cctccagcccagcgaagcca

SEQ ID NO: 44823 - DNA, 20 bp, Artificial Sequence
  Description of Artificial Sequence: Synthetic oligonucleotide
  Target: SCN10A; (-) strand; PAM type: YTN; PAM sequence: TTC
ccaaggtggacacagtttcc

SEQ ID NO: 44824 - DNA, 20 bp, Artificial Sequence
  Description of Artificial Sequence: Synthetic oligonucleotide
  Target: SCN10A; (-) strand; PAM type: YTN; PAM sequence: TTT
cccaaggtggacacagtttc

SEQ ID NO: 44825 - DNA, 20 bp, Artificial Sequence
  Description of Artificial Sequence: Synthetic oligonucleotide
  Target: SCN10A; (-) strand; PAM type: YTN; PAM sequence: CTG
ccccagcggggaggataagc

SEQ ID NO: 44826 - DNA, 20 bp, Artificial Sequence
  Description of Artificial Sequence: Synthetic oligonucleotide
  Target: SCN10A; (-) strand; PAM type: YTN; PAM sequence: CTG
agggctgccccagcggggag

SEQ ID NO: 44827 - DNA, 20 bp, Artificial Sequence
  Description of Artificial Sequence: Synthetic oligonucleotide
  Target: SCN10A; (-) strand; PAM type: YTN; PAM sequence: CTG
gctgagggctgccccagcgg

SEQ ID NO: 44828 - DNA, 20 bp, Artificial Sequence
  Description of Artificial Sequence: Synthetic oligonucleotide
  Target: SCN10A; (-) strand; PAM type: YTN; PAM sequence: CTG
tccctggctgagggctgccc

SEQ ID NO: 44829 - DNA, 20 bp, Artificial Sequence
  Description of Artificial Sequence: Synthetic oligonucleotide
  Target: SCN10A; (-) strand; PAM type: YTN; PAM sequence: CTG
tcactgtccctggctgaggg

SEQ ID NO: 44830 - DNA, 20 bp, Artificial Sequence
  Description of Artificial Sequence: Synthetic oligonucleotide
  Target: SCN10A; (-) strand; PAM type: YTN; PAM sequence: TTG
taaatccccctgtcactgtc

SEQ ID NO: 44831 - DNA, 20 bp, Artificial Sequence
  Description of Artificial Sequence: Synthetic oligonucleotide
  Target: SCN10A; (-) strand; PAM type: YTN; PAM sequence: CTT
gtaaatccccctgtcactgt

SEQ ID NO: 44832 - DNA, 20 bp, Artificial Sequence
  Description of Artificial Sequence: Synthetic oligonucleotide
  Target: SCN10A; (-) strand; PAM type: YTN; PAM sequence: TTG
aggcaaagaagacagccttg

SEQ ID NO: 44833 - DNA, 20 bp, Artificial Sequence
  Description of Artificial Sequence: Synthetic oligonucleotide
  Target: SCN10A; (-) strand; PAM type: YTN; PAM sequence: CTT
gaggcaaagaagacagcctt

SEQ ID NO: 44834 - DNA, 20 bp, Artificial Sequence
  Description of Artificial Sequence: Synthetic oligonucleotide
  Target: SCN10A; (-) strand; PAM type: YTN; PAM sequence: CTG
tcccaccttgaggcaaagaa

SEQ ID NO: 44835 - DNA, 20 bp, Artificial Sequence
  Description of Artificial Sequence: Synthetic oligonucleotide
  Target: SCN10A; (-) strand; PAM type: YTN; PAM sequence: CTG
aagcacaaaggacaccaaag

SEQ ID NO: 44836 - DNA, 20 bp, Artificial Sequence
  Description of Artificial Sequence: Synthetic oligonucleotide
  Target: SCN10A; (-) strand; PAM type: YTN; PAM sequence: CTG
atcccatggaaagccctgaa

SEQ ID NO: 44837 - DNA, 20 bp, Artificial Sequence
  Description of Artificial Sequence: Synthetic oligonucleotide
  Target: SCN10A; (-) strand; PAM type: YTN; PAM sequence: TTC
agctgatcccatggaaagcc

SEQ ID NO: 44838 - DNA, 20 bp, Artificial Sequence
  Description of Artificial Sequence: Synthetic oligonucleotide
  Target: SCN10A; (-) strand; PAM type: YTN; PAM sequence: CTT
cagctgatcccatggaaagc

SEQ ID NO: 44839 - DNA, 20 bp, Artificial Sequence
  Description of Artificial Sequence: Synthetic oligonucleotide
  Target: SCN10A; (-) strand; PAM type: YTN; PAM sequence: TTG
aaatccggcttcagctgatc

SEQ ID NO: 44840 - DNA, 20 bp, Artificial Sequence
  Description of Artificial Sequence: Synthetic oligonucleotide
  Target: SCN10A; (-) strand; PAM type: YTN; PAM sequence: TTC
agttgaaatccggcttcagc

SEQ ID NO: 44841 - DNA, 20 bp, Artificial Sequence
  Description of Artificial Sequence: Synthetic oligonucleotide
  Target: SCN10A; (-) strand; PAM type: YTN; PAM sequence: CTG
agaaaagatgtgggttcagt

SEQ ID NO: 44842 - DNA, 20 bp, Artificial Sequence
  Description of Artificial Sequence: Synthetic oligonucleotide
  Target: SCN10A; (-) strand; PAM type: YTN; PAM sequence: CTA
gacacagaatcggaagctga

SEQ ID NO: 44843 - DNA, 20 bp, Artificial Sequence
  Description of Artificial Sequence: Synthetic oligonucleotide
  Target: SCN10A; (-) strand; PAM type: YTN; PAM sequence: CTC
gtcctagacacagaatcgga

SEQ ID NO: 44844 - DNA, 20 bp, Artificial Sequence
  Description of Artificial Sequence: Synthetic oligonucleotide
  Target: SCN10A; (-) strand; PAM type: YTN; PAM sequence: TTA
gtcctcgtcctagacacaga

SEQ ID NO: 44845 - DNA, 20 bp, Artificial Sequence
  Description of Artificial Sequence: Synthetic oligonucleotide
  Target: SCN10A; (-) strand; PAM type: YTN; PAM sequence: CTT
agtcctcgtcctagacacag

SEQ ID NO: 44846 - DNA, 20 bp, Artificial Sequence
  Description of Artificial Sequence: Synthetic oligonucleotide
  Target: SCN10A; (-) strand; PAM type: YTN; PAM sequence: CTC
ccatcttagtcctcgtccta

SEQ ID NO: 44847 - DNA, 20 bp, Artificial Sequence
  Description of Artificial Sequence: Synthetic oligonucleotide
  Target: SCN10A; (-) strand; PAM type: YTN; PAM sequence: TTG
gataatctcccatcttagtc

SEQ ID NO: 44848 - DNA, 20 bp, Artificial Sequence
  Description of Artificial Sequence: Synthetic oligonucleotide
  Target: SCN10A; (-) strand; PAM type: YTN; PAM sequence: TTA
gagacgttggataatctccc

SEQ ID NO: 44849 - DNA, 20 bp, Artificial Sequence
  Description of Artificial Sequence: Synthetic oligonucleotide
  Target: SCN10A; (-) strand; PAM type: YTN; PAM sequence: CTT
agagacgttggataatctcc

SEQ ID NO: 44850 - DNA, 20 bp, Artificial Sequence
  Description of Artificial Sequence: Synthetic oligonucleotide
  Target: SCN10A; (-) strand; PAM type: YTN; PAM sequence: CTC
ccttagagacgttggataat

SEQ ID NO: 44851 - DNA, 20 bp, Artificial Sequence
  Description of Artificial Sequence: Synthetic oligonucleotide
  Target: SCN10A; (-) strand; PAM type: YTN; PAM sequence: CTG
tgtgtactcccttagagacg

SEQ ID NO: 44852 - DNA, 20 bp, Artificial Sequence
  Description of Artificial Sequence: Synthetic oligonucleotide
  Target: SCN10A; (-) strand; PAM type: YTN; PAM sequence: TTC
cctgtgtgtactcccttaga

SEQ ID NO: 44853 - DNA, 20 bp, Artificial Sequence
  Description of Artificial Sequence: Synthetic oligonucleotide
  Target: SCN10A; (-) strand; PAM type: YTN; PAM sequence: TTG
aatattccctgtgtgtactc

SEQ ID NO: 44854 - DNA, 20 bp, Artificial Sequence
  Description of Artificial Sequence: Synthetic oligonucleotide
  Target: SCN10A; (-) strand; PAM type: YTN; PAM sequence: CTA
atacacattgaatattccct

SEQ ID NO: 44855 - DNA, 20 bp, Artificial Sequence
  Description of Artificial Sequence: Synthetic oligonucleotide
  Target: SCN10A; (-) strand; PAM type: YTN; PAM sequence: TTC
taatacacattgaatattcc

SEQ ID NO: 44856 - DNA, 20 bp, Artificial Sequence
  Description of Artificial Sequence: Synthetic oligonucleotide
  Target: SCN10A; (-) strand; PAM type: YTN; PAM sequence: CTT
ctaatacacattgaatattc

SEQ ID NO: 44857 - DNA, 20 bp, Artificial Sequence
  Description of Artificial Sequence: Synthetic oligonucleotide
  Target: SCN10A; (-) strand; PAM type: YTN; PAM sequence: TTA
cttctaatacacattgaata

SEQ ID NO: 44858 - DNA, 20 bp, Artificial Sequence
  Description of Artificial Sequence: Synthetic oligonucleotide
  Target: SCN10A; (-) strand; PAM type: YTN; PAM sequence: TTT
acttctaatacacattgaat

SEQ ID NO: 44859 - DNA, 20 bp, Artificial Sequence
  Description of Artificial Sequence: Synthetic oligonucleotide
  Target: SCN10A; (-) strand; PAM type: YTN; PAM sequence: CTA
tgtttacttctaatacacat

SEQ ID NO: 44860 - DNA, 20 bp, Artificial Sequence
  Description of Artificial Sequence: Synthetic oligonucleotide
  Target: SCN10A; (-) strand; PAM type: YTN; PAM sequence: CTC
tatgtttacttctaatacac

SEQ ID NO: 44861 - DNA, 20 bp, Artificial Sequence
  Description of Artificial Sequence: Synthetic oligonucleotide
  Target: SCN10A; (-) strand; PAM type: YTN; PAM sequence: CTC
aaccaatctctatgtttact

SEQ ID NO: 44862 - DNA, 20 bp, Artificial Sequence
  Description of Artificial Sequence: Synthetic oligonucleotide
  Target: SCN10A; (-) strand; PAM type: YTN; PAM sequence: TTA
ctcaaccaatctctatgttt

SEQ ID NO: 44863 - DNA, 20 bp, Artificial Sequence
  Description of Artificial Sequence: Synthetic oligonucleotide
  Target: SCN10A; (-) strand; PAM type: YTN; PAM sequence: TTT
actcaaccaatctctatgtt

SEQ ID NO: 44864 - DNA, 20 bp, Artificial Sequence
  Description of Artificial Sequence: Synthetic oligonucleotide
  Target: SCN10A; (-) strand; PAM type: YTN; PAM sequence: TTA
taatttactcaaccaatctc

SEQ ID NO: 44865 - DNA, 20 bp, Artificial Sequence
  Description of Artificial Sequence: Synthetic oligonucleotide
  Target: SCN10A; (-) strand; PAM type: YTN; PAM sequence: TTT
ataatttactcaaccaatct

SEQ ID NO: 44866 - DNA, 20 bp, Artificial Sequence
  Description of Artificial Sequence: Synthetic oligonucleotide
  Target: SCN10A; (-) strand; PAM type: YTN; PAM sequence: CTT
tataatttactcaaccaatc

SEQ ID NO: 44867 - DNA, 20 bp, Artificial Sequence
  Description of Artificial Sequence: Synthetic oligonucleotide
  Target: SCN10A; (-) strand; PAM type: YTN; PAM sequence: TTC
ctttataatttactcaacca

SEQ ID NO: 44868 - DNA, 20 bp, Artificial Sequence
  Description of Artificial Sequence: Synthetic oligonucleotide
  Target: SCN10A; (-) strand; PAM type: YTN; PAM sequence: CTA
taacatattcctttataatt

SEQ ID NO: 44869 - DNA, 20 bp, Artificial Sequence
  Description of Artificial Sequence: Synthetic oligonucleotide
  Target: SCN10A; (-) strand; PAM type: YTN; PAM sequence: TTA
atggctataacatattcctt

SEQ ID NO: 44870 - DNA, 20 bp, Artificial Sequence
  Description of Artificial Sequence: Synthetic oligonucleotide
  Target: SCN10A; (-) strand; PAM type: YTN; PAM sequence: TTT
aatggctataacatattcct

SEQ ID NO: 44871 - DNA, 20 bp, Artificial Sequence
  Description of Artificial Sequence: Synthetic oligonucleotide
  Target: SCN10A; (-) strand; PAM type: YTN; PAM sequence: CTC
atttaatggctataacatat

SEQ ID NO: 44872 - DNA, 20 bp, Artificial Sequence
  Description of Artificial Sequence: Synthetic oligonucleotide
  Target: SCN10A; (-) strand; PAM type: YTN; PAM sequence: TTA
tctcatttaatggctataac

SEQ ID NO: 44873 - DNA, 20 bp, Artificial Sequence
  Description of Artificial Sequence: Synthetic oligonucleotide
  Target: SCN10A; (-) strand; PAM type: YTN; PAM sequence: CTC
atattatctcatttaatggc

SEQ ID NO: 44874 - DNA, 20 bp, Artificial Sequence
  Description of Artificial Sequence: Synthetic oligonucleotide
  Target: SCN10A; (-) strand; PAM type: YTN; PAM sequence: CTC
agtaaatagtctcatattat

SEQ ID NO: 44875 - DNA, 20 bp, Artificial Sequence
  Description of Artificial Sequence: Synthetic oligonucleotide
  Target: SCN10A; (-) strand; PAM type: YTN; PAM sequence: TTC
tcagtaaatagtctcatatt

SEQ ID NO: 44876 - DNA, 20 bp, Artificial Sequence
  Description of Artificial Sequence: Synthetic oligonucleotide
  Target: SCN10A; (-) strand; PAM type: YTN; PAM sequence: TTT
ctcagtaaatagtctcatat

SEQ ID NO: 44877 - DNA, 20 bp, Artificial Sequence
  Description of Artificial Sequence: Synthetic oligonucleotide
  Target: SCN10A; (-) strand; PAM type: YTN; PAM sequence: TTT
tctcagtaaatagtctcata

SEQ ID NO: 44878 - DNA, 20 bp, Artificial Sequence
  Description of Artificial Sequence: Synthetic oligonucleotide
  Target: SCN10A; (-) strand; PAM type: YTN; PAM sequence: TTT
ttctcagtaaatagtctcat

SEQ ID NO: 44879 - DNA, 20 bp, Artificial Sequence
  Description of Artificial Sequence: Synthetic oligonucleotide
  Target: SCN10A; (-) strand; PAM type: YTN; PAM sequence: CTC
agtacatttttctcagtaaa

SEQ ID NO: 44880 - DNA, 20 bp, Artificial Sequence
  Description of Artificial Sequence: Synthetic oligonucleotide
  Target: SCN10A; (-) strand; PAM type: YTN; PAM sequence: CTA
taacctcagtacatttttct

SEQ ID NO: 44881 - DNA, 20 bp, Artificial Sequence
  Description of Artificial Sequence: Synthetic oligonucleotide
  Target: SCN10A; (-) strand; PAM type: YTN; PAM sequence: TTC
tataacctcagtacattttt

SEQ ID NO: 44882 - DNA, 20 bp, Artificial Sequence
  Description of Artificial Sequence: Synthetic oligonucleotide
  Target: SCN10A; (-) strand; PAM type: YTN; PAM sequence: TTA
tgcattctataacctcagta

SEQ ID NO: 44883 - DNA, 20 bp, Artificial Sequence
  Description of Artificial Sequence: Synthetic oligonucleotide
  Target: SCN10A; (-) strand; PAM type: YTN; PAM sequence: TTT
atgcattctataacctcagt

SEQ ID NO: 44884 - DNA, 20 bp, Artificial Sequence
  Description of Artificial Sequence: Synthetic oligonucleotide
  Target: SCN10A; (-) strand; PAM type: YTN; PAM sequence: TTA
caaaaataaaaccacattta

SEQ ID NO: 44885 - DNA, 20 bp, Artificial Sequence
  Description of Artificial Sequence: Synthetic oligonucleotide
  Target: SCN10A; (-) strand; PAM type: YTN; PAM sequence: TTA
tgcataaaatatacacatat

SEQ ID NO: 44886 - DNA, 20 bp, Artificial Sequence
  Description of Artificial Sequence: Synthetic oligonucleotide
  Target: SCN10A; (-) strand; PAM type: YTN; PAM sequence: CTT
atgcataaaatatacacata

SEQ ID NO: 44887 - DNA, 20 bp, Artificial Sequence
  Description of Artificial Sequence: Synthetic oligonucleotide
  Target: SCN10A; (-) strand; PAM type: YTN; PAM sequence: TTG
cttatgcataaaatatacac

SEQ ID NO: 44888 - DNA, 20 bp, Artificial Sequence
  Description of Artificial Sequence: Synthetic oligonucleotide
  Target: SCN10A; (-) strand; PAM type: YTN; PAM sequence: CTT
gcttatgcataaaatataca

SEQ ID NO: 44889 - DNA, 20 bp, Artificial Sequence
  Description of Artificial Sequence: Synthetic oligonucleotide
  Target: SCN10A; (-) strand; PAM type: YTN; PAM sequence: CTC
atcttgcttatgcataaaat

SEQ ID NO: 44890 - DNA, 20 bp, Artificial Sequence
  Description of Artificial Sequence: Synthetic oligonucleotide
  Target: SCN10A; (-) strand; PAM type: YTN; PAM sequence: TTC
tcatcttgcttatgcataaa

SEQ ID NO: 44891 - DNA, 20 bp, Artificial Sequence
  Description of Artificial Sequence: Synthetic oligonucleotide
  Target: SCN10A; (-) strand; PAM type: YTN; PAM sequence: TTT
ctcatcttgcttatgcataa

SEQ ID NO: 44892 - DNA, 20 bp, Artificial Sequence
  Description of Artificial Sequence: Synthetic oligonucleotide
  Target: SCN10A; (-) strand; PAM type: YTN; PAM sequence: CTT
tctcatcttgcttatgcata

SEQ ID NO: 44893 - DNA, 20 bp, Artificial Sequence
  Description of Artificial Sequence: Synthetic oligonucleotide
  Target: SCN10A; (-) strand; PAM type: YTN; PAM sequence: CTC
tttctcatcttgcttatgca

SEQ ID NO: 44894 - DNA, 20 bp, Artificial Sequence
  Description of Artificial Sequence: Synthetic oligonucleotide
  Target: SCN10A; (-) strand; PAM type: YTN; PAM sequence: CTG
gtatacctctttctcatctt

SEQ ID NO: 44895 - DNA, 20 bp, Artificial Sequence
  Description of Artificial Sequence: Synthetic oligonucleotide
  Target: SCN10A; (-) strand; PAM type: YTN; PAM sequence: TTG
aaaacatgctggtatacctc

SEQ ID NO: 44896 - DNA, 20 bp, Artificial Sequence
  Description of Artificial Sequence: Synthetic oligonucleotide
  Target: SCN10A; (-) strand; PAM type: YTN; PAM sequence: CTT
gaaaacatgctggtatacct

SEQ ID NO: 44897 - DNA, 20 bp, Artificial Sequence
  Description of Artificial Sequence: Synthetic oligonucleotide
  Target: SCN10A; (-) strand; PAM type: YTN; PAM sequence: CTC
acttgaaaacatgctggtat

SEQ ID NO: 44898 - DNA, 20 bp, Artificial Sequence
  Description of Artificial Sequence: Synthetic oligonucleotide
  Target: SCN10A; (-) strand; PAM type: YTN; PAM sequence: CTC
aaagagaaactcacttgaaa

SEQ ID NO: 44899 - DNA, 20 bp, Artificial Sequence
  Description of Artificial Sequence: Synthetic oligonucleotide
  Target: SCN10A; (-) strand; PAM type: YTN; PAM sequence: CTA
tcactcaaagagaaactcac

SEQ ID NO: 44900 - DNA, 20 bp, Artificial Sequence
  Description of Artificial Sequence: Synthetic oligonucleotide
  Target: SCN10A; (-) strand; PAM type: YTN; PAM sequence: TTC
cctatcactcaaagagaaac

SEQ ID NO: 44901 - DNA, 20 bp, Artificial Sequence
  Description of Artificial Sequence: Synthetic oligonucleotide
  Target: SCN10A; (-) strand; PAM type: YTN; PAM sequence: TTT
ccctatcactcaaagagaaa

SEQ ID NO: 44902 - DNA, 20 bp, Artificial Sequence
  Description of Artificial Sequence: Synthetic oligonucleotide
  Target: SCN10A; (-) strand; PAM type: YTN; PAM sequence: TTA
tagaaaaaggtaaagaaaaa

SEQ ID NO: 44903 - DNA, 20 bp, Artificial Sequence
  Description of Artificial Sequence: Synthetic oligonucleotide
  Target: SCN10A; (-) strand; PAM type: YTN; PAM sequence: TTG
gaaattatagaaaaaggtaa

SEQ ID NO: 44904 - DNA, 20 bp, Artificial Sequence
  Description of Artificial Sequence: Synthetic oligonucleotide
  Target: SCN10A; (-) strand; PAM type: YTN; PAM sequence: CTT
ggaaattatagaaaaaggta

SEQ ID NO: 44905 - DNA, 20 bp, Artificial Sequence
  Description of Artificial Sequence: Synthetic oligonucleotide
  Target: SCN10A; (-) strand; PAM type: YTN; PAM sequence: CTG
acaaagtaaagtaccaaaaa

SEQ ID NO: 44906 - DNA, 20 bp, Artificial Sequence
  Description of Artificial Sequence: Synthetic oligonucleotide
  Target: SCN10A; (-) strand; PAM type: YTN; PAM sequence: TTC
atctgacaaagtaaagtacc

SEQ ID NO: 44907 - DNA, 20 bp, Artificial Sequence
  Description of Artificial Sequence: Synthetic oligonucleotide
  Target: SCN10A; (-) strand; PAM type: YTN; PAM sequence: TTT
catctgacaaagtaaagtac

SEQ ID NO: 44908 - DNA, 20 bp, Artificial Sequence
  Description of Artificial Sequence: Synthetic oligonucleotide
  Target: SCN10A; (-) strand; PAM type: YTN; PAM sequence: TTT
tcatctgacaaagtaaagta

SEQ ID NO: 44909 - DNA, 20 bp, Artificial Sequence
  Description of Artificial Sequence: Synthetic oligonucleotide
  Target: SCN10A; (-) strand; PAM type: YTN; PAM sequence: TTA
aaaataacatgcattttcat

SEQ ID NO: 44910 - DNA, 20 bp, Artificial Sequence
  Description of Artificial Sequence: Synthetic oligonucleotide
  Target: SCN10A; (-) strand; PAM type: YTN; PAM sequence: TTT
aaaaataacatgcattttca

SEQ ID NO: 44911 - DNA, 20 bp, Artificial Sequence
  Description of Artificial Sequence: Synthetic oligonucleotide
  Target: SCN10A; (-) strand; PAM type: YTN; PAM sequence: TTT
taaaaataacatgcattttc

SEQ ID NO: 44912 - DNA, 20 bp, Artificial Sequence
  Description of Artificial Sequence: Synthetic oligonucleotide
  Target: SCN10A; (-) strand; PAM type: YTN; PAM sequence: CTT
ttaaaaataacatgcatttt

SEQ ID NO: 44913 - DNA, 20 bp, Artificial Sequence
  Description of Artificial Sequence: Synthetic oligonucleotide
  Target: SCN10A; (-) strand; PAM type: YTN; PAM sequence: TTG
agtaccttttaaaaataaca

SEQ ID NO: 44914 - DNA, 20 bp, Artificial Sequence
  Description of Artificial Sequence: Synthetic oligonucleotide
  Target: SCN10A; (-) strand; PAM type: YTN; PAM sequence: TTT
gagtaccttttaaaaataac

SEQ ID NO: 44915 - DNA, 20 bp, Artificial Sequence
  Description of Artificial Sequence: Synthetic oligonucleotide
  Target: SCN10A; (-) strand; PAM type: YTN; PAM sequence: CTT
tgagtaccttttaaaaataa

SEQ ID NO: 44916 - DNA, 20 bp, Artificial Sequence
  Description of Artificial Sequence: Synthetic oligonucleotide
  Target: SCN10A; (-) strand; PAM type: YTN; PAM sequence: TTC
actttgagtaccttttaaaa

SEQ ID NO: 44917 - DNA, 20 bp, Artificial Sequence
  Description of Artificial Sequence: Synthetic oligonucleotide
  Target: SCN10A; (-) strand; PAM type: YTN; PAM sequence: TTT
cactttgagtaccttttaaa

SEQ ID NO: 44918 - DNA, 20 bp, Artificial Sequence
  Description of Artificial Sequence: Synthetic oligonucleotide
  Target: SCN10A; (-) strand; PAM type: YTN; PAM sequence: CTT
tcactttgagtaccttttaa

SEQ ID NO: 44919 - DNA, 20 bp, Artificial Sequence
  Description of Artificial Sequence: Synthetic oligonucleotide
  Target: SCN10A; (-) strand; PAM type: YTN; PAM sequence: TTA
ggctttcactttgagtacct

SEQ ID NO: 44920 - DNA, 20 bp, Artificial Sequence
  Description of Artificial Sequence: Synthetic oligonucleotide
  Target: SCN10A; (-) strand; PAM type: YTN; PAM sequence: TTT
aggctttcactttgagtacc

SEQ ID NO: 44921 - DNA, 20 bp, Artificial Sequence
  Description of Artificial Sequence: Synthetic oligonucleotide
  Target: SCN10A; (-) strand; PAM type: YTN; PAM sequence: CTT
taggctttcactttgagtac

SEQ ID NO: 44922 - DNA, 20 bp, Artificial Sequence
  Description of Artificial Sequence: Synthetic oligonucleotide
  Target: SCN10A; (-) strand; PAM type: YTN; PAM sequence: TTC
tttaggctttcactttgagt

SEQ ID NO: 44923 - DNA, 20 bp, Artificial Sequence
  Description of Artificial Sequence: Synthetic oligonucleotide
  Target: SCN10A; (-) strand; PAM type: YTN; PAM sequence: CTT
ctttaggctttcactttgag

SEQ ID NO: 44924 - DNA, 20 bp, Artificial Sequence
  Description of Artificial Sequence: Synthetic oligonucleotide
  Target: SCN10A; (-) strand; PAM type: YTN; PAM sequence: TTA
gccttctttaggctttcact

SEQ ID NO: 44925 - DNA, 20 bp, Artificial Sequence
  Description of Artificial Sequence: Synthetic oligonucleotide
  Target: SCN10A; (-) strand; PAM type: YTN; PAM sequence: TTT
agccttctttaggctttcac

SEQ ID NO: 44926 - DNA, 20 bp, Artificial Sequence
  Description of Artificial Sequence: Synthetic oligonucleotide
  Target: SCN10A; (-) strand; PAM type: YTN; PAM sequence: CTG
gcaccaaatttagccttctt

SEQ ID NO: 44927 - DNA, 20 bp, Artificial Sequence
  Description of Artificial Sequence: Synthetic oligonucleotide
  Target: SCN10A; (-) strand; PAM type: YTN; PAM sequence: CTG
aacaggctggcaccaaattt

SEQ ID NO: 44928 - DNA, 20 bp, Artificial Sequence
  Description of Artificial Sequence: Synthetic oligonucleotide
  Target: SCN10A; (-) strand; PAM type: YTN; PAM sequence: CTG
ggactgaacaggctggcacc

SEQ ID NO: 44929 - DNA, 20 bp, Artificial Sequence
  Description of Artificial Sequence: Synthetic oligonucleotide
  Target: SCN10A; (-) strand; PAM type: YTN; PAM sequence: TTC
ccctgggactgaacaggctg

SEQ ID NO: 44930 - DNA, 20 bp, Artificial Sequence
  Description of Artificial Sequence: Synthetic oligonucleotide
  Target: SCN10A; (-) strand; PAM type: YTN; PAM sequence: CTT
cccctgggactgaacaggct

SEQ ID NO: 44931 - DNA, 20 bp, Artificial Sequence
  Description of Artificial Sequence: Synthetic oligonucleotide
  Target: SCN10A; (-) strand; PAM type: YTN; PAM sequence: CTC
cttcccctgggactgaacag

SEQ ID NO: 44932 - DNA, 20 bp, Artificial Sequence
  Description of Artificial Sequence: Synthetic oligonucleotide
  Target: SCN10A; (-) strand; PAM type: YTN; PAM sequence: CTC
ccatctccttcccctgggac

SEQ ID NO: 44933 - DNA, 20 bp, Artificial Sequence
  Description of Artificial Sequence: Synthetic oligonucleotide
  Target: SCN10A; (-) strand; PAM type: YTN; PAM sequence: TTC
cctcccatctccttcccctg

SEQ ID NO: 44934 - DNA, 20 bp, Artificial Sequence
  Description of Artificial Sequence: Synthetic oligonucleotide
  Target: SCN10A; (-) strand; PAM type: YTN; PAM sequence: CTT
ccctcccatctccttcccct

SEQ ID NO: 44935 - DNA, 20 bp, Artificial Sequence
  Description of Artificial Sequence: Synthetic oligonucleotide
  Target: SCN10A; (-) strand; PAM type: YTN; PAM sequence: CTC
ccttccctcccatctccttc

SEQ ID NO: 44936 - DNA, 20 bp, Artificial Sequence
  Description of Artificial Sequence: Synthetic oligonucleotide
  Target: SCN10A; (-) strand; PAM type: YTN; PAM sequence: CTC
tcccttccctcccatctcct

SEQ ID NO: 44937 - DNA, 20 bp, Artificial Sequence
  Description of Artificial Sequence: Synthetic oligonucleotide
  Target: SCN10A; (-) strand; PAM type: YTN; PAM sequence: CTG
cagctctcccttccctccca

SEQ ID NO: 44938 - DNA, 20 bp, Artificial Sequence
  Description of Artificial Sequence: Synthetic oligonucleotide
  Target: SCN10A; (-) strand; PAM type: YTN; PAM sequence: CTG
cgccagcccagcccgccccc

SEQ ID NO: 44939 - DNA, 20 bp, Artificial Sequence
  Description of Artificial Sequence: Synthetic oligonucleotide
  Target: SCN10A; (-) strand; PAM type: YTN; PAM sequence: CTG
cagcactgcgccagcccagc

SEQ ID NO: 44940 - DNA, 20 bp, Artificial Sequence
  Description of Artificial Sequence: Synthetic oligonucleotide
  Target: SCN10A; (-) strand; PAM type: YTN; PAM sequence: CTC
agacctgcagcactgcgcca

SEQ ID NO: 44941 - DNA, 20 bp, Artificial Sequence
  Description of Artificial Sequence: Synthetic oligonucleotide
  Target: SCN10A; (-) strand; PAM type: YTN; PAM sequence: TTC
ccaggaggaagctcagacct

SEQ ID NO: 44942 - DNA, 20 bp, Artificial Sequence
  Description of Artificial Sequence: Synthetic oligonucleotide
  Target: SCN10A; (-) strand; PAM type: YTN; PAM sequence: TTC
acaccccggtccacccccca

SEQ ID NO: 44943 - DNA, 20 bp, Artificial Sequence
  Description of Artificial Sequence: Synthetic oligonucleotide
  Target: SCN10A; (-) strand; PAM type: YTN; PAM sequence: CTT
cacaccccggtccacccccc

SEQ ID NO: 44944 - DNA, 20 bp, Artificial Sequence
  Description of Artificial Sequence: Synthetic oligonucleotide
  Target: SCN10A; (-) strand; PAM type: YTN; PAM sequence: CTC
ttcacaccccggtccacccc

SEQ ID NO: 44945 - DNA, 20 bp, Artificial Sequence
  Description of Artificial Sequence: Synthetic oligonucleotide
  Target: SCN10A; (-) strand; PAM type: YTN; PAM sequence: TTC
tcttcacaccccggtccacc

SEQ ID NO: 44946 - DNA, 20 bp, Artificial Sequence
  Description of Artificial Sequence: Synthetic oligonucleotide
  Target: SCN10A; (-) strand; PAM type: YTN; PAM sequence: CTT
ctcttcacaccccggtccac

SEQ ID NO: 44947 - DNA, 20 bp, Artificial Sequence
  Description of Artificial Sequence: Synthetic oligonucleotide
  Target: SCN10A; (-) strand; PAM type: YTN; PAM sequence: CTA
gcccccttctcttcacaccc

SEQ ID NO: 44948 - DNA, 20 bp, Artificial Sequence
  Description of Artificial Sequence: Synthetic oligonucleotide
  Target: SCN10A; (-) strand; PAM type: YTN; PAM sequence: CTC
tagcccccttctcttcacac

SEQ ID NO: 44949 - DNA, 20 bp, Artificial Sequence
  Description of Artificial Sequence: Synthetic oligonucleotide
  Target: SCN10A; (-) strand; PAM type: YTN; PAM sequence: CTC
tctagcccccttctcttcac

SEQ ID NO: 44950 - DNA, 20 bp, Artificial Sequence
  Description of Artificial Sequence: Synthetic oligonucleotide
  Target: SCN10A; (-) strand; PAM type: YTN; PAM sequence: CTC
tctctagcccccttctcttc

SEQ ID NO: 44951 - DNA, 20 bp, Artificial Sequence
  Description of Artificial Sequence: Synthetic oligonucleotide
  Target: SCN10A; (-) strand; PAM type: YTN; PAM sequence: TTC
tctctctagcccccttctct

SEQ ID NO: 44952 - DNA, 20 bp, Artificial Sequence
  Description of Artificial Sequence: Synthetic oligonucleotide
  Target: SCN10A; (-) strand; PAM type: YTN; PAM sequence: CTT
ctctctctagcccccttctc

SEQ ID NO: 44953 - DNA, 20 bp, Artificial Sequence
  Description of Artificial Sequence: Synthetic oligonucleotide
  Target: SCN10A; (-) strand; PAM type: YTN; PAM sequence: CTC
ccttctctctctagccccct

SEQ ID NO: 44954 - DNA, 20 bp, Artificial Sequence
  Description of Artificial Sequence: Synthetic oligonucleotide
  Target: SCN10A; (-) strand; PAM type: YTN; PAM sequence: CTC
cctcccttctctctctagcc

SEQ ID NO: 44955 - DNA, 20 bp, Artificial Sequence
  Description of Artificial Sequence: Synthetic oligonucleotide
  Target: SCN10A; (-) strand; PAM type: YTN; PAM sequence: TTG
ctccctcccttctctctcta

SEQ ID NO: 44956 - DNA, 20 bp, Artificial Sequence
  Description of Artificial Sequence: Synthetic oligonucleotide
  Target: SCN10A; (-) strand; PAM type: YTN; PAM sequence: CTT
gctccctcccttctctctct

SEQ ID NO: 44957 - DNA, 20 bp, Artificial Sequence
  Description of Artificial Sequence: Synthetic oligonucleotide
  Target: SCN10A; (-) strand; PAM type: YTN; PAM sequence: CTC
ccttgctccctcccttctct

SEQ ID NO: 44958 - DNA, 20 bp, Artificial Sequence
  Description of Artificial Sequence: Synthetic oligonucleotide
  Target: SCN10A; (-) strand; PAM type: YTN; PAM sequence: CTC
tcccttgctccctcccttct

SEQ ID NO: 44959 - DNA, 20 bp, Artificial Sequence
  Description of Artificial Sequence: Synthetic oligonucleotide
  Target: SCN10A; (-) strand; PAM type: YTN; PAM sequence: CTG
ctctcccttgctccctccct

SEQ ID NO: 44960 - DNA, 20 bp, Artificial Sequence
  Description of Artificial Sequence: Synthetic oligonucleotide
  Target: SCN10A; (-) strand; PAM type: YTN; PAM sequence: CTC
tgctctcccttgctccctcc

SEQ ID NO: 44961 - DNA, 20 bp, Artificial Sequence
  Description of Artificial Sequence: Synthetic oligonucleotide
  Target: SCN10A; (-) strand; PAM type: YTN; PAM sequence: TTC
tctgctctcccttgctccct

SEQ ID NO: 44962 - DNA, 20 bp, Artificial Sequence
  Description of Artificial Sequence: Synthetic oligonucleotide
  Target: SCN10A; (-) strand; PAM type: YTN; PAM sequence: CTT
ctctgctctcccttgctccc

SEQ ID NO: 44963 - DNA, 20 bp, Artificial Sequence
  Description of Artificial Sequence: Synthetic oligonucleotide
  Target: SCN10A; (-) strand; PAM type: YTN; PAM sequence: TTG
cttctctgctctcccttgct

SEQ ID NO: 44964 - DNA, 20 bp, Artificial Sequence
  Description of Artificial Sequence: Synthetic oligonucleotide
  Target: SCN10A; (-) strand; PAM type: YTN; PAM sequence: TTT
gcttctctgctctcccttgc

SEQ ID NO: 44965 - DNA, 20 bp, Artificial Sequence
  Description of Artificial Sequence: Synthetic oligonucleotide
  Target: SCN10A; (-) strand; PAM type: YTN; PAM sequence: TTT
tgcttctctgctctcccttg

SEQ ID NO: 44966 - DNA, 20 bp, Artificial Sequence
  Description of Artificial Sequence: Synthetic oligonucleotide
  Target: SCN10A; (-) strand; PAM type: YTN; PAM sequence: CTC
attttgcttctctgctctcc

SEQ ID NO: 44967 - DNA, 20 bp, Artificial Sequence
  Description of Artificial Sequence: Synthetic oligonucleotide
  Target: SCN10A; (-) strand; PAM type: YTN; PAM sequence: CTC
ctcattttgcttctctgctc

SEQ ID NO: 44968 - DNA, 20 bp, Artificial Sequence
  Description of Artificial Sequence: Synthetic oligonucleotide
  Target: SCN10A; (-) strand; PAM type: YTN; PAM sequence: CTC
tcctcattttgcttctctgc

SEQ ID NO: 44969 - DNA, 20 bp, Artificial Sequence
  Description of Artificial Sequence: Synthetic oligonucleotide
  Target: SCN10A; (-) strand; PAM type: YTN; PAM sequence: TTC
tctcctcattttgcttctct

SEQ ID NO: 44970 - DNA, 20 bp, Artificial Sequence
  Description of Artificial Sequence: Synthetic oligonucleotide
  Target: SCN10A; (-) strand; PAM type: YTN; PAM sequence: CTT
ctctcctcattttgcttctc

SEQ ID NO: 44971 - DNA, 20 bp, Artificial Sequence
  Description of Artificial Sequence: Synthetic oligonucleotide
  Target: SCN10A; (-) strand; PAM type: YTN; PAM sequence: TTG
tgggccttctctcctcattt

SEQ ID NO: 44972 - DNA, 20 bp, Artificial Sequence
  Description of Artificial Sequence: Synthetic oligonucleotide
  Target: SCN10A; (-) strand; PAM type: YTN; PAM sequence: CTT
gtgggccttctctcctcatt

SEQ ID NO: 44973 - DNA, 20 bp, Artificial Sequence
  Description of Artificial Sequence: Synthetic oligonucleotide
  Target: SCN10A; (-) strand; PAM type: YTN; PAM sequence: TTG
gcttgtgggccttctctcct

SEQ ID NO: 44974 - DNA, 20 bp, Artificial Sequence
  Description of Artificial Sequence: Synthetic oligonucleotide
  Target: SCN10A; (-) strand; PAM type: YTN; PAM sequence: CTA
cgtcattggcttgtgggcct

SEQ ID NO: 44975 - DNA, 20 bp, Artificial Sequence
  Description of Artificial Sequence: Synthetic oligonucleotide
  Target: SCN10A; (-) strand; PAM type: YTN; PAM sequence: CTC
actacgtcattggcttgtgg

SEQ ID NO: 44976 - DNA, 20 bp, Artificial Sequence
  Description of Artificial Sequence: Synthetic oligonucleotide
  Target: SCN10A; (-) strand; PAM type: YTN; PAM sequence: CTC
ctcactacgtcattggcttg

SEQ ID NO: 44977 - DNA, 20 bp, Artificial Sequence
  Description of Artificial Sequence: Synthetic oligonucleotide
  Target: SCN10A; (-) strand; PAM type: YTN; PAM sequence: CTC
tcctcactacgtcattggct

SEQ ID NO: 44978 - DNA, 20 bp, Artificial Sequence
  Description of Artificial Sequence: Synthetic oligonucleotide
  Target: SCN10A; (-) strand; PAM type: YTN; PAM sequence: TTG
gccaggtgctctcctcacta

SEQ ID NO: 44979 - DNA, 20 bp, Artificial Sequence
  Description of Artificial Sequence: Synthetic oligonucleotide
  Target: SCN10A; (-) strand; PAM type: YTN; PAM sequence: CTG
ttggccaggtgctctcctca

SEQ ID NO: 44980 - DNA, 20 bp, Artificial Sequence
  Description of Artificial Sequence: Synthetic oligonucleotide
  Target: SCN10A; (-) strand; PAM type: YTN; PAM sequence: TTA
aagtaataaccacatgtgct

SEQ ID NO: 44981 - DNA, 20 bp, Artificial Sequence
  Description of Artificial Sequence: Synthetic oligonucleotide
  Target: SCN10A; (-) strand; PAM type: YTN; PAM sequence: CTG
gattaaagtaataaccacat

SEQ ID NO: 44982 - DNA, 20 bp, Artificial Sequence
  Description of Artificial Sequence: Synthetic oligonucleotide
  Target: SCN10A; (-) strand; PAM type: YTN; PAM sequence: CTG
ctggattaaagtaataacca

SEQ ID NO: 44983 - DNA, 20 bp, Artificial Sequence
  Description of Artificial Sequence: Synthetic oligonucleotide
  Target: SCN10A; (-) strand; PAM type: YTN; PAM sequence: TTC
cagtcctgctggattaaagt

SEQ ID NO: 44984 - DNA, 20 bp, Artificial Sequence
  Description of Artificial Sequence: Synthetic oligonucleotide
  Target: SCN10A; (-) strand; PAM type: YTN; PAM sequence: CTT
ccagtcctgctggattaaag

SEQ ID NO: 44985 - DNA, 20 bp, Artificial Sequence
  Description of Artificial Sequence: Synthetic oligonucleotide
  Target: SCN10A; (-) strand; PAM type: YTN; PAM sequence: CTC
cttccagtcctgctggatta

SEQ ID NO: 44986 - DNA, 20 bp, Artificial Sequence
  Description of Artificial Sequence: Synthetic oligonucleotide
  Target: SCN10A; (-) strand; PAM type: YTN; PAM sequence: TTC
tccttccagtcctgctggat

SEQ ID NO: 44987 - DNA, 20 bp, Artificial Sequence
  Description of Artificial Sequence: Synthetic oligonucleotide
  Target: SCN10A; (-) strand; PAM type: YTN; PAM sequence: CTT
ctccttccagtcctgctgga

SEQ ID NO: 44988 - DNA, 20 bp, Artificial Sequence
  Description of Artificial Sequence: Synthetic oligonucleotide
  Target: SCN10A; (-) strand; PAM type: YTN; PAM sequence: CTC
ttctccttccagtcctgctg

SEQ ID NO: 44989 - DNA, 20 bp, Artificial Sequence
  Description of Artificial Sequence: Synthetic oligonucleotide
  Target: SCN10A; (-) strand; PAM type: YTN; PAM sequence: CTA
tgctcttctccttccagtcc

SEQ ID NO: 44990 - DNA, 20 bp, Artificial Sequence
  Description of Artificial Sequence: Synthetic oligonucleotide
  Target: SCN10A; (-) strand; PAM type: YTN; PAM sequence: CTC
cacacctatgctcttctcct

SEQ ID NO: 44991 - DNA, 20 bp, Artificial Sequence
  Description of Artificial Sequence: Synthetic oligonucleotide
  Target: SCN10A; (-) strand; PAM type: YTN; PAM sequence: TTC
tccacacctatgctcttctc

SEQ ID NO: 44992 - DNA, 20 bp, Artificial Sequence
  Description of Artificial Sequence: Synthetic oligonucleotide
  Target: SCN10A; (-) strand; PAM type: YTN; PAM sequence: TTT
ctccacacctatgctcttct

SEQ ID NO: 44993 - DNA, 20 bp, Artificial Sequence
  Description of Artificial Sequence: Synthetic oligonucleotide
  Target: SCN10A; (-) strand; PAM type: YTN; PAM sequence: CTT
tctccacacctatgctcttc

SEQ ID NO: 44994 - DNA, 20 bp, Artificial Sequence
  Description of Artificial Sequence: Synthetic oligonucleotide
  Target: SCN10A; (-) strand; PAM type: YTN; PAM sequence: CTG
ggcagtgctttctccacacc

SEQ ID NO: 44995 - DNA, 20 bp, Artificial Sequence
  Description of Artificial Sequence: Synthetic oligonucleotide
  Target: SCN10A; (-) strand; PAM type: YTN; PAM sequence: TTG
caggggcaagagagggctgg

SEQ ID NO: 44996 - DNA, 20 bp, Artificial Sequence
  Description of Artificial Sequence: Synthetic oligonucleotide
  Target: SCN10A; (-) strand; PAM type: YTN; PAM sequence: CTC
agcacagtgtagaggccaaa

SEQ ID NO: 44997 - DNA, 20 bp, Artificial Sequence
  Description of Artificial Sequence: Synthetic oligonucleotide
  Target: SCN10A; (-) strand; PAM type: YTN; PAM sequence: TTG
tccacacggacctcagcaca

SEQ ID NO: 44998 - DNA, 20 bp, Artificial Sequence
  Description of Artificial Sequence: Synthetic oligonucleotide
  Target: SCN10A; (-) strand; PAM type: YTN; PAM sequence: CTG
gcacagggcagtgattgtcc

SEQ ID NO: 44999 - DNA, 20 bp, Artificial Sequence
  Description of Artificial Sequence: Synthetic oligonucleotide
  Target: SCN10A; (-) strand; PAM type: YTN; PAM sequence: CTG
caggtgcccagtgccctggc

SEQ ID NO: 45000 - DNA, 20 bp, Artificial Sequence
  Description of Artificial Sequence: Synthetic oligonucleotide
  Target: SCN10A; (-) strand; PAM type: YTN; PAM sequence: CTG
tgtgacagcggctgcaggtg

SEQ ID NO: 45001 - DNA, 20 bp, Artificial Sequence
  Description of Artificial Sequence: Synthetic oligonucleotide
  Target: SCN10A; (-) strand; PAM type: YTN; PAM sequence: CTG
ggtggagggggaactgtgtg

SEQ ID NO: 45002 - DNA, 20 bp, Artificial Sequence
  Description of Artificial Sequence: Synthetic oligonucleotide
  Target: SCN10A; (-) strand; PAM type: YTN; PAM sequence: CTG
ccatcctgggtggaggggga

SEQ ID NO: 45003 - DNA, 20 bp, Artificial Sequence
  Description of Artificial Sequence: Synthetic oligonucleotide
  Target: SCN10A; (-) strand; PAM type: YTN; PAM sequence: CTG
gtctgccatcctgggtggag

SEQ ID NO: 45004 - DNA, 20 bp, Artificial Sequence
  Description of Artificial Sequence: Synthetic oligonucleotide
  Target: SCN10A; (-) strand; PAM type: YTN; PAM sequence: TTC
ggggcagggactggtctgcc

SEQ ID NO: 45005 - DNA, 20 bp, Artificial Sequence
  Description of Artificial Sequence: Synthetic oligonucleotide
  Target: SCN10A; (-) strand; PAM type: YTN; PAM sequence: TTT
cggggcagggactggtctgc

SEQ ID NO: 45006 - DNA, 20 bp, Artificial Sequence
  Description of Artificial Sequence: Synthetic oligonucleotide
  Target: SCN10A; (-) strand; PAM type: YTN; PAM sequence: CTA
gggtggcaatgacgcaaagc

SEQ ID NO: 45007 - DNA, 20 bp, Artificial Sequence
  Description of Artificial Sequence: Synthetic oligonucleotide
  Target: SCN10A; (-) strand; PAM type: YTN; PAM sequence: CTG
agaggtgggaggaaaactag

SEQ ID NO: 45008 - DNA, 20 bp, Artificial Sequence
  Description of Artificial Sequence: Synthetic oligonucleotide
  Target: SCN10A; (-) strand; PAM type: YTN; PAM sequence: TTA
gggaggagcacaggtgcggg

SEQ ID NO: 45009 - DNA, 20 bp, Artificial Sequence
  Description of Artificial Sequence: Synthetic oligonucleotide
  Target: SCN10A; (-) strand; PAM type: YTN; PAM sequence: TTT
agggaggagcacaggtgcgg

SEQ ID NO: 45010 - DNA, 20 bp, Artificial Sequence
  Description of Artificial Sequence: Synthetic oligonucleotide
  Target: SCN10A; (-) strand; PAM type: YTN; PAM sequence: CTT
tagggaggagcacaggtgcg

SEQ ID NO: 45011 - DNA, 20 bp, Artificial Sequence
  Description of Artificial Sequence: Synthetic oligonucleotide
  Target: SCN10A; (-) strand; PAM type: YTN; PAM sequence: CTC
agctttagggaggagcacag

SEQ ID NO: 45012 - DNA, 20 bp, Artificial Sequence
  Description of Artificial Sequence: Synthetic oligonucleotide
  Target: SCN10A; (-) strand; PAM type: YTN; PAM sequence: CTC
ggtgcatggcctcagcttta

SEQ ID NO: 45013 - DNA, 20 bp, Artificial Sequence
  Description of Artificial Sequence: Synthetic oligonucleotide
  Target: SCN10A; (-) strand; PAM type: YTN; PAM sequence: CTG
ctcggtgcatggcctcagct

SEQ ID NO: 45014 - DNA, 20 bp, Artificial Sequence
  Description of Artificial Sequence: Synthetic oligonucleotide
  Target: SCN10A; (-) strand; PAM type: YTN; PAM sequence: TTG
tccaggaagggtgacaaaac

SEQ ID NO: 45015 - DNA, 20 bp, Artificial Sequence
  Description of Artificial Sequence: Synthetic oligonucleotide
  Target: SCN10A; (-) strand; PAM type: YTN; PAM sequence: CTA
aatgccagattgtccaggaa

SEQ ID NO: 45016 - DNA, 20 bp, Artificial Sequence
  Description of Artificial Sequence: Synthetic oligonucleotide
  Target: SCN10A; (-) strand; PAM type: YTN; PAM sequence: CTC
catctaaatgccagattgtc

SEQ ID NO: 45017 - DNA, 20 bp, Artificial Sequence
  Description of Artificial Sequence: Synthetic oligonucleotide
  Target: SCN10A; (-) strand; PAM type: YTN; PAM sequence: CTA
ggcctccatctaaatgccag

SEQ ID NO: 45018 - DNA, 20 bp, Artificial Sequence
  Description of Artificial Sequence: Synthetic oligonucleotide
  Target: SCN10A; (-) strand; PAM type: YTN; PAM sequence: CTA
aatatctaggcctccatcta

SEQ ID NO: 45019 - DNA, 20 bp, Artificial Sequence
  Description of Artificial Sequence: Synthetic oligonucleotide
  Target: SCN10A; (-) strand; PAM type: YTN; PAM sequence: CTA
ctaaatatctaggcctccat

SEQ ID NO: 45020 - DNA, 20 bp, Artificial Sequence
  Description of Artificial Sequence: Synthetic oligonucleotide
  Target: SCN10A; (-) strand; PAM type: YTN; PAM sequence: CTA
aaaacaacctactaaatatc

SEQ ID NO: 45021 - DNA, 20 bp, Artificial Sequence
  Description of Artificial Sequence: Synthetic oligonucleotide
  Target: SCN10A; (-) strand; PAM type: YTN; PAM sequence: CTC
taaaaacaacctactaaata

SEQ ID NO: 45022 - DNA, 20 bp, Artificial Sequence
  Description of Artificial Sequence: Synthetic oligonucleotide
  Target: SCN10A; (-) strand; PAM type: YTN; PAM sequence: CTC
tctaaaaacaacctactaaa

SEQ ID NO: 45023 - DNA, 20 bp, Artificial Sequence
  Description of Artificial Sequence: Synthetic oligonucleotide
  Target: SCN10A; (-) strand; PAM type: YTN; PAM sequence: TTA
ctctctaaaaacaacctact

SEQ ID NO: 45024 - DNA, 20 bp, Artificial Sequence
  Description of Artificial Sequence: Synthetic oligonucleotide
  Target: SCN10A; (-) strand; PAM type: YTN; PAM sequence: TTT
actctctaaaaacaacctac

SEQ ID NO: 45025 - DNA, 20 bp, Artificial Sequence
  Description of Artificial Sequence: Synthetic oligonucleotide
  Target: SCN10A; (-) strand; PAM type: YTN; PAM sequence: CTC
atgtgtcatttactctctaa

SEQ ID NO: 45026 - DNA, 20 bp, Artificial Sequence
  Description of Artificial Sequence: Synthetic oligonucleotide
  Target: SCN10A; (-) strand; PAM type: YTN; PAM sequence: TTG
cgcctcatgtgtcatttact

SEQ ID NO: 45027 - DNA, 20 bp, Artificial Sequence
  Description of Artificial Sequence: Synthetic oligonucleotide
  Target: SCN10A; (-) strand; PAM type: YTN; PAM sequence: CTT
gcgcctcatgtgtcatttac

SEQ ID NO: 45028 - DNA, 20 bp, Artificial Sequence
  Description of Artificial Sequence: Synthetic oligonucleotide
  Target: SCN10A; (-) strand; PAM type: YTN; PAM sequence: CTC
atcttgcgcctcatgtgtca

SEQ ID NO: 45029 - DNA, 20 bp, Artificial Sequence
  Description of Artificial Sequence: Synthetic oligonucleotide
  Target: SCN10A; (-) strand; PAM type: YTN; PAM sequence: TTC
actcatcttgcgcctcatgt

SEQ ID NO: 45030 - DNA, 20 bp, Artificial Sequence
  Description of Artificial Sequence: Synthetic oligonucleotide
  Target: SCN10A; (-) strand; PAM type: YTN; PAM sequence: TTT
cactcatcttgcgcctcatg

SEQ ID NO: 45031 - DNA, 20 bp, Artificial Sequence
  Description of Artificial Sequence: Synthetic oligonucleotide
  Target: SCN10A; (-) strand; PAM type: YTN; PAM sequence: TTT
tcactcatcttgcgcctcat

SEQ ID NO: 45032 - DNA, 20 bp, Artificial Sequence
  Description of Artificial Sequence: Synthetic oligonucleotide
  Target: SCN10A; (-) strand; PAM type: YTN; PAM sequence: CTG
cagtgttttcactcatcttg

SEQ ID NO: 45033 - DNA, 20 bp, Artificial Sequence
  Description of Artificial Sequence: Synthetic oligonucleotide
  Target: SCN10A; (-) strand; PAM type: YTN; PAM sequence: TTC
acggctgcagtgttttcact

SEQ ID NO: 45034 - DNA, 20 bp, Artificial Sequence
  Description of Artificial Sequence: Synthetic oligonucleotide
  Target: SCN10A; (-) strand; PAM type: YTN; PAM sequence: TTC
cgattcacggctgcagtgtt

SEQ ID NO: 45035 - DNA, 20 bp, Artificial Sequence
  Description of Artificial Sequence: Synthetic oligonucleotide
  Target: SCN10A; (-) strand; PAM type: YTN; PAM sequence: CTT
ccgattcacggctgcagtgt

SEQ ID NO: 45036 - DNA, 20 bp, Artificial Sequence
  Description of Artificial Sequence: Synthetic oligonucleotide
  Target: SCN10A; (-) strand; PAM type: YTN; PAM sequence: CTC
ttccgattcacggctgcagt

SEQ ID NO: 45037 - DNA, 20 bp, Artificial Sequence
  Description of Artificial Sequence: Synthetic oligonucleotide
  Target: SCN10A; (-) strand; PAM type: YTN; PAM sequence: CTA
cagtcccgctcttccgattc

SEQ ID NO: 45038 - DNA, 20 bp, Artificial Sequence
  Description of Artificial Sequence: Synthetic oligonucleotide
  Target: SCN10A; (-) strand; PAM type: YTN; PAM sequence: CTA
ggactacagtcccgctcttc

SEQ ID NO: 45039 - DNA, 20 bp, Artificial Sequence
  Description of Artificial Sequence: Synthetic oligonucleotide
  Target: SCN10A; (-) strand; PAM type: YTN; PAM sequence: TTG
aagggctaggactacagtcc

SEQ ID NO: 45040 - DNA, 20 bp, Artificial Sequence
  Description of Artificial Sequence: Synthetic oligonucleotide
  Target: SCN10A; (-) strand; PAM type: YTN; PAM sequence: TTA
gttgaagggctaggactaca

SEQ ID NO: 45041 - DNA, 20 bp, Artificial Sequence
  Description of Artificial Sequence: Synthetic oligonucleotide
  Target: SCN10A; (-) strand; PAM type: YTN; PAM sequence: CTA
attagttgaagggctaggac

SEQ ID NO: 45042 - DNA, 20 bp, Artificial Sequence
  Description of Artificial Sequence: Synthetic oligonucleotide
  Target: SCN10A; (-) strand; PAM type: YTN; PAM sequence: TTC
agggtggcagctaattagtt

SEQ ID NO: 45043 - DNA, 20 bp, Artificial Sequence
  Description of Artificial Sequence: Synthetic oligonucleotide
  Target: SCN10A; (-) strand; PAM type: YTN; PAM sequence: CTG
ggaatagagagttcagggtg

SEQ ID NO: 45044 - DNA, 20 bp, Artificial Sequence
  Description of Artificial Sequence: Synthetic oligonucleotide
  Target: SCN10A; (-) strand; PAM type: YTN; PAM sequence: TTG
aagggctgggaatagagagt

SEQ ID NO: 45045 - DNA, 20 bp, Artificial Sequence
  Description of Artificial Sequence: Synthetic oligonucleotide
  Target: SCN10A; (-) strand; PAM type: YTN; PAM sequence: TTA
gttgaagggctgggaataga

SEQ ID NO: 45046 - DNA, 20 bp, Artificial Sequence
  Description of Artificial Sequence: Synthetic oligonucleotide
  Target: SCN10A; (-) strand; PAM type: YTN; PAM sequence: TTC
aggtaattagttgaagggct

SEQ ID NO: 45047 - DNA, 20 bp, Artificial Sequence
  Description of Artificial Sequence: Synthetic oligonucleotide
  Target: SCN10A; (-) strand; PAM type: YTN; PAM sequence: CTT
caggtaattagttgaagggc

SEQ ID NO: 45048 - DNA, 20 bp, Artificial Sequence
  Description of Artificial Sequence: Synthetic oligonucleotide
  Target: SCN10A; (-) strand; PAM type: YTN; PAM sequence: CTA
aatgaggaagtcaaagccca

SEQ ID NO: 45049 - DNA, 20 bp, Artificial Sequence
  Description of Artificial Sequence: Synthetic oligonucleotide
  Target: SCN10A; (-) strand; PAM type: YTN; PAM sequence: TTC
taaatgaggaagtcaaagcc

SEQ ID NO: 45050 - DNA, 20 bp, Artificial Sequence
  Description of Artificial Sequence: Synthetic oligonucleotide
  Target: SCN10A; (-) strand; PAM type: YTN; PAM sequence: TTT
ctaaatgaggaagtcaaagc

SEQ ID NO: 45051 - DNA, 20 bp, Artificial Sequence
  Description of Artificial Sequence: Synthetic oligonucleotide
  Target: SCN10A; (-) strand; PAM type: YTN; PAM sequence: TTT
tctaaatgaggaagtcaaag

SEQ ID NO: 45052 - DNA, 20 bp, Artificial Sequence
  Description of Artificial Sequence: Synthetic oligonucleotide
  Target: SCN10A; (-) strand; PAM type: YTN; PAM sequence: TTG
cattttctaaatgaggaagt

SEQ ID NO: 45053 - DNA, 20 bp, Artificial Sequence
  Description of Artificial Sequence: Synthetic oligonucleotide
  Target: SCN10A; (-) strand; PAM type: YTN; PAM sequence: TTT
gcattttctaaatgaggaag

SEQ ID NO: 45054 - DNA, 20 bp, Artificial Sequence
  Description of Artificial Sequence: Synthetic oligonucleotide
  Target: SCN10A; (-) strand; PAM type: YTN; PAM sequence: TTG
tttgcattttctaaatgagg

SEQ ID NO: 45055 - DNA, 20 bp, Artificial Sequence
  Description of Artificial Sequence: Synthetic oligonucleotide
  Target: SCN10A; (-) strand; PAM type: YTN; PAM sequence: CTC
agttgtttgcattttctaaa

SEQ ID NO: 45056 - DNA, 20 bp, Artificial Sequence
  Description of Artificial Sequence: Synthetic oligonucleotide
  Target: SCN10A; (-) strand; PAM type: YTN; PAM sequence: TTA
acatcctcagttgtttgcat

SEQ ID NO: 45057 - DNA, 20 bp, Artificial Sequence
  Description of Artificial Sequence: Synthetic oligonucleotide
  Target: SCN10A; (-) strand; PAM type: YTN; PAM sequence: CTT
aacatcctcagttgtttgca

SEQ ID NO: 45058 - DNA, 20 bp, Artificial Sequence
  Description of Artificial Sequence: Synthetic oligonucleotide
  Target: SCN10A; (-) strand; PAM type: YTN; PAM sequence: CTC
cgccaatagaccaaggtaga

SEQ ID NO: 45059 - DNA, 20 bp, Artificial Sequence
  Description of Artificial Sequence: Synthetic oligonucleotide
  Target: SCN10A; (-) strand; PAM type: YTN; PAM sequence: CTA
ctccgccaatagaccaaggt

SEQ ID NO: 45060 - DNA, 20 bp, Artificial Sequence
  Description of Artificial Sequence: Synthetic oligonucleotide
  Target: SCN10A; (-) strand; PAM type: YTN; PAM sequence: CTC
aactactccgccaatagacc

SEQ ID NO: 45061 - DNA, 20 bp, Artificial Sequence
  Description of Artificial Sequence: Synthetic oligonucleotide
  Target: SCN10A; (-) strand; PAM type: YTN; PAM sequence: TTA
cacaatctcaactactccgc

SEQ ID NO: 45062 - DNA, 20 bp, Artificial Sequence
  Description of Artificial Sequence: Synthetic oligonucleotide
  Target: SCN10A; (-) strand; PAM type: YTN; PAM sequence: CTT
acacaatctcaactactccg

SEQ ID NO: 45063 - DNA, 20 bp, Artificial Sequence
  Description of Artificial Sequence: Synthetic oligonucleotide
  Target: SCN10A; (-) strand; PAM type: YTN; PAM sequence: CTC
cttacacaatctcaactact

SEQ ID NO: 45064 - DNA, 20 bp, Artificial Sequence
  Description of Artificial Sequence: Synthetic oligonucleotide
  Target: SCN10A; (-) strand; PAM type: YTN; PAM sequence: TTA
agctccttacacaatctcaa

SEQ ID NO: 45065 - DNA, 20 bp, Artificial Sequence
  Description of Artificial Sequence: Synthetic oligonucleotide
  Target: SCN10A; (-) strand; PAM type: YTN; PAM sequence: CTT
aagctccttacacaatctca

SEQ ID NO: 45066 - DNA, 20 bp, Artificial Sequence
  Description of Artificial Sequence: Synthetic oligonucleotide
  Target: SCN10A; (-) strand; PAM type: YTN; PAM sequence: CTG
tggcttaagctccttacaca

SEQ ID NO: 45067 - DNA, 20 bp, Artificial Sequence
  Description of Artificial Sequence: Synthetic oligonucleotide
  Target: SCN10A; (-) strand; PAM type: YTN; PAM sequence: CTG
tactgtggcttaagctcctt

SEQ ID NO: 45068 - DNA, 20 bp, Artificial Sequence
  Description of Artificial Sequence: Synthetic oligonucleotide
  Target: SCN10A; (-) strand; PAM type: YTN; PAM sequence: CTC
tgtactgtggcttaagctcc

SEQ ID NO: 45069 - DNA, 20 bp, Artificial Sequence
  Description of Artificial Sequence: Synthetic oligonucleotide
  Target: SCN10A; (-) strand; PAM type: YTN; PAM sequence: CTC
tctgtactgtggcttaagct

SEQ ID NO: 45070 - DNA, 20 bp, Artificial Sequence
  Description of Artificial Sequence: Synthetic oligonucleotide
  Target: SCN10A; (-) strand; PAM type: YTN; PAM sequence: TTC
tctctgtactgtggcttaag

SEQ ID NO: 45071 - DNA, 20 bp, Artificial Sequence
  Description of Artificial Sequence: Synthetic oligonucleotide
  Target: SCN10A; (-) strand; PAM type: YTN; PAM sequence: TTG
tagagcaaagaaggaaggtt

SEQ ID NO: 45072 - DNA, 20 bp, Artificial Sequence
  Description of Artificial Sequence: Synthetic oligonucleotide
  Target: SCN10A; (-) strand; PAM type: YTN; PAM sequence: TTT
gtagagcaaagaaggaaggt

SEQ ID NO: 45073 - DNA, 20 bp, Artificial Sequence
  Description of Artificial Sequence: Synthetic oligonucleotide
  Target: SCN10A; (-) strand; PAM type: YTN; PAM sequence: CTT
tgtagagcaaagaaggaagg

SEQ ID NO: 45074 - DNA, 20 bp, Artificial Sequence
  Description of Artificial Sequence: Synthetic oligonucleotide
  Target: SCN10A; (-) strand; PAM type: YTN; PAM sequence: CTG
ggctttgtagagcaaagaag

SEQ ID NO: 45075 - DNA, 20 bp, Artificial Sequence
  Description of Artificial Sequence: Synthetic oligonucleotide
  Target: SCN10A; (-) strand; PAM type: YTN; PAM sequence: CTG
aatactgggctttgtagagc

SEQ ID NO: 45076 - DNA, 20 bp, Artificial Sequence
  Description of Artificial Sequence: Synthetic oligonucleotide
  Target: SCN10A; (-) strand; PAM type: YTN; PAM sequence: CTG
gctgaatactgggctttgta

SEQ ID NO: 45077 - DNA, 20 bp, Artificial Sequence
  Description of Artificial Sequence: Synthetic oligonucleotide
  Target: SCN10A; (-) strand; PAM type: YTN; PAM sequence: CTA
aggccctggctgaatactgg

SEQ ID NO: 45078 - DNA, 20 bp, Artificial Sequence
  Description of Artificial Sequence: Synthetic oligonucleotide
  Target: SCN10A; (-) strand; PAM type: YTN; PAM sequence: CTC
taaggccctggctgaatact

SEQ ID NO: 45079 - DNA, 20 bp, Artificial Sequence
  Description of Artificial Sequence: Synthetic oligonucleotide
  Target: SCN10A; (-) strand; PAM type: YTN; PAM sequence: TTG
ggagacatctctaaggccct

SEQ ID NO: 45080 - DNA, 20 bp, Artificial Sequence
  Description of Artificial Sequence: Synthetic oligonucleotide
  Target: SCN10A; (-) strand; PAM type: YTN; PAM sequence: TTC
agagttgggagacatctcta

SEQ ID NO: 45081 - DNA, 20 bp, Artificial Sequence
  Description of Artificial Sequence: Synthetic oligonucleotide
  Target: SCN10A; (-) strand; PAM type: YTN; PAM sequence: TTA
tgggaatagagattcagagt

SEQ ID NO: 45082 - DNA, 20 bp, Artificial Sequence
  Description of Artificial Sequence: Synthetic oligonucleotide
  Target: SCN10A; (-) strand; PAM type: YTN; PAM sequence: CTT
atgggaatagagattcagag

SEQ ID NO: 45083 - DNA, 20 bp, Artificial Sequence
  Description of Artificial Sequence: Synthetic oligonucleotide
  Target: SCN10A; (-) strand; PAM type: YTN; PAM sequence: TTG
aataacaaggccttatggga

SEQ ID NO: 45084 - DNA, 20 bp, Artificial Sequence
  Description of Artificial Sequence: Synthetic oligonucleotide
  Target: SCN10A; (-) strand; PAM type: YTN; PAM sequence: TTT
gaataacaaggccttatggg

SEQ ID NO: 45085 - DNA, 20 bp, Artificial Sequence
  Description of Artificial Sequence: Synthetic oligonucleotide
  Target: SCN10A; (-) strand; PAM type: YTN; PAM sequence: CTT
tgaataacaaggccttatgg

SEQ ID NO: 45086 - DNA, 20 bp, Artificial Sequence
  Description of Artificial Sequence: Synthetic oligonucleotide
  Target: SCN10A; (-) strand; PAM type: YTN; PAM sequence: CTC
agtgacccacactttgaata

SEQ ID NO: 45087 - DNA, 20 bp, Artificial Sequence
  Description of Artificial Sequence: Synthetic oligonucleotide
  Target: SCN10A; (-) strand; PAM type: YTN; PAM sequence: CTG
ccctcagtgacccacacttt

SEQ ID NO: 45088 - DNA, 20 bp, Artificial Sequence
  Description of Artificial Sequence: Synthetic oligonucleotide
  Target: SCN10A; (-) strand; PAM type: YTN; PAM sequence: TTG
cactgccctcagtgacccac

SEQ ID NO: 45089 - DNA, 20 bp, Artificial Sequence
  Description of Artificial Sequence: Synthetic oligonucleotide
  Target: SCN10A; (-) strand; PAM type: YTN; PAM sequence: CTT
gcactgccctcagtgaccca

SEQ ID NO: 45090 - DNA, 20 bp, Artificial Sequence
  Description of Artificial Sequence: Synthetic oligonucleotide
  Target: SCN10A; (-) strand; PAM type: YTN; PAM sequence: CTC
ccaggtgatgcttgcactgc

SEQ ID NO: 45091 - DNA, 20 bp, Artificial Sequence
  Description of Artificial Sequence: Synthetic oligonucleotide
  Target: SCN10A; (-) strand; PAM type: YTN; PAM sequence: CTA
acaagctcccaggtgatgct

SEQ ID NO: 45092 - DNA, 20 bp, Artificial Sequence
  Description of Artificial Sequence: Synthetic oligonucleotide
  Target: SCN10A; (-) strand; PAM type: YTN; PAM sequence: TTC
taacaagctcccaggtgatg

SEQ ID NO: 45093 - DNA, 20 bp, Artificial Sequence
  Description of Artificial Sequence: Synthetic oligonucleotide
  Target: SCN10A; (-) strand; PAM type: YTN; PAM sequence: TTT
ctaacaagctcccaggtgat

SEQ ID NO: 45094 - DNA, 20 bp, Artificial Sequence
  Description of Artificial Sequence: Synthetic oligonucleotide
  Target: SCN10A; (-) strand; PAM type: YTN; PAM sequence: TTG
catttctaacaagctcccag

SEQ ID NO: 45095 - DNA, 20 bp, Artificial Sequence
  Description of Artificial Sequence: Synthetic oligonucleotide
  Target: SCN10A; (-) strand; PAM type: YTN; PAM sequence: TTT
gcatttctaacaagctccca

SEQ ID NO: 45096 - DNA, 20 bp, Artificial Sequence
  Description of Artificial Sequence: Synthetic oligonucleotide
  Target: SCN10A; (-) strand; PAM type: YTN; PAM sequence: CTG
agaatttgcatttctaacaa

SEQ ID NO: 45097 - DNA, 20 bp, Artificial Sequence
  Description of Artificial Sequence: Synthetic oligonucleotide
  Target: SCN10A; (-) strand; PAM type: YTN; PAM sequence: CTG
tggcagggcctgagaatttg

SEQ ID NO: 45098 - DNA, 20 bp, Artificial Sequence
  Description of Artificial Sequence: Synthetic oligonucleotide
  Target: SCN10A; (-) strand; PAM type: YTN; PAM sequence: TTC
cataaatctgtggcagggcc

SEQ ID NO: 45099 - DNA, 20 bp, Artificial Sequence
  Description of Artificial Sequence: Synthetic oligonucleotide
  Target: SCN10A; (-) strand; PAM type: YTN; PAM sequence: CTC
attccataaatctgtggcag

SEQ ID NO: 45100 - DNA, 20 bp, Artificial Sequence
  Description of Artificial Sequence: Synthetic oligonucleotide
  Target: SCN10A; (-) strand; PAM type: YTN; PAM sequence: TTC
tcattccataaatctgtggc

SEQ ID NO: 45101 - DNA, 20 bp, Artificial Sequence
  Description of Artificial Sequence: Synthetic oligonucleotide
  Target: SCN10A; (-) strand; PAM type: YTN; PAM sequence: TTC
aaatgcagattctcattcca

SEQ ID NO: 45102 - DNA, 20 bp, Artificial Sequence
  Description of Artificial Sequence: Synthetic oligonucleotide
  Target: SCN10A; (-) strand; PAM type: YTN; PAM sequence: TTG
ttcaaatgcagattctcatt

SEQ ID NO: 45103 - DNA, 20 bp, Artificial Sequence
  Description of Artificial Sequence: Synthetic oligonucleotide
  Target: SCN10A; (-) strand; PAM type: YTN; PAM sequence: CTT
gttcaaatgcagattctcat

SEQ ID NO: 45104 - DNA, 20 bp, Artificial Sequence
  Description of Artificial Sequence: Synthetic oligonucleotide
  Target: SCN10A; (-) strand; PAM type: YTN; PAM sequence: CTC
ccaggagcttgttcaaatgc

SEQ ID NO: 45105 - DNA, 20 bp, Artificial Sequence
  Description of Artificial Sequence: Synthetic oligonucleotide
  Target: SCN10A; (-) strand; PAM type: YTN; PAM sequence: TTA
atctcccaggagcttgttca

SEQ ID NO: 45106 - DNA, 20 bp, Artificial Sequence
  Description of Artificial Sequence: Synthetic oligonucleotide
  Target: SCN10A; (-) strand; PAM type: YTN; PAM sequence: TTT
aatctcccaggagcttgttc

SEQ ID NO: 45107 - DNA, 20 bp, Artificial Sequence
  Description of Artificial Sequence: Synthetic oligonucleotide
  Target: SCN10A; (-) strand; PAM type: YTN; PAM sequence: CTC
aaaatttaatctcccaggag

SEQ ID NO: 45108 - DNA, 20 bp, Artificial Sequence
  Description of Artificial Sequence: Synthetic oligonucleotide
  Target: SCN10A; (-) strand; PAM type: YTN; PAM sequence: TTC
tcaaaatttaatctcccagg

SEQ ID NO: 45109 - DNA, 20 bp, Artificial Sequence
  Description of Artificial Sequence: Synthetic oligonucleotide
  Target: SCN10A; (-) strand; PAM type: YTN; PAM sequence: CTT
ctcaaaatttaatctcccag

SEQ ID NO: 45110 - DNA, 20 bp, Artificial Sequence
  Description of Artificial Sequence: Synthetic oligonucleotide
  Target: SCN10A; (-) strand; PAM type: YTN; PAM sequence: TTA
caatagcacttctcaaaatt

SEQ ID NO: 45111 - DNA, 20 bp, Artificial Sequence
  Description of Artificial Sequence: Synthetic oligonucleotide
  Target: SCN10A; (-) strand; PAM type: YTN; PAM sequence: CTC
acagaaaatcattacaatag

SEQ ID NO: 45112 - DNA, 20 bp, Artificial Sequence
  Description of Artificial Sequence: Synthetic oligonucleotide
  Target: SCN10A; (-) strand; PAM type: YTN; PAM sequence: TTA
aagctcacagaaaatcatta

SEQ ID NO: 45113 - DNA, 20 bp, Artificial Sequence
  Description of Artificial Sequence: Synthetic oligonucleotide
  Target: SCN10A; (-) strand; PAM type: YTN; PAM sequence: TTT
aaagctcacagaaaatcatt

SEQ ID NO: 45114 - DNA, 20 bp, Artificial Sequence
  Description of Artificial Sequence: Synthetic oligonucleotide
  Target: SCN10A; (-) strand; PAM type: YTN; PAM sequence: CTT
taaagctcacagaaaatcat

SEQ ID NO: 45115 - DNA, 20 bp, Artificial Sequence
  Description of Artificial Sequence: Synthetic oligonucleotide
  Target: SCN10A; (-) strand; PAM type: YTN; PAM sequence: CTC
ctttaaagctcacagaaaat

SEQ ID NO: 45116 - DNA, 20 bp, Artificial Sequence
  Description of Artificial Sequence: Synthetic oligonucleotide
  Target: SCN10A; (-) strand; PAM type: YTN; PAM sequence: TTA
ctcctttaaagctcacagaa

SEQ ID NO: 45117 - DNA, 20 bp, Artificial Sequence
  Description of Artificial Sequence: Synthetic oligonucleotide
  Target: SCN10A; (-) strand; PAM type: YTN; PAM sequence: CTA
attactcctttaaagctcac

SEQ ID NO: 45118 - DNA, 20 bp, Artificial Sequence
  Description of Artificial Sequence: Synthetic oligonucleotide
  Target: SCN10A; (-) strand; PAM type: YTN; PAM sequence: CTA
ctaattactcctttaaagct

SEQ ID NO: 45119 - DNA, 20 bp, Artificial Sequence
  Description of Artificial Sequence: Synthetic oligonucleotide
  Target: SCN10A; (-) strand; PAM type: YTN; PAM sequence: TTC
caaatgctactaattactcc

SEQ ID NO: 45120 - DNA, 20 bp, Artificial Sequence
  Description of Artificial Sequence: Synthetic oligonucleotide
  Target: SCN10A; (-) strand; PAM type: YTN; PAM sequence: CTT
ccaaatgctactaattactc

SEQ ID NO: 45121 - DNA, 20 bp, Artificial Sequence
  Description of Artificial Sequence: Synthetic oligonucleotide
  Target: SCN10A; (-) strand; PAM type: YTN; PAM sequence: TTA
tcaaaccacttccaaatgct

SEQ ID NO: 45122 - DNA, 20 bp, Artificial Sequence
  Description of Artificial Sequence: Synthetic oligonucleotide
  Target: SCN10A; (-) strand; PAM type: YTN; PAM sequence: CTT
atcaaaccacttccaaatgc

SEQ ID NO: 45123 - DNA, 20 bp, Artificial Sequence
  Description of Artificial Sequence: Synthetic oligonucleotide
  Target: SCN10A; (-) strand; PAM type: YTN; PAM sequence: TTC
cttatcaaaccacttccaaa

SEQ ID NO: 45124 - DNA, 20 bp, Artificial Sequence
  Description of Artificial Sequence: Synthetic oligonucleotide
  Target: SCN10A; (-) strand; PAM type: YTN; PAM sequence: TTT
ccttatcaaaccacttccaa

SEQ ID NO: 45125 - DNA, 20 bp, Artificial Sequence
  Description of Artificial Sequence: Synthetic oligonucleotide
  Target: SCN10A; (-) strand; PAM type: YTN; PAM sequence: CTT
tccttatcaaaccacttcca

SEQ ID NO: 45126 - DNA, 20 bp, Artificial Sequence
  Description of Artificial Sequence: Synthetic oligonucleotide
  Target: SCN10A; (-) strand; PAM type: YTN; PAM sequence: CTA
tctttccttatcaaaccact

SEQ ID NO: 45127 - DNA, 20 bp, Artificial Sequence
  Description of Artificial Sequence: Synthetic oligonucleotide
  Target: SCN10A; (-) strand; PAM type: YTN; PAM sequence: CTA
caatacaaaaaggactatct

SEQ ID NO: 45128 - DNA, 20 bp, Artificial Sequence
  Description of Artificial Sequence: Synthetic oligonucleotide
  Target: SCN10A; (-) strand; PAM type: YTN; PAM sequence: CTG
aaggcctacaatacaaaaag

SEQ ID NO: 45129 - DNA, 20 bp, Artificial Sequence
  Description of Artificial Sequence: Synthetic oligonucleotide
  Target: SCN10A; (-) strand; PAM type: YTN; PAM sequence: CTC
tgaaggcctacaatacaaaa

SEQ ID NO: 45130 - DNA, 20 bp, Artificial Sequence
  Description of Artificial Sequence: Synthetic oligonucleotide
  Target: SCN10A; (-) strand; PAM type: YTN; PAM sequence: TTC
tctgaaggcctacaatacaa

SEQ ID NO: 45131 - DNA, 20 bp, Artificial Sequence
  Description of Artificial Sequence: Synthetic oligonucleotide
  Target: SCN10A; (-) strand; PAM type: YTN; PAM sequence: CTT
ctctgaaggcctacaataca

SEQ ID NO: 45132 - DNA, 20 bp, Artificial Sequence
  Description of Artificial Sequence: Synthetic oligonucleotide
  Target: SCN10A; (-) strand; PAM type: YTN; PAM sequence: CTC
cccaacacacggccttctct

SEQ ID NO: 45133 - DNA, 20 bp, Artificial Sequence
  Description of Artificial Sequence: Synthetic oligonucleotide
  Target: SCN10A; (-) strand; PAM type: YTN; PAM sequence: CTG
acctccccaacacacggcct

SEQ ID NO: 45134 - DNA, 20 bp, Artificial Sequence
  Description of Artificial Sequence: Synthetic oligonucleotide
  Target: SCN10A; (-) strand; PAM type: YTN; PAM sequence: CTC
tgacctccccaacacacggc

SEQ ID NO: 45135 - DNA, 20 bp, Artificial Sequence
  Description of Artificial Sequence: Synthetic oligonucleotide
  Target: SCN10A; (-) strand; PAM type: YTN; PAM sequence: TTC
ccaccctctgacctccccaa

SEQ ID NO: 45136 - DNA, 20 bp, Artificial Sequence
  Description of Artificial Sequence: Synthetic oligonucleotide
  Target: SCN10A; (-) strand; PAM type: YTN; PAM sequence: CTT
cccaccctctgacctcccca

SEQ ID NO: 45137 - DNA, 20 bp, Artificial Sequence
  Description of Artificial Sequence: Synthetic oligonucleotide
  Target: SCN10A; (-) strand; PAM type: YTN; PAM sequence: CTG
gcttcccaccctctgacctc

SEQ ID NO: 45138 - DNA, 20 bp, Artificial Sequence
  Description of Artificial Sequence: Synthetic oligonucleotide
  Target: SCN10A; (-) strand; PAM type: YTN; PAM sequence: TTA
atcccgaagcccctggcttc

SEQ ID NO: 45139 - DNA, 20 bp, Artificial Sequence
  Description of Artificial Sequence: Synthetic oligonucleotide
  Target: SCN10A; (-) strand; PAM type: YTN; PAM sequence: TTT
aatcccgaagcccctggctt

SEQ ID NO: 45140 - DNA, 20 bp, Artificial Sequence
  Description of Artificial Sequence: Synthetic oligonucleotide
  Target: SCN10A; (-) strand; PAM type: YTN; PAM sequence: TTA
tttaatcccgaagcccctgg

SEQ ID NO: 45141 - DNA, 20 bp, Artificial Sequence
  Description of Artificial Sequence: Synthetic oligonucleotide
  Target: SCN10A; (-) strand; PAM type: YTN; PAM sequence: CTT
atttaatcccgaagcccctg

SEQ ID NO: 45142 - DNA, 20 bp, Artificial Sequence
  Description of Artificial Sequence: Synthetic oligonucleotide
  Target: SCN10A; (-) strand; PAM type: YTN; PAM sequence: TTG
cccttatttaatcccgaagc

SEQ ID NO: 45143 - DNA, 20 bp, Artificial Sequence
  Description of Artificial Sequence: Synthetic oligonucleotide
  Target: SCN10A; (-) strand; PAM type: YTN; PAM sequence: TTT
gcccttatttaatcccgaag

SEQ ID NO: 45144 - DNA, 20 bp, Artificial Sequence
  Description of Artificial Sequence: Synthetic oligonucleotide
  Target: SCN10A; (-) strand; PAM type: YTN; PAM sequence: CTT
tgcccttatttaatcccgaa

SEQ ID NO: 45145 - DNA, 20 bp, Artificial Sequence
  Description of Artificial Sequence: Synthetic oligonucleotide
  Target: SCN10A; (-) strand; PAM type: YTN; PAM sequence: TTG
tcagtagcaaaacccagctt

SEQ ID NO: 45146 - DNA, 20 bp, Artificial Sequence
  Description of Artificial Sequence: Synthetic oligonucleotide
  Target: SCN10A; (-) strand; PAM type: YTN; PAM sequence: CTT
gtcagtagcaaaacccagct

SEQ ID NO: 45147 - DNA, 20 bp, Artificial Sequence
  Description of Artificial Sequence: Synthetic oligonucleotide
  Target: SCN10A; (-) strand; PAM type: YTN; PAM sequence: TTG
tccaaggtcacccaacttgt

SEQ ID NO: 45148 - DNA, 20 bp, Artificial Sequence
  Description of Artificial Sequence: Synthetic oligonucleotide
  Target: SCN10A; (-) strand; PAM type: YTN; PAM sequence: CTT
gtccaaggtcacccaacttg

SEQ ID NO: 45149 - DNA, 20 bp, Artificial Sequence
  Description of Artificial Sequence: Synthetic oligonucleotide
  Target: SCN10A; (-) strand; PAM type: YTN; PAM sequence: TTA
aaaggcttgtccaaggtcac

SEQ ID NO: 45150 - DNA, 20 bp, Artificial Sequence
  Description of Artificial Sequence: Synthetic oligonucleotide
  Target: SCN10A; (-) strand; PAM type: YTN; PAM sequence: TTT
aaaaggcttgtccaaggtca

SEQ ID NO: 45151 - DNA, 20 bp, Artificial Sequence
  Description of Artificial Sequence: Synthetic oligonucleotide
  Target: SCN10A; (-) strand; PAM type: YTN; PAM sequence: CTC
aaaatgtttaaaaggcttgt

SEQ ID NO: 45152 - DNA, 20 bp, Artificial Sequence
  Description of Artificial Sequence: Synthetic oligonucleotide
  Target: SCN10A; (-) strand; PAM type: YTN; PAM sequence: CTG
acactcaaaatgtttaaaag

SEQ ID NO: 45153 - DNA, 20 bp, Artificial Sequence
  Description of Artificial Sequence: Synthetic oligonucleotide
  Target: SCN10A; (-) strand; PAM type: YTN; PAM sequence: CTA
tatagatggggaaactgaca

SEQ ID NO: 45154 - DNA, 20 bp, Artificial Sequence
  Description of Artificial Sequence: Synthetic oligonucleotide
  Target: SCN10A; (-) strand; PAM type: YTN; PAM sequence: CTC
ccactatatagatggggaaa

SEQ ID NO: 45155 - DNA, 20 bp, Artificial Sequence
  Description of Artificial Sequence: Synthetic oligonucleotide
  Target: SCN10A; (-) strand; PAM type: YTN; PAM sequence: TTG
agtgagtgagtgtatgcctc

SEQ ID NO: 45156 - DNA, 20 bp, Artificial Sequence
  Description of Artificial Sequence: Synthetic oligonucleotide
  Target: SCN10A; (-) strand; PAM type: YTN; PAM sequence: TTT
gagtgagtgagtgtatgcct

SEQ ID NO: 45157 - DNA, 20 bp, Artificial Sequence
  Description of Artificial Sequence: Synthetic oligonucleotide
  Target: SCN10A; (-) strand; PAM type: YTN; PAM sequence: CTG
caagcatttgagtgagtgag

SEQ ID NO: 45158 - DNA, 20 bp, Artificial Sequence
  Description of Artificial Sequence: Synthetic oligonucleotide
  Target: SCN10A; (-) strand; PAM type: YTN; PAM sequence: CTG
gctgcaagcatttgagtgag

SEQ ID NO: 45159 - DNA, 20 bp, Artificial Sequence
  Description of Artificial Sequence: Synthetic oligonucleotide
  Target: SCN10A; (-) strand; PAM type: YTN; PAM sequence: CTG
ccaaacctggctgcaagcat

SEQ ID NO: 45160 - DNA, 20 bp, Artificial Sequence
  Description of Artificial Sequence: Synthetic oligonucleotide
  Target: SCN10A; (-) strand; PAM type: YTN; PAM sequence: TTC
aaggtgcccgtgccatggcc

SEQ ID NO: 45161 - DNA, 20 bp, Artificial Sequence
  Description of Artificial Sequence: Synthetic oligonucleotide
  Target: SCN10A; (-) strand; PAM type: YTN; PAM sequence: TTA
gcagcagagcatgggaggtg

SEQ ID NO: 45162 - DNA, 20 bp, Artificial Sequence
  Description of Artificial Sequence: Synthetic oligonucleotide
  Target: SCN10A; (-) strand; PAM type: YTN; PAM sequence: CTT
agcagcagagcatgggaggt

SEQ ID NO: 45163 - DNA, 20 bp, Artificial Sequence
  Description of Artificial Sequence: Synthetic oligonucleotide
  Target: SCN10A; (-) strand; PAM type: YTN; PAM sequence: CTC
ttagcagcagagcatgggag

SEQ ID NO: 45164 - DNA, 20 bp, Artificial Sequence
  Description of Artificial Sequence: Synthetic oligonucleotide
  Target: SCN10A; (-) strand; PAM type: YTN; PAM sequence: CTG
cagcccagggcgagggcccc

SEQ ID NO: 45165 - DNA, 20 bp, Artificial Sequence
  Description of Artificial Sequence: Synthetic oligonucleotide
  Target: SCN10A; (-) strand; PAM type: YTN; PAM sequence: CTA
gaaggagagctgcagcccag

SEQ ID NO: 45166 - DNA, 20 bp, Artificial Sequence
  Description of Artificial Sequence: Synthetic oligonucleotide
  Target: SCN10A; (-) strand; PAM type: YTN; PAM sequence: TTG
tcactagaaggagagctgca

SEQ ID NO: 45167 - DNA, 20 bp, Artificial Sequence
  Description of Artificial Sequence: Synthetic oligonucleotide
  Target: SCN10A; (-) strand; PAM type: YTN; PAM sequence: CTT
gtcactagaaggagagctgc

SEQ ID NO: 45168 - DNA, 20 bp, Artificial Sequence
  Description of Artificial Sequence: Synthetic oligonucleotide
  Target: SCN10A; (-) strand; PAM type: YTN; PAM sequence: CTG
aaagtccccaaccttgtcac

SEQ ID NO: 45169 - DNA, 20 bp, Artificial Sequence
  Description of Artificial Sequence: Synthetic oligonucleotide
  Target: SCN10A; (-) strand; PAM type: YTN; PAM sequence: CTG
agctgaaagtccccaacctt

SEQ ID NO: 45170 - DNA, 20 bp, Artificial Sequence
  Description of Artificial Sequence: Synthetic oligonucleotide
  Target: SCN10A; (-) strand; PAM type: YTN; PAM sequence: CTA
ctgagctgaaagtccccaac

SEQ ID NO: 45171 - DNA, 20 bp, Artificial Sequence
  Description of Artificial Sequence: Synthetic oligonucleotide
  Target: SCN10A; (-) strand; PAM type: YTN; PAM sequence: CTG
actactgagctgaaagtccc

SEQ ID NO: 45172 - DNA, 20 bp, Artificial Sequence
  Description of Artificial Sequence: Synthetic oligonucleotide
  Target: SCN10A; (-) strand; PAM type: YTN; PAM sequence: CTC
ctgactactgagctgaaagt

SEQ ID NO: 45173 - DNA, 20 bp, Artificial Sequence
  Description of Artificial Sequence: Synthetic oligonucleotide
  Target: SCN10A; (-) strand; PAM type: YTN; PAM sequence: TTC
tcctgactactgagctgaaa

SEQ ID NO: 45174 - DNA, 20 bp, Artificial Sequence
  Description of Artificial Sequence: Synthetic oligonucleotide
  Target: SCN10A; (-) strand; PAM type: YTN; PAM sequence: CTG
catcagtgggttctcctgac

SEQ ID NO: 45175 - DNA, 20 bp, Artificial Sequence
  Description of Artificial Sequence: Synthetic oligonucleotide
  Target: SCN10A; (-) strand; PAM type: YTN; PAM sequence: CTG
gagctgcatcagtgggttct

SEQ ID NO: 45176 - DNA, 20 bp, Artificial Sequence
  Description of Artificial Sequence: Synthetic oligonucleotide
  Target: SCN10A; (-) strand; PAM type: YTN; PAM sequence: CTA
caatccaaaggccctggagc

SEQ ID NO: 45177 - DNA, 20 bp, Artificial Sequence
  Description of Artificial Sequence: Synthetic oligonucleotide
  Target: SCN10A; (-) strand; PAM type: YTN; PAM sequence: CTC
ctacaatccaaaggccctgg

SEQ ID NO: 45178 - DNA, 20 bp, Artificial Sequence
  Description of Artificial Sequence: Synthetic oligonucleotide
  Target: SCN10A; (-) strand; PAM type: YTN; PAM sequence: CTC
cagataggaatctcctacaa

SEQ ID NO: 45179 - DNA, 20 bp, Artificial Sequence
  Description of Artificial Sequence: Synthetic oligonucleotide
  Target: SCN10A; (-) strand; PAM type: YTN; PAM sequence: CTG
cccccaaatcctccagatag

SEQ ID NO: 45180 - DNA, 20 bp, Artificial Sequence
  Description of Artificial Sequence: Synthetic oligonucleotide
  Target: SCN10A; (-) strand; PAM type: YTN; PAM sequence: CTG
gtaaggggaggcatagtccc

SEQ ID NO: 45181 - DNA, 20 bp, Artificial Sequence
  Description of Artificial Sequence: Synthetic oligonucleotide
  Target: SCN10A; (-) strand; PAM type: YTN; PAM sequence: CTC
tggtaaggggaggcatagtc

SEQ ID NO: 45182 - DNA, 20 bp, Artificial Sequence
  Description of Artificial Sequence: Synthetic oligonucleotide
  Target: SCN10A; (-) strand; PAM type: YTN; PAM sequence: CTC
agcagtggatctctggtaag

SEQ ID NO: 45183 - DNA, 20 bp, Artificial Sequence
  Description of Artificial Sequence: Synthetic oligonucleotide
  Target: SCN10A; (-) strand; PAM type: YTN; PAM sequence: CTG
ctcagcagtggatctctggt

SEQ ID NO: 45184 - DNA, 20 bp, Artificial Sequence
  Description of Artificial Sequence: Synthetic oligonucleotide
  Target: SCN10A; (-) strand; PAM type: YTN; PAM sequence: TTC
atgatcctgctcagcagtgg

SEQ ID NO: 45185 - DNA, 20 bp, Artificial Sequence
  Description of Artificial Sequence: Synthetic oligonucleotide
  Target: SCN10A; (-) strand; PAM type: YTN; PAM sequence: CTT
catgatcctgctcagcagtg

SEQ ID NO: 45186 - DNA, 20 bp, Artificial Sequence
  Description of Artificial Sequence: Synthetic oligonucleotide
  Target: SCN10A; (-) strand; PAM type: YTN; PAM sequence: TTC
atcatcttcatgatcctgct

SEQ ID NO: 45187 - DNA, 20 bp, Artificial Sequence
  Description of Artificial Sequence: Synthetic oligonucleotide
  Target: SCN10A; (-) strand; PAM type: YTN; PAM sequence: CTT
catcatcttcatgatcctgc

SEQ ID NO: 45188 - DNA, 20 bp, Artificial Sequence
  Description of Artificial Sequence: Synthetic oligonucleotide
  Target: SCN10A; (-) strand; PAM type: YTN; PAM sequence: TTG
agagcttcatcatcttcatg

SEQ ID NO: 45189 - DNA, 20 bp, Artificial Sequence
  Description of Artificial Sequence: Synthetic oligonucleotide
  Target: SCN10A; (-) strand; PAM type: YTN; PAM sequence: TTT
gagagcttcatcatcttcat

SEQ ID NO: 45190 - DNA, 20 bp, Artificial Sequence
  Description of Artificial Sequence: Synthetic oligonucleotide
  Target: SCN10A; (-) strand; PAM type: YTN; PAM sequence: CTG
gtttgagagcttcatcatct

SEQ ID NO: 45191 - DNA, 20 bp, Artificial Sequence
  Description of Artificial Sequence: Synthetic oligonucleotide
  Target: SCN10A; (-) strand; PAM type: YTN; PAM sequence: CTA
ccgtatcgtggagcacagct

SEQ ID NO: 45192 - DNA, 20 bp, Artificial Sequence
  Description of Artificial Sequence: Synthetic oligonucleotide
  Target: SCN10A; (-) strand; PAM type: YTN; PAM sequence: TTG
ctaccgtatcgtggagcaca

SEQ ID NO: 45193 - DNA, 20 bp, Artificial Sequence
  Description of Artificial Sequence: Synthetic oligonucleotide
  Target: SCN10A; (-) strand; PAM type: YTN; PAM sequence: CTT
gctaccgtatcgtggagcac

SEQ ID NO: 45194 - DNA, 20 bp, Artificial Sequence
  Description of Artificial Sequence: Synthetic oligonucleotide
  Target: SCN10A; (-) strand; PAM type: YTN; PAM sequence: CTG
gcaggtgcgcaagacttgct

SEQ ID NO: 45195 - DNA, 20 bp, Artificial Sequence
  Description of Artificial Sequence: Synthetic oligonucleotide
  Target: SCN10A; (-) strand; PAM type: YTN; PAM sequence: CTG
gataccaccaagagtccatg

SEQ ID NO: 45196 - DNA, 20 bp, Artificial Sequence
  Description of Artificial Sequence: Synthetic oligonucleotide
  Target: SCN10A; (-) strand; PAM type: YTN; PAM sequence: CTG
caaactggataccaccaaga

SEQ ID NO: 45197 - DNA, 20 bp, Artificial Sequence
  Description of Artificial Sequence: Synthetic oligonucleotide
  Target: SCN10A; (-) strand; PAM type: YTN; PAM sequence: CTG
ctgcaaactggataccacca

SEQ ID NO: 45198 - DNA, 20 bp, Artificial Sequence
  Description of Artificial Sequence: Synthetic oligonucleotide
  Target: SCN10A; (-) strand; PAM type: YTN; PAM sequence: CTG
tccctgctgcaaactggata

SEQ ID NO: 45199 - DNA, 20 bp, Artificial Sequence
  Description of Artificial Sequence: Synthetic oligonucleotide
  Target: SCN10A; (-) strand; PAM type: YTN; PAM sequence: TTC
gccactgtccctgctgcaaa

SEQ ID NO: 45200 - DNA, 20 bp, Artificial Sequence
  Description of Artificial Sequence: Synthetic oligonucleotide
  Target: SCN10A; (-) strand; PAM type: YTN; PAM sequence: CTC
cccacaggatgcattcgcca

SEQ ID NO: 45201 - DNA, 20 bp, Artificial Sequence
  Description of Artificial Sequence: Synthetic oligonucleotide
  Target: SCN10A; (-) strand; PAM type: YTN; PAM sequence: CTC
tccccacaggatgcattcgc

SEQ ID NO: 45202 - DNA, 20 bp, Artificial Sequence
  Description of Artificial Sequence: Synthetic oligonucleotide
  Target: SCN10A; (-) strand; PAM type: YTN; PAM sequence: CTG
gccatcacccaccatcagtc

SEQ ID NO: 45203 - DNA, 20 bp, Artificial Sequence
  Description of Artificial Sequence: Synthetic oligonucleotide
  Target: SCN10A; (-) strand; PAM type: YTN; PAM sequence: TTG
cccactggccatcacccacc

SEQ ID NO: 45204 - DNA, 20 bp, Artificial Sequence
  Description of Artificial Sequence: Synthetic oligonucleotide
  Target: SCN10A; (-) strand; PAM type: YTN; PAM sequence: TTT
gcccactggccatcacccac

SEQ ID NO: 45205 - DNA, 20 bp, Artificial Sequence
  Description of Artificial Sequence: Synthetic oligonucleotide
  Target: SCN10A; (-) strand; PAM type: YTN; PAM sequence: CTT
tgcccactggccatcaccca

SEQ ID NO: 45206 - DNA, 20 bp, Artificial Sequence
  Description of Artificial Sequence: Synthetic oligonucleotide
  Target: SCN10A; (-) strand; PAM type: YTN; PAM sequence: TTA
tcccctttgcccactggcca

SEQ ID NO: 45207 - DNA, 20 bp, Artificial Sequence
  Description of Artificial Sequence: Synthetic oligonucleotide
  Target: SCN10A; (-) strand; PAM type: YTN; PAM sequence: CTG
cagcaggagcagaaattatc

SEQ ID NO: 45208 - DNA, 20 bp, Artificial Sequence
  Description of Artificial Sequence: Synthetic oligonucleotide
  Target: SCN10A; (-) strand; PAM type: YTN; PAM sequence: CTC
tgcagcaggagcagaaatta

SEQ ID NO: 45209 - DNA, 20 bp, Artificial Sequence
  Description of Artificial Sequence: Synthetic oligonucleotide
  Target: SCN10A; (-) strand; PAM type: YTN; PAM sequence: TTC
tctgcagcaggagcagaaat

SEQ ID NO: 45210 - DNA, 20 bp, Artificial Sequence
  Description of Artificial Sequence: Synthetic oligonucleotide
  Target: SCN10A; (-) strand; PAM type: YTN; PAM sequence: TTT
ctctgcagcaggagcagaaa

SEQ ID NO: 45211 - DNA, 20 bp, Artificial Sequence
  Description of Artificial Sequence: Synthetic oligonucleotide
  Target: SCN10A; (-) strand; PAM type: YTN; PAM sequence: CTA
gcagaatggtttctctgcag

SEQ ID NO: 45212 - DNA, 20 bp, Artificial Sequence
  Description of Artificial Sequence: Synthetic oligonucleotide
  Target: SCN10A; (-) strand; PAM type: YTN; PAM sequence: TTC
ctagcagaatggtttctctg

SEQ ID NO: 45213 - DNA, 20 bp, Artificial Sequence
  Description of Artificial Sequence: Synthetic oligonucleotide
  Target: SCN10A; (-) strand; PAM type: YTN; PAM sequence: TTT
cctagcagaatggtttctct

SEQ ID NO: 45214 - DNA, 20 bp, Artificial Sequence
  Description of Artificial Sequence: Synthetic oligonucleotide
  Target: SCN10A; (-) strand; PAM type: YTN; PAM sequence: TTC
caagggcatgacaagtgggt

SEQ ID NO: 45215 - DNA, 20 bp, Artificial Sequence
  Description of Artificial Sequence: Synthetic oligonucleotide
  Target: SCN10A; (-) strand; PAM type: YTN; PAM sequence: TTT
ccaagggcatgacaagtggg

SEQ ID NO: 45216 - DNA, 20 bp, Artificial Sequence
  Description of Artificial Sequence: Synthetic oligonucleotide
  Target: SCN10A; (-) strand; PAM type: YTN; PAM sequence: TTT
tccaagggcatgacaagtgg

SEQ ID NO: 45217 - DNA, 20 bp, Artificial Sequence
  Description of Artificial Sequence: Synthetic oligonucleotide
  Target: SCN10A; (-) strand; PAM type: YTN; PAM sequence: TTT
ttccaagggcatgacaagtg

SEQ ID NO: 45218 - DNA, 20 bp, Artificial Sequence
  Description of Artificial Sequence: Synthetic oligonucleotide
  Target: SCN10A; (-) strand; PAM type: YTN; PAM sequence: TTT
tttccaagggcatgacaagt

SEQ ID NO: 45219 - DNA, 20 bp, Artificial Sequence
  Description of Artificial Sequence: Synthetic oligonucleotide
  Target: SCN10A; (-) strand; PAM type: YTN; PAM sequence: TTT
ttttccaagggcatgacaag

SEQ ID NO: 45220 - DNA, 20 bp, Artificial Sequence
  Description of Artificial Sequence: Synthetic oligonucleotide
  Target: SCN10A; (-) strand; PAM type: YTN; PAM sequence: TTC
caggaaagaatttttttcca

SEQ ID NO: 45221 - DNA, 20 bp, Artificial Sequence
  Description of Artificial Sequence: Synthetic oligonucleotide
  Target: SCN10A; (-) strand; PAM type: YTN; PAM sequence: TTC
acccatattccaggaaagaa

SEQ ID NO: 45222 - DNA, 20 bp, Artificial Sequence
  Description of Artificial Sequence: Synthetic oligonucleotide
  Target: SCN10A; (-) strand; PAM type: YTN; PAM sequence: CTT
cacccatattccaggaaaga

SEQ ID NO: 45223 - DNA, 20 bp, Artificial Sequence
  Description of Artificial Sequence: Synthetic oligonucleotide
  Target: SCN10A; (-) strand; PAM type: YTN; PAM sequence: CTC
ttcacccatattccaggaaa

SEQ ID NO: 45224 - DNA, 20 bp, Artificial Sequence
  Description of Artificial Sequence: Synthetic oligonucleotide
  Target: SCN10A; (-) strand; PAM type: YTN; PAM sequence: CTG
gaagggacccctcttcaccc

SEQ ID NO: 45225 - DNA, 20 bp, Artificial Sequence
  Description of Artificial Sequence: Synthetic oligonucleotide
  Target: SCN10A; (-) strand; PAM type: YTN; PAM sequence: CTC
cctggaagggacccctcttc

SEQ ID NO: 45226 - DNA, 20 bp, Artificial Sequence
  Description of Artificial Sequence: Synthetic oligonucleotide
  Target: SCN10A; (-) strand; PAM type: YTN; PAM sequence: TTG
agggactccctggaagggac

SEQ ID NO: 45227 - DNA, 20 bp, Artificial Sequence
  Description of Artificial Sequence: Synthetic oligonucleotide
  Target: SCN10A; (-) strand; PAM type: YTN; PAM sequence: CTG
gattgagggactccctggaa

SEQ ID NO: 45228 - DNA, 20 bp, Artificial Sequence
  Description of Artificial Sequence: Synthetic oligonucleotide
  Target: SCN10A; (-) strand; PAM type: YTN; PAM sequence: TTG
gtctggattgagggactccc

SEQ ID NO: 45229 - DNA, 20 bp, Artificial Sequence
  Description of Artificial Sequence: Synthetic oligonucleotide
  Target: SCN10A; (-) strand; PAM type: YTN; PAM sequence: CTG
ttggtctggattgagggact

SEQ ID NO: 45230 - DNA, 20 bp, Artificial Sequence
  Description of Artificial Sequence: Synthetic oligonucleotide
  Target: SCN10A; (-) strand; PAM type: YTN; PAM sequence: CTG
atgatggagaggaacacctg

SEQ ID NO: 45231 - DNA, 20 bp, Artificial Sequence
  Description of Artificial Sequence: Synthetic oligonucleotide
  Target: SCN10A; (-) strand; PAM type: YTN; PAM sequence: CTA
ggaaaaacatcagagtgggc

SEQ ID NO: 45232 - DNA, 20 bp, Artificial Sequence
  Description of Artificial Sequence: Synthetic oligonucleotide
  Target: SCN10A; (-) strand; PAM type: YTN; PAM sequence: CTG
taagaaggatatggctagga

SEQ ID NO: 45233 - DNA, 20 bp, Artificial Sequence
  Description of Artificial Sequence: Synthetic oligonucleotide
  Target: SCN10A; (-) strand; PAM type: YTN; PAM sequence: CTG
gtgtcatctgtaagaaggat

SEQ ID NO: 45234 - DNA, 20 bp, Artificial Sequence
  Description of Artificial Sequence: Synthetic oligonucleotide
  Target: SCN10A; (-) strand; PAM type: YTN; PAM sequence: TTC
caggtataggtgggcagaag

SEQ ID NO: 45235 - DNA, 20 bp, Artificial Sequence
  Description of Artificial Sequence: Synthetic oligonucleotide
  Target: SCN10A; (-) strand; PAM type: YTN; PAM sequence: TTT
ccaggtataggtgggcagaa

SEQ ID NO: 45236 - DNA, 20 bp, Artificial Sequence
  Description of Artificial Sequence: Synthetic oligonucleotide
  Target: SCN10A; (-) strand; PAM type: YTN; PAM sequence: TTT
tccaggtataggtgggcaga

SEQ ID NO: 45237 - DNA, 20 bp, Artificial Sequence
  Description of Artificial Sequence: Synthetic oligonucleotide
  Target: SCN10A; (-) strand; PAM type: YTN; PAM sequence: CTG
ttttccaggtataggtgggc

SEQ ID NO: 45238 - DNA, 20 bp, Artificial Sequence
  Description of Artificial Sequence: Synthetic oligonucleotide
  Target: SCN10A; (-) strand; PAM type: YTN; PAM sequence: TTG
tctgttttccaggtataggt

SEQ ID NO: 45239 - DNA, 20 bp, Artificial Sequence
  Description of Artificial Sequence: Synthetic oligonucleotide
  Target: SCN10A; (-) strand; PAM type: YTN; PAM sequence: CTT
gtctgttttccaggtatagg

SEQ ID NO: 45240 - DNA, 20 bp, Artificial Sequence
  Description of Artificial Sequence: Synthetic oligonucleotide
  Target: SCN10A; (-) strand; PAM type: YTN; PAM sequence: CTC
atacgccgtagcttgtctgt

SEQ ID NO: 45241 - DNA, 20 bp, Artificial Sequence
  Description of Artificial Sequence: Synthetic oligonucleotide
  Target: SCN10A; (-) strand; PAM type: YTN; PAM sequence: CTC
aggcacccccaggctcatac

SEQ ID NO: 45242 - DNA, 20 bp, Artificial Sequence
  Description of Artificial Sequence: Synthetic oligonucleotide
  Target: SCN10A; (-) strand; PAM type: YTN; PAM sequence: TTG
gagcatatccccctcaggca

SEQ ID NO: 45243 - DNA, 20 bp, Artificial Sequence
  Description of Artificial Sequence: Synthetic oligonucleotide
  Target: SCN10A; (-) strand; PAM type: YTN; PAM sequence: CTT
ggagcatatccccctcaggc

SEQ ID NO: 45244 - DNA, 20 bp, Artificial Sequence
  Description of Artificial Sequence: Synthetic oligonucleotide
  Target: SCN10A; (-) strand; PAM type: YTN; PAM sequence: TTG
ggcttggagcatatccccct

SEQ ID NO: 45245 - DNA, 20 bp, Artificial Sequence
  Description of Artificial Sequence: Synthetic oligonucleotide
  Target: SCN10A; (-) strand; PAM type: YTN; PAM sequence: CTT
gggcttggagcatatccccc

SEQ ID NO: 45246 - DNA, 20 bp, Artificial Sequence
  Description of Artificial Sequence: Synthetic oligonucleotide
  Target: SCN10A; (-) strand; PAM type: YTN; PAM sequence: TTC
agcttgggcttggagcatat

SEQ ID NO: 45247 - DNA, 20 bp, Artificial Sequence
  Description of Artificial Sequence: Synthetic oligonucleotide
  Target: SCN10A; (-) strand; PAM type: YTN; PAM sequence: CTC
agttcagcttgggcttggag

SEQ ID NO: 45248 - DNA, 20 bp, Artificial Sequence
  Description of Artificial Sequence: Synthetic oligonucleotide
  Target: SCN10A; (-) strand; PAM type: YTN; PAM sequence: CTG
gacccaatccccatcccagc

SEQ ID NO: 45249 - DNA, 20 bp, Artificial Sequence
  Description of Artificial Sequence: Synthetic oligonucleotide
  Target: SCN10A; (-) strand; PAM type: YTN; PAM sequence: CTG
ggctggacccaatccccatc

SEQ ID NO: 45250 - DNA, 20 bp, Artificial Sequence
  Description of Artificial Sequence: Synthetic oligonucleotide
  Target: SCN10A; (-) strand; PAM type: YTN; PAM sequence: CTG
agctgggctggacccaatcc

SEQ ID NO: 45251 - DNA, 20 bp, Artificial Sequence
  Description of Artificial Sequence: Synthetic oligonucleotide
  Target: SCN10A; (-) strand; PAM type: YTN; PAM sequence: CTG
ggctgagctgggctggaccc

SEQ ID NO: 45252 - DNA, 20 bp, Artificial Sequence
  Description of Artificial Sequence: Synthetic oligonucleotide
  Target: SCN10A; (-) strand; PAM type: YTN; PAM sequence: CTG
ggctgggctgagctgggctg

SEQ ID NO: 45253 - DNA, 20 bp, Artificial Sequence
  Description of Artificial Sequence: Synthetic oligonucleotide
  Target: SCN10A; (-) strand; PAM type: YTN; PAM sequence: TTG
accctgggctgggctgagct

SEQ ID NO: 45254 - DNA, 20 bp, Artificial Sequence
  Description of Artificial Sequence: Synthetic oligonucleotide
  Target: SCN10A; (-) strand; PAM type: YTN; PAM sequence: TTT
gaccctgggctgggctgagc

SEQ ID NO: 45255 - DNA, 20 bp, Artificial Sequence
  Description of Artificial Sequence: Synthetic oligonucleotide
  Target: SCN10A; (-) strand; PAM type: YTN; PAM sequence: TTA
tttgaccctgggctgggctg

SEQ ID NO: 45256 - DNA, 20 bp, Artificial Sequence
  Description of Artificial Sequence: Synthetic oligonucleotide
  Target: SCN10A; (-) strand; PAM type: YTN; PAM sequence: TTT
atttgaccctgggctgggct

SEQ ID NO: 45257 - DNA, 20 bp, Artificial Sequence
  Description of Artificial Sequence: Synthetic oligonucleotide
  Target: SCN10A; (-) strand; PAM type: YTN; PAM sequence: TTT
tatttgaccctgggctgggc

SEQ ID NO: 45258 - DNA, 20 bp, Artificial Sequence
  Description of Artificial Sequence: Synthetic oligonucleotide
  Target: SCN10A; (-) strand; PAM type: YTN; PAM sequence: TTA
atagttttatttgaccctgg

SEQ ID NO: 45259 - DNA, 20 bp, Artificial Sequence
  Description of Artificial Sequence: Synthetic oligonucleotide
  Target: SCN10A; (-) strand; PAM type: YTN; PAM sequence: TTA
ttaatagttttatttgaccc

SEQ ID NO: 45260 - DNA, 20 bp, Artificial Sequence
  Description of Artificial Sequence: Synthetic oligonucleotide
  Target: SCN10A; (-) strand; PAM type: YTN; PAM sequence: TTT
attaatagttttatttgacc

SEQ ID NO: 45261 - DNA, 20 bp, Artificial Sequence
  Description of Artificial Sequence: Synthetic oligonucleotide
  Target: SCN10A; (-) strand; PAM type: YTN; PAM sequence: TTT
tattaatagttttatttgac

SEQ ID NO: 45262 - DNA, 20 bp, Artificial Sequence
  Description of Artificial Sequence: Synthetic oligonucleotide
  Target: SCN10A; (-) strand; PAM type: YTN; PAM sequence: TTT
ttattaatagttttatttga

SEQ ID NO: 45263 - DNA, 20 bp, Artificial Sequence
  Description of Artificial Sequence: Synthetic oligonucleotide
  Target: SCN10A; (-) strand; PAM type: YTN; PAM sequence: TTG
agtttttattaatagtttta

SEQ ID NO: 45264 - DNA, 20 bp, Artificial Sequence
  Description of Artificial Sequence: Synthetic oligonucleotide
  Target: SCN10A; (-) strand; PAM type: YTN; PAM sequence: CTT
gagtttttattaatagtttt

SEQ ID NO: 45265 - DNA, 20 bp, Artificial Sequence
  Description of Artificial Sequence: Synthetic oligonucleotide
  Target: SCN10A; (-) strand; PAM type: YTN; PAM sequence: TTA
aatacttgagtttttattaa

SEQ ID NO: 45266 - DNA, 20 bp, Artificial Sequence
  Description of Artificial Sequence: Synthetic oligonucleotide
  Target: SCN10A; (-) strand; PAM type: YTN; PAM sequence: TTT
aaatacttgagtttttatta

SEQ ID NO: 45267 - DNA, 20 bp, Artificial Sequence
  Description of Artificial Sequence: Synthetic oligonucleotide
  Target: SCN10A; (-) strand; PAM type: YTN; PAM sequence: TTT
taaatacttgagtttttatt

SEQ ID NO: 45268 - DNA, 20 bp, Artificial Sequence
  Description of Artificial Sequence: Synthetic oligonucleotide
  Target: SCN10A; (-) strand; PAM type: YTN; PAM sequence: TTT
ttaaatacttgagtttttat

SEQ ID NO: 45269 - DNA, 20 bp, Artificial Sequence
  Description of Artificial Sequence: Synthetic oligonucleotide
  Target: SCN10A; (-) strand; PAM type: YTN; PAM sequence: TTT
tttaaatacttgagttttta

SEQ ID NO: 45270 - DNA, 20 bp, Artificial Sequence
  Description of Artificial Sequence: Synthetic oligonucleotide
  Target: SCN10A; (-) strand; PAM type: YTN; PAM sequence: CTA
aaaatacaaagaaaaatttt

SEQ ID NO: 45271 - DNA, 20 bp, Artificial Sequence
  Description of Artificial Sequence: Synthetic oligonucleotide
  Target: SCN10A; (-) strand; PAM type: YTN; PAM sequence: TTC
taaaaatacaaagaaaaatt

SEQ ID NO: 45272 - DNA, 20 bp, Artificial Sequence
  Description of Artificial Sequence: Synthetic oligonucleotide
  Target: SCN10A; (-) strand; PAM type: YTN; PAM sequence: TTT
ctaaaaatacaaagaaaaat

SEQ ID NO: 45273 - DNA, 20 bp, Artificial Sequence
  Description of Artificial Sequence: Synthetic oligonucleotide
  Target: SCN10A; (-) strand; PAM type: YTN; PAM sequence: CTT
tctaaaaatacaaagaaaaa

SEQ ID NO: 45274 - DNA, 20 bp, Artificial Sequence
  Description of Artificial Sequence: Synthetic oligonucleotide
  Target: SCN10A; (-) strand; PAM type: YTN; PAM sequence: CTC
aatgctttctaaaaatacaa

SEQ ID NO: 45275 - DNA, 20 bp, Artificial Sequence
  Description of Artificial Sequence: Synthetic oligonucleotide
  Target: SCN10A; (-) strand; PAM type: YTN; PAM sequence: TTG
tggcctcaatgctttctaaa

SEQ ID NO: 45276 - DNA, 20 bp, Artificial Sequence
  Description of Artificial Sequence: Synthetic oligonucleotide
  Target: SCN10A; (-) strand; PAM type: YTN; PAM sequence: CTA
taaagggaattgtggcctca

SEQ ID NO: 45277 - DNA, 20 bp, Artificial Sequence
  Description of Artificial Sequence: Synthetic oligonucleotide
  Target: SCN10A; (-) strand; PAM type: YTN; PAM sequence: TTC
tataaagggaattgtggcct

SEQ ID NO: 45278 - DNA, 20 bp, Artificial Sequence
  Description of Artificial Sequence: Synthetic oligonucleotide
  Target: SCN10A; (-) strand; PAM type: YTN; PAM sequence: TTG
tgcaatgaatgaatcaagag

SEQ ID NO: 45279 - DNA, 20 bp, Artificial Sequence
  Description of Artificial Sequence: Synthetic oligonucleotide
  Target: SCN10A; (-) strand; PAM type: YTN; PAM sequence: TTT
gtgcaatgaatgaatcaaga

SEQ ID NO: 45280 - DNA, 20 bp, Artificial Sequence
  Description of Artificial Sequence: Synthetic oligonucleotide
  Target: SCN10A; (-) strand; PAM type: YTN; PAM sequence: CTC
aataaatatttgtgcaatga

SEQ ID NO: 45281 - DNA, 20 bp, Artificial Sequence
  Description of Artificial Sequence: Synthetic oligonucleotide
  Target: SCN10A; (-) strand; PAM type: YTN; PAM sequence: TTC
tcaataaatatttgtgcaat

SEQ ID NO: 45282 - DNA, 20 bp, Artificial Sequence
  Description of Artificial Sequence: Synthetic oligonucleotide
  Target: SCN10A; (-) strand; PAM type: YTN; PAM sequence: TTA
cattctcaataaatatttgt

SEQ ID NO: 45283 - DNA, 20 bp, Artificial Sequence
  Description of Artificial Sequence: Synthetic oligonucleotide
  Target: SCN10A; (-) strand; PAM type: YTN; PAM sequence: TTA
gaacagtgaggcacattaca

SEQ ID NO: 45284 - DNA, 20 bp, Artificial Sequence
  Description of Artificial Sequence: Synthetic oligonucleotide
  Target: SCN10A; (-) strand; PAM type: YTN; PAM sequence: TTT
agaacagtgaggcacattac

SEQ ID NO: 45285 - DNA, 20 bp, Artificial Sequence
  Description of Artificial Sequence: Synthetic oligonucleotide
  Target: SCN10A; (-) strand; PAM type: YTN; PAM sequence: CTC
agtgtttagaacagtgaggc

SEQ ID NO: 45286 - DNA, 20 bp, Artificial Sequence
  Description of Artificial Sequence: Synthetic oligonucleotide
  Target: SCN10A; (-) strand; PAM type: YTN; PAM sequence: CTC
tcagtgtttagaacagtgag

SEQ ID NO: 45287 - DNA, 20 bp, Artificial Sequence
  Description of Artificial Sequence: Synthetic oligonucleotide
  Target: SCN10A; (-) strand; PAM type: YTN; PAM sequence: TTC
ctctcagtgtttagaacagt

SEQ ID NO: 45288 - DNA, 20 bp, Artificial Sequence
  Description of Artificial Sequence: Synthetic oligonucleotide
  Target: SCN10A; (-) strand; PAM type: YTN; PAM sequence: TTT
cctctcagtgtttagaacag

SEQ ID NO: 45289 - DNA, 20 bp, Artificial Sequence
  Description of Artificial Sequence: Synthetic oligonucleotide
  Target: SCN10A; (-) strand; PAM type: YTN; PAM sequence: CTT
tcctctcagtgtttagaaca

SEQ ID NO: 45290 - DNA, 20 bp, Artificial Sequence
  Description of Artificial Sequence: Synthetic oligonucleotide
  Target: SCN10A; (-) strand; PAM type: YTN; PAM sequence: TTA
gtcatctttcctctcagtgt

SEQ ID NO: 45291 - DNA, 20 bp, Artificial Sequence
  Description of Artificial Sequence: Synthetic oligonucleotide
  Target: SCN10A; (-) strand; PAM type: YTN; PAM sequence: CTT
agtcatctttcctctcagtg

SEQ ID NO: 45292 - DNA, 20 bp, Artificial Sequence
  Description of Artificial Sequence: Synthetic oligonucleotide
  Target: SCN10A; (-) strand; PAM type: YTN; PAM sequence: CTG
tgtcttagtcatctttcctc

SEQ ID NO: 45293 - DNA, 20 bp, Artificial Sequence
  Description of Artificial Sequence: Synthetic oligonucleotide
  Target: SCN10A; (-) strand; PAM type: YTN; PAM sequence: CTC
aaaagcagaacctgtgtctt

SEQ ID NO: 45294 - DNA, 20 bp, Artificial Sequence
  Description of Artificial Sequence: Synthetic oligonucleotide
  Target: SCN10A; (-) strand; PAM type: YTN; PAM sequence: CTC
tcaaaagcagaacctgtgtc

SEQ ID NO: 45295 - DNA, 20 bp, Artificial Sequence
  Description of Artificial Sequence: Synthetic oligonucleotide
  Target: SCN10A; (-) strand; PAM type: YTN; PAM sequence: TTA
gctctcaaaagcagaacctg

SEQ ID NO: 45296 - DNA, 20 bp, Artificial Sequence
  Description of Artificial Sequence: Synthetic oligonucleotide
  Target: SCN10A; (-) strand; PAM type: YTN; PAM sequence: TTT
agctctcaaaagcagaacct

SEQ ID NO: 45297 - DNA, 20 bp, Artificial Sequence
  Description of Artificial Sequence: Synthetic oligonucleotide
  Target: SCN10A; (-) strand; PAM type: YTN; PAM sequence: TTG
tttagctctcaaaagcagaa

SEQ ID NO: 45298 - DNA, 20 bp, Artificial Sequence
  Description of Artificial Sequence: Synthetic oligonucleotide
  Target: SCN10A; (-) strand; PAM type: YTN; PAM sequence: TTT
gtttagctctcaaaagcaga

SEQ ID NO: 45299 - DNA, 20 bp, Artificial Sequence
  Description of Artificial Sequence: Synthetic oligonucleotide
  Target: SCN10A; (-) strand; PAM type: YTN; PAM sequence: TTT
tgtttagctctcaaaagcag

SEQ ID NO: 45300 - DNA, 20 bp, Artificial Sequence
  Description of Artificial Sequence: Synthetic oligonucleotide
  Target: SCN10A; (-) strand; PAM type: YTN; PAM sequence: CTT
ttgtttagctctcaaaagca

SEQ ID NO: 45301 - DNA, 20 bp, Artificial Sequence
  Description of Artificial Sequence: Synthetic oligonucleotide
  Target: SCN10A; (-) strand; PAM type: YTN; PAM sequence: CTC
aatcttttgtttagctctca

SEQ ID NO: 45302 - DNA, 20 bp, Artificial Sequence
  Description of Artificial Sequence: Synthetic oligonucleotide
  Target: SCN10A; (-) strand; PAM type: YTN; PAM sequence: TTC
cctcaatcttttgtttagct

SEQ ID NO: 45303 - DNA, 20 bp, Artificial Sequence
  Description of Artificial Sequence: Synthetic oligonucleotide
  Target: SCN10A; (-) strand; PAM type: YTN; PAM sequence: CTT
ccctcaatcttttgtttagc

SEQ ID NO: 45304 - DNA, 20 bp, Artificial Sequence
  Description of Artificial Sequence: Synthetic oligonucleotide
  Target: SCN10A; (-) strand; PAM type: YTN; PAM sequence: CTG
cttccctcaatcttttgttt

SEQ ID NO: 45305 - DNA, 20 bp, Artificial Sequence
  Description of Artificial Sequence: Synthetic oligonucleotide
  Target: SCN10A; (-) strand; PAM type: YTN; PAM sequence: TTG
gaccatgaaggacccagagg

SEQ ID NO: 45306 - DNA, 20 bp, Artificial Sequence
  Description of Artificial Sequence: Synthetic oligonucleotide
  Target: SCN10A; (-) strand; PAM type: YTN; PAM sequence: TTT
ggaccatgaaggacccagag

SEQ ID NO: 45307 - DNA, 20 bp, Artificial Sequence
  Description of Artificial Sequence: Synthetic oligonucleotide
  Target: SCN10A; (-) strand; PAM type: YTN; PAM sequence: TTG
atttggaccatgaaggaccc

SEQ ID NO: 45308 - DNA, 20 bp, Artificial Sequence
  Description of Artificial Sequence: Synthetic oligonucleotide
  Target: SCN10A; (-) strand; PAM type: YTN; PAM sequence: CTT
gatttggaccatgaaggacc

SEQ ID NO: 45309 - DNA, 20 bp, Artificial Sequence
  Description of Artificial Sequence: Synthetic oligonucleotide
  Target: SCN10A; (-) strand; PAM type: YTN; PAM sequence: CTC
ttgatttggaccatgaagga

SEQ ID NO: 45310 - DNA, 20 bp, Artificial Sequence
  Description of Artificial Sequence: Synthetic oligonucleotide
  Target: SCN10A; (-) strand; PAM type: YTN; PAM sequence: CTG
aaaactcttgatttggacca

SEQ ID NO: 45311 - DNA, 20 bp, Artificial Sequence
  Description of Artificial Sequence: Synthetic oligonucleotide
  Target: SCN10A; (-) strand; PAM type: YTN; PAM sequence: TTG
aaagggggaaacgtagtcac

SEQ ID NO: 45312 - DNA, 20 bp, Artificial Sequence
  Description of Artificial Sequence: Synthetic oligonucleotide
  Target: SCN10A; (-) strand; PAM type: YTN; PAM sequence: TTG
agttgaaagggggaaacgta

SEQ ID NO: 45313 - DNA, 20 bp, Artificial Sequence
  Description of Artificial Sequence: Synthetic oligonucleotide
  Target: SCN10A; (-) strand; PAM type: YTN; PAM sequence: CTT
gagttgaaagggggaaacgt

SEQ ID NO: 45314 - DNA, 20 bp, Artificial Sequence
  Description of Artificial Sequence: Synthetic oligonucleotide
  Target: SCN10A; (-) strand; PAM type: YTN; PAM sequence: CTC
ttgagttgaaagggggaaac

SEQ ID NO: 45315 - DNA, 20 bp, Artificial Sequence
  Description of Artificial Sequence: Synthetic oligonucleotide
  Target: SCN10A; (-) strand; PAM type: YTN; PAM sequence: CTA
aaccagccctcttgagttga

SEQ ID NO: 45316 - DNA, 20 bp, Artificial Sequence
  Description of Artificial Sequence: Synthetic oligonucleotide
  Target: SCN10A; (-) strand; PAM type: YTN; PAM sequence: TTC
taaaccagccctcttgagtt

SEQ ID NO: 45317 - DNA, 20 bp, Artificial Sequence
  Description of Artificial Sequence: Synthetic oligonucleotide
  Target: SCN10A; (-) strand; PAM type: YTN; PAM sequence: CTC
cgtgagttctaaaccagccc

SEQ ID NO: 45318 - DNA, 20 bp, Artificial Sequence
  Description of Artificial Sequence: Synthetic oligonucleotide
  Target: SCN10A; (-) strand; PAM type: YTN; PAM sequence: CTC
aaaaacccctccgtgagttc

SEQ ID NO: 45319 - DNA, 20 bp, Artificial Sequence
  Description of Artificial Sequence: Synthetic oligonucleotide
  Target: SCN10A; (-) strand; PAM type: YTN; PAM sequence: TTA
ccctcaaaaacccctccgtg

SEQ ID NO: 45320 - DNA, 20 bp, Artificial Sequence
  Description of Artificial Sequence: Synthetic oligonucleotide
  Target: SCN10A; (-) strand; PAM type: YTN; PAM sequence: TTT
accctcaaaaacccctccgt

SEQ ID NO: 45321 - DNA, 20 bp, Artificial Sequence
  Description of Artificial Sequence: Synthetic oligonucleotide
  Target: SCN10A; (-) strand; PAM type: YTN; PAM sequence: CTT
taccctcaaaaacccctccg

SEQ ID NO: 45322 - DNA, 20 bp, Artificial Sequence
  Description of Artificial Sequence: Synthetic oligonucleotide
  Target: SCN10A; (-) strand; PAM type: YTN; PAM sequence: CTC
tttaccctcaaaaacccctc

SEQ ID NO: 45323 - DNA, 20 bp, Artificial Sequence
  Description of Artificial Sequence: Synthetic oligonucleotide
  Target: SCN10A; (-) strand; PAM type: YTN; PAM sequence: TTC
ctctttaccctcaaaaaccc

SEQ ID NO: 45324 - DNA, 20 bp, Artificial Sequence
  Description of Artificial Sequence: Synthetic oligonucleotide
  Target: SCN10A; (-) strand; PAM type: YTN; PAM sequence: CTT
cctctttaccctcaaaaacc

SEQ ID NO: 45325 - DNA, 20 bp, Artificial Sequence
  Description of Artificial Sequence: Synthetic oligonucleotide
  Target: SCN10A; (-) strand; PAM type: YTN; PAM sequence: CTA
cggagagacgtgggccttcc

SEQ ID NO: 45326 - DNA, 20 bp, Artificial Sequence
  Description of Artificial Sequence: Synthetic oligonucleotide
  Target: SCN10A; (-) strand; PAM type: YTN; PAM sequence: CTA
tcagacactacggagagacg

SEQ ID NO: 45327 - DNA, 20 bp, Artificial Sequence
  Description of Artificial Sequence: Synthetic oligonucleotide
  Target: SCN10A; (-) strand; PAM type: YTN; PAM sequence: CTC
atgccctatcagacactacg

SEQ ID NO: 45328 - DNA, 20 bp, Artificial Sequence
  Description of Artificial Sequence: Synthetic oligonucleotide
  Target: SCN10A; (-) strand; PAM type: YTN; PAM sequence: CTG
catctcatgccctatcagac

SEQ ID NO: 45329 - DNA, 20 bp, Artificial Sequence
  Description of Artificial Sequence: Synthetic oligonucleotide
  Target: SCN10A; (-) strand; PAM type: YTN; PAM sequence: CTG
gccgtggtatctgcatctca

SEQ ID NO: 45330 - DNA, 20 bp, Artificial Sequence
  Description of Artificial Sequence: Synthetic oligonucleotide
  Target: SCN10A; (-) strand; PAM type: YTN; PAM sequence: TTG
agggcgcccgcatcagacac

SEQ ID NO: 45331 - DNA, 20 bp, Artificial Sequence
  Description of Artificial Sequence: Synthetic oligonucleotide
  Target: SCN10A; (-) strand; PAM type: YTN; PAM sequence: CTT
gagggcgcccgcatcagaca

SEQ ID NO: 45332 - DNA, 20 bp, Artificial Sequence
  Description of Artificial Sequence: Synthetic oligonucleotide
  Target: SCN10A; (-) strand; PAM type: YTN; PAM sequence: CTC
ccaggcttgagggcgcccgc

SEQ ID NO: 45333 - DNA, 20 bp, Artificial Sequence
  Description of Artificial Sequence: Synthetic oligonucleotide
  Target: SCN10A; (-) strand; PAM type: YTN; PAM sequence: CTC
actcccaggcttgagggcgc

SEQ ID NO: 45334 - DNA, 20 bp, Artificial Sequence
  Description of Artificial Sequence: Synthetic oligonucleotide
  Target: SCN10A; (-) strand; PAM type: YTN; PAM sequence: CTG
cctcactcccaggcttgagg

SEQ ID NO: 45335 - DNA, 20 bp, Artificial Sequence
  Description of Artificial Sequence: Synthetic oligonucleotide
  Target: SCN10A; (-) strand; PAM type: YTN; PAM sequence: TTG
ctgcctcactcccaggcttg

SEQ ID NO: 45336 - DNA, 20 bp, Artificial Sequence
  Description of Artificial Sequence: Synthetic oligonucleotide
  Target: SCN10A; (-) strand; PAM type: YTN; PAM sequence: CTT
gctgcctcactcccaggctt

SEQ ID NO: 45337 - DNA, 20 bp, Artificial Sequence
  Description of Artificial Sequence: Synthetic oligonucleotide
  Target: SCN10A; (-) strand; PAM type: YTN; PAM sequence: CTG
tgcccacttgctgcctcact

SEQ ID NO: 45338 - DNA, 20 bp, Artificial Sequence
  Description of Artificial Sequence: Synthetic oligonucleotide
  Target: SCN10A; (-) strand; PAM type: YTN; PAM sequence: CTG
ggatccacagaagacaaaca

SEQ ID NO: 45339 - DNA, 20 bp, Artificial Sequence
  Description of Artificial Sequence: Synthetic oligonucleotide
  Target: SCN10A; (-) strand; PAM type: YTN; PAM sequence: CTC
acctgggatccacagaagac

SEQ ID NO: 45340 - DNA, 20 bp, Artificial Sequence
  Description of Artificial Sequence: Synthetic oligonucleotide
  Target: SCN10A; (-) strand; PAM type: YTN; PAM sequence: TTG
agcgaacactcacctgggat

SEQ ID NO: 45341 - DNA, 20 bp, Artificial Sequence
  Description of Artificial Sequence: Synthetic oligonucleotide
  Target: SCN10A; (-) strand; PAM type: YTN; PAM sequence: TTA
gggccagaatccagttgagc

SEQ ID NO: 45342 - DNA, 20 bp, Artificial Sequence
  Description of Artificial Sequence: Synthetic oligonucleotide
  Target: SCN10A; (-) strand; PAM type: YTN; PAM sequence: TTA
attagggccagaatccagtt

SEQ ID NO: 45343 - DNA, 20 bp, Artificial Sequence
  Description of Artificial Sequence: Synthetic oligonucleotide
  Target: SCN10A; (-) strand; PAM type: YTN; PAM sequence: CTG
atgttaattagggccagaat

SEQ ID NO: 45344 - DNA, 20 bp, Artificial Sequence
  Description of Artificial Sequence: Synthetic oligonucleotide
  Target: SCN10A; (-) strand; PAM type: YTN; PAM sequence: CTC
acactgatgttaattagggc

SEQ ID NO: 45345 - DNA, 20 bp, Artificial Sequence
  Description of Artificial Sequence: Synthetic oligonucleotide
  Target: SCN10A; (-) strand; PAM type: YTN; PAM sequence: TTC
acagaaggtgaagggacagc

SEQ ID NO: 45346 - DNA, 20 bp, Artificial Sequence
  Description of Artificial Sequence: Synthetic oligonucleotide
  Target: SCN10A; (-) strand; PAM type: YTN; PAM sequence: CTT
cacagaaggtgaagggacag

SEQ ID NO: 45347 - DNA, 20 bp, Artificial Sequence
  Description of Artificial Sequence: Synthetic oligonucleotide
  Target: SCN10A; (-) strand; PAM type: YTN; PAM sequence: CTG
cttcacagaaggtgaaggga

SEQ ID NO: 45348 - DNA, 20 bp, Artificial Sequence
  Description of Artificial Sequence: Synthetic oligonucleotide
  Target: SCN10A; (-) strand; PAM type: YTN; PAM sequence: CTG
gaagaaccagatgactgctt

SEQ ID NO: 45349 - DNA, 20 bp, Artificial Sequence
  Description of Artificial Sequence: Synthetic oligonucleotide
  Target: SCN10A; (-) strand; PAM type: YTN; PAM sequence: CTG
gcagatgacctggaagaacc

SEQ ID NO: 45350 - DNA, 20 bp, Artificial Sequence
  Description of Artificial Sequence: Synthetic oligonucleotide
  Target: SCN10A; (-) strand; PAM type: YTN; PAM sequence: CTG
agctggcagatgacctggaa

SEQ ID NO: 45351 - DNA, 20 bp, Artificial Sequence
  Description of Artificial Sequence: Synthetic oligonucleotide
  Target: SCN10A; (-) strand; PAM type: YTN; PAM sequence: CTG
aggaagatccctgagctggc

SEQ ID NO: 45352 - DNA, 20 bp, Artificial Sequence
  Description of Artificial Sequence: Synthetic oligonucleotide
  Target: SCN10A; (-) strand; PAM type: YTN; PAM sequence: CTG
aggaaatcctgaggaagatc

SEQ ID NO: 45353 - DNA, 20 bp, Artificial Sequence
  Description of Artificial Sequence: Synthetic oligonucleotide
  Target: SCN10A; (-) strand; PAM type: YTN; PAM sequence: CTA
gatcctgaggaaatcctgag

SEQ ID NO: 45354 - DNA, 20 bp, Artificial Sequence
  Description of Artificial Sequence: Synthetic oligonucleotide
  Target: SCN10A; (-) strand; PAM type: YTN; PAM sequence: CTG
cctagatcctgaggaaatcc

SEQ ID NO: 45355 - DNA, 20 bp, Artificial Sequence
  Description of Artificial Sequence: Synthetic oligonucleotide
  Target: SCN10A; (-) strand; PAM type: YTN; PAM sequence: CTG
agggcagcacggtggactgc

SEQ ID NO: 45356 - DNA, 20 bp, Artificial Sequence
  Description of Artificial Sequence: Synthetic oligonucleotide
  Target: SCN10A; (-) strand; PAM type: YTN; PAM sequence: CTC
tgagggcagcacggtggact

SEQ ID NO: 45357 - DNA, 20 bp, Artificial Sequence
  Description of Artificial Sequence: Synthetic oligonucleotide
  Target: SCN10A; (-) strand; PAM type: YTN; PAM sequence: CTC
ctctgagggcagcacggtgg

SEQ ID NO: 45358 - DNA, 20 bp, Artificial Sequence
  Description of Artificial Sequence: Synthetic oligonucleotide
  Target: SCN10A; (-) strand; PAM type: YTN; PAM sequence: CTG
cagggagtggacgacacaag

SEQ ID NO: 45359 - DNA, 20 bp, Artificial Sequence
  Description of Artificial Sequence: Synthetic oligonucleotide
  Target: SCN10A; (-) strand; PAM type: YTN; PAM sequence: CTC
ccctgcagggagtggacgac

SEQ ID NO: 45360 - DNA, 20 bp, Artificial Sequence
  Description of Artificial Sequence: Synthetic oligonucleotide
  Target: SCN10A; (-) strand; PAM type: YTN; PAM sequence: TTC
tcccctgcagggagtggacg

SEQ ID NO: 45361 - DNA, 20 bp, Artificial Sequence
  Description of Artificial Sequence: Synthetic oligonucleotide
  Target: SCN10A; (-) strand; PAM type: YTN; PAM sequence: CTT
ctcccctgcagggagtggac

SEQ ID NO: 45362 - DNA, 20 bp, Artificial Sequence
  Description of Artificial Sequence: Synthetic oligonucleotide
  Target: SCN10A; (-) strand; PAM type: YTN; PAM sequence: CTG
ggcttctcccctgcagggag

SEQ ID NO: 45363 - DNA, 20 bp, Artificial Sequence
  Description of Artificial Sequence: Synthetic oligonucleotide
  Target: SCN10A; (-) strand; PAM type: YTN; PAM sequence: CTG
ccctgggcttctcccctgca

SEQ ID NO: 45364 - DNA, 20 bp, Artificial Sequence
  Description of Artificial Sequence: Synthetic oligonucleotide
  Target: SCN10A; (-) strand; PAM type: YTN; PAM sequence: TTC
actgccctgggcttctcccc

SEQ ID NO: 45365 - DNA, 20 bp, Artificial Sequence
  Description of Artificial Sequence: Synthetic oligonucleotide
  Target: SCN10A; (-) strand; PAM type: YTN; PAM sequence: TTC
cccgggccccgcggagagac

SEQ ID NO: 45366 - DNA, 20 bp, Artificial Sequence
  Description of Artificial Sequence: Synthetic oligonucleotide
  Target: SCN10A; (-) strand; PAM type: YTN; PAM sequence: CTG
cagtgaccgtgtgcaattcc

SEQ ID NO: 45367 - DNA, 20 bp, Artificial Sequence
  Description of Artificial Sequence: Synthetic oligonucleotide
  Target: SCN10A; (-) strand; PAM type: YTN; PAM sequence: TTG
aacctgcagtgaccgtgtgc

SEQ ID NO: 45368 - DNA, 20 bp, Artificial Sequence
  Description of Artificial Sequence: Synthetic oligonucleotide
  Target: SCN10A; (-) strand; PAM type: YTN; PAM sequence: CTG
gcgaggcaccaaacatgggt

SEQ ID NO: 45369 - DNA, 20 bp, Artificial Sequence
  Description of Artificial Sequence: Synthetic oligonucleotide
  Target: SCN10A; (-) strand; PAM type: YTN; PAM sequence: CTC
agctggcgaggcaccaaaca

SEQ ID NO: 45370 - DNA, 20 bp, Artificial Sequence
  Description of Artificial Sequence: Synthetic oligonucleotide
  Target: SCN10A; (-) strand; PAM type: YTN; PAM sequence: TTC
caggcctcagctggcgaggc

SEQ ID NO: 45371 - DNA, 20 bp, Artificial Sequence
  Description of Artificial Sequence: Synthetic oligonucleotide
  Target: SCN10A; (-) strand; PAM type: YTN; PAM sequence: CTC
cagggagaagagcagtgttc

SEQ ID NO: 45372 - DNA, 20 bp, Artificial Sequence
  Description of Artificial Sequence: Synthetic oligonucleotide
  Target: SCN10A; (-) strand; PAM type: YTN; PAM sequence: CTG
gggctccagggagaagagca

SEQ ID NO: 45373 - DNA, 20 bp, Artificial Sequence
  Description of Artificial Sequence: Synthetic oligonucleotide
  Target: SCN10A; (-) strand; PAM type: YTN; PAM sequence: CTC
tggggctccagggagaagag

SEQ ID NO: 45374 - DNA, 20 bp, Artificial Sequence
  Description of Artificial Sequence: Synthetic oligonucleotide
  Target: SCN10A; (-) strand; PAM type: YTN; PAM sequence: CTA
agcctctggggctccaggga

SEQ ID NO: 45375 - DNA, 20 bp, Artificial Sequence
  Description of Artificial Sequence: Synthetic oligonucleotide
  Target: SCN10A; (-) strand; PAM type: YTN; PAM sequence: CTC
acacagctaagcctctgggg

SEQ ID NO: 45376 - DNA, 20 bp, Artificial Sequence
  Description of Artificial Sequence: Synthetic oligonucleotide
  Target: SCN10A; (-) strand; PAM type: YTN; PAM sequence: TTA
cagtctcacacagctaagcc

SEQ ID NO: 45377 - DNA, 20 bp, Artificial Sequence
  Description of Artificial Sequence: Synthetic oligonucleotide
  Target: SCN10A; (-) strand; PAM type: YTN; PAM sequence: TTT
acagtctcacacagctaagc

SEQ ID NO: 45378 - DNA, 20 bp, Artificial Sequence
  Description of Artificial Sequence: Synthetic oligonucleotide
  Target: SCN10A; (-) strand; PAM type: YTN; PAM sequence: CTC
catcaggggccccgaaggtt

SEQ ID NO: 45379 - DNA, 20 bp, Artificial Sequence
  Description of Artificial Sequence: Synthetic oligonucleotide
  Target: SCN10A; (-) strand; PAM type: YTN; PAM sequence: TTG
ccagcactccatcaggggcc

SEQ ID NO: 45380 - DNA, 20 bp, Artificial Sequence
  Description of Artificial Sequence: Synthetic oligonucleotide
  Target: SCN10A; (-) strand; PAM type: YTN; PAM sequence: CTC
gggccattgccagcactcca

SEQ ID NO: 45381 - DNA, 20 bp, Artificial Sequence
  Description of Artificial Sequence: Synthetic oligonucleotide
  Target: SCN10A; (-) strand; PAM type: YTN; PAM sequence: TTA
cggtgtctcgggccattgcc

SEQ ID NO: 45382 - DNA, 20 bp, Artificial Sequence
  Description of Artificial Sequence: Synthetic oligonucleotide
  Target: SCN10A; (-) strand; PAM type: YTN; PAM sequence: TTA
tgggtgtaattacggtgtct

SEQ ID NO: 45383 - DNA, 20 bp, Artificial Sequence
  Description of Artificial Sequence: Synthetic oligonucleotide
  Target: SCN10A; (-) strand; PAM type: YTN; PAM sequence: CTG
agagtcgttatgggtgtaat

SEQ ID NO: 45384 - DNA, 20 bp, Artificial Sequence
  Description of Artificial Sequence: Synthetic oligonucleotide
  Target: SCN10A; (-) strand; PAM type: YTN; PAM sequence: TTC
aagcccagtgaatgctgaga

SEQ ID NO: 45385 - DNA, 20 bp, Artificial Sequence
  Description of Artificial Sequence: Synthetic oligonucleotide
  Target: SCN10A; (-) strand; PAM type: YTN; PAM sequence: TTA
aatattcaagcccagtgaat

SEQ ID NO: 45386 - DNA, 20 bp, Artificial Sequence
  Description of Artificial Sequence: Synthetic oligonucleotide
  Target: SCN10A; (-) strand; PAM type: YTN; PAM sequence: CTC
catgattaaatattcaagcc

SEQ ID NO: 45387 - DNA, 20 bp, Artificial Sequence
  Description of Artificial Sequence: Synthetic oligonucleotide
  Target: SCN10A; (-) strand; PAM type: YTN; PAM sequence: TTA
ctccatgattaaatattcaa

SEQ ID NO: 45388 - DNA, 20 bp, Artificial Sequence
  Description of Artificial Sequence: Synthetic oligonucleotide
  Target: SCN10A; (-) strand; PAM type: YTN; PAM sequence: CTG
cagcattactccatgattaa

SEQ ID NO: 45389 - DNA, 20 bp, Artificial Sequence
  Description of Artificial Sequence: Synthetic oligonucleotide
  Target: SCN10A; (-) strand; PAM type: YTN; PAM sequence: CTG
ccaggagggcagcaggcccc

SEQ ID NO: 45390 - DNA, 20 bp, Artificial Sequence
  Description of Artificial Sequence: Synthetic oligonucleotide
  Target: SCN10A; (-) strand; PAM type: YTN; PAM sequence: CTG
gagctgccaggagggcagca

SEQ ID NO: 45391 - DNA, 20 bp, Artificial Sequence
  Description of Artificial Sequence: Synthetic oligonucleotide
  Target: SCN10A; (-) strand; PAM type: YTN; PAM sequence: TTA
tagggctggagctgccagga

SEQ ID NO: 45392 - DNA, 20 bp, Artificial Sequence
  Description of Artificial Sequence: Synthetic oligonucleotide
  Target: SCN10A; (-) strand; PAM type: YTN; PAM sequence: CTG
gagacattatagggctggag

SEQ ID NO: 45393 - DNA, 20 bp, Artificial Sequence
  Description of Artificial Sequence: Synthetic oligonucleotide
  Target: SCN10A; (-) strand; PAM type: YTN; PAM sequence: TTC
atctggagacattatagggc

SEQ ID NO: 45394 - DNA, 20 bp, Artificial Sequence
  Description of Artificial Sequence: Synthetic oligonucleotide
  Target: SCN10A; (-) strand; PAM type: YTN; PAM sequence: TTG
aattcatctggagacattat

SEQ ID NO: 45395 - DNA, 20 bp, Artificial Sequence
  Description of Artificial Sequence: Synthetic oligonucleotide
  Target: SCN10A; (-) strand; PAM type: YTN; PAM sequence: CTA
attgaattcatctggagaca

SEQ ID NO: 45396 - DNA, 20 bp, Artificial Sequence
  Description of Artificial Sequence: Synthetic oligonucleotide
  Target: SCN10A; (-) strand; PAM type: YTN; PAM sequence: TTC
aacccctaattgaattcatc

SEQ ID NO: 45397 - DNA, 20 bp, Artificial Sequence
  Description of Artificial Sequence: Synthetic oligonucleotide
  Target: SCN10A; (-) strand; PAM type: YTN; PAM sequence: CTT
caacccctaattgaattcat

SEQ ID NO: 45398 - DNA, 20 bp, Artificial Sequence
  Description of Artificial Sequence: Synthetic oligonucleotide
  Target: SCN10A; (-) strand; PAM type: YTN; PAM sequence: CTA
atatgagagcaacttcaacc

SEQ ID NO: 45399 - DNA, 20 bp, Artificial Sequence
  Description of Artificial Sequence: Synthetic oligonucleotide
  Target: SCN10A; (-) strand; PAM type: YTN; PAM sequence: TTA
ctaatatgagagcaacttca

SEQ ID NO: 45400 - DNA, 20 bp, Artificial Sequence
  Description of Artificial Sequence: Synthetic oligonucleotide
  Target: SCN10A; (-) strand; PAM type: YTN; PAM sequence: TTT
actaatatgagagcaacttc

SEQ ID NO: 45401 - DNA, 20 bp, Artificial Sequence
  Description of Artificial Sequence: Synthetic oligonucleotide
  Target: SCN10A; (-) strand; PAM type: YTN; PAM sequence: CTA
tcaggtttactaatatgaga

SEQ ID NO: 45402 - DNA, 20 bp, Artificial Sequence
  Description of Artificial Sequence: Synthetic oligonucleotide
  Target: SCN10A; (-) strand; PAM type: YTN; PAM sequence: TTA
gcaaagctatcaggtttact

SEQ ID NO: 45403 - DNA, 20 bp, Artificial Sequence
  Description of Artificial Sequence: Synthetic oligonucleotide
  Target: SCN10A; (-) strand; PAM type: YTN; PAM sequence: TTG
ggtccattagcaaagctatc

SEQ ID NO: 45404 - DNA, 20 bp, Artificial Sequence
  Description of Artificial Sequence: Synthetic oligonucleotide
  Target: SCN10A; (-) strand; PAM type: YTN; PAM sequence: TTT
gggtccattagcaaagctat

SEQ ID NO: 45405 - DNA, 20 bp, Artificial Sequence
  Description of Artificial Sequence: Synthetic oligonucleotide
  Target: SCN10A; (-) strand; PAM type: YTN; PAM sequence: CTG
acagcgacaaatggggaccc

SEQ ID NO: 45406 - DNA, 20 bp, Artificial Sequence
  Description of Artificial Sequence: Synthetic oligonucleotide
  Target: SCN10A; (-) strand; PAM type: YTN; PAM sequence: CTA
ggcaggaggggcctgacagc

SEQ ID NO: 45407 - DNA, 20 bp, Artificial Sequence
  Description of Artificial Sequence: Synthetic oligonucleotide
  Target: SCN10A; (-) strand; PAM type: YTN; PAM sequence: TTG
tccatgaccccggctaggca

SEQ ID NO: 45408 - DNA, 20 bp, Artificial Sequence
  Description of Artificial Sequence: Synthetic oligonucleotide
  Target: SCN10A; (-) strand; PAM type: YTN; PAM sequence: CTT
gtccatgaccccggctaggc

SEQ ID NO: 45409 - DNA, 20 bp, Artificial Sequence
  Description of Artificial Sequence: Synthetic oligonucleotide
  Target: SCN10A; (-) strand; PAM type: YTN; PAM sequence: TTC
ttgtccatgaccccggctag

SEQ ID NO: 45410 - DNA, 20 bp, Artificial Sequence
  Description of Artificial Sequence: Synthetic oligonucleotide
  Target: SCN10A; (-) strand; PAM type: YTN; PAM sequence: TTT
cttgtccatgaccccggcta

SEQ ID NO: 45411 - DNA, 20 bp, Artificial Sequence
  Description of Artificial Sequence: Synthetic oligonucleotide
  Target: SCN10A; (-) strand; PAM type: YTN; PAM sequence: TTT
tcttgtccatgaccccggct

SEQ ID NO: 45412 - DNA, 20 bp, Artificial Sequence
  Description of Artificial Sequence: Synthetic oligonucleotide
  Target: SCN10A; (-) strand; PAM type: YTN; PAM sequence: TTG
ttttcttgtccatgaccccg

SEQ ID NO: 45413 - DNA, 20 bp, Artificial Sequence
  Description of Artificial Sequence: Synthetic oligonucleotide
  Target: SCN10A; (-) strand; PAM type: YTN; PAM sequence: TTT
gttttcttgtccatgacccc

SEQ ID NO: 45414 - DNA, 20 bp, Artificial Sequence
  Description of Artificial Sequence: Synthetic oligonucleotide
  Target: SCN10A; (-) strand; PAM type: YTN; PAM sequence: TTT
tgttttcttgtccatgaccc

SEQ ID NO: 45415 - DNA, 20 bp, Artificial Sequence
  Description of Artificial Sequence: Synthetic oligonucleotide
  Target: SCN10A; (-) strand; PAM type: YTN; PAM sequence: TTT
ttgttttcttgtccatgacc

SEQ ID NO: 45416 - DNA, 20 bp, Artificial Sequence
  Description of Artificial Sequence: Synthetic oligonucleotide
  Target: SCN10A; (-) strand; PAM type: YTN; PAM sequence: TTG
tttttgttttcttgtccatg

SEQ ID NO: 45417 - DNA, 20 bp, Artificial Sequence
  Description of Artificial Sequence: Synthetic oligonucleotide
  Target: SCN10A; (-) strand; PAM type: YTN; PAM sequence: TTT
gtttttgttttcttgtccat

SEQ ID NO: 45418 - DNA, 20 bp, Artificial Sequence
  Description of Artificial Sequence: Synthetic oligonucleotide
  Target: SCN10A; (-) strand; PAM type: YTN; PAM sequence: TTT
tgtttttgttttcttgtcca

SEQ ID NO: 45419 - DNA, 20 bp, Artificial Sequence
  Description of Artificial Sequence: Synthetic oligonucleotide
  Target: SCN10A; (-) strand; PAM type: YTN; PAM sequence: TTT
ttgtttttgttttcttgtcc

SEQ ID NO: 45420 - DNA, 20 bp, Artificial Sequence
  Description of Artificial Sequence: Synthetic oligonucleotide
  Target: SCN10A; (-) strand; PAM type: YTN; PAM sequence: TTT
tttgtttttgttttcttgtc

SEQ ID NO: 45421 - DNA, 20 bp, Artificial Sequence
  Description of Artificial Sequence: Synthetic oligonucleotide
  Target: SCN10A; (-) strand; PAM type: YTN; PAM sequence: TTG
gttttttgtttttgttttct

SEQ ID NO: 45422 - DNA, 20 bp, Artificial Sequence
  Description of Artificial Sequence: Synthetic oligonucleotide
  Target: SCN10A; (-) strand; PAM type: YTN; PAM sequence: CTG
ggtgttggttttttgttttt

SEQ ID NO: 45423 - DNA, 20 bp, Artificial Sequence
  Description of Artificial Sequence: Synthetic oligonucleotide
  Target: SCN10A; (-) strand; PAM type: YTN; PAM sequence: TTC
tgggtgttggttttttgttt

SEQ ID NO: 45424 - DNA, 20 bp, Artificial Sequence
  Description of Artificial Sequence: Synthetic oligonucleotide
  Target: SCN10A; (-) strand; PAM type: YTN; PAM sequence: CTT
ctgggtgttggttttttgtt

SEQ ID NO: 45425 - DNA, 20 bp, Artificial Sequence
  Description of Artificial Sequence: Synthetic oligonucleotide
  Target: SCN10A; (-) strand; PAM type: YTN; PAM sequence: TTC
agtacacaacttctgggtgt

SEQ ID NO: 45426 - DNA, 20 bp, Artificial Sequence
  Description of Artificial Sequence: Synthetic oligonucleotide
  Target: SCN10A; (-) strand; PAM type: YTN; PAM sequence: TTT
cagtacacaacttctgggtg

SEQ ID NO: 45427 - DNA, 20 bp, Artificial Sequence
  Description of Artificial Sequence: Synthetic oligonucleotide
  Target: SCN10A; (-) strand; PAM type: YTN; PAM sequence: TTT
tcagtacacaacttctgggt

SEQ ID NO: 45428 - DNA, 20 bp, Artificial Sequence
  Description of Artificial Sequence: Synthetic oligonucleotide
  Target: SCN10A; (-) strand; PAM type: YTN; PAM sequence: CTC
aatgttttcagtacacaact

SEQ ID NO: 45429 - DNA, 20 bp, Artificial Sequence
  Description of Artificial Sequence: Synthetic oligonucleotide
  Target: SCN10A; (-) strand; PAM type: YTN; PAM sequence: CTA
ctcaatgttttcagtacaca

SEQ ID NO: 45430 - DNA, 20 bp, Artificial Sequence
  Description of Artificial Sequence: Synthetic oligonucleotide
  Target: SCN10A; (-) strand; PAM type: YTN; PAM sequence: TTG
tccctactcaatgttttcag

SEQ ID NO: 45431 - DNA, 20 bp, Artificial Sequence
  Description of Artificial Sequence: Synthetic oligonucleotide
  Target: SCN10A; (-) strand; PAM type: YTN; PAM sequence: CTA
gttgtccctactcaatgttt

SEQ ID NO: 45432 - DNA, 20 bp, Artificial Sequence
  Description of Artificial Sequence: Synthetic oligonucleotide
  Target: SCN10A; (-) strand; PAM type: YTN; PAM sequence: CTG
gctagttgtccctactcaat

SEQ ID NO: 45433 - DNA, 20 bp, Artificial Sequence
  Description of Artificial Sequence: Synthetic oligonucleotide
  Target: SCN10A; (-) strand; PAM type: YTN; PAM sequence: CTC
ccctggctagttgtccctac

SEQ ID NO: 45434 - DNA, 20 bp, Artificial Sequence
  Description of Artificial Sequence: Synthetic oligonucleotide
  Target: SCN10A; (-) strand; PAM type: YTN; PAM sequence: TTC
caaggactcccctggctagt

SEQ ID NO: 45435 - DNA, 20 bp, Artificial Sequence
  Description of Artificial Sequence: Synthetic oligonucleotide
  Target: SCN10A; (-) strand; PAM type: YTN; PAM sequence: TTC
ccaaatgttccaaggactcc

SEQ ID NO: 45436 - DNA, 20 bp, Artificial Sequence
  Description of Artificial Sequence: Synthetic oligonucleotide
  Target: SCN10A; (-) strand; PAM type: YTN; PAM sequence: CTT
cccaaatgttccaaggactc

SEQ ID NO: 45437 - DNA, 20 bp, Artificial Sequence
  Description of Artificial Sequence: Synthetic oligonucleotide
  Target: SCN10A; (-) strand; PAM type: YTN; PAM sequence: TTC
ttcccaaatgttccaaggac

SEQ ID NO: 45438 - DNA, 20 bp, Artificial Sequence
  Description of Artificial Sequence: Synthetic oligonucleotide
  Target: SCN10A; (-) strand; PAM type: YTN; PAM sequence: CTT
cttcccaaatgttccaagga

SEQ ID NO: 45439 - DNA, 20 bp, Artificial Sequence
  Description of Artificial Sequence: Synthetic oligonucleotide
  Target: SCN10A; (-) strand; PAM type: YTN; PAM sequence: CTG
cacgtggatgtcatgcttct

SEQ ID NO: 45440 - DNA, 20 bp, Artificial Sequence
  Description of Artificial Sequence: Synthetic oligonucleotide
  Target: SCN10A; (-) strand; PAM type: YTN; PAM sequence: TTC
tgcacgtggatgtcatgctt

SEQ ID NO: 45441 - DNA, 20 bp, Artificial Sequence
  Description of Artificial Sequence: Synthetic oligonucleotide
  Target: SCN10A; (-) strand; PAM type: YTN; PAM sequence: CTG
tcacattctgcacgtggatg

SEQ ID NO: 45442 - DNA, 20 bp, Artificial Sequence
  Description of Artificial Sequence: Synthetic oligonucleotide
  Target: SCN10A; (-) strand; PAM type: YTN; PAM sequence: CTG
ggtgagggctgtcacattct

SEQ ID NO: 45443 - DNA, 20 bp, Artificial Sequence
  Description of Artificial Sequence: Synthetic oligonucleotide
  Target: SCN10A; (-) strand; PAM type: YTN; PAM sequence: TTC
ccactgggtgagggctgtca

SEQ ID NO: 45444 - DNA, 20 bp, Artificial Sequence
  Description of Artificial Sequence: Synthetic oligonucleotide
  Target: SCN10A; (-) strand; PAM type: YTN; PAM sequence: TTG
gttcccactgggtgagggct

SEQ ID NO: 45445 - DNA, 20 bp, Artificial Sequence
  Description of Artificial Sequence: Synthetic oligonucleotide
  Target: SCN10A; (-) strand; PAM type: YTN; PAM sequence: CTT
ggttcccactgggtgagggc

SEQ ID NO: 45446 - DNA, 20 bp, Artificial Sequence
  Description of Artificial Sequence: Synthetic oligonucleotide
  Target: SCN10A; (-) strand; PAM type: YTN; PAM sequence: CTG
tgggtgaacagaagccgctt

SEQ ID NO: 45447 - DNA, 20 bp, Artificial Sequence
  Description of Artificial Sequence: Synthetic oligonucleotide
  Target: SCN10A; (-) strand; PAM type: YTN; PAM sequence: TTG
ggggctgtgggtgaacagaa

SEQ ID NO: 45448 - DNA, 20 bp, Artificial Sequence
  Description of Artificial Sequence: Synthetic oligonucleotide
  Target: SCN10A; (-) strand; PAM type: YTN; PAM sequence: TTT
gggggctgtgggtgaacaga

SEQ ID NO: 45449 - DNA, 20 bp, Artificial Sequence
  Description of Artificial Sequence: Synthetic oligonucleotide
  Target: SCN10A; (-) strand; PAM type: YTN; PAM sequence: CTG
ggacgggatttgggggctgt

SEQ ID NO: 45450 - DNA, 20 bp, Artificial Sequence
  Description of Artificial Sequence: Synthetic oligonucleotide
  Target: SCN10A; (-) strand; PAM type: YTN; PAM sequence: CTG
accacagcagggtaagataa

SEQ ID NO: 45451 - DNA, 20 bp, Artificial Sequence
  Description of Artificial Sequence: Synthetic oligonucleotide
  Target: SCN10A; (-) strand; PAM type: YTN; PAM sequence: CTA
ggcaaggctgaccacagcag

SEQ ID NO: 45452 - DNA, 20 bp, Artificial Sequence
  Description of Artificial Sequence: Synthetic oligonucleotide
  Target: SCN10A; (-) strand; PAM type: YTN; PAM sequence: CTG
tgtgccctaggcaaggctga

SEQ ID NO: 45453 - DNA, 20 bp, Artificial Sequence
  Description of Artificial Sequence: Synthetic oligonucleotide
  Target: SCN10A; (-) strand; PAM type: YTN; PAM sequence: CTG
gctgtgtgccctaggcaagg

SEQ ID NO: 45454 - DNA, 20 bp, Artificial Sequence
  Description of Artificial Sequence: Synthetic oligonucleotide
  Target: SCN10A; (-) strand; PAM type: YTN; PAM sequence: CTA
ctggctgtgtgccctaggca

SEQ ID NO: 45455 - DNA, 20 bp, Artificial Sequence
  Description of Artificial Sequence: Synthetic oligonucleotide
  Target: SCN10A; (-) strand; PAM type: YTN; PAM sequence: TTG
aagaatgtcagctactggct

SEQ ID NO: 45456 - DNA, 20 bp, Artificial Sequence
  Description of Artificial Sequence: Synthetic oligonucleotide
  Target: SCN10A; (-) strand; PAM type: YTN; PAM sequence: CTT
gaagaatgtcagctactggc

SEQ ID NO: 45457 - DNA, 20 bp, Artificial Sequence
  Description of Artificial Sequence: Synthetic oligonucleotide
  Target: SCN10A; (-) strand; PAM type: YTN; PAM sequence: TTC
agcttgaagaatgtcagcta

SEQ ID NO: 45458 - DNA, 20 bp, Artificial Sequence
  Description of Artificial Sequence: Synthetic oligonucleotide
  Target: SCN10A; (-) strand; PAM type: YTN; PAM sequence: CTT
cagcttgaagaatgtcagct

SEQ ID NO: 45459 - DNA, 20 bp, Artificial Sequence
  Description of Artificial Sequence: Synthetic oligonucleotide
  Target: SCN10A; (-) strand; PAM type: YTN; PAM sequence: TTA
tcaagcccttcagcttgaag

SEQ ID NO: 45460 - DNA, 20 bp, Artificial Sequence
  Description of Artificial Sequence: Synthetic oligonucleotide
  Target: SCN10A; (-) strand; PAM type: YTN; PAM sequence: TTC
atccccaaagttatcaagcc

SEQ ID NO: 45461 - DNA, 20 bp, Artificial Sequence
  Description of Artificial Sequence: Synthetic oligonucleotide
  Target: SCN10A; (-) strand; PAM type: YTN; PAM sequence: CTC
aacagagataaggaagtcat

SEQ ID NO: 45462 - DNA, 20 bp, Artificial Sequence
  Description of Artificial Sequence: Synthetic oligonucleotide
  Target: SCN10A; (-) strand; PAM type: YTN; PAM sequence: CTG
ggctcaacagagataaggaa

SEQ ID NO: 45463 - DNA, 20 bp, Artificial Sequence
  Description of Artificial Sequence: Synthetic oligonucleotide
  Target: SCN10A; (-) strand; PAM type: YTN; PAM sequence: TTG
tgacaggcactgggctcaac

SEQ ID NO: 45464 - DNA, 20 bp, Artificial Sequence
  Description of Artificial Sequence: Synthetic oligonucleotide
  Target: SCN10A; (-) strand; PAM type: YTN; PAM sequence: TTT
gtgacaggcactgggctcaa

SEQ ID NO: 45465 - DNA, 20 bp, Artificial Sequence
  Description of Artificial Sequence: Synthetic oligonucleotide
  Target: SCN10A; (-) strand; PAM type: YTN; PAM sequence: CTT
tgtgacaggcactgggctca

SEQ ID NO: 45466 - DNA, 20 bp, Artificial Sequence
  Description of Artificial Sequence: Synthetic oligonucleotide
  Target: SCN10A; (-) strand; PAM type: YTN; PAM sequence: CTG
actttgtgacaggcactggg

SEQ ID NO: 45467 - DNA, 20 bp, Artificial Sequence
  Description of Artificial Sequence: Synthetic oligonucleotide
  Target: SCN10A; (-) strand; PAM type: YTN; PAM sequence: CTG
agtgctgactttgtgacagg

SEQ ID NO: 45468 - DNA, 20 bp, Artificial Sequence
  Description of Artificial Sequence: Synthetic oligonucleotide
  Target: SCN10A; (-) strand; PAM type: YTN; PAM sequence: CTA
gccactgagtgctgactttg

SEQ ID NO: 45469 - DNA, 20 bp, Artificial Sequence
  Description of Artificial Sequence: Synthetic oligonucleotide
  Target: SCN10A; (-) strand; PAM type: YTN; PAM sequence: TTG
acacctagccactgagtgct

SEQ ID NO: 45470 - DNA, 20 bp, Artificial Sequence
  Description of Artificial Sequence: Synthetic oligonucleotide
  Target: SCN10A; (-) strand; PAM type: YTN; PAM sequence: TTT
gacacctagccactgagtgc

SEQ ID NO: 45471 - DNA, 20 bp, Artificial Sequence
  Description of Artificial Sequence: Synthetic oligonucleotide
  Target: SCN10A; (-) strand; PAM type: YTN; PAM sequence: TTA
atttgacacctagccactga

SEQ ID NO: 45472 - DNA, 20 bp, Artificial Sequence
  Description of Artificial Sequence: Synthetic oligonucleotide
  Target: SCN10A; (-) strand; PAM type: YTN; PAM sequence: TTT
aatttgacacctagccactg

SEQ ID NO: 45473 - DNA, 20 bp, Artificial Sequence
  Description of Artificial Sequence: Synthetic oligonucleotide
  Target: SCN10A; (-) strand; PAM type: YTN; PAM sequence: TTC
aagaatttaatttgacacct

SEQ ID NO: 45474 - DNA, 20 bp, Artificial Sequence
  Description of Artificial Sequence: Synthetic oligonucleotide
  Target: SCN10A; (-) strand; PAM type: YTN; PAM sequence: TTC
aattcaagaatttaatttga

SEQ ID NO: 45475 - DNA, 20 bp, Artificial Sequence
  Description of Artificial Sequence: Synthetic oligonucleotide
  Target: SCN10A; (-) strand; PAM type: YTN; PAM sequence: CTT
caattcaagaatttaatttg

SEQ ID NO: 45476 - DNA, 20 bp, Artificial Sequence
  Description of Artificial Sequence: Synthetic oligonucleotide
  Target: SCN10A; (-) strand; PAM type: YTN; PAM sequence: CTG
ccttcaattcaagaatttaa

SEQ ID NO: 45477 - DNA, 20 bp, Artificial Sequence
  Description of Artificial Sequence: Synthetic oligonucleotide
  Target: SCN10A; (-) strand; PAM type: YTN; PAM sequence: TTA
ataacactgccttcaattca

SEQ ID NO: 45478 - DNA, 20 bp, Artificial Sequence
  Description of Artificial Sequence: Synthetic oligonucleotide
  Target: SCN10A; (-) strand; PAM type: YTN; PAM sequence: TTT
aataacactgccttcaattc

SEQ ID NO: 45479 - DNA, 20 bp, Artificial Sequence
  Description of Artificial Sequence: Synthetic oligonucleotide
  Target: SCN10A; (-) strand; PAM type: YTN; PAM sequence: CTT
taataacactgccttcaatt

SEQ ID NO: 45480 - DNA, 20 bp, Artificial Sequence
  Description of Artificial Sequence: Synthetic oligonucleotide
  Target: SCN10A; (-) strand; PAM type: YTN; PAM sequence: TTA
gcatctttaataacactgcc

SEQ ID NO: 45481 - DNA, 20 bp, Artificial Sequence
  Description of Artificial Sequence: Synthetic oligonucleotide
  Target: SCN10A; (-) strand; PAM type: YTN; PAM sequence: TTT
agcatctttaataacactgc

SEQ ID NO: 45482 - DNA, 20 bp, Artificial Sequence
  Description of Artificial Sequence: Synthetic oligonucleotide
  Target: SCN10A; (-) strand; PAM type: YTN; PAM sequence: CTA
taaaagtttagcatctttaa

SEQ ID NO: 45483 - DNA, 20 bp, Artificial Sequence
  Description of Artificial Sequence: Synthetic oligonucleotide
  Target: SCN10A; (-) strand; PAM type: YTN; PAM sequence: CTA
tagggaaagaggcatctata

SEQ ID NO: 45484 - DNA, 20 bp, Artificial Sequence
  Description of Artificial Sequence: Synthetic oligonucleotide
  Target: SCN10A; (-) strand; PAM type: YTN; PAM sequence: TTG
aaggaaacaagctataggga

SEQ ID NO: 45485 - DNA, 20 bp, Artificial Sequence
  Description of Artificial Sequence: Synthetic oligonucleotide
  Target: SCN10A; (-) strand; PAM type: YTN; PAM sequence: CTT
gaaggaaacaagctataggg

SEQ ID NO: 45486 - DNA, 20 bp, Artificial Sequence
  Description of Artificial Sequence: Synthetic oligonucleotide
  Target: SCN10A; (-) strand; PAM type: YTN; PAM sequence: TTA
caaatcttgaaggaaacaag

SEQ ID NO: 45487 - DNA, 20 bp, Artificial Sequence
  Description of Artificial Sequence: Synthetic oligonucleotide
  Target: SCN10A; (-) strand; PAM type: YTN; PAM sequence: CTT
acaaatcttgaaggaaacaa

SEQ ID NO: 45488 - DNA, 20 bp, Artificial Sequence
  Description of Artificial Sequence: Synthetic oligonucleotide
  Target: SCN10A; (-) strand; PAM type: YTN; PAM sequence: TTC
acttacaaatcttgaaggaa

SEQ ID NO: 45489 - DNA, 20 bp, Artificial Sequence
  Description of Artificial Sequence: Synthetic oligonucleotide
  Target: SCN10A; (-) strand; PAM type: YTN; PAM sequence: TTT
cacttacaaatcttgaagga

SEQ ID NO: 45490 - DNA, 20 bp, Artificial Sequence
  Description of Artificial Sequence: Synthetic oligonucleotide
  Target: SCN10A; (-) strand; PAM type: YTN; PAM sequence: TTA
tacaaggtaaaaataaatgt

SEQ ID NO: 45491 - DNA, 20 bp, Artificial Sequence
  Description of Artificial Sequence: Synthetic oligonucleotide
  Target: SCN10A; (-) strand; PAM type: YTN; PAM sequence: CTT
atacaaggtaaaaataaatg

SEQ ID NO: 45492 - DNA, 20 bp, Artificial Sequence
  Description of Artificial Sequence: Synthetic oligonucleotide
  Target: SCN10A; (-) strand; PAM type: YTN; PAM sequence: TTG
tcttatacaaggtaaaaata

SEQ ID NO: 45493 - DNA, 20 bp, Artificial Sequence
  Description of Artificial Sequence: Synthetic oligonucleotide
  Target: SCN10A; (-) strand; PAM type: YTN; PAM sequence: TTA
ggattgtcttatacaaggta

SEQ ID NO: 45494 - DNA, 20 bp, Artificial Sequence
  Description of Artificial Sequence: Synthetic oligonucleotide
  Target: SCN10A; (-) strand; PAM type: YTN; PAM sequence: TTT
aggattgtcttatacaaggt

SEQ ID NO: 45495 - DNA, 20 bp, Artificial Sequence
  Description of Artificial Sequence: Synthetic oligonucleotide
  Target: SCN10A; (-) strand; PAM type: YTN; PAM sequence: TTA
gaggtttaggattgtcttat

SEQ ID NO: 45496 - DNA, 20 bp, Artificial Sequence
  Description of Artificial Sequence: Synthetic oligonucleotide
  Target: SCN10A; (-) strand; PAM type: YTN; PAM sequence: CTG
gaagattagaggtttaggat

SEQ ID NO: 45497 - DNA, 20 bp, Artificial Sequence
  Description of Artificial Sequence: Synthetic oligonucleotide
  Target: SCN10A; (-) strand; PAM type: YTN; PAM sequence: CTG
agctggaagattagaggttt

SEQ ID NO: 45498 - DNA, 20 bp, Artificial Sequence
  Description of Artificial Sequence: Synthetic oligonucleotide
  Target: SCN10A; (-) strand; PAM type: YTN; PAM sequence: CTC
acagagactgagctggaaga

SEQ ID NO: 45499 - DNA, 20 bp, Artificial Sequence
  Description of Artificial Sequence: Synthetic oligonucleotide
  Target: SCN10A; (-) strand; PAM type: YTN; PAM sequence: CTA
taggtgagtagtgaagtgac

SEQ ID NO: 45500 - DNA, 20 bp, Artificial Sequence
  Description of Artificial Sequence: Synthetic oligonucleotide
  Target: SCN10A; (-) strand; PAM type: YTN; PAM sequence: CTC
tataggtgagtagtgaagtg

SEQ ID NO: 45501 - DNA, 20 bp, Artificial Sequence
  Description of Artificial Sequence: Synthetic oligonucleotide
  Target: SCN10A; (-) strand; PAM type: YTN; PAM sequence: CTC
tctataggtgagtagtgaag

SEQ ID NO: 45502 - DNA, 20 bp, Artificial Sequence
  Description of Artificial Sequence: Synthetic oligonucleotide
  Target: SCN10A; (-) strand; PAM type: YTN; PAM sequence: CTA
gggagaggctctctataggt

SEQ ID NO: 45503 - DNA, 20 bp, Artificial Sequence
  Description of Artificial Sequence: Synthetic oligonucleotide
  Target: SCN10A; (-) strand; PAM type: YTN; PAM sequence: CTG
gggctagggagaggctctct

SEQ ID NO: 45504 - DNA, 20 bp, Artificial Sequence
  Description of Artificial Sequence: Synthetic oligonucleotide
  Target: SCN10A; (-) strand; PAM type: YTN; PAM sequence: CTA
ggcaaaagtagcctggggct

SEQ ID NO: 45505 - DNA, 20 bp, Artificial Sequence
  Description of Artificial Sequence: Synthetic oligonucleotide
  Target: SCN10A; (-) strand; PAM type: YTN; PAM sequence: CTC
taggcaaaagtagcctgggg

SEQ ID NO: 45506 - DNA, 20 bp, Artificial Sequence
  Description of Artificial Sequence: Synthetic oligonucleotide
  Target: SCN10A; (-) strand; PAM type: YTN; PAM sequence: TTC
tctaggcaaaagtagcctgg

SEQ ID NO: 45507 - DNA, 20 bp, Artificial Sequence
  Description of Artificial Sequence: Synthetic oligonucleotide
  Target: SCN10A; (-) strand; PAM type: YTN; PAM sequence: TTT
ctctaggcaaaagtagcctg

SEQ ID NO: 45508 - DNA, 20 bp, Artificial Sequence
  Description of Artificial Sequence: Synthetic oligonucleotide
  Target: SCN10A; (-) strand; PAM type: YTN; PAM sequence: TTT
tctctaggcaaaagtagcct

SEQ ID NO: 45509 - DNA, 20 bp, Artificial Sequence
  Description of Artificial Sequence: Synthetic oligonucleotide
  Target: SCN10A; (-) strand; PAM type: YTN; PAM sequence: TTG
tccacatcattttctctagg

SEQ ID NO: 45510 - DNA, 20 bp, Artificial Sequence
  Description of Artificial Sequence: Synthetic oligonucleotide
  Target: SCN10A; (-) strand; PAM type: YTN; PAM sequence: TTT
gtccacatcattttctctag

SEQ ID NO: 45511 - DNA, 20 bp, Artificial Sequence
  Description of Artificial Sequence: Synthetic oligonucleotide
  Target: SCN10A; (-) strand; PAM type: YTN; PAM sequence: TTT
tgtccacatcattttctcta

SEQ ID NO: 45512 - DNA, 20 bp, Artificial Sequence
  Description of Artificial Sequence: Synthetic oligonucleotide
  Target: SCN10A; (-) strand; PAM type: YTN; PAM sequence: CTT
ttgtccacatcattttctct

SEQ ID NO: 45513 - DNA, 20 bp, Artificial Sequence
  Description of Artificial Sequence: Synthetic oligonucleotide
  Target: SCN10A; (-) strand; PAM type: YTN; PAM sequence: TTC
ttttgtccacatcattttct

SEQ ID NO: 45514 - DNA, 20 bp, Artificial Sequence
  Description of Artificial Sequence: Synthetic oligonucleotide
  Target: SCN10A; (-) strand; PAM type: YTN; PAM sequence: TTT
cttttgtccacatcattttc

SEQ ID NO: 45515 - DNA, 20 bp, Artificial Sequence
  Description of Artificial Sequence: Synthetic oligonucleotide
  Target: SCN10A; (-) strand; PAM type: YTN; PAM sequence: CTT
tcttttgtccacatcatttt

SEQ ID NO: 45516 - DNA, 20 bp, Artificial Sequence
  Description of Artificial Sequence: Synthetic oligonucleotide
  Target: SCN10A; (-) strand; PAM type: YTN; PAM sequence: CTC
ccccactttcttttgtccac

SEQ ID NO: 45517 - DNA, 20 bp, Artificial Sequence
  Description of Artificial Sequence: Synthetic oligonucleotide
  Target: SCN10A; (-) strand; PAM type: YTN; PAM sequence: TTC
tcccccactttcttttgtcc

SEQ ID NO: 45518 - DNA, 20 bp, Artificial Sequence
  Description of Artificial Sequence: Synthetic oligonucleotide
  Target: SCN10A; (-) strand; PAM type: YTN; PAM sequence: TTG
tgattctcccccactttctt

SEQ ID NO: 45519 - DNA, 20 bp, Artificial Sequence
  Description of Artificial Sequence: Synthetic oligonucleotide
  Target: SCN10A; (-) strand; PAM type: YTN; PAM sequence: CTT
gtgattctcccccactttct

SEQ ID NO: 45520 - DNA, 20 bp, Artificial Sequence
  Description of Artificial Sequence: Synthetic oligonucleotide
  Target: SCN10A; (-) strand; PAM type: YTN; PAM sequence: TTC
ccttgtgattctcccccact

SEQ ID NO: 45521 - DNA, 20 bp, Artificial Sequence
  Description of Artificial Sequence: Synthetic oligonucleotide
  Target: SCN10A; (-) strand; PAM type: YTN; PAM sequence: TTT
cccttgtgattctcccccac

SEQ ID NO: 45522 - DNA, 20 bp, Artificial Sequence
  Description of Artificial Sequence: Synthetic oligonucleotide
  Target: SCN10A; (-) strand; PAM type: YTN; PAM sequence: TTT
tcccttgtgattctccccca

SEQ ID NO: 45523 - DNA, 20 bp, Artificial Sequence
  Description of Artificial Sequence: Synthetic oligonucleotide
  Target: SCN10A; (-) strand; PAM type: YTN; PAM sequence: CTC
acagatgaagaagttttccc

SEQ ID NO: 45524 - DNA, 20 bp, Artificial Sequence
  Description of Artificial Sequence: Synthetic oligonucleotide
  Target: SCN10A; (-) strand; PAM type: YTN; PAM sequence: TTG
gaggtgctcacagatgaaga

SEQ ID NO: 45525 - DNA, 20 bp, Artificial Sequence
  Description of Artificial Sequence: Synthetic oligonucleotide
  Target: SCN10A; (-) strand; PAM type: YTN; PAM sequence: TTC
agagccagcaaataagagtt

SEQ ID NO: 45526 - DNA, 20 bp, Artificial Sequence
  Description of Artificial Sequence: Synthetic oligonucleotide
  Target: SCN10A; (-) strand; PAM type: YTN; PAM sequence: TTT
cagagccagcaaataagagt

SEQ ID NO: 45527 - DNA, 20 bp, Artificial Sequence
  Description of Artificial Sequence: Synthetic oligonucleotide
  Target: SCN10A; (-) strand; PAM type: YTN; PAM sequence: CTT
tcagagccagcaaataagag

SEQ ID NO: 45528 - DNA, 20 bp, Artificial Sequence
  Description of Artificial Sequence: Synthetic oligonucleotide
  Target: SCN10A; (-) strand; PAM type: YTN; PAM sequence: CTG
agacaaagtaagtgcccagg

SEQ ID NO: 45529 - DNA, 20 bp, Artificial Sequence
  Description of Artificial Sequence: Synthetic oligonucleotide
  Target: SCN10A; (-) strand; PAM type: YTN; PAM sequence: CTG
cctgagacaaagtaagtgcc

SEQ ID NO: 45530 - DNA, 20 bp, Artificial Sequence
  Description of Artificial Sequence: Synthetic oligonucleotide
  Target: SCN10A; (-) strand; PAM type: YTN; PAM sequence: TTA
ggtcctgcctgagacaaagt

SEQ ID NO: 45531 - DNA, 20 bp, Artificial Sequence
  Description of Artificial Sequence: Synthetic oligonucleotide
  Target: SCN10A; (-) strand; PAM type: YTN; PAM sequence: TTT
aggtcctgcctgagacaaag

SEQ ID NO: 45532 - DNA, 20 bp, Artificial Sequence
  Description of Artificial Sequence: Synthetic oligonucleotide
  Target: SCN10A; (-) strand; PAM type: YTN; PAM sequence: TTG
tcaaatgtttaggtcctgcc

SEQ ID NO: 45533 - DNA, 20 bp, Artificial Sequence
  Description of Artificial Sequence: Synthetic oligonucleotide
  Target: SCN10A; (-) strand; PAM type: YTN; PAM sequence: CTT
gtcaaatgtttaggtcctgc

SEQ ID NO: 45534 - DNA, 20 bp, Artificial Sequence
  Description of Artificial Sequence: Synthetic oligonucleotide
  Target: SCN10A; (-) strand; PAM type: YTN; PAM sequence: CTG
cttgtcaaatgtttaggtcc

SEQ ID NO: 45535 - DNA, 20 bp, Artificial Sequence
  Description of Artificial Sequence: Synthetic oligonucleotide
  Target: SCN10A; (-) strand; PAM type: YTN; PAM sequence: TTA
aatgagatgctgcttgtcaa

SEQ ID NO: 45536 - DNA, 20 bp, Artificial Sequence
  Description of Artificial Sequence: Synthetic oligonucleotide
  Target: SCN10A; (-) strand; PAM type: YTN; PAM sequence: CTT
aaatgagatgctgcttgtca

SEQ ID NO: 45537 - DNA, 20 bp, Artificial Sequence
  Description of Artificial Sequence: Synthetic oligonucleotide
  Target: SCN10A; (-) strand; PAM type: YTN; PAM sequence: TTG
aagcttaaatgagatgctgc

SEQ ID NO: 45538 - DNA, 20 bp, Artificial Sequence
  Description of Artificial Sequence: Synthetic oligonucleotide
  Target: SCN10A; (-) strand; PAM type: YTN; PAM sequence: TTT
gaagcttaaatgagatgctg

SEQ ID NO: 45539 - DNA, 20 bp, Artificial Sequence
  Description of Artificial Sequence: Synthetic oligonucleotide
  Target: SCN10A; (-) strand; PAM type: YTN; PAM sequence: TTT
tgaagcttaaatgagatgct

SEQ ID NO: 45540 - DNA, 20 bp, Artificial Sequence
  Description of Artificial Sequence: Synthetic oligonucleotide
  Target: SCN10A; (-) strand; PAM type: YTN; PAM sequence: TTA
ttttgaagcttaaatgagat

SEQ ID NO: 45541 - DNA, 20 bp, Artificial Sequence
  Description of Artificial Sequence: Synthetic oligonucleotide
  Target: SCN10A; (-) strand; PAM type: YTN; PAM sequence: TTG
gtaggattattttgaagctt

SEQ ID NO: 45542 - DNA, 20 bp, Artificial Sequence
  Description of Artificial Sequence: Synthetic oligonucleotide
  Target: SCN10A; (-) strand; PAM type: YTN; PAM sequence: CTT
ggtaggattattttgaagct

SEQ ID NO: 45543 - DNA, 20 bp, Artificial Sequence
  Description of Artificial Sequence: Synthetic oligonucleotide
  Target: SCN10A; (-) strand; PAM type: YTN; PAM sequence: CTA
cttggtaggattattttgaa

SEQ ID NO: 45544 - DNA, 20 bp, Artificial Sequence
  Description of Artificial Sequence: Synthetic oligonucleotide
  Target: SCN10A; (-) strand; PAM type: YTN; PAM sequence: CTG
aatggtaatgcctacttggt

SEQ ID NO: 45545 - DNA, 20 bp, Artificial Sequence
  Description of Artificial Sequence: Synthetic oligonucleotide
  Target: SCN10A; (-) strand; PAM type: YTN; PAM sequence: CTA
tgaaactgaatggtaatgcc

SEQ ID NO: 45546 - DNA, 20 bp, Artificial Sequence
  Description of Artificial Sequence: Synthetic oligonucleotide
  Target: SCN10A; (-) strand; PAM type: YTN; PAM sequence: TTC
atctatgaaactgaatggta

SEQ ID NO: 45547 - DNA, 20 bp, Artificial Sequence
  Description of Artificial Sequence: Synthetic oligonucleotide
  Target: SCN10A; (-) strand; PAM type: YTN; PAM sequence: TTA
ttcatctatgaaactgaatg

SEQ ID NO: 45548 - DNA, 20 bp, Artificial Sequence
  Description of Artificial Sequence: Synthetic oligonucleotide
  Target: SCN10A; (-) strand; PAM type: YTN; PAM sequence: TTT
attcatctatgaaactgaat

SEQ ID NO: 45549 - DNA, 20 bp, Artificial Sequence
  Description of Artificial Sequence: Synthetic oligonucleotide
  Target: SCN10A; (-) strand; PAM type: YTN; PAM sequence: CTG
agccgccatttattcatcta

SEQ ID NO: 45550 - DNA, 20 bp, Artificial Sequence
  Description of Artificial Sequence: Synthetic oligonucleotide
  Target: SCN10A; (-) strand; PAM type: YTN; PAM sequence: CTC
tgagccgccatttattcatc

SEQ ID NO: 45551 - DNA, 20 bp, Artificial Sequence
  Description of Artificial Sequence: Synthetic oligonucleotide
  Target: SCN10A; (-) strand; PAM type: YTN; PAM sequence: CTC
tctgagccgccatttattca

SEQ ID NO: 45552 - DNA, 20 bp, Artificial Sequence
  Description of Artificial Sequence: Synthetic oligonucleotide
  Target: SCN10A; (-) strand; PAM type: YTN; PAM sequence: TTC
ccaaacctctctgagccgcc

SEQ ID NO: 45553 - DNA, 20 bp, Artificial Sequence
  Description of Artificial Sequence: Synthetic oligonucleotide
  Target: SCN10A; (-) strand; PAM type: YTN; PAM sequence: CTA
agatcagttcccaaacctct

SEQ ID NO: 45554 - DNA, 20 bp, Artificial Sequence
  Description of Artificial Sequence: Synthetic oligonucleotide
  Target: SCN10A; (-) strand; PAM type: YTN; PAM sequence: CTG
tgggacctaagatcagttcc

SEQ ID NO: 45555 - DNA, 20 bp, Artificial Sequence
  Description of Artificial Sequence: Synthetic oligonucleotide
  Target: SCN10A; (-) strand; PAM type: YTN; PAM sequence: CTC
cacaagctgtgggacctaag

SEQ ID NO: 45556 - DNA, 20 bp, Artificial Sequence
  Description of Artificial Sequence: Synthetic oligonucleotide
  Target: SCN10A; (-) strand; PAM type: YTN; PAM sequence: CTA
ggtatagaaagaaagagtga

SEQ ID NO: 45557 - DNA, 20 bp, Artificial Sequence
  Description of Artificial Sequence: Synthetic oligonucleotide
  Target: SCN10A; (-) strand; PAM type: YTN; PAM sequence: TTC
taggtatagaaagaaagagt

SEQ ID NO: 45558 - DNA, 20 bp, Artificial Sequence
  Description of Artificial Sequence: Synthetic oligonucleotide
  Target: SCN10A; (-) strand; PAM type: YTN; PAM sequence: CTC
cagggtggttctaggtatag

SEQ ID NO: 45559 - DNA, 20 bp, Artificial Sequence
  Description of Artificial Sequence: Synthetic oligonucleotide
  Target: SCN10A; (-) strand; PAM type: YTN; PAM sequence: CTC
actccagggtggttctaggt

SEQ ID NO: 45560 - DNA, 20 bp, Artificial Sequence
  Description of Artificial Sequence: Synthetic oligonucleotide
  Target: SCN10A; (-) strand; PAM type: YTN; PAM sequence: TTG
ccacaatctcactccagggt

SEQ ID NO: 45561 - DNA, 20 bp, Artificial Sequence
  Description of Artificial Sequence: Synthetic oligonucleotide
  Target: SCN10A; (-) strand; PAM type: YTN; PAM sequence: TTC
accatataccattgccacaa

SEQ ID NO: 45562 - DNA, 20 bp, Artificial Sequence
  Description of Artificial Sequence: Synthetic oligonucleotide
  Target: SCN10A; (-) strand; PAM type: YTN; PAM sequence: TTT
caccatataccattgccaca

SEQ ID NO: 45563 - DNA, 20 bp, Artificial Sequence
  Description of Artificial Sequence: Synthetic oligonucleotide
  Target: SCN10A; (-) strand; PAM type: YTN; PAM sequence: CTT
tcaccatataccattgccac

SEQ ID NO: 45564 - DNA, 20 bp, Artificial Sequence
  Description of Artificial Sequence: Synthetic oligonucleotide
  Target: SCN10A; (-) strand; PAM type: YTN; PAM sequence: TTC
aactttcaccatataccatt

SEQ ID NO: 45565 - DNA, 20 bp, Artificial Sequence
  Description of Artificial Sequence: Synthetic oligonucleotide
  Target: SCN10A; (-) strand; PAM type: YTN; PAM sequence: TTT
caactttcaccatataccat

SEQ ID NO: 45566 - DNA, 20 bp, Artificial Sequence
  Description of Artificial Sequence: Synthetic oligonucleotide
  Target: SCN10A; (-) strand; PAM type: YTN; PAM sequence: CTA
atccgcacaatttcaacttt

SEQ ID NO: 45567 - DNA, 20 bp, Artificial Sequence
  Description of Artificial Sequence: Synthetic oligonucleotide
  Target: SCN10A; (-) strand; PAM type: YTN; PAM sequence: CTC
cggctaatccgcacaatttc

SEQ ID NO: 45568 - DNA, 20 bp, Artificial Sequence
  Description of Artificial Sequence: Synthetic oligonucleotide
  Target: SCN10A; (-) strand; PAM type: YTN; PAM sequence: CTC
ccaacctccggctaatccgc

SEQ ID NO: 45569 - DNA, 20 bp, Artificial Sequence
  Description of Artificial Sequence: Synthetic oligonucleotide
  Target: SCN10A; (-) strand; PAM type: YTN; PAM sequence: TTA
aagtccctcccaacctccgg

SEQ ID NO: 45570 - DNA, 20 bp, Artificial Sequence
  Description of Artificial Sequence: Synthetic oligonucleotide
  Target: SCN10A; (-) strand; PAM type: YTN; PAM sequence: TTT
aaagtccctcccaacctccg

SEQ ID NO: 45571 - DNA, 20 bp, Artificial Sequence
  Description of Artificial Sequence: Synthetic oligonucleotide
  Target: SCN10A; (-) strand; PAM type: YTN; PAM sequence: TTT
taaagtccctcccaacctcc

SEQ ID NO: 45572 - DNA, 20 bp, Artificial Sequence
  Description of Artificial Sequence: Synthetic oligonucleotide
  Target: SCN10A; (-) strand; PAM type: YTN; PAM sequence: TTT
ttaaagtccctcccaacctc

SEQ ID NO: 45573 - DNA, 20 bp, Artificial Sequence
  Description of Artificial Sequence: Synthetic oligonucleotide
  Target: SCN10A; (-) strand; PAM type: YTN; PAM sequence: CTG
ggaatttttaaagtccctcc

SEQ ID NO: 45574 - DNA, 20 bp, Artificial Sequence
  Description of Artificial Sequence: Synthetic oligonucleotide
  Target: SCN10A; (-) strand; PAM type: YTN; PAM sequence: TTA
tcctgggaatttttaaagtc

SEQ ID NO: 45575 - DNA, 20 bp, Artificial Sequence
  Description of Artificial Sequence: Synthetic oligonucleotide
  Target: SCN10A; (-) strand; PAM type: YTN; PAM sequence: CTT
atcctgggaatttttaaagt

SEQ ID NO: 45576 - DNA, 20 bp, Artificial Sequence
  Description of Artificial Sequence: Synthetic oligonucleotide
  Target: SCN10A; (-) strand; PAM type: YTN; PAM sequence: TTC
ttatcctgggaatttttaaa

SEQ ID NO: 45577 - DNA, 20 bp, Artificial Sequence
  Description of Artificial Sequence: Synthetic oligonucleotide
  Target: SCN10A; (-) strand; PAM type: YTN; PAM sequence: TTT
cttatcctgggaatttttaa

SEQ ID NO: 45578 - DNA, 20 bp, Artificial Sequence
  Description of Artificial Sequence: Synthetic oligonucleotide
  Target: SCN10A; (-) strand; PAM type: YTN; PAM sequence: CTC
atttcttatcctgggaattt

SEQ ID NO: 45579 - DNA, 20 bp, Artificial Sequence
  Description of Artificial Sequence: Synthetic oligonucleotide
  Target: SCN10A; (-) strand; PAM type: YTN; PAM sequence: CTC
aatcacataacctcatttct

SEQ ID NO: 45580 - DNA, 20 bp, Artificial Sequence
  Description of Artificial Sequence: Synthetic oligonucleotide
  Target: SCN10A; (-) strand; PAM type: YTN; PAM sequence: CTG
cactcaatcacataacctca

SEQ ID NO: 45581 - DNA, 20 bp, Artificial Sequence
  Description of Artificial Sequence: Synthetic oligonucleotide
  Target: SCN10A; (-) strand; PAM type: YTN; PAM sequence: TTC
cagactgcactcaatcacat

SEQ ID NO: 45582 - DNA, 20 bp, Artificial Sequence
  Description of Artificial Sequence: Synthetic oligonucleotide
  Target: SCN10A; (-) strand; PAM type: YTN; PAM sequence: CTG
gagggtggcggtgaaggtgg

SEQ ID NO: 45583 - DNA, 20 bp, Artificial Sequence
  Description of Artificial Sequence: Synthetic oligonucleotide
  Target: SCN10A; (-) strand; PAM type: YTN; PAM sequence: CTG
gtagaggctggagggtggcg

SEQ ID NO: 45584 - DNA, 20 bp, Artificial Sequence
  Description of Artificial Sequence: Synthetic oligonucleotide
  Target: SCN10A; (-) strand; PAM type: YTN; PAM sequence: CTG
agcagtgggctggtagaggc

SEQ ID NO: 45585 - DNA, 20 bp, Artificial Sequence
  Description of Artificial Sequence: Synthetic oligonucleotide
  Target: SCN10A; (-) strand; PAM type: YTN; PAM sequence: TTG
gacagccagccagacactga

SEQ ID NO: 45586 - DNA, 20 bp, Artificial Sequence
  Description of Artificial Sequence: Synthetic oligonucleotide
  Target: SCN10A; (-) strand; PAM type: YTN; PAM sequence: CTG
gagaggttggacagccagcc

SEQ ID NO: 45587 - DNA, 20 bp, Artificial Sequence
  Description of Artificial Sequence: Synthetic oligonucleotide
  Target: SCN10A; (-) strand; PAM type: YTN; PAM sequence: TTC
ctggagaggttggacagcca

SEQ ID NO: 45588 - DNA, 20 bp, Artificial Sequence
  Description of Artificial Sequence: Synthetic oligonucleotide
  Target: SCN10A; (-) strand; PAM type: YTN; PAM sequence: CTT
cctggagaggttggacagcc

SEQ ID NO: 45589 - DNA, 20 bp, Artificial Sequence
  Description of Artificial Sequence: Synthetic oligonucleotide
  Target: SCN10A; (-) strand; PAM type: YTN; PAM sequence: CTG
aggtaggtatgtcagcttcc

SEQ ID NO: 45590 - DNA, 20 bp, Artificial Sequence
  Description of Artificial Sequence: Synthetic oligonucleotide
  Target: SCN10A; (-) strand; PAM type: YTN; PAM sequence: CTG
ctgaggtaggtatgtcagct

SEQ ID NO: 45591 - DNA, 20 bp, Artificial Sequence
  Description of Artificial Sequence: Synthetic oligonucleotide
  Target: SCN10A; (-) strand; PAM type: YTN; PAM sequence: CTC
aggtccctgctgaggtaggt

SEQ ID NO: 45592 - DNA, 20 bp, Artificial Sequence
  Description of Artificial Sequence: Synthetic oligonucleotide
  Target: SCN10A; (-) strand; PAM type: YTN; PAM sequence: TTC
ctcaggtccctgctgaggta

SEQ ID NO: 45593 - DNA, 20 bp, Artificial Sequence
  Description of Artificial Sequence: Synthetic oligonucleotide
  Target: SCN10A; (-) strand; PAM type: YTN; PAM sequence: CTG
ttcctcaggtccctgctgag

SEQ ID NO: 45594 - DNA, 20 bp, Artificial Sequence
  Description of Artificial Sequence: Synthetic oligonucleotide
  Target: SCN10A; (-) strand; PAM type: YTN; PAM sequence: CTG
ggtgagacgtggaaagatga

SEQ ID NO: 45595 - DNA, 20 bp, Artificial Sequence
  Description of Artificial Sequence: Synthetic oligonucleotide
  Target: SCN10A; (-) strand; PAM type: YTN; PAM sequence: CTC
catccctgggtgagacgtgg

SEQ ID NO: 45596 - DNA, 20 bp, Artificial Sequence
  Description of Artificial Sequence: Synthetic oligonucleotide
  Target: SCN10A; (-) strand; PAM type: YTN; PAM sequence: CTG
gctccatccctgggtgagac

SEQ ID NO: 45597 - DNA, 20 bp, Artificial Sequence
  Description of Artificial Sequence: Synthetic oligonucleotide
  Target: SCN10A; (-) strand; PAM type: YTN; PAM sequence: CTG
aggacctggctccatccctg

SEQ ID NO: 45598 - DNA, 20 bp, Artificial Sequence
  Description of Artificial Sequence: Synthetic oligonucleotide
  Target: SCN10A; (-) strand; PAM type: YTN; PAM sequence: TTC
tgaggacctggctccatccc

SEQ ID NO: 45599 - DNA, 20 bp, Artificial Sequence
  Description of Artificial Sequence: Synthetic oligonucleotide
  Target: SCN10A; (-) strand; PAM type: YTN; PAM sequence: CTT
ctgaggacctggctccatcc

SEQ ID NO: 45600 - DNA, 20 bp, Artificial Sequence
  Description of Artificial Sequence: Synthetic oligonucleotide
  Target: SCN10A; (-) strand; PAM type: YTN; PAM sequence: CTG
gaacatcttctgaggacctg

SEQ ID NO: 45601 - DNA, 20 bp, Artificial Sequence
  Description of Artificial Sequence: Synthetic oligonucleotide
  Target: SCN10A; (-) strand; PAM type: YTN; PAM sequence: CTG
acacccaggagcccaggcac

SEQ ID NO: 45602 - DNA, 20 bp, Artificial Sequence
  Description of Artificial Sequence: Synthetic oligonucleotide
  Target: SCN10A; (-) strand; PAM type: YTN; PAM sequence: CTG
cagcaagtcgagaggtgtgg

SEQ ID NO: 45603 - DNA, 20 bp, Artificial Sequence
  Description of Artificial Sequence: Synthetic oligonucleotide
  Target: SCN10A; (-) strand; PAM type: YTN; PAM sequence: CTA
gcaggagcagctgcagcaag

SEQ ID NO: 45604 - DNA, 20 bp, Artificial Sequence
  Description of Artificial Sequence: Synthetic oligonucleotide
  Target: SCN10A; (-) strand; PAM type: YTN; PAM sequence: CTC
actagcaggagcagctgcag

SEQ ID NO: 45605 - DNA, 20 bp, Artificial Sequence
  Description of Artificial Sequence: Synthetic oligonucleotide
  Target: SCN10A; (-) strand; PAM type: YTN; PAM sequence: CTC
tcactagcaggagcagctgc

SEQ ID NO: 45606 - DNA, 20 bp, Artificial Sequence
  Description of Artificial Sequence: Synthetic oligonucleotide
  Target: SCN10A; (-) strand; PAM type: YTN; PAM sequence: CTC
tctcactagcaggagcagct

SEQ ID NO: 45607 - DNA, 20 bp, Artificial Sequence
  Description of Artificial Sequence: Synthetic oligonucleotide
  Target: SCN10A; (-) strand; PAM type: YTN; PAM sequence: TTG
ggaccctctctcactagcag

SEQ ID NO: 45608 - DNA, 20 bp, Artificial Sequence
  Description of Artificial Sequence: Synthetic oligonucleotide
  Target: SCN10A; (-) strand; PAM type: YTN; PAM sequence: CTA
agggtggggccaggcaccca

SEQ ID NO: 45609 - DNA, 20 bp, Artificial Sequence
  Description of Artificial Sequence: Synthetic oligonucleotide
  Target: SCN10A; (-) strand; PAM type: YTN; PAM sequence: CTG
gtcatctaagggtggggcca

SEQ ID NO: 45610 - DNA, 20 bp, Artificial Sequence
  Description of Artificial Sequence: Synthetic oligonucleotide
  Target: SCN10A; (-) strand; PAM type: YTN; PAM sequence: TTA
gaactggtcatctaagggtg

SEQ ID NO: 45611 - DNA, 20 bp, Artificial Sequence
  Description of Artificial Sequence: Synthetic oligonucleotide
  Target: SCN10A; (-) strand; PAM type: YTN; PAM sequence: TTT
agaactggtcatctaagggt

SEQ ID NO: 45612 - DNA, 20 bp, Artificial Sequence
  Description of Artificial Sequence: Synthetic oligonucleotide
  Target: SCN10A; (-) strand; PAM type: YTN; PAM sequence: TTC
aaatttagaactggtcatct

SEQ ID NO: 45613 - DNA, 20 bp, Artificial Sequence
  Description of Artificial Sequence: Synthetic oligonucleotide
  Target: SCN10A; (-) strand; PAM type: YTN; PAM sequence: CTT
caaatttagaactggtcatc

SEQ ID NO: 45614 - DNA, 20 bp, Artificial Sequence
  Description of Artificial Sequence: Synthetic oligonucleotide
  Target: SCN10A; (-) strand; PAM type: YTN; PAM sequence: CTG
tgatgtgcaagatcccttca

SEQ ID NO: 45615 - DNA, 20 bp, Artificial Sequence
  Description of Artificial Sequence: Synthetic oligonucleotide
  Target: SCN10A; (-) strand; PAM type: YTN; PAM sequence: CTG
gcagcctgtgatgtgcaaga

SEQ ID NO: 45616 - DNA, 20 bp, Artificial Sequence
  Description of Artificial Sequence: Synthetic oligonucleotide
  Target: SCN10A; (-) strand; PAM type: YTN; PAM sequence: CTC
tggcagcctgtgatgtgcaa

SEQ ID NO: 45617 - DNA, 20 bp, Artificial Sequence
  Description of Artificial Sequence: Synthetic oligonucleotide
  Target: SCN10A; (-) strand; PAM type: YTN; PAM sequence: TTG
gctctggcagcctgtgatgt

SEQ ID NO: 45618 - DNA, 20 bp, Artificial Sequence
  Description of Artificial Sequence: Synthetic oligonucleotide
  Target: SCN10A; (-) strand; PAM type: YTN; PAM sequence: CTT
ggctctggcagcctgtgatg

SEQ ID NO: 45619 - DNA, 20 bp, Artificial Sequence
  Description of Artificial Sequence: Synthetic oligonucleotide
  Target: SCN10A; (-) strand; PAM type: YTN; PAM sequence: CTC
ttggctctggcagcctgtga

SEQ ID NO: 45620 - DNA, 20 bp, Artificial Sequence
  Description of Artificial Sequence: Synthetic oligonucleotide
  Target: SCN10A; (-) strand; PAM type: YTN; PAM sequence: TTG
catatatgaaactcttggct

SEQ ID NO: 45621 - DNA, 20 bp, Artificial Sequence
  Description of Artificial Sequence: Synthetic oligonucleotide
  Target: SCN10A; (-) strand; PAM type: YTN; PAM sequence: TTC
acacacgtgtatgtatatat

SEQ ID NO: 45622 - DNA, 20 bp, Artificial Sequence
  Description of Artificial Sequence: Synthetic oligonucleotide
  Target: SCN10A; (-) strand; PAM type: YTN; PAM sequence: CTT
cacacacgtgtatgtatata

SEQ ID NO: 45623 - DNA, 20 bp, Artificial Sequence
  Description of Artificial Sequence: Synthetic oligonucleotide
  Target: SCN10A; (-) strand; PAM type: YTN; PAM sequence: CTC
acttcacacacgtgtatgta

SEQ ID NO: 45624 - DNA, 20 bp, Artificial Sequence
  Description of Artificial Sequence: Synthetic oligonucleotide
  Target: SCN10A; (-) strand; PAM type: YTN; PAM sequence: TTC
atgctcacttcacacacgtg

SEQ ID NO: 45625 - DNA, 20 bp, Artificial Sequence
  Description of Artificial Sequence: Synthetic oligonucleotide
  Target: SCN10A; (-) strand; PAM type: YTN; PAM sequence: CTT
catgctcacttcacacacgt

SEQ ID NO: 45626 - DNA, 20 bp, Artificial Sequence
  Description of Artificial Sequence: Synthetic oligonucleotide
  Target: SCN10A; (-) strand; PAM type: YTN; PAM sequence: CTA
tagtcttcatgctcacttca

SEQ ID NO: 45627 - DNA, 20 bp, Artificial Sequence
  Description of Artificial Sequence: Synthetic oligonucleotide
  Target: SCN10A; (-) strand; PAM type: YTN; PAM sequence: CTA
gctatagtcttcatgctcac

SEQ ID NO: 45628 - DNA, 20 bp, Artificial Sequence
  Description of Artificial Sequence: Synthetic oligonucleotide
  Target: SCN10A; (-) strand; PAM type: YTN; PAM sequence: CTA
tctagctatagtcttcatgc

SEQ ID NO: 45629 - DNA, 20 bp, Artificial Sequence
  Description of Artificial Sequence: Synthetic oligonucleotide
  Target: SCN10A; (-) strand; PAM type: YTN; PAM sequence: TTA
atggagcccaaggataaaac

SEQ ID NO: 45630 - DNA, 20 bp, Artificial Sequence
  Description of Artificial Sequence: Synthetic oligonucleotide
  Target: SCN10A; (-) strand; PAM type: YTN; PAM sequence: TTA
taattaatggagcccaagga

SEQ ID NO: 45631 - DNA, 20 bp, Artificial Sequence
  Description of Artificial Sequence: Synthetic oligonucleotide
  Target: SCN10A; (-) strand; PAM type: YTN; PAM sequence: CTT
ataattaatggagcccaagg

SEQ ID NO: 45632 - DNA, 20 bp, Artificial Sequence
  Description of Artificial Sequence: Synthetic oligonucleotide
  Target: SCN10A; (-) strand; PAM type: YTN; PAM sequence: CTA
aggtcacacatcttataatt

SEQ ID NO: 45633 - DNA, 20 bp, Artificial Sequence
  Description of Artificial Sequence: Synthetic oligonucleotide
  Target: SCN10A; (-) strand; PAM type: YTN; PAM sequence: TTG
cctaaggtcacacatcttat

SEQ ID NO: 45634 - DNA, 20 bp, Artificial Sequence
  Description of Artificial Sequence: Synthetic oligonucleotide
  Target: SCN10A; (-) strand; PAM type: YTN; PAM sequence: CTT
gcctaaggtcacacatctta

SEQ ID NO: 45635 - DNA, 20 bp, Artificial Sequence
  Description of Artificial Sequence: Synthetic oligonucleotide
  Target: SCN10A; (-) strand; PAM type: YTN; PAM sequence: TTA
aacaacttgcctaaggtcac

SEQ ID NO: 45636 - DNA, 20 bp, Artificial Sequence
  Description of Artificial Sequence: Synthetic oligonucleotide
  Target: SCN10A; (-) strand; PAM type: YTN; PAM sequence: TTA
gagaggttaaacaacttgcc

SEQ ID NO: 45637 - DNA, 20 bp, Artificial Sequence
  Description of Artificial Sequence: Synthetic oligonucleotide
  Target: SCN10A; (-) strand; PAM type: YTN; PAM sequence: CTG
ggaaaaatgaagattagaga

SEQ ID NO: 45638 - DNA, 20 bp, Artificial Sequence
  Description of Artificial Sequence: Synthetic oligonucleotide
  Target: SCN10A; (-) strand; PAM type: YTN; PAM sequence: TTG
aagctgggaaaaatgaagat

SEQ ID NO: 45639 - DNA, 20 bp, Artificial Sequence
  Description of Artificial Sequence: Synthetic oligonucleotide
  Target: SCN10A; (-) strand; PAM type: YTN; PAM sequence: TTT
gaagctgggaaaaatgaaga

SEQ ID NO: 45640 - DNA, 20 bp, Artificial Sequence
  Description of Artificial Sequence: Synthetic oligonucleotide
  Target: SCN10A; (-) strand; PAM type: YTN; PAM sequence: TTT
tgaagctgggaaaaatgaag

SEQ ID NO: 45641 - DNA, 20 bp, Artificial Sequence
  Description of Artificial Sequence: Synthetic oligonucleotide
  Target: SCN10A; (-) strand; PAM type: YTN; PAM sequence: TTC
aattttgaagctgggaaaaa

SEQ ID NO: 45642 - DNA, 20 bp, Artificial Sequence
  Description of Artificial Sequence: Synthetic oligonucleotide
  Target: SCN10A; (-) strand; PAM type: YTN; PAM sequence: TTT
caattttgaagctgggaaaa

SEQ ID NO: 45643 - DNA, 20 bp, Artificial Sequence
  Description of Artificial Sequence: Synthetic oligonucleotide
  Target: SCN10A; (-) strand; PAM type: YTN; PAM sequence: TTT
tcaattttgaagctgggaaa

SEQ ID NO: 45644 - DNA, 20 bp, Artificial Sequence
  Description of Artificial Sequence: Synthetic oligonucleotide
  Target: SCN10A; (-) strand; PAM type: YTN; PAM sequence: CTT
ttcaattttgaagctgggaa

SEQ ID NO: 45645 - DNA, 20 bp, Artificial Sequence
  Description of Artificial Sequence: Synthetic oligonucleotide
  Target: SCN10A; (-) strand; PAM type: YTN; PAM sequence: CTA
gccttttcaattttgaagct

SEQ ID NO: 45646 - DNA, 20 bp, Artificial Sequence
  Description of Artificial Sequence: Synthetic oligonucleotide
  Target: SCN10A; (-) strand; PAM type: YTN; PAM sequence: CTG
aatgatgcagatctagcctt

SEQ ID NO: 45647 - DNA, 20 bp, Artificial Sequence
  Description of Artificial Sequence: Synthetic oligonucleotide
  Target: SCN10A; (-) strand; PAM type: YTN; PAM sequence: TTA
gtcatcaaaacagctgaatg

SEQ ID NO: 45648 - DNA, 20 bp, Artificial Sequence
  Description of Artificial Sequence: Synthetic oligonucleotide
  Target: SCN10A; (-) strand; PAM type: YTN; PAM sequence: TTT
agtcatcaaaacagctgaat

SEQ ID NO: 45649 - DNA, 20 bp, Artificial Sequence
  Description of Artificial Sequence: Synthetic oligonucleotide
  Target: SCN10A; (-) strand; PAM type: YTN; PAM sequence: CTA
acatatttagtcatcaaaac

SEQ ID NO: 45650 - DNA, 20 bp, Artificial Sequence
  Description of Artificial Sequence: Synthetic oligonucleotide
  Target: SCN10A; (-) strand; PAM type: YTN; PAM sequence: TTA
caagcgctaacatatttagt

SEQ ID NO: 45651 - DNA, 20 bp, Artificial Sequence
  Description of Artificial Sequence: Synthetic oligonucleotide
  Target: SCN10A; (-) strand; PAM type: YTN; PAM sequence: TTT
acaagcgctaacatatttag

SEQ ID NO: 45652 - DNA, 20 bp, Artificial Sequence
  Description of Artificial Sequence: Synthetic oligonucleotide
  Target: SCN10A; (-) strand; PAM type: YTN; PAM sequence: TTT
tacaagcgctaacatattta

SEQ ID NO: 45653 - DNA, 20 bp, Artificial Sequence
  Description of Artificial Sequence: Synthetic oligonucleotide
  Target: SCN10A; (-) strand; PAM type: YTN; PAM sequence: TTC
gtgcaaagtgttttacaagc

SEQ ID NO: 45654 - DNA, 20 bp, Artificial Sequence
  Description of Artificial Sequence: Synthetic oligonucleotide
  Target: SCN10A; (-) strand; PAM type: YTN; PAM sequence: CTT
cgtgcaaagtgttttacaag

SEQ ID NO: 45655 - DNA, 20 bp, Artificial Sequence
  Description of Artificial Sequence: Synthetic oligonucleotide
  Target: SCN10A; (-) strand; PAM type: YTN; PAM sequence: TTG
agccaagcacttcgtgcaaa

SEQ ID NO: 45656 - DNA, 20 bp, Artificial Sequence
  Description of Artificial Sequence: Synthetic oligonucleotide
  Target: SCN10A; (-) strand; PAM type: YTN; PAM sequence: CTA
ttgagccaagcacttcgtgc

SEQ ID NO: 45657 - DNA, 20 bp, Artificial Sequence
  Description of Artificial Sequence: Synthetic oligonucleotide
  Target: SCN10A; (-) strand; PAM type: YTN; PAM sequence: CTA
aaatctattgagccaagcac

SEQ ID NO: 45658 - DNA, 20 bp, Artificial Sequence
  Description of Artificial Sequence: Synthetic oligonucleotide
  Target: SCN10A; (-) strand; PAM type: YTN; PAM sequence: CTG
gacaaataacaatggtcatg

SEQ ID NO: 45659 - DNA, 20 bp, Artificial Sequence
  Description of Artificial Sequence: Synthetic oligonucleotide
  Target: SCN10A; (-) strand; PAM type: YTN; PAM sequence: CTC
tggacaaataacaatggtca

SEQ ID NO: 45660 - DNA, 20 bp, Artificial Sequence
  Description of Artificial Sequence: Synthetic oligonucleotide
  Target: SCN10A; (-) strand; PAM type: YTN; PAM sequence: TTG
acctctggacaaataacaat

SEQ ID NO: 45661 - DNA, 20 bp, Artificial Sequence
  Description of Artificial Sequence: Synthetic oligonucleotide
  Target: SCN10A; (-) strand; PAM type: YTN; PAM sequence: TTT
gacctctggacaaataacaa

SEQ ID NO: 45662 - DNA, 20 bp, Artificial Sequence
  Description of Artificial Sequence: Synthetic oligonucleotide
  Target: SCN10A; (-) strand; PAM type: YTN; PAM sequence: TTT
tgacctctggacaaataaca

SEQ ID NO: 45663 - DNA, 20 bp, Artificial Sequence
  Description of Artificial Sequence: Synthetic oligonucleotide
  Target: SCN10A; (-) strand; PAM type: YTN; PAM sequence: CTA
caattttgacctctggacaa

SEQ ID NO: 45664 - DNA, 20 bp, Artificial Sequence
  Description of Artificial Sequence: Synthetic oligonucleotide
  Target: SCN10A; (-) strand; PAM type: YTN; PAM sequence: TTC
cctacaattttgacctctgg

SEQ ID NO: 45665 - DNA, 20 bp, Artificial Sequence
  Description of Artificial Sequence: Synthetic oligonucleotide
  Target: SCN10A; (-) strand; PAM type: YTN; PAM sequence: CTC
caggtggccaagttccctac

SEQ ID NO: 45666 - DNA, 20 bp, Artificial Sequence
  Description of Artificial Sequence: Synthetic oligonucleotide
  Target: SCN10A; (-) strand; PAM type: YTN; PAM sequence: TTA
gggagctccaggtggccaag

SEQ ID NO: 45667 - DNA, 20 bp, Artificial Sequence
  Description of Artificial Sequence: Synthetic oligonucleotide
  Target: SCN10A; (-) strand; PAM type: YTN; PAM sequence: CTT
agggagctccaggtggccaa

SEQ ID NO: 45668 - DNA, 20 bp, Artificial Sequence
  Description of Artificial Sequence: Synthetic oligonucleotide
  Target: SCN10A; (-) strand; PAM type: YTN; PAM sequence: CTC
ttagggagctccaggtggcc

SEQ ID NO: 45669 - DNA, 20 bp, Artificial Sequence
  Description of Artificial Sequence: Synthetic oligonucleotide
  Target: SCN10A; (-) strand; PAM type: YTN; PAM sequence: TTG
gggctcttagggagctccag

SEQ ID NO: 45670 - DNA, 20 bp, Artificial Sequence
  Description of Artificial Sequence: Synthetic oligonucleotide
  Target: SCN10A; (-) strand; PAM type: YTN; PAM sequence: TTT
ggggctcttagggagctcca

SEQ ID NO: 45671 - DNA, 20 bp, Artificial Sequence
  Description of Artificial Sequence: Synthetic oligonucleotide
  Target: SCN10A; (-) strand; PAM type: YTN; PAM sequence: CTT
tggggctcttagggagctcc

SEQ ID NO: 45672 - DNA, 20 bp, Artificial Sequence
  Description of Artificial Sequence: Synthetic oligonucleotide
  Target: SCN10A; (-) strand; PAM type: YTN; PAM sequence: TTA
ctttggggctcttagggagc

SEQ ID NO: 45673 - DNA, 20 bp, Artificial Sequence
  Description of Artificial Sequence: Synthetic oligonucleotide
  Target: SCN10A; (-) strand; PAM type: YTN; PAM sequence: TTC
agttactttggggctcttag

SEQ ID NO: 45674 - DNA, 20 bp, Artificial Sequence
  Description of Artificial Sequence: Synthetic oligonucleotide
  Target: SCN10A; (-) strand; PAM type: YTN; PAM sequence: TTT
cagttactttggggctctta

SEQ ID NO: 45675 - DNA, 20 bp, Artificial Sequence
  Description of Artificial Sequence: Synthetic oligonucleotide
  Target: SCN10A; (-) strand; PAM type: YTN; PAM sequence: TTT
tcagttactttggggctctt

SEQ ID NO: 45676 - DNA, 20 bp, Artificial Sequence
  Description of Artificial Sequence: Synthetic oligonucleotide
  Target: SCN10A; (-) strand; PAM type: YTN; PAM sequence: CTC
agaagcattttcagttactt

SEQ ID NO: 45677 - DNA, 20 bp, Artificial Sequence
  Description of Artificial Sequence: Synthetic oligonucleotide
  Target: SCN10A; (-) strand; PAM type: YTN; PAM sequence: CTG
ccactcagaagcattttcag

SEQ ID NO: 45678 - DNA, 20 bp, Artificial Sequence
  Description of Artificial Sequence: Synthetic oligonucleotide
  Target: SCN10A; (-) strand; PAM type: YTN; PAM sequence: CTG
tctgccactcagaagcattt

SEQ ID NO: 45679 - DNA, 20 bp, Artificial Sequence
  Description of Artificial Sequence: Synthetic oligonucleotide
  Target: SCN10A; (-) strand; PAM type: YTN; PAM sequence: CTG
tgacagctgtctgccactca

SEQ ID NO: 45680 - DNA, 20 bp, Artificial Sequence
  Description of Artificial Sequence: Synthetic oligonucleotide
  Target: SCN10A; (-) strand; PAM type: YTN; PAM sequence: CTC
tgtgacagctgtctgccact

SEQ ID NO: 45681 - DNA, 20 bp, Artificial Sequence
  Description of Artificial Sequence: Synthetic oligonucleotide
  Target: SCN10A; (-) strand; PAM type: YTN; PAM sequence: CTA
ggtaacagcagagagcatga

SEQ ID NO: 45682 - DNA, 20 bp, Artificial Sequence
  Description of Artificial Sequence: Synthetic oligonucleotide
  Target: SCN10A; (-) strand; PAM type: YTN; PAM sequence: TTG
tctaggtaacagcagagagc

SEQ ID NO: 45683 - DNA, 20 bp, Artificial Sequence
  Description of Artificial Sequence: Synthetic oligonucleotide
  Target: SCN10A; (-) strand; PAM type: YTN; PAM sequence: TTT
gtctaggtaacagcagagag

SEQ ID NO: 45684 - DNA, 20 bp, Artificial Sequence
  Description of Artificial Sequence: Synthetic oligonucleotide
  Target: SCN10A; (-) strand; PAM type: YTN; PAM sequence: CTT
tgtctaggtaacagcagaga

SEQ ID NO: 45685 - DNA, 20 bp, Artificial Sequence
  Description of Artificial Sequence: Synthetic oligonucleotide
  Target: SCN10A; (-) strand; PAM type: YTN; PAM sequence: TTA
catgcctttgtctaggtaac

SEQ ID NO: 45686 - DNA, 20 bp, Artificial Sequence
  Description of Artificial Sequence: Synthetic oligonucleotide
  Target: SCN10A; (-) strand; PAM type: YTN; PAM sequence: TTT
acatgcctttgtctaggtaa

SEQ ID NO: 45687 - DNA, 20 bp, Artificial Sequence
  Description of Artificial Sequence: Synthetic oligonucleotide
  Target: SCN10A; (-) strand; PAM type: YTN; PAM sequence: TTT
tacatgcctttgtctaggta

SEQ ID NO: 45688 - DNA, 20 bp, Artificial Sequence
  Description of Artificial Sequence: Synthetic oligonucleotide
  Target: SCN10A; (-) strand; PAM type: YTN; PAM sequence: CTG
ccatattttacatgcctttg

SEQ ID NO: 45689 - DNA, 20 bp, Artificial Sequence
  Description of Artificial Sequence: Synthetic oligonucleotide
  Target: SCN10A; (-) strand; PAM type: YTN; PAM sequence: TTA
tcagctgccatattttacat

SEQ ID NO: 45690 - DNA, 20 bp, Artificial Sequence
  Description of Artificial Sequence: Synthetic oligonucleotide
  Target: SCN10A; (-) strand; PAM type: YTN; PAM sequence: CTG
ttatcagctgccatatttta

SEQ ID NO: 45691 - DNA, 20 bp, Artificial Sequence
  Description of Artificial Sequence: Synthetic oligonucleotide
  Target: SCN10A; (-) strand; PAM type: YTN; PAM sequence: CTG
ctgttatcagctgccatatt

SEQ ID NO: 45692 - DNA, 20 bp, Artificial Sequence
  Description of Artificial Sequence: Synthetic oligonucleotide
  Target: SCN10A; (-) strand; PAM type: YTN; PAM sequence: TTC
cagcagctgctgttatcagc

SEQ ID NO: 45693 - DNA, 20 bp, Artificial Sequence
  Description of Artificial Sequence: Synthetic oligonucleotide
  Target: SCN10A; (-) strand; PAM type: YTN; PAM sequence: TTG
tgttccagcagctgctgtta

SEQ ID NO: 45694 - DNA, 20 bp, Artificial Sequence
  Description of Artificial Sequence: Synthetic oligonucleotide
  Target: SCN10A; (-) strand; PAM type: YTN; PAM sequence: CTT
gtgttccagcagctgctgtt

SEQ ID NO: 45695 - DNA, 20 bp, Artificial Sequence
  Description of Artificial Sequence: Synthetic oligonucleotide
  Target: SCN10A; (-) strand; PAM type: YTN; PAM sequence: CTG
cagtcgtcacttgtgttcca

SEQ ID NO: 45696 - DNA, 20 bp, Artificial Sequence
  Description of Artificial Sequence: Synthetic oligonucleotide
  Target: SCN10A; (-) strand; PAM type: YTN; PAM sequence: TTC
cctgcagtcgtcacttgtgt

SEQ ID NO: 45697 - DNA, 20 bp, Artificial Sequence
  Description of Artificial Sequence: Synthetic oligonucleotide
  Target: SCN10A; (-) strand; PAM type: YTN; PAM sequence: CTT
ccctgcagtcgtcacttgtg

SEQ ID NO: 45698 - DNA, 20 bp, Artificial Sequence
  Description of Artificial Sequence: Synthetic oligonucleotide
  Target: SCN10A; (-) strand; PAM type: YTN; PAM sequence: TTC
ttccctgcagtcgtcacttg

SEQ ID NO: 45699 - DNA, 20 bp, Artificial Sequence
  Description of Artificial Sequence: Synthetic oligonucleotide
  Target: SCN10A; (-) strand; PAM type: YTN; PAM sequence: CTT
cttccctgcagtcgtcactt

SEQ ID NO: 45700 - DNA, 20 bp, Artificial Sequence
  Description of Artificial Sequence: Synthetic oligonucleotide
  Target: SCN10A; (-) strand; PAM type: YTN; PAM sequence: CTC
ccatagccttcttccctgca

SEQ ID NO: 45701 - DNA, 20 bp, Artificial Sequence
  Description of Artificial Sequence: Synthetic oligonucleotide
  Target: SCN10A; (-) strand; PAM type: YTN; PAM sequence: CTC
tcccatagccttcttccctg

SEQ ID NO: 45702 - DNA, 20 bp, Artificial Sequence
  Description of Artificial Sequence: Synthetic oligonucleotide
  Target: SCN10A; (-) strand; PAM type: YTN; PAM sequence: CTG
tagctctcccatagccttct

SEQ ID NO: 45703 - DNA, 20 bp, Artificial Sequence
  Description of Artificial Sequence: Synthetic oligonucleotide
  Target: SCN10A; (-) strand; PAM type: YTN; PAM sequence: TTG
agtctgtagctctcccatag

SEQ ID NO: 45704 - DNA, 20 bp, Artificial Sequence
  Description of Artificial Sequence: Synthetic oligonucleotide
  Target: SCN10A; (-) strand; PAM type: YTN; PAM sequence: TTT
gagtctgtagctctcccata

SEQ ID NO: 45705 - DNA, 20 bp, Artificial Sequence
  Description of Artificial Sequence: Synthetic oligonucleotide
  Target: SCN10A; (-) strand; PAM type: YTN; PAM sequence: CTT
tgagtctgtagctctcccat

SEQ ID NO: 45706 - DNA, 20 bp, Artificial Sequence
  Description of Artificial Sequence: Synthetic oligonucleotide
  Target: SCN10A; (-) strand; PAM type: YTN; PAM sequence: CTG
tgctttgagtctgtagctct

SEQ ID NO: 45707 - DNA, 20 bp, Artificial Sequence
  Description of Artificial Sequence: Synthetic oligonucleotide
  Target: SCN10A; (-) strand; PAM type: YTN; PAM sequence: CTA
agtggtccagaaaagctgtg

SEQ ID NO: 45708 - DNA, 20 bp, Artificial Sequence
  Description of Artificial Sequence: Synthetic oligonucleotide
  Target: SCN10A; (-) strand; PAM type: YTN; PAM sequence: TTA
ctaagtggtccagaaaagct

SEQ ID NO: 45709 - DNA, 20 bp, Artificial Sequence
  Description of Artificial Sequence: Synthetic oligonucleotide
  Target: SCN10A; (-) strand; PAM type: YTN; PAM sequence: CTG
gccaggttactaagtggtcc

SEQ ID NO: 45710 - DNA, 20 bp, Artificial Sequence
  Description of Artificial Sequence: Synthetic oligonucleotide
  Target: SCN10A; (-) strand; PAM type: YTN; PAM sequence: CTG
ctggccaggttactaagtgg

SEQ ID NO: 45711 - DNA, 20 bp, Artificial Sequence
  Description of Artificial Sequence: Synthetic oligonucleotide
  Target: SCN10A; (-) strand; PAM type: YTN; PAM sequence: CTC
aggaacatgcagggctgctg

SEQ ID NO: 45712 - DNA, 20 bp, Artificial Sequence
  Description of Artificial Sequence: Synthetic oligonucleotide
  Target: SCN10A; (-) strand; PAM type: YTN; PAM sequence: CTG
tgaggcctcaggaacatgca

SEQ ID NO: 45713 - DNA, 20 bp, Artificial Sequence
  Description of Artificial Sequence: Synthetic oligonucleotide
  Target: SCN10A; (-) strand; PAM type: YTN; PAM sequence: CTG
cccaacgtgggaaggcaggg

SEQ ID NO: 45714 - DNA, 20 bp, Artificial Sequence
  Description of Artificial Sequence: Synthetic oligonucleotide
  Target: SCN10A; (-) strand; PAM type: YTN; PAM sequence: CTC
tgcccaacgtgggaaggcag

SEQ ID NO: 45715 - DNA, 20 bp, Artificial Sequence
  Description of Artificial Sequence: Synthetic oligonucleotide
  Target: SCN10A; (-) strand; PAM type: YTN; PAM sequence: TTC
acctctgcccaacgtgggaa

SEQ ID NO: 45716 - DNA, 20 bp, Artificial Sequence
  Description of Artificial Sequence: Synthetic oligonucleotide
  Target: SCN10A; (-) strand; PAM type: YTN; PAM sequence: CTC
agggcattcacctctgccca

SEQ ID NO: 45717 - DNA, 20 bp, Artificial Sequence
  Description of Artificial Sequence: Synthetic oligonucleotide
  Target: SCN10A; (-) strand; PAM type: YTN; PAM sequence: CTC
agtaactcagggcattcacc

SEQ ID NO: 45718 - DNA, 20 bp, Artificial Sequence
  Description of Artificial Sequence: Synthetic oligonucleotide
  Target: SCN10A; (-) strand; PAM type: YTN; PAM sequence: TTC
tcagtaactcagggcattca

SEQ ID NO: 45719 - DNA, 20 bp, Artificial Sequence
  Description of Artificial Sequence: Synthetic oligonucleotide
  Target: SCN10A; (-) strand; PAM type: YTN; PAM sequence: CTT
ctcagtaactcagggcattc

SEQ ID NO: 45720 - DNA, 20 bp, Artificial Sequence
  Description of Artificial Sequence: Synthetic oligonucleotide
  Target: SCN10A; (-) strand; PAM type: YTN; PAM sequence: CTC
ttctcagtaactcagggcat

SEQ ID NO: 45721 - DNA, 20 bp, Artificial Sequence
  Description of Artificial Sequence: Synthetic oligonucleotide
  Target: SCN10A; (-) strand; PAM type: YTN; PAM sequence: CTA
acctcttctcagtaactcag

SEQ ID NO: 45722 - DNA, 20 bp, Artificial Sequence
  Description of Artificial Sequence: Synthetic oligonucleotide
  Target: SCN10A; (-) strand; PAM type: YTN; PAM sequence: CTC
gctaacctcttctcagtaac

SEQ ID NO: 45723 - DNA, 20 bp, Artificial Sequence
  Description of Artificial Sequence: Synthetic oligonucleotide
  Target: SCN10A; (-) strand; PAM type: YTN; PAM sequence: CTG
gtatatcaaccctcgctaac

SEQ ID NO: 45724 - DNA, 20 bp, Artificial Sequence
  Description of Artificial Sequence: Synthetic oligonucleotide
  Target: SCN10A; (-) strand; PAM type: YTN; PAM sequence: TTA
agctggtatatcaaccctcg

SEQ ID NO: 45725 - DNA, 20 bp, Artificial Sequence
  Description of Artificial Sequence: Synthetic oligonucleotide
  Target: SCN10A; (-) strand; PAM type: YTN; PAM sequence: CTT
aagctggtatatcaaccctc

SEQ ID NO: 45726 - DNA, 20 bp, Artificial Sequence
  Description of Artificial Sequence: Synthetic oligonucleotide
  Target: SCN10A; (-) strand; PAM type: YTN; PAM sequence: CTA
ccttaagctggtatatcaac

SEQ ID NO: 45727 - DNA, 20 bp, Artificial Sequence
  Description of Artificial Sequence: Synthetic oligonucleotide
  Target: SCN10A; (-) strand; PAM type: YTN; PAM sequence: TTA
ctaccttaagctggtatatc

SEQ ID NO: 45728 - DNA, 20 bp, Artificial Sequence
  Description of Artificial Sequence: Synthetic oligonucleotide
  Target: SCN10A; (-) strand; PAM type: YTN; PAM sequence: CTT
actaccttaagctggtatat

SEQ ID NO: 45729 - DNA, 20 bp, Artificial Sequence
  Description of Artificial Sequence: Synthetic oligonucleotide
  Target: SCN10A; (-) strand; PAM type: YTN; PAM sequence: TTC
cttactaccttaagctggta

SEQ ID NO: 45730 - DNA, 20 bp, Artificial Sequence
  Description of Artificial Sequence: Synthetic oligonucleotide
  Target: SCN10A; (-) strand; PAM type: YTN; PAM sequence: CTA
ttccttactaccttaagctg

SEQ ID NO: 45731 - DNA, 20 bp, Artificial Sequence
  Description of Artificial Sequence: Synthetic oligonucleotide
  Target: SCN10A; (-) strand; PAM type: YTN; PAM sequence: TTG
gcactattccttactacctt

SEQ ID NO: 45732 - DNA, 20 bp, Artificial Sequence
  Description of Artificial Sequence: Synthetic oligonucleotide
  Target: SCN10A; (-) strand; PAM type: YTN; PAM sequence: CTT
ggcactattccttactacct

SEQ ID NO: 45733 - DNA, 20 bp, Artificial Sequence
  Description of Artificial Sequence: Synthetic oligonucleotide
  Target: SCN10A; (-) strand; PAM type: YTN; PAM sequence: TTA
aatacttggcactattcctt

SEQ ID NO: 45734 - DNA, 20 bp, Artificial Sequence
  Description of Artificial Sequence: Synthetic oligonucleotide
  Target: SCN10A; (-) strand; PAM type: YTN; PAM sequence: TTT
aaatacttggcactattcct

SEQ ID NO: 45735 - DNA, 20 bp, Artificial Sequence
  Description of Artificial Sequence: Synthetic oligonucleotide
  Target: SCN10A; (-) strand; PAM type: YTN; PAM sequence: TTT
taaatacttggcactattcc

SEQ ID NO: 45736 - DNA, 20 bp, Artificial Sequence
  Description of Artificial Sequence: Synthetic oligonucleotide
  Target: SCN10A; (-) strand; PAM type: YTN; PAM sequence: TTT
ttaaatacttggcactattc

SEQ ID NO: 45737 - DNA, 20 bp, Artificial Sequence
  Description of Artificial Sequence: Synthetic oligonucleotide
  Target: SCN10A; (-) strand; PAM type: YTN; PAM sequence: TTG
ataatatatatttttaaata

SEQ ID NO: 45738 - DNA, 20 bp, Artificial Sequence
  Description of Artificial Sequence: Synthetic oligonucleotide
  Target: SCN10A; (-) strand; PAM type: YTN; PAM sequence: TTT
gataatatatatttttaaat

SEQ ID NO: 45739 - DNA, 20 bp, Artificial Sequence
  Description of Artificial Sequence: Synthetic oligonucleotide
  Target: SCN10A; (-) strand; PAM type: YTN; PAM sequence: TTG
agccatttgataatatatat

SEQ ID NO: 45740 - DNA, 20 bp, Artificial Sequence
  Description of Artificial Sequence: Synthetic oligonucleotide
  Target: SCN10A; (-) strand; PAM type: YTN; PAM sequence: TTT
gagccatttgataatatata

SEQ ID NO: 45741 - DNA, 20 bp, Artificial Sequence
  Description of Artificial Sequence: Synthetic oligonucleotide
  Target: SCN10A; (-) strand; PAM type: YTN; PAM sequence: TTA
aagcacatttgagccatttg

SEQ ID NO: 45742 - DNA, 20 bp, Artificial Sequence
  Description of Artificial Sequence: Synthetic oligonucleotide
  Target: SCN10A; (-) strand; PAM type: YTN; PAM sequence: TTT
aaagcacatttgagccattt

SEQ ID NO: 45743 - DNA, 20 bp, Artificial Sequence
  Description of Artificial Sequence: Synthetic oligonucleotide
  Target: SCN10A; (-) strand; PAM type: YTN; PAM sequence: CTA
atttaaagcacatttgagcc

SEQ ID NO: 45744 - DNA, 20 bp, Artificial Sequence
  Description of Artificial Sequence: Synthetic oligonucleotide
  Target: SCN10A; (-) strand; PAM type: YTN; PAM sequence: TTG
gcaccaactaatttaaagca

SEQ ID NO: 45745 - DNA, 20 bp, Artificial Sequence
  Description of Artificial Sequence: Synthetic oligonucleotide
  Target: SCN10A; (-) strand; PAM type: YTN; PAM sequence: TTT
ggcaccaactaatttaaagc

SEQ ID NO: 45746 - DNA, 20 bp, Artificial Sequence
  Description of Artificial Sequence: Synthetic oligonucleotide
  Target: SCN10A; (-) strand; PAM type: YTN; PAM sequence: TTT
tggcaccaactaatttaaag

SEQ ID NO: 45747 - DNA, 20 bp, Artificial Sequence
  Description of Artificial Sequence: Synthetic oligonucleotide
  Target: SCN10A; (-) strand; PAM type: YTN; PAM sequence: CTT
ttggcaccaactaatttaaa

SEQ ID NO: 45748 - DNA, 20 bp, Artificial Sequence
  Description of Artificial Sequence: Synthetic oligonucleotide
  Target: SCN10A; (-) strand; PAM type: YTN; PAM sequence: CTC
cttttggcaccaactaattt

SEQ ID NO: 45749 - DNA, 20 bp, Artificial Sequence
  Description of Artificial Sequence: Synthetic oligonucleotide
  Target: SCN10A; (-) strand; PAM type: YTN; PAM sequence: TTC
cccacaagtggtatcacagg

SEQ ID NO: 45750 - DNA, 20 bp, Artificial Sequence
  Description of Artificial Sequence: Synthetic oligonucleotide
  Target: SCN10A; (-) strand; PAM type: YTN; PAM sequence: TTT
ccccacaagtggtatcacag

SEQ ID NO: 45751 - DNA, 20 bp, Artificial Sequence
  Description of Artificial Sequence: Synthetic oligonucleotide
  Target: SCN10A; (-) strand; PAM type: YTN; PAM sequence: TTT
tccccacaagtggtatcaca

SEQ ID NO: 45752 - DNA, 20 bp, Artificial Sequence
  Description of Artificial Sequence: Synthetic oligonucleotide
  Target: SCN10A; (-) strand; PAM type: YTN; PAM sequence: CTT
ttccccacaagtggtatcac

SEQ ID NO: 45753 - DNA, 20 bp, Artificial Sequence
  Description of Artificial Sequence: Synthetic oligonucleotide
  Target: SCN10A; (-) strand; PAM type: YTN; PAM sequence: TTA
gccagcttttccccacaagt

SEQ ID NO: 45754 - DNA, 20 bp, Artificial Sequence
  Description of Artificial Sequence: Synthetic oligonucleotide
  Target: SCN10A; (-) strand; PAM type: YTN; PAM sequence: TTT
agccagcttttccccacaag

SEQ ID NO: 45755 - DNA, 20 bp, Artificial Sequence
  Description of Artificial Sequence: Synthetic oligonucleotide
  Target: SCN10A; (-) strand; PAM type: YTN; PAM sequence: CTC
atttagccagcttttcccca

SEQ ID NO: 45756 - DNA, 20 bp, Artificial Sequence
  Description of Artificial Sequence: Synthetic oligonucleotide
  Target: SCN10A; (-) strand; PAM type: YTN; PAM sequence: TTA
tgtgactcatttagccagct

SEQ ID NO: 45757 - DNA, 20 bp, Artificial Sequence
  Description of Artificial Sequence: Synthetic oligonucleotide
  Target: SCN10A; (-) strand; PAM type: YTN; PAM sequence: CTT
atgtgactcatttagccagc

SEQ ID NO: 45758 - DNA, 20 bp, Artificial Sequence
  Description of Artificial Sequence: Synthetic oligonucleotide
  Target: SCN10A; (-) strand; PAM type: YTN; PAM sequence: TTC
ttatgtgactcatttagcca

SEQ ID NO: 45759 - DNA, 20 bp, Artificial Sequence
  Description of Artificial Sequence: Synthetic oligonucleotide
  Target: SCN10A; (-) strand; PAM type: YTN; PAM sequence: CTG
attcttatgtgactcattta

SEQ ID NO: 45760 - DNA, 20 bp, Artificial Sequence
  Description of Artificial Sequence: Synthetic oligonucleotide
  Target: SCN10A; (-) strand; PAM type: YTN; PAM sequence: CTA
agaagtcctgattcttatgt

SEQ ID NO: 45761 - DNA, 20 bp, Artificial Sequence
  Description of Artificial Sequence: Synthetic oligonucleotide
  Target: SCN10A; (-) strand; PAM type: YTN; PAM sequence: TTA
ccagcatcctaagaagtcct

SEQ ID NO: 45762 - DNA, 20 bp, Artificial Sequence
  Description of Artificial Sequence: Synthetic oligonucleotide
  Target: SCN10A; (-) strand; PAM type: YTN; PAM sequence: TTT
accagcatcctaagaagtcc

SEQ ID NO: 45763 - DNA, 20 bp, Artificial Sequence
  Description of Artificial Sequence: Synthetic oligonucleotide
  Target: SCN10A; (-) strand; PAM type: YTN; PAM sequence: CTT
taccagcatcctaagaagtc

SEQ ID NO: 45764 - DNA, 20 bp, Artificial Sequence
  Description of Artificial Sequence: Synthetic oligonucleotide
  Target: SCN10A; (-) strand; PAM type: YTN; PAM sequence: CTA
atctttaccagcatcctaag

SEQ ID NO: 45765 - DNA, 20 bp, Artificial Sequence
  Description of Artificial Sequence: Synthetic oligonucleotide
  Target: SCN10A; (-) strand; PAM type: YTN; PAM sequence: CTC
atctaatctttaccagcatc

SEQ ID NO: 45766 - DNA, 20 bp, Artificial Sequence
  Description of Artificial Sequence: Synthetic oligonucleotide
  Target: SCN10A; (-) strand; PAM type: YTN; PAM sequence: TTG
tccaagagcaaggctcatct

SEQ ID NO: 45767 - DNA, 20 bp, Artificial Sequence
  Description of Artificial Sequence: Synthetic oligonucleotide
  Target: SCN10A; (-) strand; PAM type: YTN; PAM sequence: CTA
agaacaggatgttgtccaag

SEQ ID NO: 45768 - DNA, 20 bp, Artificial Sequence
  Description of Artificial Sequence: Synthetic oligonucleotide
  Target: SCN10A; (-) strand; PAM type: YTN; PAM sequence: CTC
taagaacaggatgttgtcca

SEQ ID NO: 45769 - DNA, 20 bp, Artificial Sequence
  Description of Artificial Sequence: Synthetic oligonucleotide
  Target: SCN10A; (-) strand; PAM type: YTN; PAM sequence: TTC
tctaagaacaggatgttgtc

SEQ ID NO: 45770 - DNA, 20 bp, Artificial Sequence
  Description of Artificial Sequence: Synthetic oligonucleotide
  Target: SCN10A; (-) strand; PAM type: YTN; PAM sequence: TTT
ctctaagaacaggatgttgt

SEQ ID NO: 45771 - DNA, 20 bp, Artificial Sequence
  Description of Artificial Sequence: Synthetic oligonucleotide
  Target: SCN10A; (-) strand; PAM type: YTN; PAM sequence: CTA
atgagatttctctaagaaca

SEQ ID NO: 45772 - DNA, 20 bp, Artificial Sequence
  Description of Artificial Sequence: Synthetic oligonucleotide
  Target: SCN10A; (-) strand; PAM type: YTN; PAM sequence: CTG
tgcatgagatgctaatgaga

SEQ ID NO: 45773 - DNA, 20 bp, Artificial Sequence
  Description of Artificial Sequence: Synthetic oligonucleotide
  Target: SCN10A; (-) strand; PAM type: YTN; PAM sequence: CTC
tgtgcatgagatgctaatga

SEQ ID NO: 45774 - DNA, 20 bp, Artificial Sequence
  Description of Artificial Sequence: Synthetic oligonucleotide
  Target: SCN10A; (-) strand; PAM type: YTN; PAM sequence: CTG
cccaacccaggctctgtgca

SEQ ID NO: 45775 - DNA, 20 bp, Artificial Sequence
  Description of Artificial Sequence: Synthetic oligonucleotide
  Target: SCN10A; (-) strand; PAM type: YTN; PAM sequence: CTC
tgcccaacccaggctctgtg

SEQ ID NO: 45776 - DNA, 20 bp, Artificial Sequence
  Description of Artificial Sequence: Synthetic oligonucleotide
  Target: SCN10A; (-) strand; PAM type: YTN; PAM sequence: CTG
tcccatgcgctctgcccaac

SEQ ID NO: 45777 - DNA, 20 bp, Artificial Sequence
  Description of Artificial Sequence: Synthetic oligonucleotide
  Target: SCN10A; (-) strand; PAM type: YTN; PAM sequence: TTC
acacagctgtcccatgcgct

SEQ ID NO: 45778 - DNA, 20 bp, Artificial Sequence
  Description of Artificial Sequence: Synthetic oligonucleotide
  Target: SCN10A; (-) strand; PAM type: YTN; PAM sequence: TTT
cacacagctgtcccatgcgc

SEQ ID NO: 45779 - DNA, 20 bp, Artificial Sequence
  Description of Artificial Sequence: Synthetic oligonucleotide
  Target: SCN10A; (-) strand; PAM type: YTN; PAM sequence: CTT
tcacacagctgtcccatgcg

SEQ ID NO: 45780 - DNA, 20 bp, Artificial Sequence
  Description of Artificial Sequence: Synthetic oligonucleotide
  Target: SCN10A; (-) strand; PAM type: YTN; PAM sequence: TTG
tctttcacacagctgtccca

SEQ ID NO: 45781 - DNA, 20 bp, Artificial Sequence
  Description of Artificial Sequence: Synthetic oligonucleotide
  Target: SCN10A; (-) strand; PAM type: YTN; PAM sequence: TTG
gggattgtctttcacacagc

SEQ ID NO: 45782 - DNA, 20 bp, Artificial Sequence
  Description of Artificial Sequence: Synthetic oligonucleotide
  Target: SCN10A; (-) strand; PAM type: YTN; PAM sequence: CTT
ggggattgtctttcacacag

SEQ ID NO: 45783 - DNA, 20 bp, Artificial Sequence
  Description of Artificial Sequence: Synthetic oligonucleotide
  Target: SCN10A; (-) strand; PAM type: YTN; PAM sequence: TTG
aggtgcttggggattgtctt

SEQ ID NO: 45784 - DNA, 20 bp, Artificial Sequence
  Description of Artificial Sequence: Synthetic oligonucleotide
  Target: SCN10A; (-) strand; PAM type: YTN; PAM sequence: CTT
gaggtgcttggggattgtct

SEQ ID NO: 45785 - DNA, 20 bp, Artificial Sequence
  Description of Artificial Sequence: Synthetic oligonucleotide
  Target: SCN10A; (-) strand; PAM type: YTN; PAM sequence: TTC
cccaggcagacaaacaggga

SEQ ID NO: 45786 - DNA, 20 bp, Artificial Sequence
  Description of Artificial Sequence: Synthetic oligonucleotide
  Target: SCN10A; (-) strand; PAM type: YTN; PAM sequence: CTG
gaagaaaaagtcagaattcc

SEQ ID NO: 45787 - DNA, 20 bp, Artificial Sequence
  Description of Artificial Sequence: Synthetic oligonucleotide
  Target: SCN10A; (-) strand; PAM type: YTN; PAM sequence: TTG
agcagggcctggaagaaaaa

SEQ ID NO: 45788 - DNA, 20 bp, Artificial Sequence
  Description of Artificial Sequence: Synthetic oligonucleotide
  Target: SCN10A; (-) strand; PAM type: YTN; PAM sequence: TTT
gagcagggcctggaagaaaa

SEQ ID NO: 45789 - DNA, 20 bp, Artificial Sequence
  Description of Artificial Sequence: Synthetic oligonucleotide
  Target: SCN10A; (-) strand; PAM type: YTN; PAM sequence: TTG
gcgtttgagcagggcctgga

SEQ ID NO: 45790 - DNA, 20 bp, Artificial Sequence
  Description of Artificial Sequence: Synthetic oligonucleotide
  Target: SCN10A; (-) strand; PAM type: YTN; PAM sequence: TTC
cagaggagttggcgtttgag

SEQ ID NO: 45791 - DNA, 20 bp, Artificial Sequence
  Description of Artificial Sequence: Synthetic oligonucleotide
  Target: SCN10A; (-) strand; PAM type: YTN; PAM sequence: TTT
ccagaggagttggcgtttga

SEQ ID NO: 45792 - DNA, 20 bp, Artificial Sequence
  Description of Artificial Sequence: Synthetic oligonucleotide
  Target: SCN10A; (-) strand; PAM type: YTN; PAM sequence: CTT
tccagaggagttggcgtttg

SEQ ID NO: 45793 - DNA, 20 bp, Artificial Sequence
  Description of Artificial Sequence: Synthetic oligonucleotide
  Target: SCN10A; (-) strand; PAM type: YTN; PAM sequence: TTA
aaccatgccaagctttccag

SEQ ID NO: 45794 - DNA, 20 bp, Artificial Sequence
  Description of Artificial Sequence: Synthetic oligonucleotide
  Target: SCN10A; (-) strand; PAM type: YTN; PAM sequence: TTT
aaaccatgccaagctttcca

SEQ ID NO: 45795 - DNA, 20 bp, Artificial Sequence
  Description of Artificial Sequence: Synthetic oligonucleotide
  Target: SCN10A; (-) strand; PAM type: YTN; PAM sequence: TTG
acataaagaagtttaaacca

SEQ ID NO: 45796 - DNA, 20 bp, Artificial Sequence
  Description of Artificial Sequence: Synthetic oligonucleotide
  Target: SCN10A; (-) strand; PAM type: YTN; PAM sequence: CTT
gacataaagaagtttaaacc

SEQ ID NO: 45797 - DNA, 20 bp, Artificial Sequence
  Description of Artificial Sequence: Synthetic oligonucleotide
  Target: SCN10A; (-) strand; PAM type: YTN; PAM sequence: TTG
agtgacaaagggcaaaaggg

SEQ ID NO: 45798 - DNA, 20 bp, Artificial Sequence
  Description of Artificial Sequence: Synthetic oligonucleotide
  Target: SCN10A; (-) strand; PAM type: YTN; PAM sequence: CTT
gagtgacaaagggcaaaagg

SEQ ID NO: 45799 - DNA, 20 bp, Artificial Sequence
  Description of Artificial Sequence: Synthetic oligonucleotide
  Target: SCN10A; (-) strand; PAM type: YTN; PAM sequence: TTC
agggcttgagtgacaaaggg

SEQ ID NO: 45800 - DNA, 20 bp, Artificial Sequence
  Description of Artificial Sequence: Synthetic oligonucleotide
  Target: SCN10A; (-) strand; PAM type: YTN; PAM sequence: CTT
cagggcttgagtgacaaagg

SEQ ID NO: 45801 - DNA, 20 bp, Artificial Sequence
  Description of Artificial Sequence: Synthetic oligonucleotide
  Target: SCN10A; (-) strand; PAM type: YTN; PAM sequence: TTA
tccccaagggacagccacag

SEQ ID NO: 45802 - DNA, 20 bp, Artificial Sequence
  Description of Artificial Sequence: Synthetic oligonucleotide
  Target: SCN10A; (-) strand; PAM type: YTN; PAM sequence: TTC
cagcaggaagtgatccccaa

SEQ ID NO: 45803 - DNA, 20 bp, Artificial Sequence
  Description of Artificial Sequence: Synthetic oligonucleotide
  Target: SCN10A; (-) strand; PAM type: YTN; PAM sequence: CTT
ccagcaggaagtgatcccca

SEQ ID NO: 45804 - DNA, 20 bp, Artificial Sequence
  Description of Artificial Sequence: Synthetic oligonucleotide
  Target: SCN10A; (-) strand; PAM type: YTN; PAM sequence: CTC
agagcttccagcaggaagtg

SEQ ID NO: 45805 - DNA, 20 bp, Artificial Sequence
  Description of Artificial Sequence: Synthetic oligonucleotide
  Target: SCN10A; (-) strand; PAM type: YTN; PAM sequence: TTG
gaggatgatggtggggaaga

SEQ ID NO: 45806 - DNA, 20 bp, Artificial Sequence
  Description of Artificial Sequence: Synthetic oligonucleotide
  Target: SCN10A; (-) strand; PAM type: YTN; PAM sequence: CTT
ggaggatgatggtggggaag

SEQ ID NO: 45807 - DNA, 20 bp, Artificial Sequence
  Description of Artificial Sequence: Synthetic oligonucleotide
  Target: SCN10A; (-) strand; PAM type: YTN; PAM sequence: TTG
atgacttggaggatgatggt

SEQ ID NO: 45808 - DNA, 20 bp, Artificial Sequence
  Description of Artificial Sequence: Synthetic oligonucleotide
  Target: SCN10A; (-) strand; PAM type: YTN; PAM sequence: CTT
gatgacttggaggatgatgg

SEQ ID NO: 45809 - DNA, 20 bp, Artificial Sequence
  Description of Artificial Sequence: Synthetic oligonucleotide
  Target: SCN10A; (-) strand; PAM type: YTN; PAM sequence: CTG
atcttgatgacttggaggat

SEQ ID NO: 45810 - DNA, 20 bp, Artificial Sequence
  Description of Artificial Sequence: Synthetic oligonucleotide
  Target: SCN10A; (-) strand; PAM type: YTN; PAM sequence: CTG
agggtgaatctgatcttgat

SEQ ID NO: 45811 - DNA, 20 bp, Artificial Sequence
  Description of Artificial Sequence: Synthetic oligonucleotide
  Target: SCN10A; (-) strand; PAM type: YTN; PAM sequence: TTG
ctgagggtgaatctgatctt

SEQ ID NO: 45812 - DNA, 20 bp, Artificial Sequence
  Description of Artificial Sequence: Synthetic oligonucleotide
  Target: SCN10A; (-) strand; PAM type: YTN; PAM sequence: CTG
tgcccattgctgagggtgaa

SEQ ID NO: 45813 - DNA, 20 bp, Artificial Sequence
  Description of Artificial Sequence: Synthetic oligonucleotide
  Target: SCN10A; (-) strand; PAM type: YTN; PAM sequence: CTC
tgtgcccattgctgagggtg

SEQ ID NO: 45814 - DNA, 20 bp, Artificial Sequence
  Description of Artificial Sequence: Synthetic oligonucleotide
  Target: SCN10A; (-) strand; PAM type: YTN; PAM sequence: CTG
tgtgggtctctgtgcccatt

SEQ ID NO: 45815 - DNA, 20 bp, Artificial Sequence
  Description of Artificial Sequence: Synthetic oligonucleotide
  Target: SCN10A; (-) strand; PAM type: YTN; PAM sequence: CTA
atccgactgtgtgggtctct

SEQ ID NO: 45816 - DNA, 20 bp, Artificial Sequence
  Description of Artificial Sequence: Synthetic oligonucleotide
  Target: SCN10A; (-) strand; PAM type: YTN; PAM sequence: TTC
atcgctaatccgactgtgtg

SEQ ID NO: 45817 - DNA, 20 bp, Artificial Sequence
  Description of Artificial Sequence: Synthetic oligonucleotide
  Target: SCN10A; (-) strand; PAM type: YTN; PAM sequence: CTT
catcgctaatccgactgtgt

SEQ ID NO: 45818 - DNA, 20 bp, Artificial Sequence
  Description of Artificial Sequence: Synthetic oligonucleotide
  Target: SCN10A; (-) strand; PAM type: YTN; PAM sequence: CTC
ccagaggccccagggatgag

SEQ ID NO: 45819 - DNA, 20 bp, Artificial Sequence
  Description of Artificial Sequence: Synthetic oligonucleotide
  Target: SCN10A; (-) strand; PAM type: YTN; PAM sequence: CTC
caagctcccagaggccccag

SEQ ID NO: 45820 - DNA, 20 bp, Artificial Sequence
  Description of Artificial Sequence: Synthetic oligonucleotide
  Target: SCN10A; (-) strand; PAM type: YTN; PAM sequence: CTG
gagggctccaagctcccaga

SEQ ID NO: 45821 - DNA, 20 bp, Artificial Sequence
  Description of Artificial Sequence: Synthetic oligonucleotide
  Target: SCN10A; (-) strand; PAM type: YTN; PAM sequence: CTC
tggagggctccaagctccca

SEQ ID NO: 45822 - DNA, 20 bp, Artificial Sequence
  Description of Artificial Sequence: Synthetic oligonucleotide
  Target: SCN10A; (-) strand; PAM type: YTN; PAM sequence: CTG
ccagggggagctctggaggg

SEQ ID NO: 45823 - DNA, 20 bp, Artificial Sequence
  Description of Artificial Sequence: Synthetic oligonucleotide
  Target: SCN10A; (-) strand; PAM type: YTN; PAM sequence: CTG
ccaacactgccagggggagc

SEQ ID NO: 45824 - DNA, 20 bp, Artificial Sequence
  Description of Artificial Sequence: Synthetic oligonucleotide
  Target: SCN10A; (-) strand; PAM type: YTN; PAM sequence: TTG
ctgccaacactgccaggggg

SEQ ID NO: 45825 - DNA, 20 bp, Artificial Sequence
  Description of Artificial Sequence: Synthetic oligonucleotide
  Target: SCN10A; (-) strand; PAM type: YTN; PAM sequence: CTG
agaaccacattgctgccaac

SEQ ID NO: 45826 - DNA, 20 bp, Artificial Sequence
  Description of Artificial Sequence: Synthetic oligonucleotide
  Target: SCN10A; (-) strand; PAM type: YTN; PAM sequence: CTC
caaggctgagaaccacattg

SEQ ID NO: 45827 - DNA, 20 bp, Artificial Sequence
  Description of Artificial Sequence: Synthetic oligonucleotide
  Target: SCN10A; (-) strand; PAM type: YTN; PAM sequence: CTC
cagctccaaggctgagaacc

SEQ ID NO: 45828 - DNA, 20 bp, Artificial Sequence
  Description of Artificial Sequence: Synthetic oligonucleotide
  Target: SCN10A; (-) strand; PAM type: YTN; PAM sequence: CTC
tccagctccaaggctgagaa

SEQ ID NO: 45829 - DNA, 20 bp, Artificial Sequence
  Description of Artificial Sequence: Synthetic oligonucleotide
  Target: SCN10A; (-) strand; PAM type: YTN; PAM sequence: CTC
ccactctccagctccaaggc

SEQ ID NO: 45830 - DNA, 20 bp, Artificial Sequence
  Description of Artificial Sequence: Synthetic oligonucleotide
  Target: SCN10A; (-) strand; PAM type: YTN; PAM sequence: CTG
gtggtgaaactcccactctc

SEQ ID NO: 45831 - DNA, 20 bp, Artificial Sequence
  Description of Artificial Sequence: Synthetic oligonucleotide
  Target: SCN10A; (-) strand; PAM type: YTN; PAM sequence: CTG
agctggtggtgaaactccca

SEQ ID NO: 45832 - DNA, 20 bp, Artificial Sequence
  Description of Artificial Sequence: Synthetic oligonucleotide
  Target: SCN10A; (-) strand; PAM type: YTN; PAM sequence: TTC
ccccagcccaaggcagagcc

SEQ ID NO: 45833 - DNA, 20 bp, Artificial Sequence
  Description of Artificial Sequence: Synthetic oligonucleotide
  Target: SCN10A; (-) strand; PAM type: YTN; PAM sequence: CTG
cccattcccccagcccaagg

SEQ ID NO: 45834 - DNA, 20 bp, Artificial Sequence
  Description of Artificial Sequence: Synthetic oligonucleotide
  Target: SCN10A; (-) strand; PAM type: YTN; PAM sequence: TTC
agcaggtcctgcccattccc

SEQ ID NO: 45835 - DNA, 20 bp, Artificial Sequence
  Description of Artificial Sequence: Synthetic oligonucleotide
  Target: SCN10A; (-) strand; PAM type: YTN; PAM sequence: CTT
cagcaggtcctgcccattcc

SEQ ID NO: 45836 - DNA, 20 bp, Artificial Sequence
  Description of Artificial Sequence: Synthetic oligonucleotide
  Target: SCN10A; (-) strand; PAM type: YTN; PAM sequence: TTC
ttcagcaggtcctgcccatt

SEQ ID NO: 45837 - DNA, 20 bp, Artificial Sequence
  Description of Artificial Sequence: Synthetic oligonucleotide
  Target: SCN10A; (-) strand; PAM type: YTN; PAM sequence: CTT
cttcagcaggtcctgcccat

SEQ ID NO: 45838 - DNA, 20 bp, Artificial Sequence
  Description of Artificial Sequence: Synthetic oligonucleotide
  Target: SCN10A; (-) strand; PAM type: YTN; PAM sequence: TTG
cagcttcttcagcaggtcct

SEQ ID NO: 45839 - DNA, 20 bp, Artificial Sequence
  Description of Artificial Sequence: Synthetic oligonucleotide
  Target: SCN10A; (-) strand; PAM type: YTN; PAM sequence: TTT
gcagcttcttcagcaggtcc

SEQ ID NO: 45840 - DNA, 20 bp, Artificial Sequence
  Description of Artificial Sequence: Synthetic oligonucleotide
  Target: SCN10A; (-) strand; PAM type: YTN; PAM sequence: CTT
tgcagcttcttcagcaggtc

SEQ ID NO: 45841 - DNA, 20 bp, Artificial Sequence
  Description of Artificial Sequence: Synthetic oligonucleotide
  Target: SCN10A; (-) strand; PAM type: YTN; PAM sequence: CTC
tttgcagcttcttcagcagg

SEQ ID NO: 45842 - DNA, 20 bp, Artificial Sequence
  Description of Artificial Sequence: Synthetic oligonucleotide
  Target: SCN10A; (-) strand; PAM type: YTN; PAM sequence: TTG
gccatcgtaccaaacaggct

SEQ ID NO: 45843 - DNA, 20 bp, Artificial Sequence
  Description of Artificial Sequence: Synthetic oligonucleotide
  Target: SCN10A; (-) strand; PAM type: YTN; PAM sequence: TTT
ggccatcgtaccaaacaggc

SEQ ID NO: 45844 - DNA, 20 bp, Artificial Sequence
  Description of Artificial Sequence: Synthetic oligonucleotide
  Target: SCN10A; (-) strand; PAM type: YTN; PAM sequence: CTT
tggccatcgtaccaaacagg

SEQ ID NO: 45845 - DNA, 20 bp, Artificial Sequence
  Description of Artificial Sequence: Synthetic oligonucleotide
  Target: SCN10A; (-) strand; PAM type: YTN; PAM sequence: CTG
gcacggatccaggtctttgg

SEQ ID NO: 45846 - DNA, 20 bp, Artificial Sequence
  Description of Artificial Sequence: Synthetic oligonucleotide
  Target: SCN10A; (-) strand; PAM type: YTN; PAM sequence: CTG
caggtggccctggcacggat

SEQ ID NO: 45847 - DNA, 20 bp, Artificial Sequence
  Description of Artificial Sequence: Synthetic oligonucleotide
  Target: SCN10A; (-) strand; PAM type: YTN; PAM sequence: CTC
acagccccggaggacgatgg

SEQ ID NO: 45848 - DNA, 20 bp, Artificial Sequence
  Description of Artificial Sequence: Synthetic oligonucleotide
  Target: SCN10A; (-) strand; PAM type: YTN; PAM sequence: CTG
acaacctcacagccccggag

SEQ ID NO: 45849 - DNA, 20 bp, Artificial Sequence
  Description of Artificial Sequence: Synthetic oligonucleotide
  Target: SCN10A; (-) strand; PAM type: YTN; PAM sequence: TTC
agtgctgacaacctcacagc

SEQ ID NO: 45850 - DNA, 20 bp, Artificial Sequence
  Description of Artificial Sequence: Synthetic oligonucleotide
  Target: SCN10A; (-) strand; PAM type: YTN; PAM sequence: TTT
cagtgctgacaacctcacag

SEQ ID NO: 45851 - DNA, 20 bp, Artificial Sequence
  Description of Artificial Sequence: Synthetic oligonucleotide
  Target: SCN10A; (-) strand; PAM type: YTN; PAM sequence: CTT
tcagtgctgacaacctcaca

SEQ ID NO: 45852 - DNA, 20 bp, Artificial Sequence
  Description of Artificial Sequence: Synthetic oligonucleotide
  Target: SCN10A; (-) strand; PAM type: YTN; PAM sequence: CTC
tttcagtgctgacaacctca

SEQ ID NO: 45853 - DNA, 20 bp, Artificial Sequence
  Description of Artificial Sequence: Synthetic oligonucleotide
  Target: SCN10A; (-) strand; PAM type: YTN; PAM sequence: TTG
aactctttcagtgctgacaa

SEQ ID NO: 45854 - DNA, 20 bp, Artificial Sequence
  Description of Artificial Sequence: Synthetic oligonucleotide
  Target: SCN10A; (-) strand; PAM type: YTN; PAM sequence: CTA
ttgaactctttcagtgctga

SEQ ID NO: 45855 - DNA, 20 bp, Artificial Sequence
  Description of Artificial Sequence: Synthetic oligonucleotide
  Target: SCN10A; (-) strand; PAM type: YTN; PAM sequence: CTG
ctattgaactctttcagtgc

SEQ ID NO: 45856 - DNA, 20 bp, Artificial Sequence
  Description of Artificial Sequence: Synthetic oligonucleotide
  Target: SCN10A; (-) strand; PAM type: YTN; PAM sequence: TTC
atcgccctgctattgaactc

SEQ ID NO: 45857 - DNA, 20 bp, Artificial Sequence
  Description of Artificial Sequence: Synthetic oligonucleotide
  Target: SCN10A; (-) strand; PAM type: YTN; PAM sequence: CTG
ttcatcgccctgctattgaa

SEQ ID NO: 45858 - DNA, 20 bp, Artificial Sequence
  Description of Artificial Sequence: Synthetic oligonucleotide
  Target: SCN10A; (-) strand; PAM type: YTN; PAM sequence: TTA
acctgttcatcgccctgcta

SEQ ID NO: 45859 - DNA, 20 bp, Artificial Sequence
  Description of Artificial Sequence: Synthetic oligonucleotide
  Target: SCN10A; (-) strand; PAM type: YTN; PAM sequence: CTT
aacctgttcatcgccctgct

SEQ ID NO: 45860 - DNA, 20 bp, Artificial Sequence
  Description of Artificial Sequence: Synthetic oligonucleotide
  Target: SCN10A; (-) strand; PAM type: YTN; PAM sequence: TTC
aggtgcttaacctgttcatc

SEQ ID NO: 45861 - DNA, 20 bp, Artificial Sequence
  Description of Artificial Sequence: Synthetic oligonucleotide
  Target: SCN10A; (-) strand; PAM type: YTN; PAM sequence: CTT
caggtgcttaacctgttcat

SEQ ID NO: 45862 - DNA, 20 bp, Artificial Sequence
  Description of Artificial Sequence: Synthetic oligonucleotide
  Target: SCN10A; (-) strand; PAM type: YTN; PAM sequence: CTC
ttcaggtgcttaacctgttc

SEQ ID NO: 45863 - DNA, 20 bp, Artificial Sequence
  Description of Artificial Sequence: Synthetic oligonucleotide
  Target: SCN10A; (-) strand; PAM type: YTN; PAM sequence: TTC
tcttcaggtgcttaacctgt

SEQ ID NO: 45864 - DNA, 20 bp, Artificial Sequence
  Description of Artificial Sequence: Synthetic oligonucleotide
  Target: SCN10A; (-) strand; PAM type: YTN; PAM sequence: CTT
ctcttcaggtgcttaacctg

SEQ ID NO: 45865 - DNA, 20 bp, Artificial Sequence
  Description of Artificial Sequence: Synthetic oligonucleotide
  Target: SCN10A; (-) strand; PAM type: YTN; PAM sequence: TTC
cttctcttcaggtgcttaac

SEQ ID NO: 45866 - DNA, 20 bp, Artificial Sequence
  Description of Artificial Sequence: Synthetic oligonucleotide
  Target: SCN10A; (-) strand; PAM type: YTN; PAM sequence: TTC
cattccttctcttcaggtgc

SEQ ID NO: 45867 - DNA, 20 bp, Artificial Sequence
  Description of Artificial Sequence: Synthetic oligonucleotide
  Target: SCN10A; (-) strand; PAM type: YTN; PAM sequence: CTT
ccattccttctcttcaggtg

SEQ ID NO: 45868 - DNA, 20 bp, Artificial Sequence
  Description of Artificial Sequence: Synthetic oligonucleotide
  Target: SCN10A; (-) strand; PAM type: YTN; PAM sequence: TTC
ccttccattccttctcttca

SEQ ID NO: 45869 - DNA, 20 bp, Artificial Sequence
  Description of Artificial Sequence: Synthetic oligonucleotide
  Target: SCN10A; (-) strand; PAM type: YTN; PAM sequence: CTT
cccttccattccttctcttc

SEQ ID NO: 45870 - DNA, 20 bp, Artificial Sequence
  Description of Artificial Sequence: Synthetic oligonucleotide
  Target: SCN10A; (-) strand; PAM type: YTN; PAM sequence: TTG
atcaatcttcccttccattc

SEQ ID NO: 45871 - DNA, 20 bp, Artificial Sequence
  Description of Artificial Sequence: Synthetic oligonucleotide
  Target: SCN10A; (-) strand; PAM type: YTN; PAM sequence: TTA
gagattgatcaatcttccct

SEQ ID NO: 45872 - DNA, 20 bp, Artificial Sequence
  Description of Artificial Sequence: Synthetic oligonucleotide
  Target: SCN10A; (-) strand; PAM type: YTN; PAM sequence: CTT
agagattgatcaatcttccc

SEQ ID NO: 45873 - DNA, 20 bp, Artificial Sequence
  Description of Artificial Sequence: Synthetic oligonucleotide
  Target: SCN10A; (-) strand; PAM type: YTN; PAM sequence: CTC
agcttagagattgatcaatc

SEQ ID NO: 45874 - DNA, 20 bp, Artificial Sequence
  Description of Artificial Sequence: Synthetic oligonucleotide
  Target: SCN10A; (-) strand; PAM type: YTN; PAM sequence: CTA
acccggtaggccaatgtggg

SEQ ID NO: 45875 - DNA, 20 bp, Artificial Sequence
  Description of Artificial Sequence: Synthetic oligonucleotide
  Target: SCN10A; (-) strand; PAM type: YTN; PAM sequence: CTG
ctaacccggtaggccaatgt

SEQ ID NO: 45876 - DNA, 20 bp, Artificial Sequence
  Description of Artificial Sequence: Synthetic oligonucleotide
  Target: SCN10A; (-) strand; PAM type: YTN; PAM sequence: TTG
ccagccagctgctaacccgg

SEQ ID NO: 45877 - DNA, 20 bp, Artificial Sequence
  Description of Artificial Sequence: Synthetic oligonucleotide
  Target: SCN10A; (-) strand; PAM type: YTN; PAM sequence: CTT
gccagccagctgctaacccg

SEQ ID NO: 45878 - DNA, 20 bp, Artificial Sequence
  Description of Artificial Sequence: Synthetic oligonucleotide
  Target: SCN10A; (-) strand; PAM type: YTN; PAM sequence: CTG
tcttgccagccagctgctaa

SEQ ID NO: 45879 - DNA, 20 bp, Artificial Sequence
  Description of Artificial Sequence: Synthetic oligonucleotide
  Target: SCN10A; (-) strand; PAM type: YTN; PAM sequence: TTC
ccccaaaagggacagcatcc

SEQ ID NO: 45880 - DNA, 20 bp, Artificial Sequence
  Description of Artificial Sequence: Synthetic oligonucleotide
  Target: SCN10A; (-) strand; PAM type: YTN; PAM sequence: CTC
agaaagtccattcccccaaa

SEQ ID NO: 45881 - DNA, 20 bp, Artificial Sequence
  Description of Artificial Sequence: Synthetic oligonucleotide
  Target: SCN10A; (-) strand; PAM type: YTN; PAM sequence: CTC
tcagaaagtccattccccca

SEQ ID NO: 45882 - DNA, 20 bp, Artificial Sequence
  Description of Artificial Sequence: Synthetic oligonucleotide
  Target: SCN10A; (-) strand; PAM type: YTN; PAM sequence: CTG
ctctcagaaagtccattccc

SEQ ID NO: 45883 - DNA, 20 bp, Artificial Sequence
  Description of Artificial Sequence: Synthetic oligonucleotide
  Target: SCN10A; (-) strand; PAM type: YTN; PAM sequence: CTC
aactgctctcagaaagtcca

SEQ ID NO: 45884 - DNA, 20 bp, Artificial Sequence
  Description of Artificial Sequence: Synthetic oligonucleotide
  Target: SCN10A; (-) strand; PAM type: YTN; PAM sequence: TTC
cctcaactgctctcagaaag

SEQ ID NO: 45885 - DNA, 20 bp, Artificial Sequence
  Description of Artificial Sequence: Synthetic oligonucleotide
  Target: SCN10A; (-) strand; PAM type: YTN; PAM sequence: TTT
ccctcaactgctctcagaaa

SEQ ID NO: 45886 - DNA, 20 bp, Artificial Sequence
  Description of Artificial Sequence: Synthetic oligonucleotide
  Target: SCN10A; (-) strand; PAM type: YTN; PAM sequence: CTT
tccctcaactgctctcagaa

SEQ ID NO: 45887 - DNA, 20 bp, Artificial Sequence
  Description of Artificial Sequence: Synthetic oligonucleotide
  Target: SCN10A; (-) strand; PAM type: YTN; PAM sequence: CTC
caggacatccccaaactttc

SEQ ID NO: 45888 - DNA, 20 bp, Artificial Sequence
  Description of Artificial Sequence: Synthetic oligonucleotide
  Target: SCN10A; (-) strand; PAM type: YTN; PAM sequence: CTG
aggcgggtcactccaggaca

SEQ ID NO: 45889 - DNA, 20 bp, Artificial Sequence
  Description of Artificial Sequence: Synthetic oligonucleotide
  Target: SCN10A; (-) strand; PAM type: YTN; PAM sequence: CTC
gtccactgaggcgggtcact

SEQ ID NO: 45890 - DNA, 20 bp, Artificial Sequence
  Description of Artificial Sequence: Synthetic oligonucleotide
  Target: SCN10A; (-) strand; PAM type: YTN; PAM sequence: TTC
caagcctcgtccactgaggc

SEQ ID NO: 45891 - DNA, 20 bp, Artificial Sequence
  Description of Artificial Sequence: Synthetic oligonucleotide
  Target: SCN10A; (-) strand; PAM type: YTN; PAM sequence: CTT
ccaagcctcgtccactgagg

SEQ ID NO: 45892 - DNA, 20 bp, Artificial Sequence
  Description of Artificial Sequence: Synthetic oligonucleotide
  Target: SCN10A; (-) strand; PAM type: YTN; PAM sequence: TTA
tggtggaaaatatgcttcca

SEQ ID NO: 45893 - DNA, 20 bp, Artificial Sequence
  Description of Artificial Sequence: Synthetic oligonucleotide
  Target: SCN10A; (-) strand; PAM type: YTN; PAM sequence: TTT
atggtggaaaatatgcttcc

SEQ ID NO: 45894 - DNA, 20 bp, Artificial Sequence
  Description of Artificial Sequence: Synthetic oligonucleotide
  Target: SCN10A; (-) strand; PAM type: YTN; PAM sequence: CTT
tatggtggaaaatatgcttc

SEQ ID NO: 45895 - DNA, 20 bp, Artificial Sequence
  Description of Artificial Sequence: Synthetic oligonucleotide
  Target: SCN10A; (-) strand; PAM type: YTN; PAM sequence: CTC
ctttatggtggaaaatatgc

SEQ ID NO: 45896 - DNA, 20 bp, Artificial Sequence
  Description of Artificial Sequence: Synthetic oligonucleotide
  Target: SCN10A; (-) strand; PAM type: YTN; PAM sequence: CTC
ctcctttatggtggaaaata

SEQ ID NO: 45897 - DNA, 20 bp, Artificial Sequence
  Description of Artificial Sequence: Synthetic oligonucleotide
  Target: SCN10A; (-) strand; PAM type: YTN; PAM sequence: CTC
agcggggggctcctccttta

SEQ ID NO: 45898 - DNA, 20 bp, Artificial Sequence
  Description of Artificial Sequence: Synthetic oligonucleotide
  Target: SCN10A; (-) strand; PAM type: YTN; PAM sequence: CTG
ctcagcggggggctcctcct

SEQ ID NO: 45899 - DNA, 20 bp, Artificial Sequence
  Description of Artificial Sequence: Synthetic oligonucleotide
  Target: SCN10A; (-) strand; PAM type: YTN; PAM sequence: CTC
tgctcagcggggggctcctc

SEQ ID NO: 45900 - DNA, 20 bp, Artificial Sequence
  Description of Artificial Sequence: Synthetic oligonucleotide
  Target: SCN10A; (-) strand; PAM type: YTN; PAM sequence: CTA
aatgtccctctgctcagcgg

SEQ ID NO: 45901 - DNA, 20 bp, Artificial Sequence
  Description of Artificial Sequence: Synthetic oligonucleotide
  Target: SCN10A; (-) strand; PAM type: YTN; PAM sequence: TTG
tccctaaatgtccctctgct

SEQ ID NO: 45902 - DNA, 20 bp, Artificial Sequence
  Description of Artificial Sequence: Synthetic oligonucleotide
  Target: SCN10A; (-) strand; PAM type: YTN; PAM sequence: CTG
ttgtccctaaatgtccctct

SEQ ID NO: 45903 - DNA, 20 bp, Artificial Sequence
  Description of Artificial Sequence: Synthetic oligonucleotide
  Target: SCN10A; (-) strand; PAM type: YTN; PAM sequence: CTC
tgttgtccctaaatgtccct

SEQ ID NO: 45904 - DNA, 20 bp, Artificial Sequence
  Description of Artificial Sequence: Synthetic oligonucleotide
  Target: SCN10A; (-) strand; PAM type: YTN; PAM sequence: CTC
tctgttgtccctaaatgtcc

SEQ ID NO: 45905 - DNA, 20 bp, Artificial Sequence
  Description of Artificial Sequence: Synthetic oligonucleotide
  Target: SCN10A; (-) strand; PAM type: YTN; PAM sequence: TTC
tctctgttgtccctaaatgt

SEQ ID NO: 45906 - DNA, 20 bp, Artificial Sequence
  Description of Artificial Sequence: Synthetic oligonucleotide
  Target: SCN10A; (-) strand; PAM type: YTN; PAM sequence: CTT
ctctctgttgtccctaaatg

SEQ ID NO: 45907 - DNA, 20 bp, Artificial Sequence
  Description of Artificial Sequence: Synthetic oligonucleotide
  Target: SCN10A; (-) strand; PAM type: YTN; PAM sequence: CTG
gtgccttctctctgttgtcc

SEQ ID NO: 45908 - DNA, 20 bp, Artificial Sequence
  Description of Artificial Sequence: Synthetic oligonucleotide
  Target: SCN10A; (-) strand; PAM type: YTN; PAM sequence: TTG
caggaagggctggtgccttc

SEQ ID NO: 45909 - DNA, 20 bp, Artificial Sequence
  Description of Artificial Sequence: Synthetic oligonucleotide
  Target: SCN10A; (-) strand; PAM type: YTN; PAM sequence: TTG
gcacatgagggtggttgcag

SEQ ID NO: 45910 - DNA, 20 bp, Artificial Sequence
  Description of Artificial Sequence: Synthetic oligonucleotide
  Target: SCN10A; (-) strand; PAM type: YTN; PAM sequence: TTT
ggcacatgagggtggttgca

SEQ ID NO: 45911 - DNA, 20 bp, Artificial Sequence
  Description of Artificial Sequence: Synthetic oligonucleotide
  Target: SCN10A; (-) strand; PAM type: YTN; PAM sequence: CTT
tggcacatgagggtggttgc

SEQ ID NO: 45912 - DNA, 20 bp, Artificial Sequence
  Description of Artificial Sequence: Synthetic oligonucleotide
  Target: SCN10A; (-) strand; PAM type: YTN; PAM sequence: TTC
cagagtcaggaacagagccc

SEQ ID NO: 45913 - DNA, 20 bp, Artificial Sequence
  Description of Artificial Sequence: Synthetic oligonucleotide
  Target: SCN10A; (-) strand; PAM type: YTN; PAM sequence: CTG
gaagcagcaagatgtgccca

SEQ ID NO: 45914 - DNA, 20 bp, Artificial Sequence
  Description of Artificial Sequence: Synthetic oligonucleotide
  Target: SCN10A; (-) strand; PAM type: YTN; PAM sequence: CTC
aagtgaagaactggaagcag

SEQ ID NO: 45915 - DNA, 20 bp, Artificial Sequence
  Description of Artificial Sequence: Synthetic oligonucleotide
  Target: SCN10A; (-) strand; PAM type: YTN; PAM sequence: CTC
tcaagtgaagaactggaagc

SEQ ID NO: 45916 - DNA, 20 bp, Artificial Sequence
  Description of Artificial Sequence: Synthetic oligonucleotide
  Target: SCN10A; (-) strand; PAM type: YTN; PAM sequence: CTG
ctctcaagtgaagaactgga

SEQ ID NO: 45917 - DNA, 20 bp, Artificial Sequence
  Description of Artificial Sequence: Synthetic oligonucleotide
  Target: SCN10A; (-) strand; PAM type: YTN; PAM sequence: TTC
atctgctctcaagtgaagaa

SEQ ID NO: 45918 - DNA, 20 bp, Artificial Sequence
  Description of Artificial Sequence: Synthetic oligonucleotide
  Target: SCN10A; (-) strand; PAM type: YTN; PAM sequence: CTT
catctgctctcaagtgaaga

SEQ ID NO: 45919 - DNA, 20 bp, Artificial Sequence
  Description of Artificial Sequence: Synthetic oligonucleotide
  Target: SCN10A; (-) strand; PAM type: YTN; PAM sequence: CTC
ttcatctgctctcaagtgaa

SEQ ID NO: 45920 - DNA, 20 bp, Artificial Sequence
  Description of Artificial Sequence: Synthetic oligonucleotide
  Target: SCN10A; (-) strand; PAM type: YTN; PAM sequence: TTC
acaaccgctcttcatctgct

SEQ ID NO: 45921 - DNA, 20 bp, Artificial Sequence
  Description of Artificial Sequence: Synthetic oligonucleotide
  Target: SCN10A; (-) strand; PAM type: YTN; PAM sequence: CTT
cacaaccgctcttcatctgc

SEQ ID NO: 45922 - DNA, 20 bp, Artificial Sequence
  Description of Artificial Sequence: Synthetic oligonucleotide
  Target: SCN10A; (-) strand; PAM type: YTN; PAM sequence: TTG
tcttcacaaccgctcttcat

SEQ ID NO: 45923 - DNA, 20 bp, Artificial Sequence
  Description of Artificial Sequence: Synthetic oligonucleotide
  Target: SCN10A; (-) strand; PAM type: YTN; PAM sequence: TTT
gtcttcacaaccgctcttca

SEQ ID NO: 45924 - DNA, 20 bp, Artificial Sequence
  Description of Artificial Sequence: Synthetic oligonucleotide
  Target: SCN10A; (-) strand; PAM type: YTN; PAM sequence: TTT
tgtcttcacaaccgctcttc

SEQ ID NO: 45925 - DNA, 20 bp, Artificial Sequence
  Description of Artificial Sequence: Synthetic oligonucleotide
  Target: SCN10A; (-) strand; PAM type: YTN; PAM sequence: CTC
atatcattttgtcttcacaa

SEQ ID NO: 45926 - DNA, 20 bp, Artificial Sequence
  Description of Artificial Sequence: Synthetic oligonucleotide
  Target: SCN10A; (-) strand; PAM type: YTN; PAM sequence: TTC
tcatatcattttgtcttcac

SEQ ID NO: 45927 - DNA, 20 bp, Artificial Sequence
  Description of Artificial Sequence: Synthetic oligonucleotide
  Target: SCN10A; (-) strand; PAM type: YTN; PAM sequence: TTT
ctcatatcattttgtcttca

SEQ ID NO: 45928 - DNA, 20 bp, Artificial Sequence
  Description of Artificial Sequence: Synthetic oligonucleotide
  Target: SCN10A; (-) strand; PAM type: YTN; PAM sequence: TTA
catttctcatatcattttgt

SEQ ID NO: 45929 - DNA, 20 bp, Artificial Sequence
  Description of Artificial Sequence: Synthetic oligonucleotide
  Target: SCN10A; (-) strand; PAM type: YTN; PAM sequence: TTT
acatttctcatatcattttg

SEQ ID NO: 45930 - DNA, 20 bp, Artificial Sequence
  Description of Artificial Sequence: Synthetic oligonucleotide
  Target: SCN10A; (-) strand; PAM type: YTN; PAM sequence: TTT
tacatttctcatatcatttt

SEQ ID NO: 45931 - DNA, 20 bp, Artificial Sequence
  Description of Artificial Sequence: Synthetic oligonucleotide
  Target: SCN10A; (-) strand; PAM type: YTN; PAM sequence: CTT
ttacatttctcatatcattt

SEQ ID NO: 45932 - DNA, 20 bp, Artificial Sequence
  Description of Artificial Sequence: Synthetic oligonucleotide
  Target: SCN10A; (-) strand; PAM type: YTN; PAM sequence: CTG
agcacttttacatttctcat

SEQ ID NO: 45933 - DNA, 20 bp, Artificial Sequence
  Description of Artificial Sequence: Synthetic oligonucleotide
  Target: SCN10A; (-) strand; PAM type: YTN; PAM sequence: CTC
tgagcacttttacatttctc

SEQ ID NO: 45934 - DNA, 20 bp, Artificial Sequence
  Description of Artificial Sequence: Synthetic oligonucleotide
  Target: SCN10A; (-) strand; PAM type: YTN; PAM sequence: TTA
cccctctgagcacttttaca

SEQ ID NO: 45935 - DNA, 20 bp, Artificial Sequence
  Description of Artificial Sequence: Synthetic oligonucleotide
  Target: SCN10A; (-) strand; PAM type: YTN; PAM sequence: TTT
acccctctgagcacttttac

SEQ ID NO: 45936 - DNA, 20 bp, Artificial Sequence
  Description of Artificial Sequence: Synthetic oligonucleotide
  Target: SCN10A; (-) strand; PAM type: YTN; PAM sequence: CTC
agacaggaagtttacccctc

SEQ ID NO: 45937 - DNA, 20 bp, Artificial Sequence
  Description of Artificial Sequence: Synthetic oligonucleotide
  Target: SCN10A; (-) strand; PAM type: YTN; PAM sequence: CTC
accctcagacaggaagttta

SEQ ID NO: 45938 - DNA, 20 bp, Artificial Sequence
  Description of Artificial Sequence: Synthetic oligonucleotide
  Target: SCN10A; (-) strand; PAM type: YTN; PAM sequence: CTG
cagagccacagatgcccctc

SEQ ID NO: 45939 - DNA, 20 bp, Artificial Sequence
  Description of Artificial Sequence: Synthetic oligonucleotide
  Target: SCN10A; (-) strand; PAM type: YTN; PAM sequence: CTG
agcccaccatccctgcagag

SEQ ID NO: 45940 - DNA, 20 bp, Artificial Sequence
  Description of Artificial Sequence: Synthetic oligonucleotide
  Target: SCN10A; (-) strand; PAM type: YTN; PAM sequence: TTC
caggctgagcccaccatccc

SEQ ID NO: 45941 - DNA, 20 bp, Artificial Sequence
  Description of Artificial Sequence: Synthetic oligonucleotide
  Target: SCN10A; (-) strand; PAM type: YTN; PAM sequence: CTT
ccaggctgagcccaccatcc

SEQ ID NO: 45942 - DNA, 20 bp, Artificial Sequence
  Description of Artificial Sequence: Synthetic oligonucleotide
  Target: SCN10A; (-) strand; PAM type: YTN; PAM sequence: TTC
ttccaggctgagcccaccat

SEQ ID NO: 45943 - DNA, 20 bp, Artificial Sequence
  Description of Artificial Sequence: Synthetic oligonucleotide
  Target: SCN10A; (-) strand; PAM type: YTN; PAM sequence: CTG
ttcttccaggctgagcccac

SEQ ID NO: 45944 - DNA, 20 bp, Artificial Sequence
  Description of Artificial Sequence: Synthetic oligonucleotide
  Target: SCN10A; (-) strand; PAM type: YTN; PAM sequence: CTC
tgttcttccaggctgagccc

SEQ ID NO: 45945 - DNA, 20 bp, Artificial Sequence
  Description of Artificial Sequence: Synthetic oligonucleotide
  Target: SCN10A; (-) strand; PAM type: YTN; PAM sequence: CTG
catcccagaaactctgttct

SEQ ID NO: 45946 - DNA, 20 bp, Artificial Sequence
  Description of Artificial Sequence: Synthetic oligonucleotide
  Target: SCN10A; (-) strand; PAM type: YTN; PAM sequence: CTG
cctgcatcccagaaactctg

SEQ ID NO: 45947 - DNA, 20 bp, Artificial Sequence
  Description of Artificial Sequence: Synthetic oligonucleotide
  Target: SCN10A; (-) strand; PAM type: YTN; PAM sequence: CTC
tgcctgcatcccagaaactc

SEQ ID NO: 45948 - DNA, 20 bp, Artificial Sequence
  Description of Artificial Sequence: Synthetic oligonucleotide
  Target: SCN10A; (-) strand; PAM type: YTN; PAM sequence: CTG
agccagggatgcctctgcct

SEQ ID NO: 45949 - DNA, 20 bp, Artificial Sequence
  Description of Artificial Sequence: Synthetic oligonucleotide
  Target: SCN10A; (-) strand; PAM type: YTN; PAM sequence: CTG
gtgcctgagccagggatgcc

SEQ ID NO: 45950 - DNA, 20 bp, Artificial Sequence
  Description of Artificial Sequence: Synthetic oligonucleotide
  Target: SCN10A; (-) strand; PAM type: YTN; PAM sequence: TTC
caccctggtgcctgagccag

SEQ ID NO: 45951 - DNA, 20 bp, Artificial Sequence
  Description of Artificial Sequence: Synthetic oligonucleotide
  Target: SCN10A; (-) strand; PAM type: YTN; PAM sequence: TTT
ccaccctggtgcctgagcca

SEQ ID NO: 45952 - DNA, 20 bp, Artificial Sequence
  Description of Artificial Sequence: Synthetic oligonucleotide
  Target: SCN10A; (-) strand; PAM type: YTN; PAM sequence: TTT
tccaccctggtgcctgagcc

SEQ ID NO: 45953 - DNA, 20 bp, Artificial Sequence
  Description of Artificial Sequence: Synthetic oligonucleotide
  Target: SCN10A; (-) strand; PAM type: YTN; PAM sequence: CTT
ttccaccctggtgcctgagc

SEQ ID NO: 45954 - DNA, 20 bp, Artificial Sequence
  Description of Artificial Sequence: Synthetic oligonucleotide
  Target: SCN10A; (-) strand; PAM type: YTN; PAM sequence: TTA
gtcttttccaccctggtgcc

SEQ ID NO: 45955 - DNA, 20 bp, Artificial Sequence
  Description of Artificial Sequence: Synthetic oligonucleotide
  Target: SCN10A; (-) strand; PAM type: YTN; PAM sequence: TTT
agtcttttccaccctggtgc

SEQ ID NO: 45956 - DNA, 20 bp, Artificial Sequence
  Description of Artificial Sequence: Synthetic oligonucleotide
  Target: SCN10A; (-) strand; PAM type: YTN; PAM sequence: CTT
tagtcttttccaccctggtg

SEQ ID NO: 45957 - DNA, 20 bp, Artificial Sequence
  Description of Artificial Sequence: Synthetic oligonucleotide
  Target: SCN10A; (-) strand; PAM type: YTN; PAM sequence: CTC
tttagtcttttccaccctgg

SEQ ID NO: 45958 - DNA, 20 bp, Artificial Sequence
  Description of Artificial Sequence: Synthetic oligonucleotide
  Target: SCN10A; (-) strand; PAM type: YTN; PAM sequence: CTA
aaccaagaaaagggaagcaa

SEQ ID NO: 45959 - DNA, 20 bp, Artificial Sequence
  Description of Artificial Sequence: Synthetic oligonucleotide
  Target: SCN10A; (-) strand; PAM type: YTN; PAM sequence: TTA
tagacagaagaaagctaaac

SEQ ID NO: 45960 - DNA, 20 bp, Artificial Sequence
  Description of Artificial Sequence: Synthetic oligonucleotide
  Target: SCN10A; (-) strand; PAM type: YTN; PAM sequence: TTT
atagacagaagaaagctaaa

SEQ ID NO: 45961 - DNA, 20 bp, Artificial Sequence
  Description of Artificial Sequence: Synthetic oligonucleotide
  Target: SCN10A; (-) strand; PAM type: YTN; PAM sequence: TTT
tatagacagaagaaagctaa

SEQ ID NO: 45962 - DNA, 20 bp, Artificial Sequence
  Description of Artificial Sequence: Synthetic oligonucleotide
  Target: SCN10A; (-) strand; PAM type: YTN; PAM sequence: CTC
atgagttttatagacagaag

SEQ ID NO: 45963 - DNA, 20 bp, Artificial Sequence
  Description of Artificial Sequence: Synthetic oligonucleotide
  Target: SCN10A; (-) strand; PAM type: YTN; PAM sequence: TTC
ctcatgagttttatagacag

SEQ ID NO: 45964 - DNA, 20 bp, Artificial Sequence
  Description of Artificial Sequence: Synthetic oligonucleotide
  Target: SCN10A; (-) strand; PAM type: YTN; PAM sequence: TTT
cctcatgagttttatagaca

SEQ ID NO: 45965 - DNA, 20 bp, Artificial Sequence
  Description of Artificial Sequence: Synthetic oligonucleotide
  Target: SCN10A; (-) strand; PAM type: YTN; PAM sequence: CTT
tcctcatgagttttatagac

SEQ ID NO: 45966 - DNA, 20 bp, Artificial Sequence
  Description of Artificial Sequence: Synthetic oligonucleotide
  Target: SCN10A; (-) strand; PAM type: YTN; PAM sequence: TTC
tttcctcatgagttttatag

SEQ ID NO: 45967 - DNA, 20 bp, Artificial Sequence
  Description of Artificial Sequence: Synthetic oligonucleotide
  Target: SCN10A; (-) strand; PAM type: YTN; PAM sequence: TTG
ggttctttcctcatgagttt

SEQ ID NO: 45968 - DNA, 20 bp, Artificial Sequence
  Description of Artificial Sequence: Synthetic oligonucleotide
  Target: SCN10A; (-) strand; PAM type: YTN; PAM sequence: CTT
gggttctttcctcatgagtt

SEQ ID NO: 45969 - DNA, 20 bp, Artificial Sequence
  Description of Artificial Sequence: Synthetic oligonucleotide
  Target: SCN10A; (-) strand; PAM type: YTN; PAM sequence: CTG
gacatcaaccaacttgggtt

SEQ ID NO: 45970 - DNA, 20 bp, Artificial Sequence
  Description of Artificial Sequence: Synthetic oligonucleotide
  Target: SCN10A; (-) strand; PAM type: YTN; PAM sequence: TTG
ccctggacatcaaccaactt

SEQ ID NO: 45971 - DNA, 20 bp, Artificial Sequence
  Description of Artificial Sequence: Synthetic oligonucleotide
  Target: SCN10A; (-) strand; PAM type: YTN; PAM sequence: TTA
ttgccctggacatcaaccaa

SEQ ID NO: 45972 - DNA, 20 bp, Artificial Sequence
  Description of Artificial Sequence: Synthetic oligonucleotide
  Target: SCN10A; (-) strand; PAM type: YTN; PAM sequence: CTT
attgccctggacatcaacca

SEQ ID NO: 45973 - DNA, 20 bp, Artificial Sequence
  Description of Artificial Sequence: Synthetic oligonucleotide
  Target: SCN10A; (-) strand; PAM type: YTN; PAM sequence: TTC
ttattgccctggacatcaac

SEQ ID NO: 45974 - DNA, 20 bp, Artificial Sequence
  Description of Artificial Sequence: Synthetic oligonucleotide
  Target: SCN10A; (-) strand; PAM type: YTN; PAM sequence: TTT
cttattgccctggacatcaa

SEQ ID NO: 45975 - DNA, 20 bp, Artificial Sequence
  Description of Artificial Sequence: Synthetic oligonucleotide
  Target: SCN10A; (-) strand; PAM type: YTN; PAM sequence: CTT
tcttattgccctggacatca

SEQ ID NO: 45976 - DNA, 20 bp, Artificial Sequence
  Description of Artificial Sequence: Synthetic oligonucleotide
  Target: SCN10A; (-) strand; PAM type: YTN; PAM sequence: TTC
cagaagcccctttcttattg

SEQ ID NO: 45977 - DNA, 20 bp, Artificial Sequence
  Description of Artificial Sequence: Synthetic oligonucleotide
  Target: SCN10A; (-) strand; PAM type: YTN; PAM sequence: CTT
ccagaagcccctttcttatt

SEQ ID NO: 45978 - DNA, 20 bp, Artificial Sequence
  Description of Artificial Sequence: Synthetic oligonucleotide
  Target: SCN10A; (-) strand; PAM type: YTN; PAM sequence: TTG
tgtgggaggatgcagtcttc

SEQ ID NO: 45979 - DNA, 20 bp, Artificial Sequence
  Description of Artificial Sequence: Synthetic oligonucleotide
  Target: SCN10A; (-) strand; PAM type: YTN; PAM sequence: CTG
gttgtgtgggaggatgcagt

SEQ ID NO: 45980 - DNA, 20 bp, Artificial Sequence
  Description of Artificial Sequence: Synthetic oligonucleotide
  Target: SCN10A; (-) strand; PAM type: YTN; PAM sequence: CTG
actggttgtgtgggaggatg

SEQ ID NO: 45981 - DNA, 20 bp, Artificial Sequence
  Description of Artificial Sequence: Synthetic oligonucleotide
  Target: SCN10A; (-) strand; PAM type: YTN; PAM sequence: CTG
ggactgactggttgtgtggg

SEQ ID NO: 45982 - DNA, 20 bp, Artificial Sequence
  Description of Artificial Sequence: Synthetic oligonucleotide
  Target: SCN10A; (-) strand; PAM type: YTN; PAM sequence: CTC
ctgggactgactggttgtgt

SEQ ID NO: 45983 - DNA, 20 bp, Artificial Sequence
  Description of Artificial Sequence: Synthetic oligonucleotide
  Target: SCN10A; (-) strand; PAM type: YTN; PAM sequence: TTG
ccctcctgggactgactggt

SEQ ID NO: 45984 - DNA, 20 bp, Artificial Sequence
  Description of Artificial Sequence: Synthetic oligonucleotide
  Target: SCN10A; (-) strand; PAM type: YTN; PAM sequence: CTT
gccctcctgggactgactgg

SEQ ID NO: 45985 - DNA, 20 bp, Artificial Sequence
  Description of Artificial Sequence: Synthetic oligonucleotide
  Target: SCN10A; (-) strand; PAM type: YTN; PAM sequence: CTG
gtcatggtggggtccttgcc

SEQ ID NO: 45986 - DNA, 20 bp, Artificial Sequence
  Description of Artificial Sequence: Synthetic oligonucleotide
  Target: SCN10A; (-) strand; PAM type: YTN; PAM sequence: CTC
tggtcatggtggggtccttg

SEQ ID NO: 45987 - DNA, 20 bp, Artificial Sequence
  Description of Artificial Sequence: Synthetic oligonucleotide
  Target: SCN10A; (-) strand; PAM type: YTN; PAM sequence: CTC
cacccactctggtcatggtg

SEQ ID NO: 45988 - DNA, 20 bp, Artificial Sequence
  Description of Artificial Sequence: Synthetic oligonucleotide
  Target: SCN10A; (-) strand; PAM type: YTN; PAM sequence: TTG
tctccacccactctggtcat

SEQ ID NO: 45989 - DNA, 20 bp, Artificial Sequence
  Description of Artificial Sequence: Synthetic oligonucleotide
  Target: SCN10A; (-) strand; PAM type: YTN; PAM sequence: CTT
gtctccacccactctggtca

SEQ ID NO: 45990 - DNA, 20 bp, Artificial Sequence
  Description of Artificial Sequence: Synthetic oligonucleotide
  Target: SCN10A; (-) strand; PAM type: YTN; PAM sequence: CTC
agcttgtctccacccactct

SEQ ID NO: 45991 - DNA, 20 bp, Artificial Sequence
  Description of Artificial Sequence: Synthetic oligonucleotide
  Target: SCN10A; (-) strand; PAM type: YTN; PAM sequence: CTG
ccctcagcttgtctccaccc

SEQ ID NO: 45992 - DNA, 20 bp, Artificial Sequence
  Description of Artificial Sequence: Synthetic oligonucleotide
  Target: SCN10A; (-) strand; PAM type: YTN; PAM sequence: CTG
gccccctgccctcagcttgt

SEQ ID NO: 45993 - DNA, 20 bp, Artificial Sequence
  Description of Artificial Sequence: Synthetic oligonucleotide
  Target: SCN10A; (-) strand; PAM type: YTN; PAM sequence: CTC
cgccccagcctggccccctg

SEQ ID NO: 45994 - DNA, 20 bp, Artificial Sequence
  Description of Artificial Sequence: Synthetic oligonucleotide
  Target: SCN10A; (-) strand; PAM type: YTN; PAM sequence: TTC
tccgccccagcctggccccc

SEQ ID NO: 45995 - DNA, 20 bp, Artificial Sequence
  Description of Artificial Sequence: Synthetic oligonucleotide
  Target: SCN10A; (-) strand; PAM type: YTN; PAM sequence: CTT
ctccgccccagcctggcccc

SEQ ID NO: 45996 - DNA, 20 bp, Artificial Sequence
  Description of Artificial Sequence: Synthetic oligonucleotide
  Target: SCN10A; (-) strand; PAM type: YTN; PAM sequence: TTG
ccaataagccccaatacccc

SEQ ID NO: 45997 - DNA, 20 bp, Artificial Sequence
  Description of Artificial Sequence: Synthetic oligonucleotide
  Target: SCN10A; (-) strand; PAM type: YTN; PAM sequence: CTT
gccaataagccccaataccc

SEQ ID NO: 45998 - DNA, 20 bp, Artificial Sequence
  Description of Artificial Sequence: Synthetic oligonucleotide
  Target: SCN10A; (-) strand; PAM type: YTN; PAM sequence: CTC
acttgccaataagccccaat

SEQ ID NO: 45999 - DNA, 20 bp, Artificial Sequence
  Description of Artificial Sequence: Synthetic oligonucleotide
  Target: SCN10A; (-) strand; PAM type: YTN; PAM sequence: CTG
gagactcacttgccaataag

SEQ ID NO: 46000 - DNA, 20 bp, Artificial Sequence
  Description of Artificial Sequence: Synthetic oligonucleotide
  Target: SCN10A; (-) strand; PAM type: YTN; PAM sequence: CTC
tggagactcacttgccaata

SEQ ID NO: 46001 - DNA, 20 bp, Artificial Sequence
  Description of Artificial Sequence: Synthetic oligonucleotide
  Target: SCN10A; (-) strand; PAM type: YTN; PAM sequence: TTG
gaggaagcccctctggagac

SEQ ID NO: 46002 - DNA, 20 bp, Artificial Sequence
  Description of Artificial Sequence: Synthetic oligonucleotide
  Target: SCN10A; (-) strand; PAM type: YTN; PAM sequence: TTT
ggaggaagcccctctggaga

SEQ ID NO: 46003 - DNA, 20 bp, Artificial Sequence
  Description of Artificial Sequence: Synthetic oligonucleotide
  Target: SCN10A; (-) strand; PAM type: YTN; PAM sequence: CTC
catgtttggaggaagcccct

SEQ ID NO: 46004 - DNA, 20 bp, Artificial Sequence
  Description of Artificial Sequence: Synthetic oligonucleotide
  Target: SCN10A; (-) strand; PAM type: YTN; PAM sequence: CTA
ctccatgtttggaggaagcc

SEQ ID NO: 46005 - DNA, 20 bp, Artificial Sequence
  Description of Artificial Sequence: Synthetic oligonucleotide
  Target: SCN10A; (-) strand; PAM type: YTN; PAM sequence: CTG
cagggagggggcacaatggg

SEQ ID NO: 46006 - DNA, 20 bp, Artificial Sequence
  Description of Artificial Sequence: Synthetic oligonucleotide
  Target: SCN10A; (-) strand; PAM type: YTN; PAM sequence: CTG
ggagcagggggagaggctgc

SEQ ID NO: 46007 - DNA, 20 bp, Artificial Sequence
  Description of Artificial Sequence: Synthetic oligonucleotide
  Target: SCN10A; (-) strand; PAM type: YTN; PAM sequence: CTA
gctgggagcagggggagagg

SEQ ID NO: 46008 - DNA, 20 bp, Artificial Sequence
  Description of Artificial Sequence: Synthetic oligonucleotide
  Target: SCN10A; (-) strand; PAM type: YTN; PAM sequence: CTG
cacaggtcctagctgggagc

SEQ ID NO: 46009 - DNA, 20 bp, Artificial Sequence
  Description of Artificial Sequence: Synthetic oligonucleotide
  Target: SCN10A; (-) strand; PAM type: YTN; PAM sequence: CTC
caagctgcacaggtcctagc

SEQ ID NO: 46010 - DNA, 20 bp, Artificial Sequence
  Description of Artificial Sequence: Synthetic oligonucleotide
  Target: SCN10A; (-) strand; PAM type: YTN; PAM sequence: TTC
tccaagctgcacaggtccta

SEQ ID NO: 46011 - DNA, 20 bp, Artificial Sequence
  Description of Artificial Sequence: Synthetic oligonucleotide
  Target: SCN10A; (-) strand; PAM type: YTN; PAM sequence: TTT
ctccaagctgcacaggtcct

SEQ ID NO: 46012 - DNA, 20 bp, Artificial Sequence
  Description of Artificial Sequence: Synthetic oligonucleotide
  Target: SCN10A; (-) strand; PAM type: YTN; PAM sequence: CTG
atttctccaagctgcacagg

SEQ ID NO: 46013 - DNA, 20 bp, Artificial Sequence
  Description of Artificial Sequence: Synthetic oligonucleotide
  Target: SCN10A; (-) strand; PAM type: YTN; PAM sequence: CTG
actgatttctccaagctgca

SEQ ID NO: 46014 - DNA, 20 bp, Artificial Sequence
  Description of Artificial Sequence: Synthetic oligonucleotide
  Target: SCN10A; (-) strand; PAM type: YTN; PAM sequence: TTC
agggaagtaagagctgactg

SEQ ID NO: 46015 - DNA, 20 bp, Artificial Sequence
  Description of Artificial Sequence: Synthetic oligonucleotide
  Target: SCN10A; (-) strand; PAM type: YTN; PAM sequence: TTA
ttcagggaagtaagagctga

SEQ ID NO: 46016 - DNA, 20 bp, Artificial Sequence
  Description of Artificial Sequence: Synthetic oligonucleotide
  Target: SCN10A; (-) strand; PAM type: YTN; PAM sequence: TTT
attcagggaagtaagagctg

SEQ ID NO: 46017 - DNA, 20 bp, Artificial Sequence
  Description of Artificial Sequence: Synthetic oligonucleotide
  Target: SCN10A; (-) strand; PAM type: YTN; PAM sequence: TTT
tattcagggaagtaagagct

SEQ ID NO: 46018 - DNA, 20 bp, Artificial Sequence
  Description of Artificial Sequence: Synthetic oligonucleotide
  Target: SCN10A; (-) strand; PAM type: YTN; PAM sequence: TTT
ttattcagggaagtaagagc

SEQ ID NO: 46019 - DNA, 20 bp, Artificial Sequence
  Description of Artificial Sequence: Synthetic oligonucleotide
  Target: SCN10A; (-) strand; PAM type: YTN; PAM sequence: CTC
agaaaacatttttattcagg

SEQ ID NO: 46020 - DNA, 20 bp, Artificial Sequence
  Description of Artificial Sequence: Synthetic oligonucleotide
  Target: SCN10A; (-) strand; PAM type: YTN; PAM sequence: CTG
agggggctcagaaaacattt

SEQ ID NO: 46021 - DNA, 20 bp, Artificial Sequence
  Description of Artificial Sequence: Synthetic oligonucleotide
  Target: SCN10A; (-) strand; PAM type: YTN; PAM sequence: TTC
cccaatctgagggggctcag

SEQ ID NO: 46022 - DNA, 20 bp, Artificial Sequence
  Description of Artificial Sequence: Synthetic oligonucleotide
  Target: SCN10A; (-) strand; PAM type: YTN; PAM sequence: CTT
ccccaatctgagggggctca

SEQ ID NO: 46023 - DNA, 20 bp, Artificial Sequence
  Description of Artificial Sequence: Synthetic oligonucleotide
  Target: SCN10A; (-) strand; PAM type: YTN; PAM sequence: TTA
aaggaaaaatgtccttcccc

SEQ ID NO: 46024 - DNA, 20 bp, Artificial Sequence
  Description of Artificial Sequence: Synthetic oligonucleotide
  Target: SCN10A; (-) strand; PAM type: YTN; PAM sequence: CTG
ttaaaggaaaaatgtccttc

SEQ ID NO: 46025 - DNA, 20 bp, Artificial Sequence
  Description of Artificial Sequence: Synthetic oligonucleotide
  Target: SCN10A; (-) strand; PAM type: YTN; PAM sequence: TTA
gctgttaaaggaaaaatgtc

SEQ ID NO: 46026 - DNA, 20 bp, Artificial Sequence
  Description of Artificial Sequence: Synthetic oligonucleotide
  Target: SCN10A; (-) strand; PAM type: YTN; PAM sequence: CTA
ttagctgttaaaggaaaaat

SEQ ID NO: 46027 - DNA, 20 bp, Artificial Sequence
  Description of Artificial Sequence: Synthetic oligonucleotide
  Target: SCN10A; (-) strand; PAM type: YTN; PAM sequence: CTC
aataaacggtgtctattagc

SEQ ID NO: 46028 - DNA, 20 bp, Artificial Sequence
  Description of Artificial Sequence: Synthetic oligonucleotide
  Target: SCN10A; (-) strand; PAM type: YTN; PAM sequence: CTG
aggcaggaactcaataaacg

SEQ ID NO: 46029 - DNA, 20 bp, Artificial Sequence
  Description of Artificial Sequence: Synthetic oligonucleotide
  Target: SCN10A; (-) strand; PAM type: YTN; PAM sequence: CTG
ggctgaggcaggaactcaat

SEQ ID NO: 46030 - DNA, 20 bp, Artificial Sequence
  Description of Artificial Sequence: Synthetic oligonucleotide
  Target: SCN10A; (-) strand; PAM type: YTN; PAM sequence: CTA
atgcaatgtctgggctgagg

SEQ ID NO: 46031 - DNA, 20 bp, Artificial Sequence
  Description of Artificial Sequence: Synthetic oligonucleotide
  Target: SCN10A; (-) strand; PAM type: YTN; PAM sequence: TTG
cctaatgcaatgtctgggct

SEQ ID NO: 46032 - DNA, 20 bp, Artificial Sequence
  Description of Artificial Sequence: Synthetic oligonucleotide
  Target: SCN10A; (-) strand; PAM type: YTN; PAM sequence: TTA
aatgacaggagatgacatat

SEQ ID NO: 46033 - DNA, 20 bp, Artificial Sequence
  Description of Artificial Sequence: Synthetic oligonucleotide
  Target: SCN10A; (-) strand; PAM type: YTN; PAM sequence: CTG
ggagaattaaatgacaggag

SEQ ID NO: 46034 - DNA, 20 bp, Artificial Sequence
  Description of Artificial Sequence: Synthetic oligonucleotide
  Target: SCN10A; (-) strand; PAM type: YTN; PAM sequence: TTA
ctgggagaattaaatgacag

SEQ ID NO: 46035 - DNA, 20 bp, Artificial Sequence
  Description of Artificial Sequence: Synthetic oligonucleotide
  Target: SCN10A; (-) strand; PAM type: YTN; PAM sequence: TTT
actgggagaattaaatgaca

SEQ ID NO: 46036 - DNA, 20 bp, Artificial Sequence
  Description of Artificial Sequence: Synthetic oligonucleotide
  Target: SCN10A; (-) strand; PAM type: YTN; PAM sequence: CTC
atgggtttactgggagaatt

SEQ ID NO: 46037 - DNA, 20 bp, Artificial Sequence
  Description of Artificial Sequence: Synthetic oligonucleotide
  Target: SCN10A; (-) strand; PAM type: YTN; PAM sequence: TTA
ctcatgggtttactgggaga

SEQ ID NO: 46038 - DNA, 20 bp, Artificial Sequence
  Description of Artificial Sequence: Synthetic oligonucleotide
  Target: SCN10A; (-) strand; PAM type: YTN; PAM sequence: CTT
actcatgggtttactgggag

SEQ ID NO: 46039 - DNA, 20 bp, Artificial Sequence
  Description of Artificial Sequence: Synthetic oligonucleotide
  Target: SCN10A; (-) strand; PAM type: YTN; PAM sequence: TTA
aaatcaagaaaataatgctt

SEQ ID NO: 46040 - DNA, 20 bp, Artificial Sequence
  Description of Artificial Sequence: Synthetic oligonucleotide
  Target: SCN10A; (-) strand; PAM type: YTN; PAM sequence: CTT
aaaatcaagaaaataatgct

SEQ ID NO: 46041 - DNA, 20 bp, Artificial Sequence
  Description of Artificial Sequence: Synthetic oligonucleotide
  Target: SCN10A; (-) strand; PAM type: YTN; PAM sequence: TTC
cttaaaatcaagaaaataat

SEQ ID NO: 46042 - DNA, 20 bp, Artificial Sequence
  Description of Artificial Sequence: Synthetic oligonucleotide
  Target: SCN10A; (-) strand; PAM type: YTN; PAM sequence: TTT
ccttaaaatcaagaaaataa

SEQ ID NO: 46043 - DNA, 20 bp, Artificial Sequence
  Description of Artificial Sequence: Synthetic oligonucleotide
  Target: SCN10A; (-) strand; PAM type: YTN; PAM sequence: CTA
atttccttaaaatcaagaaa

SEQ ID NO: 46044 - DNA, 20 bp, Artificial Sequence
  Description of Artificial Sequence: Synthetic oligonucleotide
  Target: SCN10A; (-) strand; PAM type: YTN; PAM sequence: CTC
aagatctaatttccttaaaa

SEQ ID NO: 46045 - DNA, 20 bp, Artificial Sequence
  Description of Artificial Sequence: Synthetic oligonucleotide
  Target: SCN10A; (-) strand; PAM type: YTN; PAM sequence: CTC
ctcaagatctaatttcctta

SEQ ID NO: 46046 - DNA, 20 bp, Artificial Sequence
  Description of Artificial Sequence: Synthetic oligonucleotide
  Target: SCN10A; (-) strand; PAM type: YTN; PAM sequence: TTA
atctcctcaagatctaattt

SEQ ID NO: 46047 - DNA, 20 bp, Artificial Sequence
  Description of Artificial Sequence: Synthetic oligonucleotide
  Target: SCN10A; (-) strand; PAM type: YTN; PAM sequence: CTT
aatctcctcaagatctaatt

SEQ ID NO: 46048 - DNA, 20 bp, Artificial Sequence
  Description of Artificial Sequence: Synthetic oligonucleotide
  Target: SCN10A; (-) strand; PAM type: YTN; PAM sequence: CTA
ggtgggtgaccccaggcaag

SEQ ID NO: 46049 - DNA, 20 bp, Artificial Sequence
  Description of Artificial Sequence: Synthetic oligonucleotide
  Target: SCN10A; (-) strand; PAM type: YTN; PAM sequence: TTA
ctaggtgggtgaccccaggc

SEQ ID NO: 46050 - DNA, 20 bp, Artificial Sequence
  Description of Artificial Sequence: Synthetic oligonucleotide
  Target: SCN10A; (-) strand; PAM type: YTN; PAM sequence: TTT
actaggtgggtgaccccagg

SEQ ID NO: 46051 - DNA, 20 bp, Artificial Sequence
  Description of Artificial Sequence: Synthetic oligonucleotide
  Target: SCN10A; (-) strand; PAM type: YTN; PAM sequence: CTC
caccatttactaggtgggtg

SEQ ID NO: 46052 - DNA, 20 bp, Artificial Sequence
  Description of Artificial Sequence: Synthetic oligonucleotide
  Target: SCN10A; (-) strand; PAM type: YTN; PAM sequence: CTG
ctccaccatttactaggtgg

SEQ ID NO: 46053 - DNA, 20 bp, Artificial Sequence
  Description of Artificial Sequence: Synthetic oligonucleotide
  Target: SCN10A; (-) strand; PAM type: YTN; PAM sequence: CTC
tgctccaccatttactaggt

SEQ ID NO: 46054 - DNA, 20 bp, Artificial Sequence
  Description of Artificial Sequence: Synthetic oligonucleotide
  Target: SCN10A; (-) strand; PAM type: YTN; PAM sequence: CTG
gtgtagaatctctgctccac

SEQ ID NO: 46055 - DNA, 20 bp, Artificial Sequence
  Description of Artificial Sequence: Synthetic oligonucleotide
  Target: SCN10A; (-) strand; PAM type: YTN; PAM sequence: TTA
gaaaagaaagacctggtgta

SEQ ID NO: 46056 - DNA, 20 bp, Artificial Sequence
  Description of Artificial Sequence: Synthetic oligonucleotide
  Target: SCN10A; (-) strand; PAM type: YTN; PAM sequence: TTG
caggaatgagaacatatgat

SEQ ID NO: 46057 - DNA, 20 bp, Artificial Sequence
  Description of Artificial Sequence: Synthetic oligonucleotide
  Target: SCN10A; (-) strand; PAM type: YTN; PAM sequence: CTT
gcaggaatgagaacatatga

SEQ ID NO: 46058 - DNA, 20 bp, Artificial Sequence
  Description of Artificial Sequence: Synthetic oligonucleotide
  Target: SCN10A; (-) strand; PAM type: YTN; PAM sequence: CTG
acttgcaggaatgagaacat

SEQ ID NO: 46059 - DNA, 20 bp, Artificial Sequence
  Description of Artificial Sequence: Synthetic oligonucleotide
  Target: SCN10A; (-) strand; PAM type: YTN; PAM sequence: TTG
ggaggcagtctgacttgcag

SEQ ID NO: 46060 - DNA, 20 bp, Artificial Sequence
  Description of Artificial Sequence: Synthetic oligonucleotide
  Target: SCN10A; (-) strand; PAM type: YTN; PAM sequence: CTT
gggaggcagtctgacttgca

SEQ ID NO: 46061 - DNA, 20 bp, Artificial Sequence
  Description of Artificial Sequence: Synthetic oligonucleotide
  Target: SCN10A; (-) strand; PAM type: YTN; PAM sequence: TTA
caagaagtgtgccttgggag

SEQ ID NO: 46062 - DNA, 20 bp, Artificial Sequence
  Description of Artificial Sequence: Synthetic oligonucleotide
  Target: SCN10A; (-) strand; PAM type: YTN; PAM sequence: TTC
attacaagaagtgtgccttg

SEQ ID NO: 46063 - DNA, 20 bp, Artificial Sequence
  Description of Artificial Sequence: Synthetic oligonucleotide
  Target: SCN10A; (-) strand; PAM type: YTN; PAM sequence: TTC
atgtgggattcattacaaga

SEQ ID NO: 46064 - DNA, 20 bp, Artificial Sequence
  Description of Artificial Sequence: Synthetic oligonucleotide
  Target: SCN10A; (-) strand; PAM type: YTN; PAM sequence: TTC
aaattcatgtgggattcatt

SEQ ID NO: 46065 - DNA, 20 bp, Artificial Sequence
  Description of Artificial Sequence: Synthetic oligonucleotide
  Target: SCN10A; (-) strand; PAM type: YTN; PAM sequence: TTT
caaattcatgtgggattcat

SEQ ID NO: 46066 - DNA, 20 bp, Artificial Sequence
  Description of Artificial Sequence: Synthetic oligonucleotide
  Target: SCN10A; (-) strand; PAM type: YTN; PAM sequence: TTT
tcaaattcatgtgggattca

SEQ ID NO: 46067 - DNA, 20 bp, Artificial Sequence
  Description of Artificial Sequence: Synthetic oligonucleotide
  Target: SCN10A; (-) strand; PAM type: YTN; PAM sequence: CTT
ttcaaattcatgtgggattc

SEQ ID NO: 46068 - DNA, 20 bp, Artificial Sequence
  Description of Artificial Sequence: Synthetic oligonucleotide
  Target: SCN10A; (-) strand; PAM type: YTN; PAM sequence: TTC
aaacttttcaaattcatgtg

SEQ ID NO: 46069 - DNA, 20 bp, Artificial Sequence
  Description of Artificial Sequence: Synthetic oligonucleotide
  Target: SCN10A; (-) strand; PAM type: YTN; PAM sequence: CTT
caaacttttcaaattcatgt

SEQ ID NO: 46070 - DNA, 20 bp, Artificial Sequence
  Description of Artificial Sequence: Synthetic oligonucleotide
  Target: SCN10A; (-) strand; PAM type: YTN; PAM sequence: TTG
aaaagtcttcaaacttttca

SEQ ID NO: 46071 - DNA, 20 bp, Artificial Sequence
  Description of Artificial Sequence: Synthetic oligonucleotide
  Target: SCN10A; (-) strand; PAM type: YTN; PAM sequence: CTG
gttgaaaagtcttcaaactt

SEQ ID NO: 46072 - DNA, 20 bp, Artificial Sequence
  Description of Artificial Sequence: Synthetic oligonucleotide
  Target: SCN10A; (-) strand; PAM type: YTN; PAM sequence: CTC
tggttgaaaagtcttcaaac

SEQ ID NO: 46073 - DNA, 20 bp, Artificial Sequence
  Description of Artificial Sequence: Synthetic oligonucleotide
  Target: SCN10A; (-) strand; PAM type: YTN; PAM sequence: TTC
tctggttgaaaagtcttcaa

SEQ ID NO: 46074 - DNA, 20 bp, Artificial Sequence
  Description of Artificial Sequence: Synthetic oligonucleotide
  Target: SCN10A; (-) strand; PAM type: YTN; PAM sequence: CTT
ctctggttgaaaagtcttca

SEQ ID NO: 46075 - DNA, 20 bp, Artificial Sequence
  Description of Artificial Sequence: Synthetic oligonucleotide
  Target: SCN10A; (-) strand; PAM type: YTN; PAM sequence: TTG
tacttctctggttgaaaagt

SEQ ID NO: 46076 - DNA, 20 bp, Artificial Sequence
  Description of Artificial Sequence: Synthetic oligonucleotide
  Target: SCN10A; (-) strand; PAM type: YTN; PAM sequence: TTA
tgcccagattgtacttctct

SEQ ID NO: 46077 - DNA, 20 bp, Artificial Sequence
  Description of Artificial Sequence: Synthetic oligonucleotide
  Target: SCN10A; (-) strand; PAM type: YTN; PAM sequence: TTT
atgcccagattgtacttctc

SEQ ID NO: 46078 - DNA, 20 bp, Artificial Sequence
  Description of Artificial Sequence: Synthetic oligonucleotide
  Target: SCN10A; (-) strand; PAM type: YTN; PAM sequence: TTT
tatgcccagattgtacttct

SEQ ID NO: 46079 - DNA, 20 bp, Artificial Sequence
  Description of Artificial Sequence: Synthetic oligonucleotide
  Target: SCN10A; (-) strand; PAM type: YTN; PAM sequence: TTT
ttatgcccagattgtacttc

SEQ ID NO: 46080 - DNA, 20 bp, Artificial Sequence
  Description of Artificial Sequence: Synthetic oligonucleotide
  Target: SCN10A; (-) strand; PAM type: YTN; PAM sequence: CTG
catttttatgcccagattgt

SEQ ID NO: 46081 - DNA, 20 bp, Artificial Sequence
  Description of Artificial Sequence: Synthetic oligonucleotide
  Target: SCN10A; (-) strand; PAM type: YTN; PAM sequence: TTG
atctgcatttttatgcccag

SEQ ID NO: 46082 - DNA, 20 bp, Artificial Sequence
  Description of Artificial Sequence: Synthetic oligonucleotide
  Target: SCN10A; (-) strand; PAM type: YTN; PAM sequence: TTT
gatctgcatttttatgccca

SEQ ID NO: 46083 - DNA, 20 bp, Artificial Sequence
  Description of Artificial Sequence: Synthetic oligonucleotide
  Target: SCN10A; (-) strand; PAM type: YTN; PAM sequence: CTT
tgatctgcatttttatgccc

SEQ ID NO: 46084 - DNA, 20 bp, Artificial Sequence
  Description of Artificial Sequence: Synthetic oligonucleotide
  Target: SCN10A; (-) strand; PAM type: YTN; PAM sequence: CTG
aaaaagctttgatctgcatt

SEQ ID NO: 46085 - DNA, 20 bp, Artificial Sequence
  Description of Artificial Sequence: Synthetic oligonucleotide
  Target: SCN10A; (-) strand; PAM type: YTN; PAM sequence: TTA
tctgaaaaagctttgatctg

SEQ ID NO: 46086 - DNA, 20 bp, Artificial Sequence
  Description of Artificial Sequence: Synthetic oligonucleotide
  Target: SCN10A; (-) strand; PAM type: YTN; PAM sequence: CTG
ggttatctgaaaaagctttg

SEQ ID NO: 46087 - DNA, 20 bp, Artificial Sequence
  Description of Artificial Sequence: Synthetic oligonucleotide
  Target: SCN10A; (-) strand; PAM type: YTN; PAM sequence: TTC
tgggttatctgaaaaagctt

SEQ ID NO: 46088 - DNA, 20 bp, Artificial Sequence
  Description of Artificial Sequence: Synthetic oligonucleotide
  Target: SCN10A; (-) strand; PAM type: YTN; PAM sequence: CTT
ctgggttatctgaaaaagct

SEQ ID NO: 46089 - DNA, 20 bp, Artificial Sequence
  Description of Artificial Sequence: Synthetic oligonucleotide
  Target: SCN10A; (-) strand; PAM type: YTN; PAM sequence: CTG
gggaaaggagaaggcttctg

SEQ ID NO: 46090 - DNA, 20 bp, Artificial Sequence
  Description of Artificial Sequence: Synthetic oligonucleotide
  Target: SCN10A; (-) strand; PAM type: YTN; PAM sequence: CTC
ctggggaaaggagaaggctt

SEQ ID NO: 46091 - DNA, 20 bp, Artificial Sequence
  Description of Artificial Sequence: Synthetic oligonucleotide
  Target: SCN10A; (-) strand; PAM type: YTN; PAM sequence: CTG
tctcctggggaaaggagaag

SEQ ID NO: 46092 - DNA, 20 bp, Artificial Sequence
  Description of Artificial Sequence: Synthetic oligonucleotide
  Target: SCN10A; (-) strand; PAM type: YTN; PAM sequence: CTG
ggggcactgtctcctgggga

SEQ ID NO: 46093 - DNA, 20 bp, Artificial Sequence
  Description of Artificial Sequence: Synthetic oligonucleotide
  Target: SCN10A; (-) strand; PAM type: YTN; PAM sequence: CTG
ctgggggcactgtctcctgg

SEQ ID NO: 46094 - DNA, 20 bp, Artificial Sequence
  Description of Artificial Sequence: Synthetic oligonucleotide
  Target: SCN10A; (-) strand; PAM type: YTN; PAM sequence: CTG
gtggtgagtggtgaaccctg

SEQ ID NO: 46095 - DNA, 20 bp, Artificial Sequence
  Description of Artificial Sequence: Synthetic oligonucleotide
  Target: SCN10A; (-) strand; PAM type: YTN; PAM sequence: CTA
gggaacctggtggtgagtgg

SEQ ID NO: 46096 - DNA, 20 bp, Artificial Sequence
  Description of Artificial Sequence: Synthetic oligonucleotide
  Target: SCN10A; (-) strand; PAM type: YTN; PAM sequence: TTG
acggtgatggtgctagggaa

SEQ ID NO: 46097 - DNA, 20 bp, Artificial Sequence
  Description of Artificial Sequence: Synthetic oligonucleotide
  Target: SCN10A; (-) strand; PAM type: YTN; PAM sequence: CTT
gacggtgatggtgctaggga

SEQ ID NO: 46098 - DNA, 20 bp, Artificial Sequence
  Description of Artificial Sequence: Synthetic oligonucleotide
  Target: SCN10A; (-) strand; PAM type: YTN; PAM sequence: TTC
ttgacggtgatggtgctagg

SEQ ID NO: 46099 - DNA, 20 bp, Artificial Sequence
  Description of Artificial Sequence: Synthetic oligonucleotide
  Target: SCN10A; (-) strand; PAM type: YTN; PAM sequence: TTT
cttgacggtgatggtgctag

SEQ ID NO: 46100 - DNA, 20 bp, Artificial Sequence
  Description of Artificial Sequence: Synthetic oligonucleotide
  Target: SCN10A; (-) strand; PAM type: YTN; PAM sequence: TTT
tcttgacggtgatggtgcta

SEQ ID NO: 46101 - DNA, 20 bp, Artificial Sequence
  Description of Artificial Sequence: Synthetic oligonucleotide
  Target: SCN10A; (-) strand; PAM type: YTN; PAM sequence: CTT
ttcttgacggtgatggtgct

SEQ ID NO: 46102 - DNA, 20 bp, Artificial Sequence
  Description of Artificial Sequence: Synthetic oligonucleotide
  Target: SCN10A; (-) strand; PAM type: YTN; PAM sequence: CTC
atccttttcttgacggtgat

SEQ ID NO: 46103 - DNA, 20 bp, Artificial Sequence
  Description of Artificial Sequence: Synthetic oligonucleotide
  Target: SCN10A; (-) strand; PAM type: YTN; PAM sequence: TTG
gccaaaaatccatatgcctc

SEQ ID NO: 46104 - DNA, 20 bp, Artificial Sequence
  Description of Artificial Sequence: Synthetic oligonucleotide
  Target: SCN10A; (-) strand; PAM type: YTN; PAM sequence: CTG
catggaagttggccaaaaat

SEQ ID NO: 46105 - DNA, 20 bp, Artificial Sequence
  Description of Artificial Sequence: Synthetic oligonucleotide
  Target: SCN10A; (-) strand; PAM type: YTN; PAM sequence: TTG
agaacatgtgggcctgcatg

SEQ ID NO: 46106 - DNA, 20 bp, Artificial Sequence
  Description of Artificial Sequence: Synthetic oligonucleotide
  Target: SCN10A; (-) strand; PAM type: YTN; PAM sequence: CTG
tggagagtggattgagaaca

SEQ ID NO: 46107 - DNA, 20 bp, Artificial Sequence
  Description of Artificial Sequence: Synthetic oligonucleotide
  Target: SCN10A; (-) strand; PAM type: YTN; PAM sequence: CTC
tgtggagagtggattgagaa

SEQ ID NO: 46108 - DNA, 20 bp, Artificial Sequence
  Description of Artificial Sequence: Synthetic oligonucleotide
  Target: SCN10A; (-) strand; PAM type: YTN; PAM sequence: TTC
cgtatcctctgtggagagtg

SEQ ID NO: 46109 - DNA, 20 bp, Artificial Sequence
  Description of Artificial Sequence: Synthetic oligonucleotide
  Target: SCN10A; (-) strand; PAM type: YTN; PAM sequence: CTT
ccgtatcctctgtggagagt

SEQ ID NO: 46110 - DNA, 20 bp, Artificial Sequence
  Description of Artificial Sequence: Synthetic oligonucleotide
  Target: SCN10A; (-) strand; PAM type: YTN; PAM sequence: TTG
tcttccgtatcctctgtgga

SEQ ID NO: 46111 - DNA, 20 bp, Artificial Sequence
  Description of Artificial Sequence: Synthetic oligonucleotide
  Target: SCN10A; (-) strand; PAM type: YTN; PAM sequence: CTC
attgtcttccgtatcctctg

SEQ ID NO: 46112 - DNA, 20 bp, Artificial Sequence
  Description of Artificial Sequence: Synthetic oligonucleotide
  Target: SCN10A; (-) strand; PAM type: YTN; PAM sequence: TTC
ctcattgtcttccgtatcct

SEQ ID NO: 46113 - DNA, 20 bp, Artificial Sequence
  Description of Artificial Sequence: Synthetic oligonucleotide
  Target: SCN10A; (-) strand; PAM type: YTN; PAM sequence: TTT
cctcattgtcttccgtatcc

SEQ ID NO: 46114 - DNA, 20 bp, Artificial Sequence
  Description of Artificial Sequence: Synthetic oligonucleotide
  Target: SCN10A; (-) strand; PAM type: YTN; PAM sequence: CTT
tcctcattgtcttccgtatc

SEQ ID NO: 46115 - DNA, 20 bp, Artificial Sequence
  Description of Artificial Sequence: Synthetic oligonucleotide
  Target: SCN10A; (-) strand; PAM type: YTN; PAM sequence: CTC
tttcctcattgtcttccgta

SEQ ID NO: 46116 - DNA, 20 bp, Artificial Sequence
  Description of Artificial Sequence: Synthetic oligonucleotide
  Target: SCN10A; (-) strand; PAM type: YTN; PAM sequence: TTC
cactctttcctcattgtctt

SEQ ID NO: 46117 - DNA, 20 bp, Artificial Sequence
  Description of Artificial Sequence: Synthetic oligonucleotide
  Target: SCN10A; (-) strand; PAM type: YTN; PAM sequence: CTT
ccactctttcctcattgtct

SEQ ID NO: 46118 - DNA, 20 bp, Artificial Sequence
  Description of Artificial Sequence: Synthetic oligonucleotide
  Target: SCN10A; (-) strand; PAM type: YTN; PAM sequence: TTC
ttccactctttcctcattgt

SEQ ID NO: 46119 - DNA, 20 bp, Artificial Sequence
  Description of Artificial Sequence: Synthetic oligonucleotide
  Target: SCN10A; (-) strand; PAM type: YTN; PAM sequence: CTT
cttccactctttcctcattg

SEQ ID NO: 46120 - DNA, 20 bp, Artificial Sequence
  Description of Artificial Sequence: Synthetic oligonucleotide
  Target: SCN10A; (-) strand; PAM type: YTN; PAM sequence: CTG
gcacatgcacgacttcttcc

SEQ ID NO: 46121 - DNA, 20 bp, Artificial Sequence
  Description of Artificial Sequence: Synthetic oligonucleotide
  Target: SCN10A; (-) strand; PAM type: YTN; PAM sequence: CTG
gccccgctggcacatgcacg

SEQ ID NO: 46122 - DNA, 20 bp, Artificial Sequence
  Description of Artificial Sequence: Synthetic oligonucleotide
  Target: SCN10A; (-) strand; PAM type: YTN; PAM sequence: CTC
cgcgccccatgaagactggc

SEQ ID NO: 46123 - DNA, 20 bp, Artificial Sequence
  Description of Artificial Sequence: Synthetic oligonucleotide
  Target: SCN10A; (-) strand; PAM type: YTN; PAM sequence: CTA
ccgtaacaaccgaaaaaata

SEQ ID NO: 46124 - DNA, 20 bp, Artificial Sequence
  Description of Artificial Sequence: Synthetic oligonucleotide
  Target: SCN10A; (-) strand; PAM type: YTN; PAM sequence: CTA
ggggaaaactaccgtaacaa

SEQ ID NO: 46125 - DNA, 20 bp, Artificial Sequence
  Description of Artificial Sequence: Synthetic oligonucleotide
  Target: SCN10A; (-) strand; PAM type: YTN; PAM sequence: CTC
ctaggggaaaactaccgtaa

SEQ ID NO: 46126 - DNA, 20 bp, Artificial Sequence
  Description of Artificial Sequence: Synthetic oligonucleotide
  Target: SCN10A; (-) strand; PAM type: YTN; PAM sequence: TTG
gcaagcagctcctaggggaa

SEQ ID NO: 46127 - DNA, 20 bp, Artificial Sequence
  Description of Artificial Sequence: Synthetic oligonucleotide
  Target: SCN10A; (-) strand; PAM type: YTN; PAM sequence: CTG
gttggcaagcagctcctagg

SEQ ID NO: 46128 - DNA, 20 bp, Artificial Sequence
  Description of Artificial Sequence: Synthetic oligonucleotide
  Target: SCN10A; (-) strand; PAM type: YTN; PAM sequence: CTC
tggttggcaagcagctccta

SEQ ID NO: 46129 - DNA, 20 bp, Artificial Sequence
  Description of Artificial Sequence: Synthetic oligonucleotide
  Target: SCN10A; (-) strand; PAM type: YTN; PAM sequence: TTG
ctctggttggcaagcagctc

SEQ ID NO: 46130 - DNA, 20 bp, Artificial Sequence
  Description of Artificial Sequence: Synthetic oligonucleotide
  Target: SCN10A; (-) strand; PAM type: YTN; PAM sequence: TTT
gctctggttggcaagcagct

SEQ ID NO: 46131 - DNA, 20 bp, Artificial Sequence
  Description of Artificial Sequence: Synthetic oligonucleotide
  Target: SCN10A; (-) strand; PAM type: YTN; PAM sequence: CTT
tgctctggttggcaagcagc

SEQ ID NO: 46132 - DNA, 20 bp, Artificial Sequence
  Description of Artificial Sequence: Synthetic oligonucleotide
  Target: SCN10A; (-) strand; PAM type: YTN; PAM sequence: TTG
tctttgctctggttggcaag

SEQ ID NO: 46133 - DNA, 20 bp, Artificial Sequence
  Description of Artificial Sequence: Synthetic oligonucleotide
  Target: SCN10A; (-) strand; PAM type: YTN; PAM sequence: TTT
gtctttgctctggttggcaa

SEQ ID NO: 46134 - DNA, 20 bp, Artificial Sequence
  Description of Artificial Sequence: Synthetic oligonucleotide
  Target: SCN10A; (-) strand; PAM type: YTN; PAM sequence: CTT
tgtctttgctctggttggca

SEQ ID NO: 46135 - DNA, 20 bp, Artificial Sequence
  Description of Artificial Sequence: Synthetic oligonucleotide
  Target: SCN10A; (-) strand; PAM type: YTN; PAM sequence: TTG
tctttgtctttgctctggtt

SEQ ID NO: 46136 - DNA, 20 bp, Artificial Sequence
  Description of Artificial Sequence: Synthetic oligonucleotide
  Target: SCN10A; (-) strand; PAM type: YTN; PAM sequence: CTG
gccatcattgtctttgtctt

SEQ ID NO: 46137 - DNA, 20 bp, Artificial Sequence
  Description of Artificial Sequence: Synthetic oligonucleotide
  Target: SCN10A; (-) strand; PAM type: YTN; PAM sequence: CTC
accatcatcctggccatcat

SEQ ID NO: 46138 - DNA, 20 bp, Artificial Sequence
  Description of Artificial Sequence: Synthetic oligonucleotide
  Target: SCN10A; (-) strand; PAM type: YTN; PAM sequence: CTG
gggaacctcaccatcatcct

SEQ ID NO: 46139 - DNA, 20 bp, Artificial Sequence
  Description of Artificial Sequence: Synthetic oligonucleotide
  Target: SCN10A; (-) strand; PAM type: YTN; PAM sequence: CTC
agtgggggcactggggaacc

SEQ ID NO: 46140 - DNA, 20 bp, Artificial Sequence
  Description of Artificial Sequence: Synthetic oligonucleotide
  Target: SCN10A; (-) strand; PAM type: YTN; PAM sequence: CTC
atcaagatcatcggaaactc

SEQ ID NO: 46141 - DNA, 20 bp, Artificial Sequence
  Description of Artificial Sequence: Synthetic oligonucleotide
  Target: SCN10A; (-) strand; PAM type: YTN; PAM sequence: TTA
aacacactcatcaagatcat

SEQ ID NO: 46142 - DNA, 20 bp, Artificial Sequence
  Description of Artificial Sequence: Synthetic oligonucleotide
  Target: SCN10A; (-) strand; PAM type: YTN; PAM sequence: CTT
aaacacactcatcaagatca

SEQ ID NO: 46143 - DNA, 20 bp, Artificial Sequence
  Description of Artificial Sequence: Synthetic oligonucleotide
  Target: SCN10A; (-) strand; PAM type: YTN; PAM sequence: CTG
gcccaccttaaacacactca

SEQ ID NO: 46144 - DNA, 20 bp, Artificial Sequence
  Description of Artificial Sequence: Synthetic oligonucleotide
  Target: SCN10A; (-) strand; PAM type: YTN; PAM sequence: CTG
gccaaatcctggcccacctt

SEQ ID NO: 46145 - DNA, 20 bp, Artificial Sequence
  Description of Artificial Sequence: Synthetic oligonucleotide
  Target: SCN10A; (-) strand; PAM type: YTN; PAM sequence: TTC
aagctggccaaatcctggcc

SEQ ID NO: 46146 - DNA, 20 bp, Artificial Sequence
  Description of Artificial Sequence: Synthetic oligonucleotide
  Target: SCN10A; (-) strand; PAM type: YTN; PAM sequence: CTG
cgcgtattcaagctggccaa

SEQ ID NO: 46147 - DNA, 20 bp, Artificial Sequence
  Description of Artificial Sequence: Synthetic oligonucleotide
  Target: SCN10A; (-) strand; PAM type: YTN; PAM sequence: CTG
cagctgcgcgtattcaagct

SEQ ID NO: 46148 - DNA, 20 bp, Artificial Sequence
  Description of Artificial Sequence: Synthetic oligonucleotide
  Target: SCN10A; (-) strand; PAM type: YTN; PAM sequence: CTC
tgcagctgcgcgtattcaag

SEQ ID NO: 46149 - DNA, 20 bp, Artificial Sequence
  Description of Artificial Sequence: Synthetic oligonucleotide
  Target: SCN10A; (-) strand; PAM type: YTN; PAM sequence: TTC
tctgcagctgcgcgtattca

SEQ ID NO: 46150 - DNA, 20 bp, Artificial Sequence
  Description of Artificial Sequence: Synthetic oligonucleotide
  Target: SCN10A; (-) strand; PAM type: YTN; PAM sequence: TTT
ctctgcagctgcgcgtattc

SEQ ID NO: 46151 - DNA, 20 bp, Artificial Sequence
  Description of Artificial Sequence: Synthetic oligonucleotide
  Target: SCN10A; (-) strand; PAM type: YTN; PAM sequence: CTG
tttctctgcagctgcgcgta

SEQ ID NO: 46152 - DNA, 20 bp, Artificial Sequence
  Description of Artificial Sequence: Synthetic oligonucleotide
  Target: SCN10A; (-) strand; PAM type: YTN; PAM sequence: CTC
tgtttctctgcagctgcgcg

SEQ ID NO: 46153 - DNA, 20 bp, Artificial Sequence
  Description of Artificial Sequence: Synthetic oligonucleotide
  Target: SCN10A; (-) strand; PAM type: YTN; PAM sequence: CTG
acggtctctgtttctctgca

SEQ ID NO: 46154 - DNA, 20 bp, Artificial Sequence
  Description of Artificial Sequence: Synthetic oligonucleotide
  Target: SCN10A; (-) strand; PAM type: YTN; PAM sequence: CTA
ccaaaacctgacggtctctg

SEQ ID NO: 46155 - DNA, 20 bp, Artificial Sequence
  Description of Artificial Sequence: Synthetic oligonucleotide
  Target: SCN10A; (-) strand; PAM type: YTN; PAM sequence: TTA
gatgaaaggtaatgagcaca

SEQ ID NO: 46156 - DNA, 20 bp, Artificial Sequence
  Description of Artificial Sequence: Synthetic oligonucleotide
  Target: SCN10A; (-) strand; PAM type: YTN; PAM sequence: TTT
agatgaaaggtaatgagcac

SEQ ID NO: 46157 - DNA, 20 bp, Artificial Sequence
  Description of Artificial Sequence: Synthetic oligonucleotide
  Target: SCN10A; (-) strand; PAM type: YTN; PAM sequence: CTT
tagatgaaaggtaatgagca

SEQ ID NO: 46158 - DNA, 20 bp, Artificial Sequence
  Description of Artificial Sequence: Synthetic oligonucleotide
  Target: SCN10A; (-) strand; PAM type: YTN; PAM sequence: TTC
caggcaaaactttagatgaa

SEQ ID NO: 46159 - DNA, 20 bp, Artificial Sequence
  Description of Artificial Sequence: Synthetic oligonucleotide
  Target: SCN10A; (-) strand; PAM type: YTN; PAM sequence: TTT
ccaggcaaaactttagatga

SEQ ID NO: 46160 - DNA, 20 bp, Artificial Sequence
  Description of Artificial Sequence: Synthetic oligonucleotide
  Target: SCN10A; (-) strand; PAM type: YTN; PAM sequence: TTG
gtttccaggcaaaactttag

SEQ ID NO: 46161 - DNA, 20 bp, Artificial Sequence
  Description of Artificial Sequence: Synthetic oligonucleotide
  Target: SCN10A; (-) strand; PAM type: YTN; PAM sequence: TTT
ggtttccaggcaaaacttta

SEQ ID NO: 46162 - DNA, 20 bp, Artificial Sequence
  Description of Artificial Sequence: Synthetic oligonucleotide
  Target: SCN10A; (-) strand; PAM type: YTN; PAM sequence: CTT
tggtttccaggcaaaacttt

SEQ ID NO: 46163 - DNA, 20 bp, Artificial Sequence
  Description of Artificial Sequence: Synthetic oligonucleotide
  Target: SCN10A; (-) strand; PAM type: YTN; PAM sequence: TTC
ccagatctttggtttccagg

SEQ ID NO: 46164 - DNA, 20 bp, Artificial Sequence
  Description of Artificial Sequence: Synthetic oligonucleotide
  Target: SCN10A; (-) strand; PAM type: YTN; PAM sequence: TTT
cccagatctttggtttccag

SEQ ID NO: 46165 - DNA, 20 bp, Artificial Sequence
  Description of Artificial Sequence: Synthetic oligonucleotide
  Target: SCN10A; (-) strand; PAM type: YTN; PAM sequence: TTT
tcccagatctttggtttcca

SEQ ID NO: 46166 - DNA, 20 bp, Artificial Sequence
  Description of Artificial Sequence: Synthetic oligonucleotide
  Target: SCN10A; (-) strand; PAM type: YTN; PAM sequence: TTT
ttcccagatctttggtttcc

SEQ ID NO: 46167 - DNA, 20 bp, Artificial Sequence
  Description of Artificial Sequence: Synthetic oligonucleotide
  Target: SCN10A; (-) strand; PAM type: YTN; PAM sequence: TTG
tgtttttcccagatctttgg

SEQ ID NO: 46168 - DNA, 20 bp, Artificial Sequence
  Description of Artificial Sequence: Synthetic oligonucleotide
  Target: SCN10A; (-) strand; PAM type: YTN; PAM sequence: CTT
gtgtttttcccagatctttg

SEQ ID NO: 46169 - DNA, 20 bp, Artificial Sequence
  Description of Artificial Sequence: Synthetic oligonucleotide
  Target: SCN10A; (-) strand; PAM type: YTN; PAM sequence: TTA
atgggatgagaggccttgtg

SEQ ID NO: 46170 - DNA, 20 bp, Artificial Sequence
  Description of Artificial Sequence: Synthetic oligonucleotide
  Target: SCN10A; (-) strand; PAM type: YTN; PAM sequence: TTT
aatgggatgagaggccttgt

SEQ ID NO: 46171 - DNA, 20 bp, Artificial Sequence
  Description of Artificial Sequence: Synthetic oligonucleotide
  Target: SCN10A; (-) strand; PAM type: YTN; PAM sequence: CTG
gtttaatgggatgagaggcc

SEQ ID NO: 46172 - DNA, 20 bp, Artificial Sequence
  Description of Artificial Sequence: Synthetic oligonucleotide
  Target: SCN10A; (-) strand; PAM type: YTN; PAM sequence: CTC
caaaagcagtgtccagaaaa

SEQ ID NO: 46173 - DNA, 20 bp, Artificial Sequence
  Description of Artificial Sequence: Synthetic oligonucleotide
  Target: SCN10A; (-) strand; PAM type: YTN; PAM sequence: TTA
tagcataggaagaaaggtct

SEQ ID NO: 46174 - DNA, 20 bp, Artificial Sequence
  Description of Artificial Sequence: Synthetic oligonucleotide
  Target: SCN10A; (-) strand; PAM type: YTN; PAM sequence: TTT
atagcataggaagaaaggtc

SEQ ID NO: 46175 - DNA, 20 bp, Artificial Sequence
  Description of Artificial Sequence: Synthetic oligonucleotide
  Target: SCN10A; (-) strand; PAM type: YTN; PAM sequence: TTG
agtaatttatagcataggaa

SEQ ID NO: 46176 - DNA, 20 bp, Artificial Sequence
  Description of Artificial Sequence: Synthetic oligonucleotide
  Target: SCN10A; (-) strand; PAM type: YTN; PAM sequence: TTT
gagtaatttatagcatagga

SEQ ID NO: 46177 - DNA, 20 bp, Artificial Sequence
  Description of Artificial Sequence: Synthetic oligonucleotide
  Target: SCN10A; (-) strand; PAM type: YTN; PAM sequence: TTT
tgagtaatttatagcatagg

SEQ ID NO: 46178 - DNA, 20 bp, Artificial Sequence
  Description of Artificial Sequence: Synthetic oligonucleotide
  Target: SCN10A; (-) strand; PAM type: YTN; PAM sequence: TTT
ttgagtaatttatagcatag

SEQ ID NO: 46179 - DNA, 20 bp, Artificial Sequence
  Description of Artificial Sequence: Synthetic oligonucleotide
  Target: SCN10A; (-) strand; PAM type: YTN; PAM sequence: TTA
tgaaccatagaaggcagatc

SEQ ID NO: 46180 - DNA, 20 bp, Artificial Sequence
  Description of Artificial Sequence: Synthetic oligonucleotide
  Target: SCN10A; (-) strand; PAM type: YTN; PAM sequence: CTT
atgaaccatagaaggcagat

SEQ ID NO: 46181 - DNA, 20 bp, Artificial Sequence
  Description of Artificial Sequence: Synthetic oligonucleotide
  Target: SCN10A; (-) strand; PAM type: YTN; PAM sequence: TTG
atacttatgaaccatagaag

SEQ ID NO: 46182 - DNA, 20 bp, Artificial Sequence
  Description of Artificial Sequence: Synthetic oligonucleotide
  Target: SCN10A; (-) strand; PAM type: YTN; PAM sequence: CTC
agccacagtcaatgaagcac

SEQ ID NO: 46183 - DNA, 20 bp, Artificial Sequence
  Description of Artificial Sequence: Synthetic oligonucleotide
  Target: SCN10A; (-) strand; PAM type: YTN; PAM sequence: CTG
actcagccacagtcaatgaa

SEQ ID NO: 46184 - DNA, 20 bp, Artificial Sequence
  Description of Artificial Sequence: Synthetic oligonucleotide
  Target: SCN10A; (-) strand; PAM type: YTN; PAM sequence: CTA
tagaacagagtacagatcgc

SEQ ID NO: 46185 - DNA, 20 bp, Artificial Sequence
  Description of Artificial Sequence: Synthetic oligonucleotide
  Target: SCN10A; (-) strand; PAM type: YTN; PAM sequence: CTG
tggctatagaacagagtaca

SEQ ID NO: 46186 - DNA, 20 bp, Artificial Sequence
  Description of Artificial Sequence: Synthetic oligonucleotide
  Target: SCN10A; (-) strand; PAM type: YTN; PAM sequence: TTC
aggagggatcaggcctgtgg

SEQ ID NO: 46187 - DNA, 20 bp, Artificial Sequence
  Description of Artificial Sequence: Synthetic oligonucleotide
  Target: SCN10A; (-) strand; PAM type: YTN; PAM sequence: CTC
cacagaagaggcccatattc

SEQ ID NO: 46188 - DNA, 20 bp, Artificial Sequence
  Description of Artificial Sequence: Synthetic oligonucleotide
  Target: SCN10A; (-) strand; PAM type: YTN; PAM sequence: TTG
tgagccccatcacacccacc

SEQ ID NO: 46189 - DNA, 20 bp, Artificial Sequence
  Description of Artificial Sequence: Synthetic oligonucleotide
  Target: SCN10A; (-) strand; PAM type: YTN; PAM sequence: TTT
gtgagccccatcacacccac

SEQ ID NO: 46190 - DNA, 20 bp, Artificial Sequence
  Description of Artificial Sequence: Synthetic oligonucleotide
  Target: SCN10A; (-) strand; PAM type: YTN; PAM sequence: TTA
tttgtgagccccatcacacc

SEQ ID NO: 46191 - DNA, 20 bp, Artificial Sequence
  Description of Artificial Sequence: Synthetic oligonucleotide
  Target: SCN10A; (-) strand; PAM type: YTN; PAM sequence: CTT
atttgtgagccccatcacac

SEQ ID NO: 46192 - DNA, 20 bp, Artificial Sequence
  Description of Artificial Sequence: Synthetic oligonucleotide
  Target: SCN10A; (-) strand; PAM type: YTN; PAM sequence: CTC
acttatttgtgagccccatc

SEQ ID NO: 46193 - DNA, 20 bp, Artificial Sequence
  Description of Artificial Sequence: Synthetic oligonucleotide
  Target: SCN10A; (-) strand; PAM type: YTN; PAM sequence: TTC
tcacttatttgtgagcccca

SEQ ID NO: 46194 - DNA, 20 bp, Artificial Sequence
  Description of Artificial Sequence: Synthetic oligonucleotide
  Target: SCN10A; (-) strand; PAM type: YTN; PAM sequence: TTG
ttctcacttatttgtgagcc

SEQ ID NO: 46195 - DNA, 20 bp, Artificial Sequence
  Description of Artificial Sequence: Synthetic oligonucleotide
  Target: SCN10A; (-) strand; PAM type: YTN; PAM sequence: CTT
gttctcacttatttgtgagc

SEQ ID NO: 46196 - DNA, 20 bp, Artificial Sequence
  Description of Artificial Sequence: Synthetic oligonucleotide
  Target: SCN10A; (-) strand; PAM type: YTN; PAM sequence: TTC
agtcataaataagcttgttc

SEQ ID NO: 46197 - DNA, 20 bp, Artificial Sequence
  Description of Artificial Sequence: Synthetic oligonucleotide
  Target: SCN10A; (-) strand; PAM type: YTN; PAM sequence: CTT
cagtcataaataagcttgtt

SEQ ID NO: 46198 - DNA, 20 bp, Artificial Sequence
  Description of Artificial Sequence: Synthetic oligonucleotide
  Target: SCN10A; (-) strand; PAM type: YTN; PAM sequence: CTC
ttcagtcataaataagcttg

SEQ ID NO: 46199 - DNA, 20 bp, Artificial Sequence
  Description of Artificial Sequence: Synthetic oligonucleotide
  Target: SCN10A; (-) strand; PAM type: YTN; PAM sequence: CTC
tcttcagtcataaataagct

SEQ ID NO: 46200 - DNA, 20 bp, Artificial Sequence
  Description of Artificial Sequence: Synthetic oligonucleotide
  Target: SCN10A; (-) strand; PAM type: YTN; PAM sequence: CTG
gtctctcttcagtcataaat

SEQ ID NO: 46201 - DNA, 20 bp, Artificial Sequence
  Description of Artificial Sequence: Synthetic oligonucleotide
  Target: SCN10A; (-) strand; PAM type: YTN; PAM sequence: CTA
cccgaaggaggctggtctct

SEQ ID NO: 46202 - DNA, 20 bp, Artificial Sequence
  Description of Artificial Sequence: Synthetic oligonucleotide
  Target: SCN10A; (-) strand; PAM type: YTN; PAM sequence: CTA
tcgaatgcagtgggtcatcc

SEQ ID NO: 46203 - DNA, 20 bp, Artificial Sequence
  Description of Artificial Sequence: Synthetic oligonucleotide
  Target: SCN10A; (-) strand; PAM type: YTN; PAM sequence: TTG
ccaatacctatcgaatgcag

SEQ ID NO: 46204 - DNA, 20 bp, Artificial Sequence
  Description of Artificial Sequence: Synthetic oligonucleotide
  Target: SCN10A; (-) strand; PAM type: YTN; PAM sequence: TTT
gccaatacctatcgaatgca

SEQ ID NO: 46205 - DNA, 20 bp, Artificial Sequence
  Description of Artificial Sequence: Synthetic oligonucleotide
  Target: SCN10A; (-) strand; PAM type: YTN; PAM sequence: TTT
tgccaatacctatcgaatgc

SEQ ID NO: 46206 - DNA, 20 bp, Artificial Sequence
  Description of Artificial Sequence: Synthetic oligonucleotide
  Target: SCN10A; (-) strand; PAM type: YTN; PAM sequence: CTA
agagatgttttgccaatacc

SEQ ID NO: 46207 - DNA, 20 bp, Artificial Sequence
  Description of Artificial Sequence: Synthetic oligonucleotide
  Target: SCN10A; (-) strand; PAM type: YTN; PAM sequence: CTG
ccccaagatgagaaatgccc

SEQ ID NO: 46208 - DNA, 20 bp, Artificial Sequence
  Description of Artificial Sequence: Synthetic oligonucleotide
  Target: SCN10A; (-) strand; PAM type: YTN; PAM sequence: TTG
tccactgccccaagatgaga

SEQ ID NO: 46209 - DNA, 20 bp, Artificial Sequence
  Description of Artificial Sequence: Synthetic oligonucleotide
  Target: SCN10A; (-) strand; PAM type: YTN; PAM sequence: CTG
gtgggagcaacagatgttgt

SEQ ID NO: 46210 - DNA, 20 bp, Artificial Sequence
  Description of Artificial Sequence: Synthetic oligonucleotide
  Target: SCN10A; (-) strand; PAM type: YTN; PAM sequence: TTC
aaagctggtgggagcaacag

SEQ ID NO: 46211 - DNA, 20 bp, Artificial Sequence
  Description of Artificial Sequence: Synthetic oligonucleotide
  Target: SCN10A; (-) strand; PAM type: YTN; PAM sequence: TTT
caaagctggtgggagcaaca

SEQ ID NO: 46212 - DNA, 20 bp, Artificial Sequence
  Description of Artificial Sequence: Synthetic oligonucleotide
  Target: SCN10A; (-) strand; PAM type: YTN; PAM sequence: TTG
cagtttcaaagctggtggga

SEQ ID NO: 46213 - DNA, 20 bp, Artificial Sequence
  Description of Artificial Sequence: Synthetic oligonucleotide
  Target: SCN10A; (-) strand; PAM type: YTN; PAM sequence: TTT
gcagtttcaaagctggtggg

SEQ ID NO: 46214 - DNA, 20 bp, Artificial Sequence
  Description of Artificial Sequence: Synthetic oligonucleotide
  Target: SCN10A; (-) strand; PAM type: YTN; PAM sequence: CTG
agtccatgaaatcatggaca

SEQ ID NO: 46215 - DNA, 20 bp, Artificial Sequence
  Description of Artificial Sequence: Synthetic oligonucleotide
  Target: SCN10A; (-) strand; PAM type: YTN; PAM sequence: TTA
tgaatgctgagtccatgaaa

SEQ ID NO: 46216 - DNA, 20 bp, Artificial Sequence
  Description of Artificial Sequence: Synthetic oligonucleotide
  Target: SCN10A; (-) strand; PAM type: YTN; PAM sequence: CTT
atgaatgctgagtccatgaa

SEQ ID NO: 46217 - DNA, 20 bp, Artificial Sequence
  Description of Artificial Sequence: Synthetic oligonucleotide
  Target: SCN10A; (-) strand; PAM type: YTN; PAM sequence: TTA
aatcaacttatgaatgctga

SEQ ID NO: 46218 - DNA, 20 bp, Artificial Sequence
  Description of Artificial Sequence: Synthetic oligonucleotide
  Target: SCN10A; (-) strand; PAM type: YTN; PAM sequence: TTG
gtcaattaaatcaacttatg

SEQ ID NO: 46219 - DNA, 20 bp, Artificial Sequence
  Description of Artificial Sequence: Synthetic oligonucleotide
  Target: SCN10A; (-) strand; PAM type: YTN; PAM sequence: TTC
gttggtcaattaaatcaact

SEQ ID NO: 46220 - DNA, 20 bp, Artificial Sequence
  Description of Artificial Sequence: Synthetic oligonucleotide
  Target: SCN10A; (-) strand; PAM type: YTN; PAM sequence: CTG
gggggtaggttcgttggtca

SEQ ID NO: 46221 - DNA, 20 bp, Artificial Sequence
  Description of Artificial Sequence: Synthetic oligonucleotide
  Target: SCN10A; (-) strand; PAM type: YTN; PAM sequence: TTC
tggggggtaggttcgttggt

SEQ ID NO: 46222 - DNA, 20 bp, Artificial Sequence
  Description of Artificial Sequence: Synthetic oligonucleotide
  Target: SCN10A; (-) strand; PAM type: YTN; PAM sequence: CTG
gagttctggggggtaggttc

SEQ ID NO: 46223 - DNA, 20 bp, Artificial Sequence
  Description of Artificial Sequence: Synthetic oligonucleotide
  Target: SCN10A; (-) strand; PAM type: YTN; PAM sequence: CTG
cacggctggagttctggggg

SEQ ID NO: 46224 - DNA, 20 bp, Artificial Sequence
  Description of Artificial Sequence: Synthetic oligonucleotide
  Target: SCN10A; (-) strand; PAM type: YTN; PAM sequence: CTG
ccatgcacctgcacggctgg

SEQ ID NO: 46225 - DNA, 20 bp, Artificial Sequence
  Description of Artificial Sequence: Synthetic oligonucleotide
  Target: SCN10A; (-) strand; PAM type: YTN; PAM sequence: CTA
gcacactgccatgcacctgc

SEQ ID NO: 46226 - DNA, 20 bp, Artificial Sequence
  Description of Artificial Sequence: Synthetic oligonucleotide
  Target: SCN10A; (-) strand; PAM type: YTN; PAM sequence: CTC
ataggctagcacactgccat

SEQ ID NO: 46227 - DNA, 20 bp, Artificial Sequence
  Description of Artificial Sequence: Synthetic oligonucleotide
  Target: SCN10A; (-) strand; PAM type: YTN; PAM sequence: TTC
atacacctcataggctagca

SEQ ID NO: 46228 - DNA, 20 bp, Artificial Sequence
  Description of Artificial Sequence: Synthetic oligonucleotide
  Target: SCN10A; (-) strand; PAM type: YTN; PAM sequence: CTT
catacacctcataggctagc

SEQ ID NO: 46229 - DNA, 20 bp, Artificial Sequence
  Description of Artificial Sequence: Synthetic oligonucleotide
  Target: SCN10A; (-) strand; PAM type: YTN; PAM sequence: CTC
ttcatacacctcataggcta

SEQ ID NO: 46230 - DNA, 20 bp, Artificial Sequence
  Description of Artificial Sequence: Synthetic oligonucleotide
  Target: SCN10A; (-) strand; PAM type: YTN; PAM sequence: CTC
tcttcatacacctcataggc

SEQ ID NO: 46231 - DNA, 20 bp, Artificial Sequence
  Description of Artificial Sequence: Synthetic oligonucleotide
  Target: SCN10A; (-) strand; PAM type: YTN; PAM sequence: TTC
catgagagcaagagcccaca

SEQ ID NO: 46232 - DNA, 20 bp, Artificial Sequence
  Description of Artificial Sequence: Synthetic oligonucleotide
  Target: SCN10A; (-) strand; PAM type: YTN; PAM sequence: TTG
gttccatgagagcaagagcc

SEQ ID NO: 46233 - DNA, 20 bp, Artificial Sequence
  Description of Artificial Sequence: Synthetic oligonucleotide
  Target: SCN10A; (-) strand; PAM type: YTN; PAM sequence: CTA
aaccattggttccatgagag

SEQ ID NO: 46234 - DNA, 20 bp, Artificial Sequence
  Description of Artificial Sequence: Synthetic oligonucleotide
  Target: SCN10A; (-) strand; PAM type: YTN; PAM sequence: CTC
agtaactaaaccattggttc

SEQ ID NO: 46235 - DNA, 20 bp, Artificial Sequence
  Description of Artificial Sequence: Synthetic oligonucleotide
  Target: SCN10A; (-) strand; PAM type: YTN; PAM sequence: TTC
tcagtaactaaaccattggt

SEQ ID NO: 46236 - DNA, 20 bp, Artificial Sequence
  Description of Artificial Sequence: Synthetic oligonucleotide
  Target: SCN10A; (-) strand; PAM type: YTN; PAM sequence: TTT
ctcagtaactaaaccattgg

SEQ ID NO: 46237 - DNA, 20 bp, Artificial Sequence
  Description of Artificial Sequence: Synthetic oligonucleotide
  Target: SCN10A; (-) strand; PAM type: YTN; PAM sequence: TTT
tctcagtaactaaaccattg

SEQ ID NO: 46238 - DNA, 20 bp, Artificial Sequence
  Description of Artificial Sequence: Synthetic oligonucleotide
  Target: SCN10A; (-) strand; PAM type: YTN; PAM sequence: CTT
ttctcagtaactaaaccatt

SEQ ID NO: 46239 - DNA, 20 bp, Artificial Sequence
  Description of Artificial Sequence: Synthetic oligonucleotide
  Target: SCN10A; (-) strand; PAM type: YTN; PAM sequence: TTC
atcttttctcagtaactaaa

SEQ ID NO: 46240 - DNA, 20 bp, Artificial Sequence
  Description of Artificial Sequence: Synthetic oligonucleotide
  Target: SCN10A; (-) strand; PAM type: YTN; PAM sequence: CTT
catcttttctcagtaactaa

SEQ ID NO: 46241 - DNA, 20 bp, Artificial Sequence
  Description of Artificial Sequence: Synthetic oligonucleotide
  Target: SCN10A; (-) strand; PAM type: YTN; PAM sequence: TTG
agacttcatcttttctcagt

SEQ ID NO: 46242 - DNA, 20 bp, Artificial Sequence
  Description of Artificial Sequence: Synthetic oligonucleotide
  Target: SCN10A; (-) strand; PAM type: YTN; PAM sequence: TTT
gagacttcatcttttctcag

SEQ ID NO: 46243 - DNA, 20 bp, Artificial Sequence
  Description of Artificial Sequence: Synthetic oligonucleotide
  Target: SCN10A; (-) strand; PAM type: YTN; PAM sequence: TTT
tgagacttcatcttttctca

SEQ ID NO: 46244 - DNA, 20 bp, Artificial Sequence
  Description of Artificial Sequence: Synthetic oligonucleotide
  Target: SCN10A; (-) strand; PAM type: YTN; PAM sequence: CTT
ttgagacttcatcttttctc

SEQ ID NO: 46245 - DNA, 20 bp, Artificial Sequence
  Description of Artificial Sequence: Synthetic oligonucleotide
  Target: SCN10A; (-) strand; PAM type: YTN; PAM sequence: TTA
cagtgaagacttttgagact

SEQ ID NO: 46246 - DNA, 20 bp, Artificial Sequence
  Description of Artificial Sequence: Synthetic oligonucleotide
  Target: SCN10A; (-) strand; PAM type: YTN; PAM sequence: TTT
acagtgaagacttttgagac

SEQ ID NO: 46247 - DNA, 20 bp, Artificial Sequence
  Description of Artificial Sequence: Synthetic oligonucleotide
  Target: SCN10A; (-) strand; PAM type: YTN; PAM sequence: TTG
agtttacagtgaagactttt

SEQ ID NO: 46248 - DNA, 20 bp, Artificial Sequence
  Description of Artificial Sequence: Synthetic oligonucleotide
  Target: SCN10A; (-) strand; PAM type: YTN; PAM sequence: TTT
gagtttacagtgaagacttt

SEQ ID NO: 46249 - DNA, 20 bp, Artificial Sequence
  Description of Artificial Sequence: Synthetic oligonucleotide
  Target: SCN10A; (-) strand; PAM type: YTN; PAM sequence: TTA
gcatatttgagtttacagtg

SEQ ID NO: 46250 - DNA, 20 bp, Artificial Sequence
  Description of Artificial Sequence: Synthetic oligonucleotide
  Target: SCN10A; (-) strand; PAM type: YTN; PAM sequence: CTT
agcatatttgagtttacagt

SEQ ID NO: 46251 - DNA, 20 bp, Artificial Sequence
  Description of Artificial Sequence: Synthetic oligonucleotide
  Target: SCN10A; (-) strand; PAM type: YTN; PAM sequence: TTG
tgggacttagcatatttgag

SEQ ID NO: 46252 - DNA, 20 bp, Artificial Sequence
  Description of Artificial Sequence: Synthetic oligonucleotide
  Target: SCN10A; (-) strand; PAM type: YTN; PAM sequence: CTT
gtgggacttagcatatttga

SEQ ID NO: 46253 - DNA, 20 bp, Artificial Sequence
  Description of Artificial Sequence: Synthetic oligonucleotide
  Target: SCN10A; (-) strand; PAM type: YTN; PAM sequence: CTG
tcttgtgggacttagcatat

SEQ ID NO: 46254 - DNA, 20 bp, Artificial Sequence
  Description of Artificial Sequence: Synthetic oligonucleotide
  Target: SCN10A; (-) strand; PAM type: YTN; PAM sequence: TTG
ctgtcttgtgggacttagca

SEQ ID NO: 46255 - DNA, 20 bp, Artificial Sequence
  Description of Artificial Sequence: Synthetic oligonucleotide
  Target: SCN10A; (-) strand; PAM type: YTN; PAM sequence: TTT
gctgtcttgtgggacttagc

SEQ ID NO: 46256 - DNA, 20 bp, Artificial Sequence
  Description of Artificial Sequence: Synthetic oligonucleotide
  Target: SCN10A; (-) strand; PAM type: YTN; PAM sequence: TTT
tgctgtcttgtgggacttag

SEQ ID NO: 46257 - DNA, 20 bp, Artificial Sequence
  Description of Artificial Sequence: Synthetic oligonucleotide
  Target: SCN10A; (-) strand; PAM type: YTN; PAM sequence: TTG
atgattttgctgtcttgtgg

SEQ ID NO: 46258 - DNA, 20 bp, Artificial Sequence
  Description of Artificial Sequence: Synthetic oligonucleotide
  Target: SCN10A; (-) strand; PAM type: YTN; PAM sequence: CTT
gatgattttgctgtcttgtg

SEQ ID NO: 46259 - DNA, 20 bp, Artificial Sequence
  Description of Artificial Sequence: Synthetic oligonucleotide
  Target: SCN10A; (-) strand; PAM type: YTN; PAM sequence: TTA
tgcttgatgattttgctgtc

SEQ ID NO: 46260 - DNA, 20 bp, Artificial Sequence
  Description of Artificial Sequence: Synthetic oligonucleotide
  Target: SCN10A; (-) strand; PAM type: YTN; PAM sequence: TTT
atgcttgatgattttgctgt

SEQ ID NO: 46261 - DNA, 20 bp, Artificial Sequence
  Description of Artificial Sequence: Synthetic oligonucleotide
  Target: SCN10A; (-) strand; PAM type: YTN; PAM sequence: TTT
tatgcttgatgattttgctg

SEQ ID NO: 46262 - DNA, 20 bp, Artificial Sequence
  Description of Artificial Sequence: Synthetic oligonucleotide
  Target: SCN10A; (-) strand; PAM type: YTN; PAM sequence: TTT
ttatgcttgatgattttgct

SEQ ID NO: 46263 - DNA, 20 bp, Artificial Sequence
  Description of Artificial Sequence: Synthetic oligonucleotide
  Target: SCN10A; (-) strand; PAM type: YTN; PAM sequence: TTA
aaacacatacatttttatgc

SEQ ID NO: 46264 - DNA, 20 bp, Artificial Sequence
  Description of Artificial Sequence: Synthetic oligonucleotide
  Target: SCN10A; (-) strand; PAM type: YTN; PAM sequence: TTT
aaaacacatacatttttatg

SEQ ID NO: 46265 - DNA, 20 bp, Artificial Sequence
  Description of Artificial Sequence: Synthetic oligonucleotide
  Target: SCN10A; (-) strand; PAM type: YTN; PAM sequence: TTT
taaaacacatacatttttat

SEQ ID NO: 46266 - DNA, 20 bp, Artificial Sequence
  Description of Artificial Sequence: Synthetic oligonucleotide
  Target: SCN10A; (-) strand; PAM type: YTN; PAM sequence: TTA
gagaaccatacaaatatatt

SEQ ID NO: 46267 - DNA, 20 bp, Artificial Sequence
  Description of Artificial Sequence: Synthetic oligonucleotide
  Target: SCN10A; (-) strand; PAM type: YTN; PAM sequence: CTG
acaaattagagaaccataca

SEQ ID NO: 46268 - DNA, 20 bp, Artificial Sequence
  Description of Artificial Sequence: Synthetic oligonucleotide
  Target: SCN10A; (-) strand; PAM type: YTN; PAM sequence: TTC
ctgacaaattagagaaccat

SEQ ID NO: 46269 - DNA, 20 bp, Artificial Sequence
  Description of Artificial Sequence: Synthetic oligonucleotide
  Target: SCN10A; (-) strand; PAM type: YTN; PAM sequence: TTT
cctgacaaattagagaacca

SEQ ID NO: 46270 - DNA, 20 bp, Artificial Sequence
  Description of Artificial Sequence: Synthetic oligonucleotide
  Target: SCN10A; (-) strand; PAM type: YTN; PAM sequence: TTT
tcctgacaaattagagaacc

SEQ ID NO: 46271 - DNA, 20 bp, Artificial Sequence
  Description of Artificial Sequence: Synthetic oligonucleotide
  Target: SCN10A; (-) strand; PAM type: YTN; PAM sequence: TTT
ttcctgacaaattagagaac

SEQ ID NO: 46272 - DNA, 20 bp, Artificial Sequence
  Description of Artificial Sequence: Synthetic oligonucleotide
  Target: SCN10A; (-) strand; PAM type: YTN; PAM sequence: TTT
tttcctgacaaattagagaa

SEQ ID NO: 46273 - DNA, 20 bp, Artificial Sequence
  Description of Artificial Sequence: Synthetic oligonucleotide
  Target: SCN10A; (-) strand; PAM type: YTN; PAM sequence: TTT
ttttcctgacaaattagaga

SEQ ID NO: 46274 - DNA, 20 bp, Artificial Sequence
  Description of Artificial Sequence: Synthetic oligonucleotide
  Target: SCN10A; (-) strand; PAM type: YTN; PAM sequence: TTT
tttttcctgacaaattagag

SEQ ID NO: 46275 - DNA, 20 bp, Artificial Sequence
  Description of Artificial Sequence: Synthetic oligonucleotide
  Target: SCN10A; (-) strand; PAM type: YTN; PAM sequence: CTC
agattttttttcctgacaaa

SEQ ID NO: 46276 - DNA, 20 bp, Artificial Sequence
  Description of Artificial Sequence: Synthetic oligonucleotide
  Target: SCN10A; (-) strand; PAM type: YTN; PAM sequence: TTG
agctcagattttttttcctg

SEQ ID NO: 46277 - DNA, 20 bp, Artificial Sequence
  Description of Artificial Sequence: Synthetic oligonucleotide
  Target: SCN10A; (-) strand; PAM type: YTN; PAM sequence: CTG
acagttgagctcagattttt

SEQ ID NO: 46278 - DNA, 20 bp, Artificial Sequence
  Description of Artificial Sequence: Synthetic oligonucleotide
  Target: SCN10A; (-) strand; PAM type: YTN; PAM sequence: CTG
acagactgacagttgagctc

SEQ ID NO: 46279 - DNA, 20 bp, Artificial Sequence
  Description of Artificial Sequence: Synthetic oligonucleotide
  Target: SCN10A; (-) strand; PAM type: YTN; PAM sequence: TTG
actgacagactgacagttga

SEQ ID NO: 46280 - DNA, 20 bp, Artificial Sequence
  Description of Artificial Sequence: Synthetic oligonucleotide
  Target: SCN10A; (-) strand; PAM type: YTN; PAM sequence: CTT
gactgacagactgacagttg

SEQ ID NO: 46281 - DNA, 20 bp, Artificial Sequence
  Description of Artificial Sequence: Synthetic oligonucleotide
  Target: SCN10A; (-) strand; PAM type: YTN; PAM sequence: CTC
cataaacacaccttgactga

SEQ ID NO: 46282 - DNA, 20 bp, Artificial Sequence
  Description of Artificial Sequence: Synthetic oligonucleotide
  Target: SCN10A; (-) strand; PAM type: YTN; PAM sequence: TTA
gtaggtgctccataaacaca

SEQ ID NO: 46283 - DNA, 20 bp, Artificial Sequence
  Description of Artificial Sequence: Synthetic oligonucleotide
  Target: SCN10A; (-) strand; PAM type: YTN; PAM sequence: CTT
agtaggtgctccataaacac

SEQ ID NO: 46284 - DNA, 20 bp, Artificial Sequence
  Description of Artificial Sequence: Synthetic oligonucleotide
  Target: SCN10A; (-) strand; PAM type: YTN; PAM sequence: CTC
ttagtaggtgctccataaac

SEQ ID NO: 46285 - DNA, 20 bp, Artificial Sequence
  Description of Artificial Sequence: Synthetic oligonucleotide
  Target: SCN10A; (-) strand; PAM type: YTN; PAM sequence: CTG
gctcttagtaggtgctccat

SEQ ID NO: 46286 - DNA, 20 bp, Artificial Sequence
  Description of Artificial Sequence: Synthetic oligonucleotide
  Target: SCN10A; (-) strand; PAM type: YTN; PAM sequence: CTA
agccacagcctggctcttag

SEQ ID NO: 46287 - DNA, 20 bp, Artificial Sequence
  Description of Artificial Sequence: Synthetic oligonucleotide
  Target: SCN10A; (-) strand; PAM type: YTN; PAM sequence: CTA
gcacctaagccacagcctgg

SEQ ID NO: 46288 - DNA, 20 bp, Artificial Sequence
  Description of Artificial Sequence: Synthetic oligonucleotide
  Target: SCN10A; (-) strand; PAM type: YTN; PAM sequence: TTG
catcctagcacctaagccac

SEQ ID NO: 46289 - DNA, 20 bp, Artificial Sequence
  Description of Artificial Sequence: Synthetic oligonucleotide
  Target: SCN10A; (-) strand; PAM type: YTN; PAM sequence: TTC
agcattgcatcctagcacct

SEQ ID NO: 46290 - DNA, 20 bp, Artificial Sequence
  Description of Artificial Sequence: Synthetic oligonucleotide
  Target: SCN10A; (-) strand; PAM type: YTN; PAM sequence: TTG
tgttcagcattgcatcctag

SEQ ID NO: 46291 - DNA, 20 bp, Artificial Sequence
  Description of Artificial Sequence: Synthetic oligonucleotide
  Target: SCN10A; (-) strand; PAM type: YTN; PAM sequence: CTG
ttgtgttcagcattgcatcc

SEQ ID NO: 46292 - DNA, 20 bp, Artificial Sequence
  Description of Artificial Sequence: Synthetic oligonucleotide
  Target: SCN10A; (-) strand; PAM type: YTN; PAM sequence: CTA
cactgttgtgttcagcattg

SEQ ID NO: 46293 - DNA, 20 bp, Artificial Sequence
  Description of Artificial Sequence: Synthetic oligonucleotide
  Target: SCN10A; (-) strand; PAM type: YTN; PAM sequence: TTG
tagctacactgttgtgttca

SEQ ID NO: 46294 - DNA, 20 bp, Artificial Sequence
  Description of Artificial Sequence: Synthetic oligonucleotide
  Target: SCN10A; (-) strand; PAM type: YTN; PAM sequence: CTC
acggatatgggtgataaaat

SEQ ID NO: 46295 - DNA, 20 bp, Artificial Sequence
  Description of Artificial Sequence: Synthetic oligonucleotide
  Target: SCN10A; (-) strand; PAM type: YTN; PAM sequence: TTA
ctcacggatatgggtgataa

SEQ ID NO: 46296 - DNA, 20 bp, Artificial Sequence
  Description of Artificial Sequence: Synthetic oligonucleotide
  Target: SCN10A; (-) strand; PAM type: YTN; PAM sequence: TTT
actcacggatatgggtgata

SEQ ID NO: 46297 - DNA, 20 bp, Artificial Sequence
  Description of Artificial Sequence: Synthetic oligonucleotide
  Target: SCN10A; (-) strand; PAM type: YTN; PAM sequence: CTC
ccgtgggatttactcacgga

SEQ ID NO: 46298 - DNA, 20 bp, Artificial Sequence
  Description of Artificial Sequence: Synthetic oligonucleotide
  Target: SCN10A; (-) strand; PAM type: YTN; PAM sequence: CTC
ctcccgtgggatttactcac

SEQ ID NO: 46299 - DNA, 20 bp, Artificial Sequence
  Description of Artificial Sequence: Synthetic oligonucleotide
  Target: SCN10A; (-) strand; PAM type: YTN; PAM sequence: TTA
aacctcctcccgtgggattt

SEQ ID NO: 46300 - DNA, 20 bp, Artificial Sequence
  Description of Artificial Sequence: Synthetic oligonucleotide
  Target: SCN10A; (-) strand; PAM type: YTN; PAM sequence: CTG
tataacaggattaaacctcc

SEQ ID NO: 46301 - DNA, 20 bp, Artificial Sequence
  Description of Artificial Sequence: Synthetic oligonucleotide
  Target: SCN10A; (-) strand; PAM type: YTN; PAM sequence: TTA
ctgtataacaggattaaacc

SEQ ID NO: 46302 - DNA, 20 bp, Artificial Sequence
  Description of Artificial Sequence: Synthetic oligonucleotide
  Target: SCN10A; (-) strand; PAM type: YTN; PAM sequence: CTT
actgtataacaggattaaac

SEQ ID NO: 46303 - DNA, 20 bp, Artificial Sequence
  Description of Artificial Sequence: Synthetic oligonucleotide
  Target: SCN10A; (-) strand; PAM type: YTN; PAM sequence: CTC
ccccatcacataaagaggtg

SEQ ID NO: 46304 - DNA, 20 bp, Artificial Sequence
  Description of Artificial Sequence: Synthetic oligonucleotide
  Target: SCN10A; (-) strand; PAM type: YTN; PAM sequence: CTC
tcccccatcacataaagagg

SEQ ID NO: 46305 - DNA, 20 bp, Artificial Sequence
  Description of Artificial Sequence: Synthetic oligonucleotide
  Target: SCN10A; (-) strand; PAM type: YTN; PAM sequence: TTG
ggtgtaaggtgaacgtggac

SEQ ID NO: 46306 - DNA, 20 bp, Artificial Sequence
  Description of Artificial Sequence: Synthetic oligonucleotide
  Target: SCN10A; (-) strand; PAM type: YTN; PAM sequence: TTC
cagattgggtgtaaggtgaa

SEQ ID NO: 46307 - DNA, 20 bp, Artificial Sequence
  Description of Artificial Sequence: Synthetic oligonucleotide
  Target: SCN10A; (-) strand; PAM type: YTN; PAM sequence: CTT
ccagattgggtgtaaggtga

SEQ ID NO: 46308 - DNA, 20 bp, Artificial Sequence
  Description of Artificial Sequence: Synthetic oligonucleotide
  Target: SCN10A; (-) strand; PAM type: YTN; PAM sequence: TTC
ccatatgaggagagtaactt

SEQ ID NO: 46309 - DNA, 20 bp, Artificial Sequence
  Description of Artificial Sequence: Synthetic oligonucleotide
  Target: SCN10A; (-) strand; PAM type: YTN; PAM sequence: CTT
cccatatgaggagagtaact

SEQ ID NO: 46310 - DNA, 20 bp, Artificial Sequence
  Description of Artificial Sequence: Synthetic oligonucleotide
  Target: SCN10A; (-) strand; PAM type: YTN; PAM sequence: CTG
cttcccatatgaggagagta

SEQ ID NO: 46311 - DNA, 20 bp, Artificial Sequence
  Description of Artificial Sequence: Synthetic oligonucleotide
  Target: SCN10A; (-) strand; PAM type: YTN; PAM sequence: CTC
tgcttcccatatgaggagag

SEQ ID NO: 46312 - DNA, 20 bp, Artificial Sequence
  Description of Artificial Sequence: Synthetic oligonucleotide
  Target: SCN10A; (-) strand; PAM type: YTN; PAM sequence: TTA
agctctgcttcccatatgag

SEQ ID NO: 46313 - DNA, 20 bp, Artificial Sequence
  Description of Artificial Sequence: Synthetic oligonucleotide
  Target: SCN10A; (-) strand; PAM type: YTN; PAM sequence: TTT
aagctctgcttcccatatga

SEQ ID NO: 46314 - DNA, 20 bp, Artificial Sequence
  Description of Artificial Sequence: Synthetic oligonucleotide
  Target: SCN10A; (-) strand; PAM type: YTN; PAM sequence: TTT
taagctctgcttcccatatg

SEQ ID NO: 46315 - DNA, 20 bp, Artificial Sequence
  Description of Artificial Sequence: Synthetic oligonucleotide
  Target: SCN10A; (-) strand; PAM type: YTN; PAM sequence: TTG
ttttaagctctgcttcccat

SEQ ID NO: 46316 - DNA, 20 bp, Artificial Sequence
  Description of Artificial Sequence: Synthetic oligonucleotide
  Target: SCN10A; (-) strand; PAM type: YTN; PAM sequence: TTG
ttgttttaagctctgcttcc

SEQ ID NO: 46317 - DNA, 20 bp, Artificial Sequence
  Description of Artificial Sequence: Synthetic oligonucleotide
  Target: SCN10A; (-) strand; PAM type: YTN; PAM sequence: CTG
tgaccagtccacagagttgt

SEQ ID NO: 46318 - DNA, 20 bp, Artificial Sequence
  Description of Artificial Sequence: Synthetic oligonucleotide
  Target: SCN10A; (-) strand; PAM type: YTN; PAM sequence: CTC
tgtgaccagtccacagagtt

SEQ ID NO: 46319 - DNA, 20 bp, Artificial Sequence
  Description of Artificial Sequence: Synthetic oligonucleotide
  Target: SCN10A; (-) strand; PAM type: YTN; PAM sequence: CTG
cctctgtgaccagtccacag

SEQ ID NO: 46320 - DNA, 20 bp, Artificial Sequence
  Description of Artificial Sequence: Synthetic oligonucleotide
  Target: SCN10A; (-) strand; PAM type: YTN; PAM sequence: TTA
tcagctgcctctgtgaccag

SEQ ID NO: 46321 - DNA, 20 bp, Artificial Sequence
  Description of Artificial Sequence: Synthetic oligonucleotide
  Target: SCN10A; (-) strand; PAM type: YTN; PAM sequence: TTT
atcagctgcctctgtgacca

SEQ ID NO: 46322 - DNA, 20 bp, Artificial Sequence
  Description of Artificial Sequence: Synthetic oligonucleotide
  Target: SCN10A; (-) strand; PAM type: YTN; PAM sequence: TTG
tgtttatcagctgcctctgt

SEQ ID NO: 46323 - DNA, 20 bp, Artificial Sequence
  Description of Artificial Sequence: Synthetic oligonucleotide
  Target: SCN10A; (-) strand; PAM type: YTN; PAM sequence: TTT
gtgtttatcagctgcctctg

SEQ ID NO: 46324 - DNA, 20 bp, Artificial Sequence
  Description of Artificial Sequence: Synthetic oligonucleotide
  Target: SCN10A; (-) strand; PAM type: YTN; PAM sequence: TTA
tttgtgtttatcagctgcct

SEQ ID NO: 46325 - DNA, 20 bp, Artificial Sequence
  Description of Artificial Sequence: Synthetic oligonucleotide
  Target: SCN10A; (-) strand; PAM type: YTN; PAM sequence: TTT
atttgtgtttatcagctgcc

SEQ ID NO: 46326 - DNA, 20 bp, Artificial Sequence
  Description of Artificial Sequence: Synthetic oligonucleotide
  Target: SCN10A; (-) strand; PAM type: YTN; PAM sequence: TTT
tatttgtgtttatcagctgc

SEQ ID NO: 46327 - DNA, 20 bp, Artificial Sequence
  Description of Artificial Sequence: Synthetic oligonucleotide
  Target: SCN10A; (-) strand; PAM type: YTN; PAM sequence: TTT
ttatttgtgtttatcagctg

SEQ ID NO: 46328 - DNA, 20 bp, Artificial Sequence
  Description of Artificial Sequence: Synthetic oligonucleotide
  Target: SCN10A; (-) strand; PAM type: YTN; PAM sequence: CTC
agtttttatttgtgtttatc

SEQ ID NO: 46329 - DNA, 20 bp, Artificial Sequence
  Description of Artificial Sequence: Synthetic oligonucleotide
  Target: SCN10A; (-) strand; PAM type: YTN; PAM sequence: CTA
atgctcagtttttatttgtg

SEQ ID NO: 46330 - DNA, 20 bp, Artificial Sequence
  Description of Artificial Sequence: Synthetic oligonucleotide
  Target: SCN10A; (-) strand; PAM type: YTN; PAM sequence: TTA
ctaatgctcagtttttattt

SEQ ID NO: 46331 - DNA, 20 bp, Artificial Sequence
  Description of Artificial Sequence: Synthetic oligonucleotide
  Target: SCN10A; (-) strand; PAM type: YTN; PAM sequence: CTA
gttactaatgctcagttttt

SEQ ID NO: 46332 - DNA, 20 bp, Artificial Sequence
  Description of Artificial Sequence: Synthetic oligonucleotide
  Target: SCN10A; (-) strand; PAM type: YTN; PAM sequence: CTC
cccatactagttactaatgc

SEQ ID NO: 46333 - DNA, 20 bp, Artificial Sequence
  Description of Artificial Sequence: Synthetic oligonucleotide
  Target: SCN10A; (-) strand; PAM type: YTN; PAM sequence: CTG
ctccccatactagttactaa

SEQ ID NO: 46334 - DNA, 20 bp, Artificial Sequence
  Description of Artificial Sequence: Synthetic oligonucleotide
  Target: SCN10A; (-) strand; PAM type: YTN; PAM sequence: TTC
ctgctccccatactagttac

SEQ ID NO: 46335 - DNA, 20 bp, Artificial Sequence
  Description of Artificial Sequence: Synthetic oligonucleotide
  Target: SCN10A; (-) strand; PAM type: YTN; PAM sequence: TTT
cctgctccccatactagtta

SEQ ID NO: 46336 - DNA, 20 bp, Artificial Sequence
  Description of Artificial Sequence: Synthetic oligonucleotide
  Target: SCN10A; (-) strand; PAM type: YTN; PAM sequence: CTA
cgtttcctgctccccatact

SEQ ID NO: 46337 - DNA, 20 bp, Artificial Sequence
  Description of Artificial Sequence: Synthetic oligonucleotide
  Target: SCN10A; (-) strand; PAM type: YTN; PAM sequence: TTC
ggcaggccatggactacgtt

SEQ ID NO: 46338 - DNA, 20 bp, Artificial Sequence
  Description of Artificial Sequence: Synthetic oligonucleotide
  Target: SCN10A; (-) strand; PAM type: YTN; PAM sequence: CTT
cggcaggccatggactacgt

SEQ ID NO: 46339 - DNA, 20 bp, Artificial Sequence
  Description of Artificial Sequence: Synthetic oligonucleotide
  Target: SCN10A; (-) strand; PAM type: YTN; PAM sequence: TTA
caaccttcggcaggccatgg

SEQ ID NO: 46340 - DNA, 20 bp, Artificial Sequence
  Description of Artificial Sequence: Synthetic oligonucleotide
  Target: SCN10A; (-) strand; PAM type: YTN; PAM sequence: CTT
acaaccttcggcaggccatg

SEQ ID NO: 46341 - DNA, 20 bp, Artificial Sequence
  Description of Artificial Sequence: Synthetic oligonucleotide
  Target: SCN10A; (-) strand; PAM type: YTN; PAM sequence: CTA
ggcttacaaccttcggcagg

SEQ ID NO: 46342 - DNA, 20 bp, Artificial Sequence
  Description of Artificial Sequence: Synthetic oligonucleotide
  Target: SCN10A; (-) strand; PAM type: YTN; PAM sequence: CTG
ctaggcttacaaccttcggc

SEQ ID NO: 46343 - DNA, 20 bp, Artificial Sequence
  Description of Artificial Sequence: Synthetic oligonucleotide
  Target: SCN10A; (-) strand; PAM type: YTN; PAM sequence: TTC
ctgctaggcttacaaccttc

SEQ ID NO: 46344 - DNA, 20 bp, Artificial Sequence
  Description of Artificial Sequence: Synthetic oligonucleotide
  Target: SCN10A; (-) strand; PAM type: YTN; PAM sequence: TTA
aagcagggagaaattcctgc

SEQ ID NO: 46345 - DNA, 20 bp, Artificial Sequence
  Description of Artificial Sequence: Synthetic oligonucleotide
  Target: SCN10A; (-) strand; PAM type: YTN; PAM sequence: CTT
aaagcagggagaaattcctg

SEQ ID NO: 46346 - DNA, 20 bp, Artificial Sequence
  Description of Artificial Sequence: Synthetic oligonucleotide
  Target: SCN10A; (-) strand; PAM type: YTN; PAM sequence: CTA
gtcttaaagcagggagaaat

SEQ ID NO: 46347 - DNA, 20 bp, Artificial Sequence
  Description of Artificial Sequence: Synthetic oligonucleotide
  Target: SCN10A; (-) strand; PAM type: YTN; PAM sequence: TTG
ggatctagtcttaaagcagg

SEQ ID NO: 46348 - DNA, 20 bp, Artificial Sequence
  Description of Artificial Sequence: Synthetic oligonucleotide
  Target: SCN10A; (-) strand; PAM type: YTN; PAM sequence: TTT
gggatctagtcttaaagcag

SEQ ID NO: 46349 - DNA, 20 bp, Artificial Sequence
  Description of Artificial Sequence: Synthetic oligonucleotide
  Target: SCN10A; (-) strand; PAM type: YTN; PAM sequence: CTT
tgggatctagtcttaaagca

SEQ ID NO: 46350 - DNA, 20 bp, Artificial Sequence
  Description of Artificial Sequence: Synthetic oligonucleotide
  Target: SCN10A; (-) strand; PAM type: YTN; PAM sequence: CTC
tttgggatctagtcttaaag

SEQ ID NO: 46351 - DNA, 20 bp, Artificial Sequence
  Description of Artificial Sequence: Synthetic oligonucleotide
  Target: SCN10A; (-) strand; PAM type: YTN; PAM sequence: TTA
catgaagggtatagctcttt

SEQ ID NO: 46352 - DNA, 20 bp, Artificial Sequence
  Description of Artificial Sequence: Synthetic oligonucleotide
  Target: SCN10A; (-) strand; PAM type: YTN; PAM sequence: CTT
acatgaagggtatagctctt

SEQ ID NO: 46353 - DNA, 20 bp, Artificial Sequence
  Description of Artificial Sequence: Synthetic oligonucleotide
  Target: SCN10A; (-) strand; PAM type: YTN; PAM sequence: TTC
atccttacatgaagggtata

SEQ ID NO: 46354 - DNA, 20 bp, Artificial Sequence
  Description of Artificial Sequence: Synthetic oligonucleotide
  Target: SCN10A; (-) strand; PAM type: YTN; PAM sequence: TTG
tggttcatccttacatgaag

SEQ ID NO: 46355 - DNA, 20 bp, Artificial Sequence
  Description of Artificial Sequence: Synthetic oligonucleotide
  Target: SCN10A; (-) strand; PAM type: YTN; PAM sequence: TTT
gtggttcatccttacatgaa

SEQ ID NO: 46356 - DNA, 20 bp, Artificial Sequence
  Description of Artificial Sequence: Synthetic oligonucleotide
  Target: SCN10A; (-) strand; PAM type: YTN; PAM sequence: TTG
tttgtggttcatccttacat

SEQ ID NO: 46357 - DNA, 20 bp, Artificial Sequence
  Description of Artificial Sequence: Synthetic oligonucleotide
  Target: SCN10A; (-) strand; PAM type: YTN; PAM sequence: CTG
ggattgtttgtggttcatcc

SEQ ID NO: 46358 - DNA, 20 bp, Artificial Sequence
  Description of Artificial Sequence: Synthetic oligonucleotide
  Target: SCN10A; (-) strand; PAM type: YTN; PAM sequence: CTC
ctgggattgtttgtggttca

SEQ ID NO: 46359 - DNA, 20 bp, Artificial Sequence
  Description of Artificial Sequence: Synthetic oligonucleotide
  Target: SCN10A; (-) strand; PAM type: YTN; PAM sequence: TTC
tcctgggattgtttgtggtt

SEQ ID NO: 46360 - DNA, 20 bp, Artificial Sequence
  Description of Artificial Sequence: Synthetic oligonucleotide
  Target: SCN10A; (-) strand; PAM type: YTN; PAM sequence: TTG
cattctcctgggattgtttg

SEQ ID NO: 46361 - DNA, 20 bp, Artificial Sequence
  Description of Artificial Sequence: Synthetic oligonucleotide
  Target: SCN10A; (-) strand; PAM type: YTN; PAM sequence: CTT
gcattctcctgggattgttt

SEQ ID NO: 46362 - DNA, 20 bp, Artificial Sequence
  Description of Artificial Sequence: Synthetic oligonucleotide
  Target: SCN10A; (-) strand; PAM type: YTN; PAM sequence: TTC
cttgcattctcctgggattg

SEQ ID NO: 46363 - DNA, 20 bp, Artificial Sequence
  Description of Artificial Sequence: Synthetic oligonucleotide
  Target: SCN10A; (-) strand; PAM type: YTN; PAM sequence: TTT
ccttgcattctcctgggatt

SEQ ID NO: 46364 - DNA, 20 bp, Artificial Sequence
  Description of Artificial Sequence: Synthetic oligonucleotide
  Target: SCN10A; (-) strand; PAM type: YTN; PAM sequence: TTT
tccttgcattctcctgggat

SEQ ID NO: 46365 - DNA, 20 bp, Artificial Sequence
  Description of Artificial Sequence: Synthetic oligonucleotide
  Target: SCN10A; (-) strand; PAM type: YTN; PAM sequence: TTC
aattttccttgcattctcct

SEQ ID NO: 46366 - DNA, 20 bp, Artificial Sequence
  Description of Artificial Sequence: Synthetic oligonucleotide
  Target: SCN10A; (-) strand; PAM type: YTN; PAM sequence: CTA
acaccagccattcaattttc

SEQ ID NO: 46367 - DNA, 20 bp, Artificial Sequence
  Description of Artificial Sequence: Synthetic oligonucleotide
  Target: SCN10A; (-) strand; PAM type: YTN; PAM sequence: CTG
gtacctaacaccagccattc

SEQ ID NO: 46368 - DNA, 20 bp, Artificial Sequence
  Description of Artificial Sequence: Synthetic oligonucleotide
  Target: SCN10A; (-) strand; PAM type: YTN; PAM sequence: CTG
tagctggtacctaacaccag

SEQ ID NO: 46369 - DNA, 20 bp, Artificial Sequence
  Description of Artificial Sequence: Synthetic oligonucleotide
  Target: SCN10A; (-) strand; PAM type: YTN; PAM sequence: CTC
ctgtagctggtacctaacac

SEQ ID NO: 46370 - DNA, 20 bp, Artificial Sequence
  Description of Artificial Sequence: Synthetic oligonucleotide
  Target: SCN10A; (-) strand; PAM type: YTN; PAM sequence: TTC
ctcctgtagctggtacctaa

SEQ ID NO: 46371 - DNA, 20 bp, Artificial Sequence
  Description of Artificial Sequence: Synthetic oligonucleotide
  Target: SCN10A; (-) strand; PAM type: YTN; PAM sequence: TTT
cctcctgtagctggtaccta

SEQ ID NO: 46372 - DNA, 20 bp, Artificial Sequence
  Description of Artificial Sequence: Synthetic oligonucleotide
  Target: SCN10A; (-) strand; PAM type: YTN; PAM sequence: TTT
tcctcctgtagctggtacct

SEQ ID NO: 46373 - DNA, 20 bp, Artificial Sequence
  Description of Artificial Sequence: Synthetic oligonucleotide
  Target: SCN10A; (-) strand; PAM type: YTN; PAM sequence: CTC
agcgtcaattttcctcctgt

SEQ ID NO: 46374 - DNA, 20 bp, Artificial Sequence
  Description of Artificial Sequence: Synthetic oligonucleotide
  Target: SCN10A; (-) strand; PAM type: YTN; PAM sequence: TTC
aaatgctcagcgtcaatttt

SEQ ID NO: 46375 - DNA, 20 bp, Artificial Sequence
  Description of Artificial Sequence: Synthetic oligonucleotide
  Target: SCN10A; (-) strand; PAM type: YTN; PAM sequence: TTT
caaatgctcagcgtcaattt

SEQ ID NO: 46376 - DNA, 20 bp, Artificial Sequence
  Description of Artificial Sequence: Synthetic oligonucleotide
  Target: SCN10A; (-) strand; PAM type: YTN; PAM sequence: TTG
tttcaaatgctcagcgtcaa

SEQ ID NO: 46377 - DNA, 20 bp, Artificial Sequence
  Description of Artificial Sequence: Synthetic oligonucleotide
  Target: SCN10A; (-) strand; PAM type: YTN; PAM sequence: TTG
ttgtttcaaatgctcagcgt

SEQ ID NO: 46378 - DNA, 20 bp, Artificial Sequence
  Description of Artificial Sequence: Synthetic oligonucleotide
  Target: SCN10A; (-) strand; PAM type: YTN; PAM sequence: TTT
gttgtttcaaatgctcagcg

SEQ ID NO: 46379 - DNA, 20 bp, Artificial Sequence
  Description of Artificial Sequence: Synthetic oligonucleotide
  Target: SCN10A; (-) strand; PAM type: YTN; PAM sequence: CTT
tgttgtttcaaatgctcagc

SEQ ID NO: 46380 - DNA, 20 bp, Artificial Sequence
  Description of Artificial Sequence: Synthetic oligonucleotide
  Target: SCN10A; (-) strand; PAM type: YTN; PAM sequence: CTA
tatgagcaccactttgttgt

SEQ ID NO: 46381 - DNA, 20 bp, Artificial Sequence
  Description of Artificial Sequence: Synthetic oligonucleotide
  Target: SCN10A; (-) strand; PAM type: YTN; PAM sequence: TTC
cagataaaatcctatatgag

SEQ ID NO: 46382 - DNA, 20 bp, Artificial Sequence
  Description of Artificial Sequence: Synthetic oligonucleotide
  Target: SCN10A; (-) strand; PAM type: YTN; PAM sequence: CTA
ggtagtgtgaattccagata

SEQ ID NO: 46383 - DNA, 20 bp, Artificial Sequence
  Description of Artificial Sequence: Synthetic oligonucleotide
  Target: SCN10A; (-) strand; PAM type: YTN; PAM sequence: TTA
aaatacctaggtagtgtgaa

SEQ ID NO: 46384 - DNA, 20 bp, Artificial Sequence
  Description of Artificial Sequence: Synthetic oligonucleotide
  Target: SCN10A; (-) strand; PAM type: YTN; PAM sequence: CTT
aaaatacctaggtagtgtga

SEQ ID NO: 46385 - DNA, 20 bp, Artificial Sequence
  Description of Artificial Sequence: Synthetic oligonucleotide
  Target: SCN10A; (-) strand; PAM type: YTN; PAM sequence: CTC
aacttaaaatacctaggtag

SEQ ID NO: 46386 - DNA, 20 bp, Artificial Sequence
  Description of Artificial Sequence: Synthetic oligonucleotide
  Target: SCN10A; (-) strand; PAM type: YTN; PAM sequence: TTC
tcaacttaaaatacctaggt

SEQ ID NO: 46387 - DNA, 20 bp, Artificial Sequence
  Description of Artificial Sequence: Synthetic oligonucleotide
  Target: SCN10A; (-) strand; PAM type: YTN; PAM sequence: TTA
aattctcaacttaaaatacc

SEQ ID NO: 46388 - DNA, 20 bp, Artificial Sequence
  Description of Artificial Sequence: Synthetic oligonucleotide
  Target: SCN10A; (-) strand; PAM type: YTN; PAM sequence: CTA
aattaaattctcaacttaaa

SEQ ID NO: 46389 - DNA, 20 bp, Artificial Sequence
  Description of Artificial Sequence: Synthetic oligonucleotide
  Target: SCN10A; (-) strand; PAM type: YTN; PAM sequence: CTC
taaattaaattctcaactta

SEQ ID NO: 46390 - DNA, 20 bp, Artificial Sequence
  Description of Artificial Sequence: Synthetic oligonucleotide
  Target: SCN10A; (-) strand; PAM type: YTN; PAM sequence: TTG
ctctaaattaaattctcaac

SEQ ID NO: 46391 - DNA, 20 bp, Artificial Sequence
  Description of Artificial Sequence: Synthetic oligonucleotide
  Target: SCN10A; (-) strand; PAM type: YTN; PAM sequence: TTG
tagaattgctctaaattaaa

SEQ ID NO: 46392 - DNA, 20 bp, Artificial Sequence
  Description of Artificial Sequence: Synthetic oligonucleotide
  Target: SCN10A; (-) strand; PAM type: YTN; PAM sequence: TTT
gtagaattgctctaaattaa

SEQ ID NO: 46393 - DNA, 20 bp, Artificial Sequence
  Description of Artificial Sequence: Synthetic oligonucleotide
  Target: SCN10A; (-) strand; PAM type: YTN; PAM sequence: CTT
tgtagaattgctctaaatta

SEQ ID NO: 46394 - DNA, 20 bp, Artificial Sequence
  Description of Artificial Sequence: Synthetic oligonucleotide
  Target: SCN10A; (-) strand; PAM type: YTN; PAM sequence: CTG
cagagcactttgtagaattg

SEQ ID NO: 46395 - DNA, 20 bp, Artificial Sequence
  Description of Artificial Sequence: Synthetic oligonucleotide
  Target: SCN10A; (-) strand; PAM type: YTN; PAM sequence: TTC
tgcagagcactttgtagaat

SEQ ID NO: 46396 - DNA, 20 bp, Artificial Sequence
  Description of Artificial Sequence: Synthetic oligonucleotide
  Target: SCN10A; (-) strand; PAM type: YTN; PAM sequence: TTA
attctgcagagcactttgta

SEQ ID NO: 46397 - DNA, 20 bp, Artificial Sequence
  Description of Artificial Sequence: Synthetic oligonucleotide
  Target: SCN10A; (-) strand; PAM type: YTN; PAM sequence: TTT
aattctgcagagcactttgt

SEQ ID NO: 46398 - DNA, 20 bp, Artificial Sequence
  Description of Artificial Sequence: Synthetic oligonucleotide
  Target: SCN10A; (-) strand; PAM type: YTN; PAM sequence: TTG
catttaattctgcagagcac

SEQ ID NO: 46399 - DNA, 20 bp, Artificial Sequence
  Description of Artificial Sequence: Synthetic oligonucleotide
  Target: SCN10A; (-) strand; PAM type: YTN; PAM sequence: TTT
gcatttaattctgcagagca

SEQ ID NO: 46400 - DNA, 20 bp, Artificial Sequence
  Description of Artificial Sequence: Synthetic oligonucleotide
  Target: SCN10A; (-) strand; PAM type: YTN; PAM sequence: CTC
cagaggtatttgcatttaat

SEQ ID NO: 46401 - DNA, 20 bp, Artificial Sequence
  Description of Artificial Sequence: Synthetic oligonucleotide
  Target: SCN10A; (-) strand; PAM type: YTN; PAM sequence: TTC
ctccagaggtatttgcattt

SEQ ID NO: 46402 - DNA, 20 bp, Artificial Sequence
  Description of Artificial Sequence: Synthetic oligonucleotide
  Target: SCN10A; (-) strand; PAM type: YTN; PAM sequence: CTG
agataaaggcaggttcctcc

SEQ ID NO: 46403 - DNA, 20 bp, Artificial Sequence
  Description of Artificial Sequence: Synthetic oligonucleotide
  Target: SCN10A; (-) strand; PAM type: YTN; PAM sequence: TTG
aaacctgagataaaggcagg

SEQ ID NO: 46404 - DNA, 20 bp, Artificial Sequence
  Description of Artificial Sequence: Synthetic oligonucleotide
  Target: SCN10A; (-) strand; PAM type: YTN; PAM sequence: TTT
gaaacctgagataaaggcag

SEQ ID NO: 46405 - DNA, 20 bp, Artificial Sequence
  Description of Artificial Sequence: Synthetic oligonucleotide
  Target: SCN10A; (-) strand; PAM type: YTN; PAM sequence: TTG
agggaatagtttgaaacctg

SEQ ID NO: 46406 - DNA, 20 bp, Artificial Sequence
  Description of Artificial Sequence: Synthetic oligonucleotide
  Target: SCN10A; (-) strand; PAM type: YTN; PAM sequence: TTT
gagggaatagtttgaaacct

SEQ ID NO: 46407 - DNA, 20 bp, Artificial Sequence
  Description of Artificial Sequence: Synthetic oligonucleotide
  Target: SCN10A; (-) strand; PAM type: YTN; PAM sequence: TTT
tgagggaatagtttgaaacc

SEQ ID NO: 46408 - DNA, 20 bp, Artificial Sequence
  Description of Artificial Sequence: Synthetic oligonucleotide
  Target: SCN10A; (-) strand; PAM type: YTN; PAM sequence: TTT
ttgagggaatagtttgaaac

SEQ ID NO: 46409 - DNA, 20 bp, Artificial Sequence
  Description of Artificial Sequence: Synthetic oligonucleotide
  Target: SCN10A; (-) strand; PAM type: YTN; PAM sequence: TTA
aacaatttttgagggaatag

SEQ ID NO: 46410 - DNA, 20 bp, Artificial Sequence
  Description of Artificial Sequence: Synthetic oligonucleotide
  Target: SCN10A; (-) strand; PAM type: YTN; PAM sequence: CTT
aaacaatttttgagggaata

SEQ ID NO: 46411 - DNA, 20 bp, Artificial Sequence
  Description of Artificial Sequence: Synthetic oligonucleotide
  Target: SCN10A; (-) strand; PAM type: YTN; PAM sequence: CTC
ttaaacaatttttgagggaa

SEQ ID NO: 46412 - DNA, 20 bp, Artificial Sequence
  Description of Artificial Sequence: Synthetic oligonucleotide
  Target: SCN10A; (-) strand; PAM type: YTN; PAM sequence: CTG
caactcttaaacaatttttg

SEQ ID NO: 46413 - DNA, 20 bp, Artificial Sequence
  Description of Artificial Sequence: Synthetic oligonucleotide
  Target: SCN10A; (-) strand; PAM type: YTN; PAM sequence: TTA
ctgcaactcttaaacaattt

SEQ ID NO: 46414 - DNA, 20 bp, Artificial Sequence
  Description of Artificial Sequence: Synthetic oligonucleotide
  Target: SCN10A; (-) strand; PAM type: YTN; PAM sequence: TTT
actgcaactcttaaacaatt

SEQ ID NO: 46415 - DNA, 20 bp, Artificial Sequence
  Description of Artificial Sequence: Synthetic oligonucleotide
  Target: SCN10A; (-) strand; PAM type: YTN; PAM sequence: TTT
tactgcaactcttaaacaat

SEQ ID NO: 46416 - DNA, 20 bp, Artificial Sequence
  Description of Artificial Sequence: Synthetic oligonucleotide
  Target: SCN10A; (-) strand; PAM type: YTN; PAM sequence: TTT
ttactgcaactcttaaacaa

SEQ ID NO: 46417 - DNA, 20 bp, Artificial Sequence
  Description of Artificial Sequence: Synthetic oligonucleotide
  Target: SCN10A; (-) strand; PAM type: YTN; PAM sequence: TTT
tttactgcaactcttaaaca

SEQ ID NO: 46418 - DNA, 20 bp, Artificial Sequence
  Description of Artificial Sequence: Synthetic oligonucleotide
  Target: SCN10A; (-) strand; PAM type: YTN; PAM sequence: TTT
ttttactgcaactcttaaac

SEQ ID NO: 46419 - DNA, 20 bp, Artificial Sequence
  Description of Artificial Sequence: Synthetic oligonucleotide
  Target: SCN10A; (-) strand; PAM type: YTN; PAM sequence: TTG
tttttttactgcaactctta

SEQ ID NO: 46420 - DNA, 20 bp, Artificial Sequence
  Description of Artificial Sequence: Synthetic oligonucleotide
  Target: SCN10A; (-) strand; PAM type: YTN; PAM sequence: TTT
gtttttttactgcaactctt

SEQ ID NO: 46421 - DNA, 20 bp, Artificial Sequence
  Description of Artificial Sequence: Synthetic oligonucleotide
  Target: SCN10A; (-) strand; PAM type: YTN; PAM sequence: TTG
tttgtttttttactgcaact

SEQ ID NO: 46422 - DNA, 20 bp, Artificial Sequence
  Description of Artificial Sequence: Synthetic oligonucleotide
  Target: SCN10A; (-) strand; PAM type: YTN; PAM sequence: TTT
gtttgtttttttactgcaac

SEQ ID NO: 46423 - DNA, 20 bp, Artificial Sequence
  Description of Artificial Sequence: Synthetic oligonucleotide
  Target: SCN10A; (-) strand; PAM type: YTN; PAM sequence: TTT
tgtttgtttttttactgcaa

SEQ ID NO: 46424 - DNA, 20 bp, Artificial Sequence
  Description of Artificial Sequence: Synthetic oligonucleotide
  Target: SCN10A; (-) strand; PAM type: YTN; PAM sequence: TTT
ttgtttgtttttttactgca

SEQ ID NO: 46425 - DNA, 20 bp, Artificial Sequence
  Description of Artificial Sequence: Synthetic oligonucleotide
  Target: SCN10A; (-) strand; PAM type: YTN; PAM sequence: CTG
tttttgtttgtttttttact

SEQ ID NO: 46426 - DNA, 20 bp, Artificial Sequence
  Description of Artificial Sequence: Synthetic oligonucleotide
  Target: SCN10A; (-) strand; PAM type: YTN; PAM sequence: TTC
tgtttttgtttgttttttta

SEQ ID NO: 46427 - DNA, 20 bp, Artificial Sequence
  Description of Artificial Sequence: Synthetic oligonucleotide
  Target: SCN10A; (-) strand; PAM type: YTN; PAM sequence: CTT
ctgtttttgtttgttttttt

SEQ ID NO: 46428 - DNA, 20 bp, Artificial Sequence
  Description of Artificial Sequence: Synthetic oligonucleotide
  Target: SCN10A; (-) strand; PAM type: YTN; PAM sequence: TTC
cttctgtttttgtttgtttt

SEQ ID NO: 46429 - DNA, 20 bp, Artificial Sequence
  Description of Artificial Sequence: Synthetic oligonucleotide
  Target: SCN10A; (-) strand; PAM type: YTN; PAM sequence: CTC
attccttctgtttttgtttg

SEQ ID NO: 46430 - DNA, 20 bp, Artificial Sequence
  Description of Artificial Sequence: Synthetic oligonucleotide
  Target: SCN10A; (-) strand; PAM type: YTN; PAM sequence: TTG
atgactcattccttctgttt

SEQ ID NO: 46431 - DNA, 20 bp, Artificial Sequence
  Description of Artificial Sequence: Synthetic oligonucleotide
  Target: SCN10A; (-) strand; PAM type: YTN; PAM sequence: CTT
gatgactcattccttctgtt

SEQ ID NO: 46432 - DNA, 20 bp, Artificial Sequence
  Description of Artificial Sequence: Synthetic oligonucleotide
  Target: SCN10A; (-) strand; PAM type: YTN; PAM sequence: CTC
ttgatgactcattccttctg

SEQ ID NO: 46433 - DNA, 20 bp, Artificial Sequence
  Description of Artificial Sequence: Synthetic oligonucleotide
  Target: SCN10A; (-) strand; PAM type: YTN; PAM sequence: TTC
actcttgatgactcattcct

SEQ ID NO: 46434 - DNA, 20 bp, Artificial Sequence
  Description of Artificial Sequence: Synthetic oligonucleotide
  Target: SCN10A; (-) strand; PAM type: YTN; PAM sequence: CTC
attcactcttgatgactcat

SEQ ID NO: 46435 - DNA, 20 bp, Artificial Sequence
  Description of Artificial Sequence: Synthetic oligonucleotide
  Target: SCN10A; (-) strand; PAM type: YTN; PAM sequence: TTC
aagatctcattcactcttga

SEQ ID NO: 46436 - DNA, 20 bp, Artificial Sequence
  Description of Artificial Sequence: Synthetic oligonucleotide
  Target: SCN10A; (-) strand; PAM type: YTN; PAM sequence: CTT
caagatctcattcactcttg

SEQ ID NO: 46437 - DNA, 20 bp, Artificial Sequence
  Description of Artificial Sequence: Synthetic oligonucleotide
  Target: SCN10A; (-) strand; PAM type: YTN; PAM sequence: TTC
ttcaagatctcattcactct

SEQ ID NO: 46438 - DNA, 20 bp, Artificial Sequence
  Description of Artificial Sequence: Synthetic oligonucleotide
  Target: SCN10A; (-) strand; PAM type: YTN; PAM sequence: TTT
cttcaagatctcattcactc

SEQ ID NO: 46439 - DNA, 20 bp, Artificial Sequence
  Description of Artificial Sequence: Synthetic oligonucleotide
  Target: SCN10A; (-) strand; PAM type: YTN; PAM sequence: CTG
tggtttcttcaagatctcat

SEQ ID NO: 46440 - DNA, 20 bp, Artificial Sequence
  Description of Artificial Sequence: Synthetic oligonucleotide
  Target: SCN10A; (-) strand; PAM type: YTN; PAM sequence: TTC
cacatctgtggtttcttcaa

SEQ ID NO: 46441 - DNA, 20 bp, Artificial Sequence
  Description of Artificial Sequence: Synthetic oligonucleotide
  Target: SCN10A; (-) strand; PAM type: YTN; PAM sequence: TTT
ccacatctgtggtttcttca

SEQ ID NO: 46442 - DNA, 20 bp, Artificial Sequence
  Description of Artificial Sequence: Synthetic oligonucleotide
  Target: SCN10A; (-) strand; PAM type: YTN; PAM sequence: CTA
tttccacatctgtggtttct

SEQ ID NO: 46443 - DNA, 20 bp, Artificial Sequence
  Description of Artificial Sequence: Synthetic oligonucleotide
  Target: SCN10A; (-) strand; PAM type: YTN; PAM sequence: CTG
aagaaatggaatgactattt

SEQ ID NO: 46444 - DNA, 20 bp, Artificial Sequence
  Description of Artificial Sequence: Synthetic oligonucleotide
  Target: SCN10A; (-) strand; PAM type: YTN; PAM sequence: CTA
tcatctgaagaaatggaatg

SEQ ID NO: 46445 - DNA, 20 bp, Artificial Sequence
  Description of Artificial Sequence: Synthetic oligonucleotide
  Target: SCN10A; (-) strand; PAM type: YTN; PAM sequence: TTC
tatcatctgaagaaatggaa

SEQ ID NO: 46446 - DNA, 20 bp, Artificial Sequence
  Description of Artificial Sequence: Synthetic oligonucleotide
  Target: SCN10A; (-) strand; PAM type: YTN; PAM sequence: CTA
ataattctatcatctgaaga

SEQ ID NO: 46447 - DNA, 20 bp, Artificial Sequence
  Description of Artificial Sequence: Synthetic oligonucleotide
  Target: SCN10A; (-) strand; PAM type: YTN; PAM sequence: CTG
actaataattctatcatctg

SEQ ID NO: 46448 - DNA, 20 bp, Artificial Sequence
  Description of Artificial Sequence: Synthetic oligonucleotide
  Target: SCN10A; (-) strand; PAM type: YTN; PAM sequence: CTC
tgactaataattctatcatc

SEQ ID NO: 46449 - DNA, 20 bp, Artificial Sequence
  Description of Artificial Sequence: Synthetic oligonucleotide
  Target: SCN10A; (-) strand; PAM type: YTN; PAM sequence: TTA
tctctgactaataattctat

SEQ ID NO: 46450 - DNA, 20 bp, Artificial Sequence
  Description of Artificial Sequence: Synthetic oligonucleotide
  Target: SCN10A; (-) strand; PAM type: YTN; PAM sequence: CTG
ttatctctgactaataattc

SEQ ID NO: 46451 - DNA, 20 bp, Artificial Sequence
  Description of Artificial Sequence: Synthetic oligonucleotide
  Target: SCN10A; (-) strand; PAM type: YTN; PAM sequence: TTA
tactgttatctctgactaat

SEQ ID NO: 46452 - DNA, 20 bp, Artificial Sequence
  Description of Artificial Sequence: Synthetic oligonucleotide
  Target: SCN10A; (-) strand; PAM type: YTN; PAM sequence: CTA
attatactgttatctctgac

SEQ ID NO: 46453 - DNA, 20 bp, Artificial Sequence
  Description of Artificial Sequence: Synthetic oligonucleotide
  Target: SCN10A; (-) strand; PAM type: YTN; PAM sequence: TTA
tatctaattatactgttatc

SEQ ID NO: 46454 - DNA, 20 bp, Artificial Sequence
  Description of Artificial Sequence: Synthetic oligonucleotide
  Target: SCN10A; (-) strand; PAM type: YTN; PAM sequence: TTA
acatattatatctaattata

SEQ ID NO: 46455 - DNA, 20 bp, Artificial Sequence
  Description of Artificial Sequence: Synthetic oligonucleotide
  Target: SCN10A; (-) strand; PAM type: YTN; PAM sequence: TTT
aacatattatatctaattat

SEQ ID NO: 46456 - DNA, 20 bp, Artificial Sequence
  Description of Artificial Sequence: Synthetic oligonucleotide
  Target: SCN10A; (-) strand; PAM type: YTN; PAM sequence: CTT
taacatattatatctaatta

SEQ ID NO: 46457 - DNA, 20 bp, Artificial Sequence
  Description of Artificial Sequence: Synthetic oligonucleotide
  Target: SCN10A; (-) strand; PAM type: YTN; PAM sequence: TTC
tttaacatattatatctaat

SEQ ID NO: 46458 - DNA, 20 bp, Artificial Sequence
  Description of Artificial Sequence: Synthetic oligonucleotide
  Target: SCN10A; (-) strand; PAM type: YTN; PAM sequence: TTT
ctttaacatattatatctaa

SEQ ID NO: 46459 - DNA, 20 bp, Artificial Sequence
  Description of Artificial Sequence: Synthetic oligonucleotide
  Target: SCN10A; (-) strand; PAM type: YTN; PAM sequence: TTA
tttctttaacatattatatc

SEQ ID NO: 46460 - DNA, 20 bp, Artificial Sequence
  Description of Artificial Sequence: Synthetic oligonucleotide
  Target: SCN10A; (-) strand; PAM type: YTN; PAM sequence: TTT
atttctttaacatattatat

SEQ ID NO: 46461 - DNA, 20 bp, Artificial Sequence
  Description of Artificial Sequence: Synthetic oligonucleotide
  Target: SCN10A; (-) strand; PAM type: YTN; PAM sequence: TTT
tatttctttaacatattata

SEQ ID NO: 46462 - DNA, 20 bp, Artificial Sequence
  Description of Artificial Sequence: Synthetic oligonucleotide
  Target: SCN10A; (-) strand; PAM type: YTN; PAM sequence: TTA
ttttatttctttaacatatt

SEQ ID NO: 46463 - DNA, 20 bp, Artificial Sequence
  Description of Artificial Sequence: Synthetic oligonucleotide
  Target: SCN10A; (-) strand; PAM type: YTN; PAM sequence: TTA
ttattttatttctttaacat

SEQ ID NO: 46464 - DNA, 20 bp, Artificial Sequence
  Description of Artificial Sequence: Synthetic oligonucleotide
  Target: SCN10A; (-) strand; PAM type: YTN; PAM sequence: TTC
aagttattattttatttctt

SEQ ID NO: 46465 - DNA, 20 bp, Artificial Sequence
  Description of Artificial Sequence: Synthetic oligonucleotide
  Target: SCN10A; (-) strand; PAM type: YTN; PAM sequence: TTT
caagttattattttatttct

SEQ ID NO: 46466 - DNA, 20 bp, Artificial Sequence
  Description of Artificial Sequence: Synthetic oligonucleotide
  Target: SCN10A; (-) strand; PAM type: YTN; PAM sequence: CTG
cacatagtttcaagttatta

SEQ ID NO: 46467 - DNA, 20 bp, Artificial Sequence
  Description of Artificial Sequence: Synthetic oligonucleotide
  Target: SCN10A; (-) strand; PAM type: YTN; PAM sequence: CTC
tgcacatagtttcaagttat

SEQ ID NO: 46468 - DNA, 20 bp, Artificial Sequence
  Description of Artificial Sequence: Synthetic oligonucleotide
  Target: SCN10A; (-) strand; PAM type: YTN; PAM sequence: TTC
tctgcacatagtttcaagtt

SEQ ID NO: 46469 - DNA, 20 bp, Artificial Sequence
  Description of Artificial Sequence: Synthetic oligonucleotide
  Target: SCN10A; (-) strand; PAM type: YTN; PAM sequence: TTA
ttctctgcacatagtttcaa

SEQ ID NO: 46470 - DNA, 20 bp, Artificial Sequence
  Description of Artificial Sequence: Synthetic oligonucleotide
  Target: SCN10A; (-) strand; PAM type: YTN; PAM sequence: TTT
attctctgcacatagtttca

SEQ ID NO: 46471 - DNA, 20 bp, Artificial Sequence
  Description of Artificial Sequence: Synthetic oligonucleotide
  Target: SCN10A; (-) strand; PAM type: YTN; PAM sequence: TTT
tattctctgcacatagtttc

SEQ ID NO: 46472 - DNA, 20 bp, Artificial Sequence
  Description of Artificial Sequence: Synthetic oligonucleotide
  Target: SCN10A; (-) strand; PAM type: YTN; PAM sequence: TTT
ttattctctgcacatagttt

SEQ ID NO: 46473 - DNA, 20 bp, Artificial Sequence
  Description of Artificial Sequence: Synthetic oligonucleotide
  Target: SCN10A; (-) strand; PAM type: YTN; PAM sequence: TTT
tttattctctgcacatagtt

SEQ ID NO: 46474 - DNA, 20 bp, Artificial Sequence
  Description of Artificial Sequence: Synthetic oligonucleotide
  Target: SCN10A; (-) strand; PAM type: YTN; PAM sequence: TTT
ttttattctctgcacatagt

SEQ ID NO: 46475 - DNA, 20 bp, Artificial Sequence
  Description of Artificial Sequence: Synthetic oligonucleotide
  Target: SCN10A; (-) strand; PAM type: YTN; PAM sequence: CTA
tagtttttttattctctgca

SEQ ID NO: 46476 - DNA, 20 bp, Artificial Sequence
  Description of Artificial Sequence: Synthetic oligonucleotide
  Target: SCN10A; (-) strand; PAM type: YTN; PAM sequence: TTA
tctatagtttttttattctc

SEQ ID NO: 46477 - DNA, 20 bp, Artificial Sequence
  Description of Artificial Sequence: Synthetic oligonucleotide
  Target: SCN10A; (-) strand; PAM type: YTN; PAM sequence: TTG
ttatctatagtttttttatt

SEQ ID NO: 46478 - DNA, 20 bp, Artificial Sequence
  Description of Artificial Sequence: Synthetic oligonucleotide
  Target: SCN10A; (-) strand; PAM type: YTN; PAM sequence: TTA
ttgttatctatagttttttt

SEQ ID NO: 46479 - DNA, 20 bp, Artificial Sequence
  Description of Artificial Sequence: Synthetic oligonucleotide
  Target: SCN10A; (-) strand; PAM type: YTN; PAM sequence: TTG
ttattgttatctatagtttt

SEQ ID NO: 46480 - DNA, 20 bp, Artificial Sequence
  Description of Artificial Sequence: Synthetic oligonucleotide
  Target: SCN10A; (-) strand; PAM type: YTN; PAM sequence: CTT
gttattgttatctatagttt

SEQ ID NO: 46481 - DNA, 20 bp, Artificial Sequence
  Description of Artificial Sequence: Synthetic oligonucleotide
  Target: SCN10A; (-) strand; PAM type: YTN; PAM sequence: TTC
acaacttgttattgttatct

SEQ ID NO: 46482 - DNA, 20 bp, Artificial Sequence
  Description of Artificial Sequence: Synthetic oligonucleotide
  Target: SCN10A; (-) strand; PAM type: YTN; PAM sequence: TTT
cacaacttgttattgttatc

SEQ ID NO: 46483 - DNA, 20 bp, Artificial Sequence
  Description of Artificial Sequence: Synthetic oligonucleotide
  Target: SCN10A; (-) strand; PAM type: YTN; PAM sequence: TTT
tcacaacttgttattgttat

SEQ ID NO: 46484 - DNA, 20 bp, Artificial Sequence
  Description of Artificial Sequence: Synthetic oligonucleotide
  Target: SCN10A; (-) strand; PAM type: YTN; PAM sequence: TTT
ttcacaacttgttattgtta

SEQ ID NO: 46485 - DNA, 20 bp, Artificial Sequence
  Description of Artificial Sequence: Synthetic oligonucleotide
  Target: SCN10A; (-) strand; PAM type: YTN; PAM sequence: CTA
agagtgtatttttcacaact

SEQ ID NO: 46486 - DNA, 20 bp, Artificial Sequence
  Description of Artificial Sequence: Synthetic oligonucleotide
  Target: SCN10A; (-) strand; PAM type: YTN; PAM sequence: TTC
taagagtgtatttttcacaa

SEQ ID NO: 46487 - DNA, 20 bp, Artificial Sequence
  Description of Artificial Sequence: Synthetic oligonucleotide
  Target: SCN10A; (-) strand; PAM type: YTN; PAM sequence: TTT
ctaagagtgtatttttcaca

SEQ ID NO: 46488 - DNA, 20 bp, Artificial Sequence
  Description of Artificial Sequence: Synthetic oligonucleotide
  Target: SCN10A; (-) strand; PAM type: YTN; PAM sequence: TTC
atttctaagagtgtattttt

SEQ ID NO: 46489 - DNA, 20 bp, Artificial Sequence
  Description of Artificial Sequence: Synthetic oligonucleotide
  Target: SCN10A; (-) strand; PAM type: YTN; PAM sequence: TTT
catttctaagagtgtatttt

SEQ ID NO: 46490 - DNA, 20 bp, Artificial Sequence
  Description of Artificial Sequence: Synthetic oligonucleotide
  Target: SCN10A; (-) strand; PAM type: YTN; PAM sequence: TTT
tcatttctaagagtgtattt

SEQ ID NO: 46491 - DNA, 20 bp, Artificial Sequence
  Description of Artificial Sequence: Synthetic oligonucleotide
  Target: SCN10A; (-) strand; PAM type: YTN; PAM sequence: TTT
ttcatttctaagagtgtatt

SEQ ID NO: 46492 - DNA, 20 bp, Artificial Sequence
  Description of Artificial Sequence: Synthetic oligonucleotide
  Target: SCN10A; (-) strand; PAM type: YTN; PAM sequence: TTA
tatttttcatttctaagagt

SEQ ID NO: 46493 - DNA, 20 bp, Artificial Sequence
  Description of Artificial Sequence: Synthetic oligonucleotide
  Target: SCN10A; (-) strand; PAM type: YTN; PAM sequence: TTA
agtattatatttttcatttc

SEQ ID NO: 46494 - DNA, 20 bp, Artificial Sequence
  Description of Artificial Sequence: Synthetic oligonucleotide
  Target: SCN10A; (-) strand; PAM type: YTN; PAM sequence: TTT
aagtattatatttttcattt

SEQ ID NO: 46495 - DNA, 20 bp, Artificial Sequence
  Description of Artificial Sequence: Synthetic oligonucleotide
  Target: SCN10A; (-) strand; PAM type: YTN; PAM sequence: TTT
taagtattatatttttcatt

SEQ ID NO: 46496 - DNA, 20 bp, Artificial Sequence
  Description of Artificial Sequence: Synthetic oligonucleotide
  Target: SCN10A; (-) strand; PAM type: YTN; PAM sequence: TTA
attttaagtattatattttt

SEQ ID NO: 46497 - DNA, 20 bp, Artificial Sequence
  Description of Artificial Sequence: Synthetic oligonucleotide
  Target: SCN10A; (-) strand; PAM type: YTN; PAM sequence: TTT
aattttaagtattatatttt

SEQ ID NO: 46498 - DNA, 20 bp, Artificial Sequence
  Description of Artificial Sequence: Synthetic oligonucleotide
  Target: SCN10A; (-) strand; PAM type: YTN; PAM sequence: TTT
taattttaagtattatattt

SEQ ID NO: 46499 - DNA, 20 bp, Artificial Sequence
  Description of Artificial Sequence: Synthetic oligonucleotide
  Target: SCN10A; (-) strand; PAM type: YTN; PAM sequence: TTT
ttaattttaagtattatatt

SEQ ID NO: 46500 - DNA, 20 bp, Artificial Sequence
  Description of Artificial Sequence: Synthetic oligonucleotide
  Target: SCN10A; (-) strand; PAM type: YTN; PAM sequence: TTC
ataatatttttaattttaag

SEQ ID NO: 46501 - DNA, 20 bp, Artificial Sequence
  Description of Artificial Sequence: Synthetic oligonucleotide
  Target: SCN10A; (-) strand; PAM type: YTN; PAM sequence: CTT
cataatatttttaattttaa

SEQ ID NO: 46502 - DNA, 20 bp, Artificial Sequence
  Description of Artificial Sequence: Synthetic oligonucleotide
  Target: SCN10A; (-) strand; PAM type: YTN; PAM sequence: TTC
ttcataatatttttaatttt

SEQ ID NO: 46503 - DNA, 20 bp, Artificial Sequence
  Description of Artificial Sequence: Synthetic oligonucleotide
  Target: SCN10A; (-) strand; PAM type: YTN; PAM sequence: CTT
cttcataatatttttaattt

SEQ ID NO: 46504 - DNA, 20 bp, Artificial Sequence
  Description of Artificial Sequence: Synthetic oligonucleotide
  Target: SCN10A; (-) strand; PAM type: YTN; PAM sequence: CTG
atgcaaaccttcttcataat

SEQ ID NO: 46505 - DNA, 20 bp, Artificial Sequence
  Description of Artificial Sequence: Synthetic oligonucleotide
  Target: SCN10A; (-) strand; PAM type: YTN; PAM sequence: CTG
tgtcaaatctgatgcaaacc

SEQ ID NO: 46506 - DNA, 20 bp, Artificial Sequence
  Description of Artificial Sequence: Synthetic oligonucleotide
  Target: SCN10A; (-) strand; PAM type: YTN; PAM sequence: CTC
ccaaactgtgtcaaatctga

SEQ ID NO: 46507 - DNA, 20 bp, Artificial Sequence
  Description of Artificial Sequence: Synthetic oligonucleotide
  Target: SCN10A; (-) strand; PAM type: YTN; PAM sequence: CTC
tcccaaactgtgtcaaatct

SEQ ID NO: 46508 - DNA, 20 bp, Artificial Sequence
  Description of Artificial Sequence: Synthetic oligonucleotide
  Target: SCN10A; (-) strand; PAM type: YTN; PAM sequence: TTC
tctcccaaactgtgtcaaat

SEQ ID NO: 46509 - DNA, 20 bp, Artificial Sequence
  Description of Artificial Sequence: Synthetic oligonucleotide
  Target: SCN10A; (-) strand; PAM type: YTN; PAM sequence: CTA
attctctcccaaactgtgtc

SEQ ID NO: 46510 - DNA, 20 bp, Artificial Sequence
  Description of Artificial Sequence: Synthetic oligonucleotide
  Target: SCN10A; (-) strand; PAM type: YTN; PAM sequence: TTC
actaattctctcccaaactg

SEQ ID NO: 46511 - DNA, 20 bp, Artificial Sequence
  Description of Artificial Sequence: Synthetic oligonucleotide
  Target: SCN10A; (-) strand; PAM type: YTN; PAM sequence: CTC
agttcactaattctctccca

SEQ ID NO: 46512 - DNA, 20 bp, Artificial Sequence
  Description of Artificial Sequence: Synthetic oligonucleotide
  Target: SCN10A; (-) strand; PAM type: YTN; PAM sequence: CTG
atatatcctcagttcactaa

SEQ ID NO: 46513 - DNA, 20 bp, Artificial Sequence
  Description of Artificial Sequence: Synthetic oligonucleotide
  Target: SCN10A; (-) strand; PAM type: YTN; PAM sequence: TTC
tgatatatcctcagttcact

SEQ ID NO: 46514 - DNA, 20 bp, Artificial Sequence
  Description of Artificial Sequence: Synthetic oligonucleotide
  Target: SCN10A; (-) strand; PAM type: YTN; PAM sequence: TTA
ttctgatatatcctcagttc

SEQ ID NO: 46515 - DNA, 20 bp, Artificial Sequence
  Description of Artificial Sequence: Synthetic oligonucleotide
  Target: SCN10A; (-) strand; PAM type: YTN; PAM sequence: TTT
attctgatatatcctcagtt

SEQ ID NO: 46516 - DNA, 20 bp, Artificial Sequence
  Description of Artificial Sequence: Synthetic oligonucleotide
  Target: SCN10A; (-) strand; PAM type: YTN; PAM sequence: CTG
aataatttattctgatatat

SEQ ID NO: 46517 - DNA, 20 bp, Artificial Sequence
  Description of Artificial Sequence: Synthetic oligonucleotide
  Target: SCN10A; (-) strand; PAM type: YTN; PAM sequence: TTC
tgaataatttattctgatat

SEQ ID NO: 46518 - DNA, 20 bp, Artificial Sequence
  Description of Artificial Sequence: Synthetic oligonucleotide
  Target: SCN10A; (-) strand; PAM type: YTN; PAM sequence: TTA
cattctgaataatttattct

SEQ ID NO: 46519 - DNA, 20 bp, Artificial Sequence
  Description of Artificial Sequence: Synthetic oligonucleotide
  Target: SCN10A; (-) strand; PAM type: YTN; PAM sequence: CTA
ggttacattctgaataattt

SEQ ID NO: 46520 - DNA, 20 bp, Artificial Sequence
  Description of Artificial Sequence: Synthetic oligonucleotide
  Target: SCN10A; (-) strand; PAM type: YTN; PAM sequence: CTC
taggttacattctgaataat

SEQ ID NO: 46521 - DNA, 20 bp, Artificial Sequence
  Description of Artificial Sequence: Synthetic oligonucleotide
  Target: SCN10A; (-) strand; PAM type: YTN; PAM sequence: CTC
tctaggttacattctgaata

SEQ ID NO: 46522 - DNA, 20 bp, Artificial Sequence
  Description of Artificial Sequence: Synthetic oligonucleotide
  Target: SCN10A; (-) strand; PAM type: YTN; PAM sequence: TTA
tgtctctctaggttacattc

SEQ ID NO: 46523 - DNA, 20 bp, Artificial Sequence
  Description of Artificial Sequence: Synthetic oligonucleotide
  Target: SCN10A; (-) strand; PAM type: YTN; PAM sequence: CTT
atgtctctctaggttacatt

SEQ ID NO: 46524 - DNA, 20 bp, Artificial Sequence
  Description of Artificial Sequence: Synthetic oligonucleotide
  Target: SCN10A; (-) strand; PAM type: YTN; PAM sequence: TTC
atcttatgtctctctaggtt

SEQ ID NO: 46525 - DNA, 20 bp, Artificial Sequence
  Description of Artificial Sequence: Synthetic oligonucleotide
  Target: SCN10A; (-) strand; PAM type: YTN; PAM sequence: TTT
catcttatgtctctctaggt

SEQ ID NO: 46526 - DNA, 20 bp, Artificial Sequence
  Description of Artificial Sequence: Synthetic oligonucleotide
  Target: SCN10A; (-) strand; PAM type: YTN; PAM sequence: TTT
tcatcttatgtctctctagg

SEQ ID NO: 46527 - DNA, 20 bp, Artificial Sequence
  Description of Artificial Sequence: Synthetic oligonucleotide
  Target: SCN10A; (-) strand; PAM type: YTN; PAM sequence: TTT
ttcatcttatgtctctctag

SEQ ID NO: 46528 - DNA, 20 bp, Artificial Sequence
  Description of Artificial Sequence: Synthetic oligonucleotide
  Target: SCN10A; (-) strand; PAM type: YTN; PAM sequence: TTA
tttttcatcttatgtctctc

SEQ ID NO: 46529 - DNA, 20 bp, Artificial Sequence
  Description of Artificial Sequence: Synthetic oligonucleotide
  Target: SCN10A; (-) strand; PAM type: YTN; PAM sequence: TTG
ttatttttcatcttatgtct

SEQ ID NO: 46530 - DNA, 20 bp, Artificial Sequence
  Description of Artificial Sequence: Synthetic oligonucleotide
  Target: SCN10A; (-) strand; PAM type: YTN; PAM sequence: TTT
gttatttttcatcttatgtc

SEQ ID NO: 46531 - DNA, 20 bp, Artificial Sequence
  Description of Artificial Sequence: Synthetic oligonucleotide
  Target: SCN10A; (-) strand; PAM type: YTN; PAM sequence: TTT
tgttatttttcatcttatgt

SEQ ID NO: 46532 - DNA, 20 bp, Artificial Sequence
  Description of Artificial Sequence: Synthetic oligonucleotide
  Target: SCN10A; (-) strand; PAM type: YTN; PAM sequence: CTA
ttttgttatttttcatctta

SEQ ID NO: 46533 - DNA, 20 bp, Artificial Sequence
  Description of Artificial Sequence: Synthetic oligonucleotide
  Target: SCN10A; (-) strand; PAM type: YTN; PAM sequence: TTA
cactattttgttatttttca

SEQ ID NO: 46534 - DNA, 20 bp, Artificial Sequence
  Description of Artificial Sequence: Synthetic oligonucleotide
  Target: SCN10A; (-) strand; PAM type: YTN; PAM sequence: CTT
acactattttgttatttttc

SEQ ID NO: 46535 - DNA, 20 bp, Artificial Sequence
  Description of Artificial Sequence: Synthetic oligonucleotide
  Target: SCN10A; (-) strand; PAM type: YTN; PAM sequence: CTC
ttacactattttgttatttt

SEQ ID NO: 46536 - DNA, 20 bp, Artificial Sequence
  Description of Artificial Sequence: Synthetic oligonucleotide
  Target: SCN10A; (-) strand; PAM type: YTN; PAM sequence: CTA
tgtctcttacactattttgt

SEQ ID NO: 46537 - DNA, 20 bp, Artificial Sequence
  Description of Artificial Sequence: Synthetic oligonucleotide
  Target: SCN10A; (-) strand; PAM type: YTN; PAM sequence: CTC
tatgtctcttacactatttt

SEQ ID NO: 46538 - DNA, 20 bp, Artificial Sequence
  Description of Artificial Sequence: Synthetic oligonucleotide
  Target: SCN10A; (-) strand; PAM type: YTN; PAM sequence: CTA
tcctctatgtctcttacact

SEQ ID NO: 46539 - DNA, 20 bp, Artificial Sequence
  Description of Artificial Sequence: Synthetic oligonucleotide
  Target: SCN10A; (-) strand; PAM type: YTN; PAM sequence: TTC
tatcctctatgtctcttaca

SEQ ID NO: 46540 - DNA, 20 bp, Artificial Sequence
  Description of Artificial Sequence: Synthetic oligonucleotide
  Target: SCN10A; (-) strand; PAM type: YTN; PAM sequence: CTC
attctatcctctatgtctct

SEQ ID NO: 46541 - DNA, 20 bp, Artificial Sequence
  Description of Artificial Sequence: Synthetic oligonucleotide
  Target: SCN10A; (-) strand; PAM type: YTN; PAM sequence: CTC
tcattctatcctctatgtct

SEQ ID NO: 46542 - DNA, 20 bp, Artificial Sequence
  Description of Artificial Sequence: Synthetic oligonucleotide
  Target: SCN10A; (-) strand; PAM type: YTN; PAM sequence: CTC
tctcattctatcctctatgt

SEQ ID NO: 46543 - DNA, 20 bp, Artificial Sequence
  Description of Artificial Sequence: Synthetic oligonucleotide
  Target: SCN10A; (-) strand; PAM type: YTN; PAM sequence: TTA
aactctctcattctatcctc

SEQ ID NO: 46544 - DNA, 20 bp, Artificial Sequence
  Description of Artificial Sequence: Synthetic oligonucleotide
  Target: SCN10A; (-) strand; PAM type: YTN; PAM sequence: TTA
gatagatgttaaactctctc

SEQ ID NO: 46545 - DNA, 20 bp, Artificial Sequence
  Description of Artificial Sequence: Synthetic oligonucleotide
  Target: SCN10A; (-) strand; PAM type: YTN; PAM sequence: TTG
gttagatagatgttaaactc

SEQ ID NO: 46546 - DNA, 20 bp, Artificial Sequence
  Description of Artificial Sequence: Synthetic oligonucleotide
  Target: SCN10A; (-) strand; PAM type: YTN; PAM sequence: TTT
ggttagatagatgttaaact

SEQ ID NO: 46547 - DNA, 20 bp, Artificial Sequence
  Description of Artificial Sequence: Synthetic oligonucleotide
  Target: SCN10A; (-) strand; PAM type: YTN; PAM sequence: CTT
tggttagatagatgttaaac

SEQ ID NO: 46548 - DNA, 20 bp, Artificial Sequence
  Description of Artificial Sequence: Synthetic oligonucleotide
  Target: SCN10A; (-) strand; PAM type: YTN; PAM sequence: CTG
gactttggttagatagatgt

SEQ ID NO: 46549 - DNA, 20 bp, Artificial Sequence
  Description of Artificial Sequence: Synthetic oligonucleotide
  Target: SCN10A; (-) strand; PAM type: YTN; PAM sequence: TTC
tggactttggttagatagat

SEQ ID NO: 46550 - DNA, 20 bp, Artificial Sequence
  Description of Artificial Sequence: Synthetic oligonucleotide
  Target: SCN10A; (-) strand; PAM type: YTN; PAM sequence: CTT
ctggactttggttagataga

SEQ ID NO: 46551 - DNA, 20 bp, Artificial Sequence
  Description of Artificial Sequence: Synthetic oligonucleotide
  Target: SCN10A; (-) strand; PAM type: YTN; PAM sequence: CTC
cttctggactttggttagat

SEQ ID NO: 46552 - DNA, 20 bp, Artificial Sequence
  Description of Artificial Sequence: Synthetic oligonucleotide
  Target: SCN10A; (-) strand; PAM type: YTN; PAM sequence: TTC
tccttctggactttggttag

SEQ ID NO: 46553 - DNA, 20 bp, Artificial Sequence
  Description of Artificial Sequence: Synthetic oligonucleotide
  Target: SCN10A; (-) strand; PAM type: YTN; PAM sequence: TTT
ctccttctggactttggtta

SEQ ID NO: 46554 - DNA, 20 bp, Artificial Sequence
  Description of Artificial Sequence: Synthetic oligonucleotide
  Target: SCN10A; (-) strand; PAM type: YTN; PAM sequence: TTT
tctccttctggactttggtt

SEQ ID NO: 46555 - DNA, 20 bp, Artificial Sequence
  Description of Artificial Sequence: Synthetic oligonucleotide
  Target: SCN10A; (-) strand; PAM type: YTN; PAM sequence: TTT
ttctccttctggactttggt

SEQ ID NO: 46556 - DNA, 20 bp, Artificial Sequence
  Description of Artificial Sequence: Synthetic oligonucleotide
  Target: SCN10A; (-) strand; PAM type: YTN; PAM sequence: TTT
tttctccttctggactttgg

SEQ ID NO: 46557 - DNA, 20 bp, Artificial Sequence
  Description of Artificial Sequence: Synthetic oligonucleotide
  Target: SCN10A; (-) strand; PAM type: YTN; PAM sequence: CTA
ttttttctccttctggactt

SEQ ID NO: 46558 - DNA, 20 bp, Artificial Sequence
  Description of Artificial Sequence: Synthetic oligonucleotide
  Target: SCN10A; (-) strand; PAM type: YTN; PAM sequence: TTC
tattttttctccttctggac

SEQ ID NO: 46559 - DNA, 20 bp, Artificial Sequence
  Description of Artificial Sequence: Synthetic oligonucleotide
  Target: SCN10A; (-) strand; PAM type: YTN; PAM sequence: CTC
cacgccattctattttttct

SEQ ID NO: 46560 - DNA, 20 bp, Artificial Sequence
  Description of Artificial Sequence: Synthetic oligonucleotide
  Target: SCN10A; (-) strand; PAM type: YTN; PAM sequence: TTC
ccagacatgatgtgggcagt

SEQ ID NO: 46561 - DNA, 20 bp, Artificial Sequence
  Description of Artificial Sequence: Synthetic oligonucleotide
  Target: SCN10A; (-) strand; PAM type: YTN; PAM sequence: CTG
gaaagttcccagacatgatg

SEQ ID NO: 46562 - DNA, 20 bp, Artificial Sequence
  Description of Artificial Sequence: Synthetic oligonucleotide
  Target: SCN10A; (-) strand; PAM type: YTN; PAM sequence: TTC
tggaaagttcccagacatga

SEQ ID NO: 46563 - DNA, 20 bp, Artificial Sequence
  Description of Artificial Sequence: Synthetic oligonucleotide
  Target: SCN10A; (-) strand; PAM type: YTN; PAM sequence: TTC
aattctggaaagttcccaga

SEQ ID NO: 46564 - DNA, 20 bp, Artificial Sequence
  Description of Artificial Sequence: Synthetic oligonucleotide
  Target: SCN10A; (-) strand; PAM type: YTN; PAM sequence: CTT
caattctggaaagttcccag

SEQ ID NO: 46565 - DNA, 20 bp, Artificial Sequence
  Description of Artificial Sequence: Synthetic oligonucleotide
  Target: SCN10A; (-) strand; PAM type: YTN; PAM sequence: TTC
ttcaattctggaaagttccc

SEQ ID NO: 46566 - DNA, 20 bp, Artificial Sequence
  Description of Artificial Sequence: Synthetic oligonucleotide
  Target: SCN10A; (-) strand; PAM type: YTN; PAM sequence: TTT
cttcaattctggaaagttcc

SEQ ID NO: 46567 - DNA, 20 bp, Artificial Sequence
  Description of Artificial Sequence: Synthetic oligonucleotide
  Target: SCN10A; (-) strand; PAM type: YTN; PAM sequence: TTT
tcttcaattctggaaagttc

SEQ ID NO: 46568 - DNA, 20 bp, Artificial Sequence
  Description of Artificial Sequence: Synthetic oligonucleotide
  Target: SCN10A; (-) strand; PAM type: YTN; PAM sequence: TTG
taattttcttcaattctgga

SEQ ID NO: 46569 - DNA, 20 bp, Artificial Sequence
  Description of Artificial Sequence: Synthetic oligonucleotide
  Target: SCN10A; (-) strand; PAM type: YTN; PAM sequence: TTT
gtaattttcttcaattctgg

SEQ ID NO: 46570 - DNA, 20 bp, Artificial Sequence
  Description of Artificial Sequence: Synthetic oligonucleotide
  Target: SCN10A; (-) strand; PAM type: YTN; PAM sequence: TTT
tgtaattttcttcaattctg

SEQ ID NO: 46571 - DNA, 20 bp, Artificial Sequence
  Description of Artificial Sequence: Synthetic oligonucleotide
  Target: SCN10A; (-) strand; PAM type: YTN; PAM sequence: TTA
gttttgtaattttcttcaat

SEQ ID NO: 46572 - DNA, 20 bp, Artificial Sequence
  Description of Artificial Sequence: Synthetic oligonucleotide
  Target: SCN10A; (-) strand; PAM type: YTN; PAM sequence: TTT
agttttgtaattttcttcaa

SEQ ID NO: 46573 - DNA, 20 bp, Artificial Sequence
  Description of Artificial Sequence: Synthetic oligonucleotide
  Target: SCN10A; (-) strand; PAM type: YTN; PAM sequence: CTT
tagttttgtaattttcttca

SEQ ID NO: 46574 - DNA, 20 bp, Artificial Sequence
  Description of Artificial Sequence: Synthetic oligonucleotide
  Target: SCN10A; (-) strand; PAM type: YTN; PAM sequence: TTG
aatctttagttttgtaattt

SEQ ID NO: 46575 - DNA, 20 bp, Artificial Sequence
  Description of Artificial Sequence: Synthetic oligonucleotide
  Target: SCN10A; (-) strand; PAM type: YTN; PAM sequence: CTT
gaatctttagttttgtaatt

SEQ ID NO: 46576 - DNA, 20 bp, Artificial Sequence
  Description of Artificial Sequence: Synthetic oligonucleotide
  Target: SCN10A; (-) strand; PAM type: YTN; PAM sequence: TTC
ttgaatctttagttttgtaa

SEQ ID NO: 46577 - DNA, 20 bp, Artificial Sequence
  Description of Artificial Sequence: Synthetic oligonucleotide
  Target: SCN10A; (-) strand; PAM type: YTN; PAM sequence: CTT
cttgaatctttagttttgta

SEQ ID NO: 46578 - DNA, 20 bp, Artificial Sequence
  Description of Artificial Sequence: Synthetic oligonucleotide
  Target: SCN10A; (-) strand; PAM type: YTN; PAM sequence: CTG
acttcttgaatctttagttt

SEQ ID NO: 46579 - DNA, 20 bp, Artificial Sequence
  Description of Artificial Sequence: Synthetic oligonucleotide
  Target: SCN10A; (-) strand; PAM type: YTN; PAM sequence: TTA
agatatactgacttcttgaa

SEQ ID NO: 46580 - DNA, 20 bp, Artificial Sequence
  Description of Artificial Sequence: Synthetic oligonucleotide
  Target: SCN10A; (-) strand; PAM type: YTN; PAM sequence: CTT
aagatatactgacttcttga

SEQ ID NO: 46581 - DNA, 20 bp, Artificial Sequence
  Description of Artificial Sequence: Synthetic oligonucleotide
  Target: SCN10A; (-) strand; PAM type: YTN; PAM sequence: TTA
taatgcttaagatatactga

SEQ ID NO: 46582 - DNA, 20 bp, Artificial Sequence
  Description of Artificial Sequence: Synthetic oligonucleotide
  Target: SCN10A; (-) strand; PAM type: YTN; PAM sequence: TTT
ataatgcttaagatatactg

SEQ ID NO: 46583 - DNA, 20 bp, Artificial Sequence
  Description of Artificial Sequence: Synthetic oligonucleotide
  Target: SCN10A; (-) strand; PAM type: YTN; PAM sequence: TTC
catttataatgcttaagata

SEQ ID NO: 46584 - DNA, 20 bp, Artificial Sequence
  Description of Artificial Sequence: Synthetic oligonucleotide
  Target: SCN10A; (-) strand; PAM type: YTN; PAM sequence: TTT
ccatttataatgcttaagat

SEQ ID NO: 46585 - DNA, 20 bp, Artificial Sequence
  Description of Artificial Sequence: Synthetic oligonucleotide
  Target: SCN10A; (-) strand; PAM type: YTN; PAM sequence: CTT
tccatttataatgcttaaga

SEQ ID NO: 46586 - DNA, 20 bp, Artificial Sequence
  Description of Artificial Sequence: Synthetic oligonucleotide
  Target: SCN10A; (-) strand; PAM type: YTN; PAM sequence: TTC
tttccatttataatgcttaa

SEQ ID NO: 46587 - DNA, 20 bp, Artificial Sequence
  Description of Artificial Sequence: Synthetic oligonucleotide
  Target: SCN10A; (-) strand; PAM type: YTN; PAM sequence: CTT
ctttccatttataatgctta

SEQ ID NO: 46588 - DNA, 20 bp, Artificial Sequence
  Description of Artificial Sequence: Synthetic oligonucleotide
  Target: SCN10A; (-) strand; PAM type: YTN; PAM sequence: CTA
ggtgtggacttctttccatt

SEQ ID NO: 46589 - DNA, 20 bp, Artificial Sequence
  Description of Artificial Sequence: Synthetic oligonucleotide
  Target: SCN10A; (-) strand; PAM type: YTN; PAM sequence: CTG
taatatgtctaggtgtggac

SEQ ID NO: 46590 - DNA, 20 bp, Artificial Sequence
  Description of Artificial Sequence: Synthetic oligonucleotide
  Target: SCN10A; (-) strand; PAM type: YTN; PAM sequence: TTC
actgtaatatgtctaggtgt

SEQ ID NO: 46591 - DNA, 20 bp, Artificial Sequence
  Description of Artificial Sequence: Synthetic oligonucleotide
  Target: SCN10A; (-) strand; PAM type: YTN; PAM sequence: TTT
cactgtaatatgtctaggtg

SEQ ID NO: 46592 - DNA, 20 bp, Artificial Sequence
  Description of Artificial Sequence: Synthetic oligonucleotide
  Target: SCN10A; (-) strand; PAM type: YTN; PAM sequence: CTG
cagtttcactgtaatatgtc

SEQ ID NO: 46593 - DNA, 20 bp, Artificial Sequence
  Description of Artificial Sequence: Synthetic oligonucleotide
  Target: SCN10A; (-) strand; PAM type: YTN; PAM sequence: TTC
tgcagtttcactgtaatatg

SEQ ID NO: 46594 - DNA, 20 bp, Artificial Sequence
  Description of Artificial Sequence: Synthetic oligonucleotide
  Target: SCN10A; (-) strand; PAM type: YTN; PAM sequence: TTG
gtgttctgcagtttcactgt

SEQ ID NO: 46595 - DNA, 20 bp, Artificial Sequence
  Description of Artificial Sequence: Synthetic oligonucleotide
  Target: SCN10A; (-) strand; PAM type: YTN; PAM sequence: TTT
ggtgttctgcagtttcactg

SEQ ID NO: 46596 - DNA, 20 bp, Artificial Sequence
  Description of Artificial Sequence: Synthetic oligonucleotide
  Target: SCN10A; (-) strand; PAM type: YTN; PAM sequence: CTT
tggtgttctgcagtttcact

SEQ ID NO: 46597 - DNA, 20 bp, Artificial Sequence
  Description of Artificial Sequence: Synthetic oligonucleotide
  Target: SCN10A; (-) strand; PAM type: YTN; PAM sequence: CTA
tccatctttggtgttctgca

SEQ ID NO: 46598 - DNA, 20 bp, Artificial Sequence
  Description of Artificial Sequence: Synthetic oligonucleotide
  Target: SCN10A; (-) strand; PAM type: YTN; PAM sequence: TTC
tatccatctttggtgttctg

SEQ ID NO: 46599 - DNA, 20 bp, Artificial Sequence
  Description of Artificial Sequence: Synthetic oligonucleotide
  Target: SCN10A; (-) strand; PAM type: YTN; PAM sequence: CTT
ctatccatctttggtgttct

SEQ ID NO: 46600 - DNA, 20 bp, Artificial Sequence
  Description of Artificial Sequence: Synthetic oligonucleotide
  Target: SCN10A; (-) strand; PAM type: YTN; PAM sequence: TTA
aatcttctatccatctttgg

SEQ ID NO: 46601 - DNA, 20 bp, Artificial Sequence
  Description of Artificial Sequence: Synthetic oligonucleotide
  Target: SCN10A; (-) strand; PAM type: YTN; PAM sequence: TTT
aaatcttctatccatctttg

SEQ ID NO: 46602 - DNA, 20 bp, Artificial Sequence
  Description of Artificial Sequence: Synthetic oligonucleotide
  Target: SCN10A; (-) strand; PAM type: YTN; PAM sequence: TTT
taaatcttctatccatcttt

SEQ ID NO: 46603 - DNA, 20 bp, Artificial Sequence
  Description of Artificial Sequence: Synthetic oligonucleotide
  Target: SCN10A; (-) strand; PAM type: YTN; PAM sequence: TTT
ttaaatcttctatccatctt

SEQ ID NO: 46604 - DNA, 20 bp, Artificial Sequence
  Description of Artificial Sequence: Synthetic oligonucleotide
  Target: SCN10A; (-) strand; PAM type: YTN; PAM sequence: CTT
tttaaatcttctatccatct

SEQ ID NO: 46605 - DNA, 20 bp, Artificial Sequence
  Description of Artificial Sequence: Synthetic oligonucleotide
  Target: SCN10A; (-) strand; PAM type: YTN; PAM sequence: CTG
gatgctttttaaatcttcta

SEQ ID NO: 46606 - DNA, 20 bp, Artificial Sequence
  Description of Artificial Sequence: Synthetic oligonucleotide
  Target: SCN10A; (-) strand; PAM type: YTN; PAM sequence: TTC
tggatgctttttaaatcttc

SEQ ID NO: 46607 - DNA, 20 bp, Artificial Sequence
  Description of Artificial Sequence: Synthetic oligonucleotide
  Target: SCN10A; (-) strand; PAM type: YTN; PAM sequence: TTT
ctggatgctttttaaatctt

SEQ ID NO: 46608 - DNA, 20 bp, Artificial Sequence
  Description of Artificial Sequence: Synthetic oligonucleotide
  Target: SCN10A; (-) strand; PAM type: YTN; PAM sequence: CTT
tctggatgctttttaaatct

SEQ ID NO: 46609 - DNA, 20 bp, Artificial Sequence
  Description of Artificial Sequence: Synthetic oligonucleotide
  Target: SCN10A; (-) strand; PAM type: YTN; PAM sequence: TTC
ctttctggatgctttttaaa

SEQ ID NO: 46610 - DNA, 20 bp, Artificial Sequence
  Description of Artificial Sequence: Synthetic oligonucleotide
  Target: SCN10A; (-) strand; PAM type: YTN; PAM sequence: CTT
cctttctggatgctttttaa

SEQ ID NO: 46611 - DNA, 20 bp, Artificial Sequence
  Description of Artificial Sequence: Synthetic oligonucleotide
  Target: SCN10A; (-) strand; PAM type: YTN; PAM sequence: TTC
cttcctttctggatgctttt

SEQ ID NO: 46612 - DNA, 20 bp, Artificial Sequence
  Description of Artificial Sequence: Synthetic oligonucleotide
  Target: SCN10A; (-) strand; PAM type: YTN; PAM sequence: TTA
ttccttcctttctggatgct

SEQ ID NO: 46613 - DNA, 20 bp, Artificial Sequence
  Description of Artificial Sequence: Synthetic oligonucleotide
  Target: SCN10A; (-) strand; PAM type: YTN; PAM sequence: CTG
ttattccttcctttctggat

SEQ ID NO: 46614 - DNA, 20 bp, Artificial Sequence
  Description of Artificial Sequence: Synthetic oligonucleotide
  Target: SCN10A; (-) strand; PAM type: YTN; PAM sequence: TTA
actgttattccttcctttct

SEQ ID NO: 46615 - DNA, 20 bp, Artificial Sequence
  Description of Artificial Sequence: Synthetic oligonucleotide
  Target: SCN10A; (-) strand; PAM type: YTN; PAM sequence: TTT
aactgttattccttcctttc

SEQ ID NO: 46616 - DNA, 20 bp, Artificial Sequence
  Description of Artificial Sequence: Synthetic oligonucleotide
  Target: SCN10A; (-) strand; PAM type: YTN; PAM sequence: TTC
aatttaactgttattccttc

SEQ ID NO: 46617 - DNA, 20 bp, Artificial Sequence
  Description of Artificial Sequence: Synthetic oligonucleotide
  Target: SCN10A; (-) strand; PAM type: YTN; PAM sequence: TTT
caatttaactgttattcctt

SEQ ID NO: 46618 - DNA, 20 bp, Artificial Sequence
  Description of Artificial Sequence: Synthetic oligonucleotide
  Target: SCN10A; (-) strand; PAM type: YTN; PAM sequence: CTT
tcaatttaactgttattcct

SEQ ID NO: 46619 - DNA, 20 bp, Artificial Sequence
  Description of Artificial Sequence: Synthetic oligonucleotide
  Target: SCN10A; (-) strand; PAM type: YTN; PAM sequence: CTA
atgagcagtcagctttcaat

SEQ ID NO: 46620 - DNA, 20 bp, Artificial Sequence
  Description of Artificial Sequence: Synthetic oligonucleotide
  Target: SCN10A; (-) strand; PAM type: YTN; PAM sequence: TTG
ctaatgagcagtcagctttc

SEQ ID NO: 46621 - DNA, 20 bp, Artificial Sequence
  Description of Artificial Sequence: Synthetic oligonucleotide
  Target: SCN10A; (-) strand; PAM type: YTN; PAM sequence: TTG
ttgctaatgagcagtcagct

SEQ ID NO: 46622 - DNA, 20 bp, Artificial Sequence
  Description of Artificial Sequence: Synthetic oligonucleotide
  Target: SCN10A; (-) strand; PAM type: YTN; PAM sequence: CTC
cattgttgctaatgagcagt

SEQ ID NO: 46623 - DNA, 20 bp, Artificial Sequence
  Description of Artificial Sequence: Synthetic oligonucleotide
  Target: SCN10A; (-) strand; PAM type: YTN; PAM sequence: TTA
gcctccattgttgctaatga

SEQ ID NO: 46624 - DNA, 20 bp, Artificial Sequence
  Description of Artificial Sequence: Synthetic oligonucleotide
  Target: SCN10A; (-) strand; PAM type: YTN; PAM sequence: TTC
caacaattagcctccattgt

SEQ ID NO: 46625 - DNA, 20 bp, Artificial Sequence
  Description of Artificial Sequence: Synthetic oligonucleotide
  Target: SCN10A; (-) strand; PAM type: YTN; PAM sequence: TTC
agtgaagatagtattccaac

SEQ ID NO: 46626 - DNA, 20 bp, Artificial Sequence
  Description of Artificial Sequence: Synthetic oligonucleotide
  Target: SCN10A; (-) strand; PAM type: YTN; PAM sequence: CTT
cagtgaagatagtattccaa

SEQ ID NO: 46627 - DNA, 20 bp, Artificial Sequence
  Description of Artificial Sequence: Synthetic oligonucleotide
  Target: SCN10A; (-) strand; PAM type: YTN; PAM sequence: TTC
cttcagtgaagatagtattc

SEQ ID NO: 46628 - DNA, 20 bp, Artificial Sequence
  Description of Artificial Sequence: Synthetic oligonucleotide
  Target: SCN10A; (-) strand; PAM type: YTN; PAM sequence: CTT
ccttcagtgaagatagtatt

SEQ ID NO: 46629 - DNA, 20 bp, Artificial Sequence
  Description of Artificial Sequence: Synthetic oligonucleotide
  Target: SCN10A; (-) strand; PAM type: YTN; PAM sequence: TTA
tcttccttcagtgaagatag

SEQ ID NO: 46630 - DNA, 20 bp, Artificial Sequence
  Description of Artificial Sequence: Synthetic oligonucleotide
  Target: SCN10A; (-) strand; PAM type: YTN; PAM sequence: TTT
atcttccttcagtgaagata

SEQ ID NO: 46631 - DNA, 20 bp, Artificial Sequence
  Description of Artificial Sequence: Synthetic oligonucleotide
  Target: SCN10A; (-) strand; PAM type: YTN; PAM sequence: CTT
tatcttccttcagtgaagat

SEQ ID NO: 46632 - DNA, 20 bp, Artificial Sequence
  Description of Artificial Sequence: Synthetic oligonucleotide
  Target: SCN10A; (-) strand; PAM type: YTN; PAM sequence: TTG
atactttatcttccttcagt

SEQ ID NO: 46633 - DNA, 20 bp, Artificial Sequence
  Description of Artificial Sequence: Synthetic oligonucleotide
  Target: SCN10A; (-) strand; PAM type: YTN; PAM sequence: CTA
gttgatactttatcttcctt

SEQ ID NO: 46634 - DNA, 20 bp, Artificial Sequence
  Description of Artificial Sequence: Synthetic oligonucleotide
  Target: SCN10A; (-) strand; PAM type: YTN; PAM sequence: TTC
tagttgatactttatcttcc

SEQ ID NO: 46635 - DNA, 20 bp, Artificial Sequence
  Description of Artificial Sequence: Synthetic oligonucleotide
  Target: SCN10A; (-) strand; PAM type: YTN; PAM sequence: TTA
tgaatgtaaaattctagttg

SEQ ID NO: 46636 - DNA, 20 bp, Artificial Sequence
  Description of Artificial Sequence: Synthetic oligonucleotide
  Target: SCN10A; (-) strand; PAM type: YTN; PAM sequence: CTT
atgaatgtaaaattctagtt

SEQ ID NO: 46637 - DNA, 20 bp, Artificial Sequence
  Description of Artificial Sequence: Synthetic oligonucleotide
  Target: SCN10A; (-) strand; PAM type: YTN; PAM sequence: TTC
ttatgaatgtaaaattctag

SEQ ID NO: 46638 - DNA, 20 bp, Artificial Sequence
  Description of Artificial Sequence: Synthetic oligonucleotide
  Target: SCN10A; (-) strand; PAM type: YTN; PAM sequence: TTT
cttatgaatgtaaaattcta

SEQ ID NO: 46639 - DNA, 20 bp, Artificial Sequence
  Description of Artificial Sequence: Synthetic oligonucleotide
  Target: SCN10A; (-) strand; PAM type: YTN; PAM sequence: TTG
agagacatttcttatgaatg

SEQ ID NO: 46640 - DNA, 20 bp, Artificial Sequence
  Description of Artificial Sequence: Synthetic oligonucleotide
  Target: SCN10A; (-) strand; PAM type: YTN; PAM sequence: TTT
gagagacatttcttatgaat

SEQ ID NO: 46641 - DNA, 20 bp, Artificial Sequence
  Description of Artificial Sequence: Synthetic oligonucleotide
  Target: SCN10A; (-) strand; PAM type: YTN; PAM sequence: CTT
tgagagacatttcttatgaa

SEQ ID NO: 46642 - DNA, 20 bp, Artificial Sequence
  Description of Artificial Sequence: Synthetic oligonucleotide
  Target: SCN10A; (-) strand; PAM type: YTN; PAM sequence: TTG
cccgtgtctttgagagacat

SEQ ID NO: 46643 - DNA, 20 bp, Artificial Sequence
  Description of Artificial Sequence: Synthetic oligonucleotide
  Target: SCN10A; (-) strand; PAM type: YTN; PAM sequence: TTT
gcccgtgtctttgagagaca

SEQ ID NO: 46644 - DNA, 20 bp, Artificial Sequence
  Description of Artificial Sequence: Synthetic oligonucleotide
  Target: SCN10A; (-) strand; PAM type: YTN; PAM sequence: TTC
agtttgcccgtgtctttgag

SEQ ID NO: 46645 - DNA, 20 bp, Artificial Sequence
  Description of Artificial Sequence: Synthetic oligonucleotide
  Target: SCN10A; (-) strand; PAM type: YTN; PAM sequence: CTT
cagtttgcccgtgtctttga

SEQ ID NO: 46646 - DNA, 20 bp, Artificial Sequence
  Description of Artificial Sequence: Synthetic oligonucleotide
  Target: SCN10A; (-) strand; PAM type: YTN; PAM sequence: CTC
ttcagtttgcccgtgtcttt

SEQ ID NO: 46647 - DNA, 20 bp, Artificial Sequence
  Description of Artificial Sequence: Synthetic oligonucleotide
  Target: SCN10A; (-) strand; PAM type: YTN; PAM sequence: TTG
ctcttcagtttgcccgtgtc

SEQ ID NO: 46648 - DNA, 20 bp, Artificial Sequence
  Description of Artificial Sequence: Synthetic oligonucleotide
  Target: SCN10A; (-) strand; PAM type: YTN; PAM sequence: TTT
gctcttcagtttgcccgtgt

SEQ ID NO: 46649 - DNA, 20 bp, Artificial Sequence
  Description of Artificial Sequence: Synthetic oligonucleotide
  Target: SCN10A; (-) strand; PAM type: YTN; PAM sequence: CTG
aaatttgctcttcagtttgc

SEQ ID NO: 46650 - DNA, 20 bp, Artificial Sequence
  Description of Artificial Sequence: Synthetic oligonucleotide
  Target: SCN10A; (-) strand; PAM type: YTN; PAM sequence: TTA
tctgaaatttgctcttcagt

SEQ ID NO: 46651 - DNA, 20 bp, Artificial Sequence
  Description of Artificial Sequence: Synthetic oligonucleotide
  Target: SCN10A; (-) strand; PAM type: YTN; PAM sequence: TTT
atctgaaatttgctcttcag

SEQ ID NO: 46652 - DNA, 20 bp, Artificial Sequence
  Description of Artificial Sequence: Synthetic oligonucleotide
  Target: SCN10A; (-) strand; PAM type: YTN; PAM sequence: TTG
tttatctgaaatttgctctt

SEQ ID NO: 46653 - DNA, 20 bp, Artificial Sequence
  Description of Artificial Sequence: Synthetic oligonucleotide
  Target: SCN10A; (-) strand; PAM type: YTN; PAM sequence: TTT
gtttatctgaaatttgctct

SEQ ID NO: 46654 - DNA, 20 bp, Artificial Sequence
  Description of Artificial Sequence: Synthetic oligonucleotide
  Target: SCN10A; (-) strand; PAM type: YTN; PAM sequence: CTT
tgtttatctgaaatttgctc

SEQ ID NO: 46655 - DNA, 20 bp, Artificial Sequence
  Description of Artificial Sequence: Synthetic oligonucleotide
  Target: SCN10A; (-) strand; PAM type: YTN; PAM sequence: CTC
tttgtttatctgaaatttgc

SEQ ID NO: 46656 - DNA, 20 bp, Artificial Sequence
  Description of Artificial Sequence: Synthetic oligonucleotide
  Target: SCN10A; (-) strand; PAM type: YTN; PAM sequence: CTG
gccataacctctttgtttat

SEQ ID NO: 46657 - DNA, 20 bp, Artificial Sequence
  Description of Artificial Sequence: Synthetic oligonucleotide
  Target: SCN10A; (-) strand; PAM type: YTN; PAM sequence: TTC
tggccataacctctttgttt

SEQ ID NO: 46658 - DNA, 20 bp, Artificial Sequence
  Description of Artificial Sequence: Synthetic oligonucleotide
  Target: SCN10A; (-) strand; PAM type: YTN; PAM sequence: CTT
ctggccataacctctttgtt

SEQ ID NO: 46659 - DNA, 20 bp, Artificial Sequence
  Description of Artificial Sequence: Synthetic oligonucleotide
  Target: SCN10A; (-) strand; PAM type: YTN; PAM sequence: TTA
gtaagtgccttctggccata

SEQ ID NO: 46660 - DNA, 20 bp, Artificial Sequence
  Description of Artificial Sequence: Synthetic oligonucleotide
  Target: SCN10A; (-) strand; PAM type: YTN; PAM sequence: TTT
agtaagtgccttctggccat

SEQ ID NO: 46661 - DNA, 20 bp, Artificial Sequence
  Description of Artificial Sequence: Synthetic oligonucleotide
  Target: SCN10A; (-) strand; PAM type: YTN; PAM sequence: TTT
tagtaagtgccttctggcca

SEQ ID NO: 46662 - DNA, 20 bp, Artificial Sequence
  Description of Artificial Sequence: Synthetic oligonucleotide
  Target: SCN10A; (-) strand; PAM type: YTN; PAM sequence: CTT
ttagtaagtgccttctggcc

SEQ ID NO: 46663 - DNA, 20 bp, Artificial Sequence
  Description of Artificial Sequence: Synthetic oligonucleotide
  Target: SCN10A; (-) strand; PAM type: YTN; PAM sequence: TTC
ttttagtaagtgccttctgg

SEQ ID NO: 46664 - DNA, 20 bp, Artificial Sequence
  Description of Artificial Sequence: Synthetic oligonucleotide
  Target: SCN10A; (-) strand; PAM type: YTN; PAM sequence: TTT
cttttagtaagtgccttctg

SEQ ID NO: 46665 - DNA, 20 bp, Artificial Sequence
  Description of Artificial Sequence: Synthetic oligonucleotide
  Target: SCN10A; (-) strand; PAM type: YTN; PAM sequence: TTA
gaatttcttttagtaagtgc

SEQ ID NO: 46666 - DNA, 20 bp, Artificial Sequence
  Description of Artificial Sequence: Synthetic oligonucleotide
  Target: SCN10A; (-) strand; PAM type: YTN; PAM sequence: TTT
agaatttcttttagtaagtg

SEQ ID NO: 46667 - DNA, 20 bp, Artificial Sequence
  Description of Artificial Sequence: Synthetic oligonucleotide
  Target: SCN10A; (-) strand; PAM type: YTN; PAM sequence: CTT
tagaatttcttttagtaagt

SEQ ID NO: 46668 - DNA, 20 bp, Artificial Sequence
  Description of Artificial Sequence: Synthetic oligonucleotide
  Target: SCN10A; (-) strand; PAM type: YTN; PAM sequence: CTC
ctttagaatttcttttagta

SEQ ID NO: 46669 - DNA, 20 bp, Artificial Sequence
  Description of Artificial Sequence: Synthetic oligonucleotide
  Target: SCN10A; (-) strand; PAM type: YTN; PAM sequence: CTG
aagtacctcctttagaattt

SEQ ID NO: 46670 - DNA, 20 bp, Artificial Sequence
  Description of Artificial Sequence: Synthetic oligonucleotide
  Target: SCN10A; (-) strand; PAM type: YTN; PAM sequence: CTA
cctgaagtacctcctttaga

SEQ ID NO: 46671 - DNA, 20 bp, Artificial Sequence
  Description of Artificial Sequence: Synthetic oligonucleotide
  Target: SCN10A; (-) strand; PAM type: YTN; PAM sequence: CTA
tctacctgaagtacctcctt

SEQ ID NO: 46672 - DNA, 20 bp, Artificial Sequence
  Description of Artificial Sequence: Synthetic oligonucleotide
  Target: SCN10A; (-) strand; PAM type: YTN; PAM sequence: TTC
tatctacctgaagtacctcc

SEQ ID NO: 46673 - DNA, 20 bp, Artificial Sequence
  Description of Artificial Sequence: Synthetic oligonucleotide
  Target: SCN10A; (-) strand; PAM type: YTN; PAM sequence: TTT
ctatctacctgaagtacctc

SEQ ID NO: 46674 - DNA, 20 bp, Artificial Sequence
  Description of Artificial Sequence: Synthetic oligonucleotide
  Target: SCN10A; (-) strand; PAM type: YTN; PAM sequence: CTT
tctatctacctgaagtacct

SEQ ID NO: 46675 - DNA, 20 bp, Artificial Sequence
  Description of Artificial Sequence: Synthetic oligonucleotide
  Target: SCN10A; (-) strand; PAM type: YTN; PAM sequence: CTG
ggatcactttctatctacct

SEQ ID NO: 46676 - DNA, 20 bp, Artificial Sequence
  Description of Artificial Sequence: Synthetic oligonucleotide
  Target: SCN10A; (-) strand; PAM type: YTN; PAM sequence: TTC
tgggatcactttctatctac

SEQ ID NO: 46677 - DNA, 20 bp, Artificial Sequence
  Description of Artificial Sequence: Synthetic oligonucleotide
  Target: SCN10A; (-) strand; PAM type: YTN; PAM sequence: CTT
ctgggatcactttctatcta

SEQ ID NO: 46678 - DNA, 20 bp, Artificial Sequence
  Description of Artificial Sequence: Synthetic oligonucleotide
  Target: SCN10A; (-) strand; PAM type: YTN; PAM sequence: TTA
cttctgggatcactttctat

SEQ ID NO: 46679 - DNA, 20 bp, Artificial Sequence
  Description of Artificial Sequence: Synthetic oligonucleotide
  Target: SCN10A; (-) strand; PAM type: YTN; PAM sequence: TTA
catattacttctgggatcac

SEQ ID NO: 46680 - DNA, 20 bp, Artificial Sequence
  Description of Artificial Sequence: Synthetic oligonucleotide
  Target: SCN10A; (-) strand; PAM type: YTN; PAM sequence: TTA
cacattacatattacttctg

SEQ ID NO: 46681 - DNA, 20 bp, Artificial Sequence
  Description of Artificial Sequence: Synthetic oligonucleotide
  Target: SCN10A; (-) strand; PAM type: YTN; PAM sequence: TTG
tatattacacattacatatt

SEQ ID NO: 46682 - DNA, 20 bp, Artificial Sequence
  Description of Artificial Sequence: Synthetic oligonucleotide
  Target: SCN10A; (-) strand; PAM type: YTN; PAM sequence: CTT
gtatattacacattacatat

SEQ ID NO: 46683 - DNA, 20 bp, Artificial Sequence
  Description of Artificial Sequence: Synthetic oligonucleotide
  Target: SCN10A; (-) strand; PAM type: YTN; PAM sequence: TTC
ttgtatattacacattacat

SEQ ID NO: 46684 - DNA, 20 bp, Artificial Sequence
  Description of Artificial Sequence: Synthetic oligonucleotide
  Target: SCN10A; (-) strand; PAM type: YTN; PAM sequence: TTC
acattcttgtatattacaca

SEQ ID NO: 46685 - DNA, 20 bp, Artificial Sequence
  Description of Artificial Sequence: Synthetic oligonucleotide
  Target: SCN10A; (-) strand; PAM type: YTN; PAM sequence: TTT
cacattcttgtatattacac

SEQ ID NO: 46686 - DNA, 20 bp, Artificial Sequence
  Description of Artificial Sequence: Synthetic oligonucleotide
  Target: SCN10A; (-) strand; PAM type: YTN; PAM sequence: TTG
gagcacagtttcacattctt

SEQ ID NO: 46687 - DNA, 20 bp, Artificial Sequence
  Description of Artificial Sequence: Synthetic oligonucleotide
  Target: SCN10A; (-) strand; PAM type: YTN; PAM sequence: TTT
ggagcacagtttcacattct

SEQ ID NO: 46688 - DNA, 20 bp, Artificial Sequence
  Description of Artificial Sequence: Synthetic oligonucleotide
  Target: SCN10A; (-) strand; PAM type: YTN; PAM sequence: CTT
tggagcacagtttcacattc

SEQ ID NO: 46689 - DNA, 20 bp, Artificial Sequence
  Description of Artificial Sequence: Synthetic oligonucleotide
  Target: SCN10A; (-) strand; PAM type: YTN; PAM sequence: TTC
aaccctttggagcacagttt

SEQ ID NO: 46690 - DNA, 20 bp, Artificial Sequence
  Description of Artificial Sequence: Synthetic oligonucleotide
  Target: SCN10A; (-) strand; PAM type: YTN; PAM sequence: CTT
caaccctttggagcacagtt

SEQ ID NO: 46691 - DNA, 20 bp, Artificial Sequence
  Description of Artificial Sequence: Synthetic oligonucleotide
  Target: SCN10A; (-) strand; PAM type: YTN; PAM sequence: TTC
ttcaaccctttggagcacag

SEQ ID NO: 46692 - DNA, 20 bp, Artificial Sequence
  Description of Artificial Sequence: Synthetic oligonucleotide
  Target: SCN10A; (-) strand; PAM type: YTN; PAM sequence: TTT
cttcaaccctttggagcaca

SEQ ID NO: 46693 - DNA, 20 bp, Artificial Sequence
  Description of Artificial Sequence: Synthetic oligonucleotide
  Target: SCN10A; (-) strand; PAM type: YTN; PAM sequence: TTG
atttcttcaaccctttggag

SEQ ID NO: 46694 - DNA, 20 bp, Artificial Sequence
  Description of Artificial Sequence: Synthetic oligonucleotide
  Target: SCN10A; (-) strand; PAM type: YTN; PAM sequence: TTA
ttgatttcttcaaccctttg

SEQ ID NO: 46695 - DNA, 20 bp, Artificial Sequence
  Description of Artificial Sequence: Synthetic oligonucleotide
  Target: SCN10A; (-) strand; PAM type: YTN; PAM sequence: TTA
gttattgatttcttcaaccc

SEQ ID NO: 46696 - DNA, 20 bp, Artificial Sequence
  Description of Artificial Sequence: Synthetic oligonucleotide
  Target: SCN10A; (-) strand; PAM type: YTN; PAM sequence: TTT
agttattgatttcttcaacc

SEQ ID NO: 46697 - DNA, 20 bp, Artificial Sequence
  Description of Artificial Sequence: Synthetic oligonucleotide
  Target: SCN10A; (-) strand; PAM type: YTN; PAM sequence: CTA
aaaatttagttattgatttc

SEQ ID NO: 46698 - DNA, 20 bp, Artificial Sequence
  Description of Artificial Sequence: Synthetic oligonucleotide
  Target: SCN10A; (-) strand; PAM type: YTN; PAM sequence: CTG
taagcctaaaaatttagtta

SEQ ID NO: 46699 - DNA, 20 bp, Artificial Sequence
  Description of Artificial Sequence: Synthetic oligonucleotide
  Target: SCN10A; (-) strand; PAM type: YTN; PAM sequence: CTG
gtatcctgtaagcctaaaaa

SEQ ID NO: 46700 - DNA, 20 bp, Artificial Sequence
  Description of Artificial Sequence: Synthetic oligonucleotide
  Target: SCN10A; (-) strand; PAM type: YTN; PAM sequence: TTA
tctggtatcctgtaagccta

SEQ ID NO: 46701 - DNA, 20 bp, Artificial Sequence
  Description of Artificial Sequence: Synthetic oligonucleotide
  Target: SCN10A; (-) strand; PAM type: YTN; PAM sequence: CTT
atctggtatcctgtaagcct

SEQ ID NO: 46702 - DNA, 20 bp, Artificial Sequence
  Description of Artificial Sequence: Synthetic oligonucleotide
  Target: SCN10A; (-) strand; PAM type: YTN; PAM sequence: TTC
ttatctggtatcctgtaagc

SEQ ID NO: 46703 - DNA, 20 bp, Artificial Sequence
  Description of Artificial Sequence: Synthetic oligonucleotide
  Target: SCN10A; (-) strand; PAM type: YTN; PAM sequence: TTT
cttatctggtatcctgtaag

SEQ ID NO: 46704 - DNA, 20 bp, Artificial Sequence
  Description of Artificial Sequence: Synthetic oligonucleotide
  Target: SCN10A; (-) strand; PAM type: YTN; PAM sequence: TTA
tttcttatctggtatcctgt

SEQ ID NO: 46705 - DNA, 20 bp, Artificial Sequence
  Description of Artificial Sequence: Synthetic oligonucleotide
  Target: SCN10A; (-) strand; PAM type: YTN; PAM sequence: TTC
agtgagttatttcttatctg

SEQ ID NO: 46706 - DNA, 20 bp, Artificial Sequence
  Description of Artificial Sequence: Synthetic oligonucleotide
  Target: SCN10A; (-) strand; PAM type: YTN; PAM sequence: TTT
cagtgagttatttcttatct

SEQ ID NO: 46707 - DNA, 20 bp, Artificial Sequence
  Description of Artificial Sequence: Synthetic oligonucleotide
  Target: SCN10A; (-) strand; PAM type: YTN; PAM sequence: TTT
tcagtgagttatttcttatc

SEQ ID NO: 46708 - DNA, 20 bp, Artificial Sequence
  Description of Artificial Sequence: Synthetic oligonucleotide
  Target: SCN10A; (-) strand; PAM type: YTN; PAM sequence: TTC
agattttcagtgagttattt

SEQ ID NO: 46709 - DNA, 20 bp, Artificial Sequence
  Description of Artificial Sequence: Synthetic oligonucleotide
  Target: SCN10A; (-) strand; PAM type: YTN; PAM sequence: TTT
cagattttcagtgagttatt

SEQ ID NO: 46710 - DNA, 20 bp, Artificial Sequence
  Description of Artificial Sequence: Synthetic oligonucleotide
  Target: SCN10A; (-) strand; PAM type: YTN; PAM sequence: TTG
agtttcagattttcagtgag

SEQ ID NO: 46711 - DNA, 20 bp, Artificial Sequence
  Description of Artificial Sequence: Synthetic oligonucleotide
  Target: SCN10A; (-) strand; PAM type: YTN; PAM sequence: TTT
gagtttcagattttcagtga

SEQ ID NO: 46712 - DNA, 20 bp, Artificial Sequence
  Description of Artificial Sequence: Synthetic oligonucleotide
  Target: SCN10A; (-) strand; PAM type: YTN; PAM sequence: TTG
gaacacagtttgagtttcag

SEQ ID NO: 46713 - DNA, 20 bp, Artificial Sequence
  Description of Artificial Sequence: Synthetic oligonucleotide
  Target: SCN10A; (-) strand; PAM type: YTN; PAM sequence: TTT
ggaacacagtttgagtttca

SEQ ID NO: 46714 - DNA, 20 bp, Artificial Sequence
  Description of Artificial Sequence: Synthetic oligonucleotide
  Target: SCN10A; (-) strand; PAM type: YTN; PAM sequence: CTT
tggaacacagtttgagtttc

SEQ ID NO: 46715 - DNA, 20 bp, Artificial Sequence
  Description of Artificial Sequence: Synthetic oligonucleotide
  Target: SCN10A; (-) strand; PAM type: YTN; PAM sequence: CTC
tttggaacacagtttgagtt

SEQ ID NO: 46716 - DNA, 20 bp, Artificial Sequence
  Description of Artificial Sequence: Synthetic oligonucleotide
  Target: SCN10A; (-) strand; PAM type: YTN; PAM sequence: TTA
ctctttggaacacagtttga

SEQ ID NO: 46717 - DNA, 20 bp, Artificial Sequence
  Description of Artificial Sequence: Synthetic oligonucleotide
  Target: SCN10A; (-) strand; PAM type: YTN; PAM sequence: CTT
actctttggaacacagtttg

SEQ ID NO: 46718 - DNA, 20 bp, Artificial Sequence
  Description of Artificial Sequence: Synthetic oligonucleotide
  Target: SCN10A; (-) strand; PAM type: YTN; PAM sequence: TTC
ttactctttggaacacagtt

SEQ ID NO: 46719 - DNA, 20 bp, Artificial Sequence
  Description of Artificial Sequence: Synthetic oligonucleotide
  Target: SCN10A; (-) strand; PAM type: YTN; PAM sequence: TTT
cttactctttggaacacagt

SEQ ID NO: 46720 - DNA, 20 bp, Artificial Sequence
  Description of Artificial Sequence: Synthetic oligonucleotide
  Target: SCN10A; (-) strand; PAM type: YTN; PAM sequence: CTG
atttcttactctttggaaca

SEQ ID NO: 46721 - DNA, 20 bp, Artificial Sequence
  Description of Artificial Sequence: Synthetic oligonucleotide
  Target: SCN10A; (-) strand; PAM type: YTN; PAM sequence: TTA
ctgatttcttactctttgga

SEQ ID NO: 46722 - DNA, 20 bp, Artificial Sequence
  Description of Artificial Sequence: Synthetic oligonucleotide
  Target: SCN10A; (-) strand; PAM type: YTN; PAM sequence: TTG
taagttactgatttcttact

SEQ ID NO: 46723 - DNA, 20 bp, Artificial Sequence
  Description of Artificial Sequence: Synthetic oligonucleotide
  Target: SCN10A; (-) strand; PAM type: YTN; PAM sequence: TTT
gtaagttactgatttcttac

SEQ ID NO: 46724 - DNA, 20 bp, Artificial Sequence
  Description of Artificial Sequence: Synthetic oligonucleotide
  Target: SCN10A; (-) strand; PAM type: YTN; PAM sequence: TTT
tgtaagttactgatttctta

SEQ ID NO: 46725 - DNA, 20 bp, Artificial Sequence
  Description of Artificial Sequence: Synthetic oligonucleotide
  Target: SCN10A; (-) strand; PAM type: YTN; PAM sequence: TTT
ttgtaagttactgatttctt

SEQ ID NO: 46726 - DNA, 20 bp, Artificial Sequence
  Description of Artificial Sequence: Synthetic oligonucleotide
  Target: SCN10A; (-) strand; PAM type: YTN; PAM sequence: CTC
aagaatttttgtaagttact

SEQ ID NO: 46727 - DNA, 20 bp, Artificial Sequence
  Description of Artificial Sequence: Synthetic oligonucleotide
  Target: SCN10A; (-) strand; PAM type: YTN; PAM sequence: CTA
aaaactcaagaatttttgta

SEQ ID NO: 46728 - DNA, 20 bp, Artificial Sequence
  Description of Artificial Sequence: Synthetic oligonucleotide
  Target: SCN10A; (-) strand; PAM type: YTN; PAM sequence: CTA
tcctaaaaactcaagaattt

SEQ ID NO: 46729 - DNA, 20 bp, Artificial Sequence
  Description of Artificial Sequence: Synthetic oligonucleotide
  Target: SCN10A; (-) strand; PAM type: YTN; PAM sequence: CTG
ctatcctaaaaactcaagaa

SEQ ID NO: 46730 - DNA, 20 bp, Artificial Sequence
  Description of Artificial Sequence: Synthetic oligonucleotide
  Target: SCN10A; (-) strand; PAM type: YTN; PAM sequence: CTA
tctgctatcctaaaaactca

SEQ ID NO: 46731 - DNA, 20 bp, Artificial Sequence
  Description of Artificial Sequence: Synthetic oligonucleotide
  Target: SCN10A; (-) strand; PAM type: YTN; PAM sequence: TTA
cctatctgctatcctaaaaa

SEQ ID NO: 46732 - DNA, 20 bp, Artificial Sequence
  Description of Artificial Sequence: Synthetic oligonucleotide
  Target: SCN10A; (-) strand; PAM type: YTN; PAM sequence: TTT
acctatctgctatcctaaaa

SEQ ID NO: 46733 - DNA, 20 bp, Artificial Sequence
  Description of Artificial Sequence: Synthetic oligonucleotide
  Target: SCN10A; (-) strand; PAM type: YTN; PAM sequence: CTT
tacctatctgctatcctaaa

SEQ ID NO: 46734 - DNA, 20 bp, Artificial Sequence
  Description of Artificial Sequence: Synthetic oligonucleotide
  Target: SCN10A; (-) strand; PAM type: YTN; PAM sequence: TTC
tttacctatctgctatccta

SEQ ID NO: 46735 - DNA, 20 bp, Artificial Sequence
  Description of Artificial Sequence: Synthetic oligonucleotide
  Target: SCN10A; (-) strand; PAM type: YTN; PAM sequence: TTT
ctttacctatctgctatcct

SEQ ID NO: 46736 - DNA, 20 bp, Artificial Sequence
  Description of Artificial Sequence: Synthetic oligonucleotide
  Target: SCN10A; (-) strand; PAM type: YTN; PAM sequence: TTG
tttctttacctatctgctat

SEQ ID NO: 46737 - DNA, 20 bp, Artificial Sequence
  Description of Artificial Sequence: Synthetic oligonucleotide
  Target: SCN10A; (-) strand; PAM type: YTN; PAM sequence: CTC
agcaagttgtttctttacct

SEQ ID NO: 46738 - DNA, 20 bp, Artificial Sequence
  Description of Artificial Sequence: Synthetic oligonucleotide
  Target: SCN10A; (-) strand; PAM type: YTN; PAM sequence: TTC
agtgtctcagcaagttgttt

SEQ ID NO: 46739 - DNA, 20 bp, Artificial Sequence
  Description of Artificial Sequence: Synthetic oligonucleotide
  Target: SCN10A; (-) strand; PAM type: YTN; PAM sequence: TTT
cagtgtctcagcaagttgtt

SEQ ID NO: 46740 - DNA, 20 bp, Artificial Sequence
  Description of Artificial Sequence: Synthetic oligonucleotide
  Target: SCN10A; (-) strand; PAM type: YTN; PAM sequence: TTC
atcatcacacaaggggaggg

SEQ ID NO: 46741 - DNA, 20 bp, Artificial Sequence
  Description of Artificial Sequence: Synthetic oligonucleotide
  Target: SCN10A; (-) strand; PAM type: YTN; PAM sequence: TTT
catcatcacacaaggggagg

SEQ ID NO: 46742 - DNA, 20 bp, Artificial Sequence
  Description of Artificial Sequence: Synthetic oligonucleotide
  Target: SCN10A; (-) strand; PAM type: YTN; PAM sequence: TTT
tcatcatcacacaaggggag

SEQ ID NO: 46743 - DNA, 20 bp, Artificial Sequence
  Description of Artificial Sequence: Synthetic oligonucleotide
  Target: SCN10A; (-) strand; PAM type: YTN; PAM sequence: TTT
ttcatcatcacacaagggga

SEQ ID NO: 46744 - DNA, 20 bp, Artificial Sequence
  Description of Artificial Sequence: Synthetic oligonucleotide
  Target: SCN10A; (-) strand; PAM type: YTN; PAM sequence: TTT
tttcatcatcacacaagggg

SEQ ID NO: 46745 - DNA, 20 bp, Artificial Sequence
  Description of Artificial Sequence: Synthetic oligonucleotide
  Target: SCN10A; (-) strand; PAM type: YTN; PAM sequence: CTG
ttttttcatcatcacacaag

SEQ ID NO: 46746 - DNA, 20 bp, Artificial Sequence
  Description of Artificial Sequence: Synthetic oligonucleotide
  Target: SCN10A; (-) strand; PAM type: YTN; PAM sequence: TTC
agcctgttttttcatcatca

SEQ ID NO: 46747 - DNA, 20 bp, Artificial Sequence
  Description of Artificial Sequence: Synthetic oligonucleotide
  Target: SCN10A; (-) strand; PAM type: YTN; PAM sequence: TTT
cagcctgttttttcatcatc

SEQ ID NO: 46748 - DNA, 20 bp, Artificial Sequence
  Description of Artificial Sequence: Synthetic oligonucleotide
  Target: SCN10A; (-) strand; PAM type: YTN; PAM sequence: TTG
atttcagcctgttttttcat

SEQ ID NO: 46749 - DNA, 20 bp, Artificial Sequence
  Description of Artificial Sequence: Synthetic oligonucleotide
  Target: SCN10A; (-) strand; PAM type: YTN; PAM sequence: TTC
caattgatttcagcctgttt

SEQ ID NO: 46750 - DNA, 20 bp, Artificial Sequence
  Description of Artificial Sequence: Synthetic oligonucleotide
  Target: SCN10A; (-) strand; PAM type: YTN; PAM sequence: CTG
gttccaattgatttcagcct

SEQ ID NO: 46751 - DNA, 20 bp, Artificial Sequence
  Description of Artificial Sequence: Synthetic oligonucleotide
  Target: SCN10A; (-) strand; PAM type: YTN; PAM sequence: CTC
cagtcggccatcctggttcc

SEQ ID NO: 46752 - DNA, 20 bp, Artificial Sequence
  Description of Artificial Sequence: Synthetic oligonucleotide
  Target: SCN10A; (-) strand; PAM type: YTN; PAM sequence: CTG
cacaaactccagtcggccat

SEQ ID NO: 46753 - DNA, 20 bp, Artificial Sequence
  Description of Artificial Sequence: Synthetic oligonucleotide
  Target: SCN10A; (-) strand; PAM type: YTN; PAM sequence: TTC
tgcacaaactccagtcggcc

SEQ ID NO: 46754 - DNA, 20 bp, Artificial Sequence
  Description of Artificial Sequence: Synthetic oligonucleotide
  Target: SCN10A; (-) strand; PAM type: YTN; PAM sequence: CTC
attctgcacaaactccagtc

SEQ ID NO: 46755 - DNA, 20 bp, Artificial Sequence
  Description of Artificial Sequence: Synthetic oligonucleotide
  Target: SCN10A; (-) strand; PAM type: YTN; PAM sequence: TTC
agtccatgacgtcagcaagc

SEQ ID NO: 46756 - DNA, 20 bp, Artificial Sequence
  Description of Artificial Sequence: Synthetic oligonucleotide
  Target: SCN10A; (-) strand; PAM type: YTN; PAM sequence: TTA
gtatgcaatatgaagtggaa

SEQ ID NO: 46757 - DNA, 20 bp, Artificial Sequence
  Description of Artificial Sequence: Synthetic oligonucleotide
  Target: SCN10A; (-) strand; PAM type: YTN; PAM sequence: CTG
gggggagttagtatgcaata

SEQ ID NO: 46758 - DNA, 20 bp, Artificial Sequence
  Description of Artificial Sequence: Synthetic oligonucleotide
  Target: SCN10A; (-) strand; PAM type: YTN; PAM sequence: TTG
catatgcaaatctgggggga

SEQ ID NO: 46759 - DNA, 20 bp, Artificial Sequence
  Description of Artificial Sequence: Synthetic oligonucleotide
  Target: SCN10A; (-) strand; PAM type: YTN; PAM sequence: CTC
atgggttgcatatgcaaatc

SEQ ID NO: 46760 - DNA, 20 bp, Artificial Sequence
  Description of Artificial Sequence: Synthetic oligonucleotide
  Target: SCN10A; (-) strand; PAM type: YTN; PAM sequence: TTA
ctcatgggttgcatatgcaa

SEQ ID NO: 46761 - DNA, 20 bp, Artificial Sequence
  Description of Artificial Sequence: Synthetic oligonucleotide
  Target: SCN10A; (-) strand; PAM type: YTN; PAM sequence: CTT
actcatgggttgcatatgca

SEQ ID NO: 46762 - DNA, 20 bp, Artificial Sequence
  Description of Artificial Sequence: Synthetic oligonucleotide
  Target: SCN10A; (-) strand; PAM type: YTN; PAM sequence: TTC
atgcttactcatgggttgca

SEQ ID NO: 46763 - DNA, 20 bp, Artificial Sequence
  Description of Artificial Sequence: Synthetic oligonucleotide
  Target: SCN10A; (-) strand; PAM type: YTN; PAM sequence: CTT
catgcttactcatgggttgc

SEQ ID NO: 46764 - DNA, 20 bp, Artificial Sequence
  Description of Artificial Sequence: Synthetic oligonucleotide
  Target: SCN10A; (-) strand; PAM type: YTN; PAM sequence: CTC
ttcatgcttactcatgggtt

SEQ ID NO: 46765 - DNA, 20 bp, Artificial Sequence
  Description of Artificial Sequence: Synthetic oligonucleotide
  Target: SCN10A; (-) strand; PAM type: YTN; PAM sequence: TTA
tctcttcatgcttactcatg

SEQ ID NO: 46766 - DNA, 20 bp, Artificial Sequence
  Description of Artificial Sequence: Synthetic oligonucleotide
  Target: SCN10A; (-) strand; PAM type: YTN; PAM sequence: CTG
cacagttatctcttcatgct

SEQ ID NO: 46767 - DNA, 20 bp, Artificial Sequence
  Description of Artificial Sequence: Synthetic oligonucleotide
  Target: SCN10A; (-) strand; PAM type: YTN; PAM sequence: TTG
gagagtccatgggcctgcac

SEQ ID NO: 46768 - DNA, 20 bp, Artificial Sequence
  Description of Artificial Sequence: Synthetic oligonucleotide
  Target: SCN10A; (-) strand; PAM type: YTN; PAM sequence: TTT
ggagagtccatgggcctgca

SEQ ID NO: 46769 - DNA, 20 bp, Artificial Sequence
  Description of Artificial Sequence: Synthetic oligonucleotide
  Target: SCN10A; (-) strand; PAM type: YTN; PAM sequence: TTG
gtggaaggaaaggggaggtt

SEQ ID NO: 46770 - DNA, 20 bp, Artificial Sequence
  Description of Artificial Sequence: Synthetic oligonucleotide
  Target: SCN10A; (-) strand; PAM type: YTN; PAM sequence: TTG
caggtgattggtggaaggaa

SEQ ID NO: 46771 - DNA, 20 bp, Artificial Sequence
  Description of Artificial Sequence: Synthetic oligonucleotide
  Target: SCN10A; (-) strand; PAM type: YTN; PAM sequence: TTT
gcaggtgattggtggaagga

SEQ ID NO: 46772 - DNA, 20 bp, Artificial Sequence
  Description of Artificial Sequence: Synthetic oligonucleotide
  Target: SCN10A; (-) strand; PAM type: YTN; PAM sequence: TTA
gtgggtggataccgggattt

SEQ ID NO: 46773 - DNA, 20 bp, Artificial Sequence
  Description of Artificial Sequence: Synthetic oligonucleotide
  Target: SCN10A; (-) strand; PAM type: YTN; PAM sequence: TTT
agtgggtggataccgggatt

SEQ ID NO: 46774 - DNA, 20 bp, Artificial Sequence
  Description of Artificial Sequence: Synthetic oligonucleotide
  Target: SCN10A; (-) strand; PAM type: YTN; PAM sequence: TTA
gaaaatgtttagtgggtgga

SEQ ID NO: 46775 - DNA, 20 bp, Artificial Sequence
  Description of Artificial Sequence: Synthetic oligonucleotide
  Target: SCN10A; (-) strand; PAM type: YTN; PAM sequence: TTA
ttagaaaatgtttagtgggt

SEQ ID NO: 46776 - DNA, 20 bp, Artificial Sequence
  Description of Artificial Sequence: Synthetic oligonucleotide
  Target: SCN10A; (-) strand; PAM type: YTN; PAM sequence: TTT
attagaaaatgtttagtggg

SEQ ID NO: 46777 - DNA, 20 bp, Artificial Sequence
  Description of Artificial Sequence: Synthetic oligonucleotide
  Target: SCN10A; (-) strand; PAM type: YTN; PAM sequence: TTT
tattagaaaatgtttagtgg

SEQ ID NO: 46778 - DNA, 20 bp, Artificial Sequence
  Description of Artificial Sequence: Synthetic oligonucleotide
  Target: SCN10A; (-) strand; PAM type: YTN; PAM sequence: TTT
ttattagaaaatgtttagtg

SEQ ID NO: 46779 - DNA, 20 bp, Artificial Sequence
  Description of Artificial Sequence: Synthetic oligonucleotide
  Target: SCN10A; (-) strand; PAM type: YTN; PAM sequence: TTC
aaggcagtatttttattaga

SEQ ID NO: 46780 - DNA, 20 bp, Artificial Sequence
  Description of Artificial Sequence: Synthetic oligonucleotide
  Target: SCN10A; (-) strand; PAM type: YTN; PAM sequence: CTT
caaggcagtatttttattag

SEQ ID NO: 46781 - DNA, 20 bp, Artificial Sequence
  Description of Artificial Sequence: Synthetic oligonucleotide
  Target: SCN10A; (-) strand; PAM type: YTN; PAM sequence: CTG
tcttcaaggcagtattttta

SEQ ID NO: 46782 - DNA, 20 bp, Artificial Sequence
  Description of Artificial Sequence: Synthetic oligonucleotide
  Target: SCN10A; (-) strand; PAM type: YTN; PAM sequence: CTG
tgctgtcttcaaggcagtat

SEQ ID NO: 46783 - DNA, 20 bp, Artificial Sequence
  Description of Artificial Sequence: Synthetic oligonucleotide
  Target: SCN10A; (-) strand; PAM type: YTN; PAM sequence: CTC
cctgtgctgtcttcaaggca

SEQ ID NO: 46784 - DNA, 20 bp, Artificial Sequence
  Description of Artificial Sequence: Synthetic oligonucleotide
  Target: SCN10A; (-) strand; PAM type: YTN; PAM sequence: CTG
tctccctgtgctgtcttcaa

SEQ ID NO: 46785 - DNA, 20 bp, Artificial Sequence
  Description of Artificial Sequence: Synthetic oligonucleotide
  Target: SCN10A; (-) strand; PAM type: YTN; PAM sequence: CTC
agatctgtctccctgtgctg

SEQ ID NO: 46786 - DNA, 20 bp, Artificial Sequence
  Description of Artificial Sequence: Synthetic oligonucleotide
  Target: SCN10A; (-) strand; PAM type: YTN; PAM sequence: CTG
gcaagaagacaggaggtcaa

SEQ ID NO: 46787 - DNA, 20 bp, Artificial Sequence
  Description of Artificial Sequence: Synthetic oligonucleotide
  Target: SCN10A; (-) strand; PAM type: YTN; PAM sequence: CTG
gctggcaagaagacaggagg

SEQ ID NO: 46788 - DNA, 20 bp, Artificial Sequence
  Description of Artificial Sequence: Synthetic oligonucleotide
  Target: SCN10A; (-) strand; PAM type: YTN; PAM sequence: CTG
caagctggctggcaagaaga

SEQ ID NO: 46789 - DNA, 20 bp, Artificial Sequence
  Description of Artificial Sequence: Synthetic oligonucleotide
  Target: SCN10A; (-) strand; PAM type: YTN; PAM sequence: TTA
atactgcaagctggctggca

SEQ ID NO: 46790 - DNA, 20 bp, Artificial Sequence
  Description of Artificial Sequence: Synthetic oligonucleotide
  Target: SCN10A; (-) strand; PAM type: YTN; PAM sequence: CTT
aatactgcaagctggctggc

SEQ ID NO: 46791 - DNA, 20 bp, Artificial Sequence
  Description of Artificial Sequence: Synthetic oligonucleotide
  Target: SCN10A; (-) strand; PAM type: YTN; PAM sequence: TTG
agaaaagaaaagcttaatac

SEQ ID NO: 46792 - DNA, 20 bp, Artificial Sequence
  Description of Artificial Sequence: Synthetic oligonucleotide
  Target: SCN10A; (-) strand; PAM type: YTN; PAM sequence: TTT
gagaaaagaaaagcttaata

SEQ ID NO: 46793 - DNA, 20 bp, Artificial Sequence
  Description of Artificial Sequence: Synthetic oligonucleotide
  Target: SCN10A; (-) strand; PAM type: YTN; PAM sequence: TTT
tgagaaaagaaaagcttaat

SEQ ID NO: 46794 - DNA, 20 bp, Artificial Sequence
  Description of Artificial Sequence: Synthetic oligonucleotide
  Target: SCN10A; (-) strand; PAM type: YTN; PAM sequence: CTT
ttgagaaaagaaaagcttaa

SEQ ID NO: 46795 - DNA, 20 bp, Artificial Sequence
  Description of Artificial Sequence: Synthetic oligonucleotide
  Target: SCN10A; (-) strand; PAM type: YTN; PAM sequence: TTG
gaagccaagacgaggacacc

SEQ ID NO: 46796 - DNA, 20 bp, Artificial Sequence
  Description of Artificial Sequence: Synthetic oligonucleotide
  Target: SCN10A; (-) strand; PAM type: YTN; PAM sequence: TTT
ggaagccaagacgaggacac

SEQ ID NO: 46797 - DNA, 20 bp, Artificial Sequence
  Description of Artificial Sequence: Synthetic oligonucleotide
  Target: SCN10A; (-) strand; PAM type: YTN; PAM sequence: CTT
tggaagccaagacgaggaca

SEQ ID NO: 46798 - DNA, 20 bp, Artificial Sequence
  Description of Artificial Sequence: Synthetic oligonucleotide
  Target: SCN10A; (-) strand; PAM type: YTN; PAM sequence: CTA
tgactttggaagccaagacg

SEQ ID NO: 46799 - DNA, 20 bp, Artificial Sequence
  Description of Artificial Sequence: Synthetic oligonucleotide
  Target: SCN10A; (-) strand; PAM type: YTN; PAM sequence: CTA
gaagccaatactatgacttt

SEQ ID NO: 46800 - DNA, 20 bp, Artificial Sequence
  Description of Artificial Sequence: Synthetic oligonucleotide
  Target: SCN10A; (-) strand; PAM type: YTN; PAM sequence: CTC
tagaagccaatactatgact

SEQ ID NO: 46801 - DNA, 20 bp, Artificial Sequence
  Description of Artificial Sequence: Synthetic oligonucleotide
  Target: SCN10A; (-) strand; PAM type: YTN; PAM sequence: CTG
cccaatgctctagaagccaa

SEQ ID NO: 46802 - DNA, 20 bp, Artificial Sequence
  Description of Artificial Sequence: Synthetic oligonucleotide
  Target: SCN10A; (-) strand; PAM type: YTN; PAM sequence: CTC
actgcccaatgctctagaag

SEQ ID NO: 46803 - DNA, 20 bp, Artificial Sequence
  Description of Artificial Sequence: Synthetic oligonucleotide
  Target: SCN10A; (-) strand; PAM type: YTN; PAM sequence: TTA
tagagccagtgggggctcac

SEQ ID NO: 46804 - DNA, 20 bp, Artificial Sequence
  Description of Artificial Sequence: Synthetic oligonucleotide
  Target: SCN10A; (-) strand; PAM type: YTN; PAM sequence: TTG
ttatagagccagtgggggct

SEQ ID NO: 46805 - DNA, 20 bp, Artificial Sequence
  Description of Artificial Sequence: Synthetic oligonucleotide
  Target: SCN10A; (-) strand; PAM type: YTN; PAM sequence: TTT
gttatagagccagtgggggc

SEQ ID NO: 46806 - DNA, 20 bp, Artificial Sequence
  Description of Artificial Sequence: Synthetic oligonucleotide
  Target: SCN10A; (-) strand; PAM type: YTN; PAM sequence: CTT
tgttatagagccagtggggg

SEQ ID NO: 46807 - DNA, 20 bp, Artificial Sequence
  Description of Artificial Sequence: Synthetic oligonucleotide
  Target: SCN10A; (-) strand; PAM type: YTN; PAM sequence: TTA
tacctttgttatagagccag

SEQ ID NO: 46808 - DNA, 20 bp, Artificial Sequence
  Description of Artificial Sequence: Synthetic oligonucleotide
  Target: SCN10A; (-) strand; PAM type: YTN; PAM sequence: TTT
atacctttgttatagagcca

SEQ ID NO: 46809 - DNA, 20 bp, Artificial Sequence
  Description of Artificial Sequence: Synthetic oligonucleotide
  Target: SCN10A; (-) strand; PAM type: YTN; PAM sequence: CTT
tatacctttgttatagagcc

SEQ ID NO: 46810 - DNA, 20 bp, Artificial Sequence
  Description of Artificial Sequence: Synthetic oligonucleotide
  Target: SCN10A; (-) strand; PAM type: YTN; PAM sequence: CTC
tttatacctttgttatagag

SEQ ID NO: 46811 - DNA, 20 bp, Artificial Sequence
  Description of Artificial Sequence: Synthetic oligonucleotide
  Target: SCN10A; (-) strand; PAM type: YTN; PAM sequence: TTG
ctctttatacctttgttata

SEQ ID NO: 46812 - DNA, 20 bp, Artificial Sequence
  Description of Artificial Sequence: Synthetic oligonucleotide
  Target: SCN10A; (-) strand; PAM type: YTN; PAM sequence: CTT
gctctttatacctttgttat

SEQ ID NO: 46813 - DNA, 20 bp, Artificial Sequence
  Description of Artificial Sequence: Synthetic oligonucleotide
  Target: SCN10A; (-) strand; PAM type: YTN; PAM sequence: TTC
ttgctctttatacctttgtt

SEQ ID NO: 46814 - DNA, 20 bp, Artificial Sequence
  Description of Artificial Sequence: Synthetic oligonucleotide
  Target: SCN10A; (-) strand; PAM type: YTN; PAM sequence: TTT
cttgctctttatacctttgt

SEQ ID NO: 46815 - DNA, 20 bp, Artificial Sequence
  Description of Artificial Sequence: Synthetic oligonucleotide
  Target: SCN10A; (-) strand; PAM type: YTN; PAM sequence: CTT
tcttgctctttatacctttg

SEQ ID NO: 46816 - DNA, 20 bp, Artificial Sequence
  Description of Artificial Sequence: Synthetic oligonucleotide
  Target: SCN10A; (-) strand; PAM type: YTN; PAM sequence: TTA
gcactttcttgctctttata

SEQ ID NO: 46817 - DNA, 20 bp, Artificial Sequence
  Description of Artificial Sequence: Synthetic oligonucleotide
  Target: SCN10A; (-) strand; PAM type: YTN; PAM sequence: CTT
agcactttcttgctctttat

SEQ ID NO: 46818 - DNA, 20 bp, Artificial Sequence
  Description of Artificial Sequence: Synthetic oligonucleotide
  Target: SCN10A; (-) strand; PAM type: YTN; PAM sequence: CTC
atgcttagcactttcttgct

SEQ ID NO: 46819 - DNA, 20 bp, Artificial Sequence
  Description of Artificial Sequence: Synthetic oligonucleotide
  Target: SCN10A; (-) strand; PAM type: YTN; PAM sequence: CTC
tcatgcttagcactttcttg

SEQ ID NO: 46820 - DNA, 20 bp, Artificial Sequence
  Description of Artificial Sequence: Synthetic oligonucleotide
  Target: SCN10A; (-) strand; PAM type: YTN; PAM sequence: TTC
actctcatgcttagcacttt

SEQ ID NO: 46821 - DNA, 20 bp, Artificial Sequence
  Description of Artificial Sequence: Synthetic oligonucleotide
  Target: SCN10A; (-) strand; PAM type: YTN; PAM sequence: TTA
gattcactctcatgcttagc

SEQ ID NO: 46822 - DNA, 20 bp, Artificial Sequence
  Description of Artificial Sequence: Synthetic oligonucleotide
  Target: SCN10A; (-) strand; PAM type: YTN; PAM sequence: TTT
agattcactctcatgcttag

SEQ ID NO: 46823 - DNA, 20 bp, Artificial Sequence
  Description of Artificial Sequence: Synthetic oligonucleotide
  Target: SCN10A; (-) strand; PAM type: YTN; PAM sequence: TTA
tttagattcactctcatgct

SEQ ID NO: 46824 - DNA, 20 bp, Artificial Sequence
  Description of Artificial Sequence: Synthetic oligonucleotide
  Target: SCN10A; (-) strand; PAM type: YTN; PAM sequence: TTT
atttagattcactctcatgc

SEQ ID NO: 46825 - DNA, 20 bp, Artificial Sequence
  Description of Artificial Sequence: Synthetic oligonucleotide
  Target: SCN10A; (-) strand; PAM type: YTN; PAM sequence: CTC
aatgtttatttagattcact

SEQ ID NO: 46826 - DNA, 20 bp, Artificial Sequence
  Description of Artificial Sequence: Synthetic oligonucleotide
  Target: SCN10A; (-) strand; PAM type: YTN; PAM sequence: TTG
tgtccactcaatgtttattt

SEQ ID NO: 46827 - DNA, 20 bp, Artificial Sequence
  Description of Artificial Sequence: Synthetic oligonucleotide
  Target: SCN10A; (-) strand; PAM type: YTN; PAM sequence: TTG
ttgtgtccactcaatgttta

SEQ ID NO: 46828 - DNA, 20 bp, Artificial Sequence
  Description of Artificial Sequence: Synthetic oligonucleotide
  Target: SCN10A; (-) strand; PAM type: YTN; PAM sequence: TTG
ttgttgtgtccactcaatgt

SEQ ID NO: 46829 - DNA, 20 bp, Artificial Sequence
  Description of Artificial Sequence: Synthetic oligonucleotide
  Target: SCN10A; (-) strand; PAM type: YTN; PAM sequence: CTC
acaagacattgttgttgtgt

SEQ ID NO: 46830 - DNA, 20 bp, Artificial Sequence
  Description of Artificial Sequence: Synthetic oligonucleotide
  Target: SCN10A; (-) strand; PAM type: YTN; PAM sequence: TTC
cacatctcacaagacattgt

SEQ ID NO: 46831 - DNA, 20 bp, Artificial Sequence
  Description of Artificial Sequence: Synthetic oligonucleotide
  Target: SCN10A; (-) strand; PAM type: YTN; PAM sequence: CTT
ccacatctcacaagacattg

SEQ ID NO: 46832 - DNA, 20 bp, Artificial Sequence
  Description of Artificial Sequence: Synthetic oligonucleotide
  Target: SCN10A; (-) strand; PAM type: YTN; PAM sequence: CTC
ttccacatctcacaagacat

SEQ ID NO: 46833 - DNA, 20 bp, Artificial Sequence
  Description of Artificial Sequence: Synthetic oligonucleotide
  Target: SCN10A; (-) strand; PAM type: YTN; PAM sequence: CTA
tatgaccagtctcttccaca

SEQ ID NO: 46834 - DNA, 20 bp, Artificial Sequence
  Description of Artificial Sequence: Synthetic oligonucleotide
  Target: SCN10A; (-) strand; PAM type: YTN; PAM sequence: CTG
ggaggagaaaagtgaatgga

SEQ ID NO: 46835 - DNA, 20 bp, Artificial Sequence
  Description of Artificial Sequence: Synthetic oligonucleotide
  Target: SCN10A; (-) strand; PAM type: YTN; PAM sequence: TTG
tgtctgggaggagaaaagtg

SEQ ID NO: 46836 - DNA, 20 bp, Artificial Sequence
  Description of Artificial Sequence: Synthetic oligonucleotide
  Target: SCN10A; (-) strand; PAM type: YTN; PAM sequence: TTC
cgttgtgtctgggaggagaa

SEQ ID NO: 46837 - DNA, 20 bp, Artificial Sequence
  Description of Artificial Sequence: Synthetic oligonucleotide
  Target: SCN10A; (-) strand; PAM type: YTN; PAM sequence: CTT
ccgttgtgtctgggaggaga

SEQ ID NO: 46838 - DNA, 20 bp, Artificial Sequence
  Description of Artificial Sequence: Synthetic oligonucleotide
  Target: SCN10A; (-) strand; PAM type: YTN; PAM sequence: CTG
gaaaacagtcttccgttgtg

SEQ ID NO: 46839 - DNA, 20 bp, Artificial Sequence
  Description of Artificial Sequence: Synthetic oligonucleotide
  Target: SCN10A; (-) strand; PAM type: YTN; PAM sequence: TTG
caagcaaaactggaaaacag

SEQ ID NO: 46840 - DNA, 20 bp, Artificial Sequence
  Description of Artificial Sequence: Synthetic oligonucleotide
  Target: SCN10A; (-) strand; PAM type: YTN; PAM sequence: TTT
gcaagcaaaactggaaaaca

SEQ ID NO: 46841 - DNA, 20 bp, Artificial Sequence
  Description of Artificial Sequence: Synthetic oligonucleotide
  Target: SCN10A; (-) strand; PAM type: YTN; PAM sequence: CTA
tttgcaagcaaaactggaaa

SEQ ID NO: 46842 - DNA, 20 bp, Artificial Sequence
  Description of Artificial Sequence: Synthetic oligonucleotide
  Target: SCN10A; (-) strand; PAM type: YTN; PAM sequence: CTA
acatgaccccaactatttgc

SEQ ID NO: 46843 - DNA, 20 bp, Artificial Sequence
  Description of Artificial Sequence: Synthetic oligonucleotide
  Target: SCN10A; (-) strand; PAM type: YTN; PAM sequence: TTC
caccagacagaacccactaa

SEQ ID NO: 46844 - DNA, 20 bp, Artificial Sequence
  Description of Artificial Sequence: Synthetic oligonucleotide
  Target: SCN10A; (-) strand; PAM type: YTN; PAM sequence: CTC
cattccaccagacagaaccc

SEQ ID NO: 46845 - DNA, 20 bp, Artificial Sequence
  Description of Artificial Sequence: Synthetic oligonucleotide
  Target: SCN10A; (-) strand; PAM type: YTN; PAM sequence: CTC
catctccattccaccagaca

SEQ ID NO: 46846 - DNA, 20 bp, Artificial Sequence
  Description of Artificial Sequence: Synthetic oligonucleotide
  Target: SCN10A; (-) strand; PAM type: YTN; PAM sequence: CTG
tctccatctccattccacca

SEQ ID NO: 46847 - DNA, 20 bp, Artificial Sequence
  Description of Artificial Sequence: Synthetic oligonucleotide
  Target: SCN10A; (-) strand; PAM type: YTN; PAM sequence: TTC
tgtctccatctccattccac

SEQ ID NO: 46848 - DNA, 20 bp, Artificial Sequence
  Description of Artificial Sequence: Synthetic oligonucleotide
  Target: SCN10A; (-) strand; PAM type: YTN; PAM sequence: CTT
ctgtctccatctccattcca

SEQ ID NO: 46849 - DNA, 20 bp, Artificial Sequence
  Description of Artificial Sequence: Synthetic oligonucleotide
  Target: SCN10A; (-) strand; PAM type: YTN; PAM sequence: TTA
cttctgtctccatctccatt

SEQ ID NO: 46850 - DNA, 20 bp, Artificial Sequence
  Description of Artificial Sequence: Synthetic oligonucleotide
  Target: SCN10A; (-) strand; PAM type: YTN; PAM sequence: CTA
aaagtcatgtatattacttc

SEQ ID NO: 46851 - DNA, 20 bp, Artificial Sequence
  Description of Artificial Sequence: Synthetic oligonucleotide
  Target: SCN10A; (-) strand; PAM type: YTN; PAM sequence: CTA
tgcctaaaagtcatgtatat

SEQ ID NO: 46852 - DNA, 20 bp, Artificial Sequence
  Description of Artificial Sequence: Synthetic oligonucleotide
  Target: SCN10A; (-) strand; PAM type: YTN; PAM sequence: TTA
aggctatgcctaaaagtcat

SEQ ID NO: 46853 - DNA, 20 bp, Artificial Sequence
  Description of Artificial Sequence: Synthetic oligonucleotide
  Target: SCN10A; (-) strand; PAM type: YTN; PAM sequence: TTT
aaggctatgcctaaaagtca

SEQ ID NO: 46854 - DNA, 20 bp, Artificial Sequence
  Description of Artificial Sequence: Synthetic oligonucleotide
  Target: SCN10A; (-) strand; PAM type: YTN; PAM sequence: TTC
agggggtttaaggctatgcc

SEQ ID NO: 46855 - DNA, 20 bp, Artificial Sequence
  Description of Artificial Sequence: Synthetic oligonucleotide
  Target: SCN10A; (-) strand; PAM type: YTN; PAM sequence: TTA
tggtgaacatgaaagggaaa

SEQ ID NO: 46856 - DNA, 20 bp, Artificial Sequence
  Description of Artificial Sequence: Synthetic oligonucleotide
  Target: SCN10A; (-) strand; PAM type: YTN; PAM sequence: TTT
atggtgaacatgaaagggaa

SEQ ID NO: 46857 - DNA, 20 bp, Artificial Sequence
  Description of Artificial Sequence: Synthetic oligonucleotide
  Target: SCN10A; (-) strand; PAM type: YTN; PAM sequence: CTT
tatggtgaacatgaaaggga

SEQ ID NO: 46858 - DNA, 20 bp, Artificial Sequence
  Description of Artificial Sequence: Synthetic oligonucleotide
  Target: SCN10A; (-) strand; PAM type: YTN; PAM sequence: TTA
gtgacctttatggtgaacat

SEQ ID NO: 46859 - DNA, 20 bp, Artificial Sequence
  Description of Artificial Sequence: Synthetic oligonucleotide
  Target: SCN10A; (-) strand; PAM type: YTN; PAM sequence: TTC
agttagtgacctttatggtg

SEQ ID NO: 46860 - DNA, 20 bp, Artificial Sequence
  Description of Artificial Sequence: Synthetic oligonucleotide
  Target: SCN10A; (-) strand; PAM type: YTN; PAM sequence: CTT
cagttagtgacctttatggt

SEQ ID NO: 46861 - DNA, 20 bp, Artificial Sequence
  Description of Artificial Sequence: Synthetic oligonucleotide
  Target: SCN10A; (-) strand; PAM type: YTN; PAM sequence: TTA
tcccatatcgtgatgtcacc

SEQ ID NO: 46862 - DNA, 20 bp, Artificial Sequence
  Description of Artificial Sequence: Synthetic oligonucleotide
  Target: SCN10A; (-) strand; PAM type: YTN; PAM sequence: CTA
ggattatcccatatcgtgat

SEQ ID NO: 46863 - DNA, 20 bp, Artificial Sequence
  Description of Artificial Sequence: Synthetic oligonucleotide
  Target: SCN10A; (-) strand; PAM type: YTN; PAM sequence: CTC
aaggatctaggattatccca

SEQ ID NO: 46864 - DNA, 20 bp, Artificial Sequence
  Description of Artificial Sequence: Synthetic oligonucleotide
  Target: SCN10A; (-) strand; PAM type: YTN; PAM sequence: TTC
aagtagcgcctcaaggatct

SEQ ID NO: 46865 - DNA, 20 bp, Artificial Sequence
  Description of Artificial Sequence: Synthetic oligonucleotide
  Target: SCN10A; (-) strand; PAM type: YTN; PAM sequence: CTT
caagtagcgcctcaaggatc

SEQ ID NO: 46866 - DNA, 20 bp, Artificial Sequence
  Description of Artificial Sequence: Synthetic oligonucleotide
  Target: SCN10A; (-) strand; PAM type: YTN; PAM sequence: CTA
cttcaagtagcgcctcaagg

SEQ ID NO: 46867 - DNA, 20 bp, Artificial Sequence
  Description of Artificial Sequence: Synthetic oligonucleotide
  Target: SCN10A; (-) strand; PAM type: YTN; PAM sequence: CTG
ggagtgtctacttcaagtag

SEQ ID NO: 46868 - DNA, 20 bp, Artificial Sequence
  Description of Artificial Sequence: Synthetic oligonucleotide
  Target: SCN10A; (-) strand; PAM type: YTN; PAM sequence: CTC
ctgggagtgtctacttcaag

SEQ ID NO: 46869 - DNA, 20 bp, Artificial Sequence
  Description of Artificial Sequence: Synthetic oligonucleotide
  Target: SCN10A; (-) strand; PAM type: YTN; PAM sequence: CTC
tcctgggagtgtctacttca

SEQ ID NO: 46870 - DNA, 20 bp, Artificial Sequence
  Description of Artificial Sequence: Synthetic oligonucleotide
  Target: SCN10A; (-) strand; PAM type: YTN; PAM sequence: TTG
ggaagctctcctgggagtgt

SEQ ID NO: 46871 - DNA, 20 bp, Artificial Sequence
  Description of Artificial Sequence: Synthetic oligonucleotide
  Target: SCN10A; (-) strand; PAM type: YTN; PAM sequence: TTG
ttgggaagctctcctgggag

SEQ ID NO: 46872 - DNA, 20 bp, Artificial Sequence
  Description of Artificial Sequence: Synthetic oligonucleotide
  Target: SCN10A; (-) strand; PAM type: YTN; PAM sequence: CTT
gttgggaagctctcctggga

SEQ ID NO: 46873 - DNA, 20 bp, Artificial Sequence
  Description of Artificial Sequence: Synthetic oligonucleotide
  Target: SCN10A; (-) strand; PAM type: YTN; PAM sequence: TTC
agtgcttgttgggaagctct

SEQ ID NO: 46874 - DNA, 20 bp, Artificial Sequence
  Description of Artificial Sequence: Synthetic oligonucleotide
  Target: SCN10A; (-) strand; PAM type: YTN; PAM sequence: CTC
acagcacattcagtgcttgt

SEQ ID NO: 46875 - DNA, 20 bp, Artificial Sequence
  Description of Artificial Sequence: Synthetic oligonucleotide
  Target: SCN10A; (-) strand; PAM type: YTN; PAM sequence: TTA
acataatagagatgtatgtc

SEQ ID NO: 46876 - DNA, 20 bp, Artificial Sequence
  Description of Artificial Sequence: Synthetic oligonucleotide
  Target: SCN10A; (-) strand; PAM type: YTN; PAM sequence: CTG
tgagttaacataatagagat

SEQ ID NO: 46877 - DNA, 20 bp, Artificial Sequence
  Description of Artificial Sequence: Synthetic oligonucleotide
  Target: SCN10A; (-) strand; PAM type: YTN; PAM sequence: CTA
aatctgtgagttaacataat

SEQ ID NO: 46878 - DNA, 20 bp, Artificial Sequence
  Description of Artificial Sequence: Synthetic oligonucleotide
  Target: SCN10A; (-) strand; PAM type: YTN; PAM sequence: CTC
taaatctgtgagttaacata

SEQ ID NO: 46879 - DNA, 20 bp, Artificial Sequence
  Description of Artificial Sequence: Synthetic oligonucleotide
  Target: SCN10A; (-) strand; PAM type: YTN; PAM sequence: CTG
cagtgataccctctaaatct

SEQ ID NO: 46880 - DNA, 20 bp, Artificial Sequence
  Description of Artificial Sequence: Synthetic oligonucleotide
  Target: SCN10A; (-) strand; PAM type: YTN; PAM sequence: CTA
gctgcagtgataccctctaa

SEQ ID NO: 46881 - DNA, 20 bp, Artificial Sequence
  Description of Artificial Sequence: Synthetic oligonucleotide
  Target: SCN10A; (-) strand; PAM type: YTN; PAM sequence: CTC
aagataagtacaactagctg

SEQ ID NO: 46882 - DNA, 20 bp, Artificial Sequence
  Description of Artificial Sequence: Synthetic oligonucleotide
  Target: SCN10A; (-) strand; PAM type: YTN; PAM sequence: TTA
ctcaagataagtacaactag

SEQ ID NO: 46883 - DNA, 20 bp, Artificial Sequence
  Description of Artificial Sequence: Synthetic oligonucleotide
  Target: SCN10A; (-) strand; PAM type: YTN; PAM sequence: CTC
cattactcaagataagtaca

SEQ ID NO: 46884 - DNA, 20 bp, Artificial Sequence
  Description of Artificial Sequence: Synthetic oligonucleotide
  Target: SCN10A; (-) strand; PAM type: YTN; PAM sequence: TTC
tccattactcaagataagta

SEQ ID NO: 46885 - DNA, 20 bp, Artificial Sequence
  Description of Artificial Sequence: Synthetic oligonucleotide
  Target: SCN10A; (-) strand; PAM type: YTN; PAM sequence: TTT
ctccattactcaagataagt

SEQ ID NO: 46886 - DNA, 20 bp, Artificial Sequence
  Description of Artificial Sequence: Synthetic oligonucleotide
  Target: SCN10A; (-) strand; PAM type: YTN; PAM sequence: TTC
aatgaagcaatttctccatt

SEQ ID NO: 46887 - DNA, 20 bp, Artificial Sequence
  Description of Artificial Sequence: Synthetic oligonucleotide
  Target: SCN10A; (-) strand; PAM type: YTN; PAM sequence: TTT
caatgaagcaatttctccat

SEQ ID NO: 46888 - DNA, 20 bp, Artificial Sequence
  Description of Artificial Sequence: Synthetic oligonucleotide
  Target: SCN10A; (-) strand; PAM type: YTN; PAM sequence: TTT
tcaatgaagcaatttctcca

SEQ ID NO: 46889 - DNA, 20 bp, Artificial Sequence
  Description of Artificial Sequence: Synthetic oligonucleotide
  Target: SCN10A; (-) strand; PAM type: YTN; PAM sequence: TTT
ttcaatgaagcaatttctcc

SEQ ID NO: 46890 - DNA, 20 bp, Artificial Sequence
  Description of Artificial Sequence: Synthetic oligonucleotide
  Target: SCN10A; (-) strand; PAM type: YTN; PAM sequence: TTT
tttcaatgaagcaatttctc

SEQ ID NO: 46891 - DNA, 20 bp, Artificial Sequence
  Description of Artificial Sequence: Synthetic oligonucleotide
  Target: SCN10A; (-) strand; PAM type: YTN; PAM sequence: CTT
ttttcaatgaagcaatttct

SEQ ID NO: 46892 - DNA, 20 bp, Artificial Sequence
  Description of Artificial Sequence: Synthetic oligonucleotide
  Target: SCN10A; (-) strand; PAM type: YTN; PAM sequence: TTG
aaaaggcaataccttttttc

SEQ ID NO: 46893 - DNA, 20 bp, Artificial Sequence
  Description of Artificial Sequence: Synthetic oligonucleotide
  Target: SCN10A; (-) strand; PAM type: YTN; PAM sequence: TTT
gaaaaggcaatacctttttt

SEQ ID NO: 46894 - DNA, 20 bp, Artificial Sequence
  Description of Artificial Sequence: Synthetic oligonucleotide
  Target: SCN10A; (-) strand; PAM type: YTN; PAM sequence: TTT
tgaaaaggcaataccttttt

SEQ ID NO: 46895 - DNA, 20 bp, Artificial Sequence
  Description of Artificial Sequence: Synthetic oligonucleotide
  Target: SCN10A; (-) strand; PAM type: YTN; PAM sequence: CTT
ttgaaaaggcaatacctttt

SEQ ID NO: 46896 - DNA, 20 bp, Artificial Sequence
  Description of Artificial Sequence: Synthetic oligonucleotide
  Target: SCN10A; (-) strand; PAM type: YTN; PAM sequence: TTG
atgcttttgaaaaggcaata

SEQ ID NO: 46897 - DNA, 20 bp, Artificial Sequence
  Description of Artificial Sequence: Synthetic oligonucleotide
  Target: SCN10A; (-) strand; PAM type: YTN; PAM sequence: TTA
agccagtgccacatagttga

SEQ ID NO: 46898 - DNA, 20 bp, Artificial Sequence
  Description of Artificial Sequence: Synthetic oligonucleotide
  Target: SCN10A; (-) strand; PAM type: YTN; PAM sequence: TTG
cccaccacatgatcattaag

SEQ ID NO: 46899 - DNA, 20 bp, Artificial Sequence
  Description of Artificial Sequence: Synthetic oligonucleotide
  Target: SCN10A; (-) strand; PAM type: YTN; PAM sequence: TTG
ttgcccaccacatgatcatt

SEQ ID NO: 46900 - DNA, 20 bp, Artificial Sequence
  Description of Artificial Sequence: Synthetic oligonucleotide
  Target: SCN10A; (-) strand; PAM type: YTN; PAM sequence: CTT
gttgcccaccacatgatcat

SEQ ID NO: 46901 - DNA, 20 bp, Artificial Sequence
  Description of Artificial Sequence: Synthetic oligonucleotide
  Target: SCN10A; (-) strand; PAM type: YTN; PAM sequence: TTC
cttgttgcccaccacatgat

SEQ ID NO: 46902 - DNA, 20 bp, Artificial Sequence
  Description of Artificial Sequence: Synthetic oligonucleotide
  Target: SCN10A; (-) strand; PAM type: YTN; PAM sequence: CTT
ccttgttgcccaccacatga

SEQ ID NO: 46903 - DNA, 20 bp, Artificial Sequence
  Description of Artificial Sequence: Synthetic oligonucleotide
  Target: SCN10A; (-) strand; PAM type: YTN; PAM sequence: CTA
tcagcttccttgttgcccac

SEQ ID NO: 46904 - DNA, 20 bp, Artificial Sequence
  Description of Artificial Sequence: Synthetic oligonucleotide
  Target: SCN10A; (-) strand; PAM type: YTN; PAM sequence: CTC
ctatcagcttccttgttgcc

SEQ ID NO: 46905 - DNA, 20 bp, Artificial Sequence
  Description of Artificial Sequence: Synthetic oligonucleotide
  Target: SCN10A; (-) strand; PAM type: YTN; PAM sequence: TTC
tcctatcagcttccttgttg

SEQ ID NO: 46906 - DNA, 20 bp, Artificial Sequence
  Description of Artificial Sequence: Synthetic oligonucleotide
  Target: SCN10A; (-) strand; PAM type: YTN; PAM sequence: CTT
ctcctatcagcttccttgtt

SEQ ID NO: 46907 - DNA, 20 bp, Artificial Sequence
  Description of Artificial Sequence: Synthetic oligonucleotide
  Target: SCN10A; (-) strand; PAM type: YTN; PAM sequence: TTC
caagccttctcctatcagct

SEQ ID NO: 46908 - DNA, 20 bp, Artificial Sequence
  Description of Artificial Sequence: Synthetic oligonucleotide
  Target: SCN10A; (-) strand; PAM type: YTN; PAM sequence: TTG
acattccaagccttctccta

SEQ ID NO: 46909 - DNA, 20 bp, Artificial Sequence
  Description of Artificial Sequence: Synthetic oligonucleotide
  Target: SCN10A; (-) strand; PAM type: YTN; PAM sequence: CTG
aataacatagattgacattc

SEQ ID NO: 46910 - DNA, 20 bp, Artificial Sequence
  Description of Artificial Sequence: Synthetic oligonucleotide
  Target: SCN10A; (-) strand; PAM type: YTN; PAM sequence: TTG
tcactgaataacatagattg

SEQ ID NO: 46911 - DNA, 20 bp, Artificial Sequence
  Description of Artificial Sequence: Synthetic oligonucleotide
  Target: SCN10A; (-) strand; PAM type: YTN; PAM sequence: TTT
gtcactgaataacatagatt

SEQ ID NO: 46912 - DNA, 20 bp, Artificial Sequence
  Description of Artificial Sequence: Synthetic oligonucleotide
  Target: SCN10A; (-) strand; PAM type: YTN; PAM sequence: TTT
tgtcactgaataacatagat

SEQ ID NO: 46913 - DNA, 20 bp, Artificial Sequence
  Description of Artificial Sequence: Synthetic oligonucleotide
  Target: SCN10A; (-) strand; PAM type: YTN; PAM sequence: TTT
ttgtcactgaataacataga

SEQ ID NO: 46914 - DNA, 20 bp, Artificial Sequence
  Description of Artificial Sequence: Synthetic oligonucleotide
  Target: SCN10A; (-) strand; PAM type: YTN; PAM sequence: TTG
ccagcaatatttttgtcact

SEQ ID NO: 46915 - DNA, 20 bp, Artificial Sequence
  Description of Artificial Sequence: Synthetic oligonucleotide
  Target: SCN10A; (-) strand; PAM type: YTN; PAM sequence: TTT
gccagcaatatttttgtcac

SEQ ID NO: 46916 - DNA, 20 bp, Artificial Sequence
  Description of Artificial Sequence: Synthetic oligonucleotide
  Target: SCN10A; (-) strand; PAM type: YTN; PAM sequence: TTT
tgccagcaatatttttgtca

SEQ ID NO: 46917 - DNA, 20 bp, Artificial Sequence
  Description of Artificial Sequence: Synthetic oligonucleotide
  Target: SCN10A; (-) strand; PAM type: YTN; PAM sequence: TTT
ttgccagcaatatttttgtc

SEQ ID NO: 46918 - DNA, 20 bp, Artificial Sequence
  Description of Artificial Sequence: Synthetic oligonucleotide
  Target: SCN10A; (-) strand; PAM type: YTN; PAM sequence: CTC
aaaatttttgccagcaatat

SEQ ID NO: 46919 - DNA, 20 bp, Artificial Sequence
  Description of Artificial Sequence: Synthetic oligonucleotide
  Target: SCN10A; (-) strand; PAM type: YTN; PAM sequence: CTG
cctcaaaatttttgccagca

SEQ ID NO: 46920 - DNA, 20 bp, Artificial Sequence
  Description of Artificial Sequence: Synthetic oligonucleotide
  Target: SCN10A; (-) strand; PAM type: YTN; PAM sequence: CTC
tgcctcaaaatttttgccag

SEQ ID NO: 46921 - DNA, 20 bp, Artificial Sequence
  Description of Artificial Sequence: Synthetic oligonucleotide
  Target: SCN10A; (-) strand; PAM type: YTN; PAM sequence: CTC
gtgctctgcctcaaaatttt

SEQ ID NO: 46922 - DNA, 20 bp, Artificial Sequence
  Description of Artificial Sequence: Synthetic oligonucleotide
  Target: SCN10A; (-) strand; PAM type: YTN; PAM sequence: TTC
atgaggctcgtgctctgcct

SEQ ID NO: 46923 - DNA, 20 bp, Artificial Sequence
  Description of Artificial Sequence: Synthetic oligonucleotide
  Target: SCN10A; (-) strand; PAM type: YTN; PAM sequence: CTG
gttcatgaggctcgtgctct

SEQ ID NO: 46924 - DNA, 20 bp, Artificial Sequence
  Description of Artificial Sequence: Synthetic oligonucleotide
  Target: SCN10A; (-) strand; PAM type: YTN; PAM sequence: TTG
ctggttcatgaggctcgtgc

SEQ ID NO: 46925 - DNA, 20 bp, Artificial Sequence
  Description of Artificial Sequence: Synthetic oligonucleotide
  Target: SCN10A; (-) strand; PAM type: YTN; PAM sequence: CTA
gggttgctggttcatgaggc

SEQ ID NO: 46926 - DNA, 20 bp, Artificial Sequence
  Description of Artificial Sequence: Synthetic oligonucleotide
  Target: SCN10A; (-) strand; PAM type: YTN; PAM sequence: TTC
ccctagggttgctggttcat

SEQ ID NO: 46927 - DNA, 20 bp, Artificial Sequence
  Description of Artificial Sequence: Synthetic oligonucleotide
  Target: SCN10A; (-) strand; PAM type: YTN; PAM sequence: CTT
cccctagggttgctggttca

SEQ ID NO: 46928 - DNA, 20 bp, Artificial Sequence
  Description of Artificial Sequence: Synthetic oligonucleotide
  Target: SCN10A; (-) strand; PAM type: YTN; PAM sequence: TTA
ataaacccttcccctagggt

SEQ ID NO: 46929 - DNA, 20 bp, Artificial Sequence
  Description of Artificial Sequence: Synthetic oligonucleotide
  Target: SCN10A; (-) strand; PAM type: YTN; PAM sequence: TTT
aataaacccttcccctaggg

SEQ ID NO: 46930 - DNA, 20 bp, Artificial Sequence
  Description of Artificial Sequence: Synthetic oligonucleotide
  Target: SCN10A; (-) strand; PAM type: YTN; PAM sequence: CTA
aggtttaataaacccttccc

SEQ ID NO: 46931 - DNA, 20 bp, Artificial Sequence
  Description of Artificial Sequence: Synthetic oligonucleotide
  Target: SCN10A; (-) strand; PAM type: YTN; PAM sequence: CTG
acccacaatactaaggttta

SEQ ID NO: 46932 - DNA, 20 bp, Artificial Sequence
  Description of Artificial Sequence: Synthetic oligonucleotide
  Target: SCN10A; (-) strand; PAM type: YTN; PAM sequence: TTA
caactgacccacaatactaa

SEQ ID NO: 46933 - DNA, 20 bp, Artificial Sequence
  Description of Artificial Sequence: Synthetic oligonucleotide
  Target: SCN10A; (-) strand; PAM type: YTN; PAM sequence: TTG
accaacatagccaattacaa

SEQ ID NO: 46934 - DNA, 20 bp, Artificial Sequence
  Description of Artificial Sequence: Synthetic oligonucleotide
  Target: SCN10A; (-) strand; PAM type: YTN; PAM sequence: CTT
gaccaacatagccaattaca

SEQ ID NO: 46935 - DNA, 20 bp, Artificial Sequence
  Description of Artificial Sequence: Synthetic oligonucleotide
  Target: SCN10A; (-) strand; PAM type: YTN; PAM sequence: CTG
tcttgaccaacatagccaat

SEQ ID NO: 46936 - DNA, 20 bp, Artificial Sequence
  Description of Artificial Sequence: Synthetic oligonucleotide
  Target: SCN10A; (-) strand; PAM type: YTN; PAM sequence: TTG
tactgtcttgaccaacatag

SEQ ID NO: 46937 - DNA, 20 bp, Artificial Sequence
  Description of Artificial Sequence: Synthetic oligonucleotide
  Target: SCN10A; (-) strand; PAM type: YTN; PAM sequence: CTT
gtactgtcttgaccaacata

SEQ ID NO: 46938 - DNA, 20 bp, Artificial Sequence
  Description of Artificial Sequence: Synthetic oligonucleotide
  Target: SCN10A; (-) strand; PAM type: YTN; PAM sequence: TTC
ttgtactgtcttgaccaaca

SEQ ID NO: 46939 - DNA, 20 bp, Artificial Sequence
  Description of Artificial Sequence: Synthetic oligonucleotide
  Target: SCN10A; (-) strand; PAM type: YTN; PAM sequence: TTT
cttgtactgtcttgaccaac

SEQ ID NO: 46940 - DNA, 20 bp, Artificial Sequence
  Description of Artificial Sequence: Synthetic oligonucleotide
  Target: SCN10A; (-) strand; PAM type: YTN; PAM sequence: CTT
tcttgtactgtcttgaccaa

SEQ ID NO: 46941 - DNA, 20 bp, Artificial Sequence
  Description of Artificial Sequence: Synthetic oligonucleotide
  Target: SCN10A; (-) strand; PAM type: YTN; PAM sequence: CTC
tttcttgtactgtcttgacc

SEQ ID NO: 46942 - DNA, 20 bp, Artificial Sequence
  Description of Artificial Sequence: Synthetic oligonucleotide
  Target: SCN10A; (-) strand; PAM type: YTN; PAM sequence: CTA
atctctttcttgtactgtct

SEQ ID NO: 46943 - DNA, 20 bp, Artificial Sequence
  Description of Artificial Sequence: Synthetic oligonucleotide
  Target: SCN10A; (-) strand; PAM type: YTN; PAM sequence: CTG
agctaatctctttcttgtac

SEQ ID NO: 46944 - DNA, 20 bp, Artificial Sequence
  Description of Artificial Sequence: Synthetic oligonucleotide
  Target: SCN10A; (-) strand; PAM type: YTN; PAM sequence: TTC
ctgagctaatctctttcttg

SEQ ID NO: 46945 - DNA, 20 bp, Artificial Sequence
  Description of Artificial Sequence: Synthetic oligonucleotide
  Target: SCN10A; (-) strand; PAM type: YTN; PAM sequence: TTT
cctgagctaatctctttctt

SEQ ID NO: 46946 - DNA, 20 bp, Artificial Sequence
  Description of Artificial Sequence: Synthetic oligonucleotide
  Target: SCN10A; (-) strand; PAM type: YTN; PAM sequence: CTT
tcctgagctaatctctttct

SEQ ID NO: 46947 - DNA, 20 bp, Artificial Sequence
  Description of Artificial Sequence: Synthetic oligonucleotide
  Target: SCN10A; (-) strand; PAM type: YTN; PAM sequence: CTA
aatctttcctgagctaatct

SEQ ID NO: 46948 - DNA, 20 bp, Artificial Sequence
  Description of Artificial Sequence: Synthetic oligonucleotide
  Target: SCN10A; (-) strand; PAM type: YTN; PAM sequence: TTA
taaaccagctaaatctttcc

SEQ ID NO: 46949 - DNA, 20 bp, Artificial Sequence
  Description of Artificial Sequence: Synthetic oligonucleotide
  Target: SCN10A; (-) strand; PAM type: YTN; PAM sequence: CTT
ataaaccagctaaatctttc

SEQ ID NO: 46950 - DNA, 20 bp, Artificial Sequence
  Description of Artificial Sequence: Synthetic oligonucleotide
  Target: SCN10A; (-) strand; PAM type: YTN; PAM sequence: TTC
ttataaaccagctaaatctt

SEQ ID NO: 46951 - DNA, 20 bp, Artificial Sequence
  Description of Artificial Sequence: Synthetic oligonucleotide
  Target: SCN10A; (-) strand; PAM type: YTN; PAM sequence: TTA
ttcttataaaccagctaaat

SEQ ID NO: 46952 - DNA, 20 bp, Artificial Sequence
  Description of Artificial Sequence: Synthetic oligonucleotide
  Target: SCN10A; (-) strand; PAM type: YTN; PAM sequence: TTT
attcttataaaccagctaaa

SEQ ID NO: 46953 - DNA, 20 bp, Artificial Sequence
  Description of Artificial Sequence: Synthetic oligonucleotide
  Target: SCN10A; (-) strand; PAM type: YTN; PAM sequence: TTT
tattcttataaaccagctaa

SEQ ID NO: 46954 - DNA, 20 bp, Artificial Sequence
  Description of Artificial Sequence: Synthetic oligonucleotide
  Target: SCN10A; (-) strand; PAM type: YTN; PAM sequence: CTT
ttattcttataaaccagcta

SEQ ID NO: 46955 - DNA, 20 bp, Artificial Sequence
  Description of Artificial Sequence: Synthetic oligonucleotide
  Target: SCN10A; (-) strand; PAM type: YTN; PAM sequence: TTC
ttttattcttataaaccagc

SEQ ID NO: 46956 - DNA, 20 bp, Artificial Sequence
  Description of Artificial Sequence: Synthetic oligonucleotide
  Target: SCN10A; (-) strand; PAM type: YTN; PAM sequence: TTT
cttttattcttataaaccag

SEQ ID NO: 46957 - DNA, 20 bp, Artificial Sequence
  Description of Artificial Sequence: Synthetic oligonucleotide
  Target: SCN10A; (-) strand; PAM type: YTN; PAM sequence: TTT
tcttttattcttataaacca

SEQ ID NO: 46958 - DNA, 20 bp, Artificial Sequence
  Description of Artificial Sequence: Synthetic oligonucleotide
  Target: SCN10A; (-) strand; PAM type: YTN; PAM sequence: TTA
tattttcttttattcttata

SEQ ID NO: 46959 - DNA, 20 bp, Artificial Sequence
  Description of Artificial Sequence: Synthetic oligonucleotide
  Target: SCN10A; (-) strand; PAM type: YTN; PAM sequence: CTG
gattatattttcttttattc

SEQ ID NO: 46960 - DNA, 20 bp, Artificial Sequence
  Description of Artificial Sequence: Synthetic oligonucleotide
  Target: SCN10A; (-) strand; PAM type: YTN; PAM sequence: TTC
tggattatattttcttttat

SEQ ID NO: 46961 - DNA, 20 bp, Artificial Sequence
  Description of Artificial Sequence: Synthetic oligonucleotide
  Target: SCN10A; (-) strand; PAM type: YTN; PAM sequence: CTT
ctggattatattttctttta

SEQ ID NO: 46962 - DNA, 20 bp, Artificial Sequence
  Description of Artificial Sequence: Synthetic oligonucleotide
  Target: SCN10A; (-) strand; PAM type: YTN; PAM sequence: CTA
aacttctggattatattttc

SEQ ID NO: 46963 - DNA, 20 bp, Artificial Sequence
  Description of Artificial Sequence: Synthetic oligonucleotide
  Target: SCN10A; (-) strand; PAM type: YTN; PAM sequence: CTC
taaacttctggattatattt

SEQ ID NO: 46964 - DNA, 20 bp, Artificial Sequence
  Description of Artificial Sequence: Synthetic oligonucleotide
  Target: SCN10A; (-) strand; PAM type: YTN; PAM sequence: CTA
aatcgtcaaggctctaaact

SEQ ID NO: 46965 - DNA, 20 bp, Artificial Sequence
  Description of Artificial Sequence: Synthetic oligonucleotide
  Target: SCN10A; (-) strand; PAM type: YTN; PAM sequence: TTC
cctaaatcgtcaaggctcta

SEQ ID NO: 46966 - DNA, 20 bp, Artificial Sequence
  Description of Artificial Sequence: Synthetic oligonucleotide
  Target: SCN10A; (-) strand; PAM type: YTN; PAM sequence: CTA
gaagcagtacagttccctaa

SEQ ID NO: 46967 - DNA, 20 bp, Artificial Sequence
  Description of Artificial Sequence: Synthetic oligonucleotide
  Target: SCN10A; (-) strand; PAM type: YTN; PAM sequence: CTG
gaatctagaagcagtacagt

SEQ ID NO: 46968 - DNA, 20 bp, Artificial Sequence
  Description of Artificial Sequence: Synthetic oligonucleotide
  Target: SCN10A; (-) strand; PAM type: YTN; PAM sequence: CTG
cctggaatctagaagcagta

SEQ ID NO: 46969 - DNA, 20 bp, Artificial Sequence
  Description of Artificial Sequence: Synthetic oligonucleotide
  Target: SCN10A; (-) strand; PAM type: YTN; PAM sequence: CTC
actgcctggaatctagaagc

SEQ ID NO: 46970 - DNA, 20 bp, Artificial Sequence
  Description of Artificial Sequence: Synthetic oligonucleotide
  Target: SCN10A; (-) strand; PAM type: YTN; PAM sequence: TTG
ctcactgcctggaatctaga

SEQ ID NO: 46971 - DNA, 20 bp, Artificial Sequence
  Description of Artificial Sequence: Synthetic oligonucleotide
  Target: SCN10A; (-) strand; PAM type: YTN; PAM sequence: TTA
atcccattgctcactgcctg

SEQ ID NO: 46972 - DNA, 20 bp, Artificial Sequence
  Description of Artificial Sequence: Synthetic oligonucleotide
  Target: SCN10A; (-) strand; PAM type: YTN; PAM sequence: CTT
aatcccattgctcactgcct

SEQ ID NO: 46973 - DNA, 20 bp, Artificial Sequence
  Description of Artificial Sequence: Synthetic oligonucleotide
  Target: SCN10A; (-) strand; PAM type: YTN; PAM sequence: TTG
aagacttaatcccattgctc

SEQ ID NO: 46974 - DNA, 20 bp, Artificial Sequence
  Description of Artificial Sequence: Synthetic oligonucleotide
  Target: SCN10A; (-) strand; PAM type: YTN; PAM sequence: TTT
gaagacttaatcccattgct

SEQ ID NO: 46975 - DNA, 20 bp, Artificial Sequence
  Description of Artificial Sequence: Synthetic oligonucleotide
  Target: SCN10A; (-) strand; PAM type: YTN; PAM sequence: TTC
aacatttgaagacttaatcc

SEQ ID NO: 46976 - DNA, 20 bp, Artificial Sequence
  Description of Artificial Sequence: Synthetic oligonucleotide
  Target: SCN10A; (-) strand; PAM type: YTN; PAM sequence: CTT
caacatttgaagacttaatc

SEQ ID NO: 46977 - DNA, 20 bp, Artificial Sequence
  Description of Artificial Sequence: Synthetic oligonucleotide
  Target: SCN10A; (-) strand; PAM type: YTN; PAM sequence: CTA
gtcttcaacatttgaagact

SEQ ID NO: 46978 - DNA, 20 bp, Artificial Sequence
  Description of Artificial Sequence: Synthetic oligonucleotide
  Target: SCN10A; (-) strand; PAM type: YTN; PAM sequence: TTA
actagtcttcaacatttgaa

SEQ ID NO: 46979 - DNA, 20 bp, Artificial Sequence
  Description of Artificial Sequence: Synthetic oligonucleotide
  Target: SCN10A; (-) strand; PAM type: YTN; PAM sequence: TTT
aactagtcttcaacatttga

SEQ ID NO: 46980 - DNA, 20 bp, Artificial Sequence
  Description of Artificial Sequence: Synthetic oligonucleotide
  Target: SCN10A; (-) strand; PAM type: YTN; PAM sequence: TTG
gaaaatttaactagtcttca

SEQ ID NO: 46981 - DNA, 20 bp, Artificial Sequence
  Description of Artificial Sequence: Synthetic oligonucleotide
  Target: SCN10A; (-) strand; PAM type: YTN; PAM sequence: TTA
attggaaaatttaactagtc

SEQ ID NO: 46982 - DNA, 20 bp, Artificial Sequence
  Description of Artificial Sequence: Synthetic oligonucleotide
  Target: SCN10A; (-) strand; PAM type: YTN; PAM sequence: TTT
aattggaaaatttaactagt

SEQ ID NO: 46983 - DNA, 20 bp, Artificial Sequence
  Description of Artificial Sequence: Synthetic oligonucleotide
  Target: SCN10A; (-) strand; PAM type: YTN; PAM sequence: TTC
atttaattggaaaatttaac

SEQ ID NO: 46984 - DNA, 20 bp, Artificial Sequence
  Description of Artificial Sequence: Synthetic oligonucleotide
  Target: SCN10A; (-) strand; PAM type: YTN; PAM sequence: TTT
catttaattggaaaatttaa

SEQ ID NO: 46985 - DNA, 20 bp, Artificial Sequence
  Description of Artificial Sequence: Synthetic oligonucleotide
  Target: SCN10A; (-) strand; PAM type: YTN; PAM sequence: TTG
tttcatttaattggaaaatt

SEQ ID NO: 46986 - DNA, 20 bp, Artificial Sequence
  Description of Artificial Sequence: Synthetic oligonucleotide
  Target: SCN10A; (-) strand; PAM type: YTN; PAM sequence: CTA
agagttgtttcatttaattg

SEQ ID NO: 46987 - DNA, 20 bp, Artificial Sequence
  Description of Artificial Sequence: Synthetic oligonucleotide
  Target: SCN10A; (-) strand; PAM type: YTN; PAM sequence: TTG
ctaagagttgtttcatttaa

SEQ ID NO: 46988 - DNA, 20 bp, Artificial Sequence
  Description of Artificial Sequence: Synthetic oligonucleotide
  Target: SCN10A; (-) strand; PAM type: YTN; PAM sequence: TTT
gctaagagttgtttcattta

SEQ ID NO: 46989 - DNA, 20 bp, Artificial Sequence
  Description of Artificial Sequence: Synthetic oligonucleotide
  Target: SCN10A; (-) strand; PAM type: YTN; PAM sequence: CTT
tgctaagagttgtttcattt

SEQ ID NO: 46990 - DNA, 20 bp, Artificial Sequence
  Description of Artificial Sequence: Synthetic oligonucleotide
  Target: SCN10A; (-) strand; PAM type: YTN; PAM sequence: CTA
caagctttgctaagagttgt

SEQ ID NO: 46991 - DNA, 20 bp, Artificial Sequence
  Description of Artificial Sequence: Synthetic oligonucleotide
  Target: SCN10A; (-) strand; PAM type: YTN; PAM sequence: TTA
ctacaagctttgctaagagt

SEQ ID NO: 46992 - DNA, 20 bp, Artificial Sequence
  Description of Artificial Sequence: Synthetic oligonucleotide
  Target: SCN10A; (-) strand; PAM type: YTN; PAM sequence: CTA
caccattactacaagctttg

SEQ ID NO: 46993 - DNA, 20 bp, Artificial Sequence
  Description of Artificial Sequence: Synthetic oligonucleotide
  Target: SCN10A; (-) strand; PAM type: YTN; PAM sequence: TTG
cacaagaaacagtggctaca

SEQ ID NO: 46994 - DNA, 20 bp, Artificial Sequence
  Description of Artificial Sequence: Synthetic oligonucleotide
  Target: SCN10A; (-) strand; PAM type: YTN; PAM sequence: CTT
gcacaagaaacagtggctac

SEQ ID NO: 46995 - DNA, 20 bp, Artificial Sequence
  Description of Artificial Sequence: Synthetic oligonucleotide
  Target: SCN10A; (-) strand; PAM type: YTN; PAM sequence: CTC
ttgcacaagaaacagtggct

SEQ ID NO: 46996 - DNA, 20 bp, Artificial Sequence
  Description of Artificial Sequence: Synthetic oligonucleotide
  Target: SCN10A; (-) strand; PAM type: YTN; PAM sequence: TTC
tcttgcacaagaaacagtgg

SEQ ID NO: 46997 - DNA, 20 bp, Artificial Sequence
  Description of Artificial Sequence: Synthetic oligonucleotide
  Target: SCN10A; (-) strand; PAM type: YTN; PAM sequence: TTT
ctcttgcacaagaaacagtg

SEQ ID NO: 46998 - DNA, 20 bp, Artificial Sequence
  Description of Artificial Sequence: Synthetic oligonucleotide
  Target: SCN10A; (-) strand; PAM type: YTN; PAM sequence: CTT
tctcttgcacaagaaacagt

SEQ ID NO: 46999 - DNA, 20 bp, Artificial Sequence
  Description of Artificial Sequence: Synthetic oligonucleotide
  Target: SCN10A; (-) strand; PAM type: YTN; PAM sequence: TTC
cccatgcctttctcttgcac

SEQ ID NO: 47000 - DNA, 20 bp, Artificial Sequence
  Description of Artificial Sequence: Synthetic oligonucleotide
  Target: SCN10A; (-) strand; PAM type: YTN; PAM sequence: TTT
ccccatgcctttctcttgca

SEQ ID NO: 47001 - DNA, 20 bp, Artificial Sequence
  Description of Artificial Sequence: Synthetic oligonucleotide
  Target: SCN10A; (-) strand; PAM type: YTN; PAM sequence: CTT
tccccatgcctttctcttgc

SEQ ID NO: 47002 - DNA, 20 bp, Artificial Sequence
  Description of Artificial Sequence: Synthetic oligonucleotide
  Target: SCN10A; (-) strand; PAM type: YTN; PAM sequence: TTC
ctttccccatgcctttctct

SEQ ID NO: 47003 - DNA, 20 bp, Artificial Sequence
  Description of Artificial Sequence: Synthetic oligonucleotide
  Target: SCN10A; (-) strand; PAM type: YTN; PAM sequence: TTT
cctttccccatgcctttctc

SEQ ID NO: 47004 - DNA, 20 bp, Artificial Sequence
  Description of Artificial Sequence: Synthetic oligonucleotide
  Target: SCN10A; (-) strand; PAM type: YTN; PAM sequence: CTT
tcctttccccatgcctttct

SEQ ID NO: 47005 - DNA, 20 bp, Artificial Sequence
  Description of Artificial Sequence: Synthetic oligonucleotide
  Target: SCN10A; (-) strand; PAM type: YTN; PAM sequence: TTG
ctttcctttccccatgcctt

SEQ ID NO: 47006 - DNA, 20 bp, Artificial Sequence
  Description of Artificial Sequence: Synthetic oligonucleotide
  Target: SCN10A; (-) strand; PAM type: YTN; PAM sequence: TTT
gctttcctttccccatgcct

SEQ ID NO: 47007 - DNA, 20 bp, Artificial Sequence
  Description of Artificial Sequence: Synthetic oligonucleotide
  Target: SCN10A; (-) strand; PAM type: YTN; PAM sequence: CTT
tgctttcctttccccatgcc

SEQ ID NO: 47008 - DNA, 20 bp, Artificial Sequence
  Description of Artificial Sequence: Synthetic oligonucleotide
  Target: SCN10A; (-) strand; PAM type: YTN; PAM sequence: TTC
tttgctttcctttccccatg

SEQ ID NO: 47009 - DNA, 20 bp, Artificial Sequence
  Description of Artificial Sequence: Synthetic oligonucleotide
  Target: SCN10A; (-) strand; PAM type: YTN; PAM sequence: TTT
ctttgctttcctttccccat

SEQ ID NO: 47010 - DNA, 20 bp, Artificial Sequence
  Description of Artificial Sequence: Synthetic oligonucleotide
  Target: SCN10A; (-) strand; PAM type: YTN; PAM sequence: TTA
tttctttgctttcctttccc

SEQ ID NO: 47011 - DNA, 20 bp, Artificial Sequence
  Description of Artificial Sequence: Synthetic oligonucleotide
  Target: SCN10A; (-) strand; PAM type: YTN; PAM sequence: TTT
atttctttgctttcctttcc

SEQ ID NO: 47012 - DNA, 20 bp, Artificial Sequence
  Description of Artificial Sequence: Synthetic oligonucleotide
  Target: SCN10A; (-) strand; PAM type: YTN; PAM sequence: CTT
tatttctttgctttcctttc

SEQ ID NO: 47013 - DNA, 20 bp, Artificial Sequence
  Description of Artificial Sequence: Synthetic oligonucleotide
  Target: SCN10A; (-) strand; PAM type: YTN; PAM sequence: TTC
tttatttctttgctttcctt

SEQ ID NO: 47014 - DNA, 20 bp, Artificial Sequence
  Description of Artificial Sequence: Synthetic oligonucleotide
  Target: SCN10A; (-) strand; PAM type: YTN; PAM sequence: TTG
ttctttatttctttgctttc

SEQ ID NO: 47015 - DNA, 20 bp, Artificial Sequence
  Description of Artificial Sequence: Synthetic oligonucleotide
  Target: SCN10A; (-) strand; PAM type: YTN; PAM sequence: CTC
aattgttctttatttctttg

SEQ ID NO: 47016 - DNA, 20 bp, Artificial Sequence
  Description of Artificial Sequence: Synthetic oligonucleotide
  Target: SCN10A; (-) strand; PAM type: YTN; PAM sequence: TTC
tcaattgttctttatttctt

SEQ ID NO: 47017 - DNA, 20 bp, Artificial Sequence
  Description of Artificial Sequence: Synthetic oligonucleotide
  Target: SCN10A; (-) strand; PAM type: YTN; PAM sequence: TTG
acaaagttctcaattgttct

SEQ ID NO: 47018 - DNA, 20 bp, Artificial Sequence
  Description of Artificial Sequence: Synthetic oligonucleotide
  Target: SCN10A; (-) strand; PAM type: YTN; PAM sequence: TTT
gacaaagttctcaattgttc

SEQ ID NO: 47019 - DNA, 20 bp, Artificial Sequence
  Description of Artificial Sequence: Synthetic oligonucleotide
  Target: SCN10A; (-) strand; PAM type: YTN; PAM sequence: CTT
tgacaaagttctcaattgtt

SEQ ID NO: 47020 - DNA, 20 bp, Artificial Sequence
  Description of Artificial Sequence: Synthetic oligonucleotide
  Target: SCN10A; (-) strand; PAM type: YTN; PAM sequence: TTC
tttgacaaagttctcaattg

SEQ ID NO: 47021 - DNA, 20 bp, Artificial Sequence
  Description of Artificial Sequence: Synthetic oligonucleotide
  Target: SCN10A; (-) strand; PAM type: YTN; PAM sequence: TTT
ctttgacaaagttctcaatt

SEQ ID NO: 47022 - DNA, 20 bp, Artificial Sequence
  Description of Artificial Sequence: Synthetic oligonucleotide
  Target: SCN10A; (-) strand; PAM type: YTN; PAM sequence: CTT
tctttgacaaagttctcaat

SEQ ID NO: 47023 - DNA, 20 bp, Artificial Sequence
  Description of Artificial Sequence: Synthetic oligonucleotide
  Target: SCN10A; (-) strand; PAM type: YTN; PAM sequence: TTG
ccacacaaagtgctttcttt

SEQ ID NO: 47024 - DNA, 20 bp, Artificial Sequence
  Description of Artificial Sequence: Synthetic oligonucleotide
  Target: SCN10A; (-) strand; PAM type: YTN; PAM sequence: CTC
attgccacacaaagtgcttt

SEQ ID NO: 47025 - DNA, 20 bp, Artificial Sequence
  Description of Artificial Sequence: Synthetic oligonucleotide
  Target: SCN10A; (-) strand; PAM type: YTN; PAM sequence: CTC
tcattgccacacaaagtgct

SEQ ID NO: 47026 - DNA, 20 bp, Artificial Sequence
  Description of Artificial Sequence: Synthetic oligonucleotide
  Target: SCN10A; (-) strand; PAM type: YTN; PAM sequence: TTC
agacctctcattgccacaca

SEQ ID NO: 47027 - DNA, 20 bp, Artificial Sequence
  Description of Artificial Sequence: Synthetic oligonucleotide
  Target: SCN10A; (-) strand; PAM type: YTN; PAM sequence: CTT
cagacctctcattgccacac

SEQ ID NO: 47028 - DNA, 20 bp, Artificial Sequence
  Description of Artificial Sequence: Synthetic oligonucleotide
  Target: SCN10A; (-) strand; PAM type: YTN; PAM sequence: TTA
gatggcttcagacctctcat

SEQ ID NO: 47029 - DNA, 20 bp, Artificial Sequence
  Description of Artificial Sequence: Synthetic oligonucleotide
  Target: SCN10A; (-) strand; PAM type: YTN; PAM sequence: CTT
agatggcttcagacctctca

SEQ ID NO: 47030 - DNA, 20 bp, Artificial Sequence
  Description of Artificial Sequence: Synthetic oligonucleotide
  Target: SCN10A; (-) strand; PAM type: YTN; PAM sequence: TTC
aaaaacttagatggcttcag

SEQ ID NO: 47031 - DNA, 20 bp, Artificial Sequence
  Description of Artificial Sequence: Synthetic oligonucleotide
  Target: SCN10A; (-) strand; PAM type: YTN; PAM sequence: CTT
caaaaacttagatggcttca

SEQ ID NO: 47032 - DNA, 20 bp, Artificial Sequence
  Description of Artificial Sequence: Synthetic oligonucleotide
  Target: SCN10A; (-) strand; PAM type: YTN; PAM sequence: TTA
cttcaaaaacttagatggct

SEQ ID NO: 47033 - DNA, 20 bp, Artificial Sequence
  Description of Artificial Sequence: Synthetic oligonucleotide
  Target: SCN10A; (-) strand; PAM type: YTN; PAM sequence: TTC
acaatacaattacttcaaaa

SEQ ID NO: 47034 - DNA, 20 bp, Artificial Sequence
  Description of Artificial Sequence: Synthetic oligonucleotide
  Target: SCN10A; (-) strand; PAM type: YTN; PAM sequence: TTT
cacaatacaattacttcaaa

SEQ ID NO: 47035 - DNA, 20 bp, Artificial Sequence
  Description of Artificial Sequence: Synthetic oligonucleotide
  Target: SCN10A; (-) strand; PAM type: YTN; PAM sequence: TTA
tttcacaatacaattacttc

SEQ ID NO: 47036 - DNA, 20 bp, Artificial Sequence
  Description of Artificial Sequence: Synthetic oligonucleotide
  Target: SCN10A; (-) strand; PAM type: YTN; PAM sequence: TTT
atttcacaatacaattactt

SEQ ID NO: 47037 - DNA, 20 bp, Artificial Sequence
  Description of Artificial Sequence: Synthetic oligonucleotide
  Target: SCN10A; (-) strand; PAM type: YTN; PAM sequence: TTG
atttatttcacaatacaatt

SEQ ID NO: 47038 - DNA, 20 bp, Artificial Sequence
  Description of Artificial Sequence: Synthetic oligonucleotide
  Target: SCN10A; (-) strand; PAM type: YTN; PAM sequence: TTT
gatttatttcacaatacaat

SEQ ID NO: 47039 - DNA, 20 bp, Artificial Sequence
  Description of Artificial Sequence: Synthetic oligonucleotide
  Target: SCN10A; (-) strand; PAM type: YTN; PAM sequence: TTT
tgatttatttcacaatacaa

SEQ ID NO: 47040 - DNA, 20 bp, Artificial Sequence
  Description of Artificial Sequence: Synthetic oligonucleotide
  Target: SCN10A; (-) strand; PAM type: YTN; PAM sequence: TTC
agtcagggattttgatttat

SEQ ID NO: 47041 - DNA, 20 bp, Artificial Sequence
  Description of Artificial Sequence: Synthetic oligonucleotide
  Target: SCN10A; (-) strand; PAM type: YTN; PAM sequence: TTT
cagtcagggattttgattta

SEQ ID NO: 47042 - DNA, 20 bp, Artificial Sequence
  Description of Artificial Sequence: Synthetic oligonucleotide
  Target: SCN10A; (-) strand; PAM type: YTN; PAM sequence: TTT
tcagtcagggattttgattt

SEQ ID NO: 47043 - DNA, 20 bp, Artificial Sequence
  Description of Artificial Sequence: Synthetic oligonucleotide
  Target: SCN10A; (-) strand; PAM type: YTN; PAM sequence: TTT
ttcagtcagggattttgatt

SEQ ID NO: 47044 - DNA, 20 bp, Artificial Sequence
  Description of Artificial Sequence: Synthetic oligonucleotide
  Target: SCN10A; (-) strand; PAM type: YTN; PAM sequence: CTT
tttcagtcagggattttgat

SEQ ID NO: 47045 - DNA, 20 bp, Artificial Sequence
  Description of Artificial Sequence: Synthetic oligonucleotide
  Target: SCN10A; (-) strand; PAM type: YTN; PAM sequence: TTA
aacagtgaaaggctttttca

SEQ ID NO: 47046 - DNA, 20 bp, Artificial Sequence
  Description of Artificial Sequence: Synthetic oligonucleotide
  Target: SCN10A; (-) strand; PAM type: YTN; PAM sequence: TTT
aaacagtgaaaggctttttc

SEQ ID NO: 47047 - DNA, 20 bp, Artificial Sequence
  Description of Artificial Sequence: Synthetic oligonucleotide
  Target: SCN10A; (-) strand; PAM type: YTN; PAM sequence: TTA
aggtttaaacagtgaaaggc

SEQ ID NO: 47048 - DNA, 20 bp, Artificial Sequence
  Description of Artificial Sequence: Synthetic oligonucleotide
  Target: SCN10A; (-) strand; PAM type: YTN; PAM sequence: TTT
aaggtttaaacagtgaaagg

SEQ ID NO: 47049 - DNA, 20 bp, Artificial Sequence
  Description of Artificial Sequence: Synthetic oligonucleotide
  Target: SCN10A; (-) strand; PAM type: YTN; PAM sequence: TTT
taaggtttaaacagtgaaag

SEQ ID NO: 47050 - DNA, 20 bp, Artificial Sequence
  Description of Artificial Sequence: Synthetic oligonucleotide
  Target: SCN10A; (-) strand; PAM type: YTN; PAM sequence: TTG
ttttaaggtttaaacagtga

SEQ ID NO: 47051 - DNA, 20 bp, Artificial Sequence
  Description of Artificial Sequence: Synthetic oligonucleotide
  Target: SCN10A; (-) strand; PAM type: YTN; PAM sequence: TTT
gttttaaggtttaaacagtg

SEQ ID NO: 47052 - DNA, 20 bp, Artificial Sequence
  Description of Artificial Sequence: Synthetic oligonucleotide
  Target: SCN10A; (-) strand; PAM type: YTN; PAM sequence: TTG
tgggaaaatggaaagccaag

SEQ ID NO: 47053 - DNA, 20 bp, Artificial Sequence
  Description of Artificial Sequence: Synthetic oligonucleotide
  Target: SCN10A; (-) strand; PAM type: YTN; PAM sequence: CTT
gtgggaaaatggaaagccaa

SEQ ID NO: 47054 - DNA, 20 bp, Artificial Sequence
  Description of Artificial Sequence: Synthetic oligonucleotide
  Target: SCN10A; (-) strand; PAM type: YTN; PAM sequence: CTG
cttgtgggaaaatggaaagc

SEQ ID NO: 47055 - DNA, 20 bp, Artificial Sequence
  Description of Artificial Sequence: Synthetic oligonucleotide
  Target: SCN10A; (-) strand; PAM type: YTN; PAM sequence: CTC
ctgcttgtgggaaaatggaa

SEQ ID NO: 47056 - DNA, 20 bp, Artificial Sequence
  Description of Artificial Sequence: Synthetic oligonucleotide
  Target: SCN10A; (-) strand; PAM type: YTN; PAM sequence: TTG
cctcctgcttgtgggaaaat

SEQ ID NO: 47057 - DNA, 20 bp, Artificial Sequence
  Description of Artificial Sequence: Synthetic oligonucleotide
  Target: SCN10A; (-) strand; PAM type: YTN; PAM sequence: TTT
gcctcctgcttgtgggaaaa

SEQ ID NO: 47058 - DNA, 20 bp, Artificial Sequence
  Description of Artificial Sequence: Synthetic oligonucleotide
  Target: SCN10A; (-) strand; PAM type: YTN; PAM sequence: TTC
aaagtttgcctcctgcttgt

SEQ ID NO: 47059 - DNA, 20 bp, Artificial Sequence
  Description of Artificial Sequence: Synthetic oligonucleotide
  Target: SCN10A; (-) strand; PAM type: YTN; PAM sequence: CTT
caaagtttgcctcctgcttg

SEQ ID NO: 47060 - DNA, 20 bp, Artificial Sequence
  Description of Artificial Sequence: Synthetic oligonucleotide
  Target: SCN10A; (-) strand; PAM type: YTN; PAM sequence: CTG
aaggaggccaatataacttc

SEQ ID NO: 47061 - DNA, 20 bp, Artificial Sequence
  Description of Artificial Sequence: Synthetic oligonucleotide
  Target: SCN10A; (-) strand; PAM type: YTN; PAM sequence: TTG
ccatgcctgaaggaggccaa

SEQ ID NO: 47062 - DNA, 20 bp, Artificial Sequence
  Description of Artificial Sequence: Synthetic oligonucleotide
  Target: SCN10A; (-) strand; PAM type: YTN; PAM sequence: TTT
gccatgcctgaaggaggcca

SEQ ID NO: 47063 - DNA, 20 bp, Artificial Sequence
  Description of Artificial Sequence: Synthetic oligonucleotide
  Target: SCN10A; (-) strand; PAM type: YTN; PAM sequence: CTT
tgccatgcctgaaggaggcc

SEQ ID NO: 47064 - DNA, 20 bp, Artificial Sequence
  Description of Artificial Sequence: Synthetic oligonucleotide
  Target: SCN10A; (-) strand; PAM type: YTN; PAM sequence: CTC
caagaagtgactttgccatg

SEQ ID NO: 47065 - DNA, 20 bp, Artificial Sequence
  Description of Artificial Sequence: Synthetic oligonucleotide
  Target: SCN10A; (-) strand; PAM type: YTN; PAM sequence: CTA
ggtgggactccaagaagtga

SEQ ID NO: 47066 - DNA, 20 bp, Artificial Sequence
  Description of Artificial Sequence: Synthetic oligonucleotide
  Target: SCN10A; (-) strand; PAM type: YTN; PAM sequence: CTC
taggtgggactccaagaagt

SEQ ID NO: 47067 - DNA, 20 bp, Artificial Sequence
  Description of Artificial Sequence: Synthetic oligonucleotide
  Target: SCN10A; (-) strand; PAM type: YTN; PAM sequence: CTA
atgcaagccagacagctcta

SEQ ID NO: 47068 - DNA, 20 bp, Artificial Sequence
  Description of Artificial Sequence: Synthetic oligonucleotide
  Target: SCN10A; (-) strand; PAM type: YTN; PAM sequence: CTC
gtatcatagcctaatgcaag

SEQ ID NO: 47069 - DNA, 20 bp, Artificial Sequence
  Description of Artificial Sequence: Synthetic oligonucleotide
  Target: SCN10A; (-) strand; PAM type: YTN; PAM sequence: CTC
actcgtatcatagcctaatg

SEQ ID NO: 47070 - DNA, 20 bp, Artificial Sequence
  Description of Artificial Sequence: Synthetic oligonucleotide
  Target: SCN10A; (-) strand; PAM type: YTN; PAM sequence: TTC
tcactcgtatcatagcctaa

SEQ ID NO: 47071 - DNA, 20 bp, Artificial Sequence
  Description of Artificial Sequence: Synthetic oligonucleotide
  Target: SCN10A; (-) strand; PAM type: YTN; PAM sequence: TTT
ctcactcgtatcatagccta

SEQ ID NO: 47072 - DNA, 20 bp, Artificial Sequence
  Description of Artificial Sequence: Synthetic oligonucleotide
  Target: SCN10A; (-) strand; PAM type: YTN; PAM sequence: TTA
tttctcactcgtatcatagc

SEQ ID NO: 47073 - DNA, 20 bp, Artificial Sequence
  Description of Artificial Sequence: Synthetic oligonucleotide
  Target: SCN10A; (-) strand; PAM type: YTN; PAM sequence: TTT
atttctcactcgtatcatag

SEQ ID NO: 47074 - DNA, 20 bp, Artificial Sequence
  Description of Artificial Sequence: Synthetic oligonucleotide
  Target: SCN10A; (-) strand; PAM type: YTN; PAM sequence: CTG
accccaataaaggtttattt

SEQ ID NO: 47075 - DNA, 20 bp, Artificial Sequence
  Description of Artificial Sequence: Synthetic oligonucleotide
  Target: SCN10A; (-) strand; PAM type: YTN; PAM sequence: CTG
agtaactgaccccaataaag

SEQ ID NO: 47076 - DNA, 20 bp, Artificial Sequence
  Description of Artificial Sequence: Synthetic oligonucleotide
  Target: SCN10A; (-) strand; PAM type: YTN; PAM sequence: CTA
aaactgagtaactgacccca

SEQ ID NO: 47077 - DNA, 20 bp, Artificial Sequence
  Description of Artificial Sequence: Synthetic oligonucleotide
  Target: SCN10A; (-) strand; PAM type: YTN; PAM sequence: CTC
taaaactgagtaactgaccc

SEQ ID NO: 47078 - DNA, 20 bp, Artificial Sequence
  Description of Artificial Sequence: Synthetic oligonucleotide
  Target: SCN10A; (-) strand; PAM type: YTN; PAM sequence: TTA
tacagacaatctctaaaact

SEQ ID NO: 47079 - DNA, 20 bp, Artificial Sequence
  Description of Artificial Sequence: Synthetic oligonucleotide
  Target: SCN10A; (-) strand; PAM type: YTN; PAM sequence: CTA
ttatacagacaatctctaaa

SEQ ID NO: 47080 - DNA, 20 bp, Artificial Sequence
  Description of Artificial Sequence: Synthetic oligonucleotide
  Target: SCN10A; (-) strand; PAM type: YTN; PAM sequence: CTA
cctattatacagacaatctc

SEQ ID NO: 47081 - DNA, 20 bp, Artificial Sequence
  Description of Artificial Sequence: Synthetic oligonucleotide
  Target: SCN10A; (-) strand; PAM type: YTN; PAM sequence: TTA
atcaatgaaaaataaagcta

SEQ ID NO: 47082 - DNA, 20 bp, Artificial Sequence
  Description of Artificial Sequence: Synthetic oligonucleotide
  Target: SCN10A; (-) strand; PAM type: YTN; PAM sequence: TTA
ttaatcaatgaaaaataaag

SEQ ID NO: 47083 - DNA, 20 bp, Artificial Sequence
  Description of Artificial Sequence: Synthetic oligonucleotide
  Target: SCN10A; (-) strand; PAM type: YTN; PAM sequence: TTT
attaatcaatgaaaaataaa

SEQ ID NO: 47084 - DNA, 20 bp, Artificial Sequence
  Description of Artificial Sequence: Synthetic oligonucleotide
  Target: SCN10A; (-) strand; PAM type: YTN; PAM sequence: TTT
tattaatcaatgaaaaataa

SEQ ID NO: 47085 - DNA, 20 bp, Artificial Sequence
  Description of Artificial Sequence: Synthetic oligonucleotide
  Target: SCN10A; (-) strand; PAM type: YTN; PAM sequence: TTT
ttattaatcaatgaaaaata

SEQ ID NO: 47086 - DNA, 20 bp, Artificial Sequence
  Description of Artificial Sequence: Synthetic oligonucleotide
  Target: SCN10A; (-) strand; PAM type: YTN; PAM sequence: TTA
taaaaatttttattaatcaa

SEQ ID NO: 47087 - DNA, 20 bp, Artificial Sequence
  Description of Artificial Sequence: Synthetic oligonucleotide
  Target: SCN10A; (-) strand; PAM type: YTN; PAM sequence: TTT
ataaaaatttttattaatca

SEQ ID NO: 47088 - DNA, 20 bp, Artificial Sequence
  Description of Artificial Sequence: Synthetic oligonucleotide
  Target: SCN10A; (-) strand; PAM type: YTN; PAM sequence: TTG
tttataaaaatttttattaa

SEQ ID NO: 47089 - DNA, 20 bp, Artificial Sequence
  Description of Artificial Sequence: Synthetic oligonucleotide
  Target: SCN10A; (-) strand; PAM type: YTN; PAM sequence: CTT
gtttataaaaatttttatta

SEQ ID NO: 47090 - DNA, 20 bp, Artificial Sequence
  Description of Artificial Sequence: Synthetic oligonucleotide
  Target: SCN10A; (-) strand; PAM type: YTN; PAM sequence: TTA
tcttgtttataaaaattttt

SEQ ID NO: 47091 - DNA, 20 bp, Artificial Sequence
  Description of Artificial Sequence: Synthetic oligonucleotide
  Target: SCN10A; (-) strand; PAM type: YTN; PAM sequence: TTT
atcttgtttataaaaatttt

SEQ ID NO: 47092 - DNA, 20 bp, Artificial Sequence
  Description of Artificial Sequence: Synthetic oligonucleotide
  Target: SCN10A; (-) strand; PAM type: YTN; PAM sequence: TTT
tatcttgtttataaaaattt

SEQ ID NO: 47093 - DNA, 20 bp, Artificial Sequence
  Description of Artificial Sequence: Synthetic oligonucleotide
  Target: SCN10A; (-) strand; PAM type: YTN; PAM sequence: TTA
attttatcttgtttataaaa

SEQ ID NO: 47094 - DNA, 20 bp, Artificial Sequence
  Description of Artificial Sequence: Synthetic oligonucleotide
  Target: SCN10A; (-) strand; PAM type: YTN; PAM sequence: TTT
aattttatcttgtttataaa

SEQ ID NO: 47095 - DNA, 20 bp, Artificial Sequence
  Description of Artificial Sequence: Synthetic oligonucleotide
  Target: SCN10A; (-) strand; PAM type: YTN; PAM sequence: TTT
taattttatcttgtttataa

SEQ ID NO: 47096 - DNA, 20 bp, Artificial Sequence
  Description of Artificial Sequence: Synthetic oligonucleotide
  Target: SCN10A; (-) strand; PAM type: YTN; PAM sequence: TTG
taatgataagtattttaatt

SEQ ID NO: 47097 - DNA, 20 bp, Artificial Sequence
  Description of Artificial Sequence: Synthetic oligonucleotide
  Target: SCN10A; (-) strand; PAM type: YTN; PAM sequence: TTA
ttgtaatgataagtatttta

SEQ ID NO: 47098 - DNA, 20 bp, Artificial Sequence
  Description of Artificial Sequence: Synthetic oligonucleotide
  Target: SCN10A; (-) strand; PAM type: YTN; PAM sequence: TTT
attgtaatgataagtatttt

SEQ ID NO: 47099 - DNA, 20 bp, Artificial Sequence
  Description of Artificial Sequence: Synthetic oligonucleotide
  Target: SCN10A; (-) strand; PAM type: YTN; PAM sequence: TTC
ccaatttattgtaatgataa

SEQ ID NO: 47100 - DNA, 20 bp, Artificial Sequence
  Description of Artificial Sequence: Synthetic oligonucleotide
  Target: SCN10A; (-) strand; PAM type: YTN; PAM sequence: TTT
cccaatttattgtaatgata

SEQ ID NO: 47101 - DNA, 20 bp, Artificial Sequence
  Description of Artificial Sequence: Synthetic oligonucleotide
  Target: SCN10A; (-) strand; PAM type: YTN; PAM sequence: CTT
tcccaatttattgtaatgat

SEQ ID NO: 47102 - DNA, 20 bp, Artificial Sequence
  Description of Artificial Sequence: Synthetic oligonucleotide
  Target: SCN10A; (-) strand; PAM type: YTN; PAM sequence: TTC
cagatatcctttcccaattt

SEQ ID NO: 47103 - DNA, 20 bp, Artificial Sequence
  Description of Artificial Sequence: Synthetic oligonucleotide
  Target: SCN10A; (-) strand; PAM type: YTN; PAM sequence: TTC
attccagatatcctttccca

SEQ ID NO: 47104 - DNA, 20 bp, Artificial Sequence
  Description of Artificial Sequence: Synthetic oligonucleotide
  Target: SCN10A; (-) strand; PAM type: YTN; PAM sequence: TTT
cattccagatatcctttccc

SEQ ID NO: 47105 - DNA, 20 bp, Artificial Sequence
  Description of Artificial Sequence: Synthetic oligonucleotide
  Target: SCN10A; (-) strand; PAM type: YTN; PAM sequence: TTT
tcattccagatatcctttcc

SEQ ID NO: 47106 - DNA, 20 bp, Artificial Sequence
  Description of Artificial Sequence: Synthetic oligonucleotide
  Target: SCN10A; (-) strand; PAM type: YTN; PAM sequence: CTT
ttcattccagatatcctttc

SEQ ID NO: 47107 - DNA, 20 bp, Artificial Sequence
  Description of Artificial Sequence: Synthetic oligonucleotide
  Target: SCN10A; (-) strand; PAM type: YTN; PAM sequence: CTC
caagacaacttttcattcca

SEQ ID NO: 47108 - DNA, 20 bp, Artificial Sequence
  Description of Artificial Sequence: Synthetic oligonucleotide
  Target: SCN10A; (-) strand; PAM type: YTN; PAM sequence: TTC
ctccaagacaacttttcatt

SEQ ID NO: 47109 - DNA, 20 bp, Artificial Sequence
  Description of Artificial Sequence: Synthetic oligonucleotide
  Target: SCN10A; (-) strand; PAM type: YTN; PAM sequence: CTT
cctccaagacaacttttcat

SEQ ID NO: 47110 - DNA, 20 bp, Artificial Sequence
  Description of Artificial Sequence: Synthetic oligonucleotide
  Target: SCN10A; (-) strand; PAM type: YTN; PAM sequence: TTA
accttcctccaagacaactt

SEQ ID NO: 47111 - DNA, 20 bp, Artificial Sequence
  Description of Artificial Sequence: Synthetic oligonucleotide
  Target: SCN10A; (-) strand; PAM type: YTN; PAM sequence: TTT
aaccttcctccaagacaact

SEQ ID NO: 47112 - DNA, 20 bp, Artificial Sequence
  Description of Artificial Sequence: Synthetic oligonucleotide
  Target: SCN10A; (-) strand; PAM type: YTN; PAM sequence: CTT
taaccttcctccaagacaac

SEQ ID NO: 47113 - DNA, 20 bp, Artificial Sequence
  Description of Artificial Sequence: Synthetic oligonucleotide
  Target: SCN10A; (-) strand; PAM type: YTN; PAM sequence: CTA
aaatctttaaccttcctcca

SEQ ID NO: 47114 - DNA, 20 bp, Artificial Sequence
  Description of Artificial Sequence: Synthetic oligonucleotide
  Target: SCN10A; (-) strand; PAM type: YTN; PAM sequence: TTA
gctaaaatctttaaccttcc

SEQ ID NO: 47115 - DNA, 20 bp, Artificial Sequence
  Description of Artificial Sequence: Synthetic oligonucleotide
  Target: SCN10A; (-) strand; PAM type: YTN; PAM sequence: TTA
atcaaagccaaaagttagct

SEQ ID NO: 47116 - DNA, 20 bp, Artificial Sequence
  Description of Artificial Sequence: Synthetic oligonucleotide
  Target: SCN10A; (-) strand; PAM type: YTN; PAM sequence: CTT
aatcaaagccaaaagttagc

SEQ ID NO: 47117 - DNA, 20 bp, Artificial Sequence
  Description of Artificial Sequence: Synthetic oligonucleotide
  Target: SCN10A; (-) strand; PAM type: YTN; PAM sequence: TTA
acttaatcaaagccaaaagt

SEQ ID NO: 47118 - DNA, 20 bp, Artificial Sequence
  Description of Artificial Sequence: Synthetic oligonucleotide
  Target: SCN10A; (-) strand; PAM type: YTN; PAM sequence: TTA
gttaacttaatcaaagccaa

SEQ ID NO: 47119 - DNA, 20 bp, Artificial Sequence
  Description of Artificial Sequence: Synthetic oligonucleotide
  Target: SCN10A; (-) strand; PAM type: YTN; PAM sequence: CTC
cattagttaacttaatcaaa

SEQ ID NO: 47120 - DNA, 20 bp, Artificial Sequence
  Description of Artificial Sequence: Synthetic oligonucleotide
  Target: SCN10A; (-) strand; PAM type: YTN; PAM sequence: CTC
tccattagttaacttaatca

SEQ ID NO: 47121 - DNA, 20 bp, Artificial Sequence
  Description of Artificial Sequence: Synthetic oligonucleotide
  Target: SCN10A; (-) strand; PAM type: YTN; PAM sequence: TTA
actctccattagttaactta

SEQ ID NO: 47122 - DNA, 20 bp, Artificial Sequence
  Description of Artificial Sequence: Synthetic oligonucleotide
  Target: SCN10A; (-) strand; PAM type: YTN; PAM sequence: TTA
cagcataaattaactctcca

SEQ ID NO: 47123 - DNA, 20 bp, Artificial Sequence
  Description of Artificial Sequence: Synthetic oligonucleotide
  Target: SCN10A; (-) strand; PAM type: YTN; PAM sequence: CTG
cagaaattacagcataaatt

SEQ ID NO: 47124 - DNA, 20 bp, Artificial Sequence
  Description of Artificial Sequence: Synthetic oligonucleotide
  Target: SCN10A; (-) strand; PAM type: YTN; PAM sequence: TTG
agcccaggaggtcgtggctg

SEQ ID NO: 47125 - DNA, 20 bp, Artificial Sequence
  Description of Artificial Sequence: Synthetic oligonucleotide
  Target: SCN10A; (-) strand; PAM type: YTN; PAM sequence: CTT
gagcccaggaggtcgtggct

SEQ ID NO: 47126 - DNA, 20 bp, Artificial Sequence
  Description of Artificial Sequence: Synthetic oligonucleotide
  Target: SCN10A; (-) strand; PAM type: YTN; PAM sequence: CTG
aggtgggaggatgacttgag

SEQ ID NO: 47127 - DNA, 20 bp, Artificial Sequence
  Description of Artificial Sequence: Synthetic oligonucleotide
  Target: SCN10A; (-) strand; PAM type: YTN; PAM sequence: TTG
ggaggctgaggtgggaggat

SEQ ID NO: 47128 - DNA, 20 bp, Artificial Sequence
  Description of Artificial Sequence: Synthetic oligonucleotide
  Target: SCN10A; (-) strand; PAM type: YTN; PAM sequence: TTT
gggaggctgaggtgggagga

SEQ ID NO: 47129 - DNA, 20 bp, Artificial Sequence
  Description of Artificial Sequence: Synthetic oligonucleotide
  Target: SCN10A; (-) strand; PAM type: YTN; PAM sequence: CTA
tttgggaggctgaggtggga

SEQ ID NO: 47130 - DNA, 20 bp, Artificial Sequence
  Description of Artificial Sequence: Synthetic oligonucleotide
  Target: SCN10A; (-) strand; PAM type: YTN; PAM sequence: CTC
agctatttgggaggctgagg

SEQ ID NO: 47131 - DNA, 20 bp, Artificial Sequence
  Description of Artificial Sequence: Synthetic oligonucleotide
  Target: SCN10A; (-) strand; PAM type: YTN; PAM sequence: CTG
tagtctcagctatttgggag

SEQ ID NO: 47132 - DNA, 20 bp, Artificial Sequence
  Description of Artificial Sequence: Synthetic oligonucleotide
  Target: SCN10A; (-) strand; PAM type: YTN; PAM sequence: CTG
ggcatgatggcacgtgtctg

SEQ ID NO: 47133 - DNA, 20 bp, Artificial Sequence
  Description of Artificial Sequence: Synthetic oligonucleotide
  Target: SCN10A; (-) strand; PAM type: YTN; PAM sequence: TTA
gctgggcatgatggcacgtg

SEQ ID NO: 47134 - DNA, 20 bp, Artificial Sequence
  Description of Artificial Sequence: Synthetic oligonucleotide
  Target: SCN10A; (-) strand; PAM type: YTN; PAM sequence: TTA
aaaaagaaaaggaaagaaat

SEQ ID NO: 47135 - DNA, 20 bp, Artificial Sequence
  Description of Artificial Sequence: Synthetic oligonucleotide
  Target: SCN10A; (-) strand; PAM type: YTN; PAM sequence: TTT
aaaaaagaaaaggaaagaaa

SEQ ID NO: 47136 - DNA, 20 bp, Artificial Sequence
  Description of Artificial Sequence: Synthetic oligonucleotide
  Target: SCN10A; (-) strand; PAM type: YTN; PAM sequence: TTA
aatttaaaaaagaaaaggaa

SEQ ID NO: 47137 - DNA, 20 bp, Artificial Sequence
  Description of Artificial Sequence: Synthetic oligonucleotide
  Target: SCN10A; (-) strand; PAM type: YTN; PAM sequence: TTT
aaatttaaaaaagaaaagga

SEQ ID NO: 47138 - DNA, 20 bp, Artificial Sequence
  Description of Artificial Sequence: Synthetic oligonucleotide
  Target: SCN10A; (-) strand; PAM type: YTN; PAM sequence: TTT
taaatttaaaaaagaaaagg

SEQ ID NO: 47139 - DNA, 20 bp, Artificial Sequence
  Description of Artificial Sequence: Synthetic oligonucleotide
  Target: SCN10A; (-) strand; PAM type: YTN; PAM sequence: CTC
aaaaataaataaataaataa

SEQ ID NO: 47140 - DNA, 20 bp, Artificial Sequence
  Description of Artificial Sequence: Synthetic oligonucleotide
  Target: SCN10A; (-) strand; PAM type: YTN; PAM sequence: CTC
catctcaaaaataaataaat

SEQ ID NO: 47141 - DNA, 20 bp, Artificial Sequence
  Description of Artificial Sequence: Synthetic oligonucleotide
  Target: SCN10A; (-) strand; PAM type: YTN; PAM sequence: CTG
ggcaacaagggcaaaactcc

SEQ ID NO: 47142 - DNA, 20 bp, Artificial Sequence
  Description of Artificial Sequence: Synthetic oligonucleotide
  Target: SCN10A; (-) strand; PAM type: YTN; PAM sequence: CTC
cagcctgggcaacaagggca

SEQ ID NO: 47143 - DNA, 20 bp, Artificial Sequence
  Description of Artificial Sequence: Synthetic oligonucleotide
  Target: SCN10A; (-) strand; PAM type: YTN; PAM sequence: TTG
cactccagcctgggcaacaa

SEQ ID NO: 47144 - DNA, 20 bp, Artificial Sequence
  Description of Artificial Sequence: Synthetic oligonucleotide
  Target: SCN10A; (-) strand; PAM type: YTN; PAM sequence: TTG
caccattgcactccagcctg

SEQ ID NO: 47145 - DNA, 20 bp, Artificial Sequence
  Description of Artificial Sequence: Synthetic oligonucleotide
  Target: SCN10A; (-) strand; PAM type: YTN; PAM sequence: CTG
agattgcaccattgcactcc

SEQ ID NO: 47146 - DNA, 20 bp, Artificial Sequence
  Description of Artificial Sequence: Synthetic oligonucleotide
  Target: SCN10A; (-) strand; PAM type: YTN; PAM sequence: TTG
cggtgagctgagattgcacc

SEQ ID NO: 47147 - DNA, 20 bp, Artificial Sequence
  Description of Artificial Sequence: Synthetic oligonucleotide
  Target: SCN10A; (-) strand; PAM type: YTN; PAM sequence: TTG
aacccgggaggcggaggttg

SEQ ID NO: 47148 - DNA, 20 bp, Artificial Sequence
  Description of Artificial Sequence: Synthetic oligonucleotide
  Target: SCN10A; (-) strand; PAM type: YTN; PAM sequence: CTT
gaacccgggaggcggaggtt

SEQ ID NO: 47149 - DNA, 20 bp, Artificial Sequence
  Description of Artificial Sequence: Synthetic oligonucleotide
  Target: SCN10A; (-) strand; PAM type: YTN; PAM sequence: TTG
cttgaacccgggaggcggag

SEQ ID NO: 47150 - DNA, 20 bp, Artificial Sequence
  Description of Artificial Sequence: Synthetic oligonucleotide
  Target: SCN10A; (-) strand; PAM type: YTN; PAM sequence: CTG
agggaggagaattgcttgaa

SEQ ID NO: 47151 - DNA, 20 bp, Artificial Sequence
  Description of Artificial Sequence: Synthetic oligonucleotide
  Target: SCN10A; (-) strand; PAM type: YTN; PAM sequence: TTG
ggaggctgagggaggagaat

SEQ ID NO: 47152 - DNA, 20 bp, Artificial Sequence
  Description of Artificial Sequence: Synthetic oligonucleotide
  Target: SCN10A; (-) strand; PAM type: YTN; PAM sequence: CTT
gggaggctgagggaggagaa

SEQ ID NO: 47153 - DNA, 20 bp, Artificial Sequence
  Description of Artificial Sequence: Synthetic oligonucleotide
  Target: SCN10A; (-) strand; PAM type: YTN; PAM sequence: CTA
cttgggaggctgagggagga

SEQ ID NO: 47154 - DNA, 20 bp, Artificial Sequence
  Description of Artificial Sequence: Synthetic oligonucleotide
  Target: SCN10A; (-) strand; PAM type: YTN; PAM sequence: TTA
atcccagctacttgggaggc

SEQ ID NO: 47155 - DNA, 20 bp, Artificial Sequence
  Description of Artificial Sequence: Synthetic oligonucleotide
  Target: SCN10A; (-) strand; PAM type: YTN; PAM sequence: TTT
aatcccagctacttgggagg

SEQ ID NO: 47156 - DNA, 20 bp, Artificial Sequence
  Description of Artificial Sequence: Synthetic oligonucleotide
  Target: SCN10A; (-) strand; PAM type: YTN; PAM sequence: TTT
taatcccagctacttgggag

SEQ ID NO: 47157 - DNA, 20 bp, Artificial Sequence
  Description of Artificial Sequence: Synthetic oligonucleotide
  Target: SCN10A; (-) strand; PAM type: YTN; PAM sequence: CTT
ttaatcccagctacttggga

SEQ ID NO: 47158 - DNA, 20 bp, Artificial Sequence
  Description of Artificial Sequence: Synthetic oligonucleotide
  Target: SCN10A; (-) strand; PAM type: YTN; PAM sequence: TTA
gccaggtgtgatggtgcata

SEQ ID NO: 47159 - DNA, 20 bp, Artificial Sequence
  Description of Artificial Sequence: Synthetic oligonucleotide
  Target: SCN10A; (-) strand; PAM type: YTN; PAM sequence: CTA
ccaaaaatacaaaattagcc

SEQ ID NO: 47160 - DNA, 20 bp, Artificial Sequence
  Description of Artificial Sequence: Synthetic oligonucleotide
  Target: SCN10A; (-) strand; PAM type: YTN; PAM sequence: CTC
taccaaaaatacaaaattag

SEQ ID NO: 47161 - DNA, 20 bp, Artificial Sequence
  Description of Artificial Sequence: Synthetic oligonucleotide
  Target: SCN10A; (-) strand; PAM type: YTN; PAM sequence: CTG
accaacatggagaagaccca

SEQ ID NO: 47162 - DNA, 20 bp, Artificial Sequence
  Description of Artificial Sequence: Synthetic oligonucleotide
  Target: SCN10A; (-) strand; PAM type: YTN; PAM sequence: TTC
gagaccagcctgaccaacat

SEQ ID NO: 47163 - DNA, 20 bp, Artificial Sequence
  Description of Artificial Sequence: Synthetic oligonucleotide
  Target: SCN10A; (-) strand; PAM type: YTN; PAM sequence: CTG
aggtcgggagttcgagacca

SEQ ID NO: 47164 - DNA, 20 bp, Artificial Sequence
  Description of Artificial Sequence: Synthetic oligonucleotide
  Target: SCN10A; (-) strand; PAM type: YTN; PAM sequence: TTG
gaggcgcaggcaggcggatc

SEQ ID NO: 47165 - DNA, 20 bp, Artificial Sequence
  Description of Artificial Sequence: Synthetic oligonucleotide
  Target: SCN10A; (-) strand; PAM type: YTN; PAM sequence: CTG
ttggaggcgcaggcaggcgg

SEQ ID NO: 47166 - DNA, 20 bp, Artificial Sequence
  Description of Artificial Sequence: Synthetic oligonucleotide
  Target: SCN10A; (-) strand; PAM type: YTN; PAM sequence: CTG
taatcccagcactgttggag

SEQ ID NO: 47167 - DNA, 20 bp, Artificial Sequence
  Description of Artificial Sequence: Synthetic oligonucleotide
  Target: SCN10A; (-) strand; PAM type: YTN; PAM sequence: TTA
atgcctgtaatcccagcact

SEQ ID NO: 47168 - DNA, 20 bp, Artificial Sequence
  Description of Artificial Sequence: Synthetic oligonucleotide
  Target: SCN10A; (-) strand; PAM type: YTN; PAM sequence: TTG
aaaacaataaaaagaaggcc

SEQ ID NO: 47169 - DNA, 20 bp, Artificial Sequence
  Description of Artificial Sequence: Synthetic oligonucleotide
  Target: SCN10A; (-) strand; PAM type: YTN; PAM sequence: CTC
attgaaaacaataaaaagaa

SEQ ID NO: 47170 - DNA, 20 bp, Artificial Sequence
  Description of Artificial Sequence: Synthetic oligonucleotide
  Target: SCN10A; (-) strand; PAM type: YTN; PAM sequence: CTC
cgtctcattgaaaacaataa

SEQ ID NO: 47171 - DNA, 20 bp, Artificial Sequence
  Description of Artificial Sequence: Synthetic oligonucleotide
  Target: SCN10A; (-) strand; PAM type: YTN; PAM sequence: CTG
ggcaacagagcgagactccg

SEQ ID NO: 47172 - DNA, 20 bp, Artificial Sequence
  Description of Artificial Sequence: Synthetic oligonucleotide
  Target: SCN10A; (-) strand; PAM type: YTN; PAM sequence: CTC
cagcctgggcaacagagcga

SEQ ID NO: 47173 - DNA, 20 bp, Artificial Sequence
  Description of Artificial Sequence: Synthetic oligonucleotide
  Target: SCN10A; (-) strand; PAM type: YTN; PAM sequence: CTG
cactccagcctgggcaacag

SEQ ID NO: 47174 - DNA, 20 bp, Artificial Sequence
  Description of Artificial Sequence: Synthetic oligonucleotide
  Target: SCN10A; (-) strand; PAM type: YTN; PAM sequence: CTG
agatcatgccactgcactcc

SEQ ID NO: 47175 - DNA, 20 bp, Artificial Sequence
  Description of Artificial Sequence: Synthetic oligonucleotide
  Target: SCN10A; (-) strand; PAM type: YTN; PAM sequence: TTG
cagtgagctgagatcatgcc

SEQ ID NO: 47176 - DNA, 20 bp, Artificial Sequence
  Description of Artificial Sequence: Synthetic oligonucleotide
  Target: SCN10A; (-) strand; PAM type: YTN; PAM sequence: TTG
aatcccagagacagaggttg

SEQ ID NO: 47177 - DNA, 20 bp, Artificial Sequence
  Description of Artificial Sequence: Synthetic oligonucleotide
  Target: SCN10A; (-) strand; PAM type: YTN; PAM sequence: CTT
gaatcccagagacagaggtt

SEQ ID NO: 47178 - DNA, 20 bp, Artificial Sequence
  Description of Artificial Sequence: Synthetic oligonucleotide
  Target: SCN10A; (-) strand; PAM type: YTN; PAM sequence: TTG
cttgaatcccagagacagag

SEQ ID NO: 47179 - DNA, 20 bp, Artificial Sequence
  Description of Artificial Sequence: Synthetic oligonucleotide
  Target: SCN10A; (-) strand; PAM type: YTN; PAM sequence: CTC
aggagggtgaggcatgagaa

SEQ ID NO: 47180 - DNA, 20 bp, Artificial Sequence
  Description of Artificial Sequence: Synthetic oligonucleotide
  Target: SCN10A; (-) strand; PAM type: YTN; PAM sequence: CTA
ctcaggagggtgaggcatga

SEQ ID NO: 47181 - DNA, 20 bp, Artificial Sequence
  Description of Artificial Sequence: Synthetic oligonucleotide
  Target: SCN10A; (-) strand; PAM type: YTN; PAM sequence: CTG
taatcccagctactcaggag

SEQ ID NO: 47182 - DNA, 20 bp, Artificial Sequence
  Description of Artificial Sequence: Synthetic oligonucleotide
  Target: SCN10A; (-) strand; PAM type: YTN; PAM sequence: CTG
ggtgtggtggcacacacctg

SEQ ID NO: 47183 - DNA, 20 bp, Artificial Sequence
  Description of Artificial Sequence: Synthetic oligonucleotide
  Target: SCN10A; (-) strand; PAM type: YTN; PAM sequence: TTA
gctgggtgtggtggcacaca

SEQ ID NO: 47184 - DNA, 20 bp, Artificial Sequence
  Description of Artificial Sequence: Synthetic oligonucleotide
  Target: SCN10A; (-) strand; PAM type: YTN; PAM sequence: CTA
aaaatatataaattagctgg

SEQ ID NO: 47185 - DNA, 20 bp, Artificial Sequence
  Description of Artificial Sequence: Synthetic oligonucleotide
  Target: SCN10A; (-) strand; PAM type: YTN; PAM sequence: CTA
ctaaaaatatataaattagc

SEQ ID NO: 47186 - DNA, 20 bp, Artificial Sequence
  Description of Artificial Sequence: Synthetic oligonucleotide
  Target: SCN10A; (-) strand; PAM type: YTN; PAM sequence: CTC
tactaaaaatatataaatta

SEQ ID NO: 47187 - DNA, 20 bp, Artificial Sequence
  Description of Artificial Sequence: Synthetic oligonucleotide
  Target: SCN10A; (-) strand; PAM type: YTN; PAM sequence: CTG
gccaacaggagaaaacccca

SEQ ID NO: 47188 - DNA, 20 bp, Artificial Sequence
  Description of Artificial Sequence: Synthetic oligonucleotide
  Target: SCN10A; (-) strand; PAM type: YTN; PAM sequence: TTG
gagaccagcctggccaacag

SEQ ID NO: 47189 - DNA, 20 bp, Artificial Sequence
  Description of Artificial Sequence: Synthetic oligonucleotide
  Target: SCN10A; (-) strand; PAM type: YTN; PAM sequence: TTG
aggacaggagttggagacca

SEQ ID NO: 47190 - DNA, 20 bp, Artificial Sequence
  Description of Artificial Sequence: Synthetic oligonucleotide
  Target: SCN10A; (-) strand; PAM type: YTN; PAM sequence: CTT
gaggacaggagttggagacc

SEQ ID NO: 47191 - DNA, 20 bp, Artificial Sequence
  Description of Artificial Sequence: Synthetic oligonucleotide
  Target: SCN10A; (-) strand; PAM type: YTN; PAM sequence: TTG
cttgaggacaggagttggag

SEQ ID NO: 47192 - DNA, 20 bp, Artificial Sequence
  Description of Artificial Sequence: Synthetic oligonucleotide
  Target: SCN10A; (-) strand; PAM type: YTN; PAM sequence: TTG
ggaggccaaggtgggaggat

SEQ ID NO: 47193 - DNA, 20 bp, Artificial Sequence
  Description of Artificial Sequence: Synthetic oligonucleotide
  Target: SCN10A; (-) strand; PAM type: YTN; PAM sequence: TTT
gggaggccaaggtgggagga

SEQ ID NO: 47194 - DNA, 20 bp, Artificial Sequence
  Description of Artificial Sequence: Synthetic oligonucleotide
  Target: SCN10A; (-) strand; PAM type: YTN; PAM sequence: TTT
tgggaggccaaggtgggagg

SEQ ID NO: 47195 - DNA, 20 bp, Artificial Sequence
  Description of Artificial Sequence: Synthetic oligonucleotide
  Target: SCN10A; (-) strand; PAM type: YTN; PAM sequence: CTG
taatcccagaattttgggag

SEQ ID NO: 47196 - DNA, 20 bp, Artificial Sequence
  Description of Artificial Sequence: Synthetic oligonucleotide
  Target: SCN10A; (-) strand; PAM type: YTN; PAM sequence: CTC
acgcctgtaatcccagaatt

SEQ ID NO: 47197 - DNA, 20 bp, Artificial Sequence
  Description of Artificial Sequence: Synthetic oligonucleotide
  Target: SCN10A; (-) strand; PAM type: YTN; PAM sequence: TTA
aagccaagggggccaggtgg

SEQ ID NO: 47198 - DNA, 20 bp, Artificial Sequence
  Description of Artificial Sequence: Synthetic oligonucleotide
  Target: SCN10A; (-) strand; PAM type: YTN; PAM sequence: TTT
aaagccaagggggccaggtg

SEQ ID NO: 47199 - DNA, 20 bp, Artificial Sequence
  Description of Artificial Sequence: Synthetic oligonucleotide
  Target: SCN10A; (-) strand; PAM type: YTN; PAM sequence: TTT
taaagccaagggggccaggt

SEQ ID NO: 47200 - DNA, 20 bp, Artificial Sequence
  Description of Artificial Sequence: Synthetic oligonucleotide
  Target: SCN10A; (-) strand; PAM type: YTN; PAM sequence: TTT
ttaaagccaagggggccagg

SEQ ID NO: 47201 - DNA, 20 bp, Artificial Sequence
  Description of Artificial Sequence: Synthetic oligonucleotide
  Target: SCN10A; (-) strand; PAM type: YTN; PAM sequence: TTT
tttaaagccaagggggccag

SEQ ID NO: 47202 - DNA, 20 bp, Artificial Sequence
  Description of Artificial Sequence: Synthetic oligonucleotide
  Target: SCN10A; (-) strand; PAM type: YTN; PAM sequence: TTT
ttttaaagccaagggggcca

SEQ ID NO: 47203 - DNA, 20 bp, Artificial Sequence
  Description of Artificial Sequence: Synthetic oligonucleotide
  Target: SCN10A; (-) strand; PAM type: YTN; PAM sequence: TTT
tttttaaagccaagggggcc

SEQ ID NO: 47204 - DNA, 20 bp, Artificial Sequence
  Description of Artificial Sequence: Synthetic oligonucleotide
  Target: SCN10A; (-) strand; PAM type: YTN; PAM sequence: TTT
ttttttaaagccaagggggc

SEQ ID NO: 47205 - DNA, 20 bp, Artificial Sequence
  Description of Artificial Sequence: Synthetic oligonucleotide
  Target: SCN10A; (-) strand; PAM type: YTN; PAM sequence: TTT
tttttttaaagccaaggggg

SEQ ID NO: 47206 - DNA, 20 bp, Artificial Sequence
  Description of Artificial Sequence: Synthetic oligonucleotide
  Target: SCN10A; (-) strand; PAM type: YTN; PAM sequence: TTA
tgccattttttttttaaagc

SEQ ID NO: 47207 - DNA, 20 bp, Artificial Sequence
  Description of Artificial Sequence: Synthetic oligonucleotide
  Target: SCN10A; (-) strand; PAM type: YTN; PAM sequence: TTC
caagattatgccattttttt

SEQ ID NO: 47208 - DNA, 20 bp, Artificial Sequence
  Description of Artificial Sequence: Synthetic oligonucleotide
  Target: SCN10A; (-) strand; PAM type: YTN; PAM sequence: TTG
gtatcaaggttccaagatta

SEQ ID NO: 47209 - DNA, 20 bp, Artificial Sequence
  Description of Artificial Sequence: Synthetic oligonucleotide
  Target: SCN10A; (-) strand; PAM type: YTN; PAM sequence: TTT
ggtatcaaggttccaagatt

SEQ ID NO: 47210 - DNA, 20 bp, Artificial Sequence
  Description of Artificial Sequence: Synthetic oligonucleotide
  Target: SCN10A; (-) strand; PAM type: YTN; PAM sequence: TTT
tggtatcaaggttccaagat

SEQ ID NO: 47211 - DNA, 20 bp, Artificial Sequence
  Description of Artificial Sequence: Synthetic oligonucleotide
  Target: SCN10A; (-) strand; PAM type: YTN; PAM sequence: TTG
ccaggttttggtatcaaggt

SEQ ID NO: 47212 - DNA, 20 bp, Artificial Sequence
  Description of Artificial Sequence: Synthetic oligonucleotide
  Target: SCN10A; (-) strand; PAM type: YTN; PAM sequence: CTT
gccaggttttggtatcaagg

SEQ ID NO: 47213 - DNA, 20 bp, Artificial Sequence
  Description of Artificial Sequence: Synthetic oligonucleotide
  Target: SCN10A; (-) strand; PAM type: YTN; PAM sequence: TTG
tccttgccaggttttggtat

SEQ ID NO: 47214 - DNA, 20 bp, Artificial Sequence
  Description of Artificial Sequence: Synthetic oligonucleotide
  Target: SCN10A; (-) strand; PAM type: YTN; PAM sequence: TTC
attgtccttgccaggttttg

SEQ ID NO: 47215 - DNA, 20 bp, Artificial Sequence
  Description of Artificial Sequence: Synthetic oligonucleotide
  Target: SCN10A; (-) strand; PAM type: YTN; PAM sequence: TTT
cattgtccttgccaggtttt

SEQ ID NO: 47216 - DNA, 20 bp, Artificial Sequence
  Description of Artificial Sequence: Synthetic oligonucleotide
  Target: SCN10A; (-) strand; PAM type: YTN; PAM sequence: CTT
tcattgtccttgccaggttt

SEQ ID NO: 47217 - DNA, 20 bp, Artificial Sequence
  Description of Artificial Sequence: Synthetic oligonucleotide
  Target: SCN10A; (-) strand; PAM type: YTN; PAM sequence: CTG
actttcattgtccttgccag

SEQ ID NO: 47218 - DNA, 20 bp, Artificial Sequence
  Description of Artificial Sequence: Synthetic oligonucleotide
  Target: SCN10A; (-) strand; PAM type: YTN; PAM sequence: TTC
ctgactttcattgtccttgc

SEQ ID NO: 47219 - DNA, 20 bp, Artificial Sequence
  Description of Artificial Sequence: Synthetic oligonucleotide
  Target: SCN10A; (-) strand; PAM type: YTN; PAM sequence: TTT
cctgactttcattgtccttg

SEQ ID NO: 47220 - DNA, 20 bp, Artificial Sequence
  Description of Artificial Sequence: Synthetic oligonucleotide
  Target: SCN10A; (-) strand; PAM type: YTN; PAM sequence: TTT
tcctgactttcattgtcctt

SEQ ID NO: 47221 - DNA, 20 bp, Artificial Sequence
  Description of Artificial Sequence: Synthetic oligonucleotide
  Target: SCN10A; (-) strand; PAM type: YTN; PAM sequence: CTA
taattttcctgactttcatt

SEQ ID NO: 47222 - DNA, 20 bp, Artificial Sequence
  Description of Artificial Sequence: Synthetic oligonucleotide
  Target: SCN10A; (-) strand; PAM type: YTN; PAM sequence: TTG
atctataattttcctgactt

SEQ ID NO: 47223 - DNA, 20 bp, Artificial Sequence
  Description of Artificial Sequence: Synthetic oligonucleotide
  Target: SCN10A; (-) strand; PAM type: YTN; PAM sequence: TTT
gatctataattttcctgact

SEQ ID NO: 47224 - DNA, 20 bp, Artificial Sequence
  Description of Artificial Sequence: Synthetic oligonucleotide
  Target: SCN10A; (-) strand; PAM type: YTN; PAM sequence: TTA
tccatatcaatgagtaatat

SEQ ID NO: 47225 - DNA, 20 bp, Artificial Sequence
  Description of Artificial Sequence: Synthetic oligonucleotide
  Target: SCN10A; (-) strand; PAM type: YTN; PAM sequence: TTT
atccatatcaatgagtaata

SEQ ID NO: 47226 - DNA, 20 bp, Artificial Sequence
  Description of Artificial Sequence: Synthetic oligonucleotide
  Target: SCN10A; (-) strand; PAM type: YTN; PAM sequence: TTT
tatccatatcaatgagtaat

SEQ ID NO: 47227 - DNA, 20 bp, Artificial Sequence
  Description of Artificial Sequence: Synthetic oligonucleotide
  Target: SCN10A; (-) strand; PAM type: YTN; PAM sequence: TTT
ttatccatatcaatgagtaa

SEQ ID NO: 47228 - DNA, 20 bp, Artificial Sequence
  Description of Artificial Sequence: Synthetic oligonucleotide
  Target: SCN10A; (-) strand; PAM type: YTN; PAM sequence: TTT
tttatccatatcaatgagta

SEQ ID NO: 47229 - DNA, 20 bp, Artificial Sequence
  Description of Artificial Sequence: Synthetic oligonucleotide
  Target: SCN10A; (-) strand; PAM type: YTN; PAM sequence: TTT
ttttatccatatcaatgagt

SEQ ID NO: 47230 - DNA, 20 bp, Artificial Sequence
  Description of Artificial Sequence: Synthetic oligonucleotide
  Target: SCN10A; (-) strand; PAM type: YTN; PAM sequence: TTA
agatttttttatccatatca

SEQ ID NO: 47231 - DNA, 20 bp, Artificial Sequence
  Description of Artificial Sequence: Synthetic oligonucleotide
  Target: SCN10A; (-) strand; PAM type: YTN; PAM sequence: CTT
aagatttttttatccatatc

SEQ ID NO: 47232 - DNA, 20 bp, Artificial Sequence
  Description of Artificial Sequence: Synthetic oligonucleotide
  Target: SCN10A; (-) strand; PAM type: YTN; PAM sequence: TTG
cttaagatttttttatccat

SEQ ID NO: 47233 - DNA, 20 bp, Artificial Sequence
  Description of Artificial Sequence: Synthetic oligonucleotide
  Target: SCN10A; (-) strand; PAM type: YTN; PAM sequence: TTT
gcttaagatttttttatcca

SEQ ID NO: 47234 - DNA, 20 bp, Artificial Sequence
  Description of Artificial Sequence: Synthetic oligonucleotide
  Target: SCN10A; (-) strand; PAM type: YTN; PAM sequence: CTA
aaaatttgcttaagattttt

SEQ ID NO: 47235 - DNA, 20 bp, Artificial Sequence
  Description of Artificial Sequence: Synthetic oligonucleotide
  Target: SCN10A; (-) strand; PAM type: YTN; PAM sequence: TTG
ctaaaaatttgcttaagatt

SEQ ID NO: 47236 - DNA, 20 bp, Artificial Sequence
  Description of Artificial Sequence: Synthetic oligonucleotide
  Target: SCN10A; (-) strand; PAM type: YTN; PAM sequence: TTT
gctaaaaatttgcttaagat

SEQ ID NO: 47237 - DNA, 20 bp, Artificial Sequence
  Description of Artificial Sequence: Synthetic oligonucleotide
  Target: SCN10A; (-) strand; PAM type: YTN; PAM sequence: TTA
gtttgctaaaaatttgctta

SEQ ID NO: 47238 - DNA, 20 bp, Artificial Sequence
  Description of Artificial Sequence: Synthetic oligonucleotide
  Target: SCN10A; (-) strand; PAM type: YTN; PAM sequence: TTT
agtttgctaaaaatttgctt

SEQ ID NO: 47239 - DNA, 20 bp, Artificial Sequence
  Description of Artificial Sequence: Synthetic oligonucleotide
  Target: SCN10A; (-) strand; PAM type: YTN; PAM sequence: TTG
gaagatttagtttgctaaaa

SEQ ID NO: 47240 - DNA, 20 bp, Artificial Sequence
  Description of Artificial Sequence: Synthetic oligonucleotide
  Target: SCN10A; (-) strand; PAM type: YTN; PAM sequence: TTA
atacattggaagatttagtt

SEQ ID NO: 47241 - DNA, 20 bp, Artificial Sequence
  Description of Artificial Sequence: Synthetic oligonucleotide
  Target: SCN10A; (-) strand; PAM type: YTN; PAM sequence: TTT
aatacattggaagatttagt

SEQ ID NO: 47242 - DNA, 20 bp, Artificial Sequence
  Description of Artificial Sequence: Synthetic oligonucleotide
  Target: SCN10A; (-) strand; PAM type: YTN; PAM sequence: TTT
taatacattggaagatttag

SEQ ID NO: 47243 - DNA, 20 bp, Artificial Sequence
  Description of Artificial Sequence: Synthetic oligonucleotide
  Target: SCN10A; (-) strand; PAM type: YTN; PAM sequence: TTT
ttaatacattggaagattta

SEQ ID NO: 47244 - DNA, 20 bp, Artificial Sequence
  Description of Artificial Sequence: Synthetic oligonucleotide
  Target: SCN10A; (-) strand; PAM type: YTN; PAM sequence: TTT
tttaatacattggaagattt

SEQ ID NO: 47245 - DNA, 20 bp, Artificial Sequence
  Description of Artificial Sequence: Synthetic oligonucleotide
  Target: SCN10A; (-) strand; PAM type: YTN; PAM sequence: TTG
atcgtgatgcattttttaat

SEQ ID NO: 47246 - DNA, 20 bp, Artificial Sequence
  Description of Artificial Sequence: Synthetic oligonucleotide
  Target: SCN10A; (-) strand; PAM type: YTN; PAM sequence: CTT
gatcgtgatgcattttttaa

SEQ ID NO: 47247 - DNA, 20 bp, Artificial Sequence
  Description of Artificial Sequence: Synthetic oligonucleotide
  Target: SCN10A; (-) strand; PAM type: YTN; PAM sequence: CTA
gcttgatcgtgatgcatttt

SEQ ID NO: 47248 - DNA, 20 bp, Artificial Sequence
  Description of Artificial Sequence: Synthetic oligonucleotide
  Target: SCN10A; (-) strand; PAM type: YTN; PAM sequence: CTC
aaacctagcttgatcgtgat

SEQ ID NO: 47249 - DNA, 20 bp, Artificial Sequence
  Description of Artificial Sequence: Synthetic oligonucleotide
  Target: SCN10A; (-) strand; PAM type: YTN; PAM sequence: TTC
ccagctcaaacctagcttga

SEQ ID NO: 47250 - DNA, 20 bp, Artificial Sequence
  Description of Artificial Sequence: Synthetic oligonucleotide
  Target: SCN10A; (-) strand; PAM type: YTN; PAM sequence: TTA
cattcccagctcaaacctag

SEQ ID NO: 47251 - DNA, 20 bp, Artificial Sequence
  Description of Artificial Sequence: Synthetic oligonucleotide
  Target: SCN10A; (-) strand; PAM type: YTN; PAM sequence: TTT
acattcccagctcaaaccta

SEQ ID NO: 47252 - DNA, 20 bp, Artificial Sequence
  Description of Artificial Sequence: Synthetic oligonucleotide
  Target: SCN10A; (-) strand; PAM type: YTN; PAM sequence: CTT
tacattcccagctcaaacct

SEQ ID NO: 47253 - DNA, 20 bp, Artificial Sequence
  Description of Artificial Sequence: Synthetic oligonucleotide
  Target: SCN10A; (-) strand; PAM type: YTN; PAM sequence: TTA
aatcaactttacattcccag

SEQ ID NO: 47254 - DNA, 20 bp, Artificial Sequence
  Description of Artificial Sequence: Synthetic oligonucleotide
  Target: SCN10A; (-) strand; PAM type: YTN; PAM sequence: CTA
atgttaaatcaactttacat

SEQ ID NO: 47255 - DNA, 20 bp, Artificial Sequence
  Description of Artificial Sequence: Synthetic oligonucleotide
  Target: SCN10A; (-) strand; PAM type: YTN; PAM sequence: TTC
taatgttaaatcaactttac

SEQ ID NO: 47256 - DNA, 20 bp, Artificial Sequence
  Description of Artificial Sequence: Synthetic oligonucleotide
  Target: SCN10A; (-) strand; PAM type: YTN; PAM sequence: TTT
ctaatgttaaatcaacttta

SEQ ID NO: 47257 - DNA, 20 bp, Artificial Sequence
  Description of Artificial Sequence: Synthetic oligonucleotide
  Target: SCN10A; (-) strand; PAM type: YTN; PAM sequence: TTT
tctaatgttaaatcaacttt

SEQ ID NO: 47258 - DNA, 20 bp, Artificial Sequence
  Description of Artificial Sequence: Synthetic oligonucleotide
  Target: SCN10A; (-) strand; PAM type: YTN; PAM sequence: TTG
attttctaatgttaaatcaa

SEQ ID NO: 47259 - DNA, 20 bp, Artificial Sequence
  Description of Artificial Sequence: Synthetic oligonucleotide
  Target: SCN10A; (-) strand; PAM type: YTN; PAM sequence: TTA
attgattttctaatgttaaa

SEQ ID NO: 47260 - DNA, 20 bp, Artificial Sequence
  Description of Artificial Sequence: Synthetic oligonucleotide
  Target: SCN10A; (-) strand; PAM type: YTN; PAM sequence: TTA
tattaattgattttctaatg

SEQ ID NO: 47261 - DNA, 20 bp, Artificial Sequence
  Description of Artificial Sequence: Synthetic oligonucleotide
  Target: SCN10A; (-) strand; PAM type: YTN; PAM sequence: TTA
aagtggtgaattatattaat

SEQ ID NO: 47262 - DNA, 20 bp, Artificial Sequence
  Description of Artificial Sequence: Synthetic oligonucleotide
  Target: SCN10A; (-) strand; PAM type: YTN; PAM sequence: CTG
ttaaagtggtgaattatatt

SEQ ID NO: 47263 - DNA, 20 bp, Artificial Sequence
  Description of Artificial Sequence: Synthetic oligonucleotide
  Target: SCN10A; (-) strand; PAM type: YTN; PAM sequence: TTC
aatctgttaaagtggtgaat

SEQ ID NO: 47264 - DNA, 20 bp, Artificial Sequence
  Description of Artificial Sequence: Synthetic oligonucleotide
  Target: SCN10A; (-) strand; PAM type: YTN; PAM sequence: CTT
caatctgttaaagtggtgaa

SEQ ID NO: 47265 - DNA, 20 bp, Artificial Sequence
  Description of Artificial Sequence: Synthetic oligonucleotide
  Target: SCN10A; (-) strand; PAM type: YTN; PAM sequence: CTC
cttcaatctgttaaagtggt

SEQ ID NO: 47266 - DNA, 20 bp, Artificial Sequence
  Description of Artificial Sequence: Synthetic oligonucleotide
  Target: SCN10A; (-) strand; PAM type: YTN; PAM sequence: TTC
tccttcaatctgttaaagtg

SEQ ID NO: 47267 - DNA, 20 bp, Artificial Sequence
  Description of Artificial Sequence: Synthetic oligonucleotide
  Target: SCN10A; (-) strand; PAM type: YTN; PAM sequence: TTT
ctccttcaatctgttaaagt

SEQ ID NO: 47268 - DNA, 20 bp, Artificial Sequence
  Description of Artificial Sequence: Synthetic oligonucleotide
  Target: SCN10A; (-) strand; PAM type: YTN; PAM sequence: TTT
tctccttcaatctgttaaag

SEQ ID NO: 47269 - DNA, 20 bp, Artificial Sequence
  Description of Artificial Sequence: Synthetic oligonucleotide
  Target: SCN10A; (-) strand; PAM type: YTN; PAM sequence: TTG
agataatcatgtattttctc

SEQ ID NO: 47270 - DNA, 20 bp, Artificial Sequence
  Description of Artificial Sequence: Synthetic oligonucleotide
  Target: SCN10A; (-) strand; PAM type: YTN; PAM sequence: CTA
catgtattgagataatcatg

SEQ ID NO: 47271 - DNA, 20 bp, Artificial Sequence
  Description of Artificial Sequence: Synthetic oligonucleotide
  Target: SCN10A; (-) strand; PAM type: YTN; PAM sequence: TTC
tacatgtattgagataatca

SEQ ID NO: 47272 - DNA, 20 bp, Artificial Sequence
  Description of Artificial Sequence: Synthetic oligonucleotide
  Target: SCN10A; (-) strand; PAM type: YTN; PAM sequence: TTA
ttctacatgtattgagataa

SEQ ID NO: 47273 - DNA, 20 bp, Artificial Sequence
  Description of Artificial Sequence: Synthetic oligonucleotide
  Target: SCN10A; (-) strand; PAM type: YTN; PAM sequence: TTA
tcagacaattattctacatg

SEQ ID NO: 47274 - DNA, 20 bp, Artificial Sequence
  Description of Artificial Sequence: Synthetic oligonucleotide
  Target: SCN10A; (-) strand; PAM type: YTN; PAM sequence: TTT
atcagacaattattctacat

SEQ ID NO: 47275 - DNA, 20 bp, Artificial Sequence
  Description of Artificial Sequence: Synthetic oligonucleotide
  Target: SCN10A; (-) strand; PAM type: YTN; PAM sequence: TTT
tatcagacaattattctaca

SEQ ID NO: 47276 - DNA, 20 bp, Artificial Sequence
  Description of Artificial Sequence: Synthetic oligonucleotide
  Target: SCN10A; (-) strand; PAM type: YTN; PAM sequence: TTA
attttatcagacaattattc

SEQ ID NO: 47277 - DNA, 20 bp, Artificial Sequence
  Description of Artificial Sequence: Synthetic oligonucleotide
  Target: SCN10A; (-) strand; PAM type: YTN; PAM sequence: TTT
aattttatcagacaattatt

SEQ ID NO: 47278 - DNA, 20 bp, Artificial Sequence
  Description of Artificial Sequence: Synthetic oligonucleotide
  Target: SCN10A; (-) strand; PAM type: YTN; PAM sequence: TTA
tcatgaatggatgtttaatt

SEQ ID NO: 47279 - DNA, 20 bp, Artificial Sequence
  Description of Artificial Sequence: Synthetic oligonucleotide
  Target: SCN10A; (-) strand; PAM type: YTN; PAM sequence: TTT
atcatgaatggatgtttaat

SEQ ID NO: 47280 - DNA, 20 bp, Artificial Sequence
  Description of Artificial Sequence: Synthetic oligonucleotide
  Target: SCN10A; (-) strand; PAM type: YTN; PAM sequence: TTA
tcaagaatatttatcatgaa

SEQ ID NO: 47281 - DNA, 20 bp, Artificial Sequence
  Description of Artificial Sequence: Synthetic oligonucleotide
  Target: SCN10A; (-) strand; PAM type: YTN; PAM sequence: TTT
atcaagaatatttatcatga

SEQ ID NO: 47282 - DNA, 20 bp, Artificial Sequence
  Description of Artificial Sequence: Synthetic oligonucleotide
  Target: SCN10A; (-) strand; PAM type: YTN; PAM sequence: TTT
tatcaagaatatttatcatg

SEQ ID NO: 47283 - DNA, 20 bp, Artificial Sequence
  Description of Artificial Sequence: Synthetic oligonucleotide
  Target: SCN10A; (-) strand; PAM type: YTN; PAM sequence: CTT
ttatcaagaatatttatcat

SEQ ID NO: 47284 - DNA, 20 bp, Artificial Sequence
  Description of Artificial Sequence: Synthetic oligonucleotide
  Target: SCN10A; (-) strand; PAM type: YTN; PAM sequence: CTC
ttttatcaagaatatttatc

SEQ ID NO: 47285 - DNA, 20 bp, Artificial Sequence
  Description of Artificial Sequence: Synthetic oligonucleotide
  Target: SCN10A; (-) strand; PAM type: YTN; PAM sequence: TTC
tcttttatcaagaatattta

SEQ ID NO: 47286 - DNA, 20 bp, Artificial Sequence
  Description of Artificial Sequence: Synthetic oligonucleotide
  Target: SCN10A; (-) strand; PAM type: YTN; PAM sequence: TTC
aggaagttctcttttatcaa

SEQ ID NO: 47287 - DNA, 20 bp, Artificial Sequence
  Description of Artificial Sequence: Synthetic oligonucleotide
  Target: SCN10A; (-) strand; PAM type: YTN; PAM sequence: TTA
tcagttcaggaagttctctt

SEQ ID NO: 47288 - DNA, 20 bp, Artificial Sequence
  Description of Artificial Sequence: Synthetic oligonucleotide
  Target: SCN10A; (-) strand; PAM type: YTN; PAM sequence: TTT
atcagttcaggaagttctct

SEQ ID NO: 47289 - DNA, 20 bp, Artificial Sequence
  Description of Artificial Sequence: Synthetic oligonucleotide
  Target: SCN10A; (-) strand; PAM type: YTN; PAM sequence: CTT
tatcagttcaggaagttctc

SEQ ID NO: 47290 - DNA, 20 bp, Artificial Sequence
  Description of Artificial Sequence: Synthetic oligonucleotide
  Target: SCN10A; (-) strand; PAM type: YTN; PAM sequence: TTA
aagataagaaatctttatca

SEQ ID NO: 47291 - DNA, 20 bp, Artificial Sequence
  Description of Artificial Sequence: Synthetic oligonucleotide
  Target: SCN10A; (-) strand; PAM type: YTN; PAM sequence: TTT
aaagataagaaatctttatc

SEQ ID NO: 47292 - DNA, 20 bp, Artificial Sequence
  Description of Artificial Sequence: Synthetic oligonucleotide
  Target: SCN10A; (-) strand; PAM type: YTN; PAM sequence: TTT
taaagataagaaatctttat

SEQ ID NO: 47293 - DNA, 20 bp, Artificial Sequence
  Description of Artificial Sequence: Synthetic oligonucleotide
  Target: SCN10A; (-) strand; PAM type: YTN; PAM sequence: TTT
ttaaagataagaaatcttta

SEQ ID NO: 47294 - DNA, 20 bp, Artificial Sequence
  Description of Artificial Sequence: Synthetic oligonucleotide
  Target: SCN10A; (-) strand; PAM type: YTN; PAM sequence: TTT
tttaaagataagaaatcttt

SEQ ID NO: 47295 - DNA, 20 bp, Artificial Sequence
  Description of Artificial Sequence: Synthetic oligonucleotide
  Target: SCN10A; (-) strand; PAM type: YTN; PAM sequence: TTT
ttttaaagataagaaatctt

SEQ ID NO: 47296 - DNA, 20 bp, Artificial Sequence
  Description of Artificial Sequence: Synthetic oligonucleotide
  Target: SCN10A; (-) strand; PAM type: YTN; PAM sequence: CTT
tttttaaagataagaaatct

SEQ ID NO: 47297 - DNA, 20 bp, Artificial Sequence
  Description of Artificial Sequence: Synthetic oligonucleotide
  Target: SCN10A; (-) strand; PAM type: YTN; PAM sequence: TTG
tggcaggctttttttaaaga

SEQ ID NO: 47298 - DNA, 20 bp, Artificial Sequence
  Description of Artificial Sequence: Synthetic oligonucleotide
  Target: SCN10A; (-) strand; PAM type: YTN; PAM sequence: CTA
acaattgtggcaggcttttt

SEQ ID NO: 47299 - DNA, 20 bp, Artificial Sequence
  Description of Artificial Sequence: Synthetic oligonucleotide
  Target: SCN10A; (-) strand; PAM type: YTN; PAM sequence: CTC
taacaattgtggcaggcttt

SEQ ID NO: 47300 - DNA, 20 bp, Artificial Sequence
  Description of Artificial Sequence: Synthetic oligonucleotide
  Target: SCN10A; (-) strand; PAM type: YTN; PAM sequence: TTC
accacctctaacaattgtgg

SEQ ID NO: 47301 - DNA, 20 bp, Artificial Sequence
  Description of Artificial Sequence: Synthetic oligonucleotide
  Target: SCN10A; (-) strand; PAM type: YTN; PAM sequence: TTT
caccacctctaacaattgtg

SEQ ID NO: 47302 - DNA, 20 bp, Artificial Sequence
  Description of Artificial Sequence: Synthetic oligonucleotide
  Target: SCN10A; (-) strand; PAM type: YTN; PAM sequence: TTC
aatatttcaccacctctaac

SEQ ID NO: 47303 - DNA, 20 bp, Artificial Sequence
  Description of Artificial Sequence: Synthetic oligonucleotide
  Target: SCN10A; (-) strand; PAM type: YTN; PAM sequence: TTT
caatatttcaccacctctaa

SEQ ID NO: 47304 - DNA, 20 bp, Artificial Sequence
  Description of Artificial Sequence: Synthetic oligonucleotide
  Target: SCN10A; (-) strand; PAM type: YTN; PAM sequence: CTT
tcaatatttcaccacctcta

SEQ ID NO: 47305 - DNA, 20 bp, Artificial Sequence
  Description of Artificial Sequence: Synthetic oligonucleotide
  Target: SCN10A; (-) strand; PAM type: YTN; PAM sequence: CTG
atcccaaaaagaatcctttc

SEQ ID NO: 47306 - DNA, 20 bp, Artificial Sequence
  Description of Artificial Sequence: Synthetic oligonucleotide
  Target: SCN10A; (-) strand; PAM type: YTN; PAM sequence: TTC
tgatcccaaaaagaatcctt

SEQ ID NO: 47307 - DNA, 20 bp, Artificial Sequence
  Description of Artificial Sequence: Synthetic oligonucleotide
  Target: SCN10A; (-) strand; PAM type: YTN; PAM sequence: TTT
ctgatcccaaaaagaatcct

SEQ ID NO: 47308 - DNA, 20 bp, Artificial Sequence
  Description of Artificial Sequence: Synthetic oligonucleotide
  Target: SCN10A; (-) strand; PAM type: YTN; PAM sequence: TTT
tctgatcccaaaaagaatcc

SEQ ID NO: 47309 - DNA, 20 bp, Artificial Sequence
  Description of Artificial Sequence: Synthetic oligonucleotide
  Target: SCN10A; (-) strand; PAM type: YTN; PAM sequence: TTA
tcaattttctgatcccaaaa

SEQ ID NO: 47310 - DNA, 20 bp, Artificial Sequence
  Description of Artificial Sequence: Synthetic oligonucleotide
  Target: SCN10A; (-) strand; PAM type: YTN; PAM sequence: TTT
atcaattttctgatcccaaa

SEQ ID NO: 47311 - DNA, 20 bp, Artificial Sequence
  Description of Artificial Sequence: Synthetic oligonucleotide
  Target: SCN10A; (-) strand; PAM type: YTN; PAM sequence: CTT
tatcaattttctgatcccaa

SEQ ID NO: 47312 - DNA, 20 bp, Artificial Sequence
  Description of Artificial Sequence: Synthetic oligonucleotide
  Target: SCN10A; (-) strand; PAM type: YTN; PAM sequence: TTA
ataacaggtatctttatcaa

SEQ ID NO: 47313 - DNA, 20 bp, Artificial Sequence
  Description of Artificial Sequence: Synthetic oligonucleotide
  Target: SCN10A; (-) strand; PAM type: YTN; PAM sequence: TTG
aaaagaagtgttaataacag

SEQ ID NO: 47314 - DNA, 20 bp, Artificial Sequence
  Description of Artificial Sequence: Synthetic oligonucleotide
  Target: SCN10A; (-) strand; PAM type: YTN; PAM sequence: CTG
ttgaaaagaagtgttaataa

SEQ ID NO: 47315 - DNA, 20 bp, Artificial Sequence
  Description of Artificial Sequence: Synthetic oligonucleotide
  Target: SCN10A; (-) strand; PAM type: YTN; PAM sequence: TTA
ggacatccagtacactgttg

SEQ ID NO: 47316 - DNA, 20 bp, Artificial Sequence
  Description of Artificial Sequence: Synthetic oligonucleotide
  Target: SCN10A; (-) strand; PAM type: YTN; PAM sequence: CTA
gttaggacatccagtacact

SEQ ID NO: 47317 - DNA, 20 bp, Artificial Sequence
  Description of Artificial Sequence: Synthetic oligonucleotide
  Target: SCN10A; (-) strand; PAM type: YTN; PAM sequence: CTG
tgctagttaggacatccagt

SEQ ID NO: 47318 - DNA, 20 bp, Artificial Sequence
  Description of Artificial Sequence: Synthetic oligonucleotide
  Target: SCN10A; (-) strand; PAM type: YTN; PAM sequence: CTA
gatcactgtgctagttagga

SEQ ID NO: 47319 - DNA, 20 bp, Artificial Sequence
  Description of Artificial Sequence: Synthetic oligonucleotide
  Target: SCN10A; (-) strand; PAM type: YTN; PAM sequence: TTA
ctagatcactgtgctagtta

SEQ ID NO: 47320 - DNA, 20 bp, Artificial Sequence
  Description of Artificial Sequence: Synthetic oligonucleotide
  Target: SCN10A; (-) strand; PAM type: YTN; PAM sequence: TTT
actagatcactgtgctagtt

SEQ ID NO: 47321 - DNA, 20 bp, Artificial Sequence
  Description of Artificial Sequence: Synthetic oligonucleotide
  Target: SCN10A; (-) strand; PAM type: YTN; PAM sequence: TTT
tactagatcactgtgctagt

SEQ ID NO: 47322 - DNA, 20 bp, Artificial Sequence
  Description of Artificial Sequence: Synthetic oligonucleotide
  Target: SCN10A; (-) strand; PAM type: YTN; PAM sequence: TTT
ttactagatcactgtgctag

SEQ ID NO: 47323 - DNA, 20 bp, Artificial Sequence
  Description of Artificial Sequence: Synthetic oligonucleotide
  Target: SCN10A; (-) strand; PAM type: YTN; PAM sequence: CTT
tttactagatcactgtgcta

SEQ ID NO: 47324 - DNA, 20 bp, Artificial Sequence
  Description of Artificial Sequence: Synthetic oligonucleotide
  Target: SCN10A; (-) strand; PAM type: YTN; PAM sequence: TTC
tttttactagatcactgtgc

SEQ ID NO: 47325 - DNA, 20 bp, Artificial Sequence
  Description of Artificial Sequence: Synthetic oligonucleotide
  Target: SCN10A; (-) strand; PAM type: YTN; PAM sequence: TTA
ggttctttttactagatcac

SEQ ID NO: 47326 - DNA, 20 bp, Artificial Sequence
  Description of Artificial Sequence: Synthetic oligonucleotide
  Target: SCN10A; (-) strand; PAM type: YTN; PAM sequence: TTA
tgccattaggttctttttac

SEQ ID NO: 47327 - DNA, 20 bp, Artificial Sequence
  Description of Artificial Sequence: Synthetic oligonucleotide
  Target: SCN10A; (-) strand; PAM type: YTN; PAM sequence: CTT
atgccattaggttcttttta

SEQ ID NO: 47328 - DNA, 20 bp, Artificial Sequence
  Description of Artificial Sequence: Synthetic oligonucleotide
  Target: SCN10A; (-) strand; PAM type: YTN; PAM sequence: CTA
atccttatgccattaggttc

SEQ ID NO: 47329 - DNA, 20 bp, Artificial Sequence
  Description of Artificial Sequence: Synthetic oligonucleotide
  Target: SCN10A; (-) strand; PAM type: YTN; PAM sequence: TTC
taatccttatgccattaggt

SEQ ID NO: 47330 - DNA, 20 bp, Artificial Sequence
  Description of Artificial Sequence: Synthetic oligonucleotide
  Target: SCN10A; (-) strand; PAM type: YTN; PAM sequence: TTT
ctaatccttatgccattagg

SEQ ID NO: 47331 - DNA, 20 bp, Artificial Sequence
  Description of Artificial Sequence: Synthetic oligonucleotide
  Target: SCN10A; (-) strand; PAM type: YTN; PAM sequence: TTT
tctaatccttatgccattag

SEQ ID NO: 47332 - DNA, 20 bp, Artificial Sequence
  Description of Artificial Sequence: Synthetic oligonucleotide
  Target: SCN10A; (-) strand; PAM type: YTN; PAM sequence: CTT
ttctaatccttatgccatta

SEQ ID NO: 47333 - DNA, 20 bp, Artificial Sequence
  Description of Artificial Sequence: Synthetic oligonucleotide
  Target: SCN10A; (-) strand; PAM type: YTN; PAM sequence: TTC
ttttctaatccttatgccat

SEQ ID NO: 47334 - DNA, 20 bp, Artificial Sequence
  Description of Artificial Sequence: Synthetic oligonucleotide
  Target: SCN10A; (-) strand; PAM type: YTN; PAM sequence: CTT
cttttctaatccttatgcca

SEQ ID NO: 47335 - DNA, 20 bp, Artificial Sequence
  Description of Artificial Sequence: Synthetic oligonucleotide
  Target: SCN10A; (-) strand; PAM type: YTN; PAM sequence: TTC
ttcttttctaatccttatgc

SEQ ID NO: 47336 - DNA, 20 bp, Artificial Sequence
  Description of Artificial Sequence: Synthetic oligonucleotide
  Target: SCN10A; (-) strand; PAM type: YTN; PAM sequence: TTT
cttcttttctaatccttatg

SEQ ID NO: 47337 - DNA, 20 bp, Artificial Sequence
  Description of Artificial Sequence: Synthetic oligonucleotide
  Target: SCN10A; (-) strand; PAM type: YTN; PAM sequence: CTA
atttcttcttttctaatcct

SEQ ID NO: 47338 - DNA, 20 bp, Artificial Sequence
  Description of Artificial Sequence: Synthetic oligonucleotide
  Target: SCN10A; (-) strand; PAM type: YTN; PAM sequence: TTA
caggcatgagccacccacgc

SEQ ID NO: 47339 - DNA, 20 bp, Artificial Sequence
  Description of Artificial Sequence: Synthetic oligonucleotide
  Target: SCN10A; (-) strand; PAM type: YTN; PAM sequence: CTG
ggattacaggcatgagccac

SEQ ID NO: 47340 - DNA, 20 bp, Artificial Sequence
  Description of Artificial Sequence: Synthetic oligonucleotide
  Target: SCN10A; (-) strand; PAM type: YTN; PAM sequence: CTA
aagtgctgggattacaggca

SEQ ID NO: 47341 - DNA, 20 bp, Artificial Sequence
  Description of Artificial Sequence: Synthetic oligonucleotide
  Target: SCN10A; (-) strand; PAM type: YTN; PAM sequence: CTC
ctaaagtgctgggattacag

SEQ ID NO: 47342 - DNA, 20 bp, Artificial Sequence
  Description of Artificial Sequence: Synthetic oligonucleotide
  Target: SCN10A; (-) strand; PAM type: YTN; PAM sequence: TTG
gcctcctaaagtgctgggat

SEQ ID NO: 47343 - DNA, 20 bp, Artificial Sequence
  Description of Artificial Sequence: Synthetic oligonucleotide
  Target: SCN10A; (-) strand; PAM type: YTN; PAM sequence: CTT
ggcctcctaaagtgctggga

SEQ ID NO: 47344 - DNA, 20 bp, Artificial Sequence
  Description of Artificial Sequence: Synthetic oligonucleotide
  Target: SCN10A; (-) strand; PAM type: YTN; PAM sequence: CTG
ccttggcctcctaaagtgct

SEQ ID NO: 47345 - DNA, 20 bp, Artificial Sequence
  Description of Artificial Sequence: Synthetic oligonucleotide
  Target: SCN10A; (-) strand; PAM type: YTN; PAM sequence: CTG
cctgccttggcctcctaaag

SEQ ID NO: 47346 - DNA, 20 bp, Artificial Sequence
  Description of Artificial Sequence: Synthetic oligonucleotide
  Target: SCN10A; (-) strand; PAM type: YTN; PAM sequence: CTC
atgatctgcctgccttggcc

SEQ ID NO: 47347 - DNA, 20 bp, Artificial Sequence
  Description of Artificial Sequence: Synthetic oligonucleotide
  Target: SCN10A; (-) strand; PAM type: YTN; PAM sequence: CTG
acctcatgatctgcctgcct

SEQ ID NO: 47348 - DNA, 20 bp, Artificial Sequence
  Description of Artificial Sequence: Synthetic oligonucleotide
  Target: SCN10A; (-) strand; PAM type: YTN; PAM sequence: CTC
ctgacctcatgatctgcctg

SEQ ID NO: 47349 - DNA, 20 bp, Artificial Sequence
  Description of Artificial Sequence: Synthetic oligonucleotide
  Target: SCN10A; (-) strand; PAM type: YTN; PAM sequence: CTC
gatctcctgacctcatgatc

SEQ ID NO: 47350 - DNA, 20 bp, Artificial Sequence
  Description of Artificial Sequence: Synthetic oligonucleotide
  Target: SCN10A; (-) strand; PAM type: YTN; PAM sequence: TTA
gccaggatggtctcgatctc

SEQ ID NO: 47351 - DNA, 20 bp, Artificial Sequence
  Description of Artificial Sequence: Synthetic oligonucleotide
  Target: SCN10A; (-) strand; PAM type: YTN; PAM sequence: TTC
accgtgttagccaggatggt

SEQ ID NO: 47352 - DNA, 20 bp, Artificial Sequence
  Description of Artificial Sequence: Synthetic oligonucleotide
  Target: SCN10A; (-) strand; PAM type: YTN; PAM sequence: TTT
caccgtgttagccaggatgg

SEQ ID NO: 47353 - DNA, 20 bp, Artificial Sequence
  Description of Artificial Sequence: Synthetic oligonucleotide
  Target: SCN10A; (-) strand; PAM type: YTN; PAM sequence: TTA
gtagagacggggtttcaccg

SEQ ID NO: 47354 - DNA, 20 bp, Artificial Sequence
  Description of Artificial Sequence: Synthetic oligonucleotide
  Target: SCN10A; (-) strand; PAM type: YTN; PAM sequence: TTT
agtagagacggggtttcacc

SEQ ID NO: 47355 - DNA, 20 bp, Artificial Sequence
  Description of Artificial Sequence: Synthetic oligonucleotide
  Target: SCN10A; (-) strand; PAM type: YTN; PAM sequence: TTT
tagtagagacggggtttcac

SEQ ID NO: 47356 - DNA, 20 bp, Artificial Sequence
  Description of Artificial Sequence: Synthetic oligonucleotide
  Target: SCN10A; (-) strand; PAM type: YTN; PAM sequence: TTT
ttagtagagacggggtttca

SEQ ID NO: 47357 - DNA, 20 bp, Artificial Sequence
  Description of Artificial Sequence: Synthetic oligonucleotide
  Target: SCN10A; (-) strand; PAM type: YTN; PAM sequence: TTG
tatttttagtagagacgggg

SEQ ID NO: 47358 - DNA, 20 bp, Artificial Sequence
  Description of Artificial Sequence: Synthetic oligonucleotide
  Target: SCN10A; (-) strand; PAM type: YTN; PAM sequence: TTT
gtatttttagtagagacggg

SEQ ID NO: 47359 - DNA, 20 bp, Artificial Sequence
  Description of Artificial Sequence: Synthetic oligonucleotide
  Target: SCN10A; (-) strand; PAM type: YTN; PAM sequence: CTT
tgtatttttagtagagacgg

SEQ ID NO: 47360 - DNA, 20 bp, Artificial Sequence
  Description of Artificial Sequence: Synthetic oligonucleotide
  Target: SCN10A; (-) strand; PAM type: YTN; PAM sequence: TTC
tttgtatttttagtagagac

SEQ ID NO: 47361 - DNA, 20 bp, Artificial Sequence
  Description of Artificial Sequence: Synthetic oligonucleotide
  Target: SCN10A; (-) strand; PAM type: YTN; PAM sequence: CTA
attctttgtatttttagtag

SEQ ID NO: 47362 - DNA, 20 bp, Artificial Sequence
  Description of Artificial Sequence: Synthetic oligonucleotide
  Target: SCN10A; (-) strand; PAM type: YTN; PAM sequence: CTG
gctaattctttgtattttta

SEQ ID NO: 47363 - DNA, 20 bp, Artificial Sequence
  Description of Artificial Sequence: Synthetic oligonucleotide
  Target: SCN10A; (-) strand; PAM type: YTN; PAM sequence: CTA
caggcacccaccaccatgcc

SEQ ID NO: 47364 - DNA, 20 bp, Artificial Sequence
  Description of Artificial Sequence: Synthetic oligonucleotide
  Target: SCN10A; (-) strand; PAM type: YTN; PAM sequence: CTG
ggactacaggcacccaccac

SEQ ID NO: 47365 - DNA, 20 bp, Artificial Sequence
  Description of Artificial Sequence: Synthetic oligonucleotide
  Target: SCN10A; (-) strand; PAM type: YTN; PAM sequence: CTG
agtagctgggactacaggca

SEQ ID NO: 47366 - DNA, 20 bp, Artificial Sequence
  Description of Artificial Sequence: Synthetic oligonucleotide
  Target: SCN10A; (-) strand; PAM type: YTN; PAM sequence: CTC
ctgagtagctgggactacag

SEQ ID NO: 47367 - DNA, 20 bp, Artificial Sequence
  Description of Artificial Sequence: Synthetic oligonucleotide
  Target: SCN10A; (-) strand; PAM type: YTN; PAM sequence: CTC
agcctcctgagtagctggga

SEQ ID NO: 47368 - DNA, 20 bp, Artificial Sequence
  Description of Artificial Sequence: Synthetic oligonucleotide
  Target: SCN10A; (-) strand; PAM type: YTN; PAM sequence: CTG
cctcagcctcctgagtagct

SEQ ID NO: 47369 - DNA, 20 bp, Artificial Sequence
  Description of Artificial Sequence: Synthetic oligonucleotide
  Target: SCN10A; (-) strand; PAM type: YTN; PAM sequence: CTC
ctgcctcagcctcctgagta

SEQ ID NO: 47370 - DNA, 20 bp, Artificial Sequence
  Description of Artificial Sequence: Synthetic oligonucleotide
  Target: SCN10A; (-) strand; PAM type: YTN; PAM sequence: TTC
tcctgcctcagcctcctgag

SEQ ID NO: 47371 - DNA, 20 bp, Artificial Sequence
  Description of Artificial Sequence: Synthetic oligonucleotide
  Target: SCN10A; (-) strand; PAM type: YTN; PAM sequence: TTC
acgccattctcctgcctcag

SEQ ID NO: 47372 - DNA, 20 bp, Artificial Sequence
  Description of Artificial Sequence: Synthetic oligonucleotide
  Target: SCN10A; (-) strand; PAM type: YTN; PAM sequence: CTC
ccgggttcacgccattctcc

SEQ ID NO: 47373 - DNA, 20 bp, Artificial Sequence
  Description of Artificial Sequence: Synthetic oligonucleotide
  Target: SCN10A; (-) strand; PAM type: YTN; PAM sequence: CTC
cacctcccgggttcacgcca

SEQ ID NO: 47374 - DNA, 20 bp, Artificial Sequence
  Description of Artificial Sequence: Synthetic oligonucleotide
  Target: SCN10A; (-) strand; PAM type: YTN; PAM sequence: TTG
ccagctccacctcccgggtt

SEQ ID NO: 47375 - DNA, 20 bp, Artificial Sequence
  Description of Artificial Sequence: Synthetic oligonucleotide
  Target: SCN10A; (-) strand; PAM type: YTN; PAM sequence: CTC
attgccagctccacctcccg

SEQ ID NO: 47376 - DNA, 20 bp, Artificial Sequence
  Description of Artificial Sequence: Synthetic oligonucleotide
  Target: SCN10A; (-) strand; PAM type: YTN; PAM sequence: CTC
ggctcattgccagctccacc

SEQ ID NO: 47377 - DNA, 20 bp, Artificial Sequence
  Description of Artificial Sequence: Synthetic oligonucleotide
  Target: SCN10A; (-) strand; PAM type: YTN; PAM sequence: CTA
gagtgcagtggcgtgatctc

SEQ ID NO: 47378 - DNA, 20 bp, Artificial Sequence
  Description of Artificial Sequence: Synthetic oligonucleotide
  Target: SCN10A; (-) strand; PAM type: YTN; PAM sequence: CTG
tcacccaggctagagtgcag

SEQ ID NO: 47379 - DNA, 20 bp, Artificial Sequence
  Description of Artificial Sequence: Synthetic oligonucleotide
  Target: SCN10A; (-) strand; PAM type: YTN; PAM sequence: CTC
tgtcacccaggctagagtgc

SEQ ID NO: 47380 - DNA, 20 bp, Artificial Sequence
  Description of Artificial Sequence: Synthetic oligonucleotide
  Target: SCN10A; (-) strand; PAM type: YTN; PAM sequence: CTC
gctctgtcacccaggctaga

SEQ ID NO: 47381 - DNA, 20 bp, Artificial Sequence
  Description of Artificial Sequence: Synthetic oligonucleotide
  Target: SCN10A; (-) strand; PAM type: YTN; PAM sequence: TTG
agacagagtctcgctctgtc

SEQ ID NO: 47382 - DNA, 20 bp, Artificial Sequence
  Description of Artificial Sequence: Synthetic oligonucleotide
  Target: SCN10A; (-) strand; PAM type: YTN; PAM sequence: TTT
gagacagagtctcgctctgt

SEQ ID NO: 47383 - DNA, 20 bp, Artificial Sequence
  Description of Artificial Sequence: Synthetic oligonucleotide
  Target: SCN10A; (-) strand; PAM type: YTN; PAM sequence: TTT
tgagacagagtctcgctctg

SEQ ID NO: 47384 - DNA, 20 bp, Artificial Sequence
  Description of Artificial Sequence: Synthetic oligonucleotide
  Target: SCN10A; (-) strand; PAM type: YTN; PAM sequence: TTT
ttgagacagagtctcgctct

SEQ ID NO: 47385 - DNA, 20 bp, Artificial Sequence
  Description of Artificial Sequence: Synthetic oligonucleotide
  Target: SCN10A; (-) strand; PAM type: YTN; PAM sequence: TTT
tttgagacagagtctcgctc

SEQ ID NO: 47386 - DNA, 20 bp, Artificial Sequence
  Description of Artificial Sequence: Synthetic oligonucleotide
  Target: SCN10A; (-) strand; PAM type: YTN; PAM sequence: TTT
ttttgagacagagtctcgct

SEQ ID NO: 47387 - DNA, 20 bp, Artificial Sequence
  Description of Artificial Sequence: Synthetic oligonucleotide
  Target: SCN10A; (-) strand; PAM type: YTN; PAM sequence: TTT
tttttgagacagagtctcgc

SEQ ID NO: 47388 - DNA, 20 bp, Artificial Sequence
  Description of Artificial Sequence: Synthetic oligonucleotide
  Target: SCN10A; (-) strand; PAM type: YTN; PAM sequence: TTT
ttttttgagacagagtctcg

SEQ ID NO: 47389 - DNA, 20 bp, Artificial Sequence
  Description of Artificial Sequence: Synthetic oligonucleotide
  Target: SCN10A; (-) strand; PAM type: YTN; PAM sequence: TTT
tttttttgagacagagtctc

SEQ ID NO: 47390 - DNA, 20 bp, Artificial Sequence
  Description of Artificial Sequence: Synthetic oligonucleotide
  Target: SCN10A; (-) strand; PAM type: YTN; PAM sequence: TTT
ttttttttgagacagagtct

SEQ ID NO: 47391 - DNA, 20 bp, Artificial Sequence
  Description of Artificial Sequence: Synthetic oligonucleotide
  Target: SCN10A; (-) strand; PAM type: YTN; PAM sequence: TTT
tttttttttgagacagagtc

SEQ ID NO: 47392 - DNA, 20 bp, Artificial Sequence
  Description of Artificial Sequence: Synthetic oligonucleotide
  Target: SCN10A; (-) strand; PAM type: YTN; PAM sequence: TTT
ttttttttttgagacagagt

SEQ ID NO: 47393 - DNA, 20 bp, Artificial Sequence
  Description of Artificial Sequence: Synthetic oligonucleotide
  Target: SCN10A; (-) strand; PAM type: YTN; PAM sequence: TTT
tttttttttttgagacagag

SEQ ID NO: 47394 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttgagacaga

SEQ ID NO: 47395 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttgagacag

SEQ ID NO: 47396 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttttgagaca

SEQ ID NO: 47397 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttttgagac

SEQ ID NO: 47398 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttttttgaga

SEQ ID NO: 47399 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttttttgag

SEQ ID NO: 47400 - DNA, 20 bp, Artificial Sequence
  Description of Artificial Sequence: Synthetic oligonucleotide
  Target: SCN10A; (-) strand; PAM type: YTN; PAM sequence: CTT
ttttttttttttttttttga

SEQ ID NO: 47401 - DNA, 20 bp, Artificial Sequence
  Description of Artificial Sequence: Synthetic oligonucleotide
  Target: SCN10A; (-) strand; PAM type: YTN; PAM sequence: TTC
tttttttttttttttttttt

SEQ ID NO: 47402 - DNA, 20 bp, Artificial Sequence
  Description of Artificial Sequence: Synthetic oligonucleotide
  Target: SCN10A; (-) strand; PAM type: YTN; PAM sequence: TTT
cttttttttttttttttttt

SEQ ID NO: 47403 - DNA, 20 bp, Artificial Sequence
  Description of Artificial Sequence: Synthetic oligonucleotide
  Target: SCN10A; (-) strand; PAM type: YTN; PAM sequence: CTT
tctttttttttttttttttt

SEQ ID NO: 47404 - DNA, 20 bp, Artificial Sequence
  Description of Artificial Sequence: Synthetic oligonucleotide
  Target: SCN10A; (-) strand; PAM type: YTN; PAM sequence: TTC
tttctttttttttttttttt

SEQ ID NO: 47405 - DNA, 20 bp, Artificial Sequence
  Description of Artificial Sequence: Synthetic oligonucleotide
  Target: SCN10A; (-) strand; PAM type: YTN; PAM sequence: TTT
ctttcttttttttttttttt

SEQ ID NO: 47406 - DNA, 20 bp, Artificial Sequence
  Description of Artificial Sequence: Synthetic oligonucleotide
  Target: SCN10A; (-) strand; PAM type: YTN; PAM sequence: TTT
tctttctttttttttttttt

SEQ ID NO: 47407 - DNA, 20 bp, Artificial Sequence
  Description of Artificial Sequence: Synthetic oligonucleotide
  Target: SCN10A; (-) strand; PAM type: YTN; PAM sequence: CTT
ttctttcttttttttttttt

SEQ ID NO: 47408 - DNA, 20 bp, Artificial Sequence
  Description of Artificial Sequence: Synthetic oligonucleotide
  Target: SCN10A; (-) strand; PAM type: YTN; PAM sequence: TTC
ttttctttcttttttttttt

SEQ ID NO: 47409 - DNA, 20 bp, Artificial Sequence
  Description of Artificial Sequence: Synthetic oligonucleotide
  Target: SCN10A; (-) strand; PAM type: YTN; PAM sequence: CTT
cttttctttctttttttttt

SEQ ID NO: 47410 - DNA, 20 bp, Artificial Sequence
  Description of Artificial Sequence: Synthetic oligonucleotide
  Target: SCN10A; (-) strand; PAM type: YTN; PAM sequence: TTC
ttcttttctttctttttttt

SEQ ID NO: 47411 - DNA, 20 bp, Artificial Sequence
  Description of Artificial Sequence: Synthetic oligonucleotide
  Target: SCN10A; (-) strand; PAM type: YTN; PAM sequence: TTT
cttcttttctttcttttttt

SEQ ID NO: 47412 - DNA, 20 bp, Artificial Sequence
  Description of Artificial Sequence: Synthetic oligonucleotide
  Target: SCN10A; (-) strand; PAM type: YTN; PAM sequence: TTA
atttcttcttttctttcttt

SEQ ID NO: 47413 - DNA, 20 bp, Artificial Sequence
  Description of Artificial Sequence: Synthetic oligonucleotide
  Target: SCN10A; (-) strand; PAM type: YTN; PAM sequence: TTT
aatttcttcttttctttctt

SEQ ID NO: 47414 - DNA, 20 bp, Artificial Sequence
  Description of Artificial Sequence: Synthetic oligonucleotide
  Target: SCN10A; (-) strand; PAM type: YTN; PAM sequence: CTA
acataatcacatcatgtgaa

SEQ ID NO: 47415 - DNA, 20 bp, Artificial Sequence
  Description of Artificial Sequence: Synthetic oligonucleotide
  Target: SCN10A; (-) strand; PAM type: YTN; PAM sequence: TTC
taacataatcacatcatgtg

SEQ ID NO: 47416 - DNA, 20 bp, Artificial Sequence
  Description of Artificial Sequence: Synthetic oligonucleotide
  Target: SCN10A; (-) strand; PAM type: YTN; PAM sequence: TTT
ctaacataatcacatcatgt

SEQ ID NO: 47417 - DNA, 20 bp, Artificial Sequence
  Description of Artificial Sequence: Synthetic oligonucleotide
  Target: SCN10A; (-) strand; PAM type: YTN; PAM sequence: TTT
tctaacataatcacatcatg

SEQ ID NO: 47418 - DNA, 20 bp, Artificial Sequence
  Description of Artificial Sequence: Synthetic oligonucleotide
  Target: SCN10A; (-) strand; PAM type: YTN; PAM sequence: TTA
aattttctaacataatcaca

SEQ ID NO: 47419 - DNA, 20 bp, Artificial Sequence
  Description of Artificial Sequence: Synthetic oligonucleotide
  Target: SCN10A; (-) strand; PAM type: YTN; PAM sequence: TTT
aaattttctaacataatcac

SEQ ID NO: 47420 - DNA, 20 bp, Artificial Sequence
  Description of Artificial Sequence: Synthetic oligonucleotide
  Target: SCN10A; (-) strand; PAM type: YTN; PAM sequence: TTT
taaattttctaacataatca

SEQ ID NO: 47421 - DNA, 20 bp, Artificial Sequence
  Description of Artificial Sequence: Synthetic oligonucleotide
  Target: SCN10A; (-) strand; PAM type: YTN; PAM sequence: CTA
tacaatgttttaaattttct

SEQ ID NO: 47422 - DNA, 20 bp, Artificial Sequence
  Description of Artificial Sequence: Synthetic oligonucleotide
  Target: SCN10A; (-) strand; PAM type: YTN; PAM sequence: TTA
tctatacaatgttttaaatt

SEQ ID NO: 47423 - DNA, 20 bp, Artificial Sequence
  Description of Artificial Sequence: Synthetic oligonucleotide
  Target: SCN10A; (-) strand; PAM type: YTN; PAM sequence: TTT
atctatacaatgttttaaat

SEQ ID NO: 47424 - DNA, 20 bp, Artificial Sequence
  Description of Artificial Sequence: Synthetic oligonucleotide
  Target: SCN10A; (-) strand; PAM type: YTN; PAM sequence: CTA
ataatttatctatacaatgt

SEQ ID NO: 47425 - DNA, 20 bp, Artificial Sequence
  Description of Artificial Sequence: Synthetic oligonucleotide
  Target: SCN10A; (-) strand; PAM type: YTN; PAM sequence: TTC
taataatttatctatacaat

SEQ ID NO: 47426 - DNA, 20 bp, Artificial Sequence
  Description of Artificial Sequence: Synthetic oligonucleotide
  Target: SCN10A; (-) strand; PAM type: YTN; PAM sequence: TTA
attctaataatttatctata

SEQ ID NO: 47427 - DNA, 20 bp, Artificial Sequence
  Description of Artificial Sequence: Synthetic oligonucleotide
  Target: SCN10A; (-) strand; PAM type: YTN; PAM sequence: TTA
ttaattctaataatttatct

SEQ ID NO: 47428 - DNA, 20 bp, Artificial Sequence
  Description of Artificial Sequence: Synthetic oligonucleotide
  Target: SCN10A; (-) strand; PAM type: YTN; PAM sequence: CTT
attaattctaataatttatc

SEQ ID NO: 47429 - DNA, 20 bp, Artificial Sequence
  Description of Artificial Sequence: Synthetic oligonucleotide
  Target: SCN10A; (-) strand; PAM type: YTN; PAM sequence: CTC
ttattaattctaataattta

SEQ ID NO: 47430 - DNA, 20 bp, Artificial Sequence
  Description of Artificial Sequence: Synthetic oligonucleotide
  Target: SCN10A; (-) strand; PAM type: YTN; PAM sequence: CTA
gaaatgtctcttattaattc

SEQ ID NO: 47431 - DNA, 20 bp, Artificial Sequence
  Description of Artificial Sequence: Synthetic oligonucleotide
  Target: SCN10A; (-) strand; PAM type: YTN; PAM sequence: TTG
tatctagaaatgtctcttat

SEQ ID NO: 47432 - DNA, 20 bp, Artificial Sequence
  Description of Artificial Sequence: Synthetic oligonucleotide
  Target: SCN10A; (-) strand; PAM type: YTN; PAM sequence: TTT
gtatctagaaatgtctctta

SEQ ID NO: 47433 - DNA, 20 bp, Artificial Sequence
  Description of Artificial Sequence: Synthetic oligonucleotide
  Target: SCN10A; (-) strand; PAM type: YTN; PAM sequence: TTT
tgtatctagaaatgtctctt

SEQ ID NO: 47434 - DNA, 20 bp, Artificial Sequence
  Description of Artificial Sequence: Synthetic oligonucleotide
  Target: SCN10A; (-) strand; PAM type: YTN; PAM sequence: TTT
ttgtatctagaaatgtctct

SEQ ID NO: 47435 - DNA, 20 bp, Artificial Sequence
  Description of Artificial Sequence: Synthetic oligonucleotide
  Target: SCN10A; (-) strand; PAM type: YTN; PAM sequence: TTA
acatttttgtatctagaaat

SEQ ID NO: 47436 - DNA, 20 bp, Artificial Sequence
  Description of Artificial Sequence: Synthetic oligonucleotide
  Target: SCN10A; (-) strand; PAM type: YTN; PAM sequence: TTT
aacatttttgtatctagaaa

SEQ ID NO: 47437 - DNA, 20 bp, Artificial Sequence
  Description of Artificial Sequence: Synthetic oligonucleotide
  Target: SCN10A; (-) strand; PAM type: YTN; PAM sequence: TTG
atatttaacatttttgtatc

SEQ ID NO: 47438 - DNA, 20 bp, Artificial Sequence
  Description of Artificial Sequence: Synthetic oligonucleotide
  Target: SCN10A; (-) strand; PAM type: YTN; PAM sequence: TTT
gatatttaacatttttgtat

SEQ ID NO: 47439 - DNA, 20 bp, Artificial Sequence
  Description of Artificial Sequence: Synthetic oligonucleotide
  Target: SCN10A; (-) strand; PAM type: YTN; PAM sequence: TTT
tgatatttaacatttttgta

SEQ ID NO: 47440 - DNA, 20 bp, Artificial Sequence
  Description of Artificial Sequence: Synthetic oligonucleotide
  Target: SCN10A; (-) strand; PAM type: YTN; PAM sequence: CTA
gcattttgatatttaacatt

SEQ ID NO: 47441 - DNA, 20 bp, Artificial Sequence
  Description of Artificial Sequence: Synthetic oligonucleotide
  Target: SCN10A; (-) strand; PAM type: YTN; PAM sequence: TTG
gctagcattttgatatttaa

SEQ ID NO: 47442 - DNA, 20 bp, Artificial Sequence
  Description of Artificial Sequence: Synthetic oligonucleotide
  Target: SCN10A; (-) strand; PAM type: YTN; PAM sequence: TTT
ggctagcattttgatattta

SEQ ID NO: 47443 - DNA, 20 bp, Artificial Sequence
  Description of Artificial Sequence: Synthetic oligonucleotide
  Target: SCN10A; (-) strand; PAM type: YTN; PAM sequence: TTT
tggctagcattttgatattt

SEQ ID NO: 47444 - DNA, 20 bp, Artificial Sequence
  Description of Artificial Sequence: Synthetic oligonucleotide
  Target: SCN10A; (-) strand; PAM type: YTN; PAM sequence: TTT
ttggctagcattttgatatt

SEQ ID NO: 47445 - DNA, 20 bp, Artificial Sequence
  Description of Artificial Sequence: Synthetic oligonucleotide
  Target: SCN10A; (-) strand; PAM type: YTN; PAM sequence: CTG
gcatttttggctagcatttt

SEQ ID NO: 47446 - DNA, 20 bp, Artificial Sequence
  Description of Artificial Sequence: Synthetic oligonucleotide
  Target: SCN10A; (-) strand; PAM type: YTN; PAM sequence: TTC
tggcatttttggctagcatt

SEQ ID NO: 47447 - DNA, 20 bp, Artificial Sequence
  Description of Artificial Sequence: Synthetic oligonucleotide
  Target: SCN10A; (-) strand; PAM type: YTN; PAM sequence: TTT
ctggcatttttggctagcat

SEQ ID NO: 47448 - DNA, 20 bp, Artificial Sequence
  Description of Artificial Sequence: Synthetic oligonucleotide
  Target: SCN10A; (-) strand; PAM type: YTN; PAM sequence: TTT
tctggcatttttggctagca

SEQ ID NO: 47449 - DNA, 20 bp, Artificial Sequence
  Description of Artificial Sequence: Synthetic oligonucleotide
  Target: SCN10A; (-) strand; PAM type: YTN; PAM sequence: CTT
ttctggcatttttggctagc

SEQ ID NO: 47450 - DNA, 20 bp, Artificial Sequence
  Description of Artificial Sequence: Synthetic oligonucleotide
  Target: SCN10A; (-) strand; PAM type: YTN; PAM sequence: TTC
ttttctggcatttttggcta

SEQ ID NO: 47451 - DNA, 20 bp, Artificial Sequence
  Description of Artificial Sequence: Synthetic oligonucleotide
  Target: SCN10A; (-) strand; PAM type: YTN; PAM sequence: TTA
aatgttcttttctggcattt

SEQ ID NO: 47452 - DNA, 20 bp, Artificial Sequence
  Description of Artificial Sequence: Synthetic oligonucleotide
  Target: SCN10A; (-) strand; PAM type: YTN; PAM sequence: CTT
aaatgttcttttctggcatt

SEQ ID NO: 47453 - DNA, 20 bp, Artificial Sequence
  Description of Artificial Sequence: Synthetic oligonucleotide
  Target: SCN10A; (-) strand; PAM type: YTN; PAM sequence: TTC
ttaaatgttcttttctggca

SEQ ID NO: 47454 - DNA, 20 bp, Artificial Sequence
  Description of Artificial Sequence: Synthetic oligonucleotide
  Target: SCN10A; (-) strand; PAM type: YTN; PAM sequence: CTT
cttaaatgttcttttctggc

SEQ ID NO: 47455 - DNA, 20 bp, Artificial Sequence
  Description of Artificial Sequence: Synthetic oligonucleotide
  Target: SCN10A; (-) strand; PAM type: YTN; PAM sequence: TTG
catatcttcttaaatgttct

SEQ ID NO: 47456 - DNA, 20 bp, Artificial Sequence
  Description of Artificial Sequence: Synthetic oligonucleotide
  Target: SCN10A; (-) strand; PAM type: YTN; PAM sequence: CTT
gcatatcttcttaaatgttc

SEQ ID NO: 47457 - DNA, 20 bp, Artificial Sequence
  Description of Artificial Sequence: Synthetic oligonucleotide
  Target: SCN10A; (-) strand; PAM type: YTN; PAM sequence: CTC
cataggatcttgcatatctt

SEQ ID NO: 47458 - DNA, 20 bp, Artificial Sequence
  Description of Artificial Sequence: Synthetic oligonucleotide
  Target: SCN10A; (-) strand; PAM type: YTN; PAM sequence: TTC
tccataggatcttgcatatc

SEQ ID NO: 47459 - DNA, 20 bp, Artificial Sequence
  Description of Artificial Sequence: Synthetic oligonucleotide
  Target: SCN10A; (-) strand; PAM type: YTN; PAM sequence: TTT
ctccataggatcttgcatat

SEQ ID NO: 47460 - DNA, 20 bp, Artificial Sequence
  Description of Artificial Sequence: Synthetic oligonucleotide
  Target: SCN10A; (-) strand; PAM type: YTN; PAM sequence: TTT
tctccataggatcttgcata

SEQ ID NO: 47461 - DNA, 20 bp, Artificial Sequence
  Description of Artificial Sequence: Synthetic oligonucleotide
  Target: SCN10A; (-) strand; PAM type: YTN; PAM sequence: TTA
taattttctccataggatct

SEQ ID NO: 47462 - DNA, 20 bp, Artificial Sequence
  Description of Artificial Sequence: Synthetic oligonucleotide
  Target: SCN10A; (-) strand; PAM type: YTN; PAM sequence: TTT
ataattttctccataggatc

SEQ ID NO: 47463 - DNA, 20 bp, Artificial Sequence
  Description of Artificial Sequence: Synthetic oligonucleotide
  Target: SCN10A; (-) strand; PAM type: YTN; PAM sequence: TTT
tataattttctccataggat

SEQ ID NO: 47464 - DNA, 20 bp, Artificial Sequence
  Description of Artificial Sequence: Synthetic oligonucleotide
  Target: SCN10A; (-) strand; PAM type: YTN; PAM sequence: TTT
ttataattttctccatagga

SEQ ID NO: 47465 - DNA, 20 bp, Artificial Sequence
  Description of Artificial Sequence: Synthetic oligonucleotide
  Target: SCN10A; (-) strand; PAM type: YTN; PAM sequence: TTC
catgaggtttttataatttt

SEQ ID NO: 47466 - DNA, 20 bp, Artificial Sequence
  Description of Artificial Sequence: Synthetic oligonucleotide
  Target: SCN10A; (-) strand; PAM type: YTN; PAM sequence: TTT
ccatgaggtttttataattt

SEQ ID NO: 47467 - DNA, 20 bp, Artificial Sequence
  Description of Artificial Sequence: Synthetic oligonucleotide
  Target: SCN10A; (-) strand; PAM type: YTN; PAM sequence: TTA
aaaatgtttccatgaggttt

SEQ ID NO: 47468 - DNA, 20 bp, Artificial Sequence
  Description of Artificial Sequence: Synthetic oligonucleotide
  Target: SCN10A; (-) strand; PAM type: YTN; PAM sequence: TTT
aaaaatgtttccatgaggtt

SEQ ID NO: 47469 - DNA, 20 bp, Artificial Sequence
  Description of Artificial Sequence: Synthetic oligonucleotide
  Target: SCN10A; (-) strand; PAM type: YTN; PAM sequence: TTC
aataaagtttaaaaatgttt

SEQ ID NO: 47470 - DNA, 20 bp, Artificial Sequence
  Description of Artificial Sequence: Synthetic oligonucleotide
  Target: SCN10A; (-) strand; PAM type: YTN; PAM sequence: TTT
caataaagtttaaaaatgtt

SEQ ID NO: 47471 - DNA, 20 bp, Artificial Sequence
  Description of Artificial Sequence: Synthetic oligonucleotide
  Target: SCN10A; (-) strand; PAM type: YTN; PAM sequence: CTT
tcaataaagtttaaaaatgt

SEQ ID NO: 47472 - DNA, 20 bp, Artificial Sequence
  Description of Artificial Sequence: Synthetic oligonucleotide
  Target: SCN10A; (-) strand; PAM type: YTN; PAM sequence: CTG
tataccagtctttcaataaa

SEQ ID NO: 47473 - DNA, 20 bp, Artificial Sequence
  Description of Artificial Sequence: Synthetic oligonucleotide
  Target: SCN10A; (-) strand; PAM type: YTN; PAM sequence: CTA
tgaagatagtatacgctgta

SEQ ID NO: 47474 - DNA, 20 bp, Artificial Sequence
  Description of Artificial Sequence: Synthetic oligonucleotide
  Target: SCN10A; (-) strand; PAM type: YTN; PAM sequence: CTG
atctatgaagatagtatacg

SEQ ID NO: 47475 - DNA, 20 bp, Artificial Sequence
  Description of Artificial Sequence: Synthetic oligonucleotide
  Target: SCN10A; (-) strand; PAM type: YTN; PAM sequence: TTC
tgatctatgaagatagtata

SEQ ID NO: 47476 - DNA, 20 bp, Artificial Sequence
  Description of Artificial Sequence: Synthetic oligonucleotide
  Target: SCN10A; (-) strand; PAM type: YTN; PAM sequence: CTT
ctgatctatgaagatagtat

SEQ ID NO: 47477 - DNA, 20 bp, Artificial Sequence
  Description of Artificial Sequence: Synthetic oligonucleotide
  Target: SCN10A; (-) strand; PAM type: YTN; PAM sequence: TTC
agtcttctgatctatgaaga

SEQ ID NO: 47478 - DNA, 20 bp, Artificial Sequence
  Description of Artificial Sequence: Synthetic oligonucleotide
  Target: SCN10A; (-) strand; PAM type: YTN; PAM sequence: TTA
cataattcagtcttctgatc

SEQ ID NO: 47479 - DNA, 20 bp, Artificial Sequence
  Description of Artificial Sequence: Synthetic oligonucleotide
  Target: SCN10A; (-) strand; PAM type: YTN; PAM sequence: TTT
acataattcagtcttctgat

SEQ ID NO: 47480 - DNA, 20 bp, Artificial Sequence
  Description of Artificial Sequence: Synthetic oligonucleotide
  Target: SCN10A; (-) strand; PAM type: YTN; PAM sequence: CTT
tacataattcagtcttctga

SEQ ID NO: 47481 - DNA, 20 bp, Artificial Sequence
  Description of Artificial Sequence: Synthetic oligonucleotide
  Target: SCN10A; (-) strand; PAM type: YTN; PAM sequence: TTA
taatctttacataattcagt

SEQ ID NO: 47482 - DNA, 20 bp, Artificial Sequence
  Description of Artificial Sequence: Synthetic oligonucleotide
  Target: SCN10A; (-) strand; PAM type: YTN; PAM sequence: CTT
ataatctttacataattcag

SEQ ID NO: 47483 - DNA, 20 bp, Artificial Sequence
  Description of Artificial Sequence: Synthetic oligonucleotide
  Target: SCN10A; (-) strand; PAM type: YTN; PAM sequence: TTG
ggaagacttataatctttac

SEQ ID NO: 47484 - DNA, 20 bp, Artificial Sequence
  Description of Artificial Sequence: Synthetic oligonucleotide
  Target: SCN10A; (-) strand; PAM type: YTN; PAM sequence: TTT
gggaagacttataatcttta

SEQ ID NO: 47485 - DNA, 20 bp, Artificial Sequence
  Description of Artificial Sequence: Synthetic oligonucleotide
  Target: SCN10A; (-) strand; PAM type: YTN; PAM sequence: TTG
ataggtcaatttgggaagac

SEQ ID NO: 47486 - DNA, 20 bp, Artificial Sequence
  Description of Artificial Sequence: Synthetic oligonucleotide
  Target: SCN10A; (-) strand; PAM type: YTN; PAM sequence: CTG
taattgataggtcaatttgg

SEQ ID NO: 47487 - DNA, 20 bp, Artificial Sequence
  Description of Artificial Sequence: Synthetic oligonucleotide
  Target: SCN10A; (-) strand; PAM type: YTN; PAM sequence: CTG
ctgtaattgataggtcaatt

SEQ ID NO: 47488 - DNA, 20 bp, Artificial Sequence
  Description of Artificial Sequence: Synthetic oligonucleotide
  Target: SCN10A; (-) strand; PAM type: YTN; PAM sequence: TTA
gggactgctgtaattgatag

SEQ ID NO: 47489 - DNA, 20 bp, Artificial Sequence
  Description of Artificial Sequence: Synthetic oligonucleotide
  Target: SCN10A; (-) strand; PAM type: YTN; PAM sequence: TTC
ccattagggactgctgtaat

SEQ ID NO: 47490 - DNA, 20 bp, Artificial Sequence
  Description of Artificial Sequence: Synthetic oligonucleotide
  Target: SCN10A; (-) strand; PAM type: YTN; PAM sequence: TTT
cccattagggactgctgtaa

SEQ ID NO: 47491 - DNA, 20 bp, Artificial Sequence
  Description of Artificial Sequence: Synthetic oligonucleotide
  Target: SCN10A; (-) strand; PAM type: YTN; PAM sequence: TTT
tcccattagggactgctgta

SEQ ID NO: 47492 - DNA, 20 bp, Artificial Sequence
  Description of Artificial Sequence: Synthetic oligonucleotide
  Target: SCN10A; (-) strand; PAM type: YTN; PAM sequence: TTT
ttcccattagggactgctgt

SEQ ID NO: 47493 - DNA, 20 bp, Artificial Sequence
  Description of Artificial Sequence: Synthetic oligonucleotide
  Target: SCN10A; (-) strand; PAM type: YTN; PAM sequence: TTG
tttttcccattagggactgc

SEQ ID NO: 47494 - DNA, 20 bp, Artificial Sequence
  Description of Artificial Sequence: Synthetic oligonucleotide
  Target: SCN10A; (-) strand; PAM type: YTN; PAM sequence: CTA
ttgtttttcccattagggac

SEQ ID NO: 47495 - DNA, 20 bp, Artificial Sequence
  Description of Artificial Sequence: Synthetic oligonucleotide
  Target: SCN10A; (-) strand; PAM type: YTN; PAM sequence: CTG
ctattgtttttcccattagg

SEQ ID NO: 47496 - DNA, 20 bp, Artificial Sequence
  Description of Artificial Sequence: Synthetic oligonucleotide
  Target: SCN10A; (-) strand; PAM type: YTN; PAM sequence: TTA
catacccacatacacacaaa

SEQ ID NO: 47497 - DNA, 20 bp, Artificial Sequence
  Description of Artificial Sequence: Synthetic oligonucleotide
  Target: SCN10A; (-) strand; PAM type: YTN; PAM sequence: TTG
ccaagttacatacccacata

SEQ ID NO: 47498 - DNA, 20 bp, Artificial Sequence
  Description of Artificial Sequence: Synthetic oligonucleotide
  Target: SCN10A; (-) strand; PAM type: YTN; PAM sequence: CTT
gccaagttacatacccacat

SEQ ID NO: 47499 - DNA, 20 bp, Artificial Sequence
  Description of Artificial Sequence: Synthetic oligonucleotide
  Target: SCN10A; (-) strand; PAM type: YTN; PAM sequence: TTA
tcttgccaagttacataccc

SEQ ID NO: 47500 - DNA, 20 bp, Artificial Sequence
  Description of Artificial Sequence: Synthetic oligonucleotide
  Target: SCN10A; (-) strand; PAM type: YTN; PAM sequence: TTA
gaattatcttgccaagttac

SEQ ID NO: 47501 - DNA, 20 bp, Artificial Sequence
  Description of Artificial Sequence: Synthetic oligonucleotide
  Target: SCN10A; (-) strand; PAM type: YTN; PAM sequence: TTT
agaattatcttgccaagtta

SEQ ID NO: 47502 - DNA, 20 bp, Artificial Sequence
  Description of Artificial Sequence: Synthetic oligonucleotide
  Target: SCN10A; (-) strand; PAM type: YTN; PAM sequence: CTT
tagaattatcttgccaagtt

SEQ ID NO: 47503 - DNA, 20 bp, Artificial Sequence
  Description of Artificial Sequence: Synthetic oligonucleotide
  Target: SCN10A; (-) strand; PAM type: YTN; PAM sequence: TTC
actttagaattatcttgcca

SEQ ID NO: 47504 - DNA, 20 bp, Artificial Sequence
  Description of Artificial Sequence: Synthetic oligonucleotide
  Target: SCN10A; (-) strand; PAM type: YTN; PAM sequence: TTC
atattcactttagaattatc

SEQ ID NO: 47505 - DNA, 20 bp, Artificial Sequence
  Description of Artificial Sequence: Synthetic oligonucleotide
  Target: SCN10A; (-) strand; PAM type: YTN; PAM sequence: TTT
catattcactttagaattat

SEQ ID NO: 47506 - DNA, 20 bp, Artificial Sequence
  Description of Artificial Sequence: Synthetic oligonucleotide
  Target: SCN10A; (-) strand; PAM type: YTN; PAM sequence: CTT
tcatattcactttagaatta

SEQ ID NO: 47507 - DNA, 20 bp, Artificial Sequence
  Description of Artificial Sequence: Synthetic oligonucleotide
  Target: SCN10A; (-) strand; PAM type: YTN; PAM sequence: CTG
cacactttcatattcacttt

SEQ ID NO: 47508 - DNA, 20 bp, Artificial Sequence
  Description of Artificial Sequence: Synthetic oligonucleotide
  Target: SCN10A; (-) strand; PAM type: YTN; PAM sequence: TTG
gcctgcacactttcatattc

SEQ ID NO: 47509 - DNA, 20 bp, Artificial Sequence
  Description of Artificial Sequence: Synthetic oligonucleotide
  Target: SCN10A; (-) strand; PAM type: YTN; PAM sequence: CTT
ggcctgcacactttcatatt

SEQ ID NO: 47510 - DNA, 20 bp, Artificial Sequence
  Description of Artificial Sequence: Synthetic oligonucleotide
  Target: SCN10A; (-) strand; PAM type: YTN; PAM sequence: TTC
aagaatatcttggcctgcac

SEQ ID NO: 47511 - DNA, 20 bp, Artificial Sequence
  Description of Artificial Sequence: Synthetic oligonucleotide
  Target: SCN10A; (-) strand; PAM type: YTN; PAM sequence: CTT
caagaatatcttggcctgca

SEQ ID NO: 47512 - DNA, 20 bp, Artificial Sequence
  Description of Artificial Sequence: Synthetic oligonucleotide
  Target: SCN10A; (-) strand; PAM type: YTN; PAM sequence: TTA
cttcaagaatatcttggcct

SEQ ID NO: 47513 - DNA, 20 bp, Artificial Sequence
  Description of Artificial Sequence: Synthetic oligonucleotide
  Target: SCN10A; (-) strand; PAM type: YTN; PAM sequence: TTT
acttcaagaatatcttggcc

SEQ ID NO: 47514 - DNA, 20 bp, Artificial Sequence
  Description of Artificial Sequence: Synthetic oligonucleotide
  Target: SCN10A; (-) strand; PAM type: YTN; PAM sequence: CTA
atttacttcaagaatatctt

SEQ ID NO: 47515 - DNA, 20 bp, Artificial Sequence
  Description of Artificial Sequence: Synthetic oligonucleotide
  Target: SCN10A; (-) strand; PAM type: YTN; PAM sequence: CTG
taaatcaagtaatccaccta

SEQ ID NO: 47516 - DNA, 20 bp, Artificial Sequence
  Description of Artificial Sequence: Synthetic oligonucleotide
  Target: SCN10A; (-) strand; PAM type: YTN; PAM sequence: CTG
tgtctgtaaatcaagtaatc

SEQ ID NO: 47517 - DNA, 20 bp, Artificial Sequence
  Description of Artificial Sequence: Synthetic oligonucleotide
  Target: SCN10A; (-) strand; PAM type: YTN; PAM sequence: TTA
aatatatctgtgtctgtaaa

SEQ ID NO: 47518 - DNA, 20 bp, Artificial Sequence
  Description of Artificial Sequence: Synthetic oligonucleotide
  Target: SCN10A; (-) strand; PAM type: YTN; PAM sequence: TTT
aaatatatctgtgtctgtaa

SEQ ID NO: 47519 - DNA, 20 bp, Artificial Sequence
  Description of Artificial Sequence: Synthetic oligonucleotide
  Target: SCN10A; (-) strand; PAM type: YTN; PAM sequence: CTT
taaatatatctgtgtctgta

SEQ ID NO: 47520 - DNA, 20 bp, Artificial Sequence
  Description of Artificial Sequence: Synthetic oligonucleotide
  Target: SCN10A; (-) strand; PAM type: YTN; PAM sequence: TTA
tggcagctttaaatatatct

SEQ ID NO: 47521 - DNA, 20 bp, Artificial Sequence
  Description of Artificial Sequence: Synthetic oligonucleotide
  Target: SCN10A; (-) strand; PAM type: YTN; PAM sequence: TTA
attatggcagctttaaatat

SEQ ID NO: 47522 - DNA, 20 bp, Artificial Sequence
  Description of Artificial Sequence: Synthetic oligonucleotide
  Target: SCN10A; (-) strand; PAM type: YTN; PAM sequence: CTT
aattatggcagctttaaata

SEQ ID NO: 47523 - DNA, 20 bp, Artificial Sequence
  Description of Artificial Sequence: Synthetic oligonucleotide
  Target: SCN10A; (-) strand; PAM type: YTN; PAM sequence: CTG
gcaccaatatcagtcttaat

SEQ ID NO: 47524 - DNA, 20 bp, Artificial Sequence
  Description of Artificial Sequence: Synthetic oligonucleotide
  Target: SCN10A; (-) strand; PAM type: YTN; PAM sequence: CTA
tcctggcaccaatatcagtc

SEQ ID NO: 47525 - DNA, 20 bp, Artificial Sequence
  Description of Artificial Sequence: Synthetic oligonucleotide
  Target: SCN10A; (-) strand; PAM type: YTN; PAM sequence: TTG
gtctatcctggcaccaatat

SEQ ID NO: 47526 - DNA, 20 bp, Artificial Sequence
  Description of Artificial Sequence: Synthetic oligonucleotide
  Target: SCN10A; (-) strand; PAM type: YTN; PAM sequence: TTA
gtccattggtctatcctggc

SEQ ID NO: 47527 - DNA, 20 bp, Artificial Sequence
  Description of Artificial Sequence: Synthetic oligonucleotide
  Target: SCN10A; (-) strand; PAM type: YTN; PAM sequence: CTG
ttagtccattggtctatcct

SEQ ID NO: 47528 - DNA, 20 bp, Artificial Sequence
  Description of Artificial Sequence: Synthetic oligonucleotide
  Target: SCN10A; (-) strand; PAM type: YTN; PAM sequence: CTC
tgttagtccattggtctatc

SEQ ID NO: 47529 - DNA, 20 bp, Artificial Sequence
  Description of Artificial Sequence: Synthetic oligonucleotide
  Target: SCN10A; (-) strand; PAM type: YTN; PAM sequence: TTG
ctctgttagtccattggtct

SEQ ID NO: 47530 - DNA, 20 bp, Artificial Sequence
  Description of Artificial Sequence: Synthetic oligonucleotide
  Target: SCN10A; (-) strand; PAM type: YTN; PAM sequence: TTT
gctctgttagtccattggtc

SEQ ID NO: 47531 - DNA, 20 bp, Artificial Sequence
  Description of Artificial Sequence: Synthetic oligonucleotide
  Target: SCN10A; (-) strand; PAM type: YTN; PAM sequence: CTC
catttgctctgttagtccat

SEQ ID NO: 47532 - DNA, 20 bp, Artificial Sequence
  Description of Artificial Sequence: Synthetic oligonucleotide
  Target: SCN10A; (-) strand; PAM type: YTN; PAM sequence: TTG
ctccatttgctctgttagtc

SEQ ID NO: 47533 - DNA, 20 bp, Artificial Sequence
  Description of Artificial Sequence: Synthetic oligonucleotide
  Target: SCN10A; (-) strand; PAM type: YTN; PAM sequence: CTT
gctccatttgctctgttagt

SEQ ID NO: 47534 - DNA, 20 bp, Artificial Sequence
  Description of Artificial Sequence: Synthetic oligonucleotide
  Target: SCN10A; (-) strand; PAM type: YTN; PAM sequence: TTA
aagccttgctccatttgctc

SEQ ID NO: 47535 - DNA, 20 bp, Artificial Sequence
  Description of Artificial Sequence: Synthetic oligonucleotide
  Target: SCN10A; (-) strand; PAM type: YTN; PAM sequence: CTT
aaagccttgctccatttgct

SEQ ID NO: 47536 - DNA, 20 bp, Artificial Sequence
  Description of Artificial Sequence: Synthetic oligonucleotide
  Target: SCN10A; (-) strand; PAM type: YTN; PAM sequence: CTC
ccgtcacttaaagccttgct

SEQ ID NO: 47537 - DNA, 20 bp, Artificial Sequence
  Description of Artificial Sequence: Synthetic oligonucleotide
  Target: SCN10A; (-) strand; PAM type: YTN; PAM sequence: CTC
ctcccgtcacttaaagcctt

SEQ ID NO: 47538 - DNA, 20 bp, Artificial Sequence
  Description of Artificial Sequence: Synthetic oligonucleotide
  Target: SCN10A; (-) strand; PAM type: YTN; PAM sequence: TTC
tcctcccgtcacttaaagcc

SEQ ID NO: 47539 - DNA, 20 bp, Artificial Sequence
  Description of Artificial Sequence: Synthetic oligonucleotide
  Target: SCN10A; (-) strand; PAM type: YTN; PAM sequence: CTT
ctcctcccgtcacttaaagc

SEQ ID NO: 47540 - DNA, 20 bp, Artificial Sequence
  Description of Artificial Sequence: Synthetic oligonucleotide
  Target: SCN10A; (-) strand; PAM type: YTN; PAM sequence: TTG
cttctcctcccgtcacttaa

SEQ ID NO: 47541 - DNA, 20 bp, Artificial Sequence
  Description of Artificial Sequence: Synthetic oligonucleotide
  Target: SCN10A; (-) strand; PAM type: YTN; PAM sequence: CTC
ccaaaatagcattgcttctc

SEQ ID NO: 47542 - DNA, 20 bp, Artificial Sequence
  Description of Artificial Sequence: Synthetic oligonucleotide
  Target: SCN10A; (-) strand; PAM type: YTN; PAM sequence: CTC
tcccaaaatagcattgcttc

SEQ ID NO: 47543 - DNA, 20 bp, Artificial Sequence
  Description of Artificial Sequence: Synthetic oligonucleotide
  Target: SCN10A; (-) strand; PAM type: YTN; PAM sequence: TTC
tctcccaaaatagcattgct

SEQ ID NO: 47544 - DNA, 20 bp, Artificial Sequence
  Description of Artificial Sequence: Synthetic oligonucleotide
  Target: SCN10A; (-) strand; PAM type: YTN; PAM sequence: CTT
ctctcccaaaatagcattgc

SEQ ID NO: 47545 - DNA, 20 bp, Artificial Sequence
  Description of Artificial Sequence: Synthetic oligonucleotide
  Target: SCN10A; (-) strand; PAM type: YTN; PAM sequence: TTC
cttctctcccaaaatagcat

SEQ ID NO: 47546 - DNA, 20 bp, Artificial Sequence
  Description of Artificial Sequence: Synthetic oligonucleotide
  Target: SCN10A; (-) strand; PAM type: YTN; PAM sequence: CTT
ccttctctcccaaaatagca

SEQ ID NO: 47547 - DNA, 20 bp, Artificial Sequence
  Description of Artificial Sequence: Synthetic oligonucleotide
  Target: SCN10A; (-) strand; PAM type: YTN; PAM sequence: CTG
tcttccttctctcccaaaat

SEQ ID NO: 47548 - DNA, 20 bp, Artificial Sequence
  Description of Artificial Sequence: Synthetic oligonucleotide
  Target: SCN10A; (-) strand; PAM type: YTN; PAM sequence: TTG
aaggaaggaaagaaagagag

SEQ ID NO: 47549 - DNA, 20 bp, Artificial Sequence
  Description of Artificial Sequence: Synthetic oligonucleotide
  Target: SCN10A; (-) strand; PAM type: YTN; PAM sequence: TTG
attgaaggaaggaaagaaag

SEQ ID NO: 47550 - DNA, 20 bp, Artificial Sequence
  Description of Artificial Sequence: Synthetic oligonucleotide
  Target: SCN10A; (-) strand; PAM type: YTN; PAM sequence: TTG
attgattgaaggaaggaaag

SEQ ID NO: 47551 - DNA, 20 bp, Artificial Sequence
  Description of Artificial Sequence: Synthetic oligonucleotide
  Target: SCN10A; (-) strand; PAM type: YTN; PAM sequence: CTG
ttgattgattgaaggaagga

SEQ ID NO: 47552 - DNA, 20 bp, Artificial Sequence
  Description of Artificial Sequence: Synthetic oligonucleotide
  Target: SCN10A; (-) strand; PAM type: YTN; PAM sequence: CTC
aataaacacctgttgattga

SEQ ID NO: 47553 - DNA, 20 bp, Artificial Sequence
  Description of Artificial Sequence: Synthetic oligonucleotide
  Target: SCN10A; (-) strand; PAM type: YTN; PAM sequence: CTA
gcacaaggcccagcacatac

SEQ ID NO: 47554 - DNA, 20 bp, Artificial Sequence
  Description of Artificial Sequence: Synthetic oligonucleotide
  Target: SCN10A; (-) strand; PAM type: YTN; PAM sequence: TTA
tcccaagggcctagcacaag

SEQ ID NO: 47555 - DNA, 20 bp, Artificial Sequence
  Description of Artificial Sequence: Synthetic oligonucleotide
  Target: SCN10A; (-) strand; PAM type: YTN; PAM sequence: TTT
atcccaagggcctagcacaa

SEQ ID NO: 47556 - DNA, 20 bp, Artificial Sequence
  Description of Artificial Sequence: Synthetic oligonucleotide
  Target: SCN10A; (-) strand; PAM type: YTN; PAM sequence: TTT
tatcccaagggcctagcaca

SEQ ID NO: 47557 - DNA, 20 bp, Artificial Sequence
  Description of Artificial Sequence: Synthetic oligonucleotide
  Target: SCN10A; (-) strand; PAM type: YTN; PAM sequence: CTA
ccgttttatcccaagggcct

SEQ ID NO: 47558 - DNA, 20 bp, Artificial Sequence
  Description of Artificial Sequence: Synthetic oligonucleotide
  Target: SCN10A; (-) strand; PAM type: YTN; PAM sequence: TTG
tctaccgttttatcccaagg

SEQ ID NO: 47559 - DNA, 20 bp, Artificial Sequence
  Description of Artificial Sequence: Synthetic oligonucleotide
  Target: SCN10A; (-) strand; PAM type: YTN; PAM sequence: CTT
gtctaccgttttatcccaag

SEQ ID NO: 47560 - DNA, 20 bp, Artificial Sequence
  Description of Artificial Sequence: Synthetic oligonucleotide
  Target: SCN10A; (-) strand; PAM type: YTN; PAM sequence: TTC
ttgtctaccgttttatccca

SEQ ID NO: 47561 - DNA, 20 bp, Artificial Sequence
  Description of Artificial Sequence: Synthetic oligonucleotide
  Target: SCN10A; (-) strand; PAM type: YTN; PAM sequence: TTT
cttgtctaccgttttatccc

SEQ ID NO: 47562 - DNA, 20 bp, Artificial Sequence
  Description of Artificial Sequence: Synthetic oligonucleotide
  Target: SCN10A; (-) strand; PAM type: YTN; PAM sequence: CTA
tcccatgaggcaaaaaccag

SEQ ID NO: 47563 - DNA, 20 bp, Artificial Sequence
  Description of Artificial Sequence: Synthetic oligonucleotide
  Target: SCN10A; (-) strand; PAM type: YTN; PAM sequence: CTG
ctatcccatgaggcaaaaac

SEQ ID NO: 47564 - DNA, 20 bp, Artificial Sequence
  Description of Artificial Sequence: Synthetic oligonucleotide
  Target: SCN10A; (-) strand; PAM type: YTN; PAM sequence: TTG
tcctgctatcccatgaggca

SEQ ID NO: 47565 - DNA, 20 bp, Artificial Sequence
  Description of Artificial Sequence: Synthetic oligonucleotide
  Target: SCN10A; (-) strand; PAM type: YTN; PAM sequence: TTA
caattgtcctgctatcccat

SEQ ID NO: 47566 - DNA, 20 bp, Artificial Sequence
  Description of Artificial Sequence: Synthetic oligonucleotide
  Target: SCN10A; (-) strand; PAM type: YTN; PAM sequence: TTT
acaattgtcctgctatccca

SEQ ID NO: 47567 - DNA, 20 bp, Artificial Sequence
  Description of Artificial Sequence: Synthetic oligonucleotide
  Target: SCN10A; (-) strand; PAM type: YTN; PAM sequence: CTG
gcatttacaattgtcctgct

SEQ ID NO: 47568 - DNA, 20 bp, Artificial Sequence
  Description of Artificial Sequence: Synthetic oligonucleotide
  Target: SCN10A; (-) strand; PAM type: YTN; PAM sequence: TTA
acctggcatttacaattgtc

SEQ ID NO: 47569 - DNA, 20 bp, Artificial Sequence
  Description of Artificial Sequence: Synthetic oligonucleotide
  Target: SCN10A; (-) strand; PAM type: YTN; PAM sequence: TTC
atcaaattaacctggcattt

SEQ ID NO: 47570 - DNA, 20 bp, Artificial Sequence
  Description of Artificial Sequence: Synthetic oligonucleotide
  Target: SCN10A; (-) strand; PAM type: YTN; PAM sequence: CTT
catcaaattaacctggcatt

SEQ ID NO: 47571 - DNA, 20 bp, Artificial Sequence
  Description of Artificial Sequence: Synthetic oligonucleotide
  Target: SCN10A; (-) strand; PAM type: YTN; PAM sequence: TTC
cttcatcaaattaacctggc

SEQ ID NO: 47572 - DNA, 20 bp, Artificial Sequence
  Description of Artificial Sequence: Synthetic oligonucleotide
  Target: SCN10A; (-) strand; PAM type: YTN; PAM sequence: TTG
gattccttcatcaaattaac

SEQ ID NO: 47573 - DNA, 20 bp, Artificial Sequence
  Description of Artificial Sequence: Synthetic oligonucleotide
  Target: SCN10A; (-) strand; PAM type: YTN; PAM sequence: CTA
aagttggattccttcatcaa

SEQ ID NO: 47574 - DNA, 20 bp, Artificial Sequence
  Description of Artificial Sequence: Synthetic oligonucleotide
  Target: SCN10A; (-) strand; PAM type: YTN; PAM sequence: CTA
tctaaagttggattccttca

SEQ ID NO: 47575 - DNA, 20 bp, Artificial Sequence
  Description of Artificial Sequence: Synthetic oligonucleotide
  Target: SCN10A; (-) strand; PAM type: YTN; PAM sequence: CTC
cccaaccacactatctaaag

SEQ ID NO: 47576 - DNA, 20 bp, Artificial Sequence
  Description of Artificial Sequence: Synthetic oligonucleotide
  Target: SCN10A; (-) strand; PAM type: YTN; PAM sequence: TTA
gaggggacctccccaaccac

SEQ ID NO: 47577 - DNA, 20 bp, Artificial Sequence
  Description of Artificial Sequence: Synthetic oligonucleotide
  Target: SCN10A; (-) strand; PAM type: YTN; PAM sequence: CTT
agaggggacctccccaacca

SEQ ID NO: 47578 - DNA, 20 bp, Artificial Sequence
  Description of Artificial Sequence: Synthetic oligonucleotide
  Target: SCN10A; (-) strand; PAM type: YTN; PAM sequence: CTC
cttagaggggacctccccaa

SEQ ID NO: 47579 - DNA, 20 bp, Artificial Sequence
  Description of Artificial Sequence: Synthetic oligonucleotide
  Target: SCN10A; (-) strand; PAM type: YTN; PAM sequence: TTG
tcacctccttagaggggacc

SEQ ID NO: 47580 - DNA, 20 bp, Artificial Sequence
  Description of Artificial Sequence: Synthetic oligonucleotide
  Target: SCN10A; (-) strand; PAM type: YTN; PAM sequence: CTT
gtcacctccttagaggggac

SEQ ID NO: 47581 - DNA, 20 bp, Artificial Sequence
  Description of Artificial Sequence: Synthetic oligonucleotide
  Target: SCN10A; (-) strand; PAM type: YTN; PAM sequence: TTC
aatgcacttgtcacctcctt

SEQ ID NO: 47582 - DNA, 20 bp, Artificial Sequence
  Description of Artificial Sequence: Synthetic oligonucleotide
  Target: SCN10A; (-) strand; PAM type: YTN; PAM sequence: CTG
tgttcaatgcacttgtcacc

SEQ ID NO: 47583 - DNA, 20 bp, Artificial Sequence
  Description of Artificial Sequence: Synthetic oligonucleotide
  Target: SCN10A; (-) strand; PAM type: YTN; PAM sequence: CTC
tgtgttcaatgcacttgtca

SEQ ID NO: 47584 - DNA, 20 bp, Artificial Sequence
  Description of Artificial Sequence: Synthetic oligonucleotide
  Target: SCN10A; (-) strand; PAM type: YTN; PAM sequence: CTC
aaactctgtgttcaatgcac

SEQ ID NO: 47585 - DNA, 20 bp, Artificial Sequence
  Description of Artificial Sequence: Synthetic oligonucleotide
  Target: SCN10A; (-) strand; PAM type: YTN; PAM sequence: TTC
tcaaactctgtgttcaatgc

SEQ ID NO: 47586 - DNA, 20 bp, Artificial Sequence
  Description of Artificial Sequence: Synthetic oligonucleotide
  Target: SCN10A; (-) strand; PAM type: YTN; PAM sequence: TTA
ttctcaaactctgtgttcaa

SEQ ID NO: 47587 - DNA, 20 bp, Artificial Sequence
  Description of Artificial Sequence: Synthetic oligonucleotide
  Target: SCN10A; (-) strand; PAM type: YTN; PAM sequence: CTT
attctcaaactctgtgttca

SEQ ID NO: 47588 - DNA, 20 bp, Artificial Sequence
  Description of Artificial Sequence: Synthetic oligonucleotide
  Target: SCN10A; (-) strand; PAM type: YTN; PAM sequence: CTC
acttattctcaaactctgtg

SEQ ID NO: 47589 - DNA, 20 bp, Artificial Sequence
  Description of Artificial Sequence: Synthetic oligonucleotide
  Target: SCN10A; (-) strand; PAM type: YTN; PAM sequence: TTA
gctcacttattctcaaactc

SEQ ID NO: 47590 - DNA, 20 bp, Artificial Sequence
  Description of Artificial Sequence: Synthetic oligonucleotide
  Target: SCN10A; (-) strand; PAM type: YTN; PAM sequence: CTT
agctcacttattctcaaact

SEQ ID NO: 47591 - DNA, 20 bp, Artificial Sequence
  Description of Artificial Sequence: Synthetic oligonucleotide
  Target: SCN10A; (-) strand; PAM type: YTN; PAM sequence: TTC
acttagctcacttattctca

SEQ ID NO: 47592 - DNA, 20 bp, Artificial Sequence
  Description of Artificial Sequence: Synthetic oligonucleotide
  Target: SCN10A; (-) strand; PAM type: YTN; PAM sequence: CTT
cacttagctcacttattctc

SEQ ID NO: 47593 - DNA, 20 bp, Artificial Sequence
  Description of Artificial Sequence: Synthetic oligonucleotide
  Target: SCN10A; (-) strand; PAM type: YTN; PAM sequence: TTA
gtcttcacttagctcactta

SEQ ID NO: 47594 - DNA, 20 bp, Artificial Sequence
  Description of Artificial Sequence: Synthetic oligonucleotide
  Target: SCN10A; (-) strand; PAM type: YTN; PAM sequence: TTT
agtcttcacttagctcactt

SEQ ID NO: 47595 - DNA, 20 bp, Artificial Sequence
  Description of Artificial Sequence: Synthetic oligonucleotide
  Target: SCN10A; (-) strand; PAM type: YTN; PAM sequence: CTT
tagtcttcacttagctcact

SEQ ID NO: 47596 - DNA, 20 bp, Artificial Sequence
  Description of Artificial Sequence: Synthetic oligonucleotide
  Target: SCN10A; (-) strand; PAM type: YTN; PAM sequence: TTC
ctttagtcttcacttagctc

SEQ ID NO: 47597 - DNA, 20 bp, Artificial Sequence
  Description of Artificial Sequence: Synthetic oligonucleotide
  Target: SCN10A; (-) strand; PAM type: YTN; PAM sequence: TTT
cctttagtcttcacttagct

SEQ ID NO: 47598 - DNA, 20 bp, Artificial Sequence
  Description of Artificial Sequence: Synthetic oligonucleotide
  Target: SCN10A; (-) strand; PAM type: YTN; PAM sequence: TTT
tcctttagtcttcacttagc

SEQ ID NO: 47599 - DNA, 20 bp, Artificial Sequence
  Description of Artificial Sequence: Synthetic oligonucleotide
  Target: SCN10A; (-) strand; PAM type: YTN; PAM sequence: CTT
ttcctttagtcttcacttag

SEQ ID NO: 47600 - DNA, 20 bp, Artificial Sequence
  Description of Artificial Sequence: Synthetic oligonucleotide
  Target: SCN10A; (-) strand; PAM type: YTN; PAM sequence: CTG
gaatacttttcctttagtct

SEQ ID NO: 47601 - DNA, 20 bp, Artificial Sequence
  Description of Artificial Sequence: Synthetic oligonucleotide
  Target: SCN10A; (-) strand; PAM type: YTN; PAM sequence: CTG
tgcctggaatacttttcctt

SEQ ID NO: 47602 - DNA, 20 bp, Artificial Sequence
  Description of Artificial Sequence: Synthetic oligonucleotide
  Target: SCN10A; (-) strand; PAM type: YTN; PAM sequence: TTC
gctgtgcctggaatactttt

SEQ ID NO: 47603 - DNA, 20 bp, Artificial Sequence
  Description of Artificial Sequence: Synthetic oligonucleotide
  Target: SCN10A; (-) strand; PAM type: YTN; PAM sequence: TTT
cgctgtgcctggaatacttt

SEQ ID NO: 47604 - DNA, 20 bp, Artificial Sequence
  Description of Artificial Sequence: Synthetic oligonucleotide
  Target: SCN10A; (-) strand; PAM type: YTN; PAM sequence: TTT
tcgctgtgcctggaatactt

SEQ ID NO: 47605 - DNA, 20 bp, Artificial Sequence
  Description of Artificial Sequence: Synthetic oligonucleotide
  Target: SCN10A; (-) strand; PAM type: YTN; PAM sequence: TTT
ttcgctgtgcctggaatact

SEQ ID NO: 47606 - DNA, 20 bp, Artificial Sequence
  Description of Artificial Sequence: Synthetic oligonucleotide
  Target: SCN10A; (-) strand; PAM type: YTN; PAM sequence: TTT
tttcgctgtgcctggaatac

SEQ ID NO: 47607 - DNA, 20 bp, Artificial Sequence
  Description of Artificial Sequence: Synthetic oligonucleotide
  Target: SCN10A; (-) strand; PAM type: YTN; PAM sequence: TTT
ttttcgctgtgcctggaata

SEQ ID NO: 47608 - DNA, 20 bp, Artificial Sequence
  Description of Artificial Sequence: Synthetic oligonucleotide
  Target: SCN10A; (-) strand; PAM type: YTN; PAM sequence: TTG
aagtttttttcgctgtgcct

SEQ ID NO: 47609 - DNA, 20 bp, Artificial Sequence
  Description of Artificial Sequence: Synthetic oligonucleotide
  Target: SCN10A; (-) strand; PAM type: YTN; PAM sequence: TTT
gaagtttttttcgctgtgcc

SEQ ID NO: 47610 - DNA, 20 bp, Artificial Sequence
  Description of Artificial Sequence: Synthetic oligonucleotide
  Target: SCN10A; (-) strand; PAM type: YTN; PAM sequence: CTT
tgaagtttttttcgctgtgc

SEQ ID NO: 47611 - DNA, 20 bp, Artificial Sequence
  Description of Artificial Sequence: Synthetic oligonucleotide
  Target: SCN10A; (-) strand; PAM type: YTN; PAM sequence: TTG
ggcctttgaagtttttttcg

SEQ ID NO: 47612 - DNA, 20 bp, Artificial Sequence
  Description of Artificial Sequence: Synthetic oligonucleotide
  Target: SCN10A; (-) strand; PAM type: YTN; PAM sequence: TTT
gggcctttgaagtttttttc

SEQ ID NO: 47613 - DNA, 20 bp, Artificial Sequence
  Description of Artificial Sequence: Synthetic oligonucleotide
  Target: SCN10A; (-) strand; PAM type: YTN; PAM sequence: CTT
tgggcctttgaagttttttt

SEQ ID NO: 47614 - DNA, 20 bp, Artificial Sequence
  Description of Artificial Sequence: Synthetic oligonucleotide
  Target: SCN10A; (-) strand; PAM type: YTN; PAM sequence: TTG
gctttgggcctttgaagttt

SEQ ID NO: 47615 - DNA, 20 bp, Artificial Sequence
  Description of Artificial Sequence: Synthetic oligonucleotide
  Target: SCN10A; (-) strand; PAM type: YTN; PAM sequence: CTT
ggctttgggcctttgaagtt

SEQ ID NO: 47616 - DNA, 20 bp, Artificial Sequence
  Description of Artificial Sequence: Synthetic oligonucleotide
  Target: SCN10A; (-) strand; PAM type: YTN; PAM sequence: TTC
ttggctttgggcctttgaag

SEQ ID NO: 47617 - DNA, 20 bp, Artificial Sequence
  Description of Artificial Sequence: Synthetic oligonucleotide
  Target: SCN10A; (-) strand; PAM type: YTN; PAM sequence: CTT
cttggctttgggcctttgaa

SEQ ID NO: 47618 - DNA, 20 bp, Artificial Sequence
  Description of Artificial Sequence: Synthetic oligonucleotide
  Target: SCN10A; (-) strand; PAM type: YTN; PAM sequence: TTC
acacataacagagaacttct

SEQ ID NO: 47619 - DNA, 20 bp, Artificial Sequence
  Description of Artificial Sequence: Synthetic oligonucleotide
  Target: SCN10A; (-) strand; PAM type: YTN; PAM sequence: CTT
cacacataacagagaacttc

SEQ ID NO: 47620 - DNA, 20 bp, Artificial Sequence
  Description of Artificial Sequence: Synthetic oligonucleotide
  Target: SCN10A; (-) strand; PAM type: YTN; PAM sequence: TTC
ttcacacataacagagaact

SEQ ID NO: 47621 - DNA, 20 bp, Artificial Sequence
  Description of Artificial Sequence: Synthetic oligonucleotide
  Target: SCN10A; (-) strand; PAM type: YTN; PAM sequence: CTT
cttcacacataacagagaac

SEQ ID NO: 47622 - DNA, 20 bp, Artificial Sequence
  Description of Artificial Sequence: Synthetic oligonucleotide
  Target: SCN10A; (-) strand; PAM type: YTN; PAM sequence: CTC
ttcttcacacataacagaga

SEQ ID NO: 47623 - DNA, 20 bp, Artificial Sequence
  Description of Artificial Sequence: Synthetic oligonucleotide
  Target: SCN10A; (-) strand; PAM type: YTN; PAM sequence: CTC
tcttcttcacacataacaga

SEQ ID NO: 47624 - DNA, 20 bp, Artificial Sequence
  Description of Artificial Sequence: Synthetic oligonucleotide
  Target: SCN10A; (-) strand; PAM type: YTN; PAM sequence: CTC
tctcttcttcacacataaca

SEQ ID NO: 47625 - DNA, 20 bp, Artificial Sequence
  Description of Artificial Sequence: Synthetic oligonucleotide
  Target: SCN10A; (-) strand; PAM type: YTN; PAM sequence: CTA
ctctctcttcttcacacata

SEQ ID NO: 47626 - DNA, 20 bp, Artificial Sequence
  Description of Artificial Sequence: Synthetic oligonucleotide
  Target: SCN10A; (-) strand; PAM type: YTN; PAM sequence: CTC
cagccaaaaaggcctactct

SEQ ID NO: 47627 - DNA, 20 bp, Artificial Sequence
  Description of Artificial Sequence: Synthetic oligonucleotide
  Target: SCN10A; (-) strand; PAM type: YTN; PAM sequence: TTG
ctccagccaaaaaggcctac

SEQ ID NO: 47628 - DNA, 20 bp, Artificial Sequence
  Description of Artificial Sequence: Synthetic oligonucleotide
  Target: SCN10A; (-) strand; PAM type: YTN; PAM sequence: TTT
gctccagccaaaaaggccta

SEQ ID NO: 47629 - DNA, 20 bp, Artificial Sequence
  Description of Artificial Sequence: Synthetic oligonucleotide
  Target: SCN10A; (-) strand; PAM type: YTN; PAM sequence: CTT
tgctccagccaaaaaggcct

SEQ ID NO: 47630 - DNA, 20 bp, Artificial Sequence
  Description of Artificial Sequence: Synthetic oligonucleotide
  Target: SCN10A; (-) strand; PAM type: YTN; PAM sequence: TTG
cccactttgctccagccaaa

SEQ ID NO: 47631 - DNA, 20 bp, Artificial Sequence
  Description of Artificial Sequence: Synthetic oligonucleotide
  Target: SCN10A; (-) strand; PAM type: YTN; PAM sequence: CTT
gcccactttgctccagccaa

SEQ ID NO: 47632 - DNA, 20 bp, Artificial Sequence
  Description of Artificial Sequence: Synthetic oligonucleotide
  Target: SCN10A; (-) strand; PAM type: YTN; PAM sequence: CTC
cgtcttgcccactttgctcc

SEQ ID NO: 47633 - DNA, 20 bp, Artificial Sequence
  Description of Artificial Sequence: Synthetic oligonucleotide
  Target: SCN10A; (-) strand; PAM type: YTN; PAM sequence: TTC
accagtctccgtcttgccca

SEQ ID NO: 47634 - DNA, 20 bp, Artificial Sequence
  Description of Artificial Sequence: Synthetic oligonucleotide
  Target: SCN10A; (-) strand; PAM type: YTN; PAM sequence: CTG
ccagttcaccagtctccgtc

SEQ ID NO: 47635 - DNA, 20 bp, Artificial Sequence
  Description of Artificial Sequence: Synthetic oligonucleotide
  Target: SCN10A; (-) strand; PAM type: YTN; PAM sequence: CTG
cataatcaggacctgccagt

SEQ ID NO: 47636 - DNA, 20 bp, Artificial Sequence
  Description of Artificial Sequence: Synthetic oligonucleotide
  Target: SCN10A; (-) strand; PAM type: YTN; PAM sequence: TTC
tgcataatcaggacctgcca

SEQ ID NO: 47637 - DNA, 20 bp, Artificial Sequence
  Description of Artificial Sequence: Synthetic oligonucleotide
  Target: SCN10A; (-) strand; PAM type: YTN; PAM sequence: CTC
atgatggtgtacaaagttct

SEQ ID NO: 47638 - DNA, 20 bp, Artificial Sequence
  Description of Artificial Sequence: Synthetic oligonucleotide
  Target: SCN10A; (-) strand; PAM type: YTN; PAM sequence: CTC
ctcatgatggtgtacaaagt

SEQ ID NO: 47639 - DNA, 20 bp, Artificial Sequence
  Description of Artificial Sequence: Synthetic oligonucleotide
  Target: SCN10A; (-) strand; PAM type: YTN; PAM sequence: CTG
agaataaaatccagactcct

SEQ ID NO: 47640 - DNA, 20 bp, Artificial Sequence
  Description of Artificial Sequence: Synthetic oligonucleotide
  Target: SCN10A; (-) strand; PAM type: YTN; PAM sequence: CTC
tgagaataaaatccagactc

SEQ ID NO: 47641 - DNA, 20 bp, Artificial Sequence
  Description of Artificial Sequence: Synthetic oligonucleotide
  Target: SCN10A; (-) strand; PAM type: YTN; PAM sequence: TTG
ctctgagaataaaatccaga

SEQ ID NO: 47642 - DNA, 20 bp, Artificial Sequence
  Description of Artificial Sequence: Synthetic oligonucleotide
  Target: SCN10A; (-) strand; PAM type: YTN; PAM sequence: TTC
ccattgctctgagaataaaa

SEQ ID NO: 47643 - DNA, 20 bp, Artificial Sequence
  Description of Artificial Sequence: Synthetic oligonucleotide
  Target: SCN10A; (-) strand; PAM type: YTN; PAM sequence: TTT
cccattgctctgagaataaa

SEQ ID NO: 47644 - DNA, 20 bp, Artificial Sequence
  Description of Artificial Sequence: Synthetic oligonucleotide
  Target: SCN10A; (-) strand; PAM type: YTN; PAM sequence: CTG
gtttcccattgctctgagaa

SEQ ID NO: 47645 - DNA, 20 bp, Artificial Sequence
  Description of Artificial Sequence: Synthetic oligonucleotide
  Target: SCN10A; (-) strand; PAM type: YTN; PAM sequence: TTC
actggtttcccattgctctg

SEQ ID NO: 47646 - DNA, 20 bp, Artificial Sequence
  Description of Artificial Sequence: Synthetic oligonucleotide
  Target: SCN10A; (-) strand; PAM type: YTN; PAM sequence: CTT
cactggtttcccattgctct

SEQ ID NO: 47647 - DNA, 20 bp, Artificial Sequence
  Description of Artificial Sequence: Synthetic oligonucleotide
  Target: SCN10A; (-) strand; PAM type: YTN; PAM sequence: TTA
caaataacttcactggtttc

SEQ ID NO: 47648 - DNA, 20 bp, Artificial Sequence
  Description of Artificial Sequence: Synthetic oligonucleotide
  Target: SCN10A; (-) strand; PAM type: YTN; PAM sequence: TTG
ttacaaataacttcactggt

SEQ ID NO: 47649 - DNA, 20 bp, Artificial Sequence
  Description of Artificial Sequence: Synthetic oligonucleotide
  Target: SCN10A; (-) strand; PAM type: YTN; PAM sequence: TTT
gttacaaataacttcactgg

SEQ ID NO: 47650 - DNA, 20 bp, Artificial Sequence
  Description of Artificial Sequence: Synthetic oligonucleotide
  Target: SCN10A; (-) strand; PAM type: YTN; PAM sequence: CTA
catttgttacaaataacttc

SEQ ID NO: 47651 - DNA, 20 bp, Artificial Sequence
  Description of Artificial Sequence: Synthetic oligonucleotide
  Target: SCN10A; (-) strand; PAM type: YTN; PAM sequence: TTA
gtacctacatttgttacaaa

SEQ ID NO: 47652 - DNA, 20 bp, Artificial Sequence
  Description of Artificial Sequence: Synthetic oligonucleotide
  Target: SCN10A; (-) strand; PAM type: YTN; PAM sequence: TTA
tgttagtacctacatttgtt

SEQ ID NO: 47653 - DNA, 20 bp, Artificial Sequence
  Description of Artificial Sequence: Synthetic oligonucleotide
  Target: SCN10A; (-) strand; PAM type: YTN; PAM sequence: CTT
atgttagtacctacatttgt

SEQ ID NO: 47654 - DNA, 20 bp, Artificial Sequence
  Description of Artificial Sequence: Synthetic oligonucleotide
  Target: SCN10A; (-) strand; PAM type: YTN; PAM sequence: TTA
ccaacatcttatgttagtac

SEQ ID NO: 47655 - DNA, 20 bp, Artificial Sequence
  Description of Artificial Sequence: Synthetic oligonucleotide
  Target: SCN10A; (-) strand; PAM type: YTN; PAM sequence: CTA
ttaccaacatcttatgttag

SEQ ID NO: 47656 - DNA, 20 bp, Artificial Sequence
  Description of Artificial Sequence: Synthetic oligonucleotide
  Target: SCN10A; (-) strand; PAM type: YTN; PAM sequence: TTC
cctattaccaacatcttatg

SEQ ID NO: 47657 - DNA, 20 bp, Artificial Sequence
  Description of Artificial Sequence: Synthetic oligonucleotide
  Target: SCN10A; (-) strand; PAM type: YTN; PAM sequence: TTT
ccctattaccaacatcttat

SEQ ID NO: 47658 - DNA, 20 bp, Artificial Sequence
  Description of Artificial Sequence: Synthetic oligonucleotide
  Target: SCN10A; (-) strand; PAM type: YTN; PAM sequence: TTC
atataccatcaatcccacaa

SEQ ID NO: 47659 - DNA, 20 bp, Artificial Sequence
  Description of Artificial Sequence: Synthetic oligonucleotide
  Target: SCN10A; (-) strand; PAM type: YTN; PAM sequence: TTT
catataccatcaatcccaca

SEQ ID NO: 47660 - DNA, 20 bp, Artificial Sequence
  Description of Artificial Sequence: Synthetic oligonucleotide
  Target: SCN10A; (-) strand; PAM type: YTN; PAM sequence: CTT
tcatataccatcaatcccac

SEQ ID NO: 47661 - DNA, 20 bp, Artificial Sequence
  Description of Artificial Sequence: Synthetic oligonucleotide
  Target: SCN10A; (-) strand; PAM type: YTN; PAM sequence: TTG
aacagaaagctttcatatac

SEQ ID NO: 47662 - DNA, 20 bp, Artificial Sequence
  Description of Artificial Sequence: Synthetic oligonucleotide
  Target: SCN10A; (-) strand; PAM type: YTN; PAM sequence: CTG
gagcagattgaacagaaagc

SEQ ID NO: 47663 - DNA, 20 bp, Artificial Sequence
  Description of Artificial Sequence: Synthetic oligonucleotide
  Target: SCN10A; (-) strand; PAM type: YTN; PAM sequence: TTC
agaaaactggagcagattga

SEQ ID NO: 47664 - DNA, 20 bp, Artificial Sequence
  Description of Artificial Sequence: Synthetic oligonucleotide
  Target: SCN10A; (-) strand; PAM type: YTN; PAM sequence: TTT
cagaaaactggagcagattg

SEQ ID NO: 47665 - DNA, 20 bp, Artificial Sequence
  Description of Artificial Sequence: Synthetic oligonucleotide
  Target: SCN10A; (-) strand; PAM type: YTN; PAM sequence: TTT
tcagaaaactggagcagatt

SEQ ID NO: 47666 - DNA, 20 bp, Artificial Sequence
  Description of Artificial Sequence: Synthetic oligonucleotide
  Target: SCN10A; (-) strand; PAM type: YTN; PAM sequence: TTC
agttttcagaaaactggagc

SEQ ID NO: 47667 - DNA, 20 bp, Artificial Sequence
  Description of Artificial Sequence: Synthetic oligonucleotide
  Target: SCN10A; (-) strand; PAM type: YTN; PAM sequence: TTT
cagttttcagaaaactggag

SEQ ID NO: 47668 - DNA, 20 bp, Artificial Sequence
  Description of Artificial Sequence: Synthetic oligonucleotide
  Target: SCN10A; (-) strand; PAM type: YTN; PAM sequence: TTT
tcagttttcagaaaactgga

SEQ ID NO: 47669 - DNA, 20 bp, Artificial Sequence
  Description of Artificial Sequence: Synthetic oligonucleotide
  Target: SCN10A; (-) strand; PAM type: YTN; PAM sequence: TTC
aggacagttttcagttttca

SEQ ID NO: 47670 - DNA, 20 bp, Artificial Sequence
  Description of Artificial Sequence: Synthetic oligonucleotide
  Target: SCN10A; (-) strand; PAM type: YTN; PAM sequence: TTT
caggacagttttcagttttc

SEQ ID NO: 47671 - DNA, 20 bp, Artificial Sequence
  Description of Artificial Sequence: Synthetic oligonucleotide
  Target: SCN10A; (-) strand; PAM type: YTN; PAM sequence: TTT
tcaggacagttttcagtttt

SEQ ID NO: 47672 - DNA, 20 bp, Artificial Sequence
  Description of Artificial Sequence: Synthetic oligonucleotide
  Target: SCN10A; (-) strand; PAM type: YTN; PAM sequence: TTA
ttttcaggacagttttcagt

SEQ ID NO: 47673 - DNA, 20 bp, Artificial Sequence
  Description of Artificial Sequence: Synthetic oligonucleotide
  Target: SCN10A; (-) strand; PAM type: YTN; PAM sequence: TTT
attttcaggacagttttcag

SEQ ID NO: 47674 - DNA, 20 bp, Artificial Sequence
  Description of Artificial Sequence: Synthetic oligonucleotide
  Target: SCN10A; (-) strand; PAM type: YTN; PAM sequence: CTT
tattttcaggacagttttca

SEQ ID NO: 47675 - DNA, 20 bp, Artificial Sequence
  Description of Artificial Sequence: Synthetic oligonucleotide
  Target: SCN10A; (-) strand; PAM type: YTN; PAM sequence: TTA
atagactttattttcaggac

SEQ ID NO: 47676 - DNA, 20 bp, Artificial Sequence
  Description of Artificial Sequence: Synthetic oligonucleotide
  Target: SCN10A; (-) strand; PAM type: YTN; PAM sequence: TTA
attaatagactttattttca

SEQ ID NO: 47677 - DNA, 20 bp, Artificial Sequence
  Description of Artificial Sequence: Synthetic oligonucleotide
  Target: SCN10A; (-) strand; PAM type: YTN; PAM sequence: TTT
aattaatagactttattttc

SEQ ID NO: 47678 - DNA, 20 bp, Artificial Sequence
  Description of Artificial Sequence: Synthetic oligonucleotide
  Target: SCN10A; (-) strand; PAM type: YTN; PAM sequence: TTT
taattaatagactttatttt

SEQ ID NO: 47679 - DNA, 20 bp, Artificial Sequence
  Description of Artificial Sequence: Synthetic oligonucleotide
  Target: SCN10A; (-) strand; PAM type: YTN; PAM sequence: CTG
gttttaattaatagacttta

SEQ ID NO: 47680 - DNA, 20 bp, Artificial Sequence
  Description of Artificial Sequence: Synthetic oligonucleotide
  Target: SCN10A; (-) strand; PAM type: YTN; PAM sequence: TTC
ctggttttaattaatagact

SEQ ID NO: 47681 - DNA, 20 bp, Artificial Sequence
  Description of Artificial Sequence: Synthetic oligonucleotide
  Target: SCN10A; (-) strand; PAM type: YTN; PAM sequence: TTT
cctggttttaattaatagac

SEQ ID NO: 47682 - DNA, 20 bp, Artificial Sequence
  Description of Artificial Sequence: Synthetic oligonucleotide
  Target: SCN10A; (-) strand; PAM type: YTN; PAM sequence: CTG
gtcagtttcctggttttaat

SEQ ID NO: 47683 - DNA, 20 bp, Artificial Sequence
  Description of Artificial Sequence: Synthetic oligonucleotide
  Target: SCN10A; (-) strand; PAM type: YTN; PAM sequence: CTG
gagaaaaatcaccgccagct

SEQ ID NO: 47684 - DNA, 20 bp, Artificial Sequence
  Description of Artificial Sequence: Synthetic oligonucleotide
  Target: SCN10A; (-) strand; PAM type: YTN; PAM sequence: CTG
tgagaaatgctggagaaaaa

SEQ ID NO: 47685 - DNA, 20 bp, Artificial Sequence
  Description of Artificial Sequence: Synthetic oligonucleotide
  Target: SCN10A; (-) strand; PAM type: YTN; PAM sequence: CTG
agctgtgagaaatgctggag

SEQ ID NO: 47686 - DNA, 20 bp, Artificial Sequence
  Description of Artificial Sequence: Synthetic oligonucleotide
  Target: SCN10A; (-) strand; PAM type: YTN; PAM sequence: CTG
cacctgagctgtgagaaatg

SEQ ID NO: 47687 - DNA, 20 bp, Artificial Sequence
  Description of Artificial Sequence: Synthetic oligonucleotide
  Target: SCN10A; (-) strand; PAM type: YTN; PAM sequence: TTG
tctgcacctgagctgtgaga

SEQ ID NO: 47688 - DNA, 20 bp, Artificial Sequence
  Description of Artificial Sequence: Synthetic oligonucleotide
  Target: SCN10A; (-) strand; PAM type: YTN; PAM sequence: CTT
gtctgcacctgagctgtgag

SEQ ID NO: 47689 - DNA, 20 bp, Artificial Sequence
  Description of Artificial Sequence: Synthetic oligonucleotide
  Target: SCN10A; (-) strand; PAM type: YTN; PAM sequence: CTC
caccttgtctgcacctgagc

SEQ ID NO: 47690 - DNA, 20 bp, Artificial Sequence
  Description of Artificial Sequence: Synthetic oligonucleotide
  Target: SCN10A; (-) strand; PAM type: YTN; PAM sequence: CTC
tccaccttgtctgcacctga

SEQ ID NO: 47691 - DNA, 20 bp, Artificial Sequence
  Description of Artificial Sequence: Synthetic oligonucleotide
  Target: SCN10A; (-) strand; PAM type: YTN; PAM sequence: TTC
tctccaccttgtctgcacct

SEQ ID NO: 47692 - DNA, 20 bp, Artificial Sequence
  Description of Artificial Sequence: Synthetic oligonucleotide
  Target: SCN10A; (-) strand; PAM type: YTN; PAM sequence: TTT
ctctccaccttgtctgcacc

SEQ ID NO: 47693 - DNA, 20 bp, Artificial Sequence
  Description of Artificial Sequence: Synthetic oligonucleotide
  Target: SCN10A; (-) strand; PAM type: YTN; PAM sequence: CTA
agtcaaatatttctctccac

SEQ ID NO: 47694 - DNA, 20 bp, Artificial Sequence
  Description of Artificial Sequence: Synthetic oligonucleotide
  Target: SCN10A; (-) strand; PAM type: YTN; PAM sequence: CTC
accggagagtctaagtcaaa

SEQ ID NO: 47695 - DNA, 20 bp, Artificial Sequence
  Description of Artificial Sequence: Synthetic oligonucleotide
  Target: SCN10A; (-) strand; PAM type: YTN; PAM sequence: TTG
ccaaaacctcaccggagagt

SEQ ID NO: 47696 - DNA, 20 bp, Artificial Sequence
  Description of Artificial Sequence: Synthetic oligonucleotide
  Target: SCN10A; (-) strand; PAM type: YTN; PAM sequence: TTT
gccaaaacctcaccggagag

SEQ ID NO: 47697 - DNA, 20 bp, Artificial Sequence
  Description of Artificial Sequence: Synthetic oligonucleotide
  Target: SCN10A; (-) strand; PAM type: YTN; PAM sequence: TTG
tgtttgccaaaacctcaccg

SEQ ID NO: 47698 - DNA, 20 bp, Artificial Sequence
  Description of Artificial Sequence: Synthetic oligonucleotide
  Target: SCN10A; (-) strand; PAM type: YTN; PAM sequence: TTT
gtgtttgccaaaacctcacc

SEQ ID NO: 47699 - DNA, 20 bp, Artificial Sequence
  Description of Artificial Sequence: Synthetic oligonucleotide
  Target: SCN10A; (-) strand; PAM type: YTN; PAM sequence: TTT
tgtgtttgccaaaacctcac

SEQ ID NO: 47700 - DNA, 20 bp, Artificial Sequence
  Description of Artificial Sequence: Synthetic oligonucleotide
  Target: SCN10A; (-) strand; PAM type: YTN; PAM sequence: TTT
ttgtgtttgccaaaacctca

SEQ ID NO: 47701 - DNA, 20 bp, Artificial Sequence
  Description of Artificial Sequence: Synthetic oligonucleotide
  Target: SCN10A; (-) strand; PAM type: YTN; PAM sequence: TTG
cgtttttgtgtttgccaaaa

SEQ ID NO: 47702 - DNA, 20 bp, Artificial Sequence
  Description of Artificial Sequence: Synthetic oligonucleotide
  Target: SCN10A; (-) strand; PAM type: YTN; PAM sequence: TTT
gcgtttttgtgtttgccaaa

SEQ ID NO: 47703 - DNA, 20 bp, Artificial Sequence
  Description of Artificial Sequence: Synthetic oligonucleotide
  Target: SCN10A; (-) strand; PAM type: YTN; PAM sequence: CTT
tgcgtttttgtgtttgccaa

SEQ ID NO: 47704 - DNA, 20 bp, Artificial Sequence
  Description of Artificial Sequence: Synthetic oligonucleotide
  Target: SCN10A; (-) strand; PAM type: YTN; PAM sequence: CTC
tttgcgtttttgtgtttgcc

SEQ ID NO: 47705 - DNA, 20 bp, Artificial Sequence
  Description of Artificial Sequence: Synthetic oligonucleotide
  Target: SCN10A; (-) strand; PAM type: YTN; PAM sequence: CTG
cctctttgcgtttttgtgtt

SEQ ID NO: 47706 - DNA, 20 bp, Artificial Sequence
  Description of Artificial Sequence: Synthetic oligonucleotide
  Target: SCN10A; (-) strand; PAM type: YTN; PAM sequence: CTC
tgcctctttgcgtttttgtg

SEQ ID NO: 47707 - DNA, 20 bp, Artificial Sequence
  Description of Artificial Sequence: Synthetic oligonucleotide
  Target: SCN10A; (-) strand; PAM type: YTN; PAM sequence: TTC
cctctgcctctttgcgtttt

SEQ ID NO: 47708 - DNA, 20 bp, Artificial Sequence
  Description of Artificial Sequence: Synthetic oligonucleotide
  Target: SCN10A; (-) strand; PAM type: YTN; PAM sequence: TTT
ccctctgcctctttgcgttt

SEQ ID NO: 47709 - DNA, 20 bp, Artificial Sequence
  Description of Artificial Sequence: Synthetic oligonucleotide
  Target: SCN10A; (-) strand; PAM type: YTN; PAM sequence: TTT
tccctctgcctctttgcgtt

SEQ ID NO: 47710 - DNA, 20 bp, Artificial Sequence
  Description of Artificial Sequence: Synthetic oligonucleotide
  Target: SCN10A; (-) strand; PAM type: YTN; PAM sequence: CTT
ttccctctgcctctttgcgt

SEQ ID NO: 47711 - DNA, 20 bp, Artificial Sequence
  Description of Artificial Sequence: Synthetic oligonucleotide
  Target: SCN10A; (-) strand; PAM type: YTN; PAM sequence: CTC
aatcaccttttccctctgcc

SEQ ID NO: 47712 - DNA, 20 bp, Artificial Sequence
  Description of Artificial Sequence: Synthetic oligonucleotide
  Target: SCN10A; (-) strand; PAM type: YTN; PAM sequence: TTG
aaaacaaactcaatcacctt

SEQ ID NO: 47713 - DNA, 20 bp, Artificial Sequence
  Description of Artificial Sequence: Synthetic oligonucleotide
  Target: SCN10A; (-) strand; PAM type: YTN; PAM sequence: CTT
gaaaacaaactcaatcacct

SEQ ID NO: 47714 - DNA, 20 bp, Artificial Sequence
  Description of Artificial Sequence: Synthetic oligonucleotide
  Target: SCN10A; (-) strand; PAM type: YTN; PAM sequence: TTA
tgcccttgaaaacaaactca

SEQ ID NO: 47715 - DNA, 20 bp, Artificial Sequence
  Description of Artificial Sequence: Synthetic oligonucleotide
  Target: SCN10A; (-) strand; PAM type: YTN; PAM sequence: TTA
ttatgcccttgaaaacaaac

SEQ ID NO: 47716 - DNA, 20 bp, Artificial Sequence
  Description of Artificial Sequence: Synthetic oligonucleotide
  Target: SCN10A; (-) strand; PAM type: YTN; PAM sequence: TTC
acagcccaccaatattatta

SEQ ID NO: 47717 - DNA, 20 bp, Artificial Sequence
  Description of Artificial Sequence: Synthetic oligonucleotide
  Target: SCN10A; (-) strand; PAM type: YTN; PAM sequence: TTT
cacagcccaccaatattatt

SEQ ID NO: 47718 - DNA, 20 bp, Artificial Sequence
  Description of Artificial Sequence: Synthetic oligonucleotide
  Target: SCN10A; (-) strand; PAM type: YTN; PAM sequence: TTA
gatttcacagcccaccaata

SEQ ID NO: 47719 - DNA, 20 bp, Artificial Sequence
  Description of Artificial Sequence: Synthetic oligonucleotide
  Target: SCN10A; (-) strand; PAM type: YTN; PAM sequence: CTT
agatttcacagcccaccaat

SEQ ID NO: 47720 - DNA, 20 bp, Artificial Sequence
  Description of Artificial Sequence: Synthetic oligonucleotide
  Target: SCN10A; (-) strand; PAM type: YTN; PAM sequence: CTA
gcttagatttcacagcccac

SEQ ID NO: 47721 - DNA, 20 bp, Artificial Sequence
  Description of Artificial Sequence: Synthetic oligonucleotide
  Target: SCN10A; (-) strand; PAM type: YTN; PAM sequence: CTC
atgacctagcttagatttca

SEQ ID NO: 47722 - DNA, 20 bp, Artificial Sequence
  Description of Artificial Sequence: Synthetic oligonucleotide
  Target: SCN10A; (-) strand; PAM type: YTN; PAM sequence: TTC
cctcatgacctagcttagat

SEQ ID NO: 47723 - DNA, 20 bp, Artificial Sequence
  Description of Artificial Sequence: Synthetic oligonucleotide
  Target: SCN10A; (-) strand; PAM type: YTN; PAM sequence: CTT
ccctcatgacctagcttaga

SEQ ID NO: 47724 - DNA, 20 bp, Artificial Sequence
  Description of Artificial Sequence: Synthetic oligonucleotide
  Target: SCN10A; (-) strand; PAM type: YTN; PAM sequence: TTC
cacttccctcatgacctagc

SEQ ID NO: 47725 - DNA, 20 bp, Artificial Sequence
  Description of Artificial Sequence: Synthetic oligonucleotide
  Target: SCN10A; (-) strand; PAM type: YTN; PAM sequence: CTA
ttccacttccctcatgacct

SEQ ID NO: 47726 - DNA, 20 bp, Artificial Sequence
  Description of Artificial Sequence: Synthetic oligonucleotide
  Target: SCN10A; (-) strand; PAM type: YTN; PAM sequence: TTG
ggatctattccacttccctc

SEQ ID NO: 47727 - DNA, 20 bp, Artificial Sequence
  Description of Artificial Sequence: Synthetic oligonucleotide
  Target: SCN10A; (-) strand; PAM type: YTN; PAM sequence: CTT
gggatctattccacttccct

SEQ ID NO: 47728 - DNA, 20 bp, Artificial Sequence
  Description of Artificial Sequence: Synthetic oligonucleotide
  Target: SCN10A; (-) strand; PAM type: YTN; PAM sequence: TTC
ttgggatctattccacttcc

SEQ ID NO: 47729 - DNA, 20 bp, Artificial Sequence
  Description of Artificial Sequence: Synthetic oligonucleotide
  Target: SCN10A; (-) strand; PAM type: YTN; PAM sequence: TTT
cttgggatctattccacttc

SEQ ID NO: 47730 - DNA, 20 bp, Artificial Sequence
  Description of Artificial Sequence: Synthetic oligonucleotide
  Target: SCN10A; (-) strand; PAM type: YTN; PAM sequence: CTT
tcttgggatctattccactt

SEQ ID NO: 47731 - DNA, 20 bp, Artificial Sequence
  Description of Artificial Sequence: Synthetic oligonucleotide
  Target: SCN10A; (-) strand; PAM type: YTN; PAM sequence: CTA
cacactttcttgggatctat

SEQ ID NO: 47732 - DNA, 20 bp, Artificial Sequence
  Description of Artificial Sequence: Synthetic oligonucleotide
  Target: SCN10A; (-) strand; PAM type: YTN; PAM sequence: CTA
accacacccaccaactacac

SEQ ID NO: 47733 - DNA, 20 bp, Artificial Sequence
  Description of Artificial Sequence: Synthetic oligonucleotide
  Target: SCN10A; (-) strand; PAM type: YTN; PAM sequence: TTC
cctaaccacacccaccaact

SEQ ID NO: 47734 - DNA, 20 bp, Artificial Sequence
  Description of Artificial Sequence: Synthetic oligonucleotide
  Target: SCN10A; (-) strand; PAM type: YTN; PAM sequence: CTC
aattccctaaccacacccac

SEQ ID NO: 47735 - DNA, 20 bp, Artificial Sequence
  Description of Artificial Sequence: Synthetic oligonucleotide
  Target: SCN10A; (-) strand; PAM type: YTN; PAM sequence: CTG
atcagtgctcaattccctaa

SEQ ID NO: 47736 - DNA, 20 bp, Artificial Sequence
  Description of Artificial Sequence: Synthetic oligonucleotide
  Target: SCN10A; (-) strand; PAM type: YTN; PAM sequence: TTA
acatgctgatcagtgctcaa

SEQ ID NO: 47737 - DNA, 20 bp, Artificial Sequence
  Description of Artificial Sequence: Synthetic oligonucleotide
  Target: SCN10A; (-) strand; PAM type: YTN; PAM sequence: TTT
aacatgctgatcagtgctca

SEQ ID NO: 47738 - DNA, 20 bp, Artificial Sequence
  Description of Artificial Sequence: Synthetic oligonucleotide
  Target: SCN10A; (-) strand; PAM type: YTN; PAM sequence: CTG
atttaacatgctgatcagtg

SEQ ID NO: 47739 - DNA, 20 bp, Artificial Sequence
  Description of Artificial Sequence: Synthetic oligonucleotide
  Target: SCN10A; (-) strand; PAM type: YTN; PAM sequence: CTC
gctgatttaacatgctgatc

SEQ ID NO: 47740 - DNA, 20 bp, Artificial Sequence
  Description of Artificial Sequence: Synthetic oligonucleotide
  Target: SCN10A; (-) strand; PAM type: YTN; PAM sequence: CTG
tccccacctcgctgatttaa

SEQ ID NO: 47741 - DNA, 20 bp, Artificial Sequence
  Description of Artificial Sequence: Synthetic oligonucleotide
  Target: SCN10A; (-) strand; PAM type: YTN; PAM sequence: CTA
ccctgtccccacctcgctga

SEQ ID NO: 47742 - DNA, 20 bp, Artificial Sequence
  Description of Artificial Sequence: Synthetic oligonucleotide
  Target: SCN10A; (-) strand; PAM type: YTN; PAM sequence: CTG
caggggaatgctaccctgtc

SEQ ID NO: 47743 - DNA, 20 bp, Artificial Sequence
  Description of Artificial Sequence: Synthetic oligonucleotide
  Target: SCN10A; (-) strand; PAM type: YTN; PAM sequence: TTC
tgcaggggaatgctaccctg

SEQ ID NO: 47744 - DNA, 20 bp, Artificial Sequence
  Description of Artificial Sequence: Synthetic oligonucleotide
  Target: SCN10A; (-) strand; PAM type: YTN; PAM sequence: CTA
caggattctgcaggggaatg

SEQ ID NO: 47745 - DNA, 20 bp, Artificial Sequence
  Description of Artificial Sequence: Synthetic oligonucleotide
  Target: SCN10A; (-) strand; PAM type: YTN; PAM sequence: CTG
cccctacaggattctgcagg

SEQ ID NO: 47746 - DNA, 20 bp, Artificial Sequence
  Description of Artificial Sequence: Synthetic oligonucleotide
  Target: SCN10A; (-) strand; PAM type: YTN; PAM sequence: TTC
acagtctgcccctacaggat

SEQ ID NO: 47747 - DNA, 20 bp, Artificial Sequence
  Description of Artificial Sequence: Synthetic oligonucleotide
  Target: SCN10A; (-) strand; PAM type: YTN; PAM sequence: CTT
cacagtctgcccctacagga

SEQ ID NO: 47748 - DNA, 20 bp, Artificial Sequence
  Description of Artificial Sequence: Synthetic oligonucleotide
  Target: SCN10A; (-) strand; PAM type: YTN; PAM sequence: TTA
cttcacagtctgcccctaca

SEQ ID NO: 47749 - DNA, 20 bp, Artificial Sequence
  Description of Artificial Sequence: Synthetic oligonucleotide
  Target: SCN10A; (-) strand; PAM type: YTN; PAM sequence: TTT
acttcacagtctgcccctac

SEQ ID NO: 47750 - DNA, 20 bp, Artificial Sequence
  Description of Artificial Sequence: Synthetic oligonucleotide
  Target: SCN10A; (-) strand; PAM type: YTN; PAM sequence: CTA
aagtcccaaacaaccaaaaa

SEQ ID NO: 47751 - DNA, 20 bp, Artificial Sequence
  Description of Artificial Sequence: Synthetic oligonucleotide
  Target: SCN10A; (-) strand; PAM type: YTN; PAM sequence: CTG
atcccacagtctaaagtccc

SEQ ID NO: 47752 - DNA, 20 bp, Artificial Sequence
  Description of Artificial Sequence: Synthetic oligonucleotide
  Target: SCN10A; (-) strand; PAM type: YTN; PAM sequence: TTC
tgatcccacagtctaaagtc

SEQ ID NO: 47753 - DNA, 20 bp, Artificial Sequence
  Description of Artificial Sequence: Synthetic oligonucleotide
  Target: SCN10A; (-) strand; PAM type: YTN; PAM sequence: TTG
ttctgatcccacagtctaaa

SEQ ID NO: 47754 - DNA, 20 bp, Artificial Sequence
  Description of Artificial Sequence: Synthetic oligonucleotide
  Target: SCN10A; (-) strand; PAM type: YTN; PAM sequence: TTT
gttctgatcccacagtctaa

SEQ ID NO: 47755 - DNA, 20 bp, Artificial Sequence
  Description of Artificial Sequence: Synthetic oligonucleotide
  Target: SCN10A; (-) strand; PAM type: YTN; PAM sequence: TTT
tgttctgatcccacagtcta

SEQ ID NO: 47756 - DNA, 20 bp, Artificial Sequence
  Description of Artificial Sequence: Synthetic oligonucleotide
  Target: SCN10A; (-) strand; PAM type: YTN; PAM sequence: CTT
ttgttctgatcccacagtct

SEQ ID NO: 47757 - DNA, 20 bp, Artificial Sequence
  Description of Artificial Sequence: Synthetic oligonucleotide
  Target: SCN10A; (-) strand; PAM type: YTN; PAM sequence: CTA
cttttgttctgatcccacag

SEQ ID NO: 47758 - DNA, 20 bp, Artificial Sequence
  Description of Artificial Sequence: Synthetic oligonucleotide
  Target: SCN10A; (-) strand; PAM type: YTN; PAM sequence: CTA
tgtgctacttttgttctgat

SEQ ID NO: 47759 - DNA, 20 bp, Artificial Sequence
  Description of Artificial Sequence: Synthetic oligonucleotide
  Target: SCN10A; (-) strand; PAM type: YTN; PAM sequence: TTA
aggtctatgtgctacttttg

SEQ ID NO: 47760 - DNA, 20 bp, Artificial Sequence
  Description of Artificial Sequence: Synthetic oligonucleotide
  Target: SCN10A; (-) strand; PAM type: YTN; PAM sequence: TTT
aaggtctatgtgctactttt

SEQ ID NO: 47761 - DNA, 20 bp, Artificial Sequence
  Description of Artificial Sequence: Synthetic oligonucleotide
  Target: SCN10A; (-) strand; PAM type: YTN; PAM sequence: TTT
taaggtctatgtgctacttt

SEQ ID NO: 47762 - DNA, 20 bp, Artificial Sequence
  Description of Artificial Sequence: Synthetic oligonucleotide
  Target: SCN10A; (-) strand; PAM type: YTN; PAM sequence: TTA
gtgttttaaggtctatgtgc

SEQ ID NO: 47763 - DNA, 20 bp, Artificial Sequence
  Description of Artificial Sequence: Synthetic oligonucleotide
  Target: SCN10A; (-) strand; PAM type: YTN; PAM sequence: CTT
agtgttttaaggtctatgtg

SEQ ID NO: 47764 - DNA, 20 bp, Artificial Sequence
  Description of Artificial Sequence: Synthetic oligonucleotide
  Target: SCN10A; (-) strand; PAM type: YTN; PAM sequence: TTG
gggaagcagaagcttagtgt

SEQ ID NO: 47765 - DNA, 20 bp, Artificial Sequence
  Description of Artificial Sequence: Synthetic oligonucleotide
  Target: SCN10A; (-) strand; PAM type: YTN; PAM sequence: CTT
ggggaagcagaagcttagtg

SEQ ID NO: 47766 - DNA, 20 bp, Artificial Sequence
  Description of Artificial Sequence: Synthetic oligonucleotide
  Target: SCN10A; (-) strand; PAM type: YTN; PAM sequence: CTA
cacttggggaagcagaagct

SEQ ID NO: 47767 - DNA, 20 bp, Artificial Sequence
  Description of Artificial Sequence: Synthetic oligonucleotide
  Target: SCN10A; (-) strand; PAM type: YTN; PAM sequence: CTG
ctacacttggggaagcagaa

SEQ ID NO: 47768 - DNA, 20 bp, Artificial Sequence
  Description of Artificial Sequence: Synthetic oligonucleotide
  Target: SCN10A; (-) strand; PAM type: YTN; PAM sequence: TTC
tgctacacttggggaagcag

SEQ ID NO: 47769 - DNA, 20 bp, Artificial Sequence
  Description of Artificial Sequence: Synthetic oligonucleotide
  Target: SCN10A; (-) strand; PAM type: YTN; PAM sequence: TTT
ctgctacacttggggaagca

SEQ ID NO: 47770 - DNA, 20 bp, Artificial Sequence
  Description of Artificial Sequence: Synthetic oligonucleotide
  Target: SCN10A; (-) strand; PAM type: YTN; PAM sequence: CTC
aaaaaaaaaaaaaaaaaaaa

SEQ ID NO: 47771 - DNA, 20 bp, Artificial Sequence
  Description of Artificial Sequence: Synthetic oligonucleotide
  Target: SCN10A; (-) strand; PAM type: YTN; PAM sequence: CTC
cgtctcaaaaaaaaaaaaaa

SEQ ID NO: 47772 - DNA, 20 bp, Artificial Sequence
  Description of Artificial Sequence: Synthetic oligonucleotide
  Target: SCN10A; (-) strand; PAM type: YTN; PAM sequence: CTA
aacagcgggactccgtctca

SEQ ID NO: 47773 - DNA, 20 bp, Artificial Sequence
  Description of Artificial Sequence: Synthetic oligonucleotide
  Target: SCN10A; (-) strand; PAM type: YTN; PAM sequence: CTG
ggctaaacagcgggactccg

SEQ ID NO: 47774 - DNA, 20 bp, Artificial Sequence
  Description of Artificial Sequence: Synthetic oligonucleotide
  Target: SCN10A; (-) strand; PAM type: YTN; PAM sequence: CTG
caatccggcctgggctaaac

SEQ ID NO: 47775 - DNA, 20 bp, Artificial Sequence
  Description of Artificial Sequence: Synthetic oligonucleotide
  Target: SCN10A; (-) strand; PAM type: YTN; PAM sequence: TTG
cgccactgcaatccggcctg

SEQ ID NO: 47776 - DNA, 20 bp, Artificial Sequence
  Description of Artificial Sequence: Synthetic oligonucleotide
  Target: SCN10A; (-) strand; PAM type: YTN; PAM sequence: TTA
cagtgagccgagattgcgcc

SEQ ID NO: 47777 - DNA, 20 bp, Artificial Sequence
  Description of Artificial Sequence: Synthetic oligonucleotide
  Target: SCN10A; (-) strand; PAM type: YTN; PAM sequence: CTT
acagtgagccgagattgcgc

SEQ ID NO: 47778 - DNA, 20 bp, Artificial Sequence
  Description of Artificial Sequence: Synthetic oligonucleotide
  Target: SCN10A; (-) strand; PAM type: YTN; PAM sequence: CTG
ggaggcggagcttacagtga

SEQ ID NO: 47779 - DNA, 20 bp, Artificial Sequence
  Description of Artificial Sequence: Synthetic oligonucleotide
  Target: SCN10A; (-) strand; PAM type: YTN; PAM sequence: CTG
aggcaggagaatggcgtgaa

SEQ ID NO: 47780 - DNA, 20 bp, Artificial Sequence
  Description of Artificial Sequence: Synthetic oligonucleotide
  Target: SCN10A; (-) strand; PAM type: YTN; PAM sequence: CTC
gggaggctgaggcaggagaa

SEQ ID NO: 47781 - DNA, 20 bp, Artificial Sequence
  Description of Artificial Sequence: Synthetic oligonucleotide
  Target: SCN10A; (-) strand; PAM type: YTN; PAM sequence: CTA
ctcgggaggctgaggcagga

SEQ ID NO: 47782 - DNA, 20 bp, Artificial Sequence
  Description of Artificial Sequence: Synthetic oligonucleotide
  Target: SCN10A; (-) strand; PAM type: YTN; PAM sequence: CTG
tagtcccagctactcgggag

SEQ ID NO: 47783 - DNA, 20 bp, Artificial Sequence
  Description of Artificial Sequence: Synthetic oligonucleotide
  Target: SCN10A; (-) strand; PAM type: YTN; PAM sequence: TTA
gccgggcacggtggcgggcg

SEQ ID NO: 47784 - DNA, 20 bp, Artificial Sequence
  Description of Artificial Sequence: Synthetic oligonucleotide
  Target: SCN10A; (-) strand; PAM type: YTN; PAM sequence: CTA
aaaatacaaaaaattagccg

SEQ ID NO: 47785 - DNA, 20 bp, Artificial Sequence
  Description of Artificial Sequence: Synthetic oligonucleotide
  Target: SCN10A; (-) strand; PAM type: YTN; PAM sequence: CTA
ctaaaaatacaaaaaattag

SEQ ID NO: 47786 - DNA, 20 bp, Artificial Sequence
  Description of Artificial Sequence: Synthetic oligonucleotide
  Target: SCN10A; (-) strand; PAM type: YTN; PAM sequence: CTC
tactaaaaatacaaaaaatt

SEQ ID NO: 47787 - DNA, 20 bp, Artificial Sequence
  Description of Artificial Sequence: Synthetic oligonucleotide
  Target: SCN10A; (-) strand; PAM type: YTN; PAM sequence: CTA
acacggtgaaaccccgtctc

SEQ ID NO: 47788 - DNA, 20 bp, Artificial Sequence
  Description of Artificial Sequence: Synthetic oligonucleotide
  Target: SCN10A; (-) strand; PAM type: YTN; PAM sequence: TTG
gctaacacggtgaaaccccg

SEQ ID NO: 47789 - DNA, 20 bp, Artificial Sequence
  Description of Artificial Sequence: Synthetic oligonucleotide
  Target: SCN10A; (-) strand; PAM type: YTN; PAM sequence: CTT
ggctaacacggtgaaacccc

SEQ ID NO: 47790 - DNA, 20 bp, Artificial Sequence
  Description of Artificial Sequence: Synthetic oligonucleotide
  Target: SCN10A; (-) strand; PAM type: YTN; PAM sequence: TTG
ggaggccgaggcaggcggat

SEQ ID NO: 47791 - DNA, 20 bp, Artificial Sequence
  Description of Artificial Sequence: Synthetic oligonucleotide
  Target: SCN10A; (-) strand; PAM type: YTN; PAM sequence: TTT
gggaggccgaggcaggcgga

SEQ ID NO: 47792 - DNA, 20 bp, Artificial Sequence
  Description of Artificial Sequence: Synthetic oligonucleotide
  Target: SCN10A; (-) strand; PAM type: YTN; PAM sequence: CTT
tgggaggccgaggcaggcgg

SEQ ID NO: 47793 - DNA, 20 bp, Artificial Sequence
  Description of Artificial Sequence: Synthetic oligonucleotide
  Target: SCN10A; (-) strand; PAM type: YTN; PAM sequence: CTG
taatcccagcactttgggag

SEQ ID NO: 47794 - DNA, 20 bp, Artificial Sequence
  Description of Artificial Sequence: Synthetic oligonucleotide
  Target: SCN10A; (-) strand; PAM type: YTN; PAM sequence: CTC
acgcctgtaatcccagcact

SEQ ID NO: 47795 - DNA, 20 bp, Artificial Sequence
  Description of Artificial Sequence: Synthetic oligonucleotide
  Target: SCN10A; (-) strand; PAM type: YTN; PAM sequence: CTG
ggcgcggtggctcacgcctg

SEQ ID NO: 47796 - DNA, 20 bp, Artificial Sequence
  Description of Artificial Sequence: Synthetic oligonucleotide
  Target: SCN10A; (-) strand; PAM type: YTN; PAM sequence: CTA
ataaaatacgaggctgggcg

SEQ ID NO: 47797 - DNA, 20 bp, Artificial Sequence
  Description of Artificial Sequence: Synthetic oligonucleotide
  Target: SCN10A; (-) strand; PAM type: YTN; PAM sequence: TTC
taataaaatacgaggctggg

SEQ ID NO: 47798 - DNA, 20 bp, Artificial Sequence
  Description of Artificial Sequence: Synthetic oligonucleotide
  Target: SCN10A; (-) strand; PAM type: YTN; PAM sequence: TTT
ctaataaaatacgaggctgg

SEQ ID NO: 47799 - DNA, 20 bp, Artificial Sequence
  Description of Artificial Sequence: Synthetic oligonucleotide
  Target: SCN10A; (-) strand; PAM type: YTN; PAM sequence: TTT
tctaataaaatacgaggctg

SEQ ID NO: 47800 - DNA, 20 bp, Artificial Sequence
  Description of Artificial Sequence: Synthetic oligonucleotide
  Target: SCN10A; (-) strand; PAM type: YTN; PAM sequence: TTA
gttttctaataaaatacgag

SEQ ID NO: 47801 - DNA, 20 bp, Artificial Sequence
  Description of Artificial Sequence: Synthetic oligonucleotide
  Target: SCN10A; (-) strand; PAM type: YTN; PAM sequence: CTG
gcaggcccacagttagtttt

SEQ ID NO: 47802 - DNA, 20 bp, Artificial Sequence
  Description of Artificial Sequence: Synthetic oligonucleotide
  Target: SCN10A; (-) strand; PAM type: YTN; PAM sequence: CTA
tgcacaatcgtcaagagagc

SEQ ID NO: 47803 - DNA, 20 bp, Artificial Sequence
  Description of Artificial Sequence: Synthetic oligonucleotide
  Target: SCN10A; (-) strand; PAM type: YTN; PAM sequence: CTA
atggtcaatataaggtacct

SEQ ID NO: 47804 - DNA, 20 bp, Artificial Sequence
  Description of Artificial Sequence: Synthetic oligonucleotide
  Target: SCN10A; (-) strand; PAM type: YTN; PAM sequence: CTA
agctaatggtcaatataagg

SEQ ID NO: 47805 - DNA, 20 bp, Artificial Sequence
  Description of Artificial Sequence: Synthetic oligonucleotide
  Target: SCN10A; (-) strand; PAM type: YTN; PAM sequence: TTG
atgtcaagatgtaggcccct

SEQ ID NO: 47806 - DNA, 20 bp, Artificial Sequence
  Description of Artificial Sequence: Synthetic oligonucleotide
  Target: SCN10A; (-) strand; PAM type: YTN; PAM sequence: CTA
gaaattgatgtcaagatgta

SEQ ID NO: 47807 - DNA, 20 bp, Artificial Sequence
  Description of Artificial Sequence: Synthetic oligonucleotide
  Target: SCN10A; (-) strand; PAM type: YTN; PAM sequence: CTA
ggtatctagaaattgatgtc

SEQ ID NO: 47808 - DNA, 20 bp, Artificial Sequence
  Description of Artificial Sequence: Synthetic oligonucleotide
  Target: SCN10A; (-) strand; PAM type: YTN; PAM sequence: CTC
taggtatctagaaattgatg

SEQ ID NO: 47809 - DNA, 20 bp, Artificial Sequence
  Description of Artificial Sequence: Synthetic oligonucleotide
  Target: SCN10A; (-) strand; PAM type: YTN; PAM sequence: TTC
tctaggtatctagaaattga

SEQ ID NO: 47810 - DNA, 20 bp, Artificial Sequence
  Description of Artificial Sequence: Synthetic oligonucleotide
  Target: SCN10A; (-) strand; PAM type: YTN; PAM sequence: TTT
ctctaggtatctagaaattg

SEQ ID NO: 47811 - DNA, 20 bp, Artificial Sequence
  Description of Artificial Sequence: Synthetic oligonucleotide
  Target: SCN10A; (-) strand; PAM type: YTN; PAM sequence: TTA
gaaggacagatttctctagg

SEQ ID NO: 47812 - DNA, 20 bp, Artificial Sequence
  Description of Artificial Sequence: Synthetic oligonucleotide
  Target: SCN10A; (-) strand; PAM type: YTN; PAM sequence: TTT
agaaggacagatttctctag

SEQ ID NO: 47813 - DNA, 20 bp, Artificial Sequence
  Description of Artificial Sequence: Synthetic oligonucleotide
  Target: SCN10A; (-) strand; PAM type: YTN; PAM sequence: TTT
tagaaggacagatttctcta

SEQ ID NO: 47814 - DNA, 20 bp, Artificial Sequence
  Description of Artificial Sequence: Synthetic oligonucleotide
  Target: SCN10A; (-) strand; PAM type: YTN; PAM sequence: TTT
ttagaaggacagatttctct

SEQ ID NO: 47815 - DNA, 20 bp, Artificial Sequence
  Description of Artificial Sequence: Synthetic oligonucleotide
  Target: SCN10A; (-) strand; PAM type: YTN; PAM sequence: TTA
aatcacatttttagaaggac

SEQ ID NO: 47816 - DNA, 20 bp, Artificial Sequence
  Description of Artificial Sequence: Synthetic oligonucleotide
  Target: SCN10A; (-) strand; PAM type: YTN; PAM sequence: TTA
caaggtcagaattaaatcac

SEQ ID NO: 47817 - DNA, 20 bp, Artificial Sequence
  Description of Artificial Sequence: Synthetic oligonucleotide
  Target: SCN10A; (-) strand; PAM type: YTN; PAM sequence: CTT
acaaggtcagaattaaatca

SEQ ID NO: 47818 - DNA, 20 bp, Artificial Sequence
  Description of Artificial Sequence: Synthetic oligonucleotide
  Target: SCN10A; (-) strand; PAM type: YTN; PAM sequence: TTG
aaaatcttacaaggtcagaa

SEQ ID NO: 47819 - DNA, 20 bp, Artificial Sequence
  Description of Artificial Sequence: Synthetic oligonucleotide
  Target: SCN10A; (-) strand; PAM type: YTN; PAM sequence: CTT
gaaaatcttacaaggtcaga

SEQ ID NO: 47820 - DNA, 20 bp, Artificial Sequence
  Description of Artificial Sequence: Synthetic oligonucleotide
  Target: SCN10A; (-) strand; PAM type: YTN; PAM sequence: TTA
tccataacttgaaaatctta

SEQ ID NO: 47821 - DNA, 20 bp, Artificial Sequence
  Description of Artificial Sequence: Synthetic oligonucleotide
  Target: SCN10A; (-) strand; PAM type: YTN; PAM sequence: TTT
atccataacttgaaaatctt

SEQ ID NO: 47822 - DNA, 20 bp, Artificial Sequence
  Description of Artificial Sequence: Synthetic oligonucleotide
  Target: SCN10A; (-) strand; PAM type: YTN; PAM sequence: CTT
tatccataacttgaaaatct

SEQ ID NO: 47823 - DNA, 20 bp, Artificial Sequence
  Description of Artificial Sequence: Synthetic oligonucleotide
  Target: SCN10A; (-) strand; PAM type: YTN; PAM sequence: CTC
tttatccataacttgaaaat

SEQ ID NO: 47824 - DNA, 20 bp, Artificial Sequence
  Description of Artificial Sequence: Synthetic oligonucleotide
  Target: SCN10A; (-) strand; PAM type: YTN; PAM sequence: CTG
gtaggactctttatccataa

SEQ ID NO: 47825 - DNA, 20 bp, Artificial Sequence
  Description of Artificial Sequence: Synthetic oligonucleotide
  Target: SCN10A; (-) strand; PAM type: YTN; PAM sequence: CTG
tcaccatcccagggaggaga

SEQ ID NO: 47826 - DNA, 20 bp, Artificial Sequence
  Description of Artificial Sequence: Synthetic oligonucleotide
  Target: SCN10A; (-) strand; PAM type: YTN; PAM sequence: CTG
atggtactgtcaccatccca

SEQ ID NO: 47827 - DNA, 20 bp, Artificial Sequence
  Description of Artificial Sequence: Synthetic oligonucleotide
  Target: SCN10A; (-) strand; PAM type: YTN; PAM sequence: CTA
agctgatggtactgtcacca

SEQ ID NO: 47828 - DNA, 20 bp, Artificial Sequence
  Description of Artificial Sequence: Synthetic oligonucleotide
  Target: SCN10A; (-) strand; PAM type: YTN; PAM sequence: CTG
cctaagctgatggtactgtc

SEQ ID NO: 47829 - DNA, 20 bp, Artificial Sequence
  Description of Artificial Sequence: Synthetic oligonucleotide
  Target: SCN10A; (-) strand; PAM type: YTN; PAM sequence: TTG
atggcatctgcctaagctga

SEQ ID NO: 47830 - DNA, 20 bp, Artificial Sequence
  Description of Artificial Sequence: Synthetic oligonucleotide
  Target: SCN10A; (-) strand; PAM type: YTN; PAM sequence: CTG
gttgatggcatctgcctaag

SEQ ID NO: 47831 - DNA, 20 bp, Artificial Sequence
  Description of Artificial Sequence: Synthetic oligonucleotide
  Target: SCN10A; (-) strand; PAM type: YTN; PAM sequence: CTG
tgccatgaaacgctggttga

SEQ ID NO: 47832 - DNA, 20 bp, Artificial Sequence
  Description of Artificial Sequence: Synthetic oligonucleotide
  Target: SCN10A; (-) strand; PAM type: YTN; PAM sequence: CTG
agacacagctgtgccatgaa

SEQ ID NO: 47833 - DNA, 20 bp, Artificial Sequence
  Description of Artificial Sequence: Synthetic oligonucleotide
  Target: SCN10A; (-) strand; PAM type: YTN; PAM sequence: CTA
aagaccaaataaagcatgtc

SEQ ID NO: 47834 - DNA, 20 bp, Artificial Sequence
  Description of Artificial Sequence: Synthetic oligonucleotide
  Target: SCN10A; (-) strand; PAM type: YTN; PAM sequence: CTC
taaagaccaaataaagcatg

SEQ ID NO: 47835 - DNA, 20 bp, Artificial Sequence
  Description of Artificial Sequence: Synthetic oligonucleotide
  Target: SCN10A; (-) strand; PAM type: YTN; PAM sequence: TTA
aaaacactctaaagaccaaa

SEQ ID NO: 47836 - DNA, 20 bp, Artificial Sequence
  Description of Artificial Sequence: Synthetic oligonucleotide
  Target: SCN10A; (-) strand; PAM type: YTN; PAM sequence: TTT
aaaaacactctaaagaccaa

SEQ ID NO: 47837 - DNA, 20 bp, Artificial Sequence
  Description of Artificial Sequence: Synthetic oligonucleotide
  Target: SCN10A; (-) strand; PAM type: YTN; PAM sequence: TTT
taaaaacactctaaagacca

SEQ ID NO: 47838 - DNA, 20 bp, Artificial Sequence
  Description of Artificial Sequence: Synthetic oligonucleotide
  Target: SCN10A; (-) strand; PAM type: YTN; PAM sequence: TTT
ttaaaaacactctaaagacc

SEQ ID NO: 47839 - DNA, 20 bp, Artificial Sequence
  Description of Artificial Sequence: Synthetic oligonucleotide
  Target: SCN10A; (-) strand; PAM type: YTN; PAM sequence: CTA
atccagtttttaaaaacact

SEQ ID NO: 47840 - DNA, 20 bp, Artificial Sequence
  Description of Artificial Sequence: Synthetic oligonucleotide
  Target: SCN10A; (-) strand; PAM type: YTN; PAM sequence: CTA
ctaatccagtttttaaaaac

SEQ ID NO: 47841 - DNA, 20 bp, Artificial Sequence
  Description of Artificial Sequence: Synthetic oligonucleotide
  Target: SCN10A; (-) strand; PAM type: YTN; PAM sequence: TTG
gctactaatccagtttttaa

SEQ ID NO: 47842 - DNA, 20 bp, Artificial Sequence
  Description of Artificial Sequence: Synthetic oligonucleotide
  Target: SCN10A; (-) strand; PAM type: YTN; PAM sequence: TTA
atattggctactaatccagt

SEQ ID NO: 47843 - DNA, 20 bp, Artificial Sequence
  Description of Artificial Sequence: Synthetic oligonucleotide
  Target: SCN10A; (-) strand; PAM type: YTN; PAM sequence: TTT
aatattggctactaatccag

SEQ ID NO: 47844 - DNA, 20 bp, Artificial Sequence
  Description of Artificial Sequence: Synthetic oligonucleotide
  Target: SCN10A; (-) strand; PAM type: YTN; PAM sequence: CTT
taatattggctactaatcca

SEQ ID NO: 47845 - DNA, 20 bp, Artificial Sequence
  Description of Artificial Sequence: Synthetic oligonucleotide
  Target: SCN10A; (-) strand; PAM type: YTN; PAM sequence: TTG
tgcaaatgtctttaatattg

SEQ ID NO: 47846 - DNA, 20 bp, Artificial Sequence
  Description of Artificial Sequence: Synthetic oligonucleotide
  Target: SCN10A; (-) strand; PAM type: YTN; PAM sequence: TTT
gtgcaaatgtctttaatatt

SEQ ID NO: 47847 - DNA, 20 bp, Artificial Sequence
  Description of Artificial Sequence: Synthetic oligonucleotide
  Target: SCN10A; (-) strand; PAM type: YTN; PAM sequence: TTT
tgtgcaaatgtctttaatat

SEQ ID NO: 47848 - DNA, 20 bp, Artificial Sequence
  Description of Artificial Sequence: Synthetic oligonucleotide
  Target: SCN10A; (-) strand; PAM type: YTN; PAM sequence: TTT
ttgtgcaaatgtctttaata

SEQ ID NO: 47849 - DNA, 20 bp, Artificial Sequence
  Description of Artificial Sequence: Synthetic oligonucleotide
  Target: SCN10A; (-) strand; PAM type: YTN; PAM sequence: TTC
caaaaaagtcagaaatccag

SEQ ID NO: 47850 - DNA, 20 bp, Artificial Sequence
  Description of Artificial Sequence: Synthetic oligonucleotide
  Target: SCN10A; (-) strand; PAM type: YTN; PAM sequence: TTT
ccaaaaaagtcagaaatcca

SEQ ID NO: 47851 - DNA, 20 bp, Artificial Sequence
  Description of Artificial Sequence: Synthetic oligonucleotide
  Target: SCN10A; (-) strand; PAM type: YTN; PAM sequence: TTT
tccaaaaaagtcagaaatcc

SEQ ID NO: 47852 - DNA, 20 bp, Artificial Sequence
  Description of Artificial Sequence: Synthetic oligonucleotide
  Target: SCN10A; (-) strand; PAM type: YTN; PAM sequence: CTA
attttccaaaaaagtcagaa

SEQ ID NO: 47853 - DNA, 20 bp, Artificial Sequence
  Description of Artificial Sequence: Synthetic oligonucleotide
  Target: SCN10A; (-) strand; PAM type: YTN; PAM sequence: TTA
ctaattttccaaaaaagtca

SEQ ID NO: 47854 - DNA, 20 bp, Artificial Sequence
  Description of Artificial Sequence: Synthetic oligonucleotide
  Target: SCN10A; (-) strand; PAM type: YTN; PAM sequence: TTG
tcagagttactaattttcca

SEQ ID NO: 47855 - DNA, 20 bp, Artificial Sequence
  Description of Artificial Sequence: Synthetic oligonucleotide
  Target: SCN10A; (-) strand; PAM type: YTN; PAM sequence: TTA
ttgtcagagttactaatttt

SEQ ID NO: 47856 - DNA, 20 bp, Artificial Sequence
  Description of Artificial Sequence: Synthetic oligonucleotide
  Target: SCN10A; (-) strand; PAM type: YTN; PAM sequence: CTG
tccattattgtcagagttac

SEQ ID NO: 47857 - DNA, 20 bp, Artificial Sequence
  Description of Artificial Sequence: Synthetic oligonucleotide
  Target: SCN10A; (-) strand; PAM type: YTN; PAM sequence: CTA
tggcctgtccattattgtca

SEQ ID NO: 47858 - DNA, 20 bp, Artificial Sequence
  Description of Artificial Sequence: Synthetic oligonucleotide
  Target: SCN10A; (-) strand; PAM type: YTN; PAM sequence: CTC
aaaaaagaaaggagacacag

SEQ ID NO: 47859 - DNA, 20 bp, Artificial Sequence
  Description of Artificial Sequence: Synthetic oligonucleotide
  Target: SCN10A; (-) strand; PAM type: YTN; PAM sequence: CTG
tctcaaaaaagaaaggagac

SEQ ID NO: 47860 - DNA, 20 bp, Artificial Sequence
  Description of Artificial Sequence: Synthetic oligonucleotide
  Target: SCN10A; (-) strand; PAM type: YTN; PAM sequence: CTG
ggagacagagtaagaacctg

SEQ ID NO: 47861 - DNA, 20 bp, Artificial Sequence
  Description of Artificial Sequence: Synthetic oligonucleotide
  Target: SCN10A; (-) strand; PAM type: YTN; PAM sequence: CTC
cagcctgggagacagagtaa

SEQ ID NO: 47862 - DNA, 20 bp, Artificial Sequence
  Description of Artificial Sequence: Synthetic oligonucleotide
  Target: SCN10A; (-) strand; PAM type: YTN; PAM sequence: CTG
cactccagcctgggagacag

SEQ ID NO: 47863 - DNA, 20 bp, Artificial Sequence
  Description of Artificial Sequence: Synthetic oligonucleotide
  Target: SCN10A; (-) strand; PAM type: YTN; PAM sequence: CTG
cagtgcaccatgatcgtgcc

SEQ ID NO: 47864 - DNA, 20 bp, Artificial Sequence
  Description of Artificial Sequence: Synthetic oligonucleotide
  Target: SCN10A; (-) strand; PAM type: YTN; PAM sequence: CTG
agaccagggaggtggaggct

SEQ ID NO: 47865 - DNA, 20 bp, Artificial Sequence
  Description of Artificial Sequence: Synthetic oligonucleotide
  Target: SCN10A; (-) strand; PAM type: YTN; PAM sequence: CTG
aggtgggaggatcacctgag

SEQ ID NO: 47866 - DNA, 20 bp, Artificial Sequence
  Description of Artificial Sequence: Synthetic oligonucleotide
  Target: SCN10A; (-) strand; PAM type: YTN; PAM sequence: CTC
agaagactgaggtgggagga

SEQ ID NO: 47867 - DNA, 20 bp, Artificial Sequence
  Description of Artificial Sequence: Synthetic oligonucleotide
  Target: SCN10A; (-) strand; PAM type: YTN; PAM sequence: CTA
ctcagaagactgaggtggga

SEQ ID NO: 47868 - DNA, 20 bp, Artificial Sequence
  Description of Artificial Sequence: Synthetic oligonucleotide
  Target: SCN10A; (-) strand; PAM type: YTN; PAM sequence: CTA
gctactcagaagactgaggt

SEQ ID NO: 47869 - DNA, 20 bp, Artificial Sequence
  Description of Artificial Sequence: Synthetic oligonucleotide
  Target: SCN10A; (-) strand; PAM type: YTN; PAM sequence: TTA
tcctagctactcagaagact

SEQ ID NO: 47870 - DNA, 20 bp, Artificial Sequence
  Description of Artificial Sequence: Synthetic oligonucleotide
  Target: SCN10A; (-) strand; PAM type: YTN; PAM sequence: CTG
ttatcctagctactcagaag

SEQ ID NO: 47871 - DNA, 20 bp, Artificial Sequence
  Description of Artificial Sequence: Synthetic oligonucleotide
  Target: SCN10A; (-) strand; PAM type: YTN; PAM sequence: TTA
gccaggcatggtggtgcaca

SEQ ID NO: 47872 - DNA, 20 bp, Artificial Sequence
  Description of Artificial Sequence: Synthetic oligonucleotide
  Target: SCN10A; (-) strand; PAM type: YTN; PAM sequence: CTA
caaaaaatgaaaaaattagc

SEQ ID NO: 47873 - DNA, 20 bp, Artificial Sequence
  Description of Artificial Sequence: Synthetic oligonucleotide
  Target: SCN10A; (-) strand; PAM type: YTN; PAM sequence: CTC
tacaaaaaatgaaaaaatta

SEQ ID NO: 47874 - DNA, 20 bp, Artificial Sequence
  Description of Artificial Sequence: Synthetic oligonucleotide
  Target: SCN10A; (-) strand; PAM type: YTN; PAM sequence: TTC
aagggcaacatggtgaaacc

SEQ ID NO: 47875 - DNA, 20 bp, Artificial Sequence
  Description of Artificial Sequence: Synthetic oligonucleotide
  Target: SCN10A; (-) strand; PAM type: YTN; PAM sequence: TTG
agcccaggagttcaagggca

SEQ ID NO: 47876 - DNA, 20 bp, Artificial Sequence
  Description of Artificial Sequence: Synthetic oligonucleotide
  Target: SCN10A; (-) strand; PAM type: YTN; PAM sequence: CTT
gagcccaggagttcaagggc

SEQ ID NO: 47877 - DNA, 20 bp, Artificial Sequence
  Description of Artificial Sequence: Synthetic oligonucleotide
  Target: SCN10A; (-) strand; PAM type: YTN; PAM sequence: TTG
ggaggccgaggcaggcagat

SEQ ID NO: 47878 - DNA, 20 bp, Artificial Sequence
  Description of Artificial Sequence: Synthetic oligonucleotide
  Target: SCN10A; (-) strand; PAM type: YTN; PAM sequence: TTT
gggaggccgaggcaggcaga

SEQ ID NO: 47879 - DNA, 20 bp, Artificial Sequence
  Description of Artificial Sequence: Synthetic oligonucleotide
  Target: SCN10A; (-) strand; PAM type: YTN; PAM sequence: CTT
tgggaggccgaggcaggcag

SEQ ID NO: 47880 - DNA, 20 bp, Artificial Sequence
  Description of Artificial Sequence: Synthetic oligonucleotide
  Target: SCN10A; (-) strand; PAM type: YTN; PAM sequence: CTA
gtactttgggaggccgaggc

SEQ ID NO: 47881 - DNA, 20 bp, Artificial Sequence
  Description of Artificial Sequence: Synthetic oligonucleotide
  Target: SCN10A; (-) strand; PAM type: YTN; PAM sequence: CTG
taatcctagtactttgggag

SEQ ID NO: 47882 - DNA, 20 bp, Artificial Sequence
  Description of Artificial Sequence: Synthetic oligonucleotide
  Target: SCN10A; (-) strand; PAM type: YTN; PAM sequence: CTC
acacctgtaatcctagtact

SEQ ID NO: 47883 - DNA, 20 bp, Artificial Sequence
  Description of Artificial Sequence: Synthetic oligonucleotide
  Target: SCN10A; (-) strand; PAM type: YTN; PAM sequence: CTC
aggccaggtgcagtggctca

SEQ ID NO: 47884 - DNA, 20 bp, Artificial Sequence
  Description of Artificial Sequence: Synthetic oligonucleotide
  Target: SCN10A; (-) strand; PAM type: YTN; PAM sequence: TTA
catagaaatcaatgtgacca

SEQ ID NO: 47885 - DNA, 20 bp, Artificial Sequence
  Description of Artificial Sequence: Synthetic oligonucleotide
  Target: SCN10A; (-) strand; PAM type: YTN; PAM sequence: TTT
acatagaaatcaatgtgacc

SEQ ID NO: 47886 - DNA, 20 bp, Artificial Sequence
  Description of Artificial Sequence: Synthetic oligonucleotide
  Target: SCN10A; (-) strand; PAM type: YTN; PAM sequence: CTG
ggagggatgtttacatagaa

SEQ ID NO: 47887 - DNA, 20 bp, Artificial Sequence
  Description of Artificial Sequence: Synthetic oligonucleotide
  Target: SCN10A; (-) strand; PAM type: YTN; PAM sequence: CTC
ctgggagggatgtttacata

SEQ ID NO: 47888 - DNA, 20 bp, Artificial Sequence
  Description of Artificial Sequence: Synthetic oligonucleotide
  Target: SCN10A; (-) strand; PAM type: YTN; PAM sequence: CTA
ggcagacccaaagcagtgca

SEQ ID NO: 47889 - DNA, 20 bp, Artificial Sequence
  Description of Artificial Sequence: Synthetic oligonucleotide
  Target: SCN10A; (-) strand; PAM type: YTN; PAM sequence: TTC
acctaggcagacccaaagca

SEQ ID NO: 47890 - DNA, 20 bp, Artificial Sequence
  Description of Artificial Sequence: Synthetic oligonucleotide
  Target: SCN10A; (-) strand; PAM type: YTN; PAM sequence: TTT
cacctaggcagacccaaagc

SEQ ID NO: 47891 - DNA, 20 bp, Artificial Sequence
  Description of Artificial Sequence: Synthetic oligonucleotide
  Target: SCN10A; (-) strand; PAM type: YTN; PAM sequence: CTC
catttcacctaggcagaccc

SEQ ID NO: 47892 - DNA, 20 bp, Artificial Sequence
  Description of Artificial Sequence: Synthetic oligonucleotide
  Target: SCN10A; (-) strand; PAM type: YTN; PAM sequence: CTC
aggtagacaggcaaagatga

SEQ ID NO: 47893 - DNA, 20 bp, Artificial Sequence
  Description of Artificial Sequence: Synthetic oligonucleotide
  Target: SCN10A; (-) strand; PAM type: YTN; PAM sequence: TTG
cctcaggtagacaggcaaag

SEQ ID NO: 47894 - DNA, 20 bp, Artificial Sequence
  Description of Artificial Sequence: Synthetic oligonucleotide
  Target: SCN10A; (-) strand; PAM type: YTN; PAM sequence: TTT
gcctcaggtagacaggcaaa

SEQ ID NO: 47895 - DNA, 20 bp, Artificial Sequence
  Description of Artificial Sequence: Synthetic oligonucleotide
  Target: SCN10A; (-) strand; PAM type: YTN; PAM sequence: CTG
gatatttgcctcaggtagac

SEQ ID NO: 47896 - DNA, 20 bp, Artificial Sequence
  Description of Artificial Sequence: Synthetic oligonucleotide
  Target: SCN10A; (-) strand; PAM type: YTN; PAM sequence: CTC
aaatgcccatgtgcagtgac

SEQ ID NO: 47897 - DNA, 20 bp, Artificial Sequence
  Description of Artificial Sequence: Synthetic oligonucleotide
  Target: SCN10A; (-) strand; PAM type: YTN; PAM sequence: TTA
ggggtggcaaactcaaatgc

SEQ ID NO: 47898 - DNA, 20 bp, Artificial Sequence
  Description of Artificial Sequence: Synthetic oligonucleotide
  Target: SCN10A; (-) strand; PAM type: YTN; PAM sequence: CTG
gattaggggtggcaaactca

SEQ ID NO: 47899 - DNA, 20 bp, Artificial Sequence
  Description of Artificial Sequence: Synthetic oligonucleotide
  Target: SCN10A; (-) strand; PAM type: YTN; PAM sequence: TTG
gcgtacctggattaggggtg

SEQ ID NO: 47900 - DNA, 20 bp, Artificial Sequence
  Description of Artificial Sequence: Synthetic oligonucleotide
  Target: SCN10A; (-) strand; PAM type: YTN; PAM sequence: CTT
ggcgtacctggattaggggt

SEQ ID NO: 47901 - DNA, 20 bp, Artificial Sequence
  Description of Artificial Sequence: Synthetic oligonucleotide
  Target: SCN10A; (-) strand; PAM type: YTN; PAM sequence: CTG
aacttggcgtacctggatta

SEQ ID NO: 47902 - DNA, 20 bp, Artificial Sequence
  Description of Artificial Sequence: Synthetic oligonucleotide
  Target: SCN10A; (-) strand; PAM type: YTN; PAM sequence: CTG
agcccctgaacttggcgtac

SEQ ID NO: 47903 - DNA, 20 bp, Artificial Sequence
  Description of Artificial Sequence: Synthetic oligonucleotide
  Target: SCN10A; (-) strand; PAM type: YTN; PAM sequence: CTA
tcacaggggccagtgagaca

SEQ ID NO: 47904 - DNA, 20 bp, Artificial Sequence
  Description of Artificial Sequence: Synthetic oligonucleotide
  Target: SCN10A; (-) strand; PAM type: YTN; PAM sequence: TTG
ggaccctatcacaggggcca

SEQ ID NO: 47905 - DNA, 20 bp, Artificial Sequence
  Description of Artificial Sequence: Synthetic oligonucleotide
  Target: SCN10A; (-) strand; PAM type: YTN; PAM sequence: CTT
gggaccctatcacaggggcc

SEQ ID NO: 47906 - DNA, 20 bp, Artificial Sequence
  Description of Artificial Sequence: Synthetic oligonucleotide
  Target: SCN10A; (-) strand; PAM type: YTN; PAM sequence: CTG
cttgggaccctatcacaggg

SEQ ID NO: 47907 - DNA, 20 bp, Artificial Sequence
  Description of Artificial Sequence: Synthetic oligonucleotide
  Target: SCN10A; (-) strand; PAM type: YTN; PAM sequence: CTA
ggacagatctgcttgggacc

SEQ ID NO: 47908 - DNA, 20 bp, Artificial Sequence
  Description of Artificial Sequence: Synthetic oligonucleotide
  Target: SCN10A; (-) strand; PAM type: YTN; PAM sequence: CTC
taggacagatctgcttggga

SEQ ID NO: 47909 - DNA, 20 bp, Artificial Sequence
  Description of Artificial Sequence: Synthetic oligonucleotide
  Target: SCN10A; (-) strand; PAM type: YTN; PAM sequence: TTC
aggaggcaacgagactctag

SEQ ID NO: 47910 - DNA, 20 bp, Artificial Sequence
  Description of Artificial Sequence: Synthetic oligonucleotide
  Target: SCN10A; (-) strand; PAM type: YTN; PAM sequence: TTG
aagggggtgcatggttcagg

SEQ ID NO: 47911 - DNA, 20 bp, Artificial Sequence
  Description of Artificial Sequence: Synthetic oligonucleotide
  Target: SCN10A; (-) strand; PAM type: YTN; PAM sequence: TTG
gcatccagaggttgaagggg

SEQ ID NO: 47912 - DNA, 20 bp, Artificial Sequence
  Description of Artificial Sequence: Synthetic oligonucleotide
  Target: SCN10A; (-) strand; PAM type: YTN; PAM sequence: CTG
acaagtgttggcatccagag

SEQ ID NO: 47913 - DNA, 20 bp, Artificial Sequence
  Description of Artificial Sequence: Synthetic oligonucleotide
  Target: SCN10A; (-) strand; PAM type: YTN; PAM sequence: TTC
ccaaggtcctgacaagtgtt

SEQ ID NO: 47914 - DNA, 20 bp, Artificial Sequence
  Description of Artificial Sequence: Synthetic oligonucleotide
  Target: SCN10A; (-) strand; PAM type: YTN; PAM sequence: CTT
cccaaggtcctgacaagtgt

SEQ ID NO: 47915 - DNA, 20 bp, Artificial Sequence
  Description of Artificial Sequence: Synthetic oligonucleotide
  Target: SCN10A; (-) strand; PAM type: YTN; PAM sequence: TTG
aagagaggtgacaaaacaaa

SEQ ID NO: 47916 - DNA, 20 bp, Artificial Sequence
  Description of Artificial Sequence: Synthetic oligonucleotide
  Target: SCN10A; (-) strand; PAM type: YTN; PAM sequence: CTT
gaagagaggtgacaaaacaa

SEQ ID NO: 47917 - DNA, 20 bp, Artificial Sequence
  Description of Artificial Sequence: Synthetic oligonucleotide
  Target: SCN10A; (-) strand; PAM type: YTN; PAM sequence: CTA
gacttgaagagaggtgacaa

SEQ ID NO: 47918 - DNA, 20 bp, Artificial Sequence
  Description of Artificial Sequence: Synthetic oligonucleotide
  Target: SCN10A; (-) strand; PAM type: YTN; PAM sequence: CTG
catctagacttgaagagagg

SEQ ID NO: 47919 - DNA, 20 bp, Artificial Sequence
  Description of Artificial Sequence: Synthetic oligonucleotide
  Target: SCN10A; (-) strand; PAM type: YTN; PAM sequence: CTG
ggagccctgcatctagactt

SEQ ID NO: 47920 - DNA, 20 bp, Artificial Sequence
  Description of Artificial Sequence: Synthetic oligonucleotide
  Target: SCN10A; (-) strand; PAM type: YTN; PAM sequence: TTA
actgggagccctgcatctag

SEQ ID NO: 47921 - DNA, 20 bp, Artificial Sequence
  Description of Artificial Sequence: Synthetic oligonucleotide
  Target: SCN10A; (-) strand; PAM type: YTN; PAM sequence: CTC
agtattaactgggagccctg

SEQ ID NO: 47922 - DNA, 20 bp, Artificial Sequence
  Description of Artificial Sequence: Synthetic oligonucleotide
  Target: SCN10A; (-) strand; PAM type: YTN; PAM sequence: CTC
tcagtattaactgggagccc

SEQ ID NO: 47923 - DNA, 20 bp, Artificial Sequence
  Description of Artificial Sequence: Synthetic oligonucleotide
  Target: SCN10A; (-) strand; PAM type: YTN; PAM sequence: CTC
aggaatctctcagtattaac

SEQ ID NO: 47924 - DNA, 20 bp, Artificial Sequence
  Description of Artificial Sequence: Synthetic oligonucleotide
  Target: SCN10A; (-) strand; PAM type: YTN; PAM sequence: CTC
tcaggaatctctcagtatta

SEQ ID NO: 47925 - DNA, 20 bp, Artificial Sequence
  Description of Artificial Sequence: Synthetic oligonucleotide
  Target: SCN10A; (-) strand; PAM type: YTN; PAM sequence: CTG
ctctcaggaatctctcagta

SEQ ID NO: 47926 - DNA, 20 bp, Artificial Sequence
  Description of Artificial Sequence: Synthetic oligonucleotide
  Target: SCN10A; (-) strand; PAM type: YTN; PAM sequence: TTA
gcgcaggccgcctgctctca

SEQ ID NO: 47927 - DNA, 20 bp, Artificial Sequence
  Description of Artificial Sequence: Synthetic oligonucleotide
  Target: SCN10A; (-) strand; PAM type: YTN; PAM sequence: TTG
ttagcgcaggccgcctgctc

SEQ ID NO: 47928 - DNA, 20 bp, Artificial Sequence
  Description of Artificial Sequence: Synthetic oligonucleotide
  Target: SCN10A; (-) strand; PAM type: YTN; PAM sequence: CTT
gttagcgcaggccgcctgct

SEQ ID NO: 47929 - DNA, 20 bp, Artificial Sequence
  Description of Artificial Sequence: Synthetic oligonucleotide
  Target: SCN10A; (-) strand; PAM type: YTN; PAM sequence: CTG
aagaaatgtcacggcttgtt

SEQ ID NO: 47930 - DNA, 20 bp, Artificial Sequence
  Description of Artificial Sequence: Synthetic oligonucleotide
  Target: SCN10A; (-) strand; PAM type: YTN; PAM sequence: TTG
ggaataggaaagaggcctga

SEQ ID NO: 47931 - DNA, 20 bp, Artificial Sequence
  Description of Artificial Sequence: Synthetic oligonucleotide
  Target: SCN10A; (-) strand; PAM type: YTN; PAM sequence: CTT
gggaataggaaagaggcctg

SEQ ID NO: 47932 - DNA, 20 bp, Artificial Sequence
  Description of Artificial Sequence: Synthetic oligonucleotide
  Target: SCN10A; (-) strand; PAM type: YTN; PAM sequence: CTC
ttgggaataggaaagaggcc

SEQ ID NO: 47933 - DNA, 20 bp, Artificial Sequence
  Description of Artificial Sequence: Synthetic oligonucleotide
  Target: SCN10A; (-) strand; PAM type: YTN; PAM sequence: CTG
actcttgggaataggaaaga

SEQ ID NO: 47934 - DNA, 20 bp, Artificial Sequence
  Description of Artificial Sequence: Synthetic oligonucleotide
  Target: SCN10A; (-) strand; PAM type: YTN; PAM sequence: CTC
actgactcttgggaatagga

SEQ ID NO: 47935 - DNA, 20 bp, Artificial Sequence
  Description of Artificial Sequence: Synthetic oligonucleotide
  Target: SCN10A; (-) strand; PAM type: YTN; PAM sequence: TTG
gcatctcactgactcttggg

SEQ ID NO: 47936 - DNA, 20 bp, Artificial Sequence
  Description of Artificial Sequence: Synthetic oligonucleotide
  Target: SCN10A; (-) strand; PAM type: YTN; PAM sequence: CTT
ggcatctcactgactcttgg

SEQ ID NO: 47937 - DNA, 20 bp, Artificial Sequence
  Description of Artificial Sequence: Synthetic oligonucleotide
  Target: SCN10A; (-) strand; PAM type: YTN; PAM sequence: CTG
gaggaagcttggcatctcac

SEQ ID NO: 47938 - DNA, 20 bp, Artificial Sequence
  Description of Artificial Sequence: Synthetic oligonucleotide
  Target: SCN10A; (-) strand; PAM type: YTN; PAM sequence: CTC
caggccatctggaggaagct

SEQ ID NO: 47939 - DNA, 20 bp, Artificial Sequence
  Description of Artificial Sequence: Synthetic oligonucleotide
  Target: SCN10A; (-) strand; PAM type: YTN; PAM sequence: CTA
ggtctccaggccatctggag

SEQ ID NO: 47940 - DNA, 20 bp, Artificial Sequence
  Description of Artificial Sequence: Synthetic oligonucleotide
  Target: SCN10A; (-) strand; PAM type: YTN; PAM sequence: TTC
ccaggagtgtcgggtcacta

SEQ ID NO: 47941 - DNA, 20 bp, Artificial Sequence
  Description of Artificial Sequence: Synthetic oligonucleotide
  Target: SCN10A; (-) strand; PAM type: YTN; PAM sequence: CTG
tcagattcccaggagtgtcg

SEQ ID NO: 47942 - DNA, 20 bp, Artificial Sequence
  Description of Artificial Sequence: Synthetic oligonucleotide
  Target: SCN10A; (-) strand; PAM type: YTN; PAM sequence: TTG
tcagccaaacctgtcagatt

SEQ ID NO: 47943 - DNA, 20 bp, Artificial Sequence
  Description of Artificial Sequence: Synthetic oligonucleotide
  Target: SCN10A; (-) strand; PAM type: YTN; PAM sequence: TTT
gtcagccaaacctgtcagat

SEQ ID NO: 47944 - DNA, 20 bp, Artificial Sequence
  Description of Artificial Sequence: Synthetic oligonucleotide
  Target: SCN10A; (-) strand; PAM type: YTN; PAM sequence: TTA
tcagagccacaggtttgtca

SEQ ID NO: 47945 - DNA, 20 bp, Artificial Sequence
  Description of Artificial Sequence: Synthetic oligonucleotide
  Target: SCN10A; (-) strand; PAM type: YTN; PAM sequence: TTT
atcagagccacaggtttgtc

SEQ ID NO: 47946 - DNA, 20 bp, Artificial Sequence
  Description of Artificial Sequence: Synthetic oligonucleotide
  Target: SCN10A; (-) strand; PAM type: YTN; PAM sequence: TTT
tatcagagccacaggtttgt

SEQ ID NO: 47947 - DNA, 20 bp, Artificial Sequence
  Description of Artificial Sequence: Synthetic oligonucleotide
  Target: SCN10A; (-) strand; PAM type: YTN; PAM sequence: CTT
ttatcagagccacaggtttg

SEQ ID NO: 47948 - DNA, 20 bp, Artificial Sequence
  Description of Artificial Sequence: Synthetic oligonucleotide
  Target: SCN10A; (-) strand; PAM type: YTN; PAM sequence: CTA
caggagaagtgccacaggcc

SEQ ID NO: 47949 - DNA, 20 bp, Artificial Sequence
  Description of Artificial Sequence: Synthetic oligonucleotide
  Target: SCN10A; (-) strand; PAM type: YTN; PAM sequence: CTC
tacaggagaagtgccacagg

SEQ ID NO: 47950 - DNA, 20 bp, Artificial Sequence
  Description of Artificial Sequence: Synthetic oligonucleotide
  Target: SCN10A; (-) strand; PAM type: YTN; PAM sequence: CTC
caggacgccctctacaggag

SEQ ID NO: 47951 - DNA, 20 bp, Artificial Sequence
  Description of Artificial Sequence: Synthetic oligonucleotide
  Target: SCN10A; (-) strand; PAM type: YTN; PAM sequence: CTC
agctccaggacgccctctac

SEQ ID NO: 47952 - DNA, 20 bp, Artificial Sequence
  Description of Artificial Sequence: Synthetic oligonucleotide
  Target: SCN10A; (-) strand; PAM type: YTN; PAM sequence: CTA
aactcagctccaggacgccc

SEQ ID NO: 47953 - DNA, 20 bp, Artificial Sequence
  Description of Artificial Sequence: Synthetic oligonucleotide
  Target: SCN10A; (-) strand; PAM type: YTN; PAM sequence: CTC
taaactcagctccaggacgc

SEQ ID NO: 47954 - DNA, 20 bp, Artificial Sequence
  Description of Artificial Sequence: Synthetic oligonucleotide
  Target: SCN10A; (-) strand; PAM type: YTN; PAM sequence: TTC
tctaaactcagctccaggac

SEQ ID NO: 47955 - DNA, 20 bp, Artificial Sequence
  Description of Artificial Sequence: Synthetic oligonucleotide
  Target: SCN10A; (-) strand; PAM type: YTN; PAM sequence: CTT
ctctaaactcagctccagga

SEQ ID NO: 47956 - DNA, 20 bp, Artificial Sequence
  Description of Artificial Sequence: Synthetic oligonucleotide
  Target: SCN10A; (-) strand; PAM type: YTN; PAM sequence: CTC
ttctctaaactcagctccag

SEQ ID NO: 47957 - DNA, 20 bp, Artificial Sequence
  Description of Artificial Sequence: Synthetic oligonucleotide
  Target: SCN10A; (-) strand; PAM type: YTN; PAM sequence: CTC
acatgcaatgatggctcttc

SEQ ID NO: 47958 - DNA, 20 bp, Artificial Sequence
  Description of Artificial Sequence: Synthetic oligonucleotide
  Target: SCN10A; (-) strand; PAM type: YTN; PAM sequence: CTC
actcacatgcaatgatggct

SEQ ID NO: 47959 - DNA, 20 bp, Artificial Sequence
  Description of Artificial Sequence: Synthetic oligonucleotide
  Target: SCN10A; (-) strand; PAM type: YTN; PAM sequence: TTA
gtctcactcacatgcaatga

SEQ ID NO: 47960 - DNA, 20 bp, Artificial Sequence
  Description of Artificial Sequence: Synthetic oligonucleotide
  Target: SCN10A; (-) strand; PAM type: YTN; PAM sequence: CTA
ttagtctcactcacatgcaa

SEQ ID NO: 47961 - DNA, 20 bp, Artificial Sequence
  Description of Artificial Sequence: Synthetic oligonucleotide
  Target: SCN10A; (-) strand; PAM type: YTN; PAM sequence: CTG
cctattagtctcactcacat

SEQ ID NO: 47962 - DNA, 20 bp, Artificial Sequence
  Description of Artificial Sequence: Synthetic oligonucleotide
  Target: SCN10A; (-) strand; PAM type: YTN; PAM sequence: TTC
aacctgcctattagtctcac

SEQ ID NO: 47963 - DNA, 20 bp, Artificial Sequence
  Description of Artificial Sequence: Synthetic oligonucleotide
  Target: SCN10A; (-) strand; PAM type: YTN; PAM sequence: CTT
caacctgcctattagtctca

SEQ ID NO: 47964 - DNA, 20 bp, Artificial Sequence
  Description of Artificial Sequence: Synthetic oligonucleotide
  Target: SCN10A; (-) strand; PAM type: YTN; PAM sequence: CTC
aagcaccttcaacctgccta

SEQ ID NO: 47965 - DNA, 20 bp, Artificial Sequence
  Description of Artificial Sequence: Synthetic oligonucleotide
  Target: SCN10A; (-) strand; PAM type: YTN; PAM sequence: TTG
tgcccgaaatcacagcccca

SEQ ID NO: 47966 - DNA, 20 bp, Artificial Sequence
  Description of Artificial Sequence: Synthetic oligonucleotide
  Target: SCN10A; (-) strand; PAM type: YTN; PAM sequence: CTT
gtgcccgaaatcacagcccc

SEQ ID NO: 47967 - DNA, 20 bp, Artificial Sequence
  Description of Artificial Sequence: Synthetic oligonucleotide
  Target: SCN10A; (-) strand; PAM type: YTN; PAM sequence: TTC
ccttgtgcccgaaatcacag

SEQ ID NO: 47968 - DNA, 20 bp, Artificial Sequence
  Description of Artificial Sequence: Synthetic oligonucleotide
  Target: SCN10A; (-) strand; PAM type: YTN; PAM sequence: CTG
attcccttgtgcccgaaatc

SEQ ID NO: 47969 - DNA, 20 bp, Artificial Sequence
  Description of Artificial Sequence: Synthetic oligonucleotide
  Target: SCN10A; (-) strand; PAM type: YTN; PAM sequence: CTC
tgattcccttgtgcccgaaa

SEQ ID NO: 47970 - DNA, 20 bp, Artificial Sequence
  Description of Artificial Sequence: Synthetic oligonucleotide
  Target: SCN10A; (-) strand; PAM type: YTN; PAM sequence: TTC
tctgattcccttgtgcccga

SEQ ID NO: 47971 - DNA, 20 bp, Artificial Sequence
  Description of Artificial Sequence: Synthetic oligonucleotide
  Target: SCN10A; (-) strand; PAM type: YTN; PAM sequence: CTC
aaggaagtcattctctgatt

SEQ ID NO: 47972 - DNA, 20 bp, Artificial Sequence
  Description of Artificial Sequence: Synthetic oligonucleotide
  Target: SCN10A; (-) strand; PAM type: YTN; PAM sequence: TTC
cagcctcaaggaagtcattc

SEQ ID NO: 47973 - DNA, 20 bp, Artificial Sequence
  Description of Artificial Sequence: Synthetic oligonucleotide
  Target: SCN10A; (-) strand; PAM type: YTN; PAM sequence: CTT
ccagcctcaaggaagtcatt

SEQ ID NO: 47974 - DNA, 20 bp, Artificial Sequence
  Description of Artificial Sequence: Synthetic oligonucleotide
  Target: SCN10A; (-) strand; PAM type: YTN; PAM sequence: CTC
cttccagcctcaaggaagtc

SEQ ID NO: 47975 - DNA, 20 bp, Artificial Sequence
  Description of Artificial Sequence: Synthetic oligonucleotide
  Target: SCN10A; (-) strand; PAM type: YTN; PAM sequence: CTC
cagagccccagctccttcca

SEQ ID NO: 47976 - DNA, 20 bp, Artificial Sequence
  Description of Artificial Sequence: Synthetic oligonucleotide
  Target: SCN10A; (-) strand; PAM type: YTN; PAM sequence: CTG
actccagagccccagctcct

SEQ ID NO: 47977 - DNA, 20 bp, Artificial Sequence
  Description of Artificial Sequence: Synthetic oligonucleotide
  Target: SCN10A; (-) strand; PAM type: YTN; PAM sequence: TTG
tctgactccagagccccagc

SEQ ID NO: 47978 - DNA, 20 bp, Artificial Sequence
  Description of Artificial Sequence: Synthetic oligonucleotide
  Target: SCN10A; (-) strand; PAM type: YTN; PAM sequence: CTC
aaatccaggttgtctgactc

SEQ ID NO: 47979 - DNA, 20 bp, Artificial Sequence
  Description of Artificial Sequence: Synthetic oligonucleotide
  Target: SCN10A; (-) strand; PAM type: YTN; PAM sequence: CTG
gatctcaaatccaggttgtc

SEQ ID NO: 47980 - DNA, 20 bp, Artificial Sequence
  Description of Artificial Sequence: Synthetic oligonucleotide
  Target: SCN10A; (-) strand; PAM type: YTN; PAM sequence: CTG
ccaagcaagcgaataagcca

SEQ ID NO: 47981 - DNA, 20 bp, Artificial Sequence
  Description of Artificial Sequence: Synthetic oligonucleotide
  Target: SCN10A; (-) strand; PAM type: YTN; PAM sequence: CTC
ccatctgccaagcaagcgaa

SEQ ID NO: 47982 - DNA, 20 bp, Artificial Sequence
  Description of Artificial Sequence: Synthetic oligonucleotide
  Target: SCN10A; (-) strand; PAM type: YTN; PAM sequence: TTC
catgatgacccgaaagtctc

SEQ ID NO: 47983 - DNA, 20 bp, Artificial Sequence
  Description of Artificial Sequence: Synthetic oligonucleotide
  Target: SCN10A; (-) strand; PAM type: YTN; PAM sequence: CTC
aggggtgggtgaggaaaaag

SEQ ID NO: 47984 - DNA, 20 bp, Artificial Sequence
  Description of Artificial Sequence: Synthetic oligonucleotide
  Target: SCN10A; (-) strand; PAM type: YTN; PAM sequence: TTA
agatcctcaggggtgggtga

SEQ ID NO: 47985 - DNA, 20 bp, Artificial Sequence
  Description of Artificial Sequence: Synthetic oligonucleotide
  Target: SCN10A; (-) strand; PAM type: YTN; PAM sequence: TTT
aagatcctcaggggtgggtg

SEQ ID NO: 47986 - DNA, 20 bp, Artificial Sequence
  Description of Artificial Sequence: Synthetic oligonucleotide
  Target: SCN10A; (-) strand; PAM type: YTN; PAM sequence: TTT
taagatcctcaggggtgggt

SEQ ID NO: 47987 - DNA, 20 bp, Artificial Sequence
  Description of Artificial Sequence: Synthetic oligonucleotide
  Target: SCN10A; (-) strand; PAM type: YTN; PAM sequence: TTT
ttaagatcctcaggggtggg

SEQ ID NO: 47988 - DNA, 20 bp, Artificial Sequence
  Description of Artificial Sequence: Synthetic oligonucleotide
  Target: SCN10A; (-) strand; PAM type: YTN; PAM sequence: CTG
agagatagtcgtttttaaga

SEQ ID NO: 47989 - DNA, 20 bp, Artificial Sequence
  Description of Artificial Sequence: Synthetic oligonucleotide
  Target: SCN10A; (-) strand; PAM type: YTN; PAM sequence: CTC
acaacaaccctgagagatag

SEQ ID NO: 47990 - DNA, 20 bp, Artificial Sequence
  Description of Artificial Sequence: Synthetic oligonucleotide
  Target: SCN10A; (-) strand; PAM type: YTN; PAM sequence: TTA
tgctcacaacaaccctgaga

SEQ ID NO: 47991 - DNA, 20 bp, Artificial Sequence
  Description of Artificial Sequence: Synthetic oligonucleotide
  Target: SCN10A; (-) strand; PAM type: YTN; PAM sequence: TTT
atgctcacaacaaccctgag

SEQ ID NO: 47992 - DNA, 20 bp, Artificial Sequence
  Description of Artificial Sequence: Synthetic oligonucleotide
  Target: SCN10A; (-) strand; PAM type: YTN; PAM sequence: TTT
tatgctcacaacaaccctga

SEQ ID NO: 47993 - DNA, 20 bp, Artificial Sequence
  Description of Artificial Sequence: Synthetic oligonucleotide
  Target: SCN10A; (-) strand; PAM type: YTN; PAM sequence: CTC
attttatgctcacaacaacc

SEQ ID NO: 47994 - DNA, 20 bp, Artificial Sequence
  Description of Artificial Sequence: Synthetic oligonucleotide
  Target: SCN10A; (-) strand; PAM type: YTN; PAM sequence: TTG
aaaaaacgcacctcatttta

SEQ ID NO: 47995 - DNA, 20 bp, Artificial Sequence
  Description of Artificial Sequence: Synthetic oligonucleotide
  Target: SCN10A; (-) strand; PAM type: YTN; PAM sequence: CTT
gaaaaaacgcacctcatttt

SEQ ID NO: 47996 - DNA, 20 bp, Artificial Sequence
  Description of Artificial Sequence: Synthetic oligonucleotide
  Target: SCN10A; (-) strand; PAM type: YTN; PAM sequence: CTG
gacacttgaaaaaacgcacc

SEQ ID NO: 47997 - DNA, 20 bp, Artificial Sequence
  Description of Artificial Sequence: Synthetic oligonucleotide
  Target: SCN10A; (-) strand; PAM type: YTN; PAM sequence: TTA
caatgtgtcaggcatagcac

SEQ ID NO: 47998 - DNA, 20 bp, Artificial Sequence
  Description of Artificial Sequence: Synthetic oligonucleotide
  Target: SCN10A; (-) strand; PAM type: YTN; PAM sequence: CTT
acaatgtgtcaggcatagca

SEQ ID NO: 47999 - DNA, 20 bp, Artificial Sequence
  Description of Artificial Sequence: Synthetic oligonucleotide
  Target: SCN10A; (-) strand; PAM type: YTN; PAM sequence: CTG
agcacttacaatgtgtcagg

SEQ ID NO: 48000 - DNA, 20 bp, Artificial Sequence
  Description of Artificial Sequence: Synthetic oligonucleotide
  Target: SCN10A; (-) strand; PAM type: YTN; PAM sequence: TTA
ctgagcacttacaatgtgtc

SEQ ID NO: 48001 - DNA, 20 bp, Artificial Sequence
  Description of Artificial Sequence: Synthetic oligonucleotide
  Target: SCN10A; (-) strand; PAM type: YTN; PAM sequence: CTT
actgagcacttacaatgtgt

SEQ ID NO: 48002 - DNA, 20 bp, Artificial Sequence
  Description of Artificial Sequence: Synthetic oligonucleotide
  Target: SCN10A; (-) strand; PAM type: YTN; PAM sequence: CTA
atacttactgagcacttaca

SEQ ID NO: 48003 - DNA, 20 bp, Artificial Sequence
  Description of Artificial Sequence: Synthetic oligonucleotide
  Target: SCN10A; (-) strand; PAM type: YTN; PAM sequence: TTA
tcaaataacaataacagcaa

SEQ ID NO: 48004 - DNA, 20 bp, Artificial Sequence
  Description of Artificial Sequence: Synthetic oligonucleotide
  Target: SCN10A; (-) strand; PAM type: YTN; PAM sequence: CTT
atcaaataacaataacagca

SEQ ID NO: 48005 - DNA, 20 bp, Artificial Sequence
  Description of Artificial Sequence: Synthetic oligonucleotide
  Target: SCN10A; (-) strand; PAM type: YTN; PAM sequence: CTC
ttatcaaataacaataacag

SEQ ID NO: 48006 - DNA, 20 bp, Artificial Sequence
  Description of Artificial Sequence: Synthetic oligonucleotide
  Target: SCN10A; (-) strand; PAM type: YTN; PAM sequence: CTC
gtctcttatcaaataacaat

SEQ ID NO: 48007 - DNA, 20 bp, Artificial Sequence
  Description of Artificial Sequence: Synthetic oligonucleotide
  Target: SCN10A; (-) strand; PAM type: YTN; PAM sequence: CTG
tcctcgtctcttatcaaata

SEQ ID NO: 48008 - DNA, 20 bp, Artificial Sequence
  Description of Artificial Sequence: Synthetic oligonucleotide
  Target: SCN10A; (-) strand; PAM type: YTN; PAM sequence: TTC
caagcactgtcctcgtctct

SEQ ID NO: 48009 - DNA, 20 bp, Artificial Sequence
  Description of Artificial Sequence: Synthetic oligonucleotide
  Target: SCN10A; (-) strand; PAM type: YTN; PAM sequence: CTT
ccaagcactgtcctcgtctc

SEQ ID NO: 48010 - DNA, 20 bp, Artificial Sequence
  Description of Artificial Sequence: Synthetic oligonucleotide
  Target: SCN10A; (-) strand; PAM type: YTN; PAM sequence: CTG
caccaagaggggacttccaa

SEQ ID NO: 48011 - DNA, 20 bp, Artificial Sequence
  Description of Artificial Sequence: Synthetic oligonucleotide
  Target: SCN10A; (-) strand; PAM type: YTN; PAM sequence: TTA
tctgcaccaagaggggactt

SEQ ID NO: 48012 - DNA, 20 bp, Artificial Sequence
  Description of Artificial Sequence: Synthetic oligonucleotide
  Target: SCN10A; (-) strand; PAM type: YTN; PAM sequence: CTT
atctgcaccaagaggggact

SEQ ID NO: 48013 - DNA, 20 bp, Artificial Sequence
  Description of Artificial Sequence: Synthetic oligonucleotide
  Target: SCN10A; (-) strand; PAM type: YTN; PAM sequence: CTC
ccttatctgcaccaagaggg

SEQ ID NO: 48014 - DNA, 20 bp, Artificial Sequence
  Description of Artificial Sequence: Synthetic oligonucleotide
  Target: SCN10A; (-) strand; PAM type: YTN; PAM sequence: TTG
gctcccttatctgcaccaag

SEQ ID NO: 48015 - DNA, 20 bp, Artificial Sequence
  Description of Artificial Sequence: Synthetic oligonucleotide
  Target: SCN10A; (-) strand; PAM type: YTN; PAM sequence: CTT
ggctcccttatctgcaccaa

SEQ ID NO: 48016 - DNA, 20 bp, Artificial Sequence
  Description of Artificial Sequence: Synthetic oligonucleotide
  Target: SCN10A; (-) strand; PAM type: YTN; PAM sequence: CTG
ggccttggctcccttatctg

SEQ ID NO: 48017 - DNA, 20 bp, Artificial Sequence
  Description of Artificial Sequence: Synthetic oligonucleotide
  Target: SCN10A; (-) strand; PAM type: YTN; PAM sequence: TTC
tgggccttggctcccttatc

SEQ ID NO: 48018 - DNA, 20 bp, Artificial Sequence
  Description of Artificial Sequence: Synthetic oligonucleotide
  Target: SCN10A; (-) strand; PAM type: YTN; PAM sequence: TTT
ctgggccttggctcccttat

SEQ ID NO: 48019 - DNA, 20 bp, Artificial Sequence
  Description of Artificial Sequence: Synthetic oligonucleotide
  Target: SCN10A; (-) strand; PAM type: YTN; PAM sequence: CTT
tctgggccttggctccctta

SEQ ID NO: 48020 - DNA, 20 bp, Artificial Sequence
  Description of Artificial Sequence: Synthetic oligonucleotide
  Target: SCN10A; (-) strand; PAM type: YTN; PAM sequence: CTC
ctttctgggccttggctccc

SEQ ID NO: 48021 - DNA, 20 bp, Artificial Sequence
  Description of Artificial Sequence: Synthetic oligonucleotide
  Target: SCN10A; (-) strand; PAM type: YTN; PAM sequence: TTC
tcctttctgggccttggctc

SEQ ID NO: 48022 - DNA, 20 bp, Artificial Sequence
  Description of Artificial Sequence: Synthetic oligonucleotide
  Target: SCN10A; (-) strand; PAM type: YTN; PAM sequence: CTT
ctcctttctgggccttggct

SEQ ID NO: 48023 - DNA, 20 bp, Artificial Sequence
  Description of Artificial Sequence: Synthetic oligonucleotide
  Target: SCN10A; (-) strand; PAM type: YTN; PAM sequence: CTC
agagtggggacatgccttct

SEQ ID NO: 48024 - DNA, 20 bp, Artificial Sequence
  Description of Artificial Sequence: Synthetic oligonucleotide
  Target: SCN10A; (-) strand; PAM type: YTN; PAM sequence: CTG
actcagagtggggacatgcc

SEQ ID NO: 48025 - DNA, 20 bp, Artificial Sequence
  Description of Artificial Sequence: Synthetic oligonucleotide
  Target: SCN10A; (-) strand; PAM type: YTN; PAM sequence: TTC
gctgactcagagtggggaca

SEQ ID NO: 48026 - DNA, 20 bp, Artificial Sequence
  Description of Artificial Sequence: Synthetic oligonucleotide
  Target: SCN10A; (-) strand; PAM type: YTN; PAM sequence: TTT
cgctgactcagagtggggac

SEQ ID NO: 48027 - DNA, 20 bp, Artificial Sequence
  Description of Artificial Sequence: Synthetic oligonucleotide
  Target: SCN10A; (-) strand; PAM type: YTN; PAM sequence: TTT
tcgctgactcagagtgggga

SEQ ID NO: 48028 - DNA, 20 bp, Artificial Sequence
  Description of Artificial Sequence: Synthetic oligonucleotide
  Target: SCN10A; (-) strand; PAM type: YTN; PAM sequence: CTT
ttcgctgactcagagtgggg

SEQ ID NO: 48029 - DNA, 20 bp, Artificial Sequence
  Description of Artificial Sequence: Synthetic oligonucleotide
  Target: SCN10A; (-) strand; PAM type: YTN; PAM sequence: CTG
tggccccagcttttcgctga

SEQ ID NO: 48030 - DNA, 20 bp, Artificial Sequence
  Description of Artificial Sequence: Synthetic oligonucleotide
  Target: SCN10A; (-) strand; PAM type: YTN; PAM sequence: TTG
ggtctgtggccccagctttt

SEQ ID NO: 48031 - DNA, 20 bp, Artificial Sequence
  Description of Artificial Sequence: Synthetic oligonucleotide
  Target: SCN10A; (-) strand; PAM type: YTN; PAM sequence: CTT
gggtctgtggccccagcttt

SEQ ID NO: 48032 - DNA, 20 bp, Artificial Sequence
  Description of Artificial Sequence: Synthetic oligonucleotide
  Target: SCN10A; (-) strand; PAM type: YTN; PAM sequence: CTG
gagacttgggtctgtggccc

SEQ ID NO: 48033 - DNA, 20 bp, Artificial Sequence
  Description of Artificial Sequence: Synthetic oligonucleotide
  Target: SCN10A; (-) strand; PAM type: YTN; PAM sequence: CTG
ggcgactggagacttgggtc

SEQ ID NO: 48034 - DNA, 20 bp, Artificial Sequence
  Description of Artificial Sequence: Synthetic oligonucleotide
  Target: SCN10A; (-) strand; PAM type: YTN; PAM sequence: CTC
ctgggcgactggagacttgg

SEQ ID NO: 48035 - DNA, 20 bp, Artificial Sequence
  Description of Artificial Sequence: Synthetic oligonucleotide
  Target: SCN10A; (-) strand; PAM type: YTN; PAM sequence: CTG
actcctgggcgactggagac

SEQ ID NO: 48036 - DNA, 20 bp, Artificial Sequence
  Description of Artificial Sequence: Synthetic oligonucleotide
  Target: SCN10A; (-) strand; PAM type: YTN; PAM sequence: TTG
tgggagggagcagggtctga

SEQ ID NO: 48037 - DNA, 20 bp, Artificial Sequence
  Description of Artificial Sequence: Synthetic oligonucleotide
  Target: SCN10A; (-) strand; PAM type: YTN; PAM sequence: CTT
gtgggagggagcagggtctg

SEQ ID NO: 48038 - DNA, 20 bp, Artificial Sequence
  Description of Artificial Sequence: Synthetic oligonucleotide
  Target: SCN10A; (-) strand; PAM type: YTN; PAM sequence: CTG
tccttgtgggagggagcagg

SEQ ID NO: 48039 - DNA, 20 bp, Artificial Sequence
  Description of Artificial Sequence: Synthetic oligonucleotide
  Target: SCN10A; (-) strand; PAM type: YTN; PAM sequence: CTC
ctgtccttgtgggagggagc

SEQ ID NO: 48040 - DNA, 20 bp, Artificial Sequence
  Description of Artificial Sequence: Synthetic oligonucleotide
  Target: SCN10A; (-) strand; PAM type: YTN; PAM sequence: CTC
tcctgtccttgtgggaggga

SEQ ID NO: 48041 - DNA, 20 bp, Artificial Sequence
  Description of Artificial Sequence: Synthetic oligonucleotide
  Target: SCN10A; (-) strand; PAM type: YTN; PAM sequence: TTC
ctctcctgtccttgtgggag

SEQ ID NO: 48042 - DNA, 20 bp, Artificial Sequence
  Description of Artificial Sequence: Synthetic oligonucleotide
  Target: SCN10A; (-) strand; PAM type: YTN; PAM sequence: CTT
cctctcctgtccttgtggga

SEQ ID NO: 48043 - DNA, 20 bp, Artificial Sequence
  Description of Artificial Sequence: Synthetic oligonucleotide
  Target: SCN10A; (-) strand; PAM type: YTN; PAM sequence: CTC
ccccttcctctcctgtcctt

SEQ ID NO: 48044 - DNA, 20 bp, Artificial Sequence
  Description of Artificial Sequence: Synthetic oligonucleotide
  Target: SCN10A; (-) strand; PAM type: YTN; PAM sequence: CTG
caccagccagctcccccttc

SEQ ID NO: 48045 - DNA, 20 bp, Artificial Sequence
  Description of Artificial Sequence: Synthetic oligonucleotide
  Target: SCN10A; (-) strand; PAM type: YTN; PAM sequence: CTG
gggactgcaccagccagctc

SEQ ID NO: 48046 - DNA, 20 bp, Artificial Sequence
  Description of Artificial Sequence: Synthetic oligonucleotide
  Target: SCN10A; (-) strand; PAM type: YTN; PAM sequence: CTC
tggggactgcaccagccagc

SEQ ID NO: 48047 - DNA, 20 bp, Artificial Sequence
  Description of Artificial Sequence: Synthetic oligonucleotide
  Target: SCN10A; (-) strand; PAM type: YTN; PAM sequence: CTG
tgctctggggactgcaccag

SEQ ID NO: 48048 - DNA, 20 bp, Artificial Sequence
  Description of Artificial Sequence: Synthetic oligonucleotide
  Target: SCN10A; (-) strand; PAM type: YTN; PAM sequence: TTC
agggaagacactgtgctctg

SEQ ID NO: 48049 - DNA, 20 bp, Artificial Sequence
  Description of Artificial Sequence: Synthetic oligonucleotide
  Target: SCN10A; (-) strand; PAM type: YTN; PAM sequence: CTC
ccacccagattcagggaaga

SEQ ID NO: 48050 - DNA, 20 bp, Artificial Sequence
  Description of Artificial Sequence: Synthetic oligonucleotide
  Target: SCN10A; (-) strand; PAM type: YTN; PAM sequence: TTG
gggaaactcccacccagatt

SEQ ID NO: 48051 - DNA, 20 bp, Artificial Sequence
  Description of Artificial Sequence: Synthetic oligonucleotide
  Target: SCN10A; (-) strand; PAM type: YTN; PAM sequence: CTT
ggggaaactcccacccagat

SEQ ID NO: 48052 - DNA, 20 bp, Artificial Sequence
  Description of Artificial Sequence: Synthetic oligonucleotide
  Target: SCN10A; (-) strand; PAM type: YTN; PAM sequence: TTG
atggcttggggaaactccca

SEQ ID NO: 48053 - DNA, 20 bp, Artificial Sequence
  Description of Artificial Sequence: Synthetic oligonucleotide
  Target: SCN10A; (-) strand; PAM type: YTN; PAM sequence: CTT
gatggcttggggaaactccc

SEQ ID NO: 48054 - DNA, 20 bp, Artificial Sequence
  Description of Artificial Sequence: Synthetic oligonucleotide
  Target: SCN10A; (-) strand; PAM type: YTN; PAM sequence: CTC
ttgatggcttggggaaactc

SEQ ID NO: 48055 - DNA, 20 bp, Artificial Sequence
  Description of Artificial Sequence: Synthetic oligonucleotide
  Target: SCN10A; (-) strand; PAM type: YTN; PAM sequence: TTC
tcttgatggcttggggaaac

SEQ ID NO: 48056 - DNA, 20 bp, Artificial Sequence
  Description of Artificial Sequence: Synthetic oligonucleotide
  Target: SCN10A; (-) strand; PAM type: YTN; PAM sequence: TTT
ctcttgatggcttggggaaa

SEQ ID NO: 48057 - DNA, 20 bp, Artificial Sequence
  Description of Artificial Sequence: Synthetic oligonucleotide
  Target: SCN10A; (-) strand; PAM type: YTN; PAM sequence: TTT
tctcttgatggcttggggaa

SEQ ID NO: 48058 - DNA, 20 bp, Artificial Sequence
  Description of Artificial Sequence: Synthetic oligonucleotide
  Target: SCN10A; (-) strand; PAM type: YTN; PAM sequence: TTT
ttctcttgatggcttgggga

SEQ ID NO: 48059 - DNA, 20 bp, Artificial Sequence
  Description of Artificial Sequence: Synthetic oligonucleotide
  Target: SCN10A; (-) strand; PAM type: YTN; PAM sequence: TTG
gtaatgtttttctcttgatg

SEQ ID NO: 48060 - DNA, 20 bp, Artificial Sequence
  Description of Artificial Sequence: Synthetic oligonucleotide
  Target: SCN10A; (-) strand; PAM type: YTN; PAM sequence: CTT
ggtaatgtttttctcttgat

SEQ ID NO: 48061 - DNA, 20 bp, Artificial Sequence
  Description of Artificial Sequence: Synthetic oligonucleotide
  Target: SCN10A; (-) strand; PAM type: YTN; PAM sequence: TTC
cgcttggtaatgtttttctc

SEQ ID NO: 48062 - DNA, 20 bp, Artificial Sequence
  Description of Artificial Sequence: Synthetic oligonucleotide
  Target: SCN10A; (-) strand; PAM type: YTN; PAM sequence: CTT
ccgcttggtaatgtttttct

SEQ ID NO: 48063 - DNA, 20 bp, Artificial Sequence
  Description of Artificial Sequence: Synthetic oligonucleotide
  Target: SCN10A; (-) strand; PAM type: YTN; PAM sequence: CTG
cggagcttccgcttggtaat

SEQ ID NO: 48064 - DNA, 20 bp, Artificial Sequence
  Description of Artificial Sequence: Synthetic oligonucleotide
  Target: SCN10A; (-) strand; PAM type: YTN; PAM sequence: CTG
tgctgcggagcttccgcttg

SEQ ID NO: 48065 - DNA, 20 bp, Artificial Sequence
  Description of Artificial Sequence: Synthetic oligonucleotide
  Target: SCN10A; (-) strand; PAM type: YTN; PAM sequence: CTG
tctgtgctgcggagcttccg

SEQ ID NO: 48066 - DNA, 20 bp, Artificial Sequence
  Description of Artificial Sequence: Synthetic oligonucleotide
  Target: SCN10A; (-) strand; PAM type: YTN; PAM sequence: CTG
ggcgtggccaagaagggaag

SEQ ID NO: 48067 - DNA, 20 bp, Artificial Sequence
  Description of Artificial Sequence: Synthetic oligonucleotide
  Target: SCN10A; (-) strand; PAM type: YTN; PAM sequence: CTA
gagctgggcgtggccaagaa

SEQ ID NO: 48068 - DNA, 20 bp, Artificial Sequence
  Description of Artificial Sequence: Synthetic oligonucleotide
  Target: SCN10A; (-) strand; PAM type: YTN; PAM sequence: CTG
ctagagctgggcgtggccaa

SEQ ID NO: 48069 - DNA, 20 bp, Artificial Sequence
  Description of Artificial Sequence: Synthetic oligonucleotide
  Target: SCN10A; (-) strand; PAM type: YTN; PAM sequence: CTG
tgagtctgctagagctgggc

SEQ ID NO: 48070 - DNA, 20 bp, Artificial Sequence
  Description of Artificial Sequence: Synthetic oligonucleotide
  Target: SCN10A; (-) strand; PAM type: YTN; PAM sequence: CTG
catcatcgtcactgtgagtc

SEQ ID NO: 48071 - DNA, 20 bp, Artificial Sequence
  Description of Artificial Sequence: Synthetic oligonucleotide
  Target: SCN10A; (-) strand; PAM type: YTN; PAM sequence: TTG
actgcatcatcgtcactgtg

SEQ ID NO: 48072 - DNA, 20 bp, Artificial Sequence
  Description of Artificial Sequence: Synthetic oligonucleotide
  Target: SCN10A; (-) strand; PAM type: YTN; PAM sequence: TTT
gactgcatcatcgtcactgt

SEQ ID NO: 48073 - DNA, 20 bp, Artificial Sequence
  Description of Artificial Sequence: Synthetic oligonucleotide
  Target: SCN10A; (-) strand; PAM type: YTN; PAM sequence: CTT
tgactgcatcatcgtcactg

SEQ ID NO: 48074 - DNA, 20 bp, Artificial Sequence
  Description of Artificial Sequence: Synthetic oligonucleotide
  Target: SCN10A; (-) strand; PAM type: YTN; PAM sequence: TTC
cagaagaagtggaatatctt

SEQ ID NO: 48075 - DNA, 20 bp, Artificial Sequence
  Description of Artificial Sequence: Synthetic oligonucleotide
  Target: SCN10A; (-) strand; PAM type: YTN; PAM sequence: TTT
ccagaagaagtggaatatct

SEQ ID NO: 48076 - DNA, 20 bp, Artificial Sequence
  Description of Artificial Sequence: Synthetic oligonucleotide
  Target: SCN10A; (-) strand; PAM type: YTN; PAM sequence: TTA
tttccagaagaagtggaata

SEQ ID NO: 48077 - DNA, 20 bp, Artificial Sequence
  Description of Artificial Sequence: Synthetic oligonucleotide
  Target: SCN10A; (-) strand; PAM type: YTN; PAM sequence: CTA
ttatttccagaagaagtgga

SEQ ID NO: 48078 - DNA, 20 bp, Artificial Sequence
  Description of Artificial Sequence: Synthetic oligonucleotide
  Target: SCN10A; (-) strand; PAM type: YTN; PAM sequence: TTC
gacccatactattatttcca

SEQ ID NO: 48079 - DNA, 20 bp, Artificial Sequence
  Description of Artificial Sequence: Synthetic oligonucleotide
  Target: SCN10A; (-) strand; PAM type: YTN; PAM sequence: CTT
cgacccatactattatttcc

SEQ ID NO: 48080 - DNA, 20 bp, Artificial Sequence
  Description of Artificial Sequence: Synthetic oligonucleotide
  Target: SCN10A; (-) strand; PAM type: YTN; PAM sequence: TTG
ccttcgacccatactattat

SEQ ID NO: 48081 - DNA, 20 bp, Artificial Sequence
  Description of Artificial Sequence: Synthetic oligonucleotide
  Target: SCN10A; (-) strand; PAM type: YTN; PAM sequence: TTC
aaaatcattgccttcgaccc

SEQ ID NO: 48082 - DNA, 20 bp, Artificial Sequence
  Description of Artificial Sequence: Synthetic oligonucleotide
  Target: SCN10A; (-) strand; PAM type: YTN; PAM sequence: CTT
caaaatcattgccttcgacc

SEQ ID NO: 48083 - DNA, 20 bp, Artificial Sequence
  Description of Artificial Sequence: Synthetic oligonucleotide
  Target: SCN10A; (-) strand; PAM type: YTN; PAM sequence: CTG
aaatggtcttcaaaatcatt

SEQ ID NO: 48084 - DNA, 20 bp, Artificial Sequence
  Description of Artificial Sequence: Synthetic oligonucleotide
  Target: SCN10A; (-) strand; PAM type: YTN; PAM sequence: CTG
ctgaaatggtcttcaaaatc

SEQ ID NO: 48085 - DNA, 20 bp, Artificial Sequence
  Description of Artificial Sequence: Synthetic oligonucleotide
  Target: SCN10A; (-) strand; PAM type: YTN; PAM sequence: TTA
ctgctgaaatggtcttcaaa

SEQ ID NO: 48086 - DNA, 20 bp, Artificial Sequence
  Description of Artificial Sequence: Synthetic oligonucleotide
  Target: SCN10A; (-) strand; PAM type: YTN; PAM sequence: TTT
actgctgaaatggtcttcaa

SEQ ID NO: 48087 - DNA, 20 bp, Artificial Sequence
  Description of Artificial Sequence: Synthetic oligonucleotide
  Target: SCN10A; (-) strand; PAM type: YTN; PAM sequence: TTT
tactgctgaaatggtcttca

SEQ ID NO: 48088 - DNA, 20 bp, Artificial Sequence
  Description of Artificial Sequence: Synthetic oligonucleotide
  Target: SCN10A; (-) strand; PAM type: YTN; PAM sequence: TTT
ttactgctgaaatggtcttc

SEQ ID NO: 48089 - DNA, 20 bp, Artificial Sequence
  Description of Artificial Sequence: Synthetic oligonucleotide
  Target: SCN10A; (-) strand; PAM type: YTN; PAM sequence: TTT
tttactgctgaaatggtctt

SEQ ID NO: 48090 - DNA, 20 bp, Artificial Sequence
  Description of Artificial Sequence: Synthetic oligonucleotide
  Target: SCN10A; (-) strand; PAM type: YTN; PAM sequence: TTA
ccatattttttactgctgaa

SEQ ID NO: 48091 - DNA, 20 bp, Artificial Sequence
  Description of Artificial Sequence: Synthetic oligonucleotide
  Target: SCN10A; (-) strand; PAM type: YTN; PAM sequence: TTT
accatattttttactgctga

SEQ ID NO: 48092 - DNA, 20 bp, Artificial Sequence
  Description of Artificial Sequence: Synthetic oligonucleotide
  Target: SCN10A; (-) strand; PAM type: YTN; PAM sequence: CTT
taccatattttttactgctg

SEQ ID NO: 48093 - DNA, 20 bp, Artificial Sequence
  Description of Artificial Sequence: Synthetic oligonucleotide
  Target: SCN10A; (-) strand; PAM type: YTN; PAM sequence: CTA
ggtctttaccatatttttta

SEQ ID NO: 48094 - DNA, 20 bp, Artificial Sequence
  Description of Artificial Sequence: Synthetic oligonucleotide
  Target: SCN10A; (-) strand; PAM type: YTN; PAM sequence: CTC
ctaggtctttaccatatttt

SEQ ID NO: 48095 - DNA, 20 bp, Artificial Sequence
  Description of Artificial Sequence: Synthetic oligonucleotide
  Target: SCN10A; (-) strand; PAM type: YTN; PAM sequence: TTC
cactcctaggtctttaccat

SEQ ID NO: 48096 - DNA, 20 bp, Artificial Sequence
  Description of Artificial Sequence: Synthetic oligonucleotide
  Target: SCN10A; (-) strand; PAM type: YTN; PAM sequence: TTT
ccactcctaggtctttacca

SEQ ID NO: 48097 - DNA, 20 bp, Artificial Sequence
  Description of Artificial Sequence: Synthetic oligonucleotide
  Target: SCN10A; (-) strand; PAM type: YTN; PAM sequence: TTG
tttccactcctaggtcttta

SEQ ID NO: 48098 - DNA, 20 bp, Artificial Sequence
  Description of Artificial Sequence: Synthetic oligonucleotide
  Target: SCN10A; (-) strand; PAM type: YTN; PAM sequence: CTT
gtttccactcctaggtcttt

SEQ ID NO: 48099 - DNA, 20 bp, Artificial Sequence
  Description of Artificial Sequence: Synthetic oligonucleotide
  Target: SCN10A; (-) strand; PAM type: YTN; PAM sequence: CTG
tgatgaaagcttgtttccac

SEQ ID NO: 48100 - DNA, 20 bp, Artificial Sequence
  Description of Artificial Sequence: Synthetic oligonucleotide
  Target: SCN10A; (-) strand; PAM type: YTN; PAM sequence: CTC
cgaccccacagatcccactg

SEQ ID NO: 48101 - DNA, 20 bp, Artificial Sequence
  Description of Artificial Sequence: Synthetic oligonucleotide
  Target: SCN10A; (-) strand; PAM type: YTN; PAM sequence: TTG
cctccgaccccacagatccc

SEQ ID NO: 48102 - DNA, 20 bp, Artificial Sequence
  Description of Artificial Sequence: Synthetic oligonucleotide
  Target: SCN10A; (-) strand; PAM type: YTN; PAM sequence: TTA
tcattgcctccgaccccaca

SEQ ID NO: 48103 - DNA, 20 bp, Artificial Sequence
  Description of Artificial Sequence: Synthetic oligonucleotide
  Target: SCN10A; (-) strand; PAM type: YTN; PAM sequence: TTT
atcattgcctccgaccccac

SEQ ID NO: 48104 - DNA, 20 bp, Artificial Sequence
  Description of Artificial Sequence: Synthetic oligonucleotide
  Target: SCN10A; (-) strand; PAM type: YTN; PAM sequence: TTT
tatcattgcctccgacccca

SEQ ID NO: 48105 - DNA, 20 bp, Artificial Sequence
  Description of Artificial Sequence: Synthetic oligonucleotide
  Target: SCN10A; (-) strand; PAM type: YTN; PAM sequence: TTT
ttatcattgcctccgacccc

SEQ ID NO: 48106 - DNA, 20 bp, Artificial Sequence
  Description of Artificial Sequence: Synthetic oligonucleotide
  Target: SCN10A; (-) strand; PAM type: YTN; PAM sequence: CTG
ccatttttatcattgcctcc

SEQ ID NO: 48107 - DNA, 20 bp, Artificial Sequence
  Description of Artificial Sequence: Synthetic oligonucleotide
  Target: SCN10A; (-) strand; PAM type: YTN; PAM sequence: TTG
ctgccatttttatcattgcc

SEQ ID NO: 48108 - DNA, 20 bp, Artificial Sequence
  Description of Artificial Sequence: Synthetic oligonucleotide
  Target: SCN10A; (-) strand; PAM type: YTN; PAM sequence: CTT
gctgccatttttatcattgc

SEQ ID NO: 48109 - DNA, 20 bp, Artificial Sequence
  Description of Artificial Sequence: Synthetic oligonucleotide
  Target: SCN10A; (-) strand; PAM type: YTN; PAM sequence: TTC
ttgctgccatttttatcatt

SEQ ID NO: 48110 - DNA, 20 bp, Artificial Sequence
  Description of Artificial Sequence: Synthetic oligonucleotide
  Target: SCN10A; (-) strand; PAM type: YTN; PAM sequence: TTT
cttgctgccatttttatcat

SEQ ID NO: 48111 - DNA, 20 bp, Artificial Sequence
  Description of Artificial Sequence: Synthetic oligonucleotide
  Target: SCN10A; (-) strand; PAM type: YTN; PAM sequence: TTT
tcttgctgccatttttatca

SEQ ID NO: 48112 - DNA, 20 bp, Artificial Sequence
  Description of Artificial Sequence: Synthetic oligonucleotide
  Target: SCN10A; (-) strand; PAM type: YTN; PAM sequence: TTG
taaataagacattttcttgc

SEQ ID NO: 48113 - DNA, 20 bp, Artificial Sequence
  Description of Artificial Sequence: Synthetic oligonucleotide
  Target: SCN10A; (-) strand; PAM type: YTN; PAM sequence: TTT
gtaaataagacattttcttg

SEQ ID NO: 48114 - DNA, 20 bp, Artificial Sequence
  Description of Artificial Sequence: Synthetic oligonucleotide
  Target: SCN10A; (-) strand; PAM type: YTN; PAM sequence: TTT
tgtaaataagacattttctt

SEQ ID NO: 48115 - DNA, 20 bp, Artificial Sequence
  Description of Artificial Sequence: Synthetic oligonucleotide
  Target: SCN10A; (-) strand; PAM type: YTN; PAM sequence: CTA
ttttgtaaataagacatttt

SEQ ID NO: 48116 - DNA, 20 bp, Artificial Sequence
  Description of Artificial Sequence: Synthetic oligonucleotide
  Target: SCN10A; (-) strand; PAM type: YTN; PAM sequence: TTC
tattttgtaaataagacatt

SEQ ID NO: 48117 - DNA, 20 bp, Artificial Sequence
  Description of Artificial Sequence: Synthetic oligonucleotide
  Target: SCN10A; (-) strand; PAM type: YTN; PAM sequence: TTT
ctattttgtaaataagacat

SEQ ID NO: 48118 - DNA, 20 bp, Artificial Sequence
  Description of Artificial Sequence: Synthetic oligonucleotide
  Target: SCN10A; (-) strand; PAM type: YTN; PAM sequence: TTT
tctattttgtaaataagaca

SEQ ID NO: 48119 - DNA, 20 bp, Artificial Sequence
  Description of Artificial Sequence: Synthetic oligonucleotide
  Target: SCN10A; (-) strand; PAM type: YTN; PAM sequence: CTG
aacaaaacaaaaggattttc

SEQ ID NO: 48120 - DNA, 20 bp, Artificial Sequence
  Description of Artificial Sequence: Synthetic oligonucleotide
  Target: SCN10A; (-) strand; PAM type: YTN; PAM sequence: CTC
aggagcccacagataacata

SEQ ID NO: 48121 - DNA, 20 bp, Artificial Sequence
  Description of Artificial Sequence: Synthetic oligonucleotide
  Target: SCN10A; (-) strand; PAM type: YTN; PAM sequence: CTG
gccaatcctcaggagcccac

SEQ ID NO: 48122 - DNA, 20 bp, Artificial Sequence
  Description of Artificial Sequence: Synthetic oligonucleotide
  Target: SCN10A; (-) strand; PAM type: YTN; PAM sequence: TTA
ccctggccaatcctcaggag

SEQ ID NO: 48123 - DNA, 20 bp, Artificial Sequence
  Description of Artificial Sequence: Synthetic oligonucleotide
  Target: SCN10A; (-) strand; PAM type: YTN; PAM sequence: CTG
ttaccctggccaatcctcag

SEQ ID NO: 48124 - DNA, 20 bp, Artificial Sequence
  Description of Artificial Sequence: Synthetic oligonucleotide
  Target: SCN10A; (-) strand; PAM type: YTN; PAM sequence: TTG
actgttaccctggccaatcc

SEQ ID NO: 48125 - DNA, 20 bp, Artificial Sequence
  Description of Artificial Sequence: Synthetic oligonucleotide
  Target: SCN10A; (-) strand; PAM type: YTN; PAM sequence: CTG
tcacgttgactgttaccctg

SEQ ID NO: 48126 - DNA, 20 bp, Artificial Sequence
  Description of Artificial Sequence: Synthetic oligonucleotide
  Target: SCN10A; (-) strand; PAM type: YTN; PAM sequence: TTC
tgtcacgttgactgttaccc

SEQ ID NO: 48127 - DNA, 20 bp, Artificial Sequence
  Description of Artificial Sequence: Synthetic oligonucleotide
  Target: SCN10A; (-) strand; PAM type: YTN; PAM sequence: CTC
cattctgtcacgttgactgt

SEQ ID NO: 48128 - DNA, 20 bp, Artificial Sequence
  Description of Artificial Sequence: Synthetic oligonucleotide
  Target: SCN10A; (-) strand; PAM type: YTN; PAM sequence: CTG
agaatggtgcagaaatgtct

SEQ ID NO: 48129 - DNA, 20 bp, Artificial Sequence
  Description of Artificial Sequence: Synthetic oligonucleotide
  Target: SCN10A; (-) strand; PAM type: YTN; PAM sequence: CTG
cagcatgcacagcccctgag

SEQ ID NO: 48130 - DNA, 20 bp, Artificial Sequence
  Description of Artificial Sequence: Synthetic oligonucleotide
  Target: SCN10A; (-) strand; PAM type: YTN; PAM sequence: TTC
acgtggaaaaactgcagcat

SEQ ID NO: 48131 - DNA, 20 bp, Artificial Sequence
  Description of Artificial Sequence: Synthetic oligonucleotide
  Target: SCN10A; (-) strand; PAM type: YTN; PAM sequence: CTC
ccaccaccattcacgtggaa

SEQ ID NO: 48132 - DNA, 20 bp, Artificial Sequence
  Description of Artificial Sequence: Synthetic oligonucleotide
  Target: SCN10A; (-) strand; PAM type: YTN; PAM sequence: TTC
cactcccaccaccattcacg

SEQ ID NO: 48133 - DNA, 20 bp, Artificial Sequence
  Description of Artificial Sequence: Synthetic oligonucleotide
  Target: SCN10A; (-) strand; PAM type: YTN; PAM sequence: TTA
ttccactcccaccaccattc

SEQ ID NO: 48134 - DNA, 20 bp, Artificial Sequence
  Description of Artificial Sequence: Synthetic oligonucleotide
  Target: SCN10A; (-) strand; PAM type: YTN; PAM sequence: CTT
attccactcccaccaccatt

SEQ ID NO: 48135 - DNA, 20 bp, Artificial Sequence
  Description of Artificial Sequence: Synthetic oligonucleotide
  Target: SCN10A; (-) strand; PAM type: YTN; PAM sequence: CTA
tccgcttattccactcccac

SEQ ID NO: 48136 - DNA, 20 bp, Artificial Sequence
  Description of Artificial Sequence: Synthetic oligonucleotide
  Target: SCN10A; (-) strand; PAM type: YTN; PAM sequence: TTA
aagactatccgcttattcca

SEQ ID NO: 48137 - DNA, 20 bp, Artificial Sequence
  Description of Artificial Sequence: Synthetic oligonucleotide
  Target: SCN10A; (-) strand; PAM type: YTN; PAM sequence: CTT
aaagactatccgcttattcc

SEQ ID NO: 48138 - DNA, 20 bp, Artificial Sequence
  Description of Artificial Sequence: Synthetic oligonucleotide
  Target: SCN10A; (-) strand; PAM type: YTN; PAM sequence: TTA
taataatgatcttaaagact

SEQ ID NO: 48139 - DNA, 20 bp, Artificial Sequence
  Description of Artificial Sequence: Synthetic oligonucleotide
  Target: SCN10A; (-) strand; PAM type: YTN; PAM sequence: CTG
acaaaatgatattataataa

SEQ ID NO: 48140 - DNA, 20 bp, Artificial Sequence
  Description of Artificial Sequence: Synthetic oligonucleotide
  Target: SCN10A; (-) strand; PAM type: YTN; PAM sequence: TTC
actgacaaaatgatattata

SEQ ID NO: 48141 - DNA, 20 bp, Artificial Sequence
  Description of Artificial Sequence: Synthetic oligonucleotide
  Target: SCN10A; (-) strand; PAM type: YTN; PAM sequence: CTT
cactgacaaaatgatattat

SEQ ID NO: 48142 - DNA, 20 bp, Artificial Sequence
  Description of Artificial Sequence: Synthetic oligonucleotide
  Target: SCN10A; (-) strand; PAM type: YTN; PAM sequence: CTC
ttcactgacaaaatgatatt

SEQ ID NO: 48143 - DNA, 20 bp, Artificial Sequence
  Description of Artificial Sequence: Synthetic oligonucleotide
  Target: SCN10A; (-) strand; PAM type: YTN; PAM sequence: CTG
actcttcactgacaaaatga

SEQ ID NO: 48144 - DNA, 20 bp, Artificial Sequence
  Description of Artificial Sequence: Synthetic oligonucleotide
  Target: SCN10A; (-) strand; PAM type: YTN; PAM sequence: CTG
aaccagactgactcttcact

SEQ ID NO: 48145 - DNA, 20 bp, Artificial Sequence
  Description of Artificial Sequence: Synthetic oligonucleotide
  Target: SCN10A; (-) strand; PAM type: YTN; PAM sequence: CTA
ctgaaccagactgactcttc

SEQ ID NO: 48146 - DNA, 20 bp, Artificial Sequence
  Description of Artificial Sequence: Synthetic oligonucleotide
  Target: SCN10A; (-) strand; PAM type: YTN; PAM sequence: TTA
actactgaaccagactgact

SEQ ID NO: 48147 - DNA, 20 bp, Artificial Sequence
  Description of Artificial Sequence: Synthetic oligonucleotide
  Target: SCN10A; (-) strand; PAM type: YTN; PAM sequence: TTT
aactactgaaccagactgac

SEQ ID NO: 48148 - DNA, 20 bp, Artificial Sequence
  Description of Artificial Sequence: Synthetic oligonucleotide
  Target: SCN10A; (-) strand; PAM type: YTN; PAM sequence: TTT
taactactgaaccagactga

SEQ ID NO: 48149 - DNA, 20 bp, Artificial Sequence
  Description of Artificial Sequence: Synthetic oligonucleotide
  Target: SCN10A; (-) strand; PAM type: YTN; PAM sequence: CTG
tgatgtcccacaacccacac

SEQ ID NO: 48150 - DNA, 20 bp, Artificial Sequence
  Description of Artificial Sequence: Synthetic oligonucleotide
  Target: SCN10A; (-) strand; PAM type: YTN; PAM sequence: TTA
atccaggtctgtgatgtccc

SEQ ID NO: 48151 - DNA, 20 bp, Artificial Sequence
  Description of Artificial Sequence: Synthetic oligonucleotide
  Target: SCN10A; (-) strand; PAM type: YTN; PAM sequence: TTT
aatccaggtctgtgatgtcc

SEQ ID NO: 48152 - DNA, 20 bp, Artificial Sequence
  Description of Artificial Sequence: Synthetic oligonucleotide
  Target: SCN10A; (-) strand; PAM type: YTN; PAM sequence: TTT
taatccaggtctgtgatgtc

SEQ ID NO: 48153 - DNA, 20 bp, Artificial Sequence
  Description of Artificial Sequence: Synthetic oligonucleotide
  Target: SCN10A; (-) strand; PAM type: YTN; PAM sequence: CTG
ggattttaatccaggtctgt

SEQ ID NO: 48154 - DNA, 20 bp, Artificial Sequence
  Description of Artificial Sequence: Synthetic oligonucleotide
  Target: SCN10A; (-) strand; PAM type: YTN; PAM sequence: CTG
ggctgggattttaatccagg

SEQ ID NO: 48155 - DNA, 20 bp, Artificial Sequence
  Description of Artificial Sequence: Synthetic oligonucleotide
  Target: SCN10A; (-) strand; PAM type: YTN; PAM sequence: CTA
ggaaatgtctgggctgggat

SEQ ID NO: 48156 - DNA, 20 bp, Artificial Sequence
  Description of Artificial Sequence: Synthetic oligonucleotide
  Target: SCN10A; (-) strand; PAM type: YTN; PAM sequence: TTA
cataagctaggaaatgtctg

SEQ ID NO: 48157 - DNA, 20 bp, Artificial Sequence
  Description of Artificial Sequence: Synthetic oligonucleotide
  Target: SCN10A; (-) strand; PAM type: YTN; PAM sequence: CTT
acataagctaggaaatgtct

SEQ ID NO: 48158 - DNA, 20 bp, Artificial Sequence
  Description of Artificial Sequence: Synthetic oligonucleotide
  Target: SCN10A; (-) strand; PAM type: YTN; PAM sequence: TTG
tccaagcttacataagctag

SEQ ID NO: 48159 - DNA, 20 bp, Artificial Sequence
  Description of Artificial Sequence: Synthetic oligonucleotide
  Target: SCN10A; (-) strand; PAM type: YTN; PAM sequence: TTT
gtccaagcttacataagcta

SEQ ID NO: 48160 - DNA, 20 bp, Artificial Sequence
  Description of Artificial Sequence: Synthetic oligonucleotide
  Target: SCN10A; (-) strand; PAM type: YTN; PAM sequence: TTA
tttgtccaagcttacataag

SEQ ID NO: 48161 - DNA, 20 bp, Artificial Sequence
  Description of Artificial Sequence: Synthetic oligonucleotide
  Target: SCN10A; (-) strand; PAM type: YTN; PAM sequence: TTG
aggtacaggaaggatgcatt

SEQ ID NO: 48162 - DNA, 20 bp, Artificial Sequence
  Description of Artificial Sequence: Synthetic oligonucleotide
  Target: SCN10A; (-) strand; PAM type: YTN; PAM sequence: TTA
tacagatgaggaaattgagg

SEQ ID NO: 48163 - DNA, 20 bp, Artificial Sequence
  Description of Artificial Sequence: Synthetic oligonucleotide
  Target: SCN10A; (-) strand; PAM type: YTN; PAM sequence: TTA
tgcccattatacagatgagg

SEQ ID NO: 48164 - DNA, 20 bp, Artificial Sequence
  Description of Artificial Sequence: Synthetic oligonucleotide
  Target: SCN10A; (-) strand; PAM type: YTN; PAM sequence: TTT
atgcccattatacagatgag

SEQ ID NO: 48165 - DNA, 20 bp, Artificial Sequence
  Description of Artificial Sequence: Synthetic oligonucleotide
  Target: SCN10A; (-) strand; PAM type: YTN; PAM sequence: TTT
tatgcccattatacagatga

SEQ ID NO: 48166 - DNA, 20 bp, Artificial Sequence
  Description of Artificial Sequence: Synthetic oligonucleotide
  Target: SCN10A; (-) strand; PAM type: YTN; PAM sequence: CTC
attttatgcccattatacag

SEQ ID NO: 48167 - DNA, 20 bp, Artificial Sequence
  Description of Artificial Sequence: Synthetic oligonucleotide
  Target: SCN10A; (-) strand; PAM type: YTN; PAM sequence: TTG
gctcattttatgcccattat

SEQ ID NO: 48168 - DNA, 20 bp, Artificial Sequence
  Description of Artificial Sequence: Synthetic oligonucleotide
  Target: SCN10A; (-) strand; PAM type: YTN; PAM sequence: CTG
cacatgcattggctcatttt

SEQ ID NO: 48169 - DNA, 20 bp, Artificial Sequence
  Description of Artificial Sequence: Synthetic oligonucleotide
  Target: SCN10A; (-) strand; PAM type: YTN; PAM sequence: TTA
agaactgcacatgcattggc

SEQ ID NO: 48170 - DNA, 20 bp, Artificial Sequence
  Description of Artificial Sequence: Synthetic oligonucleotide
  Target: SCN10A; (-) strand; PAM type: YTN; PAM sequence: TTG
ttaagaactgcacatgcatt

SEQ ID NO: 48171 - DNA, 20 bp, Artificial Sequence
  Description of Artificial Sequence: Synthetic oligonucleotide
  Target: SCN10A; (-) strand; PAM type: YTN; PAM sequence: TTT
gttaagaactgcacatgcat

SEQ ID NO: 48172 - DNA, 20 bp, Artificial Sequence
  Description of Artificial Sequence: Synthetic oligonucleotide
  Target: SCN10A; (-) strand; PAM type: YTN; PAM sequence: CTT
tgttaagaactgcacatgca

SEQ ID NO: 48173 - DNA, 20 bp, Artificial Sequence
  Description of Artificial Sequence: Synthetic oligonucleotide
  Target: SCN10A; (-) strand; PAM type: YTN; PAM sequence: CTG
ccaggccctttgttaagaac

SEQ ID NO: 48174 - DNA, 20 bp, Artificial Sequence
  Description of Artificial Sequence: Synthetic oligonucleotide
  Target: SCN10A; (-) strand; PAM type: YTN; PAM sequence: CTG
tctgccaggccctttgttaa

SEQ ID NO: 48175 - DNA, 20 bp, Artificial Sequence
  Description of Artificial Sequence: Synthetic oligonucleotide
  Target: SCN10A; (-) strand; PAM type: YTN; PAM sequence: TTA
ctgtctgccaggccctttgt

SEQ ID NO: 48176 - DNA, 20 bp, Artificial Sequence
  Description of Artificial Sequence: Synthetic oligonucleotide
  Target: SCN10A; (-) strand; PAM type: YTN; PAM sequence: TTA
tgaatgaattactgtctgcc

SEQ ID NO: 48177 - DNA, 20 bp, Artificial Sequence
  Description of Artificial Sequence: Synthetic oligonucleotide
  Target: SCN10A; (-) strand; PAM type: YTN; PAM sequence: CTT
atgaatgaattactgtctgc

SEQ ID NO: 48178 - DNA, 20 bp, Artificial Sequence
  Description of Artificial Sequence: Synthetic oligonucleotide
  Target: SCN10A; (-) strand; PAM type: YTN; PAM sequence: TTA
cttatgaatgaattactgtc

SEQ ID NO: 48179 - DNA, 20 bp, Artificial Sequence
  Description of Artificial Sequence: Synthetic oligonucleotide
  Target: SCN10A; (-) strand; PAM type: YTN; PAM sequence: CTG
ttacttatgaatgaattact

SEQ ID NO: 48180 - DNA, 20 bp, Artificial Sequence
  Description of Artificial Sequence: Synthetic oligonucleotide
  Target: SCN10A; (-) strand; PAM type: YTN; PAM sequence: CTA
gtcactgttacttatgaatg

SEQ ID NO: 48181 - DNA, 20 bp, Artificial Sequence
  Description of Artificial Sequence: Synthetic oligonucleotide
  Target: SCN10A; (-) strand; PAM type: YTN; PAM sequence: TTA
ctagtcactgttacttatga

SEQ ID NO: 48182 - DNA, 20 bp, Artificial Sequence
  Description of Artificial Sequence: Synthetic oligonucleotide
  Target: SCN10A; (-) strand; PAM type: YTN; PAM sequence: CTT
actagtcactgttacttatg

SEQ ID NO: 48183 - DNA, 20 bp, Artificial Sequence
  Description of Artificial Sequence: Synthetic oligonucleotide
  Target: SCN10A; (-) strand; PAM type: YTN; PAM sequence: TTC
ttactagtcactgttactta

SEQ ID NO: 48184 - DNA, 20 bp, Artificial Sequence
  Description of Artificial Sequence: Synthetic oligonucleotide
  Target: SCN10A; (-) strand; PAM type: YTN; PAM sequence: TTG
ttcttactagtcactgttac

SEQ ID NO: 48185 - DNA, 20 bp, Artificial Sequence
  Description of Artificial Sequence: Synthetic oligonucleotide
  Target: SCN10A; (-) strand; PAM type: YTN; PAM sequence: TTA
gaggcaatgaatcattgttc

SEQ ID NO: 48186 - DNA, 20 bp, Artificial Sequence
  Description of Artificial Sequence: Synthetic oligonucleotide
  Target: SCN10A; (-) strand; PAM type: YTN; PAM sequence: CTT
agaggcaatgaatcattgtt

SEQ ID NO: 48187 - DNA, 20 bp, Artificial Sequence
  Description of Artificial Sequence: Synthetic oligonucleotide
  Target: SCN10A; (-) strand; PAM type: YTN; PAM sequence: CTA
aaagaatcttagaggcaatg

SEQ ID NO: 48188 - DNA, 20 bp, Artificial Sequence
  Description of Artificial Sequence: Synthetic oligonucleotide
  Target: SCN10A; (-) strand; PAM type: YTN; PAM sequence: TTA
gagacacacagagcctaaaa

SEQ ID NO: 48189 - DNA, 20 bp, Artificial Sequence
  Description of Artificial Sequence: Synthetic oligonucleotide
  Target: SCN10A; (-) strand; PAM type: YTN; PAM sequence: TTA
agacaattagagacacacag

SEQ ID NO: 48190 - DNA, 20 bp, Artificial Sequence
  Description of Artificial Sequence: Synthetic oligonucleotide
  Target: SCN10A; (-) strand; PAM type: YTN; PAM sequence: TTT
aagacaattagagacacaca

SEQ ID NO: 48191 - DNA, 20 bp, Artificial Sequence
  Description of Artificial Sequence: Synthetic oligonucleotide
  Target: SCN10A; (-) strand; PAM type: YTN; PAM sequence: CTA
tttaagacaattagagacac

SEQ ID NO: 48192 - DNA, 20 bp, Artificial Sequence
  Description of Artificial Sequence: Synthetic oligonucleotide
  Target: SCN10A; (-) strand; PAM type: YTN; PAM sequence: CTG
tcctatttaagacaattaga

SEQ ID NO: 48193 - DNA, 20 bp, Artificial Sequence
  Description of Artificial Sequence: Synthetic oligonucleotide
  Target: SCN10A; (-) strand; PAM type: YTN; PAM sequence: TTC
tgtcctatttaagacaatta

SEQ ID NO: 48194 - DNA, 20 bp, Artificial Sequence
  Description of Artificial Sequence: Synthetic oligonucleotide
  Target: SCN10A; (-) strand; PAM type: YTN; PAM sequence: CTC
agtgtcagaattctgtccta

SEQ ID NO: 48195 - DNA, 20 bp, Artificial Sequence
  Description of Artificial Sequence: Synthetic oligonucleotide
  Target: SCN10A; (-) strand; PAM type: YTN; PAM sequence: CTC
tcagtgtcagaattctgtcc

SEQ ID NO: 48196 - DNA, 20 bp, Artificial Sequence
  Description of Artificial Sequence: Synthetic oligonucleotide
  Target: SCN10A; (-) strand; PAM type: YTN; PAM sequence: CTC
tctcagtgtcagaattctgt

SEQ ID NO: 48197 - DNA, 20 bp, Artificial Sequence
  Description of Artificial Sequence: Synthetic oligonucleotide
  Target: SCN10A; (-) strand; PAM type: YTN; PAM sequence: CTG
acctctctcagtgtcagaat

SEQ ID NO: 48198 - DNA, 20 bp, Artificial Sequence
  Description of Artificial Sequence: Synthetic oligonucleotide
  Target: SCN10A; (-) strand; PAM type: YTN; PAM sequence: TTC
tgacctctctcagtgtcaga

SEQ ID NO: 48199 - DNA, 20 bp, Artificial Sequence
  Description of Artificial Sequence: Synthetic oligonucleotide
  Target: SCN10A; (-) strand; PAM type: YTN; PAM sequence: CTG
gttctgacctctctcagtgt

SEQ ID NO: 48200 - DNA, 20 bp, Artificial Sequence
  Description of Artificial Sequence: Synthetic oligonucleotide
  Target: SCN10A; (-) strand; PAM type: YTN; PAM sequence: TTA
cccgagcctggttctgacct

SEQ ID NO: 48201 - DNA, 20 bp, Artificial Sequence
  Description of Artificial Sequence: Synthetic oligonucleotide
  Target: SCN10A; (-) strand; PAM type: YTN; PAM sequence: TTG
tgttacccgagcctggttct

SEQ ID NO: 48202 - DNA, 20 bp, Artificial Sequence
  Description of Artificial Sequence: Synthetic oligonucleotide
  Target: SCN10A; (-) strand; PAM type: YTN; PAM sequence: TTG
ttgtgttacccgagcctggt

SEQ ID NO: 48203 - DNA, 20 bp, Artificial Sequence
  Description of Artificial Sequence: Synthetic oligonucleotide
  Target: SCN10A; (-) strand; PAM type: YTN; PAM sequence: CTG
gttgttgtgttacccgagcc

SEQ ID NO: 48204 - DNA, 20 bp, Artificial Sequence
  Description of Artificial Sequence: Synthetic oligonucleotide
  Target: SCN10A; (-) strand; PAM type: YTN; PAM sequence: CTG
ctggttgttgtgttacccga

SEQ ID NO: 48205 - DNA, 20 bp, Artificial Sequence
  Description of Artificial Sequence: Synthetic oligonucleotide
  Target: SCN10A; (-) strand; PAM type: YTN; PAM sequence: TTC
cctgctggttgttgtgttac

SEQ ID NO: 48206 - DNA, 20 bp, Artificial Sequence
  Description of Artificial Sequence: Synthetic oligonucleotide
  Target: SCN10A; (-) strand; PAM type: YTN; PAM sequence: CTT
ccctgctggttgttgtgtta

SEQ ID NO: 48207 - DNA, 20 bp, Artificial Sequence
  Description of Artificial Sequence: Synthetic oligonucleotide
  Target: SCN10A; (-) strand; PAM type: YTN; PAM sequence: CTC
ccttccctgctggttgttgt

SEQ ID NO: 48208 - DNA, 20 bp, Artificial Sequence
  Description of Artificial Sequence: Synthetic oligonucleotide
  Target: SCN10A; (-) strand; PAM type: YTN; PAM sequence: CTG
tctcccttccctgctggttg

SEQ ID NO: 48209 - DNA, 20 bp, Artificial Sequence
  Description of Artificial Sequence: Synthetic oligonucleotide
  Target: SCN10A; (-) strand; PAM type: YTN; PAM sequence: CTC
tgtctcccttccctgctggt

SEQ ID NO: 48210 - DNA, 20 bp, Artificial Sequence
  Description of Artificial Sequence: Synthetic oligonucleotide
  Target: SCN10A; (-) strand; PAM type: YTN; PAM sequence: TTC
tctgtctcccttccctgctg

SEQ ID NO: 48211 - DNA, 20 bp, Artificial Sequence
  Description of Artificial Sequence: Synthetic oligonucleotide
  Target: SCN10A; (-) strand; PAM type: YTN; PAM sequence: CTT
ctctgtctcccttccctgct

SEQ ID NO: 48212 - DNA, 20 bp, Artificial Sequence
  Description of Artificial Sequence: Synthetic oligonucleotide
  Target: SCN10A; (-) strand; PAM type: YTN; PAM sequence: CTC
cttctctgtctcccttccct

SEQ ID NO: 48213 - DNA, 20 bp, Artificial Sequence
  Description of Artificial Sequence: Synthetic oligonucleotide
  Target: SCN10A; (-) strand; PAM type: YTN; PAM sequence: TTC
ctccttctctgtctcccttc

SEQ ID NO: 48214 - DNA, 20 bp, Artificial Sequence
  Description of Artificial Sequence: Synthetic oligonucleotide
  Target: SCN10A; (-) strand; PAM type: YTN; PAM sequence: TTT
cctccttctctgtctccctt

SEQ ID NO: 48215 - DNA, 20 bp, Artificial Sequence
  Description of Artificial Sequence: Synthetic oligonucleotide
  Target: SCN10A; (-) strand; PAM type: YTN; PAM sequence: CTT
tcctccttctctgtctccct

SEQ ID NO: 48216 - DNA, 20 bp, Artificial Sequence
  Description of Artificial Sequence: Synthetic oligonucleotide
  Target: SCN10A; (-) strand; PAM type: YTN; PAM sequence: TTG
ctttcctccttctctgtctc

SEQ ID NO: 48217 - DNA, 20 bp, Artificial Sequence
  Description of Artificial Sequence: Synthetic oligonucleotide
  Target: SCN10A; (-) strand; PAM type: YTN; PAM sequence: CTG
gtcgttgctttcctccttct

SEQ ID NO: 48218 - DNA, 20 bp, Artificial Sequence
  Description of Artificial Sequence: Synthetic oligonucleotide
  Target: SCN10A; (-) strand; PAM type: YTN; PAM sequence: CTG
accctggtcgttgctttcct

SEQ ID NO: 48219 - DNA, 20 bp, Artificial Sequence
  Description of Artificial Sequence: Synthetic oligonucleotide
  Target: SCN10A; (-) strand; PAM type: YTN; PAM sequence: CTC
agataaaaagatatgaagga

SEQ ID NO: 48220 - DNA, 20 bp, Artificial Sequence
  Description of Artificial Sequence: Synthetic oligonucleotide
  Target: SCN10A; (-) strand; PAM type: YTN; PAM sequence: CTG
gtgaggggctcagataaaaa

SEQ ID NO: 48221 - DNA, 20 bp, Artificial Sequence
  Description of Artificial Sequence: Synthetic oligonucleotide
  Target: SCN10A; (-) strand; PAM type: YTN; PAM sequence: CTC
aggctggtgaggggctcaga

SEQ ID NO: 48222 - DNA, 20 bp, Artificial Sequence
  Description of Artificial Sequence: Synthetic oligonucleotide
  Target: SCN10A; (-) strand; PAM type: YTN; PAM sequence: TTC
tcaggctggtgaggggctca

SEQ ID NO: 48223 - DNA, 20 bp, Artificial Sequence
  Description of Artificial Sequence: Synthetic oligonucleotide
  Target: SCN10A; (-) strand; PAM type: YTN; PAM sequence: TTT
ctcaggctggtgaggggctc

SEQ ID NO: 48224 - DNA, 20 bp, Artificial Sequence
  Description of Artificial Sequence: Synthetic oligonucleotide
  Target: SCN10A; (-) strand; PAM type: YTN; PAM sequence: CTG
tttctcaggctggtgagggg

SEQ ID NO: 48225 - DNA, 20 bp, Artificial Sequence
  Description of Artificial Sequence: Synthetic oligonucleotide
  Target: SCN10A; (-) strand; PAM type: YTN; PAM sequence: TTG
tctgtttctcaggctggtga

SEQ ID NO: 48226 - DNA, 20 bp, Artificial Sequence
  Description of Artificial Sequence: Synthetic oligonucleotide
  Target: SCN10A; (-) strand; PAM type: YTN; PAM sequence: CTC
cataagaaggatgcattgtc

SEQ ID NO: 48227 - DNA, 20 bp, Artificial Sequence
  Description of Artificial Sequence: Synthetic oligonucleotide
  Target: SCN10A; (-) strand; PAM type: YTN; PAM sequence: TTC
tccataagaaggatgcattg

SEQ ID NO: 48228 - DNA, 20 bp, Artificial Sequence
  Description of Artificial Sequence: Synthetic oligonucleotide
  Target: SCN10A; (-) strand; PAM type: YTN; PAM sequence: CTT
ctccataagaaggatgcatt

SEQ ID NO: 48229 - DNA, 20 bp, Artificial Sequence
  Description of Artificial Sequence: Synthetic oligonucleotide
  Target: SCN10A; (-) strand; PAM type: YTN; PAM sequence: TTC
ttctccataagaaggatgca

SEQ ID NO: 48230 - DNA, 20 bp, Artificial Sequence
  Description of Artificial Sequence: Synthetic oligonucleotide
  Target: SCN10A; (-) strand; PAM type: YTN; PAM sequence: TTT
cttctccataagaaggatgc

SEQ ID NO: 48231 - DNA, 20 bp, Artificial Sequence
  Description of Artificial Sequence: Synthetic oligonucleotide
  Target: SCN10A; (-) strand; PAM type: YTN; PAM sequence: TTT
tcttctccataagaaggatg

SEQ ID NO: 48232 - DNA, 20 bp, Artificial Sequence
  Description of Artificial Sequence: Synthetic oligonucleotide
  Target: SCN10A; (-) strand; PAM type: YTN; PAM sequence: CTG
ttttcttctccataagaagg

SEQ ID NO: 48233 - DNA, 20 bp, Artificial Sequence
  Description of Artificial Sequence: Synthetic oligonucleotide
  Target: SCN10A; (-) strand; PAM type: YTN; PAM sequence: CTC
agcctgttttcttctccata

SEQ ID NO: 48234 - DNA, 20 bp, Artificial Sequence
  Description of Artificial Sequence: Synthetic oligonucleotide
  Target: SCN10A; (-) strand; PAM type: YTN; PAM sequence: CTC
tcagcctgttttcttctcca

SEQ ID NO: 48235 - DNA, 20 bp, Artificial Sequence
  Description of Artificial Sequence: Synthetic oligonucleotide
  Target: SCN10A; (-) strand; PAM type: YTN; PAM sequence: TTA
aactctcagcctgttttctt

SEQ ID NO: 48236 - DNA, 20 bp, Artificial Sequence
  Description of Artificial Sequence: Synthetic oligonucleotide
  Target: SCN10A; (-) strand; PAM type: YTN; PAM sequence: CTT
aaactctcagcctgttttct

SEQ ID NO: 48237 - DNA, 20 bp, Artificial Sequence
  Description of Artificial Sequence: Synthetic oligonucleotide
  Target: SCN10A; (-) strand; PAM type: YTN; PAM sequence: TTG
tggcatgagaaagtcactta

SEQ ID NO: 48238 - DNA, 20 bp, Artificial Sequence
  Description of Artificial Sequence: Synthetic oligonucleotide
  Target: SCN10A; (-) strand; PAM type: YTN; PAM sequence: CTT
gtggcatgagaaagtcactt

SEQ ID NO: 48239 - DNA, 20 bp, Artificial Sequence
  Description of Artificial Sequence: Synthetic oligonucleotide
  Target: SCN10A; (-) strand; PAM type: YTN; PAM sequence: TTG
aatcagtcttgtggcatgag

SEQ ID NO: 48240 - DNA, 20 bp, Artificial Sequence
  Description of Artificial Sequence: Synthetic oligonucleotide
  Target: SCN10A; (-) strand; PAM type: YTN; PAM sequence: TTT
gaatcagtcttgtggcatga

SEQ ID NO: 48241 - DNA, 20 bp, Artificial Sequence
  Description of Artificial Sequence: Synthetic oligonucleotide
  Target: SCN10A; (-) strand; PAM type: YTN; PAM sequence: CTT
tgaatcagtcttgtggcatg

SEQ ID NO: 48242 - DNA, 20 bp, Artificial Sequence
  Description of Artificial Sequence: Synthetic oligonucleotide
  Target: SCN10A; (-) strand; PAM type: YTN; PAM sequence: CTC
tttgaatcagtcttgtggca

SEQ ID NO: 48243 - DNA, 20 bp, Artificial Sequence
  Description of Artificial Sequence: Synthetic oligonucleotide
  Target: SCN10A; (-) strand; PAM type: YTN; PAM sequence: CTC
catagatactctttgaatca

SEQ ID NO: 48244 - DNA, 20 bp, Artificial Sequence
  Description of Artificial Sequence: Synthetic oligonucleotide
  Target: SCN10A; (-) strand; PAM type: YTN; PAM sequence: CTA
caagggacactccatagata

SEQ ID NO: 48245 - DNA, 20 bp, Artificial Sequence
  Description of Artificial Sequence: Synthetic oligonucleotide
  Target: SCN10A; (-) strand; PAM type: YTN; PAM sequence: TTG
cctacaagggacactccata

SEQ ID NO: 48246 - DNA, 20 bp, Artificial Sequence
  Description of Artificial Sequence: Synthetic oligonucleotide
  Target: SCN10A; (-) strand; PAM type: YTN; PAM sequence: CTT
gcctacaagggacactccat

SEQ ID NO: 48247 - DNA, 20 bp, Artificial Sequence
  Description of Artificial Sequence: Synthetic oligonucleotide
  Target: SCN10A; (-) strand; PAM type: YTN; PAM sequence: CTG
acttgcctacaagggacact

SEQ ID NO: 48248 - DNA, 20 bp, Artificial Sequence
  Description of Artificial Sequence: Synthetic oligonucleotide
  Target: SCN10A; (-) strand; PAM type: YTN; PAM sequence: CTA
ccccccaccacaccacactg

SEQ ID NO: 48249 - DNA, 20 bp, Artificial Sequence
  Description of Artificial Sequence: Synthetic oligonucleotide
  Target: SCN10A; (-) strand; PAM type: YTN; PAM sequence: CTC
aaccctaccccccaccacac

SEQ ID NO: 48250 - DNA, 20 bp, Artificial Sequence
  Description of Artificial Sequence: Synthetic oligonucleotide
  Target: SCN10A; (-) strand; PAM type: YTN; PAM sequence: CTG
gaagacacaagacctcaacc

SEQ ID NO: 48251 - DNA, 20 bp, Artificial Sequence
  Description of Artificial Sequence: Synthetic oligonucleotide
  Target: SCN10A; (-) strand; PAM type: YTN; PAM sequence: CTC
tggaagacacaagacctcaa

SEQ ID NO: 48252 - DNA, 20 bp, Artificial Sequence
  Description of Artificial Sequence: Synthetic oligonucleotide
  Target: SCN10A; (-) strand; PAM type: YTN; PAM sequence: CTG
gtgagggtggatccagggtg

SEQ ID NO: 48253 - DNA, 20 bp, Artificial Sequence
  Description of Artificial Sequence: Synthetic oligonucleotide
  Target: SCN10A; (-) strand; PAM type: YTN; PAM sequence: TTG
tatagctggtgagggtggat

SEQ ID NO: 48254 - DNA, 20 bp, Artificial Sequence
  Description of Artificial Sequence: Synthetic oligonucleotide
  Target: SCN10A; (-) strand; PAM type: YTN; PAM sequence: CTG
cccaaaattgtatagctggt

SEQ ID NO: 48255 - DNA, 20 bp, Artificial Sequence
  Description of Artificial Sequence: Synthetic oligonucleotide
  Target: SCN10A; (-) strand; PAM type: YTN; PAM sequence: TTA
aatatcctgcccaaaattgt

SEQ ID NO: 48256 - DNA, 20 bp, Artificial Sequence
  Description of Artificial Sequence: Synthetic oligonucleotide
  Target: SCN10A; (-) strand; PAM type: YTN; PAM sequence: CTC
agagaggttaaatatcctgc

SEQ ID NO: 48257 - DNA, 20 bp, Artificial Sequence
  Description of Artificial Sequence: Synthetic oligonucleotide
  Target: SCN10A; (-) strand; PAM type: YTN; PAM sequence: CTA
agactcagagaggttaaata

SEQ ID NO: 48258 - DNA, 20 bp, Artificial Sequence
  Description of Artificial Sequence: Synthetic oligonucleotide
  Target: SCN10A; (-) strand; PAM type: YTN; PAM sequence: CTC
acatgacaaaagagagcact

SEQ ID NO: 48259 - DNA, 20 bp, Artificial Sequence
  Description of Artificial Sequence: Synthetic oligonucleotide
  Target: SCN10A; (-) strand; PAM type: YTN; PAM sequence: TTA
acatcaccctcacatgacaa

SEQ ID NO: 48260 - DNA, 20 bp, Artificial Sequence
  Description of Artificial Sequence: Synthetic oligonucleotide
  Target: SCN10A; (-) strand; PAM type: YTN; PAM sequence: TTA
tgaggttaacatcaccctca

SEQ ID NO: 48261 - DNA, 20 bp, Artificial Sequence
  Description of Artificial Sequence: Synthetic oligonucleotide
  Target: SCN10A; (-) strand; PAM type: YTN; PAM sequence: TTC
agtgtcacaacaacattatg

SEQ ID NO: 48262 - DNA, 20 bp, Artificial Sequence
  Description of Artificial Sequence: Synthetic oligonucleotide
  Target: SCN10A; (-) strand; PAM type: YTN; PAM sequence: TTT
cagtgtcacaacaacattat

SEQ ID NO: 48263 - DNA, 20 bp, Artificial Sequence
  Description of Artificial Sequence: Synthetic oligonucleotide
  Target: SCN10A; (-) strand; PAM type: YTN; PAM sequence: TTA
tttcagtgtcacaacaacat

SEQ ID NO: 48264 - DNA, 20 bp, Artificial Sequence
  Description of Artificial Sequence: Synthetic oligonucleotide
  Target: SCN10A; (-) strand; PAM type: YTN; PAM sequence: TTA
tgaatgttatttcagtgtca

SEQ ID NO: 48265 - DNA, 20 bp, Artificial Sequence
  Description of Artificial Sequence: Synthetic oligonucleotide
  Target: SCN10A; (-) strand; PAM type: YTN; PAM sequence: TTT
atgaatgttatttcagtgtc

SEQ ID NO: 48266 - DNA, 20 bp, Artificial Sequence
  Description of Artificial Sequence: Synthetic oligonucleotide
  Target: SCN10A; (-) strand; PAM type: YTN; PAM sequence: CTT
tatgaatgttatttcagtgt

SEQ ID NO: 48267 - DNA, 20 bp, Artificial Sequence
  Description of Artificial Sequence: Synthetic oligonucleotide
  Target: SCN10A; (-) strand; PAM type: YTN; PAM sequence: CTG
caatgagtcaggtgctttat

SEQ ID NO: 48268 - DNA, 20 bp, Artificial Sequence
  Description of Artificial Sequence: Synthetic oligonucleotide
  Target: SCN10A; (-) strand; PAM type: YTN; PAM sequence: TTG
gtgcctgcaatgagtcaggt

SEQ ID NO: 48269 - DNA, 20 bp, Artificial Sequence
  Description of Artificial Sequence: Synthetic oligonucleotide
  Target: SCN10A; (-) strand; PAM type: YTN; PAM sequence: CTT
ggtgcctgcaatgagtcagg

SEQ ID NO: 48270 - DNA, 20 bp, Artificial Sequence
  Description of Artificial Sequence: Synthetic oligonucleotide
  Target: SCN10A; (-) strand; PAM type: YTN; PAM sequence: TTA
aagcaagaaagtcatgtgct

SEQ ID NO: 48271 - DNA, 20 bp, Artificial Sequence
  Description of Artificial Sequence: Synthetic oligonucleotide
  Target: SCN10A; (-) strand; PAM type: YTN; PAM sequence: TTT
aaagcaagaaagtcatgtgc

SEQ ID NO: 48272 - DNA, 20 bp, Artificial Sequence
  Description of Artificial Sequence: Synthetic oligonucleotide
  Target: SCN10A; (-) strand; PAM type: YTN; PAM sequence: TTT
taaagcaagaaagtcatgtg

SEQ ID NO: 48273 - DNA, 20 bp, Artificial Sequence
  Description of Artificial Sequence: Synthetic oligonucleotide
  Target: SCN10A; (-) strand; PAM type: YTN; PAM sequence: TTT
ttaaagcaagaaagtcatgt

SEQ ID NO: 48274 - DNA, 20 bp, Artificial Sequence
  Description of Artificial Sequence: Synthetic oligonucleotide
  Target: SCN10A; (-) strand; PAM type: YTN; PAM sequence: TTT
tttaaagcaagaaagtcatg

SEQ ID NO: 48275 - DNA, 20 bp, Artificial Sequence
  Description of Artificial Sequence: Synthetic oligonucleotide
  Target: SCN10A; (-) strand; PAM type: YTN; PAM sequence: CTT
ttttaaagcaagaaagtcat

SEQ ID NO: 48276 - DNA, 20 bp, Artificial Sequence
  Description of Artificial Sequence: Synthetic oligonucleotide
  Target: SCN10A; (-) strand; PAM type: YTN; PAM sequence: TTC
ccacagtgtcagaggaaagt

SEQ ID NO: 48277 - DNA, 20 bp, Artificial Sequence
  Description of Artificial Sequence: Synthetic oligonucleotide
  Target: SCN10A; (-) strand; PAM type: YTN; PAM sequence: TTT
cccacagtgtcagaggaaag

SEQ ID NO: 48278 - DNA, 20 bp, Artificial Sequence
  Description of Artificial Sequence: Synthetic oligonucleotide
  Target: SCN10A; (-) strand; PAM type: YTN; PAM sequence: CTT
tcccacagtgtcagaggaaa

SEQ ID NO: 48279 - DNA, 20 bp, Artificial Sequence
  Description of Artificial Sequence: Synthetic oligonucleotide
  Target: SCN10A; (-) strand; PAM type: YTN; PAM sequence: TTA
gaaaagtggaagcaagagag

SEQ ID NO: 48280 - DNA, 20 bp, Artificial Sequence
  Description of Artificial Sequence: Synthetic oligonucleotide
  Target: SCN10A; (-) strand; PAM type: YTN; PAM sequence: CTA
cagttagaaaagtggaagca

SEQ ID NO: 48281 - DNA, 20 bp, Artificial Sequence
  Description of Artificial Sequence: Synthetic oligonucleotide
  Target: SCN10A; (-) strand; PAM type: YTN; PAM sequence: TTC
tacagttagaaaagtggaag

SEQ ID NO: 48282 - DNA, 20 bp, Artificial Sequence
  Description of Artificial Sequence: Synthetic oligonucleotide
  Target: SCN10A; (-) strand; PAM type: YTN; PAM sequence: CTC
attctacagttagaaaagtg

SEQ ID NO: 48283 - DNA, 20 bp, Artificial Sequence
  Description of Artificial Sequence: Synthetic oligonucleotide
  Target: SCN10A; (-) strand; PAM type: YTN; PAM sequence: TTG
agcccacaccctcattctac

SEQ ID NO: 48284 - DNA, 20 bp, Artificial Sequence
  Description of Artificial Sequence: Synthetic oligonucleotide
  Target: SCN10A; (-) strand; PAM type: YTN; PAM sequence: TTT
gagcccacaccctcattcta

SEQ ID NO: 48285 - DNA, 20 bp, Artificial Sequence
  Description of Artificial Sequence: Synthetic oligonucleotide
  Target: SCN10A; (-) strand; PAM type: YTN; PAM sequence: TTA
tggaatagacatttgagccc

SEQ ID NO: 48286 - DNA, 20 bp, Artificial Sequence
  Description of Artificial Sequence: Synthetic oligonucleotide
  Target: SCN10A; (-) strand; PAM type: YTN; PAM sequence: CTT
atggaatagacatttgagcc

SEQ ID NO: 48287 - DNA, 20 bp, Artificial Sequence
  Description of Artificial Sequence: Synthetic oligonucleotide
  Target: SCN10A; (-) strand; PAM type: YTN; PAM sequence: CTA
agaccacagagggccttatg

SEQ ID NO: 48288 - DNA, 20 bp, Artificial Sequence
  Description of Artificial Sequence: Synthetic oligonucleotide
  Target: SCN10A; (-) strand; PAM type: YTN; PAM sequence: TTC
ccaagaagtcagcctaagac

SEQ ID NO: 48289 - DNA, 20 bp, Artificial Sequence
  Description of Artificial Sequence: Synthetic oligonucleotide
  Target: SCN10A; (-) strand; PAM type: YTN; PAM sequence: TTA
ttcccaagaagtcagcctaa

SEQ ID NO: 48290 - DNA, 20 bp, Artificial Sequence
  Description of Artificial Sequence: Synthetic oligonucleotide
  Target: SCN10A; (-) strand; PAM type: YTN; PAM sequence: CTT
attcccaagaagtcagccta

SEQ ID NO: 48291 - DNA, 20 bp, Artificial Sequence
  Description of Artificial Sequence: Synthetic oligonucleotide
  Target: SCN10A; (-) strand; PAM type: YTN; PAM sequence: TTG
atatgaaaaggaaaaatgga

SEQ ID NO: 48292 - DNA, 20 bp, Artificial Sequence
  Description of Artificial Sequence: Synthetic oligonucleotide
  Target: SCN10A; (-) strand; PAM type: YTN; PAM sequence: CTA
aagttgatatgaaaaggaaa

SEQ ID NO: 48293 - DNA, 20 bp, Artificial Sequence
  Description of Artificial Sequence: Synthetic oligonucleotide
  Target: SCN10A; (-) strand; PAM type: YTN; PAM sequence: CTG
aggtcacatcctaaagttga

SEQ ID NO: 48294 - DNA, 20 bp, Artificial Sequence
  Description of Artificial Sequence: Synthetic oligonucleotide
  Target: SCN10A; (-) strand; PAM type: YTN; PAM sequence: CTA
ggctgaggtcacatcctaaa

SEQ ID NO: 48295 - DNA, 20 bp, Artificial Sequence
  Description of Artificial Sequence: Synthetic oligonucleotide
  Target: SCN10A; (-) strand; PAM type: YTN; PAM sequence: TTG
gcagcacctaggctgaggtc

SEQ ID NO: 48296 - DNA, 20 bp, Artificial Sequence
  Description of Artificial Sequence: Synthetic oligonucleotide
  Target: SCN10A; (-) strand; PAM type: YTN; PAM sequence: TTT
ggcagcacctaggctgaggt

SEQ ID NO: 48297 - DNA, 20 bp, Artificial Sequence
  Description of Artificial Sequence: Synthetic oligonucleotide
  Target: SCN10A; (-) strand; PAM type: YTN; PAM sequence: TTT
tggcagcacctaggctgagg

SEQ ID NO: 48298 - DNA, 20 bp, Artificial Sequence
  Description of Artificial Sequence: Synthetic oligonucleotide
  Target: SCN10A; (-) strand; PAM type: YTN; PAM sequence: CTC
atgttttggcagcacctagg

SEQ ID NO: 48299 - DNA, 20 bp, Artificial Sequence
  Description of Artificial Sequence: Synthetic oligonucleotide
  Target: SCN10A; (-) strand; PAM type: YTN; PAM sequence: CTG
gaacatggtggaatcagcat

SEQ ID NO: 48300 - DNA, 20 bp, Artificial Sequence
  Description of Artificial Sequence: Synthetic oligonucleotide
  Target: SCN10A; (-) strand; PAM type: YTN; PAM sequence: TTC
tggaacatggtggaatcagc

SEQ ID NO: 48301 - DNA, 20 bp, Artificial Sequence
  Description of Artificial Sequence: Synthetic oligonucleotide
  Target: SCN10A; (-) strand; PAM type: YTN; PAM sequence: CTG
tgaaaggggcagcagtaggt

SEQ ID NO: 48302 - DNA, 20 bp, Artificial Sequence
  Description of Artificial Sequence: Synthetic oligonucleotide
  Target: SCN10A; (-) strand; PAM type: YTN; PAM sequence: CTC
cgccataatccagggctgtg

SEQ ID NO: 48303 - DNA, 20 bp, Artificial Sequence
  Description of Artificial Sequence: Synthetic oligonucleotide
  Target: SCN10A; (-) strand; PAM type: YTN; PAM sequence: CTC
cctccgccataatccagggc

SEQ ID NO: 48304 - DNA, 20 bp, Artificial Sequence
  Description of Artificial Sequence: Synthetic oligonucleotide
  Target: SCN10A; (-) strand; PAM type: YTN; PAM sequence: CTA
gaaaccactccctccgccat

SEQ ID NO: 48305 - DNA, 20 bp, Artificial Sequence
  Description of Artificial Sequence: Synthetic oligonucleotide
  Target: SCN10A; (-) strand; PAM type: YTN; PAM sequence: TTG
tccctagaaaccactccctc

SEQ ID NO: 48306 - DNA, 20 bp, Artificial Sequence
  Description of Artificial Sequence: Synthetic oligonucleotide
  Target: SCN10A; (-) strand; PAM type: YTN; PAM sequence: CTT
gtccctagaaaccactccct

SEQ ID NO: 48307 - DNA, 20 bp, Artificial Sequence
  Description of Artificial Sequence: Synthetic oligonucleotide
  Target: SCN10A; (-) strand; PAM type: YTN; PAM sequence: CTA
cttgtccctagaaaccactc

SEQ ID NO: 48308 - DNA, 20 bp, Artificial Sequence
  Description of Artificial Sequence: Synthetic oligonucleotide
  Target: SCN10A; (-) strand; PAM type: YTN; PAM sequence: TTA
ggtggagggggaaggcccag

SEQ ID NO: 48309 - DNA, 20 bp, Artificial Sequence
  Description of Artificial Sequence: Synthetic oligonucleotide
  Target: SCN10A; (-) strand; PAM type: YTN; PAM sequence: CTT
aggtggagggggaaggccca

SEQ ID NO: 48310 - DNA, 20 bp, Artificial Sequence
  Description of Artificial Sequence: Synthetic oligonucleotide
  Target: SCN10A; (-) strand; PAM type: YTN; PAM sequence: CTG
cagacttaggtggaggggga

SEQ ID NO: 48311 - DNA, 20 bp, Artificial Sequence
  Description of Artificial Sequence: Synthetic oligonucleotide
  Target: SCN10A; (-) strand; PAM type: YTN; PAM sequence: TTA
taggctgcagacttaggtgg

SEQ ID NO: 48312 - DNA, 20 bp, Artificial Sequence
  Description of Artificial Sequence: Synthetic oligonucleotide
  Target: SCN10A; (-) strand; PAM type: YTN; PAM sequence: CTT
ataggctgcagacttaggtg

SEQ ID NO: 48313 - DNA, 20 bp, Artificial Sequence
  Description of Artificial Sequence: Synthetic oligonucleotide
  Target: SCN10A; (-) strand; PAM type: YTN; PAM sequence: TTC
ttataggctgcagacttagg

SEQ ID NO: 48314 - DNA, 20 bp, Artificial Sequence
  Description of Artificial Sequence: Synthetic oligonucleotide
  Target: SCN10A; (-) strand; PAM type: YTN; PAM sequence: CTT
cttataggctgcagacttag

SEQ ID NO: 48315 - DNA, 20 bp, Artificial Sequence
  Description of Artificial Sequence: Synthetic oligonucleotide
  Target: SCN10A; (-) strand; PAM type: YTN; PAM sequence: TTG
gggtccagcttcttataggc

SEQ ID NO: 48316 - DNA, 20 bp, Artificial Sequence
  Description of Artificial Sequence: Synthetic oligonucleotide
  Target: SCN10A; (-) strand; PAM type: YTN; PAM sequence: TTT
ggggtccagcttcttatagg

SEQ ID NO: 48317 - DNA, 20 bp, Artificial Sequence
  Description of Artificial Sequence: Synthetic oligonucleotide
  Target: SCN10A; (-) strand; PAM type: YTN; PAM sequence: CTT
tggggtccagcttcttatag

SEQ ID NO: 48318 - DNA, 20 bp, Artificial Sequence
  Description of Artificial Sequence: Synthetic oligonucleotide
  Target: SCN10A; (-) strand; PAM type: YTN; PAM sequence: CTG
gctttggggtccagcttctt

SEQ ID NO: 48319 - DNA, 20 bp, Artificial Sequence
  Description of Artificial Sequence: Synthetic oligonucleotide
  Target: SCN10A; (-) strand; PAM type: YTN; PAM sequence: CTG
tctggctttggggtccagct

SEQ ID NO: 48320 - DNA, 20 bp, Artificial Sequence
  Description of Artificial Sequence: Synthetic oligonucleotide
  Target: SCN10A; (-) strand; PAM type: YTN; PAM sequence: TTC
accagaactgtctggctttg

SEQ ID NO: 48321 - DNA, 20 bp, Artificial Sequence
  Description of Artificial Sequence: Synthetic oligonucleotide
  Target: SCN10A; (-) strand; PAM type: YTN; PAM sequence: CTG
gattcaccagaactgtctgg

SEQ ID NO: 48322 - DNA, 20 bp, Artificial Sequence
  Description of Artificial Sequence: Synthetic oligonucleotide
  Target: SCN10A; (-) strand; PAM type: YTN; PAM sequence: CTA
ctggattcaccagaactgtc

SEQ ID NO: 48323 - DNA, 20 bp, Artificial Sequence
  Description of Artificial Sequence: Synthetic oligonucleotide
  Target: SCN10A; (-) strand; PAM type: YTN; PAM sequence: CTG
gaggtgacctactggattca

SEQ ID NO: 48324 - DNA, 20 bp, Artificial Sequence
  Description of Artificial Sequence: Synthetic oligonucleotide
  Target: SCN10A; (-) strand; PAM type: YTN; PAM sequence: TTC
atgtccgcagcagggtccac

SEQ ID NO: 48325 - DNA, 20 bp, Artificial Sequence
  Description of Artificial Sequence: Synthetic oligonucleotide
  Target: SCN10A; (-) strand; PAM type: YTN; PAM sequence: CTT
catgtccgcagcagggtcca

SEQ ID NO: 48326 - DNA, 20 bp, Artificial Sequence
  Description of Artificial Sequence: Synthetic oligonucleotide
  Target: SCN10A; (-) strand; PAM type: YTN; PAM sequence: CTG
ccttcatgtccgcagcaggg

SEQ ID NO: 48327 - DNA, 20 bp, Artificial Sequence
  Description of Artificial Sequence: Synthetic oligonucleotide
  Target: SCN10A; (-) strand; PAM type: YTN; PAM sequence: CTA
gaaagggtcagcatcctgcc

SEQ ID NO: 48328 - DNA, 20 bp, Artificial Sequence
  Description of Artificial Sequence: Synthetic oligonucleotide
  Target: SCN10A; (-) strand; PAM type: YTN; PAM sequence: TTC
aaacacacgcacacatgata

SEQ ID NO: 48329 - DNA, 20 bp, Artificial Sequence
  Description of Artificial Sequence: Synthetic oligonucleotide
  Target: SCN10A; (-) strand; PAM type: YTN; PAM sequence: TTG
cgtgtgtgtgtgtgtgtgtg

SEQ ID NO: 48330 - DNA, 20 bp, Artificial Sequence
  Description of Artificial Sequence: Synthetic oligonucleotide
  Target: SCN10A; (-) strand; PAM type: YTN; PAM sequence: CTT
gcgtgtgtgtgtgtgtgtgt

SEQ ID NO: 48331 - DNA, 20 bp, Artificial Sequence
  Description of Artificial Sequence: Synthetic oligonucleotide
  Target: SCN10A; (-) strand; PAM type: YTN; PAM sequence: CTC
acaagacttgcgtgtgtgtg

SEQ ID NO: 48332 - DNA, 20 bp, Artificial Sequence
  Description of Artificial Sequence: Synthetic oligonucleotide
  Target: SCN10A; (-) strand; PAM type: YTN; PAM sequence: TTA
agccacctcacaagacttgc

SEQ ID NO: 48333 - DNA, 20 bp, Artificial Sequence
  Description of Artificial Sequence: Synthetic oligonucleotide
  Target: SCN10A; (-) strand; PAM type: YTN; PAM sequence: CTG
aattaagccacctcacaaga

SEQ ID NO: 48334 - DNA, 20 bp, Artificial Sequence
  Description of Artificial Sequence: Synthetic oligonucleotide
  Target: SCN10A; (-) strand; PAM type: YTN; PAM sequence: TTA
acccctgaattaagccacct

SEQ ID NO: 48335 - DNA, 20 bp, Artificial Sequence
  Description of Artificial Sequence: Synthetic oligonucleotide
  Target: SCN10A; (-) strand; PAM type: YTN; PAM sequence: CTT
aacccctgaattaagccacc

SEQ ID NO: 48336 - DNA, 20 bp, Artificial Sequence
  Description of Artificial Sequence: Synthetic oligonucleotide
  Target: SCN10A; (-) strand; PAM type: YTN; PAM sequence: TTC
ttaacccctgaattaagcca

SEQ ID NO: 48337 - DNA, 20 bp, Artificial Sequence
  Description of Artificial Sequence: Synthetic oligonucleotide
  Target: SCN10A; (-) strand; PAM type: YTN; PAM sequence: TTT
cttaacccctgaattaagcc

SEQ ID NO: 48338 - DNA, 20 bp, Artificial Sequence
  Description of Artificial Sequence: Synthetic oligonucleotide
  Target: SCN10A; (-) strand; PAM type: YTN; PAM sequence: TTT
tcttaacccctgaattaagc

SEQ ID NO: 48339 - DNA, 20 bp, Artificial Sequence
  Description of Artificial Sequence: Synthetic oligonucleotide
  Target: SCN10A; (-) strand; PAM type: YTN; PAM sequence: CTT
ttcttaacccctgaattaag

SEQ ID NO: 48340 - DNA, 20 bp, Artificial Sequence
  Description of Artificial Sequence: Synthetic oligonucleotide
  Target: SCN10A; (-) strand; PAM type: YTN; PAM sequence: CTG
ccaagcccgcttttcttaac

SEQ ID NO: 48341 - DNA, 20 bp, Artificial Sequence
  Description of Artificial Sequence: Synthetic oligonucleotide
  Target: SCN10A; (-) strand; PAM type: YTN; PAM sequence: TTG
aacccagacagaccggctgc

SEQ ID NO: 48342 - DNA, 20 bp, Artificial Sequence
  Description of Artificial Sequence: Synthetic oligonucleotide
  Target: SCN10A; (-) strand; PAM type: YTN; PAM sequence: TTT
gaacccagacagaccggctg

SEQ ID NO: 48343 - DNA, 20 bp, Artificial Sequence
  Description of Artificial Sequence: Synthetic oligonucleotide
  Target: SCN10A; (-) strand; PAM type: YTN; PAM sequence: TTA
gtggccacatcagaatttga

SEQ ID NO: 48344 - DNA, 20 bp, Artificial Sequence
  Description of Artificial Sequence: Synthetic oligonucleotide
  Target: SCN10A; (-) strand; PAM type: YTN; PAM sequence: TTT
agtggccacatcagaatttg

SEQ ID NO: 48345 - DNA, 20 bp, Artificial Sequence
  Description of Artificial Sequence: Synthetic oligonucleotide
  Target: SCN10A; (-) strand; PAM type: YTN; PAM sequence: TTG
agtttagtggccacatcaga

SEQ ID NO: 48346 - DNA, 20 bp, Artificial Sequence
  Description of Artificial Sequence: Synthetic oligonucleotide
  Target: SCN10A; (-) strand; PAM type: YTN; PAM sequence: TTC
ccaagatcatagagttgagt

SEQ ID NO: 48347 - DNA, 20 bp, Artificial Sequence
  Description of Artificial Sequence: Synthetic oligonucleotide
  Target: SCN10A; (-) strand; PAM type: YTN; PAM sequence: CTT
cccaagatcatagagttgag

SEQ ID NO: 48348 - DNA, 20 bp, Artificial Sequence
  Description of Artificial Sequence: Synthetic oligonucleotide
  Target: SCN10A; (-) strand; PAM type: YTN; PAM sequence: TTA
aataatcttcccaagatcat

SEQ ID NO: 48349 - DNA, 20 bp, Artificial Sequence
  Description of Artificial Sequence: Synthetic oligonucleotide
  Target: SCN10A; (-) strand; PAM type: YTN; PAM sequence: TTC
ccagatggaaaaatggagat

SEQ ID NO: 48350 - DNA, 20 bp, Artificial Sequence
  Description of Artificial Sequence: Synthetic oligonucleotide
  Target: SCN10A; (-) strand; PAM type: YTN; PAM sequence: TTT
cccagatggaaaaatggaga

SEQ ID NO: 48351 - DNA, 20 bp, Artificial Sequence
  Description of Artificial Sequence: Synthetic oligonucleotide
  Target: SCN10A; (-) strand; PAM type: YTN; PAM sequence: CTT
tcccagatggaaaaatggag

SEQ ID NO: 48352 - DNA, 20 bp, Artificial Sequence
  Description of Artificial Sequence: Synthetic oligonucleotide
  Target: SCN10A; (-) strand; PAM type: YTN; PAM sequence: TTC
cctttcccagatggaaaaat

SEQ ID NO: 48353 - DNA, 20 bp, Artificial Sequence
  Description of Artificial Sequence: Synthetic oligonucleotide
  Target: SCN10A; (-) strand; PAM type: YTN; PAM sequence: TTA
ttccctttcccagatggaaa

SEQ ID NO: 48354 - DNA, 20 bp, Artificial Sequence
  Description of Artificial Sequence: Synthetic oligonucleotide
  Target: SCN10A; (-) strand; PAM type: YTN; PAM sequence: TTG
ttattccctttcccagatgg

SEQ ID NO: 48355 - DNA, 20 bp, Artificial Sequence
  Description of Artificial Sequence: Synthetic oligonucleotide
  Target: SCN10A; (-) strand; PAM type: YTN; PAM sequence: CTT
gttattccctttcccagatg

SEQ ID NO: 48356 - DNA, 20 bp, Artificial Sequence
  Description of Artificial Sequence: Synthetic oligonucleotide
  Target: SCN10A; (-) strand; PAM type: YTN; PAM sequence: CTC
ttgttattccctttcccaga

SEQ ID NO: 48357 - DNA, 20 bp, Artificial Sequence
  Description of Artificial Sequence: Synthetic oligonucleotide
  Target: SCN10A; (-) strand; PAM type: YTN; PAM sequence: CTA
catggtaggcactcttgtta

SEQ ID NO: 48358 - DNA, 20 bp, Artificial Sequence
  Description of Artificial Sequence: Synthetic oligonucleotide
  Target: SCN10A; (-) strand; PAM type: YTN; PAM sequence: TTC
acaacaaccctacatggtag

SEQ ID NO: 48359 - DNA, 20 bp, Artificial Sequence
  Description of Artificial Sequence: Synthetic oligonucleotide
  Target: SCN10A; (-) strand; PAM type: YTN; PAM sequence: TTT
cacaacaaccctacatggta

SEQ ID NO: 48360 - DNA, 20 bp, Artificial Sequence
  Description of Artificial Sequence: Synthetic oligonucleotide
  Target: SCN10A; (-) strand; PAM type: YTN; PAM sequence: TTT
tcacaacaaccctacatggt

SEQ ID NO: 48361 - DNA, 20 bp, Artificial Sequence
  Description of Artificial Sequence: Synthetic oligonucleotide
  Target: SCN10A; (-) strand; PAM type: YTN; PAM sequence: TTA
ttttcacaacaaccctacat

SEQ ID NO: 48362 - DNA, 20 bp, Artificial Sequence
  Description of Artificial Sequence: Synthetic oligonucleotide
  Target: SCN10A; (-) strand; PAM type: YTN; PAM sequence: TTT
attttcacaacaaccctaca

SEQ ID NO: 48363 - DNA, 20 bp, Artificial Sequence
  Description of Artificial Sequence: Synthetic oligonucleotide
  Target: SCN10A; (-) strand; PAM type: YTN; PAM sequence: TTT
tattttcacaacaaccctac

SEQ ID NO: 48364 - DNA, 20 bp, Artificial Sequence
  Description of Artificial Sequence: Synthetic oligonucleotide
  Target: SCN10A; (-) strand; PAM type: YTN; PAM sequence: CTC
attttattttcacaacaacc

SEQ ID NO: 48365 - DNA, 20 bp, Artificial Sequence
  Description of Artificial Sequence: Synthetic oligonucleotide
  Target: SCN10A; (-) strand; PAM type: YTN; PAM sequence: TTA
tctcattttattttcacaac

SEQ ID NO: 48366 - DNA, 20 bp, Artificial Sequence
  Description of Artificial Sequence: Synthetic oligonucleotide
  Target: SCN10A; (-) strand; PAM type: YTN; PAM sequence: CTC
atggattatctcattttatt

SEQ ID NO: 48367 - DNA, 20 bp, Artificial Sequence
  Description of Artificial Sequence: Synthetic oligonucleotide
  Target: SCN10A; (-) strand; PAM type: YTN; PAM sequence: TTC
tcatggattatctcatttta

SEQ ID NO: 48368 - DNA, 20 bp, Artificial Sequence
  Description of Artificial Sequence: Synthetic oligonucleotide
  Target: SCN10A; (-) strand; PAM type: YTN; PAM sequence: CTT
ctcatggattatctcatttt

SEQ ID NO: 48369 - DNA, 20 bp, Artificial Sequence
  Description of Artificial Sequence: Synthetic oligonucleotide
  Target: SCN10A; (-) strand; PAM type: YTN; PAM sequence: CTC
agatgcttctcatggattat

SEQ ID NO: 48370 - DNA, 20 bp, Artificial Sequence
  Description of Artificial Sequence: Synthetic oligonucleotide
  Target: SCN10A; (-) strand; PAM type: YTN; PAM sequence: TTG
ccccacccacaggaatagta

SEQ ID NO: 48371 - DNA, 20 bp, Artificial Sequence
  Description of Artificial Sequence: Synthetic oligonucleotide
  Target: SCN10A; (-) strand; PAM type: YTN; PAM sequence: CTT
gccccacccacaggaatagt

SEQ ID NO: 48372 - DNA, 20 bp, Artificial Sequence
  Description of Artificial Sequence: Synthetic oligonucleotide
  Target: SCN10A; (-) strand; PAM type: YTN; PAM sequence: CTC
caaccttgccccacccacag

SEQ ID NO: 48373 - DNA, 20 bp, Artificial Sequence
  Description of Artificial Sequence: Synthetic oligonucleotide
  Target: SCN10A; (-) strand; PAM type: YTN; PAM sequence: CTG
ctccaaccttgccccaccca

SEQ ID NO: 48374 - DNA, 20 bp, Artificial Sequence
  Description of Artificial Sequence: Synthetic oligonucleotide
  Target: SCN10A; (-) strand; PAM type: YTN; PAM sequence: CTC
agagggacaacaactgctcc

SEQ ID NO: 48375 - DNA, 20 bp, Artificial Sequence
  Description of Artificial Sequence: Synthetic oligonucleotide
  Target: SCN10A; (-) strand; PAM type: YTN; PAM sequence: CTG
actcagagggacaacaactg

SEQ ID NO: 48376 - DNA, 20 bp, Artificial Sequence
  Description of Artificial Sequence: Synthetic oligonucleotide
  Target: SCN10A; (-) strand; PAM type: YTN; PAM sequence: CTG
gataaagtatctgactcaga

SEQ ID NO: 48377 - DNA, 20 bp, Artificial Sequence
  Description of Artificial Sequence: Synthetic oligonucleotide
  Target: SCN10A; (-) strand; PAM type: YTN; PAM sequence: CTA
tatactggataaagtatctg

SEQ ID NO: 48378 - DNA, 20 bp, Artificial Sequence
  Description of Artificial Sequence: Synthetic oligonucleotide
  Target: SCN10A; (-) strand; PAM type: YTN; PAM sequence: TTC
actatatactggataaagta

SEQ ID NO: 48379 - DNA, 20 bp, Artificial Sequence
  Description of Artificial Sequence: Synthetic oligonucleotide
  Target: SCN10A; (-) strand; PAM type: YTN; PAM sequence: TTT
cactatatactggataaagt

SEQ ID NO: 48380 - DNA, 20 bp, Artificial Sequence
  Description of Artificial Sequence: Synthetic oligonucleotide
  Target: SCN10A; (-) strand; PAM type: YTN; PAM sequence: CTG
gatttcactatatactggat

SEQ ID NO: 48381 - DNA, 20 bp, Artificial Sequence
  Description of Artificial Sequence: Synthetic oligonucleotide
  Target: SCN10A; (-) strand; PAM type: YTN; PAM sequence: TTA
acaagatacaatccatactg

SEQ ID NO: 48382 - DNA, 20 bp, Artificial Sequence
  Description of Artificial Sequence: Synthetic oligonucleotide
  Target: SCN10A; (-) strand; PAM type: YTN; PAM sequence: CTT
aacaagatacaatccatact

SEQ ID NO: 48383 - DNA, 20 bp, Artificial Sequence
  Description of Artificial Sequence: Synthetic oligonucleotide
  Target: SCN10A; (-) strand; PAM type: YTN; PAM sequence: CTC
ttaacaagatacaatccata

SEQ ID NO: 48384 - DNA, 20 bp, Artificial Sequence
  Description of Artificial Sequence: Synthetic oligonucleotide
  Target: SCN10A; (-) strand; PAM type: YTN; PAM sequence: TTA
ctcttaacaagatacaatcc

SEQ ID NO: 48385 - DNA, 20 bp, Artificial Sequence
  Description of Artificial Sequence: Synthetic oligonucleotide
  Target: SCN10A; (-) strand; PAM type: YTN; PAM sequence: TTT
actcttaacaagatacaatc

SEQ ID NO: 48386 - DNA, 20 bp, Artificial Sequence
  Description of Artificial Sequence: Synthetic oligonucleotide
  Target: SCN10A; (-) strand; PAM type: YTN; PAM sequence: TTA
tttactcttaacaagataca

SEQ ID NO: 48387 - DNA, 20 bp, Artificial Sequence
  Description of Artificial Sequence: Synthetic oligonucleotide
  Target: SCN10A; (-) strand; PAM type: YTN; PAM sequence: TTA
gtattatttactcttaacaa

SEQ ID NO: 48388 - DNA, 20 bp, Artificial Sequence
  Description of Artificial Sequence: Synthetic oligonucleotide
  Target: SCN10A; (-) strand; PAM type: YTN; PAM sequence: TTG
ttagtattatttactcttaa

SEQ ID NO: 48389 - DNA, 20 bp, Artificial Sequence
  Description of Artificial Sequence: Synthetic oligonucleotide
  Target: SCN10A; (-) strand; PAM type: YTN; PAM sequence: CTT
gttagtattatttactctta

SEQ ID NO: 48390 - DNA, 20 bp, Artificial Sequence
  Description of Artificial Sequence: Synthetic oligonucleotide
  Target: SCN10A; (-) strand; PAM type: YTN; PAM sequence: CTC
catcacttgttagtattatt

SEQ ID NO: 48391 - DNA, 20 bp, Artificial Sequence
  Description of Artificial Sequence: Synthetic oligonucleotide
  Target: SCN10A; (-) strand; PAM type: YTN; PAM sequence: TTC
ctccatcacttgttagtatt

SEQ ID NO: 48392 - DNA, 20 bp, Artificial Sequence
  Description of Artificial Sequence: Synthetic oligonucleotide
  Target: SCN10A; (-) strand; PAM type: YTN; PAM sequence: TTT
cctccatcacttgttagtat

SEQ ID NO: 48393 - DNA, 20 bp, Artificial Sequence
  Description of Artificial Sequence: Synthetic oligonucleotide
  Target: SCN10A; (-) strand; PAM type: YTN; PAM sequence: TTT
tcctccatcacttgttagta

SEQ ID NO: 48394 - DNA, 20 bp, Artificial Sequence
  Description of Artificial Sequence: Synthetic oligonucleotide
  Target: SCN10A; (-) strand; PAM type: YTN; PAM sequence: TTA
aattttcctccatcacttgt

SEQ ID NO: 48395 - DNA, 20 bp, Artificial Sequence
  Description of Artificial Sequence: Synthetic oligonucleotide
  Target: SCN10A; (-) strand; PAM type: YTN; PAM sequence: TTT
aaattttcctccatcacttg

SEQ ID NO: 48396 - DNA, 20 bp, Artificial Sequence
  Description of Artificial Sequence: Synthetic oligonucleotide
  Target: SCN10A; (-) strand; PAM type: YTN; PAM sequence: CTT
taaattttcctccatcactt

SEQ ID NO: 48397 - DNA, 20 bp, Artificial Sequence
  Description of Artificial Sequence: Synthetic oligonucleotide
  Target: SCN10A; (-) strand; PAM type: YTN; PAM sequence: CTG
ctttaaattttcctccatca

SEQ ID NO: 48398 - DNA, 20 bp, Artificial Sequence
  Description of Artificial Sequence: Synthetic oligonucleotide
  Target: SCN10A; (-) strand; PAM type: YTN; PAM sequence: TTA
gacatcatgctgctttaaat

SEQ ID NO: 48399 - DNA, 20 bp, Artificial Sequence
  Description of Artificial Sequence: Synthetic oligonucleotide
  Target: SCN10A; (-) strand; PAM type: YTN; PAM sequence: TTT
agacatcatgctgctttaaa

SEQ ID NO: 48400 - DNA, 20 bp, Artificial Sequence
  Description of Artificial Sequence: Synthetic oligonucleotide
  Target: SCN10A; (-) strand; PAM type: YTN; PAM sequence: CTA
gtttagacatcatgctgctt

SEQ ID NO: 48401 - DNA, 20 bp, Artificial Sequence
  Description of Artificial Sequence: Synthetic oligonucleotide
  Target: SCN10A; (-) strand; PAM type: YTN; PAM sequence: TTG
gcatctagtttagacatcat

SEQ ID NO: 48402 - DNA, 20 bp, Artificial Sequence
  Description of Artificial Sequence: Synthetic oligonucleotide
  Target: SCN10A; (-) strand; PAM type: YTN; PAM sequence: TTT
ggcatctagtttagacatca

SEQ ID NO: 48403 - DNA, 20 bp, Artificial Sequence
  Description of Artificial Sequence: Synthetic oligonucleotide
  Target: SCN10A; (-) strand; PAM type: YTN; PAM sequence: CTT
tggcatctagtttagacatc

SEQ ID NO: 48404 - DNA, 20 bp, Artificial Sequence
  Description of Artificial Sequence: Synthetic oligonucleotide
  Target: SCN10A; (-) strand; PAM type: YTN; PAM sequence: TTC
tttggcatctagtttagaca

SEQ ID NO: 48405 - DNA, 20 bp, Artificial Sequence
  Description of Artificial Sequence: Synthetic oligonucleotide
  Target: SCN10A; (-) strand; PAM type: YTN; PAM sequence: TTT
ctttggcatctagtttagac

SEQ ID NO: 48406 - DNA, 20 bp, Artificial Sequence
  Description of Artificial Sequence: Synthetic oligonucleotide
  Target: SCN10A; (-) strand; PAM type: YTN; PAM sequence: TTT
tctttggcatctagtttaga

SEQ ID NO: 48407 - DNA, 20 bp, Artificial Sequence
  Description of Artificial Sequence: Synthetic oligonucleotide
  Target: SCN10A; (-) strand; PAM type: YTN; PAM sequence: CTT
ttctttggcatctagtttag

SEQ ID NO: 48408 - DNA, 20 bp, Artificial Sequence
  Description of Artificial Sequence: Synthetic oligonucleotide
  Target: SCN10A; (-) strand; PAM type: YTN; PAM sequence: TTG
taacaaaagcatcaggaagt

SEQ ID NO: 48409 - DNA, 20 bp, Artificial Sequence
  Description of Artificial Sequence: Synthetic oligonucleotide
  Target: SCN10A; (-) strand; PAM type: YTN; PAM sequence: CTG
ttgtaacaaaagcatcagga

SEQ ID NO: 48410 - DNA, 20 bp, Artificial Sequence
  Description of Artificial Sequence: Synthetic oligonucleotide
  Target: SCN10A; (-) strand; PAM type: YTN; PAM sequence: TTG
ctgttgtaacaaaagcatca

SEQ ID NO: 48411 - DNA, 20 bp, Artificial Sequence
  Description of Artificial Sequence: Synthetic oligonucleotide
  Target: SCN10A; (-) strand; PAM type: YTN; PAM sequence: TTG
gggagggaaggggaagacag

SEQ ID NO: 48412 - DNA, 20 bp, Artificial Sequence
  Description of Artificial Sequence: Synthetic oligonucleotide
  Target: SCN10A; (-) strand; PAM type: YTN; PAM sequence: TTA
aggagaaaaagagttgggga

SEQ ID NO: 48413 - DNA, 20 bp, Artificial Sequence
  Description of Artificial Sequence: Synthetic oligonucleotide
  Target: SCN10A; (-) strand; PAM type: YTN; PAM sequence: CTT
aaggagaaaaagagttgggg

SEQ ID NO: 48414 - DNA, 20 bp, Artificial Sequence
  Description of Artificial Sequence: Synthetic oligonucleotide
  Target: SCN10A; (-) strand; PAM type: YTN; PAM sequence: TTG
tcacttaaggagaaaaagag

SEQ ID NO: 48415 - DNA, 20 bp, Artificial Sequence
  Description of Artificial Sequence: Synthetic oligonucleotide
  Target: SCN10A; (-) strand; PAM type: YTN; PAM sequence: TTC
aatgttgtcacttaaggaga

SEQ ID NO: 48416 - DNA, 20 bp, Artificial Sequence
  Description of Artificial Sequence: Synthetic oligonucleotide
  Target: SCN10A; (-) strand; PAM type: YTN; PAM sequence: TTT
caatgttgtcacttaaggag

SEQ ID NO: 48417 - DNA, 20 bp, Artificial Sequence
  Description of Artificial Sequence: Synthetic oligonucleotide
  Target: SCN10A; (-) strand; PAM type: YTN; PAM sequence: TTT
tcaatgttgtcacttaagga

SEQ ID NO: 48418 - DNA, 20 bp, Artificial Sequence
  Description of Artificial Sequence: Synthetic oligonucleotide
  Target: SCN10A; (-) strand; PAM type: YTN; PAM sequence: TTA
acagtagccacgattttcaa

SEQ ID NO: 48419 - DNA, 20 bp, Artificial Sequence
  Description of Artificial Sequence: Synthetic oligonucleotide
  Target: SCN10A; (-) strand; PAM type: YTN; PAM sequence: TTA
tgaccacaattaacagtagc

SEQ ID NO: 48420 - DNA, 20 bp, Artificial Sequence
  Description of Artificial Sequence: Synthetic oligonucleotide
  Target: SCN10A; (-) strand; PAM type: YTN; PAM sequence: TTT
atgaccacaattaacagtag

SEQ ID NO: 48421 - DNA, 20 bp, Artificial Sequence
  Description of Artificial Sequence: Synthetic oligonucleotide
  Target: SCN10A; (-) strand; PAM type: YTN; PAM sequence: TTT
tatgaccacaattaacagta

SEQ ID NO: 48422 - DNA, 20 bp, Artificial Sequence
  Description of Artificial Sequence: Synthetic oligonucleotide
  Target: SCN10A; (-) strand; PAM type: YTN; PAM sequence: CTT
ttatgaccacaattaacagt

SEQ ID NO: 48423 - DNA, 20 bp, Artificial Sequence
  Description of Artificial Sequence: Synthetic oligonucleotide
  Target: SCN10A; (-) strand; PAM type: YTN; PAM sequence: TTA
cttttatgaccacaattaac

SEQ ID NO: 48424 - DNA, 20 bp, Artificial Sequence
  Description of Artificial Sequence: Synthetic oligonucleotide
  Target: SCN10A; (-) strand; PAM type: YTN; PAM sequence: TTC
caatgtaattacttttatga

SEQ ID NO: 48425 - DNA, 20 bp, Artificial Sequence
  Description of Artificial Sequence: Synthetic oligonucleotide
  Target: SCN10A; (-) strand; PAM type: YTN; PAM sequence: CTT
ccaatgtaattacttttatg

SEQ ID NO: 48426 - DNA, 20 bp, Artificial Sequence
  Description of Artificial Sequence: Synthetic oligonucleotide
  Target: SCN10A; (-) strand; PAM type: YTN; PAM sequence: TTC
cttccaatgtaattactttt

SEQ ID NO: 48427 - DNA, 20 bp, Artificial Sequence
  Description of Artificial Sequence: Synthetic oligonucleotide
  Target: SCN10A; (-) strand; PAM type: YTN; PAM sequence: TTT
ccttccaatgtaattacttt

SEQ ID NO: 48428 - DNA, 20 bp, Artificial Sequence
  Description of Artificial Sequence: Synthetic oligonucleotide
  Target: SCN10A; (-) strand; PAM type: YTN; PAM sequence: CTG
tttccttccaatgtaattac

SEQ ID NO: 48429 - DNA, 20 bp, Artificial Sequence
  Description of Artificial Sequence: Synthetic oligonucleotide
  Target: SCN10A; (-) strand; PAM type: YTN; PAM sequence: TTG
tctgtttccttccaatgtaa

SEQ ID NO: 48430 - DNA, 20 bp, Artificial Sequence
  Description of Artificial Sequence: Synthetic oligonucleotide
  Target: SCN10A; (-) strand; PAM type: YTN; PAM sequence: CTT
gtctgtttccttccaatgta

SEQ ID NO: 48431 - DNA, 20 bp, Artificial Sequence
  Description of Artificial Sequence: Synthetic oligonucleotide
  Target: SCN10A; (-) strand; PAM type: YTN; PAM sequence: TTG
gacttgtctgtttccttcca

SEQ ID NO: 48432 - DNA, 20 bp, Artificial Sequence
  Description of Artificial Sequence: Synthetic oligonucleotide
  Target: SCN10A; (-) strand; PAM type: YTN; PAM sequence: TTT
ggacttgtctgtttccttcc

SEQ ID NO: 48433 - DNA, 20 bp, Artificial Sequence
  Description of Artificial Sequence: Synthetic oligonucleotide
  Target: SCN10A; (-) strand; PAM type: YTN; PAM sequence: CTT
tggacttgtctgtttccttc

SEQ ID NO: 48434 - DNA, 20 bp, Artificial Sequence
  Description of Artificial Sequence: Synthetic oligonucleotide
  Target: SCN10A; (-) strand; PAM type: YTN; PAM sequence: CTA
aagacaatctttggacttgt

SEQ ID NO: 48435 - DNA, 20 bp, Artificial Sequence
  Description of Artificial Sequence: Synthetic oligonucleotide
  Target: SCN10A; (-) strand; PAM type: YTN; PAM sequence: TTA
tctaaagacaatctttggac

SEQ ID NO: 48436 - DNA, 20 bp, Artificial Sequence
  Description of Artificial Sequence: Synthetic oligonucleotide
  Target: SCN10A; (-) strand; PAM type: YTN; PAM sequence: TTT
atctaaagacaatctttgga

SEQ ID NO: 48437 - DNA, 20 bp, Artificial Sequence
  Description of Artificial Sequence: Synthetic oligonucleotide
  Target: SCN10A; (-) strand; PAM type: YTN; PAM sequence: TTT
tatctaaagacaatctttgg

SEQ ID NO: 48438 - DNA, 20 bp, Artificial Sequence
  Description of Artificial Sequence: Synthetic oligonucleotide
  Target: SCN10A; (-) strand; PAM type: YTN; PAM sequence: TTT
ttatctaaagacaatctttg

SEQ ID NO: 48439 - DNA, 20 bp, Artificial Sequence
  Description of Artificial Sequence: Synthetic oligonucleotide
  Target: SCN10A; (-) strand; PAM type: YTN; PAM sequence: TTT
tttatctaaagacaatcttt

SEQ ID NO: 48440 - DNA, 20 bp, Artificial Sequence
  Description of Artificial Sequence: Synthetic oligonucleotide
  Target: SCN10A; (-) strand; PAM type: YTN; PAM sequence: CTT
ttttatctaaagacaatctt

SEQ ID NO: 48441 - DNA, 20 bp, Artificial Sequence
  Description of Artificial Sequence: Synthetic oligonucleotide
  Target: SCN10A; (-) strand; PAM type: YTN; PAM sequence: TTG
aaatgaggataaatgtcact

SEQ ID NO: 48442 - DNA, 20 bp, Artificial Sequence
  Description of Artificial Sequence: Synthetic oligonucleotide
  Target: SCN10A; (-) strand; PAM type: YTN; PAM sequence: CTT
gaaatgaggataaatgtcac

SEQ ID NO: 48443 - DNA, 20 bp, Artificial Sequence
  Description of Artificial Sequence: Synthetic oligonucleotide
  Target: SCN10A; (-) strand; PAM type: YTN; PAM sequence: CTA
ccttgaaatgaggataaatg

SEQ ID NO: 48444 - DNA, 20 bp, Artificial Sequence
  Description of Artificial Sequence: Synthetic oligonucleotide
  Target: SCN10A; (-) strand; PAM type: YTN; PAM sequence: CTC
taccttgaaatgaggataaa

SEQ ID NO: 48445 - DNA, 20 bp, Artificial Sequence
  Description of Artificial Sequence: Synthetic oligonucleotide
  Target: SCN10A; (-) strand; PAM type: YTN; PAM sequence: TTG
cctctaccttgaaatgagga

SEQ ID NO: 48446 - DNA, 20 bp, Artificial Sequence
  Description of Artificial Sequence: Synthetic oligonucleotide
  Target: SCN10A; (-) strand; PAM type: YTN; PAM sequence: CTC
agttgcctctaccttgaaat

SEQ ID NO: 48447 - DNA, 20 bp, Artificial Sequence
  Description of Artificial Sequence: Synthetic oligonucleotide
  Target: SCN10A; (-) strand; PAM type: YTN; PAM sequence: CTG
gatctcagttgcctctacct

SEQ ID NO: 48448 - DNA, 20 bp, Artificial Sequence
  Description of Artificial Sequence: Synthetic oligonucleotide
  Target: SCN10A; (-) strand; PAM type: YTN; PAM sequence: TTC
tggatctcagttgcctctac

SEQ ID NO: 48449 - DNA, 20 bp, Artificial Sequence
  Description of Artificial Sequence: Synthetic oligonucleotide
  Target: SCN10A; (-) strand; PAM type: YTN; PAM sequence: TTT
ctggatctcagttgcctcta

SEQ ID NO: 48450 - DNA, 20 bp, Artificial Sequence
  Description of Artificial Sequence: Synthetic oligonucleotide
  Target: SCN10A; (-) strand; PAM type: YTN; PAM sequence: TTT
tctggatctcagttgcctct

SEQ ID NO: 48451 - DNA, 20 bp, Artificial Sequence
  Description of Artificial Sequence: Synthetic oligonucleotide
  Target: SCN10A; (-) strand; PAM type: YTN; PAM sequence: TTG
aattttctggatctcagttg

SEQ ID NO: 48452 - DNA, 20 bp, Artificial Sequence
  Description of Artificial Sequence: Synthetic oligonucleotide
  Target: SCN10A; (-) strand; PAM type: YTN; PAM sequence: CTT
gaattttctggatctcagtt

SEQ ID NO: 48453 - DNA, 20 bp, Artificial Sequence
  Description of Artificial Sequence: Synthetic oligonucleotide
  Target: SCN10A; (-) strand; PAM type: YTN; PAM sequence: TTA
caaaacataggacaaccact

SEQ ID NO: 48454 - DNA, 20 bp, Artificial Sequence
  Description of Artificial Sequence: Synthetic oligonucleotide
  Target: SCN10A; (-) strand; PAM type: YTN; PAM sequence: TTT
acaaaacataggacaaccac

SEQ ID NO: 48455 - DNA, 20 bp, Artificial Sequence
  Description of Artificial Sequence: Synthetic oligonucleotide
  Target: SCN10A; (-) strand; PAM type: YTN; PAM sequence: CTT
tacaaaacataggacaacca

SEQ ID NO: 48456 - DNA, 20 bp, Artificial Sequence
  Description of Artificial Sequence: Synthetic oligonucleotide
  Target: SCN10A; (-) strand; PAM type: YTN; PAM sequence: TTG
ccctttacaaaacataggac

SEQ ID NO: 48457 - DNA, 20 bp, Artificial Sequence
  Description of Artificial Sequence: Synthetic oligonucleotide
  Target: SCN10A; (-) strand; PAM type: YTN; PAM sequence: CTA
gttgccctttacaaaacata

SEQ ID NO: 48458 - DNA, 20 bp, Artificial Sequence
  Description of Artificial Sequence: Synthetic oligonucleotide
  Target: SCN10A; (-) strand; PAM type: YTN; PAM sequence: CTG
gagccagaggcagctagttg

SEQ ID NO: 48459 - DNA, 20 bp, Artificial Sequence
  Description of Artificial Sequence: Synthetic oligonucleotide
  Target: SCN10A; (-) strand; PAM type: YTN; PAM sequence: TTG
ggatgaacaagcacaggaaa

SEQ ID NO: 48460 - DNA, 20 bp, Artificial Sequence
  Description of Artificial Sequence: Synthetic oligonucleotide
  Target: SCN10A; (-) strand; PAM type: YTN; PAM sequence: TTT
gggatgaacaagcacaggaa

SEQ ID NO: 48461 - DNA, 20 bp, Artificial Sequence
  Description of Artificial Sequence: Synthetic oligonucleotide
  Target: SCN10A; (-) strand; PAM type: YTN; PAM sequence: CTT
tgggatgaacaagcacagga

SEQ ID NO: 48462 - DNA, 20 bp, Artificial Sequence
  Description of Artificial Sequence: Synthetic oligonucleotide
  Target: SCN10A; (-) strand; PAM type: YTN; PAM sequence: CTG
gtgggaatggctttgggatg

SEQ ID NO: 48463 - DNA, 20 bp, Artificial Sequence
  Description of Artificial Sequence: Synthetic oligonucleotide
  Target: SCN10A; (-) strand; PAM type: YTN; PAM sequence: CTG
agctggtgggaatggctttg

SEQ ID NO: 48464 - DNA, 20 bp, Artificial Sequence
  Description of Artificial Sequence: Synthetic oligonucleotide
  Target: SCN10A; (-) strand; PAM type: YTN; PAM sequence: TTC
aggaggtcaagtgtgggagg

SEQ ID NO: 48465 - DNA, 20 bp, Artificial Sequence
  Description of Artificial Sequence: Synthetic oligonucleotide
  Target: SCN10A; (-) strand; PAM type: YTN; PAM sequence: CTG
ggttcaggaggtcaagtgtg

SEQ ID NO: 48466 - DNA, 20 bp, Artificial Sequence
  Description of Artificial Sequence: Synthetic oligonucleotide
  Target: SCN10A; (-) strand; PAM type: YTN; PAM sequence: CTG
agagcagagcagcagtgcag

SEQ ID NO: 48467 - DNA, 20 bp, Artificial Sequence
  Description of Artificial Sequence: Synthetic oligonucleotide
  Target: SCN10A; (-) strand; PAM type: YTN; PAM sequence: TTA
gctgagagcagagcagcagt

SEQ ID NO: 48468 - DNA, 20 bp, Artificial Sequence
  Description of Artificial Sequence: Synthetic oligonucleotide
  Target: SCN10A; (-) strand; PAM type: YTN; PAM sequence: TTG
agccagttagctgagagcag

SEQ ID NO: 48469 - DNA, 20 bp, Artificial Sequence
  Description of Artificial Sequence: Synthetic oligonucleotide
  Target: SCN10A; (-) strand; PAM type: YTN; PAM sequence: TTA
gtgtgttgagccagttagct

SEQ ID NO: 48470 - DNA, 20 bp, Artificial Sequence
  Description of Artificial Sequence: Synthetic oligonucleotide
  Target: SCN10A; (-) strand; PAM type: YTN; PAM sequence: TTG
gttagtgtgttgagccagtt

SEQ ID NO: 48471 - DNA, 20 bp, Artificial Sequence
  Description of Artificial Sequence: Synthetic oligonucleotide
  Target: SCN10A; (-) strand; PAM type: YTN; PAM sequence: TTA
ttggttagtgtgttgagcca

SEQ ID NO: 48472 - DNA, 20 bp, Artificial Sequence
  Description of Artificial Sequence: Synthetic oligonucleotide
  Target: SCN10A; (-) strand; PAM type: YTN; PAM sequence: CTT
attggttagtgtgttgagcc

SEQ ID NO: 48473 - DNA, 20 bp, Artificial Sequence
  Description of Artificial Sequence: Synthetic oligonucleotide
  Target: SCN10A; (-) strand; PAM type: YTN; PAM sequence: TTC
gggtggggtggggcatgccc

SEQ ID NO: 48474 - DNA, 20 bp, Artificial Sequence
  Description of Artificial Sequence: Synthetic oligonucleotide
  Target: SCN10A; (-) strand; PAM type: YTN; PAM sequence: CTG
gcgtggtcggggcggggtgg

SEQ ID NO: 48475 - DNA, 20 bp, Artificial Sequence
  Description of Artificial Sequence: Synthetic oligonucleotide
  Target: SCN10A; (-) strand; PAM type: YTN; PAM sequence: CTC
actggcgtggtcggggcggg

SEQ ID NO: 48476 - DNA, 20 bp, Artificial Sequence
  Description of Artificial Sequence: Synthetic oligonucleotide
  Target: SCN10A; (-) strand; PAM type: YTN; PAM sequence: CTG
ccctcactggcgtggtcggg

SEQ ID NO: 48477 - DNA, 20 bp, Artificial Sequence
  Description of Artificial Sequence: Synthetic oligonucleotide
  Target: SCN10A; (-) strand; PAM type: YTN; PAM sequence: CTG
gtactgccctcactggcgtg

SEQ ID NO: 48478 - DNA, 20 bp, Artificial Sequence
  Description of Artificial Sequence: Synthetic oligonucleotide
  Target: SCN10A; (-) strand; PAM type: YTN; PAM sequence: CTG
gctggtactgccctcactgg

SEQ ID NO: 48479 - DNA, 20 bp, Artificial Sequence
  Description of Artificial Sequence: Synthetic oligonucleotide
  Target: SCN10A; (-) strand; PAM type: YTN; PAM sequence: CTC
tggctggtactgccctcact

SEQ ID NO: 48480 - DNA, 20 bp, Artificial Sequence
  Description of Artificial Sequence: Synthetic oligonucleotide
  Target: SCN10A; (-) strand; PAM type: YTN; PAM sequence: CTC
cagataggcaacatcgtgag

SEQ ID NO: 48481 - DNA, 20 bp, Artificial Sequence
  Description of Artificial Sequence: Synthetic oligonucleotide
  Target: SCN10A; (-) strand; PAM type: YTN; PAM sequence: TTC
gaagccatgctccagatagg

SEQ ID NO: 48482 - DNA, 20 bp, Artificial Sequence
  Description of Artificial Sequence: Synthetic oligonucleotide
  Target: SCN10A; (-) strand; PAM type: YTN; PAM sequence: CTT
cgaagccatgctccagatag

SEQ ID NO: 48483 - DNA, 20 bp, Artificial Sequence
  Description of Artificial Sequence: Synthetic oligonucleotide
  Target: SCN10A; (-) strand; PAM type: YTN; PAM sequence: CTA
ccttcgaagccatgctccag

SEQ ID NO: 48484 - DNA, 20 bp, Artificial Sequence
  Description of Artificial Sequence: Synthetic oligonucleotide
  Target: SCN10A; (-) strand; PAM type: YTN; PAM sequence: TTC
atggccatggagcaccatgg

SEQ ID NO: 48485 - DNA, 20 bp, Artificial Sequence
  Description of Artificial Sequence: Synthetic oligonucleotide
  Target: SCN10A; (-) strand; PAM type: YTN; PAM sequence: CTT
catggccatggagcaccatg

SEQ ID NO: 48486 - DNA, 20 bp, Artificial Sequence
  Description of Artificial Sequence: Synthetic oligonucleotide
  Target: SCN10A; (-) strand; PAM type: YTN; PAM sequence: TTG
tgcatcgtggtgaacaccat

SEQ ID NO: 48487 - DNA, 20 bp, Artificial Sequence
  Description of Artificial Sequence: Synthetic oligonucleotide
  Target: SCN10A; (-) strand; PAM type: YTN; PAM sequence: CTT
gtgcatcgtggtgaacacca

SEQ ID NO: 48488 - DNA, 20 bp, Artificial Sequence
  Description of Artificial Sequence: Synthetic oligonucleotide
  Target: SCN10A; (-) strand; PAM type: YTN; PAM sequence: CTC
accatcaccttgtgcatcgt

SEQ ID NO: 48489 - DNA, 20 bp, Artificial Sequence
  Description of Artificial Sequence: Synthetic oligonucleotide
  Target: SCN10A; (-) strand; PAM type: YTN; PAM sequence: TTG
cagagctcaccatcaccttg

SEQ ID NO: 48490 - DNA, 20 bp, Artificial Sequence
  Description of Artificial Sequence: Synthetic oligonucleotide
  Target: SCN10A; (-) strand; PAM type: YTN; PAM sequence: TTT
gcagagctcaccatcacctt

SEQ ID NO: 48491 - DNA, 20 bp, Artificial Sequence
  Description of Artificial Sequence: Synthetic oligonucleotide
  Target: SCN10A; (-) strand; PAM type: YTN; PAM sequence: CTT
tgcagagctcaccatcacct

SEQ ID NO: 48492 - DNA, 20 bp, Artificial Sequence
  Description of Artificial Sequence: Synthetic oligonucleotide
  Target: SCN10A; (-) strand; PAM type: YTN; PAM sequence: TTG
tgacggatccctttgcagag

SEQ ID NO: 48493 - DNA, 20 bp, Artificial Sequence
  Description of Artificial Sequence: Synthetic oligonucleotide
  Target: SCN10A; (-) strand; PAM type: YTN; PAM sequence: CTT
gtgacggatccctttgcaga

SEQ ID NO: 48494 - DNA, 20 bp, Artificial Sequence
  Description of Artificial Sequence: Synthetic oligonucleotide
  Target: SCN10A; (-) strand; PAM type: YTN; PAM sequence: TTG
ggcttgtgacggatcccttt

SEQ ID NO: 48495 - DNA, 20 bp, Artificial Sequence
  Description of Artificial Sequence: Synthetic oligonucleotide
  Target: SCN10A; (-) strand; PAM type: YTN; PAM sequence: TTT
gggcttgtgacggatccctt

SEQ ID NO: 48496 - DNA, 20 bp, Artificial Sequence
  Description of Artificial Sequence: Synthetic oligonucleotide
  Target: SCN10A; (-) strand; PAM type: YTN; PAM sequence: CTT
tgggcttgtgacggatccct

SEQ ID NO: 48497 - DNA, 20 bp, Artificial Sequence
  Description of Artificial Sequence: Synthetic oligonucleotide
  Target: SCN10A; (-) strand; PAM type: YTN; PAM sequence: CTC
tttgggcttgtgacggatcc

SEQ ID NO: 48498 - DNA, 20 bp, Artificial Sequence
  Description of Artificial Sequence: Synthetic oligonucleotide
  Target: SCN10A; (-) strand; PAM type: YTN; PAM sequence: TTC
tctttgggcttgtgacggat

SEQ ID NO: 48499 - DNA, 20 bp, Artificial Sequence
  Description of Artificial Sequence: Synthetic oligonucleotide
  Target: SCN10A; (-) strand; PAM type: YTN; PAM sequence: CTC
aagacaattctctttgggct

SEQ ID NO: 48500 - DNA, 20 bp, Artificial Sequence
  Description of Artificial Sequence: Synthetic oligonucleotide
  Target: SCN10A; (-) strand; PAM type: YTN; PAM sequence: CTG
ccccatgtgggtgaagctca

SEQ ID NO: 48501 - DNA, 20 bp, Artificial Sequence
  Description of Artificial Sequence: Synthetic oligonucleotide
  Target: SCN10A; (-) strand; PAM type: YTN; PAM sequence: TTG
ctgccccatgtgggtgaagc

SEQ ID NO: 48502 - DNA, 20 bp, Artificial Sequence
  Description of Artificial Sequence: Synthetic oligonucleotide
  Target: SCN10A; (-) strand; PAM type: YTN; PAM sequence: CTG
ggattgctgccccatgtggg

SEQ ID NO: 48503 - DNA, 20 bp, Artificial Sequence
  Description of Artificial Sequence: Synthetic oligonucleotide
  Target: SCN10A; (-) strand; PAM type: YTN; PAM sequence: CTG
atctgggattgctgccccat

SEQ ID NO: 48504 - DNA, 20 bp, Artificial Sequence
  Description of Artificial Sequence: Synthetic oligonucleotide
  Target: SCN10A; (-) strand; PAM type: YTN; PAM sequence: CTC
agaagtatctgatctgggat

SEQ ID NO: 48505 - DNA, 20 bp, Artificial Sequence
  Description of Artificial Sequence: Synthetic oligonucleotide
  Target: SCN10A; (-) strand; PAM type: YTN; PAM sequence: TTG
tctcagaagtatctgatctg

SEQ ID NO: 48506 - DNA, 20 bp, Artificial Sequence
  Description of Artificial Sequence: Synthetic oligonucleotide
  Target: SCN10A; (-) strand; PAM type: YTN; PAM sequence: CTT
gtctcagaagtatctgatct

SEQ ID NO: 48507 - DNA, 20 bp, Artificial Sequence
  Description of Artificial Sequence: Synthetic oligonucleotide
  Target: SCN10A; (-) strand; PAM type: YTN; PAM sequence: TTG
accagcttgtctcagaagta

SEQ ID NO: 48508 - DNA, 20 bp, Artificial Sequence
  Description of Artificial Sequence: Synthetic oligonucleotide
  Target: SCN10A; (-) strand; PAM type: YTN; PAM sequence: CTT
gaccagcttgtctcagaagt

SEQ ID NO: 48509 - DNA, 20 bp, Artificial Sequence
  Description of Artificial Sequence: Synthetic oligonucleotide
  Target: SCN10A; (-) strand; PAM type: YTN; PAM sequence: CTG
cttgaccagcttgtctcaga

SEQ ID NO: 48510 - DNA, 20 bp, Artificial Sequence
  Description of Artificial Sequence: Synthetic oligonucleotide
  Target: SCN10A; (-) strand; PAM type: YTN; PAM sequence: CTG
aacagaagtgcccaccctgc

SEQ ID NO: 48511 - DNA, 20 bp, Artificial Sequence
  Description of Artificial Sequence: Synthetic oligonucleotide
  Target: SCN10A; (-) strand; PAM type: YTN; PAM sequence: CTC
gaggagtctgaacagaagtg

SEQ ID NO: 48512 - DNA, 20 bp, Artificial Sequence
  Description of Artificial Sequence: Synthetic oligonucleotide
  Target: SCN10A; (-) strand; PAM type: YTN; PAM sequence: CTA
taatgcagaactcgaggagt

SEQ ID NO: 48513 - DNA, 20 bp, Artificial Sequence
  Description of Artificial Sequence: Synthetic oligonucleotide
  Target: SCN10A; (-) strand; PAM type: YTN; PAM sequence: TTG
accacactataatgcagaac

SEQ ID NO: 48514 - DNA, 20 bp, Artificial Sequence
  Description of Artificial Sequence: Synthetic oligonucleotide
  Target: SCN10A; (-) strand; PAM type: YTN; PAM sequence: CTG
tcattgaccacactataatg

SEQ ID NO: 48515 - DNA, 20 bp, Artificial Sequence
  Description of Artificial Sequence: Synthetic oligonucleotide
  Target: SCN10A; (-) strand; PAM type: YTN; PAM sequence: CTG
acagctgtcattgaccacac

SEQ ID NO: 48516 - DNA, 20 bp, Artificial Sequence
  Description of Artificial Sequence: Synthetic oligonucleotide
  Target: SCN10A; (-) strand; PAM type: YTN; PAM sequence: TTG
gggtccaaggtgacacatgg

SEQ ID NO: 48517 - DNA, 20 bp, Artificial Sequence
  Description of Artificial Sequence: Synthetic oligonucleotide
  Target: SCN10A; (-) strand; PAM type: YTN; PAM sequence: CTA
gaggatgaccgcagaattgg

SEQ ID NO: 48518 - DNA, 20 bp, Artificial Sequence
  Description of Artificial Sequence: Synthetic oligonucleotide
  Target: SCN10A; (-) strand; PAM type: YTN; PAM sequence: TTA
acaacaaggtctagaggatg

SEQ ID NO: 48519 - DNA, 20 bp, Artificial Sequence
  Description of Artificial Sequence: Synthetic oligonucleotide
  Target: SCN10A; (-) strand; PAM type: YTN; PAM sequence: TTA
ttaacaacaaggtctagagg

SEQ ID NO: 48520 - DNA, 20 bp, Artificial Sequence
  Description of Artificial Sequence: Synthetic oligonucleotide
  Target: SCN10A; (-) strand; PAM type: YTN; PAM sequence: TTA
ttattaacaacaaggtctag

SEQ ID NO: 48521 - DNA, 20 bp, Artificial Sequence
  Description of Artificial Sequence: Synthetic oligonucleotide
  Target: SCN10A; (-) strand; PAM type: YTN; PAM sequence: CTT
attattaacaacaaggtcta

SEQ ID NO: 48522 - DNA, 20 bp, Artificial Sequence
  Description of Artificial Sequence: Synthetic oligonucleotide
  Target: SCN10A; (-) strand; PAM type: YTN; PAM sequence: TTG
gaggtggtacttattattaa

SEQ ID NO: 48523 - DNA, 20 bp, Artificial Sequence
  Description of Artificial Sequence: Synthetic oligonucleotide
  Target: SCN10A; (-) strand; PAM type: YTN; PAM sequence: CTG
aagtcaaaatgttggaggtg

SEQ ID NO: 48524 - DNA, 20 bp, Artificial Sequence
  Description of Artificial Sequence: Synthetic oligonucleotide
  Target: SCN10A; (-) strand; PAM type: YTN; PAM sequence: TTC
aaaatataggaaatgaatac

SEQ ID NO: 48525 - DNA, 20 bp, Artificial Sequence
  Description of Artificial Sequence: Synthetic oligonucleotide
  Target: SCN10A; (-) strand; PAM type: YTN; PAM sequence: CTA
aaggagttcaaaatatagga

SEQ ID NO: 48526 - DNA, 20 bp, Artificial Sequence
  Description of Artificial Sequence: Synthetic oligonucleotide
  Target: SCN10A; (-) strand; PAM type: YTN; PAM sequence: TTG
caggactaaaggagttcaaa

SEQ ID NO: 48527 - DNA, 20 bp, Artificial Sequence
  Description of Artificial Sequence: Synthetic oligonucleotide
  Target: SCN10A; (-) strand; PAM type: YTN; PAM sequence: TTG
gagttgcaggactaaaggag

SEQ ID NO: 48528 - DNA, 20 bp, Artificial Sequence
  Description of Artificial Sequence: Synthetic oligonucleotide
  Target: SCN10A; (-) strand; PAM type: YTN; PAM sequence: TTA
attggagttgcaggactaaa

SEQ ID NO: 48529 - DNA, 20 bp, Artificial Sequence
  Description of Artificial Sequence: Synthetic oligonucleotide
  Target: SCN10A; (-) strand; PAM type: YTN; PAM sequence: CTG
gatggggcagatattaattg

SEQ ID NO: 48530 - DNA, 20 bp, Artificial Sequence
  Description of Artificial Sequence: Synthetic oligonucleotide
  Target: SCN10A; (-) strand; PAM type: YTN; PAM sequence: TTA
aaggactggatggggcagat

SEQ ID NO: 48531 - DNA, 20 bp, Artificial Sequence
  Description of Artificial Sequence: Synthetic oligonucleotide
  Target: SCN10A; (-) strand; PAM type: YTN; PAM sequence: TTT
aaaggactggatggggcaga

SEQ ID NO: 48532 - DNA, 20 bp, Artificial Sequence
  Description of Artificial Sequence: Synthetic oligonucleotide
  Target: SCN10A; (-) strand; PAM type: YTN; PAM sequence: TTG
agaagtaaggacatgatata

SEQ ID NO: 48533 - DNA, 20 bp, Artificial Sequence
  Description of Artificial Sequence: Synthetic oligonucleotide
  Target: SCN10A; (-) strand; PAM type: YTN; PAM sequence: CTG
ggcaaattgagaagtaagga

SEQ ID NO: 48534 - DNA, 20 bp, Artificial Sequence
  Description of Artificial Sequence: Synthetic oligonucleotide
  Target: SCN10A; (-) strand; PAM type: YTN; PAM sequence: CTA
agctgggcaaattgagaagt

SEQ ID NO: 48535 - DNA, 20 bp, Artificial Sequence
  Description of Artificial Sequence: Synthetic oligonucleotide
  Target: SCN10A; (-) strand; PAM type: YTN; PAM sequence: TTA
gagagatggatgtgaaatct

SEQ ID NO: 48536 - DNA, 20 bp, Artificial Sequence
  Description of Artificial Sequence: Synthetic oligonucleotide
  Target: SCN10A; (-) strand; PAM type: YTN; PAM sequence: CTA
caagggagtagttagagaga

SEQ ID NO: 48537 - DNA, 20 bp, Artificial Sequence
  Description of Artificial Sequence: Synthetic oligonucleotide
  Target: SCN10A; (-) strand; PAM type: YTN; PAM sequence: TTG
agggtgcctacaagggagta

SEQ ID NO: 48538 - DNA, 20 bp, Artificial Sequence
  Description of Artificial Sequence: Synthetic oligonucleotide
  Target: SCN10A; (-) strand; PAM type: YTN; PAM sequence: TTG
ccaggcaagtacaatgaagg

SEQ ID NO: 48539 - DNA, 20 bp, Artificial Sequence
  Description of Artificial Sequence: Synthetic oligonucleotide
  Target: SCN10A; (-) strand; PAM type: YTN; PAM sequence: TTT
gccaggcaagtacaatgaag

SEQ ID NO: 48540 - DNA, 20 bp, Artificial Sequence
  Description of Artificial Sequence: Synthetic oligonucleotide
  Target: SCN10A; (-) strand; PAM type: YTN; PAM sequence: TTT
tgccaggcaagtacaatgaa

SEQ ID NO: 48541 - DNA, 20 bp, Artificial Sequence
  Description of Artificial Sequence: Synthetic oligonucleotide
  Target: SCN10A; (-) strand; PAM type: YTN; PAM sequence: TTC
aggttttgccaggcaagtac

SEQ ID NO: 48542 - DNA, 20 bp, Artificial Sequence
  Description of Artificial Sequence: Synthetic oligonucleotide
  Target: SCN10A; (-) strand; PAM type: YTN; PAM sequence: TTC
acagttcaggttttgccagg

SEQ ID NO: 48543 - DNA, 20 bp, Artificial Sequence
  Description of Artificial Sequence: Synthetic oligonucleotide
  Target: SCN10A; (-) strand; PAM type: YTN; PAM sequence: CTA
ttcacagttcaggttttgcc

SEQ ID NO: 48544 - DNA, 20 bp, Artificial Sequence
  Description of Artificial Sequence: Synthetic oligonucleotide
  Target: SCN10A; (-) strand; PAM type: YTN; PAM sequence: TTG
ggtctattcacagttcaggt

SEQ ID NO: 48545 - DNA, 20 bp, Artificial Sequence
  Description of Artificial Sequence: Synthetic oligonucleotide
  Target: SCN10A; (-) strand; PAM type: YTN; PAM sequence: CTA
caaattgggtctattcacag

SEQ ID NO: 48546 - DNA, 20 bp, Artificial Sequence
  Description of Artificial Sequence: Synthetic oligonucleotide
  Target: SCN10A; (-) strand; PAM type: YTN; PAM sequence: TTG
ggtgcaagtacagagtagtc

SEQ ID NO: 48547 - DNA, 20 bp, Artificial Sequence
  Description of Artificial Sequence: Synthetic oligonucleotide
  Target: SCN10A; (-) strand; PAM type: YTN; PAM sequence: CTG
gttgggtgcaagtacagagt

SEQ ID NO: 48548 - DNA, 20 bp, Artificial Sequence
  Description of Artificial Sequence: Synthetic oligonucleotide
  Target: SCN10A; (-) strand; PAM type: YTN; PAM sequence: TTC
cagccaggtccagctggttg

SEQ ID NO: 48549 - DNA, 20 bp, Artificial Sequence
  Description of Artificial Sequence: Synthetic oligonucleotide
  Target: SCN10A; (-) strand; PAM type: YTN; PAM sequence: TTT
ccagccaggtccagctggtt

SEQ ID NO: 48550 - DNA, 20 bp, Artificial Sequence
  Description of Artificial Sequence: Synthetic oligonucleotide
  Target: SCN10A; (-) strand; PAM type: YTN; PAM sequence: TTT
tccagccaggtccagctggt

SEQ ID NO: 48551 - DNA, 20 bp, Artificial Sequence
  Description of Artificial Sequence: Synthetic oligonucleotide
  Target: SCN10A; (-) strand; PAM type: YTN; PAM sequence: TTT
ttccagccaggtccagctgg

SEQ ID NO: 48552 - DNA, 20 bp, Artificial Sequence
  Description of Artificial Sequence: Synthetic oligonucleotide
  Target: SCN10A; (-) strand; PAM type: YTN; PAM sequence: TTT
tttccagccaggtccagctg

SEQ ID NO: 48553 - DNA, 20 bp, Artificial Sequence
  Description of Artificial Sequence: Synthetic oligonucleotide
  Target: SCN10A; (-) strand; PAM type: YTN; PAM sequence: TTG
tgtattttttccagccaggt

SEQ ID NO: 48554 - DNA, 20 bp, Artificial Sequence
  Description of Artificial Sequence: Synthetic oligonucleotide
  Target: SCN10A; (-) strand; PAM type: YTN; PAM sequence: TTG
gtaagcatagttgtgtattt

SEQ ID NO: 48555 - DNA, 20 bp, Artificial Sequence
  Description of Artificial Sequence: Synthetic oligonucleotide
  Target: SCN10A; (-) strand; PAM type: YTN; PAM sequence: CTA
ggagggttggtaagcatagt

SEQ ID NO: 48556 - DNA, 20 bp, Artificial Sequence
  Description of Artificial Sequence: Synthetic oligonucleotide
  Target: SCN10A; (-) strand; PAM type: YTN; PAM sequence: CTC
taggagggttggtaagcata

SEQ ID NO: 48557 - DNA, 20 bp, Artificial Sequence
  Description of Artificial Sequence: Synthetic oligonucleotide
  Target: SCN10A; (-) strand; PAM type: YTN; PAM sequence: CTC
acagatctctaggagggttg

SEQ ID NO: 48558 - DNA, 20 bp, Artificial Sequence
  Description of Artificial Sequence: Synthetic oligonucleotide
  Target: SCN10A; (-) strand; PAM type: YTN; PAM sequence: CTG
gggctcacagatctctagga

SEQ ID NO: 48559 - DNA, 20 bp, Artificial Sequence
  Description of Artificial Sequence: Synthetic oligonucleotide
  Target: SCN10A; (-) strand; PAM type: YTN; PAM sequence: CTG
ggcagggcaaggctggggct

SEQ ID NO: 48560 - DNA, 20 bp, Artificial Sequence
  Description of Artificial Sequence: Synthetic oligonucleotide
  Target: SCN10A; (-) strand; PAM type: YTN; PAM sequence: TTC
tgggcagggcaaggctgggg

SEQ ID NO: 48561 - DNA, 20 bp, Artificial Sequence
  Description of Artificial Sequence: Synthetic oligonucleotide
  Target: SCN10A; (-) strand; PAM type: YTN; PAM sequence: TTT
ctgggcagggcaaggctggg

SEQ ID NO: 48562 - DNA, 20 bp, Artificial Sequence
  Description of Artificial Sequence: Synthetic oligonucleotide
  Target: SCN10A; (-) strand; PAM type: YTN; PAM sequence: CTG
gaagaatgaaggaatggaat

SEQ ID NO: 48563 - DNA, 20 bp, Artificial Sequence
  Description of Artificial Sequence: Synthetic oligonucleotide
  Target: SCN10A; (-) strand; PAM type: YTN; PAM sequence: TTA
gacgggggaagaggaagtga

SEQ ID NO: 48564 - DNA, 20 bp, Artificial Sequence
  Description of Artificial Sequence: Synthetic oligonucleotide
  Target: SCN10A; (-) strand; PAM type: YTN; PAM sequence: CTC
atcaacagagagtaagtaga

SEQ ID NO: 48565 - DNA, 20 bp, Artificial Sequence
  Description of Artificial Sequence: Synthetic oligonucleotide
  Target: SCN10A; (-) strand; PAM type: YTN; PAM sequence: CTG
agtgaaataaaagggagctc

SEQ ID NO: 48566 - DNA, 20 bp, Artificial Sequence
  Description of Artificial Sequence: Synthetic oligonucleotide
  Target: SCN10A; (-) strand; PAM type: YTN; PAM sequence: TTC
tgagtgaaataaaagggagc

SEQ ID NO: 48567 - DNA, 20 bp, Artificial Sequence
  Description of Artificial Sequence: Synthetic oligonucleotide
  Target: SCN10A; (-) strand; PAM type: YTN; PAM sequence: CTA
tattctgagtgaaataaaag

SEQ ID NO: 48568 - DNA, 20 bp, Artificial Sequence
  Description of Artificial Sequence: Synthetic oligonucleotide
  Target: SCN10A; (-) strand; PAM type: YTN; PAM sequence: CTA
gtctatattctgagtgaaat

SEQ ID NO: 48569 - DNA, 20 bp, Artificial Sequence
  Description of Artificial Sequence: Synthetic oligonucleotide
  Target: SCN10A; (-) strand; PAM type: YTN; PAM sequence: TTG
tgaactagtctatattctga

SEQ ID NO: 48570 - DNA, 20 bp, Artificial Sequence
  Description of Artificial Sequence: Synthetic oligonucleotide
  Target: SCN10A; (-) strand; PAM type: YTN; PAM sequence: TTT
gtgaactagtctatattctg

SEQ ID NO: 48571 - DNA, 20 bp, Artificial Sequence
  Description of Artificial Sequence: Synthetic oligonucleotide
  Target: SCN10A; (-) strand; PAM type: YTN; PAM sequence: TTT
tgtgaactagtctatattct

SEQ ID NO: 48572 - DNA, 20 bp, Artificial Sequence
  Description of Artificial Sequence: Synthetic oligonucleotide
  Target: SCN10A; (-) strand; PAM type: YTN; PAM sequence: CTT
ttgtgaactagtctatattc

SEQ ID NO: 48573 - DNA, 20 bp, Artificial Sequence
  Description of Artificial Sequence: Synthetic oligonucleotide
  Target: SCN10A; (-) strand; PAM type: YTN; PAM sequence: TTC
ttttgtgaactagtctatat

SEQ ID NO: 48574 - DNA, 20 bp, Artificial Sequence
  Description of Artificial Sequence: Synthetic oligonucleotide
  Target: SCN10A; (-) strand; PAM type: YTN; PAM sequence: TTA
gtggtaggaagaaggggaag

SEQ ID NO: 48575 - DNA, 20 bp, Artificial Sequence
  Description of Artificial Sequence: Synthetic oligonucleotide
  Target: SCN10A; (-) strand; PAM type: YTN; PAM sequence: TTT
agtggtaggaagaaggggaa

SEQ ID NO: 48576 - DNA, 20 bp, Artificial Sequence
  Description of Artificial Sequence: Synthetic oligonucleotide
  Target: SCN10A; (-) strand; PAM type: YTN; PAM sequence: TTG
cagatatgccagagatttag

SEQ ID NO: 48577 - DNA, 20 bp, Artificial Sequence
  Description of Artificial Sequence: Synthetic oligonucleotide
  Target: SCN10A; (-) strand; PAM type: YTN; PAM sequence: CTT
gcagatatgccagagattta

SEQ ID NO: 48578 - DNA, 20 bp, Artificial Sequence
  Description of Artificial Sequence: Synthetic oligonucleotide
  Target: SCN10A; (-) strand; PAM type: YTN; PAM sequence: CTG
tgtggggcacgaagacagaa

SEQ ID NO: 48579 - DNA, 20 bp, Artificial Sequence
  Description of Artificial Sequence: Synthetic oligonucleotide
  Target: SCN10A; (-) strand; PAM type: YTN; PAM sequence: TTG
aataggtgggagaggaaaga

SEQ ID NO: 48580 - DNA, 20 bp, Artificial Sequence
  Description of Artificial Sequence: Synthetic oligonucleotide
  Target: SCN10A; (-) strand; PAM type: YTN; PAM sequence: CTT
gaataggtgggagaggaaag

SEQ ID NO: 48581 - DNA, 20 bp, Artificial Sequence
  Description of Artificial Sequence: Synthetic oligonucleotide
  Target: SCN10A; (-) strand; PAM type: YTN; PAM sequence: CTG
gatgatgcaggccttgaata

SEQ ID NO: 48582 - DNA, 20 bp, Artificial Sequence
  Description of Artificial Sequence: Synthetic oligonucleotide
  Target: SCN10A; (-) strand; PAM type: YTN; PAM sequence: CTG
gaagggagacaggtctggat

SEQ ID NO: 48583 - DNA, 20 bp, Artificial Sequence
  Description of Artificial Sequence: Synthetic oligonucleotide
  Target: SCN10A; (-) strand; PAM type: YTN; PAM sequence: CTC
atggcaatggtctggaaggg

SEQ ID NO: 48584 - DNA, 20 bp, Artificial Sequence
  Description of Artificial Sequence: Synthetic oligonucleotide
  Target: SCN10A; (-) strand; PAM type: YTN; PAM sequence: CTG
ctcatggcaatggtctggaa

SEQ ID NO: 48585 - DNA, 20 bp, Artificial Sequence
  Description of Artificial Sequence: Synthetic oligonucleotide
  Target: SCN10A; (-) strand; PAM type: YTN; PAM sequence: TTA
cctgctcatggcaatggtct

SEQ ID NO: 48586 - DNA, 20 bp, Artificial Sequence
  Description of Artificial Sequence: Synthetic oligonucleotide
  Target: SCN10A; (-) strand; PAM type: YTN; PAM sequence: TTT
acctgctcatggcaatggtc

SEQ ID NO: 48587 - DNA, 20 bp, Artificial Sequence
  Description of Artificial Sequence: Synthetic oligonucleotide
  Target: SCN10A; (-) strand; PAM type: YTN; PAM sequence: TTA
aagcatgtttacctgctcat

SEQ ID NO: 48588 - DNA, 20 bp, Artificial Sequence
  Description of Artificial Sequence: Synthetic oligonucleotide
  Target: SCN10A; (-) strand; PAM type: YTN; PAM sequence: TTC
aaagccgcgagataattaaa

SEQ ID NO: 48589 - DNA, 20 bp, Artificial Sequence
  Description of Artificial Sequence: Synthetic oligonucleotide
  Target: SCN10A; (-) strand; PAM type: YTN; PAM sequence: TTT
caaagccgcgagataattaa

SEQ ID NO: 48590 - DNA, 20 bp, Artificial Sequence
  Description of Artificial Sequence: Synthetic oligonucleotide
  Target: SCN10A; (-) strand; PAM type: YTN; PAM sequence: TTT
tcaaagccgcgagataatta

SEQ ID NO: 48591 - DNA, 20 bp, Artificial Sequence
  Description of Artificial Sequence: Synthetic oligonucleotide
  Target: SCN10A; (-) strand; PAM type: YTN; PAM sequence: TTT
ttcaaagccgcgagataatt

SEQ ID NO: 48592 - DNA, 20 bp, Artificial Sequence
  Description of Artificial Sequence: Synthetic oligonucleotide
  Target: SCN10A; (-) strand; PAM type: YTN; PAM sequence: CTT
tttcaaagccgcgagataat

SEQ ID NO: 48593 - DNA, 20 bp, Artificial Sequence
  Description of Artificial Sequence: Synthetic oligonucleotide
  Target: SCN10A; (-) strand; PAM type: YTN; PAM sequence: CTG
tcaaagaagcagtaatgaaa

SEQ ID NO: 48594 - DNA, 20 bp, Artificial Sequence
  Description of Artificial Sequence: Synthetic oligonucleotide
  Target: SCN10A; (-) strand; PAM type: YTN; PAM sequence: TTA
ctgtcaaagaagcagtaatg

SEQ ID NO: 48595 - DNA, 20 bp, Artificial Sequence
  Description of Artificial Sequence: Synthetic oligonucleotide
  Target: SCN10A; (-) strand; PAM type: YTN; PAM sequence: TTT
actgtcaaagaagcagtaat

SEQ ID NO: 48596 - DNA, 20 bp, Artificial Sequence
  Description of Artificial Sequence: Synthetic oligonucleotide
  Target: SCN10A; (-) strand; PAM type: YTN; PAM sequence: TTT
tactgtcaaagaagcagtaa

SEQ ID NO: 48597 - DNA, 20 bp, Artificial Sequence
  Description of Artificial Sequence: Synthetic oligonucleotide
  Target: SCN10A; (-) strand; PAM type: YTN; PAM sequence: TTG
caaggaattttactgtcaaa

SEQ ID NO: 48598 - DNA, 20 bp, Artificial Sequence
  Description of Artificial Sequence: Synthetic oligonucleotide
  Target: SCN10A; (-) strand; PAM type: YTN; PAM sequence: CTT
gcaaggaattttactgtcaa

SEQ ID NO: 48599 - DNA, 20 bp, Artificial Sequence
  Description of Artificial Sequence: Synthetic oligonucleotide
  Target: SCN10A; (-) strand; PAM type: YTN; PAM sequence: CTC
ttgcaaggaattttactgtc

SEQ ID NO: 48600 - DNA, 20 bp, Artificial Sequence
  Description of Artificial Sequence: Synthetic oligonucleotide
  Target: SCN10A; (-) strand; PAM type: YTN; PAM sequence: TTA
agtgtagaaaactcttgcaa

SEQ ID NO: 48601 - DNA, 20 bp, Artificial Sequence
  Description of Artificial Sequence: Synthetic oligonucleotide
  Target: SCN10A; (-) strand; PAM type: YTN; PAM sequence: CTG
tagaaggttaagtgtagaaa

SEQ ID NO: 48602 - DNA, 20 bp, Artificial Sequence
  Description of Artificial Sequence: Synthetic oligonucleotide
  Target: SCN10A; (-) strand; PAM type: YTN; PAM sequence: CTG
cagagaaaaaaagaggtaag

SEQ ID NO: 48603 - DNA, 20 bp, Artificial Sequence
  Description of Artificial Sequence: Synthetic oligonucleotide
  Target: SCN10A; (-) strand; PAM type: YTN; PAM sequence: TTC
caggggctgcagagaaaaaa

SEQ ID NO: 48604 - DNA, 20 bp, Artificial Sequence
  Description of Artificial Sequence: Synthetic oligonucleotide
  Target: SCN10A; (-) strand; PAM type: YTN; PAM sequence: TTA
aagtcagattccaggggctg

SEQ ID NO: 48605 - DNA, 20 bp, Artificial Sequence
  Description of Artificial Sequence: Synthetic oligonucleotide
  Target: SCN10A; (-) strand; PAM type: YTN; PAM sequence: TTG
gaagcagttaaagtcagatt

SEQ ID NO: 48606 - DNA, 20 bp, Artificial Sequence
  Description of Artificial Sequence: Synthetic oligonucleotide
  Target: SCN10A; (-) strand; PAM type: YTN; PAM sequence: TTT
ggaagcagttaaagtcagat

SEQ ID NO: 48607 - DNA, 20 bp, Artificial Sequence
  Description of Artificial Sequence: Synthetic oligonucleotide
  Target: SCN10A; (-) strand; PAM type: YTN; PAM sequence: TTG
aatttggaagcagttaaagt

SEQ ID NO: 48608 - DNA, 20 bp, Artificial Sequence
  Description of Artificial Sequence: Synthetic oligonucleotide
  Target: SCN10A; (-) strand; PAM type: YTN; PAM sequence: TTT
gaatttggaagcagttaaag

SEQ ID NO: 48609 - DNA, 20 bp, Artificial Sequence
  Description of Artificial Sequence: Synthetic oligonucleotide
  Target: SCN10A; (-) strand; PAM type: YTN; PAM sequence: TTA
tttgaatttggaagcagtta

SEQ ID NO: 48610 - DNA, 20 bp, Artificial Sequence
  Description of Artificial Sequence: Synthetic oligonucleotide
  Target: SCN10A; (-) strand; PAM type: YTN; PAM sequence: CTG
gaaatcaattatttgaattt

SEQ ID NO: 48611 - DNA, 20 bp, Artificial Sequence
  Description of Artificial Sequence: Synthetic oligonucleotide
  Target: SCN10A; (-) strand; PAM type: YTN; PAM sequence: TTA
taagggtaagatgagaactg

SEQ ID NO: 48612 - DNA, 20 bp, Artificial Sequence
  Description of Artificial Sequence: Synthetic oligonucleotide
  Target: SCN10A; (-) strand; PAM type: YTN; PAM sequence: CTG
tcaaatgttataagggtaag

SEQ ID NO: 48613 - DNA, 20 bp, Artificial Sequence
  Description of Artificial Sequence: Synthetic oligonucleotide
  Target: SCN10A; (-) strand; PAM type: YTN; PAM sequence: TTC
tgtcaaatgttataagggta

SEQ ID NO: 48614 - DNA, 20 bp, Artificial Sequence
  Description of Artificial Sequence: Synthetic oligonucleotide
  Target: SCN10A; (-) strand; PAM type: YTN; PAM sequence: TTC
aaagagaacaatataaattc

SEQ ID NO: 48615 - DNA, 20 bp, Artificial Sequence
  Description of Artificial Sequence: Synthetic oligonucleotide
  Target: SCN10A; (-) strand; PAM type: YTN; PAM sequence: TTT
caaagagaacaatataaatt

SEQ ID NO: 48616 - DNA, 20 bp, Artificial Sequence
  Description of Artificial Sequence: Synthetic oligonucleotide
  Target: SCN10A; (-) strand; PAM type: YTN; PAM sequence: CTG
gtttcaaagagaacaatata

SEQ ID NO: 48617 - DNA, 20 bp, Artificial Sequence
  Description of Artificial Sequence: Synthetic oligonucleotide
  Target: SCN10A; (-) strand; PAM type: YTN; PAM sequence: TTA
caagcaggaaaggaaaaggg

SEQ ID NO: 48618 - DNA, 20 bp, Artificial Sequence
  Description of Artificial Sequence: Synthetic oligonucleotide
  Target: SCN10A; (-) strand; PAM type: YTN; PAM sequence: TTT
acaagcaggaaaggaaaagg

SEQ ID NO: 48619 - DNA, 20 bp, Artificial Sequence
  Description of Artificial Sequence: Synthetic oligonucleotide
  Target: SCN10A; (-) strand; PAM type: YTN; PAM sequence: TTC
aacatttacaagcaggaaag

SEQ ID NO: 48620 - DNA, 20 bp, Artificial Sequence
  Description of Artificial Sequence: Synthetic oligonucleotide
  Target: SCN10A; (-) strand; PAM type: YTN; PAM sequence: TTA
ttcaacatttacaagcagga

SEQ ID NO: 48621 - DNA, 20 bp, Artificial Sequence
  Description of Artificial Sequence: Synthetic oligonucleotide
  Target: SCN10A; (-) strand; PAM type: YTN; PAM sequence: TTG
agttattcaacatttacaag

SEQ ID NO: 48622 - DNA, 20 bp, Artificial Sequence
  Description of Artificial Sequence: Synthetic oligonucleotide
  Target: SCN10A; (-) strand; PAM type: YTN; PAM sequence: CTT
gagttattcaacatttacaa

SEQ ID NO: 48623 - DNA, 20 bp, Artificial Sequence
  Description of Artificial Sequence: Synthetic oligonucleotide
  Target: SCN10A; (-) strand; PAM type: YTN; PAM sequence: CTA
aggtgagaatgcttgagtta

SEQ ID NO: 48624 - DNA, 20 bp, Artificial Sequence
  Description of Artificial Sequence: Synthetic oligonucleotide
  Target: SCN10A; (-) strand; PAM type: YTN; PAM sequence: TTC
aaaaacacagagaagctaag

SEQ ID NO: 48625 - DNA, 20 bp, Artificial Sequence
  Description of Artificial Sequence: Synthetic oligonucleotide
  Target: SCN10A; (-) strand; PAM type: YTN; PAM sequence: CTA
tgagattcaaaaacacagag

SEQ ID NO: 48626 - DNA, 20 bp, Artificial Sequence
  Description of Artificial Sequence: Synthetic oligonucleotide
  Target: SCN10A; (-) strand; PAM type: YTN; PAM sequence: TTA
gggctatgagattcaaaaac

SEQ ID NO: 48627 - DNA, 20 bp, Artificial Sequence
  Description of Artificial Sequence: Synthetic oligonucleotide
  Target: SCN10A; (-) strand; PAM type: YTN; PAM sequence: TTT
agggctatgagattcaaaaa

SEQ ID NO: 48628 - DNA, 20 bp, Artificial Sequence
  Description of Artificial Sequence: Synthetic oligonucleotide
  Target: SCN10A; (-) strand; PAM type: YTN; PAM sequence: TTT
tagggctatgagattcaaaa

SEQ ID NO: 48629 - DNA, 20 bp, Artificial Sequence
  Description of Artificial Sequence: Synthetic oligonucleotide
  Target: SCN10A; (-) strand; PAM type: YTN; PAM sequence: TTT
ttagggctatgagattcaaa

SEQ ID NO: 48630 - DNA, 20 bp, Artificial Sequence
  Description of Artificial Sequence: Synthetic oligonucleotide
  Target: SCN10A; (-) strand; PAM type: YTN; PAM sequence: TTT
tttagggctatgagattcaa

SEQ ID NO: 48631 - DNA, 20 bp, Artificial Sequence
  Description of Artificial Sequence: Synthetic oligonucleotide
  Target: SCN10A; (-) strand; PAM type: YTN; PAM sequence: TTG
gcatagagatggttttttag

SEQ ID NO: 48632 - DNA, 20 bp, Artificial Sequence
  Description of Artificial Sequence: Synthetic oligonucleotide
  Target: SCN10A; (-) strand; PAM type: YTN; PAM sequence: TTG
gtgggaattggcatagagat

SEQ ID NO: 48633 - DNA, 20 bp, Artificial Sequence
  Description of Artificial Sequence: Synthetic oligonucleotide
  Target: SCN10A; (-) strand; PAM type: YTN; PAM sequence: TTT
ggtgggaattggcatagaga

SEQ ID NO: 48634 - DNA, 20 bp, Artificial Sequence
  Description of Artificial Sequence: Synthetic oligonucleotide
  Target: SCN10A; (-) strand; PAM type: YTN; PAM sequence: TTG
gacacataatttggtgggaa

SEQ ID NO: 48635 - DNA, 20 bp, Artificial Sequence
  Description of Artificial Sequence: Synthetic oligonucleotide
  Target: SCN10A; (-) strand; PAM type: YTN; PAM sequence: TTC
aggaagggatcagaaattgg

SEQ ID NO: 48636 - DNA, 20 bp, Artificial Sequence
  Description of Artificial Sequence: Synthetic oligonucleotide
  Target: SCN10A; (-) strand; PAM type: YTN; PAM sequence: CTA
gtgttcaggaagggatcaga

SEQ ID NO: 48637 - DNA, 20 bp, Artificial Sequence
  Description of Artificial Sequence: Synthetic oligonucleotide
  Target: SCN10A; (-) strand; PAM type: YTN; PAM sequence: TTA
acggaggcaggtagagagat

SEQ ID NO: 48638 - DNA, 20 bp, Artificial Sequence
  Description of Artificial Sequence: Synthetic oligonucleotide
  Target: SCN10A; (-) strand; PAM type: YTN; PAM sequence: TTT
aacggaggcaggtagagaga

SEQ ID NO: 48639 - DNA, 20 bp, Artificial Sequence
  Description of Artificial Sequence: Synthetic oligonucleotide
  Target: SCN10A; (-) strand; PAM type: YTN; PAM sequence: TTA
cacatccacatggagattta

SEQ ID NO: 48640 - DNA, 20 bp, Artificial Sequence
  Description of Artificial Sequence: Synthetic oligonucleotide
  Target: SCN10A; (-) strand; PAM type: YTN; PAM sequence: CTC
catcgaggtgaacacagtta

SEQ ID NO: 48641 - DNA, 20 bp, Artificial Sequence
  Description of Artificial Sequence: Synthetic oligonucleotide
  Target: SCN10A; (-) strand; PAM type: YTN; PAM sequence: TTG
ccctccatcgaggtgaacac

SEQ ID NO: 48642 - DNA, 20 bp, Artificial Sequence
  Description of Artificial Sequence: Synthetic oligonucleotide
  Target: SCN10A; (-) strand; PAM type: YTN; PAM sequence: CTA
agaaattgccctccatcgag

SEQ ID NO: 48643 - DNA, 20 bp, Artificial Sequence
  Description of Artificial Sequence: Synthetic oligonucleotide
  Target: SCN10A; (-) strand; PAM type: YTN; PAM sequence: CTA
aagctaagaaattgccctcc

SEQ ID NO: 48644 - DNA, 20 bp, Artificial Sequence
  Description of Artificial Sequence: Synthetic oligonucleotide
  Target: SCN10A; (-) strand; PAM type: YTN; PAM sequence: TTA
tagataaacctaaagctaag

SEQ ID NO: 48645 - DNA, 20 bp, Artificial Sequence
  Description of Artificial Sequence: Synthetic oligonucleotide
  Target: SCN10A; (-) strand; PAM type: YTN; PAM sequence: TTT
atagataaacctaaagctaa

SEQ ID NO: 48646 - DNA, 20 bp, Artificial Sequence
  Description of Artificial Sequence: Synthetic oligonucleotide
  Target: SCN10A; (-) strand; PAM type: YTN; PAM sequence: TTG
ccgaggaatttatagataaa

SEQ ID NO: 48647 - DNA, 20 bp, Artificial Sequence
  Description of Artificial Sequence: Synthetic oligonucleotide
  Target: SCN10A; (-) strand; PAM type: YTN; PAM sequence: CTT
gccgaggaatttatagataa

SEQ ID NO: 48648 - DNA, 20 bp, Artificial Sequence
  Description of Artificial Sequence: Synthetic oligonucleotide
  Target: SCN10A; (-) strand; PAM type: YTN; PAM sequence: TTC
aagatgcatgtcttgccgag

SEQ ID NO: 48649 - DNA, 20 bp, Artificial Sequence
  Description of Artificial Sequence: Synthetic oligonucleotide
  Target: SCN10A; (-) strand; PAM type: YTN; PAM sequence: CTG
ttcaagatgcatgtcttgcc

SEQ ID NO: 48650 - DNA, 20 bp, Artificial Sequence
  Description of Artificial Sequence: Synthetic oligonucleotide
  Target: SCN10A; (-) strand; PAM type: YTN; PAM sequence: CTG
atatctgttcaagatgcatg

SEQ ID NO: 48651 - DNA, 20 bp, Artificial Sequence
  Description of Artificial Sequence: Synthetic oligonucleotide
  Target: SCN10A; (-) strand; PAM type: YTN; PAM sequence: TTG
cccacataggctgatatctg

SEQ ID NO: 48652 - DNA, 20 bp, Artificial Sequence
  Description of Artificial Sequence: Synthetic oligonucleotide
  Target: SCN10A; (-) strand; PAM type: YTN; PAM sequence: TTT
gcccacataggctgatatct

SEQ ID NO: 48653 - DNA, 20 bp, Artificial Sequence
  Description of Artificial Sequence: Synthetic oligonucleotide
  Target: SCN10A; (-) strand; PAM type: YTN; PAM sequence: CTT
tgcccacataggctgatatc

SEQ ID NO: 48654 - DNA, 20 bp, Artificial Sequence
  Description of Artificial Sequence: Synthetic oligonucleotide
  Target: SCN10A; (-) strand; PAM type: YTN; PAM sequence: TTC
tttgcccacataggctgata

SEQ ID NO: 48655 - DNA, 20 bp, Artificial Sequence
  Description of Artificial Sequence: Synthetic oligonucleotide
  Target: SCN10A; (-) strand; PAM type: YTN; PAM sequence: TTT
ctttgcccacataggctgat

SEQ ID NO: 48656 - DNA, 20 bp, Artificial Sequence
  Description of Artificial Sequence: Synthetic oligonucleotide
  Target: SCN10A; (-) strand; PAM type: YTN; PAM sequence: CTT
tctttgcccacataggctga

SEQ ID NO: 48657 - DNA, 20 bp, Artificial Sequence
  Description of Artificial Sequence: Synthetic oligonucleotide
  Target: SCN10A; (-) strand; PAM type: YTN; PAM sequence: TTA
taaacaatggacatcatctt

SEQ ID NO: 48658 - DNA, 20 bp, Artificial Sequence
  Description of Artificial Sequence: Synthetic oligonucleotide
  Target: SCN10A; (-) strand; PAM type: YTN; PAM sequence: TTA
ttataaacaatggacatcat

SEQ ID NO: 48659 - DNA, 20 bp, Artificial Sequence
  Description of Artificial Sequence: Synthetic oligonucleotide
  Target: SCN10A; (-) strand; PAM type: YTN; PAM sequence: TTA
ttattataaacaatggacat

SEQ ID NO: 48660 - DNA, 20 bp, Artificial Sequence
  Description of Artificial Sequence: Synthetic oligonucleotide
  Target: SCN10A; (-) strand; PAM type: YTN; PAM sequence: TTC
cattattattataaacaatg

SEQ ID NO: 48661 - DNA, 20 bp, Artificial Sequence
  Description of Artificial Sequence: Synthetic oligonucleotide
  Target: SCN10A; (-) strand; PAM type: YTN; PAM sequence: TTT
ccattattattataaacaat

SEQ ID NO: 48662 - DNA, 20 bp, Artificial Sequence
  Description of Artificial Sequence: Synthetic oligonucleotide
  Target: SCN10A; (-) strand; PAM type: YTN; PAM sequence: TTT
tccattattattataaacaa

SEQ ID NO: 48663 - DNA, 20 bp, Artificial Sequence
  Description of Artificial Sequence: Synthetic oligonucleotide
  Target: SCN10A; (-) strand; PAM type: YTN; PAM sequence: TTG
ttttccattattattataaa

SEQ ID NO: 48664 - DNA, 20 bp, Artificial Sequence
  Description of Artificial Sequence: Synthetic oligonucleotide
  Target: SCN10A; (-) strand; PAM type: YTN; PAM sequence: TTG
ttgttttccattattattat

SEQ ID NO: 48665 - DNA, 20 bp, Artificial Sequence
  Description of Artificial Sequence: Synthetic oligonucleotide
  Target: SCN10A; (-) strand; PAM type: YTN; PAM sequence: TTA
tcagttgttgttttccatta

SEQ ID NO: 48666 - DNA, 20 bp, Artificial Sequence
  Description of Artificial Sequence: Synthetic oligonucleotide
  Target: SCN10A; (-) strand; PAM type: YTN; PAM sequence: TTT
atcagttgttgttttccatt

SEQ ID NO: 48667 - DNA, 20 bp, Artificial Sequence
  Description of Artificial Sequence: Synthetic oligonucleotide
  Target: SCN10A; (-) strand; PAM type: YTN; PAM sequence: CTT
tatcagttgttgttttccat

SEQ ID NO: 48668 - DNA, 20 bp, Artificial Sequence
  Description of Artificial Sequence: Synthetic oligonucleotide
  Target: SCN10A; (-) strand; PAM type: YTN; PAM sequence: TTA
tgctttatcagttgttgttt

SEQ ID NO: 48669 - DNA, 20 bp, Artificial Sequence
  Description of Artificial Sequence: Synthetic oligonucleotide
  Target: SCN10A; (-) strand; PAM type: YTN; PAM sequence: TTC
acaatgtattatgctttatc

SEQ ID NO: 48670 - DNA, 20 bp, Artificial Sequence
  Description of Artificial Sequence: Synthetic oligonucleotide
  Target: SCN10A; (-) strand; PAM type: YTN; PAM sequence: TTT
cacaatgtattatgctttat

SEQ ID NO: 48671 - DNA, 20 bp, Artificial Sequence
  Description of Artificial Sequence: Synthetic oligonucleotide
  Target: SCN10A; (-) strand; PAM type: YTN; PAM sequence: TTT
tcacaatgtattatgcttta

SEQ ID NO: 48672 - DNA, 20 bp, Artificial Sequence
  Description of Artificial Sequence: Synthetic oligonucleotide
  Target: SCN10A; (-) strand; PAM type: YTN; PAM sequence: TTT
ttcacaatgtattatgcttt

SEQ ID NO: 48673 - DNA, 20 bp, Artificial Sequence
  Description of Artificial Sequence: Synthetic oligonucleotide
  Target: SCN10A; (-) strand; PAM type: YTN; PAM sequence: CTT
tttcacaatgtattatgctt

SEQ ID NO: 48674 - DNA, 20 bp, Artificial Sequence
  Description of Artificial Sequence: Synthetic oligonucleotide
  Target: SCN10A; (-) strand; PAM type: YTN; PAM sequence: TTC
tttttcacaatgtattatgc

SEQ ID NO: 48675 - DNA, 20 bp, Artificial Sequence
  Description of Artificial Sequence: Synthetic oligonucleotide
  Target: SCN10A; (-) strand; PAM type: YTN; PAM sequence: CTC
attctttttcacaatgtatt

SEQ ID NO: 48676 - DNA, 20 bp, Artificial Sequence
  Description of Artificial Sequence: Synthetic oligonucleotide
  Target: SCN10A; (-) strand; PAM type: YTN; PAM sequence: CTG
cctcattctttttcacaatg

SEQ ID NO: 48677 - DNA, 20 bp, Artificial Sequence
  Description of Artificial Sequence: Synthetic oligonucleotide
  Target: SCN10A; (-) strand; PAM type: YTN; PAM sequence: CTA
catcaccacaaataaatctg

SEQ ID NO: 48678 - DNA, 20 bp, Artificial Sequence
  Description of Artificial Sequence: Synthetic oligonucleotide
  Target: SCN10A; (-) strand; PAM type: YTN; PAM sequence: TTC
tacatcaccacaaataaatc

SEQ ID NO: 48679 - DNA, 20 bp, Artificial Sequence
  Description of Artificial Sequence: Synthetic oligonucleotide
  Target: SCN10A; (-) strand; PAM type: YTN; PAM sequence: TTT
ctacatcaccacaaataaat

SEQ ID NO: 48680 - DNA, 20 bp, Artificial Sequence
  Description of Artificial Sequence: Synthetic oligonucleotide
  Target: SCN10A; (-) strand; PAM type: YTN; PAM sequence: TTT
tctacatcaccacaaataaa

SEQ ID NO: 48681 - DNA, 20 bp, Artificial Sequence
  Description of Artificial Sequence: Synthetic oligonucleotide
  Target: SCN10A; (-) strand; PAM type: YTN; PAM sequence: TTT
ttctacatcaccacaaataa

SEQ ID NO: 48682 - DNA, 20 bp, Artificial Sequence
  Description of Artificial Sequence: Synthetic oligonucleotide
  Target: SCN10A; (-) strand; PAM type: YTN; PAM sequence: CTA
cacatacatatttttctaca

SEQ ID NO: 48683 - DNA, 20 bp, Artificial Sequence
  Description of Artificial Sequence: Synthetic oligonucleotide
  Target: SCN10A; (-) strand; PAM type: YTN; PAM sequence: CTA
tgcatatataagcacatgca

SEQ ID NO: 48684 - DNA, 20 bp, Artificial Sequence
  Description of Artificial Sequence: Synthetic oligonucleotide
  Target: SCN10A; (-) strand; PAM type: YTN; PAM sequence: TTC
tatgcatatataagcacatg

SEQ ID NO: 48685 - DNA, 20 bp, Artificial Sequence
  Description of Artificial Sequence: Synthetic oligonucleotide
  Target: SCN10A; (-) strand; PAM type: YTN; PAM sequence: TTC
aagcaatgttctatgcatat

SEQ ID NO: 48686 - DNA, 20 bp, Artificial Sequence
  Description of Artificial Sequence: Synthetic oligonucleotide
  Target: SCN10A; (-) strand; PAM type: YTN; PAM sequence: CTT
caagcaatgttctatgcata

SEQ ID NO: 48687 - DNA, 20 bp, Artificial Sequence
  Description of Artificial Sequence: Synthetic oligonucleotide
  Target: SCN10A; (-) strand; PAM type: YTN; PAM sequence: TTC
ttcaagcaatgttctatgca

SEQ ID NO: 48688 - DNA, 20 bp, Artificial Sequence
  Description of Artificial Sequence: Synthetic oligonucleotide
  Target: SCN10A; (-) strand; PAM type: YTN; PAM sequence: TTA
tattcttcaagcaatgttct

SEQ ID NO: 48689 - DNA, 20 bp, Artificial Sequence
  Description of Artificial Sequence: Synthetic oligonucleotide
  Target: SCN10A; (-) strand; PAM type: YTN; PAM sequence: CTT
atattcttcaagcaatgttc

SEQ ID NO: 48690 - DNA, 20 bp, Artificial Sequence
  Description of Artificial Sequence: Synthetic oligonucleotide
  Target: SCN10A; (-) strand; PAM type: YTN; PAM sequence: TTA
tcttatattcttcaagcaat

SEQ ID NO: 48691 - DNA, 20 bp, Artificial Sequence
  Description of Artificial Sequence: Synthetic oligonucleotide
  Target: SCN10A; (-) strand; PAM type: YTN; PAM sequence: TTT
atcttatattcttcaagcaa

SEQ ID NO: 48692 - DNA, 20 bp, Artificial Sequence
  Description of Artificial Sequence: Synthetic oligonucleotide
  Target: SCN10A; (-) strand; PAM type: YTN; PAM sequence: CTC
cagtttatcttatattcttc

SEQ ID NO: 48693 - DNA, 20 bp, Artificial Sequence
  Description of Artificial Sequence: Synthetic oligonucleotide
  Target: SCN10A; (-) strand; PAM type: YTN; PAM sequence: CTC
ccactccagtttatcttata

SEQ ID NO: 48694 - DNA, 20 bp, Artificial Sequence
  Description of Artificial Sequence: Synthetic oligonucleotide
  Target: SCN10A; (-) strand; PAM type: YTN; PAM sequence: CTG
gtgcacccccctcccactcc

SEQ ID NO: 48695 - DNA, 20 bp, Artificial Sequence
  Description of Artificial Sequence: Synthetic oligonucleotide
  Target: SCN10A; (-) strand; PAM type: YTN; PAM sequence: CTC
ctggtgcacccccctcccac

SEQ ID NO: 48696 - DNA, 20 bp, Artificial Sequence
  Description of Artificial Sequence: Synthetic oligonucleotide
  Target: SCN10A; (-) strand; PAM type: YTN; PAM sequence: CTC
cccagactcctggtgcaccc

SEQ ID NO: 48697 - DNA, 20 bp, Artificial Sequence
  Description of Artificial Sequence: Synthetic oligonucleotide
  Target: SCN10A; (-) strand; PAM type: YTN; PAM sequence: CTG
ctccccagactcctggtgca

SEQ ID NO: 48698 - DNA, 20 bp, Artificial Sequence
  Description of Artificial Sequence: Synthetic oligonucleotide
  Target: SCN10A; (-) strand; PAM type: YTN; PAM sequence: TTC
ctgctccccagactcctggt

SEQ ID NO: 48699 - DNA, 20 bp, Artificial Sequence
  Description of Artificial Sequence: Synthetic oligonucleotide
  Target: SCN10A; (-) strand; PAM type: YTN; PAM sequence: CTT
cctgctccccagactcctgg

SEQ ID NO: 48700 - DNA, 20 bp, Artificial Sequence
  Description of Artificial Sequence: Synthetic oligonucleotide
  Target: SCN10A; (-) strand; PAM type: YTN; PAM sequence: CTA
tagacccttcctgctcccca

SEQ ID NO: 48701 - DNA, 20 bp, Artificial Sequence
  Description of Artificial Sequence: Synthetic oligonucleotide
  Target: SCN10A; (-) strand; PAM type: YTN; PAM sequence: TTC
ccactatagacccttcctgc

SEQ ID NO: 48702 - DNA, 20 bp, Artificial Sequence
  Description of Artificial Sequence: Synthetic oligonucleotide
  Target: SCN10A; (-) strand; PAM type: YTN; PAM sequence: CTT
cccactatagacccttcctg

SEQ ID NO: 48703 - DNA, 20 bp, Artificial Sequence
  Description of Artificial Sequence: Synthetic oligonucleotide
  Target: SCN10A; (-) strand; PAM type: YTN; PAM sequence: CTC
cttcccactatagacccttc

SEQ ID NO: 48704 - DNA, 20 bp, Artificial Sequence
  Description of Artificial Sequence: Synthetic oligonucleotide
  Target: SCN10A; (-) strand; PAM type: YTN; PAM sequence: CTA
tgtctccttcccactataga

SEQ ID NO: 48705 - DNA, 20 bp, Artificial Sequence
  Description of Artificial Sequence: Synthetic oligonucleotide
  Target: SCN10A; (-) strand; PAM type: YTN; PAM sequence: CTG
caagtgtgtatgcaatgaca

SEQ ID NO: 48706 - DNA, 20 bp, Artificial Sequence
  Description of Artificial Sequence: Synthetic oligonucleotide
  Target: SCN10A; (-) strand; PAM type: YTN; PAM sequence: CTA
aacactgcaagtgtgtatgc

SEQ ID NO: 48707 - DNA, 20 bp, Artificial Sequence
  Description of Artificial Sequence: Synthetic oligonucleotide
  Target: SCN10A; (-) strand; PAM type: YTN; PAM sequence: TTC
aagtgcatatagtaaaaaaa

SEQ ID NO: 48708 - DNA, 20 bp, Artificial Sequence
  Description of Artificial Sequence: Synthetic oligonucleotide
  Target: SCN10A; (-) strand; PAM type: YTN; PAM sequence: TTT
caagtgcatatagtaaaaaa

SEQ ID NO: 48709 - DNA, 20 bp, Artificial Sequence
  Description of Artificial Sequence: Synthetic oligonucleotide
  Target: SCN10A; (-) strand; PAM type: YTN; PAM sequence: TTT
tcaagtgcatatagtaaaaa

SEQ ID NO: 48710 - DNA, 20 bp, Artificial Sequence
  Description of Artificial Sequence: Synthetic oligonucleotide
  Target: SCN10A; (-) strand; PAM type: YTN; PAM sequence: TTT
ttcaagtgcatatagtaaaa

SEQ ID NO: 48711 - DNA, 20 bp, Artificial Sequence
  Description of Artificial Sequence: Synthetic oligonucleotide
  Target: SCN10A; (-) strand; PAM type: YTN; PAM sequence: CTG
atttttcaagtgcatatagt

SEQ ID NO: 48712 - DNA, 20 bp, Artificial Sequence
  Description of Artificial Sequence: Synthetic oligonucleotide
  Target: SCN10A; (-) strand; PAM type: YTN; PAM sequence: CTA
aactgatttttcaagtgcat

SEQ ID NO: 48713 - DNA, 20 bp, Artificial Sequence
  Description of Artificial Sequence: Synthetic oligonucleotide
  Target: SCN10A; (-) strand; PAM type: YTN; PAM sequence: CTC
taaactgatttttcaagtgc

SEQ ID NO: 48714 - DNA, 20 bp, Artificial Sequence
  Description of Artificial Sequence: Synthetic oligonucleotide
  Target: SCN10A; (-) strand; PAM type: YTN; PAM sequence: TTC
tctaaactgatttttcaagt

SEQ ID NO: 48715 - DNA, 20 bp, Artificial Sequence
  Description of Artificial Sequence: Synthetic oligonucleotide
  Target: SCN10A; (-) strand; PAM type: YTN; PAM sequence: TTT
ctctaaactgatttttcaag

SEQ ID NO: 48716 - DNA, 20 bp, Artificial Sequence
  Description of Artificial Sequence: Synthetic oligonucleotide
  Target: SCN10A; (-) strand; PAM type: YTN; PAM sequence: TTA
tttctctaaactgatttttc

SEQ ID NO: 48717 - DNA, 20 bp, Artificial Sequence
  Description of Artificial Sequence: Synthetic oligonucleotide
  Target: SCN10A; (-) strand; PAM type: YTN; PAM sequence: TTG
ggggcacacagttatttctc

SEQ ID NO: 48718 - DNA, 20 bp, Artificial Sequence
  Description of Artificial Sequence: Synthetic oligonucleotide
  Target: SCN10A; (-) strand; PAM type: YTN; PAM sequence: TTT
gggggcacacagttatttct

SEQ ID NO: 48719 - DNA, 20 bp, Artificial Sequence
  Description of Artificial Sequence: Synthetic oligonucleotide
  Target: SCN10A; (-) strand; PAM type: YTN; PAM sequence: TTA
gcaaaatttgggggcacaca

SEQ ID NO: 48720 - DNA, 20 bp, Artificial Sequence
  Description of Artificial Sequence: Synthetic oligonucleotide
  Target: SCN10A; (-) strand; PAM type: YTN; PAM sequence: CTG
ttagcaaaatttgggggcac

SEQ ID NO: 48721 - DNA, 20 bp, Artificial Sequence
  Description of Artificial Sequence: Synthetic oligonucleotide
  Target: SCN10A; (-) strand; PAM type: YTN; PAM sequence: TTA
tcaggaaaaaacactgttag

SEQ ID NO: 48722 - DNA, 20 bp, Artificial Sequence
  Description of Artificial Sequence: Synthetic oligonucleotide
  Target: SCN10A; (-) strand; PAM type: YTN; PAM sequence: TTA
aattatcaggaaaaaacact

SEQ ID NO: 48723 - DNA, 20 bp, Artificial Sequence
  Description of Artificial Sequence: Synthetic oligonucleotide
  Target: SCN10A; (-) strand; PAM type: YTN; PAM sequence: TTT
aaattatcaggaaaaaacac

SEQ ID NO: 48724 - DNA, 20 bp, Artificial Sequence
  Description of Artificial Sequence: Synthetic oligonucleotide
  Target: SCN10A; (-) strand; PAM type: YTN; PAM sequence: TTT
taaattatcaggaaaaaaca

SEQ ID NO: 48725 - DNA, 20 bp, Artificial Sequence
  Description of Artificial Sequence: Synthetic oligonucleotide
  Target: SCN10A; (-) strand; PAM type: YTN; PAM sequence: TTT
ttaaattatcaggaaaaaac

SEQ ID NO: 48726 - DNA, 20 bp, Artificial Sequence
  Description of Artificial Sequence: Synthetic oligonucleotide
  Target: SCN10A; (-) strand; PAM type: YTN; PAM sequence: CTA
catacacatttttaaattat

SEQ ID NO: 48727 - DNA, 20 bp, Artificial Sequence
  Description of Artificial Sequence: Synthetic oligonucleotide
  Target: SCN10A; (-) strand; PAM type: YTN; PAM sequence: TTG
actacatacacatttttaaa

SEQ ID NO: 48728 - DNA, 20 bp, Artificial Sequence
  Description of Artificial Sequence: Synthetic oligonucleotide
  Target: SCN10A; (-) strand; PAM type: YTN; PAM sequence: CTT
gactacatacacatttttaa

SEQ ID NO: 48729 - DNA, 20 bp, Artificial Sequence
  Description of Artificial Sequence: Synthetic oligonucleotide
  Target: SCN10A; (-) strand; PAM type: YTN; PAM sequence: CTG
ataaatcttgactacataca

SEQ ID NO: 48730 - DNA, 20 bp, Artificial Sequence
  Description of Artificial Sequence: Synthetic oligonucleotide
  Target: SCN10A; (-) strand; PAM type: YTN; PAM sequence: CTA
ctgataaatcttgactacat

SEQ ID NO: 48731 - DNA, 20 bp, Artificial Sequence
  Description of Artificial Sequence: Synthetic oligonucleotide
  Target: SCN10A; (-) strand; PAM type: YTN; PAM sequence: TTG
aaaaaaaaagaaaacaaata

SEQ ID NO: 48732 - DNA, 20 bp, Artificial Sequence
  Description of Artificial Sequence: Synthetic oligonucleotide
  Target: SCN10A; (-) strand; PAM type: YTN; PAM sequence: TTA
aaataaaaaaatgaagaaaa

SEQ ID NO: 48733 - DNA, 20 bp, Artificial Sequence
  Description of Artificial Sequence: Synthetic oligonucleotide
  Target: SCN10A; (-) strand; PAM type: YTN; PAM sequence: TTT
aaaataaaaaaatgaagaaa

SEQ ID NO: 48734 - DNA, 20 bp, Artificial Sequence
  Description of Artificial Sequence: Synthetic oligonucleotide
  Target: SCN10A; (-) strand; PAM type: YTN; PAM sequence: TTA
aaaaaagaaaaaaatttaaa

SEQ ID NO: 48735 - DNA, 20 bp, Artificial Sequence
  Description of Artificial Sequence: Synthetic oligonucleotide
  Target: SCN10A; (-) strand; PAM type: YTN; PAM sequence: TTT
aaaaaaagaaaaaaatttaa

SEQ ID NO: 48736 - DNA, 20 bp, Artificial Sequence
  Description of Artificial Sequence: Synthetic oligonucleotide
  Target: SCN10A; (-) strand; PAM type: YTN; PAM sequence: TTA
aagtataatttaaaaaaaga

SEQ ID NO: 48737 - DNA, 20 bp, Artificial Sequence
  Description of Artificial Sequence: Synthetic oligonucleotide
  Target: SCN10A; (-) strand; PAM type: YTN; PAM sequence: CTT
aaagtataatttaaaaaaag

SEQ ID NO: 48738 - DNA, 20 bp, Artificial Sequence
  Description of Artificial Sequence: Synthetic oligonucleotide
  Target: SCN10A; (-) strand; PAM type: YTN; PAM sequence: CTA
aaacttaaagtataatttaa

SEQ ID NO: 48739 - DNA, 20 bp, Artificial Sequence
  Description of Artificial Sequence: Synthetic oligonucleotide
  Target: SCN10A; (-) strand; PAM type: YTN; PAM sequence: TTA
ccctaaaacttaaagtataa

SEQ ID NO: 48740 - DNA, 20 bp, Artificial Sequence
  Description of Artificial Sequence: Synthetic oligonucleotide
  Target: SCN10A; (-) strand; PAM type: YTN; PAM sequence: TTT
accctaaaacttaaagtata

SEQ ID NO: 48741 - DNA, 20 bp, Artificial Sequence
  Description of Artificial Sequence: Synthetic oligonucleotide
  Target: SCN10A; (-) strand; PAM type: YTN; PAM sequence: CTG
cataatgtgcacatttaccc

SEQ ID NO: 48742 - DNA, 20 bp, Artificial Sequence
  Description of Artificial Sequence: Synthetic oligonucleotide
  Target: SCN10A; (-) strand; PAM type: YTN; PAM sequence: CTA
acctgcataatgtgcacatt

SEQ ID NO: 48743 - DNA, 20 bp, Artificial Sequence
  Description of Artificial Sequence: Synthetic oligonucleotide
  Target: SCN10A; (-) strand; PAM type: YTN; PAM sequence: TTC
atatgtaaggcatgtatgca

SEQ ID NO: 48744 - DNA, 20 bp, Artificial Sequence
  Description of Artificial Sequence: Synthetic oligonucleotide
  Target: SCN10A; (-) strand; PAM type: YTN; PAM sequence: CTT
catatgtaaggcatgtatgc

SEQ ID NO: 48745 - DNA, 20 bp, Artificial Sequence
  Description of Artificial Sequence: Synthetic oligonucleotide
  Target: SCN10A; (-) strand; PAM type: YTN; PAM sequence: TTG
tagtgagaaaagcttcatat

SEQ ID NO: 48746 - DNA, 20 bp, Artificial Sequence
  Description of Artificial Sequence: Synthetic oligonucleotide
  Target: SCN10A; (-) strand; PAM type: YTN; PAM sequence: CTT
gtagtgagaaaagcttcata

SEQ ID NO: 48747 - DNA, 20 bp, Artificial Sequence
  Description of Artificial Sequence: Synthetic oligonucleotide
  Target: SCN10A; (-) strand; PAM type: YTN; PAM sequence: TTC
caagccttgtagtgagaaaa

SEQ ID NO: 48748 - DNA, 20 bp, Artificial Sequence
  Description of Artificial Sequence: Synthetic oligonucleotide
  Target: SCN10A; (-) strand; PAM type: YTN; PAM sequence: TTT
ccaagccttgtagtgagaaa

SEQ ID NO: 48749 - DNA, 20 bp, Artificial Sequence
  Description of Artificial Sequence: Synthetic oligonucleotide
  Target: SCN10A; (-) strand; PAM type: YTN; PAM sequence: TTT
tccaagccttgtagtgagaa

SEQ ID NO: 48750 - DNA, 20 bp, Artificial Sequence
  Description of Artificial Sequence: Synthetic oligonucleotide
  Target: SCN10A; (-) strand; PAM type: YTN; PAM sequence: CTA
caaaagaaagaaaaaaacat

SEQ ID NO: 48751 - DNA, 20 bp, Artificial Sequence
  Description of Artificial Sequence: Synthetic oligonucleotide
  Target: SCN10A; (-) strand; PAM type: YTN; PAM sequence: TTA
agtgaaaaaagtgaaactac

SEQ ID NO: 48752 - DNA, 20 bp, Artificial Sequence
  Description of Artificial Sequence: Synthetic oligonucleotide
  Target: SCN10A; (-) strand; PAM type: YTN; PAM sequence: TTT
aagtgaaaaaagtgaaacta

SEQ ID NO: 48753 - DNA, 20 bp, Artificial Sequence
  Description of Artificial Sequence: Synthetic oligonucleotide
  Target: SCN10A; (-) strand; PAM type: YTN; PAM sequence: TTT
taagtgaaaaaagtgaaact

SEQ ID NO: 48754 - DNA, 20 bp, Artificial Sequence
  Description of Artificial Sequence: Synthetic oligonucleotide
  Target: SCN10A; (-) strand; PAM type: YTN; PAM sequence: TTC
aaatgcaccaaagttttaag

SEQ ID NO: 48755 - DNA, 20 bp, Artificial Sequence
  Description of Artificial Sequence: Synthetic oligonucleotide
  Target: SCN10A; (-) strand; PAM type: YTN; PAM sequence: TTT
caaatgcaccaaagttttaa

SEQ ID NO: 48756 - DNA, 20 bp, Artificial Sequence
  Description of Artificial Sequence: Synthetic oligonucleotide
  Target: SCN10A; (-) strand; PAM type: YTN; PAM sequence: TTA
cccaaaataaatttcaaatg

SEQ ID NO: 48757 - DNA, 20 bp, Artificial Sequence
  Description of Artificial Sequence: Synthetic oligonucleotide
  Target: SCN10A; (-) strand; PAM type: YTN; PAM sequence: TTT
acccaaaataaatttcaaat

SEQ ID NO: 48758 - DNA, 20 bp, Artificial Sequence
  Description of Artificial Sequence: Synthetic oligonucleotide
  Target: SCN10A; (-) strand; PAM type: YTN; PAM sequence: CTT
tacccaaaataaatttcaaa

SEQ ID NO: 48759 - DNA, 20 bp, Artificial Sequence
  Description of Artificial Sequence: Synthetic oligonucleotide
  Target: SCN10A; (-) strand; PAM type: YTN; PAM sequence: CTC
tttacccaaaataaatttca

SEQ ID NO: 48760 - DNA, 20 bp, Artificial Sequence
  Description of Artificial Sequence: Synthetic oligonucleotide
  Target: SCN10A; (-) strand; PAM type: YTN; PAM sequence: TTA
ctctttacccaaaataaatt

SEQ ID NO: 48761 - DNA, 20 bp, Artificial Sequence
  Description of Artificial Sequence: Synthetic oligonucleotide
  Target: SCN10A; (-) strand; PAM type: YTN; PAM sequence: CTT
actctttacccaaaataaat

SEQ ID NO: 48762 - DNA, 20 bp, Artificial Sequence
  Description of Artificial Sequence: Synthetic oligonucleotide
  Target: SCN10A; (-) strand; PAM type: YTN; PAM sequence: TTG
atataaataatcagagacag

SEQ ID NO: 48763 - DNA, 20 bp, Artificial Sequence
  Description of Artificial Sequence: Synthetic oligonucleotide
  Target: SCN10A; (-) strand; PAM type: YTN; PAM sequence: TTC
aataagtaatgttgatataa

SEQ ID NO: 48764 - DNA, 20 bp, Artificial Sequence
  Description of Artificial Sequence: Synthetic oligonucleotide
  Target: SCN10A; (-) strand; PAM type: YTN; PAM sequence: TTA
ttcaataagtaatgttgata

SEQ ID NO: 48765 - DNA, 20 bp, Artificial Sequence
  Description of Artificial Sequence: Synthetic oligonucleotide
  Target: SCN10A; (-) strand; PAM type: YTN; PAM sequence: TTG
ggaaaatgaaaaattattca

SEQ ID NO: 48766 - DNA, 20 bp, Artificial Sequence
  Description of Artificial Sequence: Synthetic oligonucleotide
  Target: SCN10A; (-) strand; PAM type: YTN; PAM sequence: CTT
gggaaaatgaaaaattattc

SEQ ID NO: 48767 - DNA, 20 bp, Artificial Sequence
  Description of Artificial Sequence: Synthetic oligonucleotide
  Target: SCN10A; (-) strand; PAM type: YTN; PAM sequence: TTC
aaatcttgggaaaatgaaaa

SEQ ID NO: 48768 - DNA, 20 bp, Artificial Sequence
  Description of Artificial Sequence: Synthetic oligonucleotide
  Target: SCN10A; (-) strand; PAM type: YTN; PAM sequence: TTT
caaatcttgggaaaatgaaa

SEQ ID NO: 48769 - DNA, 20 bp, Artificial Sequence
  Description of Artificial Sequence: Synthetic oligonucleotide
  Target: SCN10A; (-) strand; PAM type: YTN; PAM sequence: CTG
tggaagagaaatggacatgt

SEQ ID NO: 48770 - DNA, 20 bp, Artificial Sequence
  Description of Artificial Sequence: Synthetic oligonucleotide
  Target: SCN10A; (-) strand; PAM type: YTN; PAM sequence: CTG
atctgtggaagagaaatgga

SEQ ID NO: 48771 - DNA, 20 bp, Artificial Sequence
  Description of Artificial Sequence: Synthetic oligonucleotide
  Target: SCN10A; (-) strand; PAM type: YTN; PAM sequence: TTA
aaacagcatgacagtgaaaa

SEQ ID NO: 48772 - DNA, 20 bp, Artificial Sequence
  Description of Artificial Sequence: Synthetic oligonucleotide
  Target: SCN10A; (-) strand; PAM type: YTN; PAM sequence: CTA
aaatccagtcagtgattaaa

SEQ ID NO: 48773 - DNA, 20 bp, Artificial Sequence
  Description of Artificial Sequence: Synthetic oligonucleotide
  Target: SCN10A; (-) strand; PAM type: YTN; PAM sequence: TTC
taaaatccagtcagtgatta

SEQ ID NO: 48774 - DNA, 20 bp, Artificial Sequence
  Description of Artificial Sequence: Synthetic oligonucleotide
  Target: SCN10A; (-) strand; PAM type: YTN; PAM sequence: TTT
ctaaaatccagtcagtgatt

SEQ ID NO: 48775 - DNA, 20 bp, Artificial Sequence
  Description of Artificial Sequence: Synthetic oligonucleotide
  Target: SCN10A; (-) strand; PAM type: YTN; PAM sequence: CTG
tagtttctaaaatccagtca

SEQ ID NO: 48776 - DNA, 20 bp, Artificial Sequence
  Description of Artificial Sequence: Synthetic oligonucleotide
  Target: SCN10A; (-) strand; PAM type: YTN; PAM sequence: TTG
gacatctgtagtttctaaaa

SEQ ID NO: 48777 - DNA, 20 bp, Artificial Sequence
  Description of Artificial Sequence: Synthetic oligonucleotide
  Target: SCN10A; (-) strand; PAM type: YTN; PAM sequence: TTT
ggacatctgtagtttctaaa

SEQ ID NO: 48778 - DNA, 20 bp, Artificial Sequence
  Description of Artificial Sequence: Synthetic oligonucleotide
  Target: SCN10A; (-) strand; PAM type: YTN; PAM sequence: TTG
ccagtttggacatctgtagt

SEQ ID NO: 48779 - DNA, 20 bp, Artificial Sequence
  Description of Artificial Sequence: Synthetic oligonucleotide
  Target: SCN10A; (-) strand; PAM type: YTN; PAM sequence: TTT
gccagtttggacatctgtag

SEQ ID NO: 48780 - DNA, 20 bp, Artificial Sequence
  Description of Artificial Sequence: Synthetic oligonucleotide
  Target: SCN10A; (-) strand; PAM type: YTN; PAM sequence: CTT
tgccagtttggacatctgta

SEQ ID NO: 48781 - DNA, 20 bp, Artificial Sequence
  Description of Artificial Sequence: Synthetic oligonucleotide
  Target: SCN10A; (-) strand; PAM type: YTN; PAM sequence: CTA
tgctttgccagtttggacat

SEQ ID NO: 48782 - DNA, 20 bp, Artificial Sequence
  Description of Artificial Sequence: Synthetic oligonucleotide
  Target: SCN10A; (-) strand; PAM type: YTN; PAM sequence: TTA
gagaactatgctttgccagt

SEQ ID NO: 48783 - DNA, 20 bp, Artificial Sequence
  Description of Artificial Sequence: Synthetic oligonucleotide
  Target: SCN10A; (-) strand; PAM type: YTN; PAM sequence: TTT
agagaactatgctttgccag

SEQ ID NO: 48784 - DNA, 20 bp, Artificial Sequence
  Description of Artificial Sequence: Synthetic oligonucleotide
  Target: SCN10A; (-) strand; PAM type: YTN; PAM sequence: CTT
tagagaactatgctttgcca

SEQ ID NO: 48785 - DNA, 20 bp, Artificial Sequence
  Description of Artificial Sequence: Synthetic oligonucleotide
  Target: SCN10A; (-) strand; PAM type: YTN; PAM sequence: TTC
tttagagaactatgctttgc

SEQ ID NO: 48786 - DNA, 20 bp, Artificial Sequence
  Description of Artificial Sequence: Synthetic oligonucleotide
  Target: SCN10A; (-) strand; PAM type: YTN; PAM sequence: CTT
ctttagagaactatgctttg

SEQ ID NO: 48787 - DNA, 20 bp, Artificial Sequence
  Description of Artificial Sequence: Synthetic oligonucleotide
  Target: SCN10A; (-) strand; PAM type: YTN; PAM sequence: TTG
gtcccaggatgtgccaactt

SEQ ID NO: 48788 - DNA, 20 bp, Artificial Sequence
  Description of Artificial Sequence: Synthetic oligonucleotide
  Target: SCN10A; (-) strand; PAM type: YTN; PAM sequence: TTT
ggtcccaggatgtgccaact

SEQ ID NO: 48789 - DNA, 20 bp, Artificial Sequence
  Description of Artificial Sequence: Synthetic oligonucleotide
  Target: SCN10A; (-) strand; PAM type: YTN; PAM sequence: TTT
tggtcccaggatgtgccaac

SEQ ID NO: 48790 - DNA, 20 bp, Artificial Sequence
  Description of Artificial Sequence: Synthetic oligonucleotide
  Target: SCN10A; (-) strand; PAM type: YTN; PAM sequence: TTG
attttggtcccaggatgtgc

SEQ ID NO: 48791 - DNA, 20 bp, Artificial Sequence
  Description of Artificial Sequence: Synthetic oligonucleotide
  Target: SCN10A; (-) strand; PAM type: YTN; PAM sequence: TTG
ttgattttggtcccaggatg

SEQ ID NO: 48792 - DNA, 20 bp, Artificial Sequence
  Description of Artificial Sequence: Synthetic oligonucleotide
  Target: SCN10A; (-) strand; PAM type: YTN; PAM sequence: TTC
caaacagggattgttgattt

SEQ ID NO: 48793 - DNA, 20 bp, Artificial Sequence
  Description of Artificial Sequence: Synthetic oligonucleotide
  Target: SCN10A; (-) strand; PAM type: YTN; PAM sequence: TTG
ttccaaacagggattgttga

SEQ ID NO: 48794 - DNA, 20 bp, Artificial Sequence
  Description of Artificial Sequence: Synthetic oligonucleotide
  Target: SCN10A; (-) strand; PAM type: YTN; PAM sequence: TTT
gttccaaacagggattgttg

SEQ ID NO: 48795 - DNA, 20 bp, Artificial Sequence
  Description of Artificial Sequence: Synthetic oligonucleotide
  Target: SCN10A; (-) strand; PAM type: YTN; PAM sequence: TTT
tgttccaaacagggattgtt

SEQ ID NO: 48796 - DNA, 20 bp, Artificial Sequence
  Description of Artificial Sequence: Synthetic oligonucleotide
  Target: SCN10A; (-) strand; PAM type: YTN; PAM sequence: CTT
ttgttccaaacagggattgt

SEQ ID NO: 48797 - DNA, 20 bp, Artificial Sequence
  Description of Artificial Sequence: Synthetic oligonucleotide
  Target: SCN10A; (-) strand; PAM type: YTN; PAM sequence: TTG
cttttgttccaaacagggat

SEQ ID NO: 48798 - DNA, 20 bp, Artificial Sequence
  Description of Artificial Sequence: Synthetic oligonucleotide
  Target: SCN10A; (-) strand; PAM type: YTN; PAM sequence: CTT
gcttttgttccaaacaggga

SEQ ID NO: 48799 - DNA, 20 bp, Artificial Sequence
  Description of Artificial Sequence: Synthetic oligonucleotide
  Target: SCN10A; (-) strand; PAM type: YTN; PAM sequence: TTC
ttgcttttgttccaaacagg

SEQ ID NO: 48800 - DNA, 20 bp, Artificial Sequence
  Description of Artificial Sequence: Synthetic oligonucleotide
  Target: SCN10A; (-) strand; PAM type: YTN; PAM sequence: TTA
gtgccaaaataggtccaggg

SEQ ID NO: 48801 - DNA, 20 bp, Artificial Sequence
  Description of Artificial Sequence: Synthetic oligonucleotide
  Target: SCN10A; (-) strand; PAM type: YTN; PAM sequence: TTT
agtgccaaaataggtccagg

SEQ ID NO: 48802 - DNA, 20 bp, Artificial Sequence
  Description of Artificial Sequence: Synthetic oligonucleotide
  Target: SCN10A; (-) strand; PAM type: YTN; PAM sequence: TTT
tagtgccaaaataggtccag

SEQ ID NO: 48803 - DNA, 20 bp, Artificial Sequence
  Description of Artificial Sequence: Synthetic oligonucleotide
  Target: SCN10A; (-) strand; PAM type: YTN; PAM sequence: TTT
ttagtgccaaaataggtcca

SEQ ID NO: 48804 - DNA, 20 bp, Artificial Sequence
  Description of Artificial Sequence: Synthetic oligonucleotide
  Target: SCN10A; (-) strand; PAM type: YTN; PAM sequence: CTT
tttagtgccaaaataggtcc

SEQ ID NO: 48805 - DNA, 20 bp, Artificial Sequence
  Description of Artificial Sequence: Synthetic oligonucleotide
  Target: SCN10A; (-) strand; PAM type: YTN; PAM sequence: TTC
tttttagtgccaaaataggt

SEQ ID NO: 48806 - DNA, 20 bp, Artificial Sequence
  Description of Artificial Sequence: Synthetic oligonucleotide
  Target: SCN10A; (-) strand; PAM type: YTN; PAM sequence: CTT
ctttttagtgccaaaatagg

SEQ ID NO: 48807 - DNA, 20 bp, Artificial Sequence
  Description of Artificial Sequence: Synthetic oligonucleotide
  Target: SCN10A; (-) strand; PAM type: YTN; PAM sequence: CTG
tgcttctttttagtgccaaa

SEQ ID NO: 48808 - DNA, 20 bp, Artificial Sequence
  Description of Artificial Sequence: Synthetic oligonucleotide
  Target: SCN10A; (-) strand; PAM type: YTN; PAM sequence: TTC
ctgtgcttctttttagtgcc

SEQ ID NO: 48809 - DNA, 20 bp, Artificial Sequence
  Description of Artificial Sequence: Synthetic oligonucleotide
  Target: SCN10A; (-) strand; PAM type: YTN; PAM sequence: CTT
cctgtgcttctttttagtgc

SEQ ID NO: 48810 - DNA, 20 bp, Artificial Sequence
  Description of Artificial Sequence: Synthetic oligonucleotide
  Target: SCN10A; (-) strand; PAM type: YTN; PAM sequence: CTA
cttcctgtgcttctttttag

SEQ ID NO: 48811 - DNA, 20 bp, Artificial Sequence
  Description of Artificial Sequence: Synthetic oligonucleotide
  Target: SCN10A; (-) strand; PAM type: YTN; PAM sequence: TTC
atgactacttcctgtgcttc

SEQ ID NO: 48812 - DNA, 20 bp, Artificial Sequence
  Description of Artificial Sequence: Synthetic oligonucleotide
  Target: SCN10A; (-) strand; PAM type: YTN; PAM sequence: CTC
attcatgactacttcctgtg

SEQ ID NO: 48813 - DNA, 20 bp, Artificial Sequence
  Description of Artificial Sequence: Synthetic oligonucleotide
  Target: SCN10A; (-) strand; PAM type: YTN; PAM sequence: CTA
aagtgtcctcattcatgact

SEQ ID NO: 48814 - DNA, 20 bp, Artificial Sequence
  Description of Artificial Sequence: Synthetic oligonucleotide
  Target: SCN10A; (-) strand; PAM type: YTN; PAM sequence: CTG
ccaaaatggcacatctaaag

SEQ ID NO: 48815 - DNA, 20 bp, Artificial Sequence
  Description of Artificial Sequence: Synthetic oligonucleotide
  Target: SCN10A; (-) strand; PAM type: YTN; PAM sequence: TTC
ctgccaaaatggcacatcta

SEQ ID NO: 48816 - DNA, 20 bp, Artificial Sequence
  Description of Artificial Sequence: Synthetic oligonucleotide
  Target: SCN10A; (-) strand; PAM type: YTN; PAM sequence: CTT
cctgccaaaatggcacatct

SEQ ID NO: 48817 - DNA, 20 bp, Artificial Sequence
  Description of Artificial Sequence: Synthetic oligonucleotide
  Target: SCN10A; (-) strand; PAM type: YTN; PAM sequence: CTG
cttcctgccaaaatggcaca

SEQ ID NO: 48818 - DNA, 20 bp, Artificial Sequence
  Description of Artificial Sequence: Synthetic oligonucleotide
  Target: SCN10A; (-) strand; PAM type: YTN; PAM sequence: CTC
acaggtggctgcttcctgcc

SEQ ID NO: 48819 - DNA, 20 bp, Artificial Sequence
  Description of Artificial Sequence: Synthetic oligonucleotide
  Target: SCN10A; (-) strand; PAM type: YTN; PAM sequence: TTC
ccatcatgcctcacaggtgg

SEQ ID NO: 48820 - DNA, 20 bp, Artificial Sequence
  Description of Artificial Sequence: Synthetic oligonucleotide
  Target: SCN10A; (-) strand; PAM type: YTN; PAM sequence: TTT
cccatcatgcctcacaggtg

SEQ ID NO: 48821 - DNA, 20 bp, Artificial Sequence
  Description of Artificial Sequence: Synthetic oligonucleotide
  Target: SCN10A; (-) strand; PAM type: YTN; PAM sequence: TTT
tcccatcatgcctcacaggt

SEQ ID NO: 48822 - DNA, 20 bp, Artificial Sequence
  Description of Artificial Sequence: Synthetic oligonucleotide
  Target: SCN10A; (-) strand; PAM type: YTN; PAM sequence: CTT
ttcccatcatgcctcacagg

SEQ ID NO: 48823 - DNA, 20 bp, Artificial Sequence
  Description of Artificial Sequence: Synthetic oligonucleotide
  Target: SCN10A; (-) strand; PAM type: YTN; PAM sequence: CTC
ttttcccatcatgcctcaca

SEQ ID NO: 48824 - DNA, 20 bp, Artificial Sequence
  Description of Artificial Sequence: Synthetic oligonucleotide
  Target: SCN10A; (-) strand; PAM type: YTN; PAM sequence: CTC
tcttttcccatcatgcctca

SEQ ID NO: 48825 - DNA, 20 bp, Artificial Sequence
  Description of Artificial Sequence: Synthetic oligonucleotide
  Target: SCN10A; (-) strand; PAM type: YTN; PAM sequence: TTA
caaagatgcctctcttttcc

SEQ ID NO: 48826 - DNA, 20 bp, Artificial Sequence
  Description of Artificial Sequence: Synthetic oligonucleotide
  Target: SCN10A; (-) strand; PAM type: YTN; PAM sequence: TTT
acaaagatgcctctcttttc

SEQ ID NO: 48827 - DNA, 20 bp, Artificial Sequence
  Description of Artificial Sequence: Synthetic oligonucleotide
  Target: SCN10A; (-) strand; PAM type: YTN; PAM sequence: CTG
tttacaaagatgcctctctt

SEQ ID NO: 48828 - DNA, 20 bp, Artificial Sequence
  Description of Artificial Sequence: Synthetic oligonucleotide
  Target: SCN10A; (-) strand; PAM type: YTN; PAM sequence: TTC
aacaatgtcaaggctgttta

SEQ ID NO: 48829 - DNA, 20 bp, Artificial Sequence
  Description of Artificial Sequence: Synthetic oligonucleotide
  Target: SCN10A; (-) strand; PAM type: YTN; PAM sequence: CTG
caatcaatcaagttcaacaa

SEQ ID NO: 48830 - DNA, 20 bp, Artificial Sequence
  Description of Artificial Sequence: Synthetic oligonucleotide
  Target: SCN10A; (-) strand; PAM type: YTN; PAM sequence: CTC
tgcaatcaatcaagttcaac

SEQ ID NO: 48831 - DNA, 20 bp, Artificial Sequence
  Description of Artificial Sequence: Synthetic oligonucleotide
  Target: SCN10A; (-) strand; PAM type: YTN; PAM sequence: CTG
tgtctctgcaatcaatcaag

SEQ ID NO: 48832 - DNA, 20 bp, Artificial Sequence
  Description of Artificial Sequence: Synthetic oligonucleotide
  Target: SCN10A; (-) strand; PAM type: YTN; PAM sequence: CTC
tgtgtctctgcaatcaatca

SEQ ID NO: 48833 - DNA, 20 bp, Artificial Sequence
  Description of Artificial Sequence: Synthetic oligonucleotide
  Target: SCN10A; (-) strand; PAM type: YTN; PAM sequence: TTA
gtctctgtgtctctgcaatc

SEQ ID NO: 48834 - DNA, 20 bp, Artificial Sequence
  Description of Artificial Sequence: Synthetic oligonucleotide
  Target: SCN10A; (-) strand; PAM type: YTN; PAM sequence: TTT
agtctctgtgtctctgcaat

SEQ ID NO: 48835 - DNA, 20 bp, Artificial Sequence
  Description of Artificial Sequence: Synthetic oligonucleotide
  Target: SCN10A; (-) strand; PAM type: YTN; PAM sequence: TTT
tagtctctgtgtctctgcaa

SEQ ID NO: 48836 - DNA, 20 bp, Artificial Sequence
  Description of Artificial Sequence: Synthetic oligonucleotide
  Target: SCN10A; (-) strand; PAM type: YTN; PAM sequence: CTT
ttagtctctgtgtctctgca

SEQ ID NO: 48837 - DNA, 20 bp, Artificial Sequence
  Description of Artificial Sequence: Synthetic oligonucleotide
  Target: SCN10A; (-) strand; PAM type: YTN; PAM sequence: CTG
gcaagtagatacttttagtc

SEQ ID NO: 48838 - DNA, 20 bp, Artificial Sequence
  Description of Artificial Sequence: Synthetic oligonucleotide
  Target: SCN10A; (-) strand; PAM type: YTN; PAM sequence: TTA
agctggcaagtagatacttt

SEQ ID NO: 48839 - DNA, 20 bp, Artificial Sequence
  Description of Artificial Sequence: Synthetic oligonucleotide
  Target: SCN10A; (-) strand; PAM type: YTN; PAM sequence: TTT
aagctggcaagtagatactt

SEQ ID NO: 48840 - DNA, 20 bp, Artificial Sequence
  Description of Artificial Sequence: Synthetic oligonucleotide
  Target: SCN10A; (-) strand; PAM type: YTN; PAM sequence: TTT
taagctggcaagtagatact

SEQ ID NO: 48841 - DNA, 20 bp, Artificial Sequence
  Description of Artificial Sequence: Synthetic oligonucleotide
  Target: SCN10A; (-) strand; PAM type: YTN; PAM sequence: TTG
aggtggggccatggtcatgt

SEQ ID NO: 48842 - DNA, 20 bp, Artificial Sequence
  Description of Artificial Sequence: Synthetic oligonucleotide
  Target: SCN10A; (-) strand; PAM type: YTN; PAM sequence: TTT
gaggtggggccatggtcatg

SEQ ID NO: 48843 - DNA, 20 bp, Artificial Sequence
  Description of Artificial Sequence: Synthetic oligonucleotide
  Target: SCN10A; (-) strand; PAM type: YTN; PAM sequence: TTT
tgaggtggggccatggtcat

SEQ ID NO: 48844 - DNA, 20 bp, Artificial Sequence
  Description of Artificial Sequence: Synthetic oligonucleotide
  Target: SCN10A; (-) strand; PAM type: YTN; PAM sequence: CTT
ttgaggtggggccatggtca

SEQ ID NO: 48845 - DNA, 20 bp, Artificial Sequence
  Description of Artificial Sequence: Synthetic oligonucleotide
  Target: SCN10A; (-) strand; PAM type: YTN; PAM sequence: TTA
tataggagatccttttgagg

SEQ ID NO: 48846 - DNA, 20 bp, Artificial Sequence
  Description of Artificial Sequence: Synthetic oligonucleotide
  Target: SCN10A; (-) strand; PAM type: YTN; PAM sequence: TTT
atataggagatccttttgag

SEQ ID NO: 48847 - DNA, 20 bp, Artificial Sequence
  Description of Artificial Sequence: Synthetic oligonucleotide
  Target: SCN10A; (-) strand; PAM type: YTN; PAM sequence: TTT
tatataggagatccttttga

SEQ ID NO: 48848 - DNA, 20 bp, Artificial Sequence
  Description of Artificial Sequence: Synthetic oligonucleotide
  Target: SCN10A; (-) strand; PAM type: YTN; PAM sequence: TTA
tcaattttatataggagatc

SEQ ID NO: 48849 - DNA, 20 bp, Artificial Sequence
  Description of Artificial Sequence: Synthetic oligonucleotide
  Target: SCN10A; (-) strand; PAM type: YTN; PAM sequence: CTG
ttatcaattttatataggag

SEQ ID NO: 48850 - DNA, 20 bp, Artificial Sequence
  Description of Artificial Sequence: Synthetic oligonucleotide
  Target: SCN10A; (-) strand; PAM type: YTN; PAM sequence: CTC
tgttatcaattttatatagg

SEQ ID NO: 48851 - DNA, 20 bp, Artificial Sequence
  Description of Artificial Sequence: Synthetic oligonucleotide
  Target: SCN10A; (-) strand; PAM type: YTN; PAM sequence: CTC
tctgttatcaattttatata

SEQ ID NO: 48852 - DNA, 20 bp, Artificial Sequence
  Description of Artificial Sequence: Synthetic oligonucleotide
  Target: SCN10A; (-) strand; PAM type: YTN; PAM sequence: TTC
tctctgttatcaattttata

SEQ ID NO: 48853 - DNA, 20 bp, Artificial Sequence
  Description of Artificial Sequence: Synthetic oligonucleotide
  Target: SCN10A; (-) strand; PAM type: YTN; PAM sequence: TTA
agcgtaacaggatgaaggga

SEQ ID NO: 48854 - DNA, 20 bp, Artificial Sequence
  Description of Artificial Sequence: Synthetic oligonucleotide
  Target: SCN10A; (-) strand; PAM type: YTN; PAM sequence: TTT
aagcgtaacaggatgaaggg

SEQ ID NO: 48855 - DNA, 20 bp, Artificial Sequence
  Description of Artificial Sequence: Synthetic oligonucleotide
  Target: SCN10A; (-) strand; PAM type: YTN; PAM sequence: CTT
taagcgtaacaggatgaagg

SEQ ID NO: 48856 - DNA, 20 bp, Artificial Sequence
  Description of Artificial Sequence: Synthetic oligonucleotide
  Target: SCN10A; (-) strand; PAM type: YTN; PAM sequence: CTC
tttaagcgtaacaggatgaa

SEQ ID NO: 48857 - DNA, 20 bp, Artificial Sequence
  Description of Artificial Sequence: Synthetic oligonucleotide
  Target: SCN10A; (-) strand; PAM type: YTN; PAM sequence: TTA
acaggagcagggggacctct

SEQ ID NO: 48858 - DNA, 20 bp, Artificial Sequence
  Description of Artificial Sequence: Synthetic oligonucleotide
  Target: SCN10A; (-) strand; PAM type: YTN; PAM sequence: CTG
gtgttaacaggagcaggggg

SEQ ID NO: 48859 - DNA, 20 bp, Artificial Sequence
  Description of Artificial Sequence: Synthetic oligonucleotide
  Target: SCN10A; (-) strand; PAM type: YTN; PAM sequence: CTG
cagtggcaggagagaatgca

SEQ ID NO: 48860 - DNA, 20 bp, Artificial Sequence
  Description of Artificial Sequence: Synthetic oligonucleotide
  Target: SCN10A; (-) strand; PAM type: YTN; PAM sequence: CTC
ctgcagtggcaggagagaat

SEQ ID NO: 48861 - DNA, 20 bp, Artificial Sequence
  Description of Artificial Sequence: Synthetic oligonucleotide
  Target: SCN10A; (-) strand; PAM type: YTN; PAM sequence: TTC
aacagactcctgcagtggca

SEQ ID NO: 48862 - DNA, 20 bp, Artificial Sequence
  Description of Artificial Sequence: Synthetic oligonucleotide
  Target: SCN10A; (-) strand; PAM type: YTN; PAM sequence: TTA
agggaagaaagggtatattc

SEQ ID NO: 48863 - DNA, 20 bp, Artificial Sequence
  Description of Artificial Sequence: Synthetic oligonucleotide
  Target: SCN10A; (-) strand; PAM type: YTN; PAM sequence: CTG
aagattaagggaagaaaggg

SEQ ID NO: 48864 - DNA, 20 bp, Artificial Sequence
  Description of Artificial Sequence: Synthetic oligonucleotide
  Target: SCN10A; (-) strand; PAM type: YTN; PAM sequence: CTG
ggagaataagagagactgaa

SEQ ID NO: 48865 - DNA, 20 bp, Artificial Sequence
  Description of Artificial Sequence: Synthetic oligonucleotide
  Target: SCN10A; (-) strand; PAM type: YTN; PAM sequence: CTA
atgggaaggatctgggagaa

SEQ ID NO: 48866 - DNA, 20 bp, Artificial Sequence
  Description of Artificial Sequence: Synthetic oligonucleotide
  Target: SCN10A; (-) strand; PAM type: YTN; PAM sequence: TTG
catgctaatgggaaggatct

SEQ ID NO: 48867 - DNA, 20 bp, Artificial Sequence
  Description of Artificial Sequence: Synthetic oligonucleotide
  Target: SCN10A; (-) strand; PAM type: YTN; PAM sequence: TTT
gcatgctaatgggaaggatc

SEQ ID NO: 48868 - DNA, 20 bp, Artificial Sequence
  Description of Artificial Sequence: Synthetic oligonucleotide
  Target: SCN10A; (-) strand; PAM type: YTN; PAM sequence: TTG
agcatatttgcatgctaatg

SEQ ID NO: 48869 - DNA, 20 bp, Artificial Sequence
  Description of Artificial Sequence: Synthetic oligonucleotide
  Target: SCN10A; (-) strand; PAM type: YTN; PAM sequence: TTT
gagcatatttgcatgctaat

SEQ ID NO: 48870 - DNA, 20 bp, Artificial Sequence
  Description of Artificial Sequence: Synthetic oligonucleotide
  Target: SCN10A; (-) strand; PAM type: YTN; PAM sequence: TTT
tgagcatatttgcatgctaa

SEQ ID NO: 48871 - DNA, 20 bp, Artificial Sequence
  Description of Artificial Sequence: Synthetic oligonucleotide
  Target: SCN10A; (-) strand; PAM type: YTN; PAM sequence: TTG
ttttgagcatatttgcatgc

SEQ ID NO: 48872 - DNA, 20 bp, Artificial Sequence
  Description of Artificial Sequence: Synthetic oligonucleotide
  Target: SCN10A; (-) strand; PAM type: YTN; PAM sequence: TTT
gttttgagcatatttgcatg

SEQ ID NO: 48873 - DNA, 20 bp, Artificial Sequence
  Description of Artificial Sequence: Synthetic oligonucleotide
  Target: SCN10A; (-) strand; PAM type: YTN; PAM sequence: TTG
tttgttttgagcatatttgc

SEQ ID NO: 48874 - DNA, 20 bp, Artificial Sequence
  Description of Artificial Sequence: Synthetic oligonucleotide
  Target: SCN10A; (-) strand; PAM type: YTN; PAM sequence: TTT
gtttgttttgagcatatttg

SEQ ID NO: 48875 - DNA, 20 bp, Artificial Sequence
  Description of Artificial Sequence: Synthetic oligonucleotide
  Target: SCN10A; (-) strand; PAM type: YTN; PAM sequence: TTG
tttgtttgttttgagcatat

SEQ ID NO: 48876 - DNA, 20 bp, Artificial Sequence
  Description of Artificial Sequence: Synthetic oligonucleotide
  Target: SCN10A; (-) strand; PAM type: YTN; PAM sequence: TTT
gtttgtttgttttgagcata

SEQ ID NO: 48877 - DNA, 20 bp, Artificial Sequence
  Description of Artificial Sequence: Synthetic oligonucleotide
  Target: SCN10A; (-) strand; PAM type: YTN; PAM sequence: TTG
tttgtttgtttgttttgagc

SEQ ID NO: 48878 - DNA, 20 bp, Artificial Sequence
  Description of Artificial Sequence: Synthetic oligonucleotide
  Target: SCN10A; (-) strand; PAM type: YTN; PAM sequence: TTT
gtttgtttgtttgttttgag

SEQ ID NO: 48879 - DNA, 20 bp, Artificial Sequence
  Description of Artificial Sequence: Synthetic oligonucleotide
  Target: SCN10A; (-) strand; PAM type: YTN; PAM sequence: TTT
tgtttgtttgtttgttttga

SEQ ID NO: 48880 - DNA, 20 bp, Artificial Sequence
  Description of Artificial Sequence: Synthetic oligonucleotide
  Target: SCN10A; (-) strand; PAM type: YTN; PAM sequence: TTT
ttgtttgtttgtttgttttg

SEQ ID NO: 48881 - DNA, 20 bp, Artificial Sequence
  Description of Artificial Sequence: Synthetic oligonucleotide
  Target: SCN10A; (-) strand; PAM type: YTN; PAM sequence: TTG
ggggagtttttgtttgtttg

SEQ ID NO: 48882 - DNA, 20 bp, Artificial Sequence
  Description of Artificial Sequence: Synthetic oligonucleotide
  Target: SCN10A; (-) strand; PAM type: YTN; PAM sequence: TTT
gggggagtttttgtttgttt

SEQ ID NO: 48883 - DNA, 20 bp, Artificial Sequence
  Description of Artificial Sequence: Synthetic oligonucleotide
  Target: SCN10A; (-) strand; PAM type: YTN; PAM sequence: TTG
tgtttgggggagtttttgtt

SEQ ID NO: 48884 - DNA, 20 bp, Artificial Sequence
  Description of Artificial Sequence: Synthetic oligonucleotide
  Target: SCN10A; (-) strand; PAM type: YTN; PAM sequence: TTT
gtgtttgggggagtttttgt

SEQ ID NO: 48885 - DNA, 20 bp, Artificial Sequence
  Description of Artificial Sequence: Synthetic oligonucleotide
  Target: SCN10A; (-) strand; PAM type: YTN; PAM sequence: TTT
tgtgtttgggggagtttttg

SEQ ID NO: 48886 - DNA, 20 bp, Artificial Sequence
  Description of Artificial Sequence: Synthetic oligonucleotide
  Target: SCN10A; (-) strand; PAM type: YTN; PAM sequence: TTT
ttgtgtttgggggagttttt

SEQ ID NO: 48887 - DNA, 20 bp, Artificial Sequence
  Description of Artificial Sequence: Synthetic oligonucleotide
  Target: SCN10A; (-) strand; PAM type: YTN; PAM sequence: TTG
gtttttgtgtttgggggagt

SEQ ID NO: 48888 - DNA, 20 bp, Artificial Sequence
  Description of Artificial Sequence: Synthetic oligonucleotide
  Target: SCN10A; (-) strand; PAM type: YTN; PAM sequence: TTT
ggtttttgtgtttgggggag

SEQ ID NO: 48889 - DNA, 20 bp, Artificial Sequence
  Description of Artificial Sequence: Synthetic oligonucleotide
  Target: SCN10A; (-) strand; PAM type: YTN; PAM sequence: TTT
tggtttttgtgtttggggga

SEQ ID NO: 48890 - DNA, 20 bp, Artificial Sequence
  Description of Artificial Sequence: Synthetic oligonucleotide
  Target: SCN10A; (-) strand; PAM type: YTN; PAM sequence: TTT
ttggtttttgtgtttggggg

SEQ ID NO: 48891 - DNA, 20 bp, Artificial Sequence
  Description of Artificial Sequence: Synthetic oligonucleotide
  Target: SCN10A; (-) strand; PAM type: YTN; PAM sequence: CTT
tttggtttttgtgtttgggg

SEQ ID NO: 48892 - DNA, 20 bp, Artificial Sequence
  Description of Artificial Sequence: Synthetic oligonucleotide
  Target: SCN10A; (-) strand; PAM type: YTN; PAM sequence: TTG
aaagaagactttttggtttt

SEQ ID NO: 48893 - DNA, 20 bp, Artificial Sequence
  Description of Artificial Sequence: Synthetic oligonucleotide
  Target: SCN10A; (-) strand; PAM type: YTN; PAM sequence: CTA
gggagtagggagaattgaaa

SEQ ID NO: 48894 - DNA, 20 bp, Artificial Sequence
  Description of Artificial Sequence: Synthetic oligonucleotide
  Target: SCN10A; (-) strand; PAM type: YTN; PAM sequence: CTG
tgaggaaaaggagatagtaa

SEQ ID NO: 48895 - DNA, 20 bp, Artificial Sequence
  Description of Artificial Sequence: Synthetic oligonucleotide
  Target: SCN10A; (-) strand; PAM type: YTN; PAM sequence: TTG
cctgtgaggaaaaggagata

SEQ ID NO: 48896 - DNA, 20 bp, Artificial Sequence
  Description of Artificial Sequence: Synthetic oligonucleotide
  Target: SCN10A; (-) strand; PAM type: YTN; PAM sequence: TTT
gcctgtgaggaaaaggagat

SEQ ID NO: 48897 - DNA, 20 bp, Artificial Sequence
  Description of Artificial Sequence: Synthetic oligonucleotide
  Target: SCN10A; (-) strand; PAM type: YTN; PAM sequence: TTC
aagaagtttgcctgtgagga

SEQ ID NO: 48898 - DNA, 20 bp, Artificial Sequence
  Description of Artificial Sequence: Synthetic oligonucleotide
  Target: SCN10A; (-) strand; PAM type: YTN; PAM sequence: TTT
caagaagtttgcctgtgagg

SEQ ID NO: 48899 - DNA, 20 bp, Artificial Sequence
  Description of Artificial Sequence: Synthetic oligonucleotide
  Target: SCN10A; (-) strand; PAM type: YTN; PAM sequence: TTT
tcaagaagtttgcctgtgag

SEQ ID NO: 48900 - DNA, 20 bp, Artificial Sequence
  Description of Artificial Sequence: Synthetic oligonucleotide
  Target: SCN10A; (-) strand; PAM type: YTN; PAM sequence: TTT
ttcaagaagtttgcctgtga

SEQ ID NO: 48901 - DNA, 20 bp, Artificial Sequence
  Description of Artificial Sequence: Synthetic oligonucleotide
  Target: SCN10A; (-) strand; PAM type: YTN; PAM sequence: TTT
tttcaagaagtttgcctgtg

SEQ ID NO: 48902 - DNA, 20 bp, Artificial Sequence
  Description of Artificial Sequence: Synthetic oligonucleotide
  Target: SCN10A; (-) strand; PAM type: YTN; PAM sequence: TTA
aagagcgggtgagaggtgaa

SEQ ID NO: 48903 - DNA, 20 bp, Artificial Sequence
  Description of Artificial Sequence: Synthetic oligonucleotide
  Target: SCN10A; (-) strand; PAM type: YTN; PAM sequence: CTT
aaagagcgggtgagaggtga

SEQ ID NO: 48904 - DNA, 20 bp, Artificial Sequence
  Description of Artificial Sequence: Synthetic oligonucleotide
  Target: SCN10A; (-) strand; PAM type: YTN; PAM sequence: TTG
aaggggcttaaagagcgggt

SEQ ID NO: 48905 - DNA, 20 bp, Artificial Sequence
  Description of Artificial Sequence: Synthetic oligonucleotide
  Target: SCN10A; (-) strand; PAM type: YTN; PAM sequence: TTA
atggagtaaaagggtaggca

SEQ ID NO: 48906 - DNA, 20 bp, Artificial Sequence
  Description of Artificial Sequence: Synthetic oligonucleotide
  Target: SCN10A; (-) strand; PAM type: YTN; PAM sequence: CTA
agcaaaagaggattaatgga

SEQ ID NO: 48907 - DNA, 20 bp, Artificial Sequence
  Description of Artificial Sequence: Synthetic oligonucleotide
  Target: SCN10A; (-) strand; PAM type: YTN; PAM sequence: TTG
gtgatctaagcaaaagagga

SEQ ID NO: 48908 - DNA, 20 bp, Artificial Sequence
  Description of Artificial Sequence: Synthetic oligonucleotide
  Target: SCN10A; (-) strand; PAM type: YTN; PAM sequence: TTT
ggtgatctaagcaaaagagg

SEQ ID NO: 48909 - DNA, 20 bp, Artificial Sequence
  Description of Artificial Sequence: Synthetic oligonucleotide
  Target: SCN10A; (-) strand; PAM type: YTN; PAM sequence: CTT
tggtgatctaagcaaaagag

SEQ ID NO: 48910 - DNA, 20 bp, Artificial Sequence
  Description of Artificial Sequence: Synthetic oligonucleotide
  Target: SCN10A; (-) strand; PAM type: YTN; PAM sequence: TTA
gtcacatggatgtctttggt

SEQ ID NO: 48911 - DNA, 20 bp, Artificial Sequence
  Description of Artificial Sequence: Synthetic oligonucleotide
  Target: SCN10A; (-) strand; PAM type: YTN; PAM sequence: TTT
agtcacatggatgtctttgg

SEQ ID NO: 48912 - DNA, 20 bp, Artificial Sequence
  Description of Artificial Sequence: Synthetic oligonucleotide
  Target: SCN10A; (-) strand; PAM type: YTN; PAM sequence: CTT
tagtcacatggatgtctttg

SEQ ID NO: 48913 - DNA, 20 bp, Artificial Sequence
  Description of Artificial Sequence: Synthetic oligonucleotide
  Target: SCN10A; (-) strand; PAM type: YTN; PAM sequence: CTG
tggaaaggtcaggtaaaatg

SEQ ID NO: 48914 - DNA, 20 bp, Artificial Sequence
  Description of Artificial Sequence: Synthetic oligonucleotide
  Target: SCN10A; (-) strand; PAM type: YTN; PAM sequence: TTC
agaaagaatagaaaggccaa

SEQ ID NO: 48915 - DNA, 20 bp, Artificial Sequence
  Description of Artificial Sequence: Synthetic oligonucleotide
  Target: SCN10A; (-) strand; PAM type: YTN; PAM sequence: CTT
cagaaagaatagaaaggcca

SEQ ID NO: 48916 - DNA, 20 bp, Artificial Sequence
  Description of Artificial Sequence: Synthetic oligonucleotide
  Target: SCN10A; (-) strand; PAM type: YTN; PAM sequence: TTC
ttcagaaagaatagaaaggc

SEQ ID NO: 48917 - DNA, 20 bp, Artificial Sequence
  Description of Artificial Sequence: Synthetic oligonucleotide
  Target: SCN10A; (-) strand; PAM type: YTN; PAM sequence: TTT
cttcagaaagaatagaaagg

SEQ ID NO: 48918 - DNA, 20 bp, Artificial Sequence
  Description of Artificial Sequence: Synthetic oligonucleotide
  Target: SCN10A; (-) strand; PAM type: YTN; PAM sequence: CTA
gaagaatacaatgcagagcc

SEQ ID NO: 48919 - DNA, 20 bp, Artificial Sequence
  Description of Artificial Sequence: Synthetic oligonucleotide
  Target: SCN10A; (-) strand; PAM type: YTN; PAM sequence: CTG
aaaaggaaggtacagaaata

SEQ ID NO: 48920 - DNA, 20 bp, Artificial Sequence
  Description of Artificial Sequence: Synthetic oligonucleotide
  Target: SCN10A; (-) strand; PAM type: YTN; PAM sequence: TTA
agcagaagagatggacccag

SEQ ID NO: 48921 - DNA, 20 bp, Artificial Sequence
  Description of Artificial Sequence: Synthetic oligonucleotide
  Target: SCN10A; (-) strand; PAM type: YTN; PAM sequence: TTA
atagttaagcagaagagatg

SEQ ID NO: 48922 - DNA, 20 bp, Artificial Sequence
  Description of Artificial Sequence: Synthetic oligonucleotide
  Target: SCN10A; (-) strand; PAM type: YTN; PAM sequence: TTT
aatagttaagcagaagagat

SEQ ID NO: 48923 - DNA, 20 bp, Artificial Sequence
  Description of Artificial Sequence: Synthetic oligonucleotide
  Target: SCN10A; (-) strand; PAM type: YTN; PAM sequence: CTA
aatgtttaatagttaagcag

SEQ ID NO: 48924 - DNA, 20 bp, Artificial Sequence
  Description of Artificial Sequence: Synthetic oligonucleotide
  Target: SCN10A; (-) strand; PAM type: YTN; PAM sequence: CTA
acaaactaaatgtttaatag

SEQ ID NO: 48925 - DNA, 20 bp, Artificial Sequence
  Description of Artificial Sequence: Synthetic oligonucleotide
  Target: SCN10A; (-) strand; PAM type: YTN; PAM sequence: TTC
taacaaactaaatgtttaat

SEQ ID NO: 48926 - DNA, 20 bp, Artificial Sequence
  Description of Artificial Sequence: Synthetic oligonucleotide
  Target: SCN10A; (-) strand; PAM type: YTN; PAM sequence: CTC
agacacagttctaacaaact

SEQ ID NO: 48927 - DNA, 20 bp, Artificial Sequence
  Description of Artificial Sequence: Synthetic oligonucleotide
  Target: SCN10A; (-) strand; PAM type: YTN; PAM sequence: TTG
aagtaagaagagaagaaggc

SEQ ID NO: 48928 - DNA, 20 bp, Artificial Sequence
  Description of Artificial Sequence: Synthetic oligonucleotide
  Target: SCN10A; (-) strand; PAM type: YTN; PAM sequence: TTA
acacagaagggttgaagtaa

SEQ ID NO: 48929 - DNA, 20 bp, Artificial Sequence
  Description of Artificial Sequence: Synthetic oligonucleotide
  Target: SCN10A; (-) strand; PAM type: YTN; PAM sequence: CTG
gatgagttaacacagaaggg

SEQ ID NO: 48930 - DNA, 20 bp, Artificial Sequence
  Description of Artificial Sequence: Synthetic oligonucleotide
  Target: SCN10A; (-) strand; PAM type: YTN; PAM sequence: TTG
aaaagatgcaactggatgag

SEQ ID NO: 48931 - DNA, 20 bp, Artificial Sequence
  Description of Artificial Sequence: Synthetic oligonucleotide
  Target: SCN10A; (-) strand; PAM type: YTN; PAM sequence: TTT
gaaaagatgcaactggatga

SEQ ID NO: 48932 - DNA, 20 bp, Artificial Sequence
  Description of Artificial Sequence: Synthetic oligonucleotide
  Target: SCN10A; (-) strand; PAM type: YTN; PAM sequence: TTT
tgaaaagatgcaactggatg

SEQ ID NO: 48933 - DNA, 20 bp, Artificial Sequence
  Description of Artificial Sequence: Synthetic oligonucleotide
  Target: SCN10A; (-) strand; PAM type: YTN; PAM sequence: TTG
aatgtaagtggtaattttga

SEQ ID NO: 48934 - DNA, 20 bp, Artificial Sequence
  Description of Artificial Sequence: Synthetic oligonucleotide
  Target: SCN10A; (-) strand; PAM type: YTN; PAM sequence: TTT
gaatgtaagtggtaattttg

SEQ ID NO: 48935 - DNA, 20 bp, Artificial Sequence
  Description of Artificial Sequence: Synthetic oligonucleotide
  Target: SCN10A; (-) strand; PAM type: YTN; PAM sequence: TTG
aaagcagtttgaatgtaagt

SEQ ID NO: 48936 - DNA, 20 bp, Artificial Sequence
  Description of Artificial Sequence: Synthetic oligonucleotide
  Target: SCN10A; (-) strand; PAM type: YTN; PAM sequence: TTT
gaaagcagtttgaatgtaag

SEQ ID NO: 48937 - DNA, 20 bp, Artificial Sequence
  Description of Artificial Sequence: Synthetic oligonucleotide
  Target: SCN10A; (-) strand; PAM type: YTN; PAM sequence: TTA
gatgacaaagatggcatata

SEQ ID NO: 48938 - DNA, 20 bp, Artificial Sequence
  Description of Artificial Sequence: Synthetic oligonucleotide
  Target: SCN10A; (-) strand; PAM type: YTN; PAM sequence: CTT
agatgacaaagatggcatat

SEQ ID NO: 48939 - DNA, 20 bp, Artificial Sequence
  Description of Artificial Sequence: Synthetic oligonucleotide
  Target: SCN10A; (-) strand; PAM type: YTN; PAM sequence: CTA
gaacttagatgacaaagatg

SEQ ID NO: 48940 - DNA, 20 bp, Artificial Sequence
  Description of Artificial Sequence: Synthetic oligonucleotide
  Target: SCN10A; (-) strand; PAM type: YTN; PAM sequence: TTA
ggatataggggtctagaact

SEQ ID NO: 48941 - DNA, 20 bp, Artificial Sequence
  Description of Artificial Sequence: Synthetic oligonucleotide
  Target: SCN10A; (-) strand; PAM type: YTN; PAM sequence: TTT
aggatataggggtctagaac

SEQ ID NO: 48942 - DNA, 20 bp, Artificial Sequence
  Description of Artificial Sequence: Synthetic oligonucleotide
  Target: SCN10A; (-) strand; PAM type: YTN; PAM sequence: CTT
taggatataggggtctagaa

SEQ ID NO: 48943 - DNA, 20 bp, Artificial Sequence
  Description of Artificial Sequence: Synthetic oligonucleotide
  Target: SCN10A; (-) strand; PAM type: YTN; PAM sequence: TTG
actttaggatataggggtct

SEQ ID NO: 48944 - DNA, 20 bp, Artificial Sequence
  Description of Artificial Sequence: Synthetic oligonucleotide
  Target: SCN10A; (-) strand; PAM type: YTN; PAM sequence: CTA
ggtaggggtgtccagtagga

SEQ ID NO: 48945 - DNA, 20 bp, Artificial Sequence
  Description of Artificial Sequence: Synthetic oligonucleotide
  Target: SCN10A; (-) strand; PAM type: YTN; PAM sequence: TTG
gagcatctaggtaggggtgt

SEQ ID NO: 48946 - DNA, 20 bp, Artificial Sequence
  Description of Artificial Sequence: Synthetic oligonucleotide
  Target: SCN10A; (-) strand; PAM type: YTN; PAM sequence: CTT
ggagcatctaggtaggggtg

SEQ ID NO: 48947 - DNA, 20 bp, Artificial Sequence
  Description of Artificial Sequence: Synthetic oligonucleotide
  Target: SCN10A; (-) strand; PAM type: YTN; PAM sequence: TTC
aggtgcccttggagcatcta

SEQ ID NO: 48948 - DNA, 20 bp, Artificial Sequence
  Description of Artificial Sequence: Synthetic oligonucleotide
  Target: SCN10A; (-) strand; PAM type: YTN; PAM sequence: TTT
caggtgcccttggagcatct

SEQ ID NO: 48949 - DNA, 20 bp, Artificial Sequence
  Description of Artificial Sequence: Synthetic oligonucleotide
  Target: SCN10A; (-) strand; PAM type: YTN; PAM sequence: TTG
ggtttcaggtgcccttggag

SEQ ID NO: 48950 - DNA, 20 bp, Artificial Sequence
  Description of Artificial Sequence: Synthetic oligonucleotide
  Target: SCN10A; (-) strand; PAM type: YTN; PAM sequence: CTG
ggatatattgggtttcaggt

SEQ ID NO: 48951 - DNA, 20 bp, Artificial Sequence
  Description of Artificial Sequence: Synthetic oligonucleotide
  Target: SCN10A; (-) strand; PAM type: YTN; PAM sequence: TTG
agtctgggatatattgggtt

SEQ ID NO: 48952 - DNA, 20 bp, Artificial Sequence
  Description of Artificial Sequence: Synthetic oligonucleotide
  Target: SCN10A; (-) strand; PAM type: YTN; PAM sequence: TTA
tgagttgagtctgggatata

SEQ ID NO: 48953 - DNA, 20 bp, Artificial Sequence
  Description of Artificial Sequence: Synthetic oligonucleotide
  Target: SCN10A; (-) strand; PAM type: YTN; PAM sequence: TTA
atggggaaagatgaaagaag

SEQ ID NO: 48954 - DNA, 20 bp, Artificial Sequence
  Description of Artificial Sequence: Synthetic oligonucleotide
  Target: SCN10A; (-) strand; PAM type: YTN; PAM sequence: TTT
aatggggaaagatgaaagaa

SEQ ID NO: 48955 - DNA, 20 bp, Artificial Sequence
  Description of Artificial Sequence: Synthetic oligonucleotide
  Target: SCN10A; (-) strand; PAM type: YTN; PAM sequence: CTT
taatggggaaagatgaaaga

SEQ ID NO: 48956 - DNA, 20 bp, Artificial Sequence
  Description of Artificial Sequence: Synthetic oligonucleotide
  Target: SCN10A; (-) strand; PAM type: YTN; PAM sequence: TTA
ggggaagaagggggctttaa

SEQ ID NO: 48957 - DNA, 20 bp, Artificial Sequence
  Description of Artificial Sequence: Synthetic oligonucleotide
  Target: SCN10A; (-) strand; PAM type: YTN; PAM sequence: TTT
aggggaagaagggggcttta

SEQ ID NO: 48958 - DNA, 20 bp, Artificial Sequence
  Description of Artificial Sequence: Synthetic oligonucleotide
  Target: SCN10A; (-) strand; PAM type: YTN; PAM sequence: TTT
taggggaagaagggggcttt

SEQ ID NO: 48959 - DNA, 20 bp, Artificial Sequence
  Description of Artificial Sequence: Synthetic oligonucleotide
  Target: SCN10A; (-) strand; PAM type: YTN; PAM sequence: CTC
ataaagggagcattttaggg

SEQ ID NO: 48960 - DNA, 20 bp, Artificial Sequence
  Description of Artificial Sequence: Synthetic oligonucleotide
  Target: SCN10A; (-) strand; PAM type: YTN; PAM sequence: CTG
atacaataactcataaaggg

SEQ ID NO: 48961 - DNA, 20 bp, Artificial Sequence
  Description of Artificial Sequence: Synthetic oligonucleotide
  Target: SCN10A; (-) strand; PAM type: YTN; PAM sequence: TTA
agatatgctgatacaataac

SEQ ID NO: 48962 - DNA, 20 bp, Artificial Sequence
  Description of Artificial Sequence: Synthetic oligonucleotide
  Target: SCN10A; (-) strand; PAM type: YTN; PAM sequence: CTT
aagatatgctgatacaataa

SEQ ID NO: 48963 - DNA, 20 bp, Artificial Sequence
  Description of Artificial Sequence: Synthetic oligonucleotide
  Target: SCN10A; (-) strand; PAM type: YTN; PAM sequence: CTG
gtataagtgccttaagatat

SEQ ID NO: 48964 - DNA, 20 bp, Artificial Sequence
  Description of Artificial Sequence: Synthetic oligonucleotide
  Target: SCN10A; (-) strand; PAM type: YTN; PAM sequence: TTC
tggtataagtgccttaagat

SEQ ID NO: 48965 - DNA, 20 bp, Artificial Sequence
  Description of Artificial Sequence: Synthetic oligonucleotide
  Target: SCN10A; (-) strand; PAM type: YTN; PAM sequence: TTG
atgatgcatatggttctggt

SEQ ID NO: 48966 - DNA, 20 bp, Artificial Sequence
  Description of Artificial Sequence: Synthetic oligonucleotide
  Target: SCN10A; (-) strand; PAM type: YTN; PAM sequence: CTT
gatgatgcatatggttctgg

SEQ ID NO: 48967 - DNA, 20 bp, Artificial Sequence
  Description of Artificial Sequence: Synthetic oligonucleotide
  Target: SCN10A; (-) strand; PAM type: YTN; PAM sequence: TTC
aggacttgatgatgcatatg

SEQ ID NO: 48968 - DNA, 20 bp, Artificial Sequence
  Description of Artificial Sequence: Synthetic oligonucleotide
  Target: SCN10A; (-) strand; PAM type: YTN; PAM sequence: CTA
aggggcataagattcaggac

SEQ ID NO: 48969 - DNA, 20 bp, Artificial Sequence
  Description of Artificial Sequence: Synthetic oligonucleotide
  Target: SCN10A; (-) strand; PAM type: YTN; PAM sequence: CTA
tctaaggggcataagattca

SEQ ID NO: 48970 - DNA, 20 bp, Artificial Sequence
  Description of Artificial Sequence: Synthetic oligonucleotide
  Target: SCN10A; (-) strand; PAM type: YTN; PAM sequence: CTG
atgggaaatggaaggatatg

SEQ ID NO: 48971 - DNA, 20 bp, Artificial Sequence
  Description of Artificial Sequence: Synthetic oligonucleotide
  Target: SCN10A; (-) strand; PAM type: YTN; PAM sequence: CTG
gggtagtgacagtggggctg

SEQ ID NO: 48972 - DNA, 20 bp, Artificial Sequence
  Description of Artificial Sequence: Synthetic oligonucleotide
  Target: SCN10A; (-) strand; PAM type: YTN; PAM sequence: CTC
tggggtagtgacagtggggc

SEQ ID NO: 48973 - DNA, 20 bp, Artificial Sequence
  Description of Artificial Sequence: Synthetic oligonucleotide
  Target: SCN10A; (-) strand; PAM type: YTN; PAM sequence: TTG
aactctggggtagtgacagt

SEQ ID NO: 48974 - DNA, 20 bp, Artificial Sequence
  Description of Artificial Sequence: Synthetic oligonucleotide
  Target: SCN10A; (-) strand; PAM type: YTN; PAM sequence: CTT
gaactctggggtagtgacag

SEQ ID NO: 48975 - DNA, 20 bp, Artificial Sequence
  Description of Artificial Sequence: Synthetic oligonucleotide
  Target: SCN10A; (-) strand; PAM type: YTN; PAM sequence: TTA
ggaggaagccaagtacaaga

SEQ ID NO: 48976 - DNA, 20 bp, Artificial Sequence
  Description of Artificial Sequence: Synthetic oligonucleotide
  Target: SCN10A; (-) strand; PAM type: YTN; PAM sequence: TTG
tcagggaaaccagttaggag

SEQ ID NO: 48977 - DNA, 20 bp, Artificial Sequence
  Description of Artificial Sequence: Synthetic oligonucleotide
  Target: SCN10A; (-) strand; PAM type: YTN; PAM sequence: TTG
tagatataagaggggaagta

SEQ ID NO: 48978 - DNA, 20 bp, Artificial Sequence
  Description of Artificial Sequence: Synthetic oligonucleotide
  Target: SCN10A; (-) strand; PAM type: YTN; PAM sequence: CTT
gtagatataagaggggaagt

SEQ ID NO: 48979 - DNA, 20 bp, Artificial Sequence
  Description of Artificial Sequence: Synthetic oligonucleotide
  Target: SCN10A; (-) strand; PAM type: YTN; PAM sequence: CTG
gatacttgtagatataagag

SEQ ID NO: 48980 - DNA, 20 bp, Artificial Sequence
  Description of Artificial Sequence: Synthetic oligonucleotide
  Target: SCN10A; (-) strand; PAM type: YTN; PAM sequence: CTC
tggatacttgtagatataag

SEQ ID NO: 48981 - DNA, 20 bp, Artificial Sequence
  Description of Artificial Sequence: Synthetic oligonucleotide
  Target: SCN10A; (-) strand; PAM type: YTN; PAM sequence: TTA
ctctggatacttgtagatat

SEQ ID NO: 48982 - DNA, 20 bp, Artificial Sequence
  Description of Artificial Sequence: Synthetic oligonucleotide
  Target: SCN10A; (-) strand; PAM type: YTN; PAM sequence: TTA
taaaagttactctggatact

SEQ ID NO: 48983 - DNA, 20 bp, Artificial Sequence
  Description of Artificial Sequence: Synthetic oligonucleotide
  Target: SCN10A; (-) strand; PAM type: YTN; PAM sequence: TTT
ataaaagttactctggatac

SEQ ID NO: 48984 - DNA, 20 bp, Artificial Sequence
  Description of Artificial Sequence: Synthetic oligonucleotide
  Target: SCN10A; (-) strand; PAM type: YTN; PAM sequence: TTT
tataaaagttactctggata

SEQ ID NO: 48985 - DNA, 20 bp, Artificial Sequence
  Description of Artificial Sequence: Synthetic oligonucleotide
  Target: SCN10A; (-) strand; PAM type: YTN; PAM sequence: TTG
cattttataaaagttactct

SEQ ID NO: 48986 - DNA, 20 bp, Artificial Sequence
  Description of Artificial Sequence: Synthetic oligonucleotide
  Target: SCN10A; (-) strand; PAM type: YTN; PAM sequence: TTT
gcattttataaaagttactc

SEQ ID NO: 48987 - DNA, 20 bp, Artificial Sequence
  Description of Artificial Sequence: Synthetic oligonucleotide
  Target: SCN10A; (-) strand; PAM type: YTN; PAM sequence: TTA
catttgcattttataaaagt

SEQ ID NO: 48988 - DNA, 20 bp, Artificial Sequence
  Description of Artificial Sequence: Synthetic oligonucleotide
  Target: SCN10A; (-) strand; PAM type: YTN; PAM sequence: TTG
gaggcagggaagttacattt

SEQ ID NO: 48989 - DNA, 20 bp, Artificial Sequence
  Description of Artificial Sequence: Synthetic oligonucleotide
  Target: SCN10A; (-) strand; PAM type: YTN; PAM sequence: TTA
aaggattggaggcagggaag

SEQ ID NO: 48990 - DNA, 20 bp, Artificial Sequence
  Description of Artificial Sequence: Synthetic oligonucleotide
  Target: SCN10A; (-) strand; PAM type: YTN; PAM sequence: CTA
agaggagtgaggtgccatta

SEQ ID NO: 48991 - DNA, 20 bp, Artificial Sequence
  Description of Artificial Sequence: Synthetic oligonucleotide
  Target: SCN10A; (-) strand; PAM type: YTN; PAM sequence: TTC
atgctaagaggagtgaggtg

SEQ ID NO: 48992 - DNA, 20 bp, Artificial Sequence
  Description of Artificial Sequence: Synthetic oligonucleotide
  Target: SCN10A; (-) strand; PAM type: YTN; PAM sequence: CTT
catgctaagaggagtgaggt

SEQ ID NO: 48993 - DNA, 20 bp, Artificial Sequence
  Description of Artificial Sequence: Synthetic oligonucleotide
  Target: SCN10A; (-) strand; PAM type: YTN; PAM sequence: TTA
aggatatgggacttcatgct

SEQ ID NO: 48994 - DNA, 20 bp, Artificial Sequence
  Description of Artificial Sequence: Synthetic oligonucleotide
  Target: SCN10A; (-) strand; PAM type: YTN; PAM sequence: CTG
cattaaggatatgggacttc

SEQ ID NO: 48995 - DNA, 20 bp, Artificial Sequence
  Description of Artificial Sequence: Synthetic oligonucleotide
  Target: SCN10A; (-) strand; PAM type: YTN; PAM sequence: CTA
gactgcattaaggatatggg

SEQ ID NO: 48996 - DNA, 20 bp, Artificial Sequence
  Description of Artificial Sequence: Synthetic oligonucleotide
  Target: SCN10A; (-) strand; PAM type: YTN; PAM sequence: CTC
ctagactgcattaaggatat

SEQ ID NO: 48997 - DNA, 20 bp, Artificial Sequence
  Description of Artificial Sequence: Synthetic oligonucleotide
  Target: SCN10A; (-) strand; PAM type: YTN; PAM sequence: TTG
gggccagatcccaagaaact

SEQ ID NO: 48998 - DNA, 20 bp, Artificial Sequence
  Description of Artificial Sequence: Synthetic oligonucleotide
  Target: SCN10A; (-) strand; PAM type: YTN; PAM sequence: CTA
gagggatgagttggggccag

SEQ ID NO: 48999 - DNA, 20 bp, Artificial Sequence
  Description of Artificial Sequence: Synthetic oligonucleotide
  Target: SCN10A; (-) strand; PAM type: YTN; PAM sequence: CTG
aaaataaggctagagggatg

SEQ ID NO: 49000 - DNA, 20 bp, Artificial Sequence
  Description of Artificial Sequence: Synthetic oligonucleotide
  Target: SCN10A; (-) strand; PAM type: YTN; PAM sequence: CTA
gagaaccaggagaactgaaa

SEQ ID NO: 49001 - DNA, 20 bp, Artificial Sequence
  Description of Artificial Sequence: Synthetic oligonucleotide
  Target: SCN10A; (-) strand; PAM type: YTN; PAM sequence: CTG
taacctagagaaccaggaga

SEQ ID NO: 49002 - DNA, 20 bp, Artificial Sequence
  Description of Artificial Sequence: Synthetic oligonucleotide
  Target: SCN10A; (-) strand; PAM type: YTN; PAM sequence: CTA
atgtagctgtaacctagaga

SEQ ID NO: 49003 - DNA, 20 bp, Artificial Sequence
  Description of Artificial Sequence: Synthetic oligonucleotide
  Target: SCN10A; (-) strand; PAM type: YTN; PAM sequence: TTG
aaggaatgaaaaagcctaat

SEQ ID NO: 49004 - DNA, 20 bp, Artificial Sequence
  Description of Artificial Sequence: Synthetic oligonucleotide
  Target: SCN10A; (-) strand; PAM type: YTN; PAM sequence: TTT
gaaggaatgaaaaagcctaa

SEQ ID NO: 49005 - DNA, 20 bp, Artificial Sequence
  Description of Artificial Sequence: Synthetic oligonucleotide
  Target: SCN10A; (-) strand; PAM type: YTN; PAM sequence: CTG
caaagcagaagagagaataa

SEQ ID NO: 49006 - DNA, 20 bp, Artificial Sequence
  Description of Artificial Sequence: Synthetic oligonucleotide
  Target: SCN10A; (-) strand; PAM type: YTN; PAM sequence: CTG
aaaggactgcaaagcagaag

SEQ ID NO: 49007 - DNA, 20 bp, Artificial Sequence
  Description of Artificial Sequence: Synthetic oligonucleotide
  Target: SCN10A; (-) strand; PAM type: YTN; PAM sequence: TTA
tcccaggctgaaaggactgc

SEQ ID NO: 49008 - DNA, 20 bp, Artificial Sequence
  Description of Artificial Sequence: Synthetic oligonucleotide
  Target: SCN10A; (-) strand; PAM type: YTN; PAM sequence: CTG
gagccagggaattatcccag

SEQ ID NO: 49009 - DNA, 20 bp, Artificial Sequence
  Description of Artificial Sequence: Synthetic oligonucleotide
  Target: SCN10A; (-) strand; PAM type: YTN; PAM sequence: TTG
cctggagccagggaattatc

SEQ ID NO: 49010 - DNA, 20 bp, Artificial Sequence
  Description of Artificial Sequence: Synthetic oligonucleotide
  Target: SCN10A; (-) strand; PAM type: YTN; PAM sequence: TTT
gcctggagccagggaattat

SEQ ID NO: 49011 - DNA, 20 bp, Artificial Sequence
  Description of Artificial Sequence: Synthetic oligonucleotide
  Target: SCN10A; (-) strand; PAM type: YTN; PAM sequence: CTA
agtgaaatatggtaagattt

SEQ ID NO: 49012 - DNA, 20 bp, Artificial Sequence
  Description of Artificial Sequence: Synthetic oligonucleotide
  Target: SCN10A; (-) strand; PAM type: YTN; PAM sequence: TTA
aagaggaagtgcaggatact

SEQ ID NO: 49013 - DNA, 20 bp, Artificial Sequence
  Description of Artificial Sequence: Synthetic oligonucleotide
  Target: SCN10A; (-) strand; PAM type: YTN; PAM sequence: CTT
aaagaggaagtgcaggatac

SEQ ID NO: 49014 - DNA, 20 bp, Artificial Sequence
  Description of Artificial Sequence: Synthetic oligonucleotide
  Target: SCN10A; (-) strand; PAM type: YTN; PAM sequence: CTG
gagtggtgagtgccttaaag

SEQ ID NO: 49015 - DNA, 20 bp, Artificial Sequence
  Description of Artificial Sequence: Synthetic oligonucleotide
  Target: SCN10A; (-) strand; PAM type: YTN; PAM sequence: TTA
ctggagtggtgagtgcctta

SEQ ID NO: 49016 - DNA, 20 bp, Artificial Sequence
  Description of Artificial Sequence: Synthetic oligonucleotide
  Target: SCN10A; (-) strand; PAM type: YTN; PAM sequence: CTT
actggagtggtgagtgcctt

SEQ ID NO: 49017 - DNA, 20 bp, Artificial Sequence
  Description of Artificial Sequence: Synthetic oligonucleotide
  Target: SCN10A; (-) strand; PAM type: YTN; PAM sequence: CTG
ggtcacagcagtgagcttac

SEQ ID NO: 49018 - DNA, 20 bp, Artificial Sequence
  Description of Artificial Sequence: Synthetic oligonucleotide
  Target: SCN10A; (-) strand; PAM type: YTN; PAM sequence: TTC
cagaagctgggtcacagcag

SEQ ID NO: 49019 - DNA, 20 bp, Artificial Sequence
  Description of Artificial Sequence: Synthetic oligonucleotide
  Target: SCN10A; (-) strand; PAM type: YTN; PAM sequence: TTG
tccaagccagaattccagaa

SEQ ID NO: 49020 - DNA, 20 bp, Artificial Sequence
  Description of Artificial Sequence: Synthetic oligonucleotide
  Target: SCN10A; (-) strand; PAM type: YTN; PAM sequence: CTG
ttgtccaagccagaattcca

SEQ ID NO: 49021 - DNA, 20 bp, Artificial Sequence
  Description of Artificial Sequence: Synthetic oligonucleotide
  Target: SCN10A; (-) strand; PAM type: YTN; PAM sequence: TTC
actgttgtccaagccagaat

SEQ ID NO: 49022 - DNA, 20 bp, Artificial Sequence
  Description of Artificial Sequence: Synthetic oligonucleotide
  Target: SCN10A; (-) strand; PAM type: YTN; PAM sequence: TTT
cactgttgtccaagccagaa

SEQ ID NO: 49023 - DNA, 20 bp, Artificial Sequence
  Description of Artificial Sequence: Synthetic oligonucleotide
  Target: SCN10A; (-) strand; PAM type: YTN; PAM sequence: CTG
agatttcactgttgtccaag

SEQ ID NO: 49024 - DNA, 20 bp, Artificial Sequence
  Description of Artificial Sequence: Synthetic oligonucleotide
  Target: SCN10A; (-) strand; PAM type: YTN; PAM sequence: TTG
gcatgcaagctgagatttca

SEQ ID NO: 49025 - DNA, 20 bp, Artificial Sequence
  Description of Artificial Sequence: Synthetic oligonucleotide
  Target: SCN10A; (-) strand; PAM type: YTN; PAM sequence: CTT
ggcatgcaagctgagatttc

SEQ ID NO: 49026 - DNA, 20 bp, Artificial Sequence
  Description of Artificial Sequence: Synthetic oligonucleotide
  Target: SCN10A; (-) strand; PAM type: YTN; PAM sequence: CTA
tgcttggcatgcaagctgag

SEQ ID NO: 49027 - DNA, 20 bp, Artificial Sequence
  Description of Artificial Sequence: Synthetic oligonucleotide
  Target: SCN10A; (-) strand; PAM type: YTN; PAM sequence: TTC
tatgcttggcatgcaagctg

SEQ ID NO: 49028 - DNA, 20 bp, Artificial Sequence
  Description of Artificial Sequence: Synthetic oligonucleotide
  Target: SCN10A; (-) strand; PAM type: YTN; PAM sequence: CTT
ctatgcttggcatgcaagct

SEQ ID NO: 49029 - DNA, 20 bp, Artificial Sequence
  Description of Artificial Sequence: Synthetic oligonucleotide
  Target: SCN10A; (-) strand; PAM type: YTN; PAM sequence: CTC
aaagcatgtgaaccttctat

SEQ ID NO: 49030 - DNA, 20 bp, Artificial Sequence
  Description of Artificial Sequence: Synthetic oligonucleotide
  Target: SCN10A; (-) strand; PAM type: YTN; PAM sequence: CTG
aactcaaagcatgtgaacct

SEQ ID NO: 49031 - DNA, 20 bp, Artificial Sequence
  Description of Artificial Sequence: Synthetic oligonucleotide
  Target: SCN10A; (-) strand; PAM type: YTN; PAM sequence: TTC
actgaactcaaagcatgtga

SEQ ID NO: 49032 - DNA, 20 bp, Artificial Sequence
  Description of Artificial Sequence: Synthetic oligonucleotide
  Target: SCN10A; (-) strand; PAM type: YTN; PAM sequence: TTG
acaattcactgaactcaaag

SEQ ID NO: 49033 - DNA, 20 bp, Artificial Sequence
  Description of Artificial Sequence: Synthetic oligonucleotide
  Target: SCN10A; (-) strand; PAM type: YTN; PAM sequence: TTT
gacaattcactgaactcaaa

SEQ ID NO: 49034 - DNA, 20 bp, Artificial Sequence
  Description of Artificial Sequence: Synthetic oligonucleotide
  Target: SCN10A; (-) strand; PAM type: YTN; PAM sequence: TTG
gcccaaaccaacaggagttt

SEQ ID NO: 49035 - DNA, 20 bp, Artificial Sequence
  Description of Artificial Sequence: Synthetic oligonucleotide
  Target: SCN10A; (-) strand; PAM type: YTN; PAM sequence: TTT
ggcccaaaccaacaggagtt

SEQ ID NO: 49036 - DNA, 20 bp, Artificial Sequence
  Description of Artificial Sequence: Synthetic oligonucleotide
  Target: SCN10A; (-) strand; PAM type: YTN; PAM sequence: TTA
agaaagtttggcccaaacca

SEQ ID NO: 49037 - DNA, 20 bp, Artificial Sequence
  Description of Artificial Sequence: Synthetic oligonucleotide
  Target: SCN10A; (-) strand; PAM type: YTN; PAM sequence: CTT
aagaaagtttggcccaaacc

SEQ ID NO: 49038 - DNA, 20 bp, Artificial Sequence
  Description of Artificial Sequence: Synthetic oligonucleotide
  Target: SCN10A; (-) strand; PAM type: YTN; PAM sequence: TTA
tgcttaagaaagtttggccc

SEQ ID NO: 49039 - DNA, 20 bp, Artificial Sequence
  Description of Artificial Sequence: Synthetic oligonucleotide
  Target: SCN10A; (-) strand; PAM type: YTN; PAM sequence: TTA
agagggattatgcttaagaa

SEQ ID NO: 49040 - DNA, 20 bp, Artificial Sequence
  Description of Artificial Sequence: Synthetic oligonucleotide
  Target: SCN10A; (-) strand; PAM type: YTN; PAM sequence: TTT
aagagggattatgcttaaga

SEQ ID NO: 49041 - DNA, 20 bp, Artificial Sequence
  Description of Artificial Sequence: Synthetic oligonucleotide
  Target: SCN10A; (-) strand; PAM type: YTN; PAM sequence: CTT
taagagggattatgcttaag

SEQ ID NO: 49042 - DNA, 20 bp, Artificial Sequence
  Description of Artificial Sequence: Synthetic oligonucleotide
  Target: SCN10A; (-) strand; PAM type: YTN; PAM sequence: CTC
tttaagagggattatgctta

SEQ ID NO: 49043 - DNA, 20 bp, Artificial Sequence
  Description of Artificial Sequence: Synthetic oligonucleotide
  Target: SCN10A; (-) strand; PAM type: YTN; PAM sequence: TTA
taaaggccacctctttaaga

SEQ ID NO: 49044 - DNA, 20 bp, Artificial Sequence
  Description of Artificial Sequence: Synthetic oligonucleotide
  Target: SCN10A; (-) strand; PAM type: YTN; PAM sequence: TTT
ataaaggccacctctttaag

SEQ ID NO: 49045 - DNA, 20 bp, Artificial Sequence
  Description of Artificial Sequence: Synthetic oligonucleotide
  Target: SCN10A; (-) strand; PAM type: YTN; PAM sequence: CTG
ccagagtcgtaataggattt

SEQ ID NO: 49046 - DNA, 20 bp, Artificial Sequence
  Description of Artificial Sequence: Synthetic oligonucleotide
  Target: SCN10A; (-) strand; PAM type: YTN; PAM sequence: TTC
atgctgccagagtcgtaata

SEQ ID NO: 49047 - DNA, 20 bp, Artificial Sequence
  Description of Artificial Sequence: Synthetic oligonucleotide
  Target: SCN10A; (-) strand; PAM type: YTN; PAM sequence: CTT
catgctgccagagtcgtaat

SEQ ID NO: 49048 - DNA, 20 bp, Artificial Sequence
  Description of Artificial Sequence: Synthetic oligonucleotide
  Target: SCN10A; (-) strand; PAM type: YTN; PAM sequence: CTG
aaggatgcttcatgctgcca

SEQ ID NO: 49049 - DNA, 20 bp, Artificial Sequence
  Description of Artificial Sequence: Synthetic oligonucleotide
  Target: SCN10A; (-) strand; PAM type: YTN; PAM sequence: TTA
cacacatgagacacctgaag

SEQ ID NO: 49050 - DNA, 20 bp, Artificial Sequence
  Description of Artificial Sequence: Synthetic oligonucleotide
  Target: SCN10A; (-) strand; PAM type: YTN; PAM sequence: TTC
attacacacatgagacacct

SEQ ID NO: 49051 - DNA, 20 bp, Artificial Sequence
  Description of Artificial Sequence: Synthetic oligonucleotide
  Target: SCN10A; (-) strand; PAM type: YTN; PAM sequence: TTA
tattcattacacacatgaga

SEQ ID NO: 49052 - DNA, 20 bp, Artificial Sequence
  Description of Artificial Sequence: Synthetic oligonucleotide
  Target: SCN10A; (-) strand; PAM type: YTN; PAM sequence: TTG
gatgttatattcattacaca

SEQ ID NO: 49053 - DNA, 20 bp, Artificial Sequence
  Description of Artificial Sequence: Synthetic oligonucleotide
  Target: SCN10A; (-) strand; PAM type: YTN; PAM sequence: CTG
gttggatgttatattcatta

SEQ ID NO: 49054 - DNA, 20 bp, Artificial Sequence
  Description of Artificial Sequence: Synthetic oligonucleotide
  Target: SCN10A; (-) strand; PAM type: YTN; PAM sequence: CTC
tggttggatgttatattcat

SEQ ID NO: 49055 - DNA, 20 bp, Artificial Sequence
  Description of Artificial Sequence: Synthetic oligonucleotide
  Target: SCN10A; (-) strand; PAM type: YTN; PAM sequence: TTC
tctggttggatgttatattc

SEQ ID NO: 49056 - DNA, 20 bp, Artificial Sequence
  Description of Artificial Sequence: Synthetic oligonucleotide
  Target: SCN10A; (-) strand; PAM type: YTN; PAM sequence: CTT
ctctggttggatgttatatt

SEQ ID NO: 49057 - DNA, 20 bp, Artificial Sequence
  Description of Artificial Sequence: Synthetic oligonucleotide
  Target: SCN10A; (-) strand; PAM type: YTN; PAM sequence: CTG
agcatagggcacatcatctt

SEQ ID NO: 49058 - DNA, 20 bp, Artificial Sequence
  Description of Artificial Sequence: Synthetic oligonucleotide
  Target: SCN10A; (-) strand; PAM type: YTN; PAM sequence: TTC
tgagcatagggcacatcatc

SEQ ID NO: 49059 - DNA, 20 bp, Artificial Sequence
  Description of Artificial Sequence: Synthetic oligonucleotide
  Target: SCN10A; (-) strand; PAM type: YTN; PAM sequence: TTT
ctgagcatagggcacatcat

SEQ ID NO: 49060 - DNA, 20 bp, Artificial Sequence
  Description of Artificial Sequence: Synthetic oligonucleotide
  Target: SCN10A; (-) strand; PAM type: YTN; PAM sequence: TTT
tctgagcatagggcacatca

SEQ ID NO: 49061 - DNA, 20 bp, Artificial Sequence
  Description of Artificial Sequence: Synthetic oligonucleotide
  Target: SCN10A; (-) strand; PAM type: YTN; PAM sequence: TTA
aataaaagaggtcaaagttt

SEQ ID NO: 49062 - DNA, 20 bp, Artificial Sequence
  Description of Artificial Sequence: Synthetic oligonucleotide
  Target: SCN10A; (-) strand; PAM type: YTN; PAM sequence: TTA
ggttaaataaaagaggtcaa

SEQ ID NO: 49063 - DNA, 20 bp, Artificial Sequence
  Description of Artificial Sequence: Synthetic oligonucleotide
  Target: SCN10A; (-) strand; PAM type: YTN; PAM sequence: CTT
aggttaaataaaagaggtca

SEQ ID NO: 49064 - DNA, 20 bp, Artificial Sequence
  Description of Artificial Sequence: Synthetic oligonucleotide
  Target: SCN10A; (-) strand; PAM type: YTN; PAM sequence: CTG
aggagaggaaaccttaggtt

SEQ ID NO: 49065 - DNA, 20 bp, Artificial Sequence
  Description of Artificial Sequence: Synthetic oligonucleotide
  Target: SCN10A; (-) strand; PAM type: YTN; PAM sequence: TTA
aagaaaatctgaggagagga

SEQ ID NO: 49066 - DNA, 20 bp, Artificial Sequence
  Description of Artificial Sequence: Synthetic oligonucleotide
  Target: SCN10A; (-) strand; PAM type: YTN; PAM sequence: TTT
aaagaaaatctgaggagagg

SEQ ID NO: 49067 - DNA, 20 bp, Artificial Sequence
  Description of Artificial Sequence: Synthetic oligonucleotide
  Target: SCN10A; (-) strand; PAM type: YTN; PAM sequence: TTT
taaagaaaatctgaggagag

SEQ ID NO: 49068 - DNA, 20 bp, Artificial Sequence
  Description of Artificial Sequence: Synthetic oligonucleotide
  Target: SCN10A; (-) strand; PAM type: YTN; PAM sequence: CTG
tgacagtagagtaagaaagg

SEQ ID NO: 49069 - DNA, 20 bp, Artificial Sequence
  Description of Artificial Sequence: Synthetic oligonucleotide
  Target: SCN10A; (-) strand; PAM type: YTN; PAM sequence: CTC
aaggaagatgctgtgacagt

SEQ ID NO: 49070 - DNA, 20 bp, Artificial Sequence
  Description of Artificial Sequence: Synthetic oligonucleotide
  Target: SCN10A; (-) strand; PAM type: YTN; PAM sequence: TTC
ccctcaaggaagatgctgtg

SEQ ID NO: 49071 - DNA, 20 bp, Artificial Sequence
  Description of Artificial Sequence: Synthetic oligonucleotide
  Target: SCN10A; (-) strand; PAM type: YTN; PAM sequence: CTT
cccctcaaggaagatgctgt

SEQ ID NO: 49072 - DNA, 20 bp, Artificial Sequence
  Description of Artificial Sequence: Synthetic oligonucleotide
  Target: SCN10A; (-) strand; PAM type: YTN; PAM sequence: TTG
gggtagggtagacttcccct

SEQ ID NO: 49073 - DNA, 20 bp, Artificial Sequence
  Description of Artificial Sequence: Synthetic oligonucleotide
  Target: SCN10A; (-) strand; PAM type: YTN; PAM sequence: CTG
ataaaaaggaagaaaataag

SEQ ID NO: 49074 - DNA, 20 bp, Artificial Sequence
  Description of Artificial Sequence: Synthetic oligonucleotide
  Target: SCN10A; (-) strand; PAM type: YTN; PAM sequence: TTA
taacagtgtgaactgataaa

SEQ ID NO: 49075 - DNA, 20 bp, Artificial Sequence
  Description of Artificial Sequence: Synthetic oligonucleotide
  Target: SCN10A; (-) strand; PAM type: YTN; PAM sequence: TTT
ataacagtgtgaactgataa

SEQ ID NO: 49076 - DNA, 20 bp, Artificial Sequence
  Description of Artificial Sequence: Synthetic oligonucleotide
  Target: SCN10A; (-) strand; PAM type: YTN; PAM sequence: CTA
atttataacagtgtgaactg

SEQ ID NO: 49077 - DNA, 20 bp, Artificial Sequence
  Description of Artificial Sequence: Synthetic oligonucleotide
  Target: SCN10A; (-) strand; PAM type: YTN; PAM sequence: TTG
gcggcgggagtgatgctaat

SEQ ID NO: 49078 - DNA, 20 bp, Artificial Sequence
  Description of Artificial Sequence: Synthetic oligonucleotide
  Target: SCN10A; (-) strand; PAM type: YTN; PAM sequence: TTG
ggtggttggcggcgggagtg

SEQ ID NO: 49079 - DNA, 20 bp, Artificial Sequence
  Description of Artificial Sequence: Synthetic oligonucleotide
  Target: SCN10A; (-) strand; PAM type: YTN; PAM sequence: TTT
gggtggttggcggcgggagt

SEQ ID NO: 49080 - DNA, 20 bp, Artificial Sequence
  Description of Artificial Sequence: Synthetic oligonucleotide
  Target: SCN10A; (-) strand; PAM type: YTN; PAM sequence: TTA
cccagaagacaagtgcatgc

SEQ ID NO: 49081 - DNA, 20 bp, Artificial Sequence
  Description of Artificial Sequence: Synthetic oligonucleotide
  Target: SCN10A; (-) strand; PAM type: YTN; PAM sequence: CTC
cattacccagaagacaagtg

SEQ ID NO: 49082 - DNA, 20 bp, Artificial Sequence
  Description of Artificial Sequence: Synthetic oligonucleotide
  Target: SCN10A; (-) strand; PAM type: YTN; PAM sequence: CTG
acctccattacccagaagac

SEQ ID NO: 49083 - DNA, 20 bp, Artificial Sequence
  Description of Artificial Sequence: Synthetic oligonucleotide
  Target: SCN10A; (-) strand; PAM type: YTN; PAM sequence: CTC
acagcctgacctccattacc

SEQ ID NO: 49084 - DNA, 20 bp, Artificial Sequence
  Description of Artificial Sequence: Synthetic oligonucleotide
  Target: SCN10A; (-) strand; PAM type: YTN; PAM sequence: TTG
ctcacagcctgacctccatt

SEQ ID NO: 49085 - DNA, 20 bp, Artificial Sequence
  Description of Artificial Sequence: Synthetic oligonucleotide
  Target: SCN10A; (-) strand; PAM type: YTN; PAM sequence: TTT
gctcacagcctgacctccat

SEQ ID NO: 49086 - DNA, 20 bp, Artificial Sequence
  Description of Artificial Sequence: Synthetic oligonucleotide
  Target: SCN10A; (-) strand; PAM type: YTN; PAM sequence: TTT
tgctcacagcctgacctcca

SEQ ID NO: 49087 - DNA, 20 bp, Artificial Sequence
  Description of Artificial Sequence: Synthetic oligonucleotide
  Target: SCN10A; (-) strand; PAM type: YTN; PAM sequence: CTG
ttttgctcacagcctgacct

SEQ ID NO: 49088 - DNA, 20 bp, Artificial Sequence
  Description of Artificial Sequence: Synthetic oligonucleotide
  Target: SCN10A; (-) strand; PAM type: YTN; PAM sequence: CTA
tgagggcggagatgtgtctg

SEQ ID NO: 49089 - DNA, 20 bp, Artificial Sequence
  Description of Artificial Sequence: Synthetic oligonucleotide
  Target: SCN10A; (-) strand; PAM type: YTN; PAM sequence: TTG
taaaatctatgagggcggag

SEQ ID NO: 49090 - DNA, 20 bp, Artificial Sequence
  Description of Artificial Sequence: Synthetic oligonucleotide
  Target: SCN10A; (-) strand; PAM type: YTN; PAM sequence: CTA
ggttgtaaaatctatgaggg

SEQ ID NO: 49091 - DNA, 20 bp, Artificial Sequence
  Description of Artificial Sequence: Synthetic oligonucleotide
  Target: SCN10A; (-) strand; PAM type: YTN; PAM sequence: TTA
ctaggttgtaaaatctatga

SEQ ID NO: 49092 - DNA, 20 bp, Artificial Sequence
  Description of Artificial Sequence: Synthetic oligonucleotide
  Target: SCN10A; (-) strand; PAM type: YTN; PAM sequence: TTT
actaggttgtaaaatctatg

SEQ ID NO: 49093 - DNA, 20 bp, Artificial Sequence
  Description of Artificial Sequence: Synthetic oligonucleotide
  Target: SCN10A; (-) strand; PAM type: YTN; PAM sequence: TTA
tgatttactaggttgtaaaa

SEQ ID NO: 49094 - DNA, 20 bp, Artificial Sequence
  Description of Artificial Sequence: Synthetic oligonucleotide
  Target: SCN10A; (-) strand; PAM type: YTN; PAM sequence: CTA
ttatgatttactaggttgta

SEQ ID NO: 49095 - DNA, 20 bp, Artificial Sequence
  Description of Artificial Sequence: Synthetic oligonucleotide
  Target: SCN10A; (-) strand; PAM type: YTN; PAM sequence: TTG
gctattatgatttactaggt

SEQ ID NO: 49096 - DNA, 20 bp, Artificial Sequence
  Description of Artificial Sequence: Synthetic oligonucleotide
  Target: SCN10A; (-) strand; PAM type: YTN; PAM sequence: TTT
ggctattatgatttactagg

SEQ ID NO: 49097 - DNA, 20 bp, Artificial Sequence
  Description of Artificial Sequence: Synthetic oligonucleotide
  Target: SCN10A; (-) strand; PAM type: YTN; PAM sequence: CTC
atcacatttggctattatga

SEQ ID NO: 49098 - DNA, 20 bp, Artificial Sequence
  Description of Artificial Sequence: Synthetic oligonucleotide
  Target: SCN10A; (-) strand; PAM type: YTN; PAM sequence: CTG
gcatgtagtaaatactcatc

SEQ ID NO: 49099 - DNA, 20 bp, Artificial Sequence
  Description of Artificial Sequence: Synthetic oligonucleotide
  Target: SCN10A; (-) strand; PAM type: YTN; PAM sequence: TTA
gaaccacgactggcatgtag

SEQ ID NO: 49100 - DNA, 20 bp, Artificial Sequence
  Description of Artificial Sequence: Synthetic oligonucleotide
  Target: SCN10A; (-) strand; PAM type: YTN; PAM sequence: CTT
agaaccacgactggcatgta

SEQ ID NO: 49101 - DNA, 20 bp, Artificial Sequence
  Description of Artificial Sequence: Synthetic oligonucleotide
  Target: SCN10A; (-) strand; PAM type: YTN; PAM sequence: TTA
aatgagtcaggtcaagcaaa

SEQ ID NO: 49102 - DNA, 20 bp, Artificial Sequence
  Description of Artificial Sequence: Synthetic oligonucleotide
  Target: SCN10A; (-) strand; PAM type: YTN; PAM sequence: TTG
tgaggattaaatgagtcagg

SEQ ID NO: 49103 - DNA, 20 bp, Artificial Sequence
  Description of Artificial Sequence: Synthetic oligonucleotide
  Target: SCN10A; (-) strand; PAM type: YTN; PAM sequence: TTT
gtgaggattaaatgagtcag

SEQ ID NO: 49104 - DNA, 20 bp, Artificial Sequence
  Description of Artificial Sequence: Synthetic oligonucleotide
  Target: SCN10A; (-) strand; PAM type: YTN; PAM sequence: TTT
tgtgaggattaaatgagtca

SEQ ID NO: 49105 - DNA, 20 bp, Artificial Sequence
  Description of Artificial Sequence: Synthetic oligonucleotide
  Target: SCN10A; (-) strand; PAM type: YTN; PAM sequence: TTG
tagagttttgtgaggattaa

SEQ ID NO: 49106 - DNA, 20 bp, Artificial Sequence
  Description of Artificial Sequence: Synthetic oligonucleotide
  Target: SCN10A; (-) strand; PAM type: YTN; PAM sequence: CTT
gtagagttttgtgaggatta

SEQ ID NO: 49107 - DNA, 20 bp, Artificial Sequence
  Description of Artificial Sequence: Synthetic oligonucleotide
  Target: SCN10A; (-) strand; PAM type: YTN; PAM sequence: TTA
tcttgtagagttttgtgagg

SEQ ID NO: 49108 - DNA, 20 bp, Artificial Sequence
  Description of Artificial Sequence: Synthetic oligonucleotide
  Target: SCN10A; (-) strand; PAM type: YTN; PAM sequence: CTT
atcttgtagagttttgtgag

SEQ ID NO: 49109 - DNA, 20 bp, Artificial Sequence
  Description of Artificial Sequence: Synthetic oligonucleotide
  Target: SCN10A; (-) strand; PAM type: YTN; PAM sequence: CTG
taaagtagtgagaatatact

SEQ ID NO: 49110 - DNA, 20 bp, Artificial Sequence
  Description of Artificial Sequence: Synthetic oligonucleotide
  Target: SCN10A; (-) strand; PAM type: YTN; PAM sequence: TTA
gcctgtaaagtagtgagaat

SEQ ID NO: 49111 - DNA, 20 bp, Artificial Sequence
  Description of Artificial Sequence: Synthetic oligonucleotide
  Target: SCN10A; (-) strand; PAM type: YTN; PAM sequence: TTT
agcctgtaaagtagtgagaa

SEQ ID NO: 49112 - DNA, 20 bp, Artificial Sequence
  Description of Artificial Sequence: Synthetic oligonucleotide
  Target: SCN10A; (-) strand; PAM type: YTN; PAM sequence: TTT
tagcctgtaaagtagtgaga

SEQ ID NO: 49113 - DNA, 20 bp, Artificial Sequence
  Description of Artificial Sequence: Synthetic oligonucleotide
  Target: SCN10A; (-) strand; PAM type: YTN; PAM sequence: TTT
ttagcctgtaaagtagtgag

SEQ ID NO: 49114 - DNA, 20 bp, Artificial Sequence
  Description of Artificial Sequence: Synthetic oligonucleotide
  Target: SCN10A; (-) strand; PAM type: YTN; PAM sequence: CTC
agatttttagcctgtaaagt

SEQ ID NO: 49115 - DNA, 20 bp, Artificial Sequence
  Description of Artificial Sequence: Synthetic oligonucleotide
  Target: SCN10A; (-) strand; PAM type: YTN; PAM sequence: CTG
tgcctcagatttttagcctg

SEQ ID NO: 49116 - DNA, 20 bp, Artificial Sequence
  Description of Artificial Sequence: Synthetic oligonucleotide
  Target: SCN10A; (-) strand; PAM type: YTN; PAM sequence: TTC
tgtgcctcagatttttagcc

SEQ ID NO: 49117 - DNA, 20 bp, Artificial Sequence
  Description of Artificial Sequence: Synthetic oligonucleotide
  Target: SCN10A; (-) strand; PAM type: YTN; PAM sequence: TTT
ctgtgcctcagatttttagc

SEQ ID NO: 49118 - DNA, 20 bp, Artificial Sequence
  Description of Artificial Sequence: Synthetic oligonucleotide
  Target: SCN10A; (-) strand; PAM type: YTN; PAM sequence: TTT
tctgtgcctcagatttttag

SEQ ID NO: 49119 - DNA, 20 bp, Artificial Sequence
  Description of Artificial Sequence: Synthetic oligonucleotide
  Target: SCN10A; (-) strand; PAM type: YTN; PAM sequence: CTT
ttctgtgcctcagattttta

SEQ ID NO: 49120 - DNA, 20 bp, Artificial Sequence
  Description of Artificial Sequence: Synthetic oligonucleotide
  Target: SCN10A; (-) strand; PAM type: YTN; PAM sequence: TTC
agtaacttttctgtgcctca

SEQ ID NO: 49121 - DNA, 20 bp, Artificial Sequence
  Description of Artificial Sequence: Synthetic oligonucleotide
  Target: SCN10A; (-) strand; PAM type: YTN; PAM sequence: CTT
cagtaacttttctgtgcctc

SEQ ID NO: 49122 - DNA, 20 bp, Artificial Sequence
  Description of Artificial Sequence: Synthetic oligonucleotide
  Target: SCN10A; (-) strand; PAM type: YTN; PAM sequence: TTG
gagcttcagtaacttttctg

SEQ ID NO: 49123 - DNA, 20 bp, Artificial Sequence
  Description of Artificial Sequence: Synthetic oligonucleotide
  Target: SCN10A; (-) strand; PAM type: YTN; PAM sequence: CTT
ggagcttcagtaacttttct

SEQ ID NO: 49124 - DNA, 20 bp, Artificial Sequence
  Description of Artificial Sequence: Synthetic oligonucleotide
  Target: SCN10A; (-) strand; PAM type: YTN; PAM sequence: TTA
tggtacacagtgtgaccttg

SEQ ID NO: 49125 - DNA, 20 bp, Artificial Sequence
  Description of Artificial Sequence: Synthetic oligonucleotide
  Target: SCN10A; (-) strand; PAM type: YTN; PAM sequence: CTT
atggtacacagtgtgacctt

SEQ ID NO: 49126 - DNA, 20 bp, Artificial Sequence
  Description of Artificial Sequence: Synthetic oligonucleotide
  Target: SCN10A; (-) strand; PAM type: YTN; PAM sequence: TTC
cacttatggtacacagtgtg

SEQ ID NO: 49127 - DNA, 20 bp, Artificial Sequence
  Description of Artificial Sequence: Synthetic oligonucleotide
  Target: SCN10A; (-) strand; PAM type: YTN; PAM sequence: CTT
ccacttatggtacacagtgt

SEQ ID NO: 49128 - DNA, 20 bp, Artificial Sequence
  Description of Artificial Sequence: Synthetic oligonucleotide
  Target: SCN10A; (-) strand; PAM type: YTN; PAM sequence: CTC
ttccacttatggtacacagt

SEQ ID NO: 49129 - DNA, 20 bp, Artificial Sequence
  Description of Artificial Sequence: Synthetic oligonucleotide
  Target: SCN10A; (-) strand; PAM type: YTN; PAM sequence: CTA
gctcttccacttatggtaca

SEQ ID NO: 49130 - DNA, 20 bp, Artificial Sequence
  Description of Artificial Sequence: Synthetic oligonucleotide
  Target: SCN10A; (-) strand; PAM type: YTN; PAM sequence: TTG
catcctagctcttccactta

SEQ ID NO: 49131 - DNA, 20 bp, Artificial Sequence
  Description of Artificial Sequence: Synthetic oligonucleotide
  Target: SCN10A; (-) strand; PAM type: YTN; PAM sequence: TTT
gcatcctagctcttccactt

SEQ ID NO: 49132 - DNA, 20 bp, Artificial Sequence
  Description of Artificial Sequence: Synthetic oligonucleotide
  Target: SCN10A; (-) strand; PAM type: YTN; PAM sequence: CTG
ggtttgcatcctagctcttc

SEQ ID NO: 49133 - DNA, 20 bp, Artificial Sequence
  Description of Artificial Sequence: Synthetic oligonucleotide
  Target: SCN10A; (-) strand; PAM type: YTN; PAM sequence: CTG
cctgggtttgcatcctagct

SEQ ID NO: 49134 - DNA, 20 bp, Artificial Sequence
  Description of Artificial Sequence: Synthetic oligonucleotide
  Target: SCN10A; (-) strand; PAM type: YTN; PAM sequence: CTG
gaacccggctgcctgggttt

SEQ ID NO: 49135 - DNA, 20 bp, Artificial Sequence
  Description of Artificial Sequence: Synthetic oligonucleotide
  Target: SCN10A; (-) strand; PAM type: YTN; PAM sequence: CTC
tggaacccggctgcctgggt

SEQ ID NO: 49136 - DNA, 20 bp, Artificial Sequence
  Description of Artificial Sequence: Synthetic oligonucleotide
  Target: SCN10A; (-) strand; PAM type: YTN; PAM sequence: CTG
ctctggaacccggctgcctg

SEQ ID NO: 49137 - DNA, 20 bp, Artificial Sequence
  Description of Artificial Sequence: Synthetic oligonucleotide
  Target: SCN10A; (-) strand; PAM type: YTN; PAM sequence: TTA
gaacactgctctggaacccg

SEQ ID NO: 49138 - DNA, 20 bp, Artificial Sequence
  Description of Artificial Sequence: Synthetic oligonucleotide
  Target: SCN10A; (-) strand; PAM type: YTN; PAM sequence: CTG
caagaatgagatagcaacaa

SEQ ID NO: 49139 - DNA, 20 bp, Artificial Sequence
  Description of Artificial Sequence: Synthetic oligonucleotide
  Target: SCN10A; (-) strand; PAM type: YTN; PAM sequence: TTC
tgcaagaatgagatagcaac

SEQ ID NO: 49140 - DNA, 20 bp, Artificial Sequence
  Description of Artificial Sequence: Synthetic oligonucleotide
  Target: SCN10A; (-) strand; PAM type: YTN; PAM sequence: TTC
gcagacacaaatagcaagta

SEQ ID NO: 49141 - DNA, 20 bp, Artificial Sequence
  Description of Artificial Sequence: Synthetic oligonucleotide
  Target: SCN10A; (-) strand; PAM type: YTN; PAM sequence: CTG
aggagaaagttcgcagacac

SEQ ID NO: 49142 - DNA, 20 bp, Artificial Sequence
  Description of Artificial Sequence: Synthetic oligonucleotide
  Target: SCN10A; (-) strand; PAM type: YTN; PAM sequence: CTA
tgtaagaagctgaggagaaa

SEQ ID NO: 49143 - DNA, 20 bp, Artificial Sequence
  Description of Artificial Sequence: Synthetic oligonucleotide
  Target: SCN10A; (-) strand; PAM type: YTN; PAM sequence: TTA
aataaaggaatcagctatgt

SEQ ID NO: 49144 - DNA, 20 bp, Artificial Sequence
  Description of Artificial Sequence: Synthetic oligonucleotide
  Target: SCN10A; (-) strand; PAM type: YTN; PAM sequence: TTG
aattaaataaaggaatcagc

SEQ ID NO: 49145 - DNA, 20 bp, Artificial Sequence
  Description of Artificial Sequence: Synthetic oligonucleotide
  Target: SCN10A; (-) strand; PAM type: YTN; PAM sequence: TTT
gaattaaataaaggaatcag

SEQ ID NO: 49146 - DNA, 20 bp, Artificial Sequence
  Description of Artificial Sequence: Synthetic oligonucleotide
  Target: SCN10A; (-) strand; PAM type: YTN; PAM sequence: CTC
caagaagaacagaaatttga

SEQ ID NO: 49147 - DNA, 20 bp, Artificial Sequence
  Description of Artificial Sequence: Synthetic oligonucleotide
  Target: SCN10A; (-) strand; PAM type: YTN; PAM sequence: CTC
tccaagaagaacagaaattt

SEQ ID NO: 49148 - DNA, 20 bp, Artificial Sequence
  Description of Artificial Sequence: Synthetic oligonucleotide
  Target: SCN10A; (-) strand; PAM type: YTN; PAM sequence: TTC
tctccaagaagaacagaaat

SEQ ID NO: 49149 - DNA, 20 bp, Artificial Sequence
  Description of Artificial Sequence: Synthetic oligonucleotide
  Target: SCN10A; (-) strand; PAM type: YTN; PAM sequence: TTC
agatataagaagtaggagaa

SEQ ID NO: 49150 - DNA, 20 bp, Artificial Sequence
  Description of Artificial Sequence: Synthetic oligonucleotide
  Target: SCN10A; (-) strand; PAM type: YTN; PAM sequence: CTA
gcagggaaggggacatgaaa

SEQ ID NO: 49151 - DNA, 20 bp, Artificial Sequence
  Description of Artificial Sequence: Synthetic oligonucleotide
  Target: SCN10A; (-) strand; PAM type: YTN; PAM sequence: CTA
catcctagcagggaagggga

SEQ ID NO: 49152 - DNA, 20 bp, Artificial Sequence
  Description of Artificial Sequence: Synthetic oligonucleotide
  Target: SCN10A; (-) strand; PAM type: YTN; PAM sequence: CTC
atggaatctacatcctagca

SEQ ID NO: 49153 - DNA, 20 bp, Artificial Sequence
  Description of Artificial Sequence: Synthetic oligonucleotide
  Target: SCN10A; (-) strand; PAM type: YTN; PAM sequence: TTG
cgctcatggaatctacatcc

SEQ ID NO: 49154 - DNA, 20 bp, Artificial Sequence
  Description of Artificial Sequence: Synthetic oligonucleotide
  Target: SCN10A; (-) strand; PAM type: YTN; PAM sequence: CTT
gcgctcatggaatctacatc

SEQ ID NO: 49155 - DNA, 20 bp, Artificial Sequence
  Description of Artificial Sequence: Synthetic oligonucleotide
  Target: SCN10A; (-) strand; PAM type: YTN; PAM sequence: CTG
atataagcttgcgctcatgg

SEQ ID NO: 49156 - DNA, 20 bp, Artificial Sequence
  Description of Artificial Sequence: Synthetic oligonucleotide
  Target: SCN10A; (-) strand; PAM type: YTN; PAM sequence: TTC
agtggtgaactgatataagc

SEQ ID NO: 49157 - DNA, 20 bp, Artificial Sequence
  Description of Artificial Sequence: Synthetic oligonucleotide
  Target: SCN10A; (-) strand; PAM type: YTN; PAM sequence: CTG
ggattcagtggtgaactgat

SEQ ID NO: 49158 - DNA, 20 bp, Artificial Sequence
  Description of Artificial Sequence: Synthetic oligonucleotide
  Target: SCN10A; (-) strand; PAM type: YTN; PAM sequence: TTC
aggtgctgggattcagtggt

SEQ ID NO: 49159 - DNA, 20 bp, Artificial Sequence
  Description of Artificial Sequence: Synthetic oligonucleotide
  Target: SCN10A; (-) strand; PAM type: YTN; PAM sequence: CTT
caggtgctgggattcagtgg

SEQ ID NO: 49160 - DNA, 20 bp, Artificial Sequence
  Description of Artificial Sequence: Synthetic oligonucleotide
  Target: SCN10A; (-) strand; PAM type: YTN; PAM sequence: TTG
cttcaggtgctgggattcag

SEQ ID NO: 49161 - DNA, 20 bp, Artificial Sequence
  Description of Artificial Sequence: Synthetic oligonucleotide
  Target: SCN10A; (-) strand; PAM type: YTN; PAM sequence: TTG
tgtgtgtggcattgcttcag

SEQ ID NO: 49162 - DNA, 20 bp, Artificial Sequence
  Description of Artificial Sequence: Synthetic oligonucleotide
  Target: SCN10A; (-) strand; PAM type: YTN; PAM sequence: CTG
ttgtgtgtgtggcattgctt

SEQ ID NO: 49163 - DNA, 20 bp, Artificial Sequence
  Description of Artificial Sequence: Synthetic oligonucleotide
  Target: SCN10A; (-) strand; PAM type: YTN; PAM sequence: TTG
agcccctgttgtgtgtgtgg

SEQ ID NO: 49164 - DNA, 20 bp, Artificial Sequence
  Description of Artificial Sequence: Synthetic oligonucleotide
  Target: SCN10A; (-) strand; PAM type: YTN; PAM sequence: TTG
ttgagcccctgttgtgtgtg

SEQ ID NO: 49165 - DNA, 20 bp, Artificial Sequence
  Description of Artificial Sequence: Synthetic oligonucleotide
  Target: SCN10A; (-) strand; PAM type: YTN; PAM sequence: TTT
gttgagcccctgttgtgtgt

SEQ ID NO: 49166 - DNA, 20 bp, Artificial Sequence
  Description of Artificial Sequence: Synthetic oligonucleotide
  Target: SCN10A; (-) strand; PAM type: YTN; PAM sequence: TTA
tcaacaagcatttgttgagc

SEQ ID NO: 49167 - DNA, 20 bp, Artificial Sequence
  Description of Artificial Sequence: Synthetic oligonucleotide
  Target: SCN10A; (-) strand; PAM type: YTN; PAM sequence: CTT
atcaacaagcatttgttgag

SEQ ID NO: 49168 - DNA, 20 bp, Artificial Sequence
  Description of Artificial Sequence: Synthetic oligonucleotide
  Target: SCN10A; (-) strand; PAM type: YTN; PAM sequence: CTC
ttatcaacaagcatttgttg

SEQ ID NO: 49169 - DNA, 20 bp, Artificial Sequence
  Description of Artificial Sequence: Synthetic oligonucleotide
  Target: SCN10A; (-) strand; PAM type: YTN; PAM sequence: TTC
tcttatcaacaagcatttgt

SEQ ID NO: 49170 - DNA, 20 bp, Artificial Sequence
  Description of Artificial Sequence: Synthetic oligonucleotide
  Target: SCN10A; (-) strand; PAM type: YTN; PAM sequence: TTA
ttctcttatcaacaagcatt

SEQ ID NO: 49171 - DNA, 20 bp, Artificial Sequence
  Description of Artificial Sequence: Synthetic oligonucleotide
  Target: SCN10A; (-) strand; PAM type: YTN; PAM sequence: TTT
attctcttatcaacaagcat

SEQ ID NO: 49172 - DNA, 20 bp, Artificial Sequence
  Description of Artificial Sequence: Synthetic oligonucleotide
  Target: SCN10A; (-) strand; PAM type: YTN; PAM sequence: TTC
atttattctcttatcaacaa

SEQ ID NO: 49173 - DNA, 20 bp, Artificial Sequence
  Description of Artificial Sequence: Synthetic oligonucleotide
  Target: SCN10A; (-) strand; PAM type: YTN; PAM sequence: TTT
catttattctcttatcaaca

SEQ ID NO: 49174 - DNA, 20 bp, Artificial Sequence
  Description of Artificial Sequence: Synthetic oligonucleotide
  Target: SCN10A; (-) strand; PAM type: YTN; PAM sequence: CTT
tcatttattctcttatcaac

SEQ ID NO: 49175 - DNA, 20 bp, Artificial Sequence
  Description of Artificial Sequence: Synthetic oligonucleotide
  Target: SCN10A; (-) strand; PAM type: YTN; PAM sequence: TTC
tttcatttattctcttatca

SEQ ID NO: 49176 - DNA, 20 bp, Artificial Sequence
  Description of Artificial Sequence: Synthetic oligonucleotide
  Target: SCN10A; (-) strand; PAM type: YTN; PAM sequence: CTT
ctttcatttattctcttatc

SEQ ID NO: 49177 - DNA, 20 bp, Artificial Sequence
  Description of Artificial Sequence: Synthetic oligonucleotide
  Target: SCN10A; (-) strand; PAM type: YTN; PAM sequence: CTC
ttctttcatttattctctta

SEQ ID NO: 49178 - DNA, 20 bp, Artificial Sequence
  Description of Artificial Sequence: Synthetic oligonucleotide
  Target: SCN10A; (-) strand; PAM type: YTN; PAM sequence: CTC
tcttctttcatttattctct

SEQ ID NO: 49179 - DNA, 20 bp, Artificial Sequence
  Description of Artificial Sequence: Synthetic oligonucleotide
  Target: SCN10A; (-) strand; PAM type: YTN; PAM sequence: TTC
tctcttctttcatttattct

SEQ ID NO: 49180 - DNA, 20 bp, Artificial Sequence
  Description of Artificial Sequence: Synthetic oligonucleotide
  Target: SCN10A; (-) strand; PAM type: YTN; PAM sequence: CTT
ctctcttctttcatttattc

SEQ ID NO: 49181 - DNA, 20 bp, Artificial Sequence
  Description of Artificial Sequence: Synthetic oligonucleotide
  Target: SCN10A; (-) strand; PAM type: YTN; PAM sequence: CTC
cttctctcttctttcattta

SEQ ID NO: 49182 - DNA, 20 bp, Artificial Sequence
  Description of Artificial Sequence: Synthetic oligonucleotide
  Target: SCN10A; (-) strand; PAM type: YTN; PAM sequence: TTC
ctccttctctcttctttcat

SEQ ID NO: 49183 - DNA, 20 bp, Artificial Sequence
  Description of Artificial Sequence: Synthetic oligonucleotide
  Target: SCN10A; (-) strand; PAM type: YTN; PAM sequence: CTT
cctccttctctcttctttca

SEQ ID NO: 49184 - DNA, 20 bp, Artificial Sequence
  Description of Artificial Sequence: Synthetic oligonucleotide
  Target: SCN10A; (-) strand; PAM type: YTN; PAM sequence: TTA
agcttcctccttctctcttc

SEQ ID NO: 49185 - DNA, 20 bp, Artificial Sequence
  Description of Artificial Sequence: Synthetic oligonucleotide
  Target: SCN10A; (-) strand; PAM type: YTN; PAM sequence: CTG
ttaagcttcctccttctctc

SEQ ID NO: 49186 - DNA, 20 bp, Artificial Sequence
  Description of Artificial Sequence: Synthetic oligonucleotide
  Target: SCN10A; (-) strand; PAM type: YTN; PAM sequence: CTC
gaaaactgttaagcttcctc

SEQ ID NO: 49187 - DNA, 20 bp, Artificial Sequence
  Description of Artificial Sequence: Synthetic oligonucleotide
  Target: SCN10A; (-) strand; PAM type: YTN; PAM sequence: TTC
tcgaaaactgttaagcttcc

SEQ ID NO: 49188 - DNA, 20 bp, Artificial Sequence
  Description of Artificial Sequence: Synthetic oligonucleotide
  Target: SCN10A; (-) strand; PAM type: YTN; PAM sequence: TTA
ttctcgaaaactgttaagct

SEQ ID NO: 49189 - DNA, 20 bp, Artificial Sequence
  Description of Artificial Sequence: Synthetic oligonucleotide
  Target: SCN10A; (-) strand; PAM type: YTN; PAM sequence: TTT
attctcgaaaactgttaagc

SEQ ID NO: 49190 - DNA, 20 bp, Artificial Sequence
  Description of Artificial Sequence: Synthetic oligonucleotide
  Target: SCN10A; (-) strand; PAM type: YTN; PAM sequence: TTC
atttattctcgaaaactgtt

SEQ ID NO: 49191 - DNA, 20 bp, Artificial Sequence
  Description of Artificial Sequence: Synthetic oligonucleotide
  Target: SCN10A; (-) strand; PAM type: YTN; PAM sequence: TTT
catttattctcgaaaactgt

SEQ ID NO: 49192 - DNA, 20 bp, Artificial Sequence
  Description of Artificial Sequence: Synthetic oligonucleotide
  Target: SCN10A; (-) strand; PAM type: YTN; PAM sequence: TTT
tcatttattctcgaaaactg

SEQ ID NO: 49193 - DNA, 20 bp, Artificial Sequence
  Description of Artificial Sequence: Synthetic oligonucleotide
  Target: SCN10A; (-) strand; PAM type: YTN; PAM sequence: TTT
ttcatttattctcgaaaact

SEQ ID NO: 49194 - DNA, 20 bp, Artificial Sequence
  Description of Artificial Sequence: Synthetic oligonucleotide
  Target: SCN10A; (-) strand; PAM type: YTN; PAM sequence: TTT
tttcatttattctcgaaaac

SEQ ID NO: 49195 - DNA, 20 bp, Artificial Sequence
  Description of Artificial Sequence: Synthetic oligonucleotide
  Target: SCN10A; (-) strand; PAM type: YTN; PAM sequence: TTT
ttttcatttattctcgaaaa

SEQ ID NO: 49196 - DNA, 20 bp, Artificial Sequence
  Description of Artificial Sequence: Synthetic oligonucleotide
  Target: SCN10A; (-) strand; PAM type: YTN; PAM sequence: TTG
tttttttcatttattctcga

SEQ ID NO: 49197 - DNA, 20 bp, Artificial Sequence
  Description of Artificial Sequence: Synthetic oligonucleotide
  Target: SCN10A; (-) strand; PAM type: YTN; PAM sequence: TTT
gtttttttcatttattctcg

SEQ ID NO: 49198 - DNA, 20 bp, Artificial Sequence
  Description of Artificial Sequence: Synthetic oligonucleotide
  Target: SCN10A; (-) strand; PAM type: YTN; PAM sequence: TTG
aatacaaacagtttgttttt

SEQ ID NO: 49199 - DNA, 20 bp, Artificial Sequence
  Description of Artificial Sequence: Synthetic oligonucleotide
  Target: SCN10A; (-) strand; PAM type: YTN; PAM sequence: TTA
gtcatcaaacagcaaacatt

SEQ ID NO: 49200 - DNA, 20 bp, Artificial Sequence
  Description of Artificial Sequence: Synthetic oligonucleotide
  Target: SCN10A; (-) strand; PAM type: YTN; PAM sequence: CTA
ttagtcatcaaacagcaaac

SEQ ID NO: 49201 - DNA, 20 bp, Artificial Sequence
  Description of Artificial Sequence: Synthetic oligonucleotide
  Target: SCN10A; (-) strand; PAM type: YTN; PAM sequence: TTG
ctattagtcatcaaacagca

SEQ ID NO: 49202 - DNA, 20 bp, Artificial Sequence
  Description of Artificial Sequence: Synthetic oligonucleotide
  Target: SCN10A; (-) strand; PAM type: YTN; PAM sequence: TTT
gctattagtcatcaaacagc

SEQ ID NO: 49203 - DNA, 20 bp, Artificial Sequence
  Description of Artificial Sequence: Synthetic oligonucleotide
  Target: SCN10A; (-) strand; PAM type: YTN; PAM sequence: TTT
tgctattagtcatcaaacag

SEQ ID NO: 49204 - DNA, 20 bp, Artificial Sequence
  Description of Artificial Sequence: Synthetic oligonucleotide
  Target: SCN10A; (-) strand; PAM type: YTN; PAM sequence: TTG
ttttgctattagtcatcaaa

SEQ ID NO: 49205 - DNA, 20 bp, Artificial Sequence
  Description of Artificial Sequence: Synthetic oligonucleotide
  Target: SCN10A; (-) strand; PAM type: YTN; PAM sequence: TTT
gttttgctattagtcatcaa

SEQ ID NO: 49206 - DNA, 20 bp, Artificial Sequence
  Description of Artificial Sequence: Synthetic oligonucleotide
  Target: SCN10A; (-) strand; PAM type: YTN; PAM sequence: TTT
tgttttgctattagtcatca

SEQ ID NO: 49207 - DNA, 20 bp, Artificial Sequence
  Description of Artificial Sequence: Synthetic oligonucleotide
  Target: SCN10A; (-) strand; PAM type: YTN; PAM sequence: TTT
ttgttttgctattagtcatc

SEQ ID NO: 49208 - DNA, 20 bp, Artificial Sequence
  Description of Artificial Sequence: Synthetic oligonucleotide
  Target: SCN10A; (-) strand; PAM type: YTN; PAM sequence: TTG
gtttttgttttgctattagt

SEQ ID NO: 49209 - DNA, 20 bp, Artificial Sequence
  Description of Artificial Sequence: Synthetic oligonucleotide
  Target: SCN10A; (-) strand; PAM type: YTN; PAM sequence: TTT
ggtttttgttttgctattag

SEQ ID NO: 49210 - DNA, 20 bp, Artificial Sequence
  Description of Artificial Sequence: Synthetic oligonucleotide
  Target: SCN10A; (-) strand; PAM type: YTN; PAM sequence: TTT
tggtttttgttttgctatta

SEQ ID NO: 49211 - DNA, 20 bp, Artificial Sequence
  Description of Artificial Sequence: Synthetic oligonucleotide
  Target: SCN10A; (-) strand; PAM type: YTN; PAM sequence: TTG
ttttggtttttgttttgcta

SEQ ID NO: 49212 - DNA, 20 bp, Artificial Sequence
  Description of Artificial Sequence: Synthetic oligonucleotide
  Target: SCN10A; (-) strand; PAM type: YTN; PAM sequence: TTT
gttttggtttttgttttgct

SEQ ID NO: 49213 - DNA, 20 bp, Artificial Sequence
  Description of Artificial Sequence: Synthetic oligonucleotide
  Target: SCN10A; (-) strand; PAM type: YTN; PAM sequence: TTG
tttgttttggtttttgtttt

SEQ ID NO: 49214 - DNA, 20 bp, Artificial Sequence
  Description of Artificial Sequence: Synthetic oligonucleotide
  Target: SCN10A; (-) strand; PAM type: YTN; PAM sequence: TTT
gtttgttttggtttttgttt

SEQ ID NO: 49215 - DNA, 20 bp, Artificial Sequence
  Description of Artificial Sequence: Synthetic oligonucleotide
  Target: SCN10A; (-) strand; PAM type: YTN; PAM sequence: TTG
tttgtttgttttggtttttg

SEQ ID NO: 49216 - DNA, 20 bp, Artificial Sequence
  Description of Artificial Sequence: Synthetic oligonucleotide
  Target: SCN10A; (-) strand; PAM type: YTN; PAM sequence: TTT
gtttgtttgttttggttttt

SEQ ID NO: 49217 - DNA, 20 bp, Artificial Sequence
  Description of Artificial Sequence: Synthetic oligonucleotide
  Target: SCN10A; (-) strand; PAM type: YTN; PAM sequence: TTT
tgtttgtttgttttggtttt

SEQ ID NO: 49218 - DNA, 20 bp, Artificial Sequence
  Description of Artificial Sequence: Synthetic oligonucleotide
  Target: SCN10A; (-) strand; PAM type: YTN; PAM sequence: TTT
ttgtttgtttgttttggttt

SEQ ID NO: 49219 - DNA, 20 bp, Artificial Sequence
  Description of Artificial Sequence: Synthetic oligonucleotide
  Target: SCN10A; (-) strand; PAM type: YTN; PAM sequence: TTG
gtttttgtttgtttgttttg

SEQ ID NO: 49220 - DNA, 20 bp, Artificial Sequence
  Description of Artificial Sequence: Synthetic oligonucleotide
  Target: SCN10A; (-) strand; PAM type: YTN; PAM sequence: CTT
ggtttttgtttgtttgtttt

SEQ ID NO: 49221 - DNA, 20 bp, Artificial Sequence
  Description of Artificial Sequence: Synthetic oligonucleotide
  Target: SCN10A; (-) strand; PAM type: YTN; PAM sequence: TTC
ttggtttttgtttgtttgtt

SEQ ID NO: 49222 - DNA, 20 bp, Artificial Sequence
  Description of Artificial Sequence: Synthetic oligonucleotide
  Target: SCN10A; (-) strand; PAM type: YTN; PAM sequence: TTT
cttggtttttgtttgtttgt

SEQ ID NO: 49223 - DNA, 20 bp, Artificial Sequence
  Description of Artificial Sequence: Synthetic oligonucleotide
  Target: SCN10A; (-) strand; PAM type: YTN; PAM sequence: TTG
gccagataggtttcttggtt

SEQ ID NO: 49224 - DNA, 20 bp, Artificial Sequence
  Description of Artificial Sequence: Synthetic oligonucleotide
  Target: SCN10A; (-) strand; PAM type: YTN; PAM sequence: CTT
ggccagataggtttcttggt

SEQ ID NO: 49225 - DNA, 20 bp, Artificial Sequence
  Description of Artificial Sequence: Synthetic oligonucleotide
  Target: SCN10A; (-) strand; PAM type: YTN; PAM sequence: TTC
ttggccagataggtttcttg

SEQ ID NO: 49226 - DNA, 20 bp, Artificial Sequence
  Description of Artificial Sequence: Synthetic oligonucleotide
  Target: SCN10A; (-) strand; PAM type: YTN; PAM sequence: TTT
cttggccagataggtttctt

SEQ ID NO: 49227 - DNA, 20 bp, Artificial Sequence
  Description of Artificial Sequence: Synthetic oligonucleotide
  Target: SCN10A; (-) strand; PAM type: YTN; PAM sequence: CTT
tcttggccagataggtttct

SEQ ID NO: 49228 - DNA, 20 bp, Artificial Sequence
  Description of Artificial Sequence: Synthetic oligonucleotide
  Target: SCN10A; (-) strand; PAM type: YTN; PAM sequence: TTC
tttcttggccagataggttt

SEQ ID NO: 49229 - DNA, 20 bp, Artificial Sequence
  Description of Artificial Sequence: Synthetic oligonucleotide
  Target: SCN10A; (-) strand; PAM type: YTN; PAM sequence: TTT
ctttcttggccagataggtt

SEQ ID NO: 49230 - DNA, 20 bp, Artificial Sequence
  Description of Artificial Sequence: Synthetic oligonucleotide
  Target: SCN10A; (-) strand; PAM type: YTN; PAM sequence: TTC
ccacaatttctttcttggcc

SEQ ID NO: 49231 - DNA, 20 bp, Artificial Sequence
  Description of Artificial Sequence: Synthetic oligonucleotide
  Target: SCN10A; (-) strand; PAM type: YTN; PAM sequence: CTA
ttcccacaatttctttcttg

SEQ ID NO: 49232 - DNA, 20 bp, Artificial Sequence
  Description of Artificial Sequence: Synthetic oligonucleotide
  Target: SCN10A; (-) strand; PAM type: YTN; PAM sequence: CTG
ctattcccacaatttctttc

SEQ ID NO: 49233 - DNA, 20 bp, Artificial Sequence
  Description of Artificial Sequence: Synthetic oligonucleotide
  Target: SCN10A; (-) strand; PAM type: YTN; PAM sequence: TTG
accaagctgctattcccaca

SEQ ID NO: 49234 - DNA, 20 bp, Artificial Sequence
  Description of Artificial Sequence: Synthetic oligonucleotide
  Target: SCN10A; (-) strand; PAM type: YTN; PAM sequence: TTT
gaccaagctgctattcccac

SEQ ID NO: 49235 - DNA, 20 bp, Artificial Sequence
  Description of Artificial Sequence: Synthetic oligonucleotide
  Target: SCN10A; (-) strand; PAM type: YTN; PAM sequence: TTC
atggcatagaatttgaccaa

SEQ ID NO: 49236 - DNA, 20 bp, Artificial Sequence
  Description of Artificial Sequence: Synthetic oligonucleotide
  Target: SCN10A; (-) strand; PAM type: YTN; PAM sequence: TTT
catggcatagaatttgacca

SEQ ID NO: 49237 - DNA, 20 bp, Artificial Sequence
  Description of Artificial Sequence: Synthetic oligonucleotide
  Target: SCN10A; (-) strand; PAM type: YTN; PAM sequence: TTT
tcatggcatagaatttgacc

SEQ ID NO: 49238 - DNA, 20 bp, Artificial Sequence
  Description of Artificial Sequence: Synthetic oligonucleotide
  Target: SCN10A; (-) strand; PAM type: YTN; PAM sequence: TTT
ttcatggcatagaatttgac

SEQ ID NO: 49239 - DNA, 20 bp, Artificial Sequence
  Description of Artificial Sequence: Synthetic oligonucleotide
  Target: SCN10A; (-) strand; PAM type: YTN; PAM sequence: CTA
acatttttcatggcatagaa

SEQ ID NO: 49240 - DNA, 20 bp, Artificial Sequence
  Description of Artificial Sequence: Synthetic oligonucleotide
  Target: SCN10A; (-) strand; PAM type: YTN; PAM sequence: TTC
taacatttttcatggcatag

SEQ ID NO: 49241 - DNA, 20 bp, Artificial Sequence
  Description of Artificial Sequence: Synthetic oligonucleotide
  Target: SCN10A; (-) strand; PAM type: YTN; PAM sequence: CTT
ctaacatttttcatggcata

SEQ ID NO: 49242 - DNA, 20 bp, Artificial Sequence
  Description of Artificial Sequence: Synthetic oligonucleotide
  Target: SCN10A; (-) strand; PAM type: YTN; PAM sequence: CTG
tacttctaacatttttcatg

SEQ ID NO: 49243 - DNA, 20 bp, Artificial Sequence
  Description of Artificial Sequence: Synthetic oligonucleotide
  Target: SCN10A; (-) strand; PAM type: YTN; PAM sequence: TTG
taatagagtctgtacttcta

SEQ ID NO: 49244 - DNA, 20 bp, Artificial Sequence
  Description of Artificial Sequence: Synthetic oligonucleotide
  Target: SCN10A; (-) strand; PAM type: YTN; PAM sequence: TTC
attgtaatagagtctgtact

SEQ ID NO: 49245 - DNA, 20 bp, Artificial Sequence
  Description of Artificial Sequence: Synthetic oligonucleotide
  Target: SCN10A; (-) strand; PAM type: YTN; PAM sequence: CTG
ttcattgtaatagagtctgt

SEQ ID NO: 49246 - DNA, 20 bp, Artificial Sequence
  Description of Artificial Sequence: Synthetic oligonucleotide
  Target: SCN10A; (-) strand; PAM type: YTN; PAM sequence: TTA
atatcactgttcattgtaat

SEQ ID NO: 49247 - DNA, 20 bp, Artificial Sequence
  Description of Artificial Sequence: Synthetic oligonucleotide
  Target: SCN10A; (-) strand; PAM type: YTN; PAM sequence: TTT
aatatcactgttcattgtaa

SEQ ID NO: 49248 - DNA, 20 bp, Artificial Sequence
  Description of Artificial Sequence: Synthetic oligonucleotide
  Target: SCN10A; (-) strand; PAM type: YTN; PAM sequence: TTA
tttaatatcactgttcattg

SEQ ID NO: 49249 - DNA, 20 bp, Artificial Sequence
  Description of Artificial Sequence: Synthetic oligonucleotide
  Target: SCN10A; (-) strand; PAM type: YTN; PAM sequence: TTG
ataattatttaatatcactg

SEQ ID NO: 49250 - DNA, 20 bp, Artificial Sequence
  Description of Artificial Sequence: Synthetic oligonucleotide
  Target: SCN10A; (-) strand; PAM type: YTN; PAM sequence: CTC
attgataattatttaatatc

SEQ ID NO: 49251 - DNA, 20 bp, Artificial Sequence
  Description of Artificial Sequence: Synthetic oligonucleotide
  Target: SCN10A; (-) strand; PAM type: YTN; PAM sequence: TTC
tcattgataattatttaata

SEQ ID NO: 49252 - DNA, 20 bp, Artificial Sequence
  Description of Artificial Sequence: Synthetic oligonucleotide
  Target: SCN10A; (-) strand; PAM type: YTN; PAM sequence: TTT
ctcattgataattatttaat

SEQ ID NO: 49253 - DNA, 20 bp, Artificial Sequence
  Description of Artificial Sequence: Synthetic oligonucleotide
  Target: SCN10A; (-) strand; PAM type: YTN; PAM sequence: TTT
tctcattgataattatttaa

SEQ ID NO: 49254 - DNA, 20 bp, Artificial Sequence
  Description of Artificial Sequence: Synthetic oligonucleotide
  Target: SCN10A; (-) strand; PAM type: YTN; PAM sequence: TTT
ttctcattgataattattta

SEQ ID NO: 49255 - DNA, 20 bp, Artificial Sequence
  Description of Artificial Sequence: Synthetic oligonucleotide
  Target: SCN10A; (-) strand; PAM type: YTN; PAM sequence: TTT
tttctcattgataattattt

SEQ ID NO: 49256 - DNA, 20 bp, Artificial Sequence
  Description of Artificial Sequence: Synthetic oligonucleotide
  Target: SCN10A; (-) strand; PAM type: YTN; PAM sequence: TTA
ttttttctcattgataatta

SEQ ID NO: 49257 - DNA, 20 bp, Artificial Sequence
  Description of Artificial Sequence: Synthetic oligonucleotide
  Target: SCN10A; (-) strand; PAM type: YTN; PAM sequence: CTA
ttattttttctcattgataa

SEQ ID NO: 49258 - DNA, 20 bp, Artificial Sequence
  Description of Artificial Sequence: Synthetic oligonucleotide
  Target: SCN10A; (-) strand; PAM type: YTN; PAM sequence: TTC
tattattttttctcattgat

SEQ ID NO: 49259 - DNA, 20 bp, Artificial Sequence
  Description of Artificial Sequence: Synthetic oligonucleotide
  Target: SCN10A; (-) strand; PAM type: YTN; PAM sequence: CTT
ctattattttttctcattga

SEQ ID NO: 49260 - DNA, 20 bp, Artificial Sequence
  Description of Artificial Sequence: Synthetic oligonucleotide
  Target: SCN10A; (-) strand; PAM type: YTN; PAM sequence: CTC
ttctattattttttctcatt

SEQ ID NO: 49261 - DNA, 20 bp, Artificial Sequence
  Description of Artificial Sequence: Synthetic oligonucleotide
  Target: SCN10A; (-) strand; PAM type: YTN; PAM sequence: CTC
tcttctattattttttctca

SEQ ID NO: 49262 - DNA, 20 bp, Artificial Sequence
  Description of Artificial Sequence: Synthetic oligonucleotide
  Target: SCN10A; (-) strand; PAM type: YTN; PAM sequence: CTC
aacaacaacgtgtacagact

SEQ ID NO: 49263 - DNA, 20 bp, Artificial Sequence
  Description of Artificial Sequence: Synthetic oligonucleotide
  Target: SCN10A; (-) strand; PAM type: YTN; PAM sequence: TTC
tcaacaacaacgtgtacaga

SEQ ID NO: 49264 - DNA, 20 bp, Artificial Sequence
  Description of Artificial Sequence: Synthetic oligonucleotide
  Target: SCN10A; (-) strand; PAM type: YTN; PAM sequence: TTT
ctcaacaacaacgtgtacag

SEQ ID NO: 49265 - DNA, 20 bp, Artificial Sequence
  Description of Artificial Sequence: Synthetic oligonucleotide
  Target: SCN10A; (-) strand; PAM type: YTN; PAM sequence: CTC
atttctcaacaacaacgtgt

SEQ ID NO: 49266 - DNA, 20 bp, Artificial Sequence
  Description of Artificial Sequence: Synthetic oligonucleotide
  Target: SCN10A; (-) strand; PAM type: YTN; PAM sequence: TTG
agaaatgtgtactcatttct

SEQ ID NO: 49267 - DNA, 20 bp, Artificial Sequence
  Description of Artificial Sequence: Synthetic oligonucleotide
  Target: SCN10A; (-) strand; PAM type: YTN; PAM sequence: TTT
gagaaatgtgtactcatttc

SEQ ID NO: 49268 - DNA, 20 bp, Artificial Sequence
  Description of Artificial Sequence: Synthetic oligonucleotide
  Target: SCN10A; (-) strand; PAM type: YTN; PAM sequence: CTT
tgagaaatgtgtactcattt

SEQ ID NO: 49269 - DNA, 20 bp, Artificial Sequence
  Description of Artificial Sequence: Synthetic oligonucleotide
  Target: SCN10A; (-) strand; PAM type: YTN; PAM sequence: TTG
tgctttgagaaatgtgtact

SEQ ID NO: 49270 - DNA, 20 bp, Artificial Sequence
  Description of Artificial Sequence: Synthetic oligonucleotide
  Target: SCN10A; (-) strand; PAM type: YTN; PAM sequence: TTT
gtgctttgagaaatgtgtac

SEQ ID NO: 49271 - DNA, 20 bp, Artificial Sequence
  Description of Artificial Sequence: Synthetic oligonucleotide
  Target: SCN10A; (-) strand; PAM type: YTN; PAM sequence: CTG
agtttgtgctttgagaaatg

SEQ ID NO: 49272 - DNA, 20 bp, Artificial Sequence
  Description of Artificial Sequence: Synthetic oligonucleotide
  Target: SCN10A; (-) strand; PAM type: YTN; PAM sequence: TTG
catacctgagtttgtgcttt

SEQ ID NO: 49273 - DNA, 20 bp, Artificial Sequence
  Description of Artificial Sequence: Synthetic oligonucleotide
  Target: SCN10A; (-) strand; PAM type: YTN; PAM sequence: CTT
gcatacctgagtttgtgctt

SEQ ID NO: 49274 - DNA, 20 bp, Artificial Sequence
  Description of Artificial Sequence: Synthetic oligonucleotide
  Target: SCN10A; (-) strand; PAM type: YTN; PAM sequence: TTC
ttgcatacctgagtttgtgc

SEQ ID NO: 49275 - DNA, 20 bp, Artificial Sequence
  Description of Artificial Sequence: Synthetic oligonucleotide
  Target: SCN10A; (-) strand; PAM type: YTN; PAM sequence: TTT
cttgcatacctgagtttgtg

SEQ ID NO: 49276 - DNA, 20 bp, Artificial Sequence
  Description of Artificial Sequence: Synthetic oligonucleotide
  Target: SCN10A; (-) strand; PAM type: YTN; PAM sequence: TTA
catttcttgcatacctgagt

SEQ ID NO: 49277 - DNA, 20 bp, Artificial Sequence
  Description of Artificial Sequence: Synthetic oligonucleotide
  Target: SCN10A; (-) strand; PAM type: YTN; PAM sequence: CTA
agttacatttcttgcatacc

SEQ ID NO: 49278 - DNA, 20 bp, Artificial Sequence
  Description of Artificial Sequence: Synthetic oligonucleotide
  Target: SCN10A; (-) strand; PAM type: YTN; PAM sequence: TTC
aactaagttacatttcttgc

SEQ ID NO: 49279 - DNA, 20 bp, Artificial Sequence
  Description of Artificial Sequence: Synthetic oligonucleotide
  Target: SCN10A; (-) strand; PAM type: YTN; PAM sequence: TTG
aattcaactaagttacattt

SEQ ID NO: 49280 - DNA, 20 bp, Artificial Sequence
  Description of Artificial Sequence: Synthetic oligonucleotide
  Target: SCN10A; (-) strand; PAM type: YTN; PAM sequence: TTG
aagcataaattgaattcaac

SEQ ID NO: 49281 - DNA, 20 bp, Artificial Sequence
  Description of Artificial Sequence: Synthetic oligonucleotide
  Target: SCN10A; (-) strand; PAM type: YTN; PAM sequence: CTT
gaagcataaattgaattcaa

SEQ ID NO: 49282 - DNA, 20 bp, Artificial Sequence
  Description of Artificial Sequence: Synthetic oligonucleotide
  Target: SCN10A; (-) strand; PAM type: YTN; PAM sequence: TTC
ccatggtgaggacttgaagc

SEQ ID NO: 49283 - DNA, 20 bp, Artificial Sequence
  Description of Artificial Sequence: Synthetic oligonucleotide
  Target: SCN10A; (-) strand; PAM type: YTN; PAM sequence: TTA
acaagagacagttcccatgg

SEQ ID NO: 49284 - DNA, 20 bp, Artificial Sequence
  Description of Artificial Sequence: Synthetic oligonucleotide
  Target: SCN10A; (-) strand; PAM type: YTN; PAM sequence: CTT
aacaagagacagttcccatg

SEQ ID NO: 49285 - DNA, 20 bp, Artificial Sequence
  Description of Artificial Sequence: Synthetic oligonucleotide
  Target: SCN10A; (-) strand; PAM type: YTN; PAM sequence: TTG
acttaacaagagacagttcc

SEQ ID NO: 49286 - DNA, 20 bp, Artificial Sequence
  Description of Artificial Sequence: Synthetic oligonucleotide
  Target: SCN10A; (-) strand; PAM type: YTN; PAM sequence: TTG
aaatagtacccaacattgac

SEQ ID NO: 49287 - DNA, 20 bp, Artificial Sequence
  Description of Artificial Sequence: Synthetic oligonucleotide
  Target: SCN10A; (-) strand; PAM type: YTN; PAM sequence: CTC
agatattgaaatagtaccca

SEQ ID NO: 49288 - DNA, 20 bp, Artificial Sequence
  Description of Artificial Sequence: Synthetic oligonucleotide
  Target: SCN10A; (-) strand; PAM type: YTN; PAM sequence: CTC
agacacagactcagatattg

SEQ ID NO: 49289 - DNA, 20 bp, Artificial Sequence
  Description of Artificial Sequence: Synthetic oligonucleotide
  Target: SCN10A; (-) strand; PAM type: YTN; PAM sequence: CTA
caaaactcagacacagactc

SEQ ID NO: 49290 - DNA, 20 bp, Artificial Sequence
  Description of Artificial Sequence: Synthetic oligonucleotide
  Target: SCN10A; (-) strand; PAM type: YTN; PAM sequence: TTG
agccctacaaaactcagaca

SEQ ID NO: 49291 - DNA, 20 bp, Artificial Sequence
  Description of Artificial Sequence: Synthetic oligonucleotide
  Target: SCN10A; (-) strand; PAM type: YTN; PAM sequence: TTT
gagccctacaaaactcagac

SEQ ID NO: 49292 - DNA, 20 bp, Artificial Sequence
  Description of Artificial Sequence: Synthetic oligonucleotide
  Target: SCN10A; (-) strand; PAM type: YTN; PAM sequence: CTC
caggtttgagccctacaaaa

SEQ ID NO: 49293 - DNA, 20 bp, Artificial Sequence
  Description of Artificial Sequence: Synthetic oligonucleotide
  Target: SCN10A; (-) strand; PAM type: YTN; PAM sequence: CTC
ctccaggtttgagccctaca

SEQ ID NO: 49294 - DNA, 20 bp, Artificial Sequence
  Description of Artificial Sequence: Synthetic oligonucleotide
  Target: SCN10A; (-) strand; PAM type: YTN; PAM sequence: CTC
tcctccaggtttgagcccta

SEQ ID NO: 49295 - DNA, 20 bp, Artificial Sequence
  Description of Artificial Sequence: Synthetic oligonucleotide
  Target: SCN10A; (-) strand; PAM type: YTN; PAM sequence: CTC
aactctcctccaggtttgag

SEQ ID NO: 49296 - DNA, 20 bp, Artificial Sequence
  Description of Artificial Sequence: Synthetic oligonucleotide
  Target: SCN10A; (-) strand; PAM type: YTN; PAM sequence: TTA
gcaatgacaaaggaccagct

SEQ ID NO: 49297 - DNA, 20 bp, Artificial Sequence
  Description of Artificial Sequence: Synthetic oligonucleotide
  Target: SCN10A; (-) strand; PAM type: YTN; PAM sequence: CTT
agcaatgacaaaggaccagc

SEQ ID NO: 49298 - DNA, 20 bp, Artificial Sequence
  Description of Artificial Sequence: Synthetic oligonucleotide
  Target: SCN10A; (-) strand; PAM type: YTN; PAM sequence: CTC
aggcaaaatacgcttagcaa

SEQ ID NO: 49299 - DNA, 20 bp, Artificial Sequence
  Description of Artificial Sequence: Synthetic oligonucleotide
  Target: SCN10A; (-) strand; PAM type: YTN; PAM sequence: CTA
caactcaggcaaaatacgct

SEQ ID NO: 49300 - DNA, 20 bp, Artificial Sequence
  Description of Artificial Sequence: Synthetic oligonucleotide
  Target: SCN10A; (-) strand; PAM type: YTN; PAM sequence: CTC
ccaccagggaccagatggga

SEQ ID NO: 49301 - DNA, 20 bp, Artificial Sequence
  Description of Artificial Sequence: Synthetic oligonucleotide
  Target: SCN10A; (-) strand; PAM type: YTN; PAM sequence: CTC
tcccaccagggaccagatgg

SEQ ID NO: 49302 - DNA, 20 bp, Artificial Sequence
  Description of Artificial Sequence: Synthetic oligonucleotide
  Target: SCN10A; (-) strand; PAM type: YTN; PAM sequence: TTC
atggactctcccaccaggga

SEQ ID NO: 49303 - DNA, 20 bp, Artificial Sequence
  Description of Artificial Sequence: Synthetic oligonucleotide
  Target: SCN10A; (-) strand; PAM type: YTN; PAM sequence: CTT
catggactctcccaccaggg

SEQ ID NO: 49304 - DNA, 20 bp, Artificial Sequence
  Description of Artificial Sequence: Synthetic oligonucleotide
  Target: SCN10A; (-) strand; PAM type: YTN; PAM sequence: CTA
gagagagaagagccatcttc

SEQ ID NO: 49305 - DNA, 20 bp, Artificial Sequence
  Description of Artificial Sequence: Synthetic oligonucleotide
  Target: SCN10A; (-) strand; PAM type: YTN; PAM sequence: CTA
tggaaaaagatgagtgagac

SEQ ID NO: 49306 - DNA, 20 bp, Artificial Sequence
  Description of Artificial Sequence: Synthetic oligonucleotide
  Target: SCN10A; (-) strand; PAM type: YTN; PAM sequence: TTA
gcccccagtgaaggctatgg

SEQ ID NO: 49307 - DNA, 20 bp, Artificial Sequence
  Description of Artificial Sequence: Synthetic oligonucleotide
  Target: SCN10A; (-) strand; PAM type: YTN; PAM sequence: CTT
agcccccagtgaaggctatg

SEQ ID NO: 49308 - DNA, 20 bp, Artificial Sequence
  Description of Artificial Sequence: Synthetic oligonucleotide
  Target: SCN10A; (-) strand; PAM type: YTN; PAM sequence: CTG
ggtgatgacttagcccccag

SEQ ID NO: 49309 - DNA, 20 bp, Artificial Sequence
  Description of Artificial Sequence: Synthetic oligonucleotide
  Target: SCN10A; (-) strand; PAM type: YTN; PAM sequence: CTC
cagaatggcagagaggagct

SEQ ID NO: 49310 - DNA, 20 bp, Artificial Sequence
  Description of Artificial Sequence: Synthetic oligonucleotide
  Target: SCN10A; (-) strand; PAM type: YTN; PAM sequence: CTG
tggctccagaatggcagaga

SEQ ID NO: 49311 - DNA, 20 bp, Artificial Sequence
  Description of Artificial Sequence: Synthetic oligonucleotide
  Target: SCN10A; (-) strand; PAM type: YTN; PAM sequence: CTC
agagagagccctgtggctcc

SEQ ID NO: 49312 - DNA, 20 bp, Artificial Sequence
  Description of Artificial Sequence: Synthetic oligonucleotide
  Target: SCN10A; (-) strand; PAM type: YTN; PAM sequence: CTG
aagcagcctcagagagagcc

SEQ ID NO: 49313 - DNA, 20 bp, Artificial Sequence
  Description of Artificial Sequence: Synthetic oligonucleotide
  Target: SCN10A; (-) strand; PAM type: YTN; PAM sequence: TTA
gagaaggcctgaagcagcct

SEQ ID NO: 49314 - DNA, 20 bp, Artificial Sequence
  Description of Artificial Sequence: Synthetic oligonucleotide
  Target: SCN10A; (-) strand; PAM type: YTN; PAM sequence: TTA
ggttagagaaggcctgaagc

SEQ ID NO: 49315 - DNA, 20 bp, Artificial Sequence
  Description of Artificial Sequence: Synthetic oligonucleotide
  Target: SCN10A; (-) strand; PAM type: YTN; PAM sequence: CTT
aggttagagaaggcctgaag

SEQ ID NO: 49316 - DNA, 20 bp, Artificial Sequence
  Description of Artificial Sequence: Synthetic oligonucleotide
  Target: SCN10A; (-) strand; PAM type: YTN; PAM sequence: TTA
ggtcaaccttaggttagaga

SEQ ID NO: 49317 - DNA, 20 bp, Artificial Sequence
  Description of Artificial Sequence: Synthetic oligonucleotide
  Target: SCN10A; (-) strand; PAM type: YTN; PAM sequence: CTT
aggtcaaccttaggttagag

SEQ ID NO: 49318 - DNA, 20 bp, Artificial Sequence
  Description of Artificial Sequence: Synthetic oligonucleotide
  Target: SCN10A; (-) strand; PAM type: YTN; PAM sequence: TTA
gcttaggtcaaccttaggtt

SEQ ID NO: 49319 - DNA, 20 bp, Artificial Sequence
  Description of Artificial Sequence: Synthetic oligonucleotide
  Target: SCN10A; (-) strand; PAM type: YTN; PAM sequence: CTT
agcttaggtcaaccttaggt

SEQ ID NO: 49320 - DNA, 20 bp, Artificial Sequence
  Description of Artificial Sequence: Synthetic oligonucleotide
  Target: SCN10A; (-) strand; PAM type: YTN; PAM sequence: CTG
gggaaaggcaaccttagctt

SEQ ID NO: 49321 - DNA, 20 bp, Artificial Sequence
  Description of Artificial Sequence: Synthetic oligonucleotide
  Target: SCN10A; (-) strand; PAM type: YTN; PAM sequence: TTA
agaaaatctggggaaaggca

SEQ ID NO: 49322 - DNA, 20 bp, Artificial Sequence
  Description of Artificial Sequence: Synthetic oligonucleotide
  Target: SCN10A; (-) strand; PAM type: YTN; PAM sequence: TTT
aagaaaatctggggaaaggc

SEQ ID NO: 49323 - DNA, 20 bp, Artificial Sequence
  Description of Artificial Sequence: Synthetic oligonucleotide
  Target: SCN10A; (-) strand; PAM type: YTN; PAM sequence: TTT
taagaaaatctggggaaagg

SEQ ID NO: 49324 - DNA, 20 bp, Artificial Sequence
  Description of Artificial Sequence: Synthetic oligonucleotide
  Target: SCN10A; (-) strand; PAM type: YTN; PAM sequence: TTT
ttaagaaaatctggggaaag

SEQ ID NO: 49325 - DNA, 20 bp, Artificial Sequence
  Description of Artificial Sequence: Synthetic oligonucleotide
  Target: SCN10A; (-) strand; PAM type: YTN; PAM sequence: CTG
tgagagtagagtaagaaagg

SEQ ID NO: 49326 - DNA, 20 bp, Artificial Sequence
  Description of Artificial Sequence: Synthetic oligonucleotide
  Target: SCN10A; (-) strand; PAM type: YTN; PAM sequence: CTC
aaggaagatactgtgagagt

SEQ ID NO: 49327 - DNA, 20 bp, Artificial Sequence
  Description of Artificial Sequence: Synthetic oligonucleotide
  Target: SCN10A; (-) strand; PAM type: YTN; PAM sequence: TTC
cgctcaaggaagatactgtg

SEQ ID NO: 49328 - DNA, 20 bp, Artificial Sequence
  Description of Artificial Sequence: Synthetic oligonucleotide
  Target: SCN10A; (-) strand; PAM type: YTN; PAM sequence: CTT
ccgctcaaggaagatactgt

SEQ ID NO: 49329 - DNA, 20 bp, Artificial Sequence
  Description of Artificial Sequence: Synthetic oligonucleotide
  Target: SCN10A; (-) strand; PAM type: YTN; PAM sequence: TTG
gggtaggatagacttccgct

SEQ ID NO: 49330 - DNA, 20 bp, Artificial Sequence
  Description of Artificial Sequence: Synthetic oligonucleotide
  Target: SCN10A; (-) strand; PAM type: YTN; PAM sequence: CTT
ggggtaggatagacttccgc

SEQ ID NO: 49331 - DNA, 20 bp, Artificial Sequence
  Description of Artificial Sequence: Synthetic oligonucleotide
  Target: SCN10A; (-) strand; PAM type: YTN; PAM sequence: CTG
ataaaaaggaagaaaataag

SEQ ID NO: 49332 - DNA, 20 bp, Artificial Sequence
  Description of Artificial Sequence: Synthetic oligonucleotide
  Target: SCN10A; (-) strand; PAM type: YTN; PAM sequence: TTA
tagtggtgtaaactgataaa

SEQ ID NO: 49333 - DNA, 20 bp, Artificial Sequence
  Description of Artificial Sequence: Synthetic oligonucleotide
  Target: SCN10A; (-) strand; PAM type: YTN; PAM sequence: TTT
atagtggtgtaaactgataa

SEQ ID NO: 49334 - DNA, 20 bp, Artificial Sequence
  Description of Artificial Sequence: Synthetic oligonucleotide
  Target: SCN10A; (-) strand; PAM type: YTN; PAM sequence: CTT
tatagtggtgtaaactgata

SEQ ID NO: 49335 - DNA, 20 bp, Artificial Sequence
  Description of Artificial Sequence: Synthetic oligonucleotide
  Target: SCN10A; (-) strand; PAM type: YTN; PAM sequence: CTA
ctttatagtggtgtaaactg

SEQ ID NO: 49336 - DNA, 20 bp, Artificial Sequence
  Description of Artificial Sequence: Synthetic oligonucleotide
  Target: SCN10A; (-) strand; PAM type: YTN; PAM sequence: CTG
gggggtgatgctactttata

SEQ ID NO: 49337 - DNA, 20 bp, Artificial Sequence
  Description of Artificial Sequence: Synthetic oligonucleotide
  Target: SCN10A; (-) strand; PAM type: YTN; PAM sequence: TTA
acaaaggtgatatctggggg

SEQ ID NO: 49338 - DNA, 20 bp, Artificial Sequence
  Description of Artificial Sequence: Synthetic oligonucleotide
  Target: SCN10A; (-) strand; PAM type: YTN; PAM sequence: CTA
gaagagcagtgcattaacaa

SEQ ID NO: 49339 - DNA, 20 bp, Artificial Sequence
  Description of Artificial Sequence: Synthetic oligonucleotide
  Target: SCN10A; (-) strand; PAM type: YTN; PAM sequence: TTA
cctagaagagcagtgcatta

SEQ ID NO: 49340 - DNA, 20 bp, Artificial Sequence
  Description of Artificial Sequence: Synthetic oligonucleotide
  Target: SCN10A; (-) strand; PAM type: YTN; PAM sequence: CTC
cattacctagaagagcagtg

SEQ ID NO: 49341 - DNA, 20 bp, Artificial Sequence
  Description of Artificial Sequence: Synthetic oligonucleotide
  Target: SCN10A; (-) strand; PAM type: YTN; PAM sequence: CTG
gatctccattacctagaaga

SEQ ID NO: 49342 - DNA, 20 bp, Artificial Sequence
  Description of Artificial Sequence: Synthetic oligonucleotide
  Target: SCN10A; (-) strand; PAM type: YTN; PAM sequence: CTC
acagctggatctccattacc

SEQ ID NO: 49343 - DNA, 20 bp, Artificial Sequence
  Description of Artificial Sequence: Synthetic oligonucleotide
  Target: SCN10A; (-) strand; PAM type: YTN; PAM sequence: TTG
ctcacagctggatctccatt

SEQ ID NO: 49344 - DNA, 20 bp, Artificial Sequence
  Description of Artificial Sequence: Synthetic oligonucleotide
  Target: SCN10A; (-) strand; PAM type: YTN; PAM sequence: TTT
gctcacagctggatctccat

SEQ ID NO: 49345 - DNA, 20 bp, Artificial Sequence
  Description of Artificial Sequence: Synthetic oligonucleotide
  Target: SCN10A; (-) strand; PAM type: YTN; PAM sequence: TTT
tgctcacagctggatctcca

SEQ ID NO: 49346 - DNA, 20 bp, Artificial Sequence
  Description of Artificial Sequence: Synthetic oligonucleotide
  Target: SCN10A; (-) strand; PAM type: YTN; PAM sequence: CTG
ttttgctcacagctggatct

SEQ ID NO: 49347 - DNA, 20 bp, Artificial Sequence
  Description of Artificial Sequence: Synthetic oligonucleotide
  Target: SCN10A; (-) strand; PAM type: YTN; PAM sequence: TTA
ccagatatgcagagatgtat

SEQ ID NO: 49348 - DNA, 20 bp, Artificial Sequence
  Description of Artificial Sequence: Synthetic oligonucleotide
  Target: SCN10A; (-) strand; PAM type: YTN; PAM sequence: TTT
accagatatgcagagatgta

SEQ ID NO: 49349 - DNA, 20 bp, Artificial Sequence
  Description of Artificial Sequence: Synthetic oligonucleotide
  Target: SCN10A; (-) strand; PAM type: YTN; PAM sequence: CTA
gccagtaatttaccagatat

SEQ ID NO: 49350 - DNA, 20 bp, Artificial Sequence
  Description of Artificial Sequence: Synthetic oligonucleotide
  Target: SCN10A; (-) strand; PAM type: YTN; PAM sequence: CTG
tagagtagaactagccagta

SEQ ID NO: 49351 - DNA, 20 bp, Artificial Sequence
  Description of Artificial Sequence: Synthetic oligonucleotide
  Target: SCN10A; (-) strand; PAM type: YTN; PAM sequence: TTC
acatgcacagaaactgtaga

SEQ ID NO: 49352 - DNA, 20 bp, Artificial Sequence
  Description of Artificial Sequence: Synthetic oligonucleotide
  Target: SCN10A; (-) strand; PAM type: YTN; PAM sequence: TTA
gagagagattcacatgcaca

SEQ ID NO: 49353 - DNA, 20 bp, Artificial Sequence
  Description of Artificial Sequence: Synthetic oligonucleotide
  Target: SCN10A; (-) strand; PAM type: YTN; PAM sequence: CTT
agagagagattcacatgcac

SEQ ID NO: 49354 - DNA, 20 bp, Artificial Sequence
  Description of Artificial Sequence: Synthetic oligonucleotide
  Target: SCN10A; (-) strand; PAM type: YTN; PAM sequence: CTA
ggtaaagccagaggtggcaa

SEQ ID NO: 49355 - DNA, 20 bp, Artificial Sequence
  Description of Artificial Sequence: Synthetic oligonucleotide
  Target: SCN10A; (-) strand; PAM type: YTN; PAM sequence: TTC
taggtaaagccagaggtggc

SEQ ID NO: 49356 - DNA, 20 bp, Artificial Sequence
  Description of Artificial Sequence: Synthetic oligonucleotide
  Target: SCN10A; (-) strand; PAM type: YTN; PAM sequence: TTT
ctaggtaaagccagaggtgg

SEQ ID NO: 49357 - DNA, 20 bp, Artificial Sequence
  Description of Artificial Sequence: Synthetic oligonucleotide
  Target: SCN10A; (-) strand; PAM type: YTN; PAM sequence: CTT
tctaggtaaagccagaggtg

SEQ ID NO: 49358 - DNA, 20 bp, Artificial Sequence
  Description of Artificial Sequence: Synthetic oligonucleotide
  Target: SCN10A; (-) strand; PAM type: YTN; PAM sequence: CTA
ctttctaggtaaagccagag

SEQ ID NO: 49359 - DNA, 20 bp, Artificial Sequence
  Description of Artificial Sequence: Synthetic oligonucleotide
  Target: SCN10A; (-) strand; PAM type: YTN; PAM sequence: TTC
aaaacagagccaatgtgtgc

SEQ ID NO: 49360 - DNA, 20 bp, Artificial Sequence
  Description of Artificial Sequence: Synthetic oligonucleotide
  Target: SCN10A; (-) strand; PAM type: YTN; PAM sequence: TTT
caaaacagagccaatgtgtg

SEQ ID NO: 49361 - DNA, 20 bp, Artificial Sequence
  Description of Artificial Sequence: Synthetic oligonucleotide
  Target: SCN10A; (-) strand; PAM type: YTN; PAM sequence: TTG
agggatttcaaaacagagcc

SEQ ID NO: 49362 - DNA, 20 bp, Artificial Sequence
  Description of Artificial Sequence: Synthetic oligonucleotide
  Target: SCN10A; (-) strand; PAM type: YTN; PAM sequence: TTT
gagggatttcaaaacagagc

SEQ ID NO: 49363 - DNA, 20 bp, Artificial Sequence
  Description of Artificial Sequence: Synthetic oligonucleotide
  Target: SCN10A; (-) strand; PAM type: YTN; PAM sequence: TTG
aggggaagaagtggtgagca

SEQ ID NO: 49364 - DNA, 20 bp, Artificial Sequence
  Description of Artificial Sequence: Synthetic oligonucleotide
  Target: SCN10A; (-) strand; PAM type: YTN; PAM sequence: TTT
gaggggaagaagtggtgagc

SEQ ID NO: 49365 - DNA, 20 bp, Artificial Sequence
  Description of Artificial Sequence: Synthetic oligonucleotide
  Target: SCN10A; (-) strand; PAM type: YTN; PAM sequence: CTA
atttgaggggaagaagtggt

SEQ ID NO: 49366 - DNA, 20 bp, Artificial Sequence
  Description of Artificial Sequence: Synthetic oligonucleotide
  Target: SCN10A; (-) strand; PAM type: YTN; PAM sequence: CTG
aatcctaatttgaggggaag

SEQ ID NO: 49367 - DNA, 20 bp, Artificial Sequence
  Description of Artificial Sequence: Synthetic oligonucleotide
  Target: SCN10A; (-) strand; PAM type: YTN; PAM sequence: CTA
ggctgaatcctaatttgagg

SEQ ID NO: 49368 - DNA, 20 bp, Artificial Sequence
  Description of Artificial Sequence: Synthetic oligonucleotide
  Target: SCN10A; (-) strand; PAM type: YTN; PAM sequence: CTC
ccagccctaggctgaatcct

SEQ ID NO: 49369 - DNA, 20 bp, Artificial Sequence
  Description of Artificial Sequence: Synthetic oligonucleotide
  Target: SCN10A; (-) strand; PAM type: YTN; PAM sequence: TTC
ctcccagccctaggctgaat

SEQ ID NO: 49370 - DNA, 20 bp, Artificial Sequence
  Description of Artificial Sequence: Synthetic oligonucleotide
  Target: SCN10A; (-) strand; PAM type: YTN; PAM sequence: TTT
cctcccagccctaggctgaa

SEQ ID NO: 49371 - DNA, 20 bp, Artificial Sequence
  Description of Artificial Sequence: Synthetic oligonucleotide
  Target: SCN10A; (-) strand; PAM type: YTN; PAM sequence: TTT
tcctcccagccctaggctga

SEQ ID NO: 49372 - DNA, 20 bp, Artificial Sequence
  Description of Artificial Sequence: Synthetic oligonucleotide
  Target: SCN10A; (-) strand; PAM type: YTN; PAM sequence: CTG
tgtgttttcctcccagccct

SEQ ID NO: 49373 - DNA, 20 bp, Artificial Sequence
  Description of Artificial Sequence: Synthetic oligonucleotide
  Target: SCN10A; (-) strand; PAM type: YTN; PAM sequence: CTG
agaaggagtcctgtgtgttt

SEQ ID NO: 49374 - DNA, 20 bp, Artificial Sequence
  Description of Artificial Sequence: Synthetic oligonucleotide
  Target: SCN10A; (-) strand; PAM type: YTN; PAM sequence: CTG
gtgtgcccctgagaaggagt

SEQ ID NO: 49375 - DNA, 20 bp, Artificial Sequence
  Description of Artificial Sequence: Synthetic oligonucleotide
  Target: SCN10A; (-) strand; PAM type: YTN; PAM sequence: TTG
agtgctggtgtgcccctgag

SEQ ID NO: 49376 - DNA, 20 bp, Artificial Sequence
  Description of Artificial Sequence: Synthetic oligonucleotide
  Target: SCN10A; (-) strand; PAM type: YTN; PAM sequence: CTT
gagtgctggtgtgcccctga

SEQ ID NO: 49377 - DNA, 20 bp, Artificial Sequence
  Description of Artificial Sequence: Synthetic oligonucleotide
  Target: SCN10A; (-) strand; PAM type: YTN; PAM sequence: TTG
taagggagcttgagtgctgg

SEQ ID NO: 49378 - DNA, 20 bp, Artificial Sequence
  Description of Artificial Sequence: Synthetic oligonucleotide
  Target: SCN10A; (-) strand; PAM type: YTN; PAM sequence: CTG
gaggagttgtaagggagctt

SEQ ID NO: 49379 - DNA, 20 bp, Artificial Sequence
  Description of Artificial Sequence: Synthetic oligonucleotide
  Target: SCN10A; (-) strand; PAM type: YTN; PAM sequence: CTA
ggctggaggagttgtaaggg

SEQ ID NO: 49380 - DNA, 20 bp, Artificial Sequence
  Description of Artificial Sequence: Synthetic oligonucleotide
  Target: SCN10A; (-) strand; PAM type: YTN; PAM sequence: CTG
acctaggctggaggagttgt

SEQ ID NO: 49381 - DNA, 20 bp, Artificial Sequence
  Description of Artificial Sequence: Synthetic oligonucleotide
  Target: SCN10A; (-) strand; PAM type: YTN; PAM sequence: TTA
aactgacctaggctggagga

SEQ ID NO: 49382 - DNA, 20 bp, Artificial Sequence
  Description of Artificial Sequence: Synthetic oligonucleotide
  Target: SCN10A; (-) strand; PAM type: YTN; PAM sequence: CTA
gacaaattaaactgacctag

SEQ ID NO: 49383 - DNA, 20 bp, Artificial Sequence
  Description of Artificial Sequence: Synthetic oligonucleotide
  Target: SCN10A; (-) strand; PAM type: YTN; PAM sequence: CTC
ccctagacaaattaaactga

SEQ ID NO: 49384 - DNA, 20 bp, Artificial Sequence
  Description of Artificial Sequence: Synthetic oligonucleotide
  Target: SCN10A; (-) strand; PAM type: YTN; PAM sequence: TTA
ctcccctagacaaattaaac

SEQ ID NO: 49385 - DNA, 20 bp, Artificial Sequence
  Description of Artificial Sequence: Synthetic oligonucleotide
  Target: SCN10A; (-) strand; PAM type: YTN; PAM sequence: CTT
actcccctagacaaattaaa

SEQ ID NO: 49386 - DNA, 20 bp, Artificial Sequence
  Description of Artificial Sequence: Synthetic oligonucleotide
  Target: SCN10A; (-) strand; PAM type: YTN; PAM sequence: TTA
tcttactcccctagacaaat

SEQ ID NO: 49387 - DNA, 20 bp, Artificial Sequence
  Description of Artificial Sequence: Synthetic oligonucleotide
  Target: SCN10A; (-) strand; PAM type: YTN; PAM sequence: TTC
cagttatcttactcccctag

SEQ ID NO: 49388 - DNA, 20 bp, Artificial Sequence
  Description of Artificial Sequence: Synthetic oligonucleotide
  Target: SCN10A; (-) strand; PAM type: YTN; PAM sequence: TTT
ccagttatcttactccccta

SEQ ID NO: 49389 - DNA, 20 bp, Artificial Sequence
  Description of Artificial Sequence: Synthetic oligonucleotide
  Target: SCN10A; (-) strand; PAM type: YTN; PAM sequence: TTC
atcatttccagttatcttac

SEQ ID NO: 49390 - DNA, 20 bp, Artificial Sequence
  Description of Artificial Sequence: Synthetic oligonucleotide
  Target: SCN10A; (-) strand; PAM type: YTN; PAM sequence: CTT
catcatttccagttatctta

SEQ ID NO: 49391 - DNA, 20 bp, Artificial Sequence
  Description of Artificial Sequence: Synthetic oligonucleotide
  Target: SCN10A; (-) strand; PAM type: YTN; PAM sequence: TTA
gggtatggagaatgcaacct

SEQ ID NO: 49392 - DNA, 20 bp, Artificial Sequence
  Description of Artificial Sequence: Synthetic oligonucleotide
  Target: SCN10A; (-) strand; PAM type: YTN; PAM sequence: CTT
agggtatggagaatgcaacc

SEQ ID NO: 49393 - DNA, 20 bp, Artificial Sequence
  Description of Artificial Sequence: Synthetic oligonucleotide
  Target: SCN10A; (-) strand; PAM type: YTN; PAM sequence: TTG
ccttagggtatggagaatgc

SEQ ID NO: 49394 - DNA, 20 bp, Artificial Sequence
  Description of Artificial Sequence: Synthetic oligonucleotide
  Target: SCN10A; (-) strand; PAM type: YTN; PAM sequence: TTT
gccttagggtatggagaatg

SEQ ID NO: 49395 - DNA, 20 bp, Artificial Sequence
  Description of Artificial Sequence: Synthetic oligonucleotide
  Target: SCN10A; (-) strand; PAM type: YTN; PAM sequence: TTT
tgccttagggtatggagaat

SEQ ID NO: 49396 - DNA, 20 bp, Artificial Sequence
  Description of Artificial Sequence: Synthetic oligonucleotide
  Target: SCN10A; (-) strand; PAM type: YTN; PAM sequence: TTT
ttgccttagggtatggagaa

SEQ ID NO: 49397 - DNA, 20 bp, Artificial Sequence
  Description of Artificial Sequence: Synthetic oligonucleotide
  Target: SCN10A; (-) strand; PAM type: YTN; PAM sequence: TTT
tttgccttagggtatggaga

SEQ ID NO: 49398 - DNA, 20 bp, Artificial Sequence
  Description of Artificial Sequence: Synthetic oligonucleotide
  Target: SCN10A; (-) strand; PAM type: YTN; PAM sequence: TTT
ttttgccttagggtatggag

SEQ ID NO: 49399 - DNA, 20 bp, Artificial Sequence
  Description of Artificial Sequence: Synthetic oligonucleotide
  Target: SCN10A; (-) strand; PAM type: YTN; PAM sequence: CTT
tttttgccttagggtatgga

SEQ ID NO: 49400 - DNA, 20 bp, Artificial Sequence
  Description of Artificial Sequence: Synthetic oligonucleotide
  Target: SCN10A; (-) strand; PAM type: YTN; PAM sequence: CTA
atccagcctttttttgcctt

SEQ ID NO: 49401 - DNA, 20 bp, Artificial Sequence
  Description of Artificial Sequence: Synthetic oligonucleotide
  Target: SCN10A; (-) strand; PAM type: YTN; PAM sequence: TTC
taatccagcctttttttgcc

SEQ ID NO: 49402 - DNA, 20 bp, Artificial Sequence
  Description of Artificial Sequence: Synthetic oligonucleotide
  Target: SCN10A; (-) strand; PAM type: YTN; PAM sequence: CTG
ttctaatccagccttttttt

SEQ ID NO: 49403 - DNA, 20 bp, Artificial Sequence
  Description of Artificial Sequence: Synthetic oligonucleotide
  Target: SCN10A; (-) strand; PAM type: YTN; PAM sequence: TTG
agcaggaggtctgttctaat

SEQ ID NO: 49404 - DNA, 20 bp, Artificial Sequence
  Description of Artificial Sequence: Synthetic oligonucleotide
  Target: SCN10A; (-) strand; PAM type: YTN; PAM sequence: CTT
gagcaggaggtctgttctaa

SEQ ID NO: 49405 - DNA, 20 bp, Artificial Sequence
  Description of Artificial Sequence: Synthetic oligonucleotide
  Target: SCN10A; (-) strand; PAM type: YTN; PAM sequence: CTA
accttgagcaggaggtctgt

SEQ ID NO: 49406 - DNA, 20 bp, Artificial Sequence
  Description of Artificial Sequence: Synthetic oligonucleotide
  Target: SCN10A; (-) strand; PAM type: YTN; PAM sequence: CTC
taaccttgagcaggaggtct

SEQ ID NO: 49407 - DNA, 20 bp, Artificial Sequence
  Description of Artificial Sequence: Synthetic oligonucleotide
  Target: SCN10A; (-) strand; PAM type: YTN; PAM sequence: TTG
catccctctaaccttgagca

SEQ ID NO: 49408 - DNA, 20 bp, Artificial Sequence
  Description of Artificial Sequence: Synthetic oligonucleotide
  Target: SCN10A; (-) strand; PAM type: YTN; PAM sequence: TTG
ccatagagcgtgattgcatc

SEQ ID NO: 49409 - DNA, 20 bp, Artificial Sequence
  Description of Artificial Sequence: Synthetic oligonucleotide
  Target: SCN10A; (-) strand; PAM type: YTN; PAM sequence: TTT
gccatagagcgtgattgcat

SEQ ID NO: 49410 - DNA, 20 bp, Artificial Sequence
  Description of Artificial Sequence: Synthetic oligonucleotide
  Target: SCN10A; (-) strand; PAM type: YTN; PAM sequence: CTT
tgccatagagcgtgattgca

SEQ ID NO: 49411 - DNA, 20 bp, Artificial Sequence
  Description of Artificial Sequence: Synthetic oligonucleotide
  Target: SCN10A; (-) strand; PAM type: YTN; PAM sequence: CTA
tccacacactttgccataga

SEQ ID NO: 49412 - DNA, 20 bp, Artificial Sequence
  Description of Artificial Sequence: Synthetic oligonucleotide
  Target: SCN10A; (-) strand; PAM type: YTN; PAM sequence: TTC
caagccaaagggtagaggaa

SEQ ID NO: 49413 - DNA, 20 bp, Artificial Sequence
  Description of Artificial Sequence: Synthetic oligonucleotide
  Target: SCN10A; (-) strand; PAM type: YTN; PAM sequence: CTA
agttccaagccaaagggtag

SEQ ID NO: 49414 - DNA, 20 bp, Artificial Sequence
  Description of Artificial Sequence: Synthetic oligonucleotide
  Target: SCN10A; (-) strand; PAM type: YTN; PAM sequence: CTC
cccagcaatgtatctaagtt

SEQ ID NO: 49415 - DNA, 20 bp, Artificial Sequence
  Description of Artificial Sequence: Synthetic oligonucleotide
  Target: SCN10A; (-) strand; PAM type: YTN; PAM sequence: CTC
agtctccccagcaatgtatc

SEQ ID NO: 49416 - DNA, 20 bp, Artificial Sequence
  Description of Artificial Sequence: Synthetic oligonucleotide
  Target: SCN10A; (-) strand; PAM type: YTN; PAM sequence: CTA
ccaatcaagtgggaatccac

SEQ ID NO: 49417 - DNA, 20 bp, Artificial Sequence
  Description of Artificial Sequence: Synthetic oligonucleotide
  Target: SCN10A; (-) strand; PAM type: YTN; PAM sequence: TTC
taccaatcaagtgggaatcc

SEQ ID NO: 49418 - DNA, 20 bp, Artificial Sequence
  Description of Artificial Sequence: Synthetic oligonucleotide
  Target: SCN10A; (-) strand; PAM type: YTN; PAM sequence: TTA
gaattctaccaatcaagtgg

SEQ ID NO: 49419 - DNA, 20 bp, Artificial Sequence
  Description of Artificial Sequence: Synthetic oligonucleotide
  Target: SCN10A; (-) strand; PAM type: YTN; PAM sequence: TTT
agaattctaccaatcaagtg

SEQ ID NO: 49420 - DNA, 20 bp, Artificial Sequence
  Description of Artificial Sequence: Synthetic oligonucleotide
  Target: SCN10A; (-) strand; PAM type: YTN; PAM sequence: TTA
atttagaattctaccaatca

SEQ ID NO: 49421 - DNA, 20 bp, Artificial Sequence
  Description of Artificial Sequence: Synthetic oligonucleotide
  Target: SCN10A; (-) strand; PAM type: YTN; PAM sequence: TTG
ttaatttagaattctaccaa

SEQ ID NO: 49422 - DNA, 20 bp, Artificial Sequence
  Description of Artificial Sequence: Synthetic oligonucleotide
  Target: SCN10A; (-) strand; PAM type: YTN; PAM sequence: CTT
gttaatttagaattctacca

SEQ ID NO: 49423 - DNA, 20 bp, Artificial Sequence
  Description of Artificial Sequence: Synthetic oligonucleotide
  Target: SCN10A; (-) strand; PAM type: YTN; PAM sequence: CTA
agtccttgttaatttagaat

SEQ ID NO: 49424 - DNA, 20 bp, Artificial Sequence
  Description of Artificial Sequence: Synthetic oligonucleotide
  Target: SCN10A; (-) strand; PAM type: YTN; PAM sequence: TTA
actaagtccttgttaattta

SEQ ID NO: 49425 - DNA, 20 bp, Artificial Sequence
  Description of Artificial Sequence: Synthetic oligonucleotide
  Target: SCN10A; (-) strand; PAM type: YTN; PAM sequence: TTT
aactaagtccttgttaattt

SEQ ID NO: 49426 - DNA, 20 bp, Artificial Sequence
  Description of Artificial Sequence: Synthetic oligonucleotide
  Target: SCN10A; (-) strand; PAM type: YTN; PAM sequence: TTA
atcagtcaatttaactaagt

SEQ ID NO: 49427 - DNA, 20 bp, Artificial Sequence
  Description of Artificial Sequence: Synthetic oligonucleotide
  Target: SCN10A; (-) strand; PAM type: YTN; PAM sequence: TTA
agtccattaatcagtcaatt

SEQ ID NO: 49428 - DNA, 20 bp, Artificial Sequence
  Description of Artificial Sequence: Synthetic oligonucleotide
  Target: SCN10A; (-) strand; PAM type: YTN; PAM sequence: TTT
aagtccattaatcagtcaat

SEQ ID NO: 49429 - DNA, 20 bp, Artificial Sequence
  Description of Artificial Sequence: Synthetic oligonucleotide
  Target: SCN10A; (-) strand; PAM type: YTN; PAM sequence: TTG
gtagacaatttaagtccatt

SEQ ID NO: 49430 - DNA, 20 bp, Artificial Sequence
  Description of Artificial Sequence: Synthetic oligonucleotide
  Target: SCN10A; (-) strand; PAM type: YTN; PAM sequence: CTG
aatattggtagacaatttaa

SEQ ID NO: 49431 - DNA, 20 bp, Artificial Sequence
  Description of Artificial Sequence: Synthetic oligonucleotide
  Target: SCN10A; (-) strand; PAM type: YTN; PAM sequence: TTA
tgctgaatattggtagacaa

SEQ ID NO: 49432 - DNA, 20 bp, Artificial Sequence
  Description of Artificial Sequence: Synthetic oligonucleotide
  Target: SCN10A; (-) strand; PAM type: YTN; PAM sequence: TTC
aagcccacattatgctgaat

SEQ ID NO: 49433 - DNA, 20 bp, Artificial Sequence
  Description of Artificial Sequence: Synthetic oligonucleotide
  Target: SCN10A; (-) strand; PAM type: YTN; PAM sequence: TTG
ttcaagcccacattatgctg

SEQ ID NO: 49434 - DNA, 20 bp, Artificial Sequence
  Description of Artificial Sequence: Synthetic oligonucleotide
  Target: SCN10A; (-) strand; PAM type: YTN; PAM sequence: CTT
gttcaagcccacattatgct

SEQ ID NO: 49435 - DNA, 20 bp, Artificial Sequence
  Description of Artificial Sequence: Synthetic oligonucleotide
  Target: SCN10A; (-) strand; PAM type: YTN; PAM sequence: TTC
ttgttcaagcccacattatg

SEQ ID NO: 49436 - DNA, 20 bp, Artificial Sequence
  Description of Artificial Sequence: Synthetic oligonucleotide
  Target: SCN10A; (-) strand; PAM type: YTN; PAM sequence: TTT
cttgttcaagcccacattat

SEQ ID NO: 49437 - DNA, 20 bp, Artificial Sequence
  Description of Artificial Sequence: Synthetic oligonucleotide
  Target: SCN10A; (-) strand; PAM type: YTN; PAM sequence: TTA
atttcttgttcaagcccaca

SEQ ID NO: 49438 - DNA, 20 bp, Artificial Sequence
  Description of Artificial Sequence: Synthetic oligonucleotide
  Target: SCN10A; (-) strand; PAM type: YTN; PAM sequence: TTT
aatttcttgttcaagcccac

SEQ ID NO: 49439 - DNA, 20 bp, Artificial Sequence
  Description of Artificial Sequence: Synthetic oligonucleotide
  Target: SCN10A; (-) strand; PAM type: YTN; PAM sequence: TTG
taatttaatttcttgttcaa

SEQ ID NO: 49440 - DNA, 20 bp, Artificial Sequence
  Description of Artificial Sequence: Synthetic oligonucleotide
  Target: SCN10A; (-) strand; PAM type: YTN; PAM sequence: TTA
cacagttgtaatttaatttc

SEQ ID NO: 49441 - DNA, 20 bp, Artificial Sequence
  Description of Artificial Sequence: Synthetic oligonucleotide
  Target: SCN10A; (-) strand; PAM type: YTN; PAM sequence: CTT
acacagttgtaatttaattt

SEQ ID NO: 49442 - DNA, 20 bp, Artificial Sequence
  Description of Artificial Sequence: Synthetic oligonucleotide
  Target: SCN10A; (-) strand; PAM type: YTN; PAM sequence: TTG
taacttacacagttgtaatt

SEQ ID NO: 49443 - DNA, 20 bp, Artificial Sequence
  Description of Artificial Sequence: Synthetic oligonucleotide
  Target: SCN10A; (-) strand; PAM type: YTN; PAM sequence: TTC
atggttgtaacttacacagt

SEQ ID NO: 49444 - DNA, 20 bp, Artificial Sequence
  Description of Artificial Sequence: Synthetic oligonucleotide
  Target: SCN10A; (-) strand; PAM type: YTN; PAM sequence: TTT
catggttgtaacttacacag

SEQ ID NO: 49445 - DNA, 20 bp, Artificial Sequence
  Description of Artificial Sequence: Synthetic oligonucleotide
  Target: SCN10A; (-) strand; PAM type: YTN; PAM sequence: TTT
tcatggttgtaacttacaca

SEQ ID NO: 49446 - DNA, 20 bp, Artificial Sequence
  Description of Artificial Sequence: Synthetic oligonucleotide
  Target: SCN10A; (-) strand; PAM type: YTN; PAM sequence: TTT
ttcatggttgtaacttacac

SEQ ID NO: 49447 - DNA, 20 bp, Artificial Sequence
  Description of Artificial Sequence: Synthetic oligonucleotide
  Target: SCN10A; (-) strand; PAM type: YTN; PAM sequence: TTA
tatttttcatggttgtaact

SEQ ID NO: 49448 - DNA, 20 bp, Artificial Sequence
  Description of Artificial Sequence: Synthetic oligonucleotide
  Target: SCN10A; (-) strand; PAM type: YTN; PAM sequence: TTC
ataattatatttttcatggt

SEQ ID NO: 49449 - DNA, 20 bp, Artificial Sequence
  Description of Artificial Sequence: Synthetic oligonucleotide
  Target: SCN10A; (-) strand; PAM type: YTN; PAM sequence: TTT
cataattatatttttcatgg

SEQ ID NO: 49450 - DNA, 20 bp, Artificial Sequence
  Description of Artificial Sequence: Synthetic oligonucleotide
  Target: SCN10A; (-) strand; PAM type: YTN; PAM sequence: TTC
atggtttcataattatattt

SEQ ID NO: 49451 - DNA, 20 bp, Artificial Sequence
  Description of Artificial Sequence: Synthetic oligonucleotide
  Target: SCN10A; (-) strand; PAM type: YTN; PAM sequence: TTT
catggtttcataattatatt

SEQ ID NO: 49452 - DNA, 20 bp, Artificial Sequence
  Description of Artificial Sequence: Synthetic oligonucleotide
  Target: SCN10A; (-) strand; PAM type: YTN; PAM sequence: TTT
tcatggtttcataattatat

SEQ ID NO: 49453 - DNA, 20 bp, Artificial Sequence
  Description of Artificial Sequence: Synthetic oligonucleotide
  Target: SCN10A; (-) strand; PAM type: YTN; PAM sequence: CTT
ttcatggtttcataattata

SEQ ID NO: 49454 - DNA, 20 bp, Artificial Sequence
  Description of Artificial Sequence: Synthetic oligonucleotide
  Target: SCN10A; (-) strand; PAM type: YTN; PAM sequence: TTA
tccttttcatggtttcataa

SEQ ID NO: 49455 - DNA, 20 bp, Artificial Sequence
  Description of Artificial Sequence: Synthetic oligonucleotide
  Target: SCN10A; (-) strand; PAM type: YTN; PAM sequence: TTC
caacatggcaaaattatcct

SEQ ID NO: 49456 - DNA, 20 bp, Artificial Sequence
  Description of Artificial Sequence: Synthetic oligonucleotide
  Target: SCN10A; (-) strand; PAM type: YTN; PAM sequence: TTT
ccaacatggcaaaattatcc

SEQ ID NO: 49457 - DNA, 20 bp, Artificial Sequence
  Description of Artificial Sequence: Synthetic oligonucleotide
  Target: SCN10A; (-) strand; PAM type: YTN; PAM sequence: TTT
tccaacatggcaaaattatc

SEQ ID NO: 49458 - DNA, 20 bp, Artificial Sequence
  Description of Artificial Sequence: Synthetic oligonucleotide
  Target: SCN10A; (-) strand; PAM type: YTN; PAM sequence: TTA
attttccaacatggcaaaat

SEQ ID NO: 49459 - DNA, 20 bp, Artificial Sequence
  Description of Artificial Sequence: Synthetic oligonucleotide
  Target: SCN10A; (-) strand; PAM type: YTN; PAM sequence: CTT
aattttccaacatggcaaaa

SEQ ID NO: 49460 - DNA, 20 bp, Artificial Sequence
  Description of Artificial Sequence: Synthetic oligonucleotide
  Target: SCN10A; (-) strand; PAM type: YTN; PAM sequence: TTA
accatccttaattttccaac

SEQ ID NO: 49461 - DNA, 20 bp, Artificial Sequence
  Description of Artificial Sequence: Synthetic oligonucleotide
  Target: SCN10A; (-) strand; PAM type: YTN; PAM sequence: TTT
aaccatccttaattttccaa

SEQ ID NO: 49462 - DNA, 20 bp, Artificial Sequence
  Description of Artificial Sequence: Synthetic oligonucleotide
  Target: SCN10A; (-) strand; PAM type: YTN; PAM sequence: CTC
cggtgtacaagaaatttaac

SEQ ID NO: 49463 - DNA, 20 bp, Artificial Sequence
  Description of Artificial Sequence: Synthetic oligonucleotide
  Target: SCN10A; (-) strand; PAM type: YTN; PAM sequence: CTC
tccggtgtacaagaaattta

SEQ ID NO: 49464 - DNA, 20 bp, Artificial Sequence
  Description of Artificial Sequence: Synthetic oligonucleotide
  Target: SCN10A; (-) strand; PAM type: YTN; PAM sequence: TTC
aggccagctctccggtgtac

SEQ ID NO: 49465 - DNA, 20 bp, Artificial Sequence
  Description of Artificial Sequence: Synthetic oligonucleotide
  Target: SCN10A; (-) strand; PAM type: YTN; PAM sequence: TTT
caggccagctctccggtgta

SEQ ID NO: 49466 - DNA, 20 bp, Artificial Sequence
  Description of Artificial Sequence: Synthetic oligonucleotide
  Target: SCN10A; (-) strand; PAM type: YTN; PAM sequence: CTG
gcaggcatcagagaatttca

SEQ ID NO: 49467 - DNA, 20 bp, Artificial Sequence
  Description of Artificial Sequence: Synthetic oligonucleotide
  Target: SCN10A; (-) strand; PAM type: YTN; PAM sequence: TTA
aaagtgatctggcaggcatc

SEQ ID NO: 49468 - DNA, 20 bp, Artificial Sequence
  Description of Artificial Sequence: Synthetic oligonucleotide
  Target: SCN10A; (-) strand; PAM type: YTN; PAM sequence: TTT
aaaagtgatctggcaggcat

SEQ ID NO: 49469 - DNA, 20 bp, Artificial Sequence
  Description of Artificial Sequence: Synthetic oligonucleotide
  Target: SCN10A; (-) strand; PAM type: YTN; PAM sequence: TTT
taaaagtgatctggcaggca

SEQ ID NO: 49470 - DNA, 20 bp, Artificial Sequence
  Description of Artificial Sequence: Synthetic oligonucleotide
  Target: SCN10A; (-) strand; PAM type: YTN; PAM sequence: TTT
ttaaaagtgatctggcaggc

SEQ ID NO: 49471 - DNA, 20 bp, Artificial Sequence
  Description of Artificial Sequence: Synthetic oligonucleotide
  Target: SCN10A; (-) strand; PAM type: YTN; PAM sequence: CTA
gatttttaaaagtgatctgg

SEQ ID NO: 49472 - DNA, 20 bp, Artificial Sequence
  Description of Artificial Sequence: Synthetic oligonucleotide
  Target: SCN10A; (-) strand; PAM type: YTN; PAM sequence: TTG
catgcatcacaaaactagat

SEQ ID NO: 49473 - DNA, 20 bp, Artificial Sequence
  Description of Artificial Sequence: Synthetic oligonucleotide
  Target: SCN10A; (-) strand; PAM type: YTN; PAM sequence: TTT
gcatgcatcacaaaactaga

SEQ ID NO: 49474 - DNA, 20 bp, Artificial Sequence
  Description of Artificial Sequence: Synthetic oligonucleotide
  Target: SCN10A; (-) strand; PAM type: YTN; PAM sequence: CTT
tgcatgcatcacaaaactag

SEQ ID NO: 49475 - DNA, 20 bp, Artificial Sequence
  Description of Artificial Sequence: Synthetic oligonucleotide
  Target: SCN10A; (-) strand; PAM type: YTN; PAM sequence: CTG
ctttgcatgcatcacaaaac

SEQ ID NO: 49476 - DNA, 20 bp, Artificial Sequence
  Description of Artificial Sequence: Synthetic oligonucleotide
  Target: SCN10A; (-) strand; PAM type: YTN; PAM sequence: TTA
gcatctgctttgcatgcatc

SEQ ID NO: 49477 - DNA, 20 bp, Artificial Sequence
  Description of Artificial Sequence: Synthetic oligonucleotide
  Target: SCN10A; (-) strand; PAM type: YTN; PAM sequence: TTC
aaattagcatctgctttgca

SEQ ID NO: 49478 - DNA, 20 bp, Artificial Sequence
  Description of Artificial Sequence: Synthetic oligonucleotide
  Target: SCN10A; (-) strand; PAM type: YTN; PAM sequence: TTG
ttcaaattagcatctgcttt

SEQ ID NO: 49479 - DNA, 20 bp, Artificial Sequence
  Description of Artificial Sequence: Synthetic oligonucleotide
  Target: SCN10A; (-) strand; PAM type: YTN; PAM sequence: CTT
gttcaaattagcatctgctt

SEQ ID NO: 49480 - DNA, 20 bp, Artificial Sequence
  Description of Artificial Sequence: Synthetic oligonucleotide
  Target: SCN10A; (-) strand; PAM type: YTN; PAM sequence: CTC
ttgttcaaattagcatctgc

SEQ ID NO: 49481 - DNA, 20 bp, Artificial Sequence
  Description of Artificial Sequence: Synthetic oligonucleotide
  Target: SCN10A; (-) strand; PAM type: YTN; PAM sequence: CTC
atctcttgttcaaattagca

SEQ ID NO: 49482 - DNA, 20 bp, Artificial Sequence
  Description of Artificial Sequence: Synthetic oligonucleotide
  Target: SCN10A; (-) strand; PAM type: YTN; PAM sequence: CTA
gctcatctcttgttcaaatt

SEQ ID NO: 49483 - DNA, 20 bp, Artificial Sequence
  Description of Artificial Sequence: Synthetic oligonucleotide
  Target: SCN10A; (-) strand; PAM type: YTN; PAM sequence: TTG
atgaataaaatatcctagct

SEQ ID NO: 49484 - DNA, 20 bp, Artificial Sequence
  Description of Artificial Sequence: Synthetic oligonucleotide
  Target: SCN10A; (-) strand; PAM type: YTN; PAM sequence: TTT
gatgaataaaatatcctagc

SEQ ID NO: 49485 - DNA, 20 bp, Artificial Sequence
  Description of Artificial Sequence: Synthetic oligonucleotide
  Target: SCN10A; (-) strand; PAM type: YTN; PAM sequence: TTC
aaaaacaaaataatttgatg

SEQ ID NO: 49486 - DNA, 20 bp, Artificial Sequence
  Description of Artificial Sequence: Synthetic oligonucleotide
  Target: SCN10A; (-) strand; PAM type: YTN; PAM sequence: TTT
caaaaacaaaataatttgat

SEQ ID NO: 49487 - DNA, 20 bp, Artificial Sequence
  Description of Artificial Sequence: Synthetic oligonucleotide
  Target: SCN10A; (-) strand; PAM type: YTN; PAM sequence: TTT
tcaaaaacaaaataatttga

SEQ ID NO: 49488 - DNA, 20 bp, Artificial Sequence
  Description of Artificial Sequence: Synthetic oligonucleotide
  Target: SCN10A; (-) strand; PAM type: YTN; PAM sequence: TTT
ttcaaaaacaaaataatttg

SEQ ID NO: 49489 - DNA, 20 bp, Artificial Sequence
  Description of Artificial Sequence: Synthetic oligonucleotide
  Target: SCN10A; (-) strand; PAM type: YTN; PAM sequence: TTA
gatgcataatttttcaaaaa

SEQ ID NO: 49490 - DNA, 20 bp, Artificial Sequence
  Description of Artificial Sequence: Synthetic oligonucleotide
  Target: SCN10A; (-) strand; PAM type: YTN; PAM sequence: TTT
agatgcataatttttcaaaa

SEQ ID NO: 49491 - DNA, 20 bp, Artificial Sequence
  Description of Artificial Sequence: Synthetic oligonucleotide
  Target: SCN10A; (-) strand; PAM type: YTN; PAM sequence: TTT
tagatgcataatttttcaaa

SEQ ID NO: 49492 - DNA, 20 bp, Artificial Sequence
  Description of Artificial Sequence: Synthetic oligonucleotide
  Target: SCN10A; (-) strand; PAM type: YTN; PAM sequence: TTT
ttagatgcataatttttcaa

SEQ ID NO: 49493 - DNA, 20 bp, Artificial Sequence
  Description of Artificial Sequence: Synthetic oligonucleotide
  Target: SCN10A; (-) strand; PAM type: YTN; PAM sequence: TTT
tttagatgcataatttttca

SEQ ID NO: 49494 - DNA, 20 bp, Artificial Sequence
  Description of Artificial Sequence: Synthetic oligonucleotide
  Target: SCN10A; (-) strand; PAM type: YTN; PAM sequence: TTA
tcaatgtggttttttagatg

SEQ ID NO: 49495 - DNA, 20 bp, Artificial Sequence
  Description of Artificial Sequence: Synthetic oligonucleotide
  Target: SCN10A; (-) strand; PAM type: YTN; PAM sequence: TTT
atcaatgtggttttttagat

SEQ ID NO: 49496 - DNA, 20 bp, Artificial Sequence
  Description of Artificial Sequence: Synthetic oligonucleotide
  Target: SCN10A; (-) strand; PAM type: YTN; PAM sequence: TTT
tatcaatgtggttttttaga

SEQ ID NO: 49497 - DNA, 20 bp, Artificial Sequence
  Description of Artificial Sequence: Synthetic oligonucleotide
  Target: SCN10A; (-) strand; PAM type: YTN; PAM sequence: CTT
ttatcaatgtggttttttag

SEQ ID NO: 49498 - DNA, 20 bp, Artificial Sequence
  Description of Artificial Sequence: Synthetic oligonucleotide
  Target: SCN10A; (-) strand; PAM type: YTN; PAM sequence: TTA
ggccccaccatcttttatca

SEQ ID NO: 49499 - DNA, 20 bp, Artificial Sequence
  Description of Artificial Sequence: Synthetic oligonucleotide
  Target: SCN10A; (-) strand; PAM type: YTN; PAM sequence: CTT
aggccccaccatcttttatc

SEQ ID NO: 49500 - DNA, 20 bp, Artificial Sequence
  Description of Artificial Sequence: Synthetic oligonucleotide
  Target: SCN10A; (-) strand; PAM type: YTN; PAM sequence: TTA
tgtcttaggccccaccatct

SEQ ID NO: 49501 - DNA, 20 bp, Artificial Sequence
  Description of Artificial Sequence: Synthetic oligonucleotide
  Target: SCN10A; (-) strand; PAM type: YTN; PAM sequence: CTT
atgtcttaggccccaccatc

SEQ ID NO: 49502 - DNA, 20 bp, Artificial Sequence
  Description of Artificial Sequence: Synthetic oligonucleotide
  Target: SCN10A; (-) strand; PAM type: YTN; PAM sequence: TTC
ttatgtcttaggccccacca

SEQ ID NO: 49503 - DNA, 20 bp, Artificial Sequence
  Description of Artificial Sequence: Synthetic oligonucleotide
  Target: SCN10A; (-) strand; PAM type: YTN; PAM sequence: CTC
attcttatgtcttaggcccc

SEQ ID NO: 49504 - DNA, 20 bp, Artificial Sequence
  Description of Artificial Sequence: Synthetic oligonucleotide
  Target: SCN10A; (-) strand; PAM type: YTN; PAM sequence: CTC
ctcattcttatgtcttaggc

SEQ ID NO: 49505 - DNA, 20 bp, Artificial Sequence
  Description of Artificial Sequence: Synthetic oligonucleotide
  Target: SCN10A; (-) strand; PAM type: YTN; PAM sequence: CTA
atactcctcattcttatgtc

SEQ ID NO: 49506 - DNA, 20 bp, Artificial Sequence
  Description of Artificial Sequence: Synthetic oligonucleotide
  Target: SCN10A; (-) strand; PAM type: YTN; PAM sequence: TTC
ctaatactcctcattcttat

SEQ ID NO: 49507 - DNA, 20 bp, Artificial Sequence
  Description of Artificial Sequence: Synthetic oligonucleotide
  Target: SCN10A; (-) strand; PAM type: YTN; PAM sequence: CTG
gaattcctaatactcctcat

SEQ ID NO: 49508 - DNA, 20 bp, Artificial Sequence
  Description of Artificial Sequence: Synthetic oligonucleotide
  Target: SCN10A; (-) strand; PAM type: YTN; PAM sequence: CTG
tgtactggaattcctaatac

SEQ ID NO: 49509 - DNA, 20 bp, Artificial Sequence
  Description of Artificial Sequence: Synthetic oligonucleotide
  Target: SCN10A; (-) strand; PAM type: YTN; PAM sequence: CTC
tgtgtactggaattcctaat

SEQ ID NO: 49510 - DNA, 20 bp, Artificial Sequence
  Description of Artificial Sequence: Synthetic oligonucleotide
  Target: SCN10A; (-) strand; PAM type: YTN; PAM sequence: CTC
gtgtcaaagcgtccatctct

SEQ ID NO: 49511 - DNA, 20 bp, Artificial Sequence
  Description of Artificial Sequence: Synthetic oligonucleotide
  Target: SCN10A; (-) strand; PAM type: YTN; PAM sequence: CTA
actcgtgtcaaagcgtccat

SEQ ID NO: 49512 - DNA, 20 bp, Artificial Sequence
  Description of Artificial Sequence: Synthetic oligonucleotide
  Target: SCN10A; (-) strand; PAM type: YTN; PAM sequence: CTC
taactcgtgtcaaagcgtcc

SEQ ID NO: 49513 - DNA, 20 bp, Artificial Sequence
  Description of Artificial Sequence: Synthetic oligonucleotide
  Target: SCN10A; (-) strand; PAM type: YTN; PAM sequence: TTC
ccatgtgagcagcagaagca

SEQ ID NO: 49514 - DNA, 20 bp, Artificial Sequence
  Description of Artificial Sequence: Synthetic oligonucleotide
  Target: SCN10A; (-) strand; PAM type: YTN; PAM sequence: CTG
tgtcatgatgaattcccatg

SEQ ID NO: 49515 - DNA, 20 bp, Artificial Sequence
  Description of Artificial Sequence: Synthetic oligonucleotide
  Target: SCN10A; (-) strand; PAM type: YTN; PAM sequence: TTC
atccactgtgtcatgatgaa

SEQ ID NO: 49516 - DNA, 20 bp, Artificial Sequence
  Description of Artificial Sequence: Synthetic oligonucleotide
  Target: SCN10A; (-) strand; PAM type: YTN; PAM sequence: TTG
ttcatccactgtgtcatgat

SEQ ID NO: 49517 - DNA, 20 bp, Artificial Sequence
  Description of Artificial Sequence: Synthetic oligonucleotide
  Target: SCN10A; (-) strand; PAM type: YTN; PAM sequence: CTG
cattgttcatccactgtgtc

SEQ ID NO: 49518 - DNA, 20 bp, Artificial Sequence
  Description of Artificial Sequence: Synthetic oligonucleotide
  Target: SCN10A; (-) strand; PAM type: YTN; PAM sequence: CTC
actgcattgttcatccactg

SEQ ID NO: 49519 - DNA, 20 bp, Artificial Sequence
  Description of Artificial Sequence: Synthetic oligonucleotide
  Target: SCN10A; (-) strand; PAM type: YTN; PAM sequence: CTG
ctcactgcattgttcatcca

SEQ ID NO: 49520 - DNA, 20 bp, Artificial Sequence
  Description of Artificial Sequence: Synthetic oligonucleotide
  Target: SCN10A; (-) strand; PAM type: YTN; PAM sequence: TTG
agggtaagtgctgctcactg

SEQ ID NO: 49521 - DNA, 20 bp, Artificial Sequence
  Description of Artificial Sequence: Synthetic oligonucleotide
  Target: SCN10A; (-) strand; PAM type: YTN; PAM sequence: CTT
gagggtaagtgctgctcact

SEQ ID NO: 49522 - DNA, 20 bp, Artificial Sequence
  Description of Artificial Sequence: Synthetic oligonucleotide
  Target: SCN10A; (-) strand; PAM type: YTN; PAM sequence: CTC
cgtccttgagggtaagtgct

SEQ ID NO: 49523 - DNA, 20 bp, Artificial Sequence
  Description of Artificial Sequence: Synthetic oligonucleotide
  Target: SCN10A; (-) strand; PAM type: YTN; PAM sequence: TTG
tcagtatcataacctccgtc

SEQ ID NO: 49524 - DNA, 20 bp, Artificial Sequence
  Description of Artificial Sequence: Synthetic oligonucleotide
  Target: SCN10A; (-) strand; PAM type: YTN; PAM sequence: TTC
cgggcccaaagggcaatgag

SEQ ID NO: 49525 - DNA, 20 bp, Artificial Sequence
  Description of Artificial Sequence: Synthetic oligonucleotide
  Target: SCN10A; (-) strand; PAM type: YTN; PAM sequence: TTT
ccgggcccaaagggcaatga

SEQ ID NO: 49526 - DNA, 20 bp, Artificial Sequence
  Description of Artificial Sequence: Synthetic oligonucleotide
  Target: SCN10A; (-) strand; PAM type: YTN; PAM sequence: CTT
tccgggcccaaagggcaatg

SEQ ID NO: 49527 - DNA, 20 bp, Artificial Sequence
  Description of Artificial Sequence: Synthetic oligonucleotide
  Target: SCN10A; (-) strand; PAM type: YTN; PAM sequence: TTA
gatgaacctttccgggccca

SEQ ID NO: 49528 - DNA, 20 bp, Artificial Sequence
  Description of Artificial Sequence: Synthetic oligonucleotide
  Target: SCN10A; (-) strand; PAM type: YTN; PAM sequence: CTT
agatgaacctttccgggccc

SEQ ID NO: 49529 - DNA, 20 bp, Artificial Sequence
  Description of Artificial Sequence: Synthetic oligonucleotide
  Target: SCN10A; (-) strand; PAM type: YTN; PAM sequence: TTG
tcagcagaatacttagatga

SEQ ID NO: 49530 - DNA, 20 bp, Artificial Sequence
  Description of Artificial Sequence: Synthetic oligonucleotide
  Target: SCN10A; (-) strand; PAM type: YTN; PAM sequence: CTT
gtcagcagaatacttagatg

SEQ ID NO: 49531 - DNA, 20 bp, Artificial Sequence
  Description of Artificial Sequence: Synthetic oligonucleotide
  Target: SCN10A; (-) strand; PAM type: YTN; PAM sequence: TTC
ttgtcagcagaatacttaga

SEQ ID NO: 49532 - DNA, 20 bp, Artificial Sequence
  Description of Artificial Sequence: Synthetic oligonucleotide
  Target: SCN10A; (-) strand; PAM type: YTN; PAM sequence: TTT
cttgtcagcagaatacttag

SEQ ID NO: 49533 - DNA, 20 bp, Artificial Sequence
  Description of Artificial Sequence: Synthetic oligonucleotide
  Target: SCN10A; (-) strand; PAM type: YTN; PAM sequence: CTT
tcttgtcagcagaatactta

SEQ ID NO: 49534 - DNA, 20 bp, Artificial Sequence
  Description of Artificial Sequence: Synthetic oligonucleotide
  Target: SCN10A; (-) strand; PAM type: YTN; PAM sequence: TTC
gatgcaggacaaaagaagac

SEQ ID NO: 49535 - DNA, 20 bp, Artificial Sequence
  Description of Artificial Sequence: Synthetic oligonucleotide
  Target: SCN10A; (-) strand; PAM type: YTN; PAM sequence: CTC
aacaggcattcgatgcagga

SEQ ID NO: 49536 - DNA, 20 bp, Artificial Sequence
  Description of Artificial Sequence: Synthetic oligonucleotide
  Target: SCN10A; (-) strand; PAM type: YTN; PAM sequence: TTG
tgtctcaacaggcattcgat

SEQ ID NO: 49537 - DNA, 20 bp, Artificial Sequence
  Description of Artificial Sequence: Synthetic oligonucleotide
  Target: SCN10A; (-) strand; PAM type: YTN; PAM sequence: TTT
gtgtctcaacaggcattcga

SEQ ID NO: 49538 - DNA, 20 bp, Artificial Sequence
  Description of Artificial Sequence: Synthetic oligonucleotide
  Target: SCN10A; (-) strand; PAM type: YTN; PAM sequence: CTG
tttgtgtctcaacaggcatt

SEQ ID NO: 49539 - DNA, 20 bp, Artificial Sequence
  Description of Artificial Sequence: Synthetic oligonucleotide
  Target: SCN10A; (-) strand; PAM type: YTN; PAM sequence: CTC
tgtttgtgtctcaacaggca

SEQ ID NO: 49540 - DNA, 20 bp, Artificial Sequence
  Description of Artificial Sequence: Synthetic oligonucleotide
  Target: SCN10A; (-) strand; PAM type: YTN; PAM sequence: CTG
actctgtttgtgtctcaaca

SEQ ID NO: 49541 - DNA, 20 bp, Artificial Sequence
  Description of Artificial Sequence: Synthetic oligonucleotide
  Target: SCN10A; (-) strand; PAM type: YTN; PAM sequence: TTA
aaggagcgtcctgactctgt

SEQ ID NO: 49542 - DNA, 20 bp, Artificial Sequence
  Description of Artificial Sequence: Synthetic oligonucleotide
  Target: SCN10A; (-) strand; PAM type: YTN; PAM sequence: TTG
ccatgaagatgtcaggttaa

SEQ ID NO: 49543 - DNA, 20 bp, Artificial Sequence
  Description of Artificial Sequence: Synthetic oligonucleotide
  Target: SCN10A; (-) strand; PAM type: YTN; PAM sequence: TTT
gccatgaagatgtcaggtta

SEQ ID NO: 49544 - DNA, 20 bp, Artificial Sequence
  Description of Artificial Sequence: Synthetic oligonucleotide
  Target: SCN10A; (-) strand; PAM type: YTN; PAM sequence: CTT
tgccatgaagatgtcaggtt

SEQ ID NO: 49545 - DNA, 20 bp, Artificial Sequence
  Description of Artificial Sequence: Synthetic oligonucleotide
  Target: SCN10A; (-) strand; PAM type: YTN; PAM sequence: CTG
aatgatccaactttgccatg

SEQ ID NO: 49546 - DNA, 20 bp, Artificial Sequence
  Description of Artificial Sequence: Synthetic oligonucleotide
  Target: SCN10A; (-) strand; PAM type: YTN; PAM sequence: TTG
gccaataagaggctgaatga

SEQ ID NO: 49547 - DNA, 20 bp, Artificial Sequence
  Description of Artificial Sequence: Synthetic oligonucleotide
  Target: SCN10A; (-) strand; PAM type: YTN; PAM sequence: CTA
tatatgagattggccaataa

SEQ ID NO: 49548 - DNA, 20 bp, Artificial Sequence
  Description of Artificial Sequence: Synthetic oligonucleotide
  Target: SCN10A; (-) strand; PAM type: YTN; PAM sequence: CTG
taagtgacatatgactatat

SEQ ID NO: 49549 - DNA, 20 bp, Artificial Sequence
  Description of Artificial Sequence: Synthetic oligonucleotide
  Target: SCN10A; (-) strand; PAM type: YTN; PAM sequence: CTA
tctgtaagtgacatatgact

SEQ ID NO: 49550 - DNA, 20 bp, Artificial Sequence
  Description of Artificial Sequence: Synthetic oligonucleotide
  Target: SCN10A; (-) strand; PAM type: YTN; PAM sequence: CTC
tatctgtaagtgacatatga

SEQ ID NO: 49551 - DNA, 20 bp, Artificial Sequence
  Description of Artificial Sequence: Synthetic oligonucleotide
  Target: SCN10A; (-) strand; PAM type: YTN; PAM sequence: TTG
tcagaacatatctctatctg

SEQ ID NO: 49552 - DNA, 20 bp, Artificial Sequence
  Description of Artificial Sequence: Synthetic oligonucleotide
  Target: SCN10A; (-) strand; PAM type: YTN; PAM sequence: TTT
gtcagaacatatctctatct

SEQ ID NO: 49553 - DNA, 20 bp, Artificial Sequence
  Description of Artificial Sequence: Synthetic oligonucleotide
  Target: SCN10A; (-) strand; PAM type: YTN; PAM sequence: CTA
atgatgtatttgtcagaaca

SEQ ID NO: 49554 - DNA, 20 bp, Artificial Sequence
  Description of Artificial Sequence: Synthetic oligonucleotide
  Target: SCN10A; (-) strand; PAM type: YTN; PAM sequence: TTC
acagaatgatgaaatcacct

SEQ ID NO: 49555 - DNA, 20 bp, Artificial Sequence
  Description of Artificial Sequence: Synthetic oligonucleotide
  Target: SCN10A; (-) strand; PAM type: YTN; PAM sequence: TTG
tgtaaatacaatgtaggata

SEQ ID NO: 49556 - DNA, 20 bp, Artificial Sequence
  Description of Artificial Sequence: Synthetic oligonucleotide
  Target: SCN10A; (-) strand; PAM type: YTN; PAM sequence: TTT
gtgtaaatacaatgtaggat

SEQ ID NO: 49557 - DNA, 20 bp, Artificial Sequence
  Description of Artificial Sequence: Synthetic oligonucleotide
  Target: SCN10A; (-) strand; PAM type: YTN; PAM sequence: TTG
tttgtgtaaatacaatgtag

SEQ ID NO: 49558 - DNA, 20 bp, Artificial Sequence
  Description of Artificial Sequence: Synthetic oligonucleotide
  Target: SCN10A; (-) strand; PAM type: YTN; PAM sequence: TTT
gtttgtgtaaatacaatgta

SEQ ID NO: 49559 - DNA, 20 bp, Artificial Sequence
  Description of Artificial Sequence: Synthetic oligonucleotide
  Target: SCN10A; (-) strand; PAM type: YTN; PAM sequence: CTA
tagcatttgtttgtgtaaat

SEQ ID NO: 49560 - DNA, 20 bp, Artificial Sequence
  Description of Artificial Sequence: Synthetic oligonucleotide
  Target: SCN10A; (-) strand; PAM type: YTN; PAM sequence: CTA
gatgtatagaaggctatagc

SEQ ID NO: 49561 - DNA, 20 bp, Artificial Sequence
  Description of Artificial Sequence: Synthetic oligonucleotide
  Target: SCN10A; (-) strand; PAM type: YTN; PAM sequence: TTA
gcctagatgtatagaaggct

SEQ ID NO: 49562 - DNA, 20 bp, Artificial Sequence
  Description of Artificial Sequence: Synthetic oligonucleotide
  Target: SCN10A; (-) strand; PAM type: YTN; PAM sequence: TTT
agcctagatgtatagaaggc

SEQ ID NO: 49563 - DNA, 20 bp, Artificial Sequence
  Description of Artificial Sequence: Synthetic oligonucleotide
  Target: SCN10A; (-) strand; PAM type: YTN; PAM sequence: CTA
tttagcctagatgtatagaa

SEQ ID NO: 49564 - DNA, 20 bp, Artificial Sequence
  Description of Artificial Sequence: Synthetic oligonucleotide
  Target: SCN10A; (-) strand; PAM type: YTN; PAM sequence: CTA
ggagcaataggccacactat

SEQ ID NO: 49565 - DNA, 20 bp, Artificial Sequence
  Description of Artificial Sequence: Synthetic oligonucleotide
  Target: SCN10A; (-) strand; PAM type: YTN; PAM sequence: TTG
tagcctaggagcaataggcc

SEQ ID NO: 49566 - DNA, 20 bp, Artificial Sequence
  Description of Artificial Sequence: Synthetic oligonucleotide
  Target: SCN10A; (-) strand; PAM type: YTN; PAM sequence: TTT
gtagcctaggagcaataggc

SEQ ID NO: 49567 - DNA, 20 bp, Artificial Sequence
  Description of Artificial Sequence: Synthetic oligonucleotide
  Target: SCN10A; (-) strand; PAM type: YTN; PAM sequence: CTG
tacagatttgtagcctagga

SEQ ID NO: 49568 - DNA, 20 bp, Artificial Sequence
  Description of Artificial Sequence: Synthetic oligonucleotide
  Target: SCN10A; (-) strand; PAM type: YTN; PAM sequence: TTC
agcaataacatgctgtacag

SEQ ID NO: 49569 - DNA, 20 bp, Artificial Sequence
  Description of Artificial Sequence: Synthetic oligonucleotide
  Target: SCN10A; (-) strand; PAM type: YTN; PAM sequence: TTA
cagtattcagcaataacatg

SEQ ID NO: 49570 - DNA, 20 bp, Artificial Sequence
  Description of Artificial Sequence: Synthetic oligonucleotide
  Target: SCN10A; (-) strand; PAM type: YTN; PAM sequence: CTT
acagtattcagcaataacat

SEQ ID NO: 49571 - DNA, 20 bp, Artificial Sequence
  Description of Artificial Sequence: Synthetic oligonucleotide
  Target: SCN10A; (-) strand; PAM type: YTN; PAM sequence: TTA
tacttacagtattcagcaat

SEQ ID NO: 49572 - DNA, 20 bp, Artificial Sequence
  Description of Artificial Sequence: Synthetic oligonucleotide
  Target: SCN10A; (-) strand; PAM type: YTN; PAM sequence: TTT
atacttacagtattcagcaa

SEQ ID NO: 49573 - DNA, 20 bp, Artificial Sequence
  Description of Artificial Sequence: Synthetic oligonucleotide
  Target: SCN10A; (-) strand; PAM type: YTN; PAM sequence: CTG
tttatacttacagtattcag

SEQ ID NO: 49574 - DNA, 20 bp, Artificial Sequence
  Description of Artificial Sequence: Synthetic oligonucleotide
  Target: SCN10A; (-) strand; PAM type: YTN; PAM sequence: TTA
actgtttatacttacagtat

SEQ ID NO: 49575 - DNA, 20 bp, Artificial Sequence
  Description of Artificial Sequence: Synthetic oligonucleotide
  Target: SCN10A; (-) strand; PAM type: YTN; PAM sequence: TTA
ttaactgtttatacttacag

SEQ ID NO: 49576 - DNA, 20 bp, Artificial Sequence
  Description of Artificial Sequence: Synthetic oligonucleotide
  Target: SCN10A; (-) strand; PAM type: YTN; PAM sequence: TTT
attaactgtttatacttaca

SEQ ID NO: 49577 - DNA, 20 bp, Artificial Sequence
  Description of Artificial Sequence: Synthetic oligonucleotide
  Target: SCN10A; (-) strand; PAM type: YTN; PAM sequence: TTA
tgtttattaactgtttatac

SEQ ID NO: 49578 - DNA, 20 bp, Artificial Sequence
  Description of Artificial Sequence: Synthetic oligonucleotide
  Target: SCN10A; (-) strand; PAM type: YTN; PAM sequence: TTT
atgtttattaactgtttata

SEQ ID NO: 49579 - DNA, 20 bp, Artificial Sequence
  Description of Artificial Sequence: Synthetic oligonucleotide
  Target: SCN10A; (-) strand; PAM type: YTN; PAM sequence: CTT
tatgtttattaactgtttat

SEQ ID NO: 49580 - DNA, 20 bp, Artificial Sequence
  Description of Artificial Sequence: Synthetic oligonucleotide
  Target: SCN10A; (-) strand; PAM type: YTN; PAM sequence: TTC
tttatgtttattaactgttt

SEQ ID NO: 49581 - DNA, 20 bp, Artificial Sequence
  Description of Artificial Sequence: Synthetic oligonucleotide
  Target: SCN10A; (-) strand; PAM type: YTN; PAM sequence: TTT
ctttatgtttattaactgtt

SEQ ID NO: 49582 - DNA, 20 bp, Artificial Sequence
  Description of Artificial Sequence: Synthetic oligonucleotide
  Target: SCN10A; (-) strand; PAM type: YTN; PAM sequence: CTT
tctttatgtttattaactgt

SEQ ID NO: 49583 - DNA, 20 bp, Artificial Sequence
  Description of Artificial Sequence: Synthetic oligonucleotide
  Target: SCN10A; (-) strand; PAM type: YTN; PAM sequence: TTA
taaactttctttatgtttat

SEQ ID NO: 49584 - DNA, 20 bp, Artificial Sequence
  Description of Artificial Sequence: Synthetic oligonucleotide
  Target: SCN10A; (-) strand; PAM type: YTN; PAM sequence: TTT
ataaactttctttatgttta

SEQ ID NO: 49585 - DNA, 20 bp, Artificial Sequence
  Description of Artificial Sequence: Synthetic oligonucleotide
  Target: SCN10A; (-) strand; PAM type: YTN; PAM sequence: CTT
tataaactttctttatgttt

SEQ ID NO: 49586 - DNA, 20 bp, Artificial Sequence
  Description of Artificial Sequence: Synthetic oligonucleotide
  Target: SCN10A; (-) strand; PAM type: YTN; PAM sequence: TTG
gaagctttataaactttctt

SEQ ID NO: 49587 - DNA, 20 bp, Artificial Sequence
  Description of Artificial Sequence: Synthetic oligonucleotide
  Target: SCN10A; (-) strand; PAM type: YTN; PAM sequence: CTC
atggttggaagctttataaa

SEQ ID NO: 49588 - DNA, 20 bp, Artificial Sequence
  Description of Artificial Sequence: Synthetic oligonucleotide
  Target: SCN10A; (-) strand; PAM type: YTN; PAM sequence: TTA
gtcctcatggttggaagctt

SEQ ID NO: 49589 - DNA, 20 bp, Artificial Sequence
  Description of Artificial Sequence: Synthetic oligonucleotide
  Target: SCN10A; (-) strand; PAM type: YTN; PAM sequence: CTT
agtcctcatggttggaagct

SEQ ID NO: 49590 - DNA, 20 bp, Artificial Sequence
  Description of Artificial Sequence: Synthetic oligonucleotide
  Target: SCN10A; (-) strand; PAM type: YTN; PAM sequence: TTG
cttagtcctcatggttggaa

SEQ ID NO: 49591 - DNA, 20 bp, Artificial Sequence
  Description of Artificial Sequence: Synthetic oligonucleotide
  Target: SCN10A; (-) strand; PAM type: YTN; PAM sequence: TTT
gcttagtcctcatggttgga

SEQ ID NO: 49592 - DNA, 20 bp, Artificial Sequence
  Description of Artificial Sequence: Synthetic oligonucleotide
  Target: SCN10A; (-) strand; PAM type: YTN; PAM sequence: CTA
gtatcatttgcttagtcctc

SEQ ID NO: 49593 - DNA, 20 bp, Artificial Sequence
  Description of Artificial Sequence: Synthetic oligonucleotide
  Target: SCN10A; (-) strand; PAM type: YTN; PAM sequence: CTA
ctagtatcatttgcttagtc

SEQ ID NO: 49594 - DNA, 20 bp, Artificial Sequence
  Description of Artificial Sequence: Synthetic oligonucleotide
  Target: SCN10A; (-) strand; PAM type: YTN; PAM sequence: CTG
acagataacaataaatagtg

SEQ ID NO: 49595 - DNA, 20 bp, Artificial Sequence
  Description of Artificial Sequence: Synthetic oligonucleotide
  Target: SCN10A; (-) strand; PAM type: YTN; PAM sequence: TTA
tacatgtctgacagataaca

SEQ ID NO: 49596 - DNA, 20 bp, Artificial Sequence
  Description of Artificial Sequence: Synthetic oligonucleotide
  Target: SCN10A; (-) strand; PAM type: YTN; PAM sequence: TTT
atacatgtctgacagataac

SEQ ID NO: 49597 - DNA, 20 bp, Artificial Sequence
  Description of Artificial Sequence: Synthetic oligonucleotide
  Target: SCN10A; (-) strand; PAM type: YTN; PAM sequence: TTT
tatacatgtctgacagataa

SEQ ID NO: 49598 - DNA, 20 bp, Artificial Sequence
  Description of Artificial Sequence: Synthetic oligonucleotide
  Target: SCN10A; (-) strand; PAM type: YTN; PAM sequence: TTT
ttatacatgtctgacagata

SEQ ID NO: 49599 - DNA, 20 bp, Artificial Sequence
  Description of Artificial Sequence: Synthetic oligonucleotide
  Target: SCN10A; (-) strand; PAM type: YTN; PAM sequence: CTA
catttttatacatgtctgac

SEQ ID NO: 49600 - DNA, 20 bp, Artificial Sequence
  Description of Artificial Sequence: Synthetic oligonucleotide
  Target: SCN10A; (-) strand; PAM type: YTN; PAM sequence: TTA
aatgaaataacaaagtgcct

SEQ ID NO: 49601 - DNA, 20 bp, Artificial Sequence
  Description of Artificial Sequence: Synthetic oligonucleotide
  Target: SCN10A; (-) strand; PAM type: YTN; PAM sequence: CTG
gagggttaaatgaaataaca

SEQ ID NO: 49602 - DNA, 20 bp, Artificial Sequence
  Description of Artificial Sequence: Synthetic oligonucleotide
  Target: SCN10A; (-) strand; PAM type: YTN; PAM sequence: CTA
aatagctggagggttaaatg

SEQ ID NO: 49603 - DNA, 20 bp, Artificial Sequence
  Description of Artificial Sequence: Synthetic oligonucleotide
  Target: SCN10A; (-) strand; PAM type: YTN; PAM sequence: TTC
taaatagctggagggttaaa

SEQ ID NO: 49604 - DNA, 20 bp, Artificial Sequence
  Description of Artificial Sequence: Synthetic oligonucleotide
  Target: SCN10A; (-) strand; PAM type: YTN; PAM sequence: TTT
ctaaatagctggagggttaa

SEQ ID NO: 49605 - DNA, 20 bp, Artificial Sequence
  Description of Artificial Sequence: Synthetic oligonucleotide
  Target: SCN10A; (-) strand; PAM type: YTN; PAM sequence: TTG
taaaaaggtttctaaatagc

SEQ ID NO: 49606 - DNA, 20 bp, Artificial Sequence
  Description of Artificial Sequence: Synthetic oligonucleotide
  Target: SCN10A; (-) strand; PAM type: YTN; PAM sequence: CTT
gtaaaaaggtttctaaatag

SEQ ID NO: 49607 - DNA, 20 bp, Artificial Sequence
  Description of Artificial Sequence: Synthetic oligonucleotide
  Target: SCN10A; (-) strand; PAM type: YTN; PAM sequence: CTC
cccttgtaaaaaggtttcta

SEQ ID NO: 49608 - DNA, 20 bp, Artificial Sequence
  Description of Artificial Sequence: Synthetic oligonucleotide
  Target: SCN10A; (-) strand; PAM type: YTN; PAM sequence: TTA
tctccccttgtaaaaaggtt

SEQ ID NO: 49609 - DNA, 20 bp, Artificial Sequence
  Description of Artificial Sequence: Synthetic oligonucleotide
  Target: SCN10A; (-) strand; PAM type: YTN; PAM sequence: CTT
atctccccttgtaaaaaggt

SEQ ID NO: 49610 - DNA, 20 bp, Artificial Sequence
  Description of Artificial Sequence: Synthetic oligonucleotide
  Target: SCN10A; (-) strand; PAM type: YTN; PAM sequence: CTC
cttatctccccttgtaaaaa

SEQ ID NO: 49611 - DNA, 20 bp, Artificial Sequence
  Description of Artificial Sequence: Synthetic oligonucleotide
  Target: SCN10A; (-) strand; PAM type: YTN; PAM sequence: TTA
tccaagcctccttatctccc

SEQ ID NO: 49612 - DNA, 20 bp, Artificial Sequence
  Description of Artificial Sequence: Synthetic oligonucleotide
  Target: SCN10A; (-) strand; PAM type: YTN; PAM sequence: TTA
aattatccaagcctccttat

SEQ ID NO: 49613 - DNA, 20 bp, Artificial Sequence
  Description of Artificial Sequence: Synthetic oligonucleotide
  Target: SCN10A; (-) strand; PAM type: YTN; PAM sequence: TTT
aaattatccaagcctcctta

SEQ ID NO: 49614 - DNA, 20 bp, Artificial Sequence
  Description of Artificial Sequence: Synthetic oligonucleotide
  Target: SCN10A; (-) strand; PAM type: YTN; PAM sequence: CTT
taaattatccaagcctcctt

SEQ ID NO: 49615 - DNA, 20 bp, Artificial Sequence
  Description of Artificial Sequence: Synthetic oligonucleotide
  Target: SCN10A; (-) strand; PAM type: YTN; PAM sequence: TTA
gcaagtcctttaaattatcc

SEQ ID NO: 49616 - DNA, 20 bp, Artificial Sequence
  Description of Artificial Sequence: Synthetic oligonucleotide
  Target: SCN10A; (-) strand; PAM type: YTN; PAM sequence: TTT
agcaagtcctttaaattatc

SEQ ID NO: 49617 - DNA, 20 bp, Artificial Sequence
  Description of Artificial Sequence: Synthetic oligonucleotide
  Target: SCN10A; (-) strand; PAM type: YTN; PAM sequence: CTG
agtcacatttagcaagtcct

SEQ ID NO: 49618 - DNA, 20 bp, Artificial Sequence
  Description of Artificial Sequence: Synthetic oligonucleotide
  Target: SCN10A; (-) strand; PAM type: YTN; PAM sequence: TTA
ccacctgagtcacatttagc

SEQ ID NO: 49619 - DNA, 20 bp, Artificial Sequence
  Description of Artificial Sequence: Synthetic oligonucleotide
  Target: SCN10A; (-) strand; PAM type: YTN; PAM sequence: CTG
tgccagttaccacctgagtc

SEQ ID NO: 49620 - DNA, 20 bp, Artificial Sequence
  Description of Artificial Sequence: Synthetic oligonucleotide
  Target: SCN10A; (-) strand; PAM type: YTN; PAM sequence: TTA
gtcccaactgtgccagttac

SEQ ID NO: 49621 - DNA, 20 bp, Artificial Sequence
  Description of Artificial Sequence: Synthetic oligonucleotide
  Target: SCN10A; (-) strand; PAM type: YTN; PAM sequence: TTT
agtcccaactgtgccagtta

SEQ ID NO: 49622 - DNA, 20 bp, Artificial Sequence
  Description of Artificial Sequence: Synthetic oligonucleotide
  Target: SCN10A; (-) strand; PAM type: YTN; PAM sequence: TTT
tagtcccaactgtgccagtt

SEQ ID NO: 49623 - DNA, 20 bp, Artificial Sequence
  Description of Artificial Sequence: Synthetic oligonucleotide
  Target: SCN10A; (-) strand; PAM type: YTN; PAM sequence: CTA
tattttagtcccaactgtgc

SEQ ID NO: 49624 - DNA, 20 bp, Artificial Sequence
  Description of Artificial Sequence: Synthetic oligonucleotide
  Target: SCN10A; (-) strand; PAM type: YTN; PAM sequence: TTA
gtatggacctatattttagt

SEQ ID NO: 49625 - DNA, 20 bp, Artificial Sequence
  Description of Artificial Sequence: Synthetic oligonucleotide
  Target: SCN10A; (-) strand; PAM type: YTN; PAM sequence: TTT
agtatggacctatattttag

SEQ ID NO: 49626 - DNA, 20 bp, Artificial Sequence
  Description of Artificial Sequence: Synthetic oligonucleotide
  Target: SCN10A; (-) strand; PAM type: YTN; PAM sequence: CTG
tttagtatggacctatattt

SEQ ID NO: 49627 - DNA, 20 bp, Artificial Sequence
  Description of Artificial Sequence: Synthetic oligonucleotide
  Target: SCN10A; (-) strand; PAM type: YTN; PAM sequence: TTC
tgtttagtatggacctatat

SEQ ID NO: 49628 - DNA, 20 bp, Artificial Sequence
  Description of Artificial Sequence: Synthetic oligonucleotide
  Target: SCN10A; (-) strand; PAM type: YTN; PAM sequence: CTT
ctgtttagtatggacctata

SEQ ID NO: 49629 - DNA, 20 bp, Artificial Sequence
  Description of Artificial Sequence: Synthetic oligonucleotide
  Target: SCN10A; (-) strand; PAM type: YTN; PAM sequence: TTA
ggcccttctgtttagtatgg

SEQ ID NO: 49630 - DNA, 20 bp, Artificial Sequence
  Description of Artificial Sequence: Synthetic oligonucleotide
  Target: SCN10A; (-) strand; PAM type: YTN; PAM sequence: TTT
aggcccttctgtttagtatg

SEQ ID NO: 49631 - DNA, 20 bp, Artificial Sequence
  Description of Artificial Sequence: Synthetic oligonucleotide
  Target: SCN10A; (-) strand; PAM type: YTN; PAM sequence: CTT
taggcccttctgtttagtat

SEQ ID NO: 49632 - DNA, 20 bp, Artificial Sequence
  Description of Artificial Sequence: Synthetic oligonucleotide
  Target: SCN10A; (-) strand; PAM type: YTN; PAM sequence: CTC
tttaggcccttctgtttagt

SEQ ID NO: 49633 - DNA, 20 bp, Artificial Sequence
  Description of Artificial Sequence: Synthetic oligonucleotide
  Target: SCN10A; (-) strand; PAM type: YTN; PAM sequence: TTG
actctttaggcccttctgtt

SEQ ID NO: 49634 - DNA, 20 bp, Artificial Sequence
  Description of Artificial Sequence: Synthetic oligonucleotide
  Target: SCN10A; (-) strand; PAM type: YTN; PAM sequence: CTA
gtgaaagattgactctttag

SEQ ID NO: 49635 - DNA, 20 bp, Artificial Sequence
  Description of Artificial Sequence: Synthetic oligonucleotide
  Target: SCN10A; (-) strand; PAM type: YTN; PAM sequence: TTA
ccaggctagtgaaagattga

SEQ ID NO: 49636 - DNA, 20 bp, Artificial Sequence
  Description of Artificial Sequence: Synthetic oligonucleotide
  Target: SCN10A; (-) strand; PAM type: YTN; PAM sequence: TTA
aattaccaggctagtgaaag

SEQ ID NO: 49637 - DNA, 20 bp, Artificial Sequence
  Description of Artificial Sequence: Synthetic oligonucleotide
  Target: SCN10A; (-) strand; PAM type: YTN; PAM sequence: CTA
gttaaattaccaggctagtg

SEQ ID NO: 49638 - DNA, 20 bp, Artificial Sequence
  Description of Artificial Sequence: Synthetic oligonucleotide
  Target: SCN10A; (-) strand; PAM type: YTN; PAM sequence: TTC
tagttaaattaccaggctag

SEQ ID NO: 49639 - DNA, 20 bp, Artificial Sequence
  Description of Artificial Sequence: Synthetic oligonucleotide
  Target: SCN10A; (-) strand; PAM type: YTN; PAM sequence: TTC
attctagttaaattaccagg

SEQ ID NO: 49640 - DNA, 20 bp, Artificial Sequence
  Description of Artificial Sequence: Synthetic oligonucleotide
  Target: SCN10A; (-) strand; PAM type: YTN; PAM sequence: TTG
attcattctagttaaattac

SEQ ID NO: 49641 - DNA, 20 bp, Artificial Sequence
  Description of Artificial Sequence: Synthetic oligonucleotide
  Target: SCN10A; (-) strand; PAM type: YTN; PAM sequence: CTT
gattcattctagttaaatta

SEQ ID NO: 49642 - DNA, 20 bp, Artificial Sequence
  Description of Artificial Sequence: Synthetic oligonucleotide
  Target: SCN10A; (-) strand; PAM type: YTN; PAM sequence: CTG
accttgattcattctagtta

SEQ ID NO: 49643 - DNA, 20 bp, Artificial Sequence
  Description of Artificial Sequence: Synthetic oligonucleotide
  Target: SCN10A; (-) strand; PAM type: YTN; PAM sequence: TTC
tgaccttgattcattctagt

SEQ ID NO: 49644 - DNA, 20 bp, Artificial Sequence
  Description of Artificial Sequence: Synthetic oligonucleotide
  Target: SCN10A; (-) strand; PAM type: YTN; PAM sequence: CTA
gatattctgaccttgattca

SEQ ID NO: 49645 - DNA, 20 bp, Artificial Sequence
  Description of Artificial Sequence: Synthetic oligonucleotide
  Target: SCN10A; (-) strand; PAM type: YTN; PAM sequence: TTA
tcatgtgtctagatattctg

SEQ ID NO: 49646 - DNA, 20 bp, Artificial Sequence
  Description of Artificial Sequence: Synthetic oligonucleotide
  Target: SCN10A; (-) strand; PAM type: YTN; PAM sequence: CTG
agattatcatgtgtctagat

SEQ ID NO: 49647 - DNA, 20 bp, Artificial Sequence
  Description of Artificial Sequence: Synthetic oligonucleotide
  Target: SCN10A; (-) strand; PAM type: YTN; PAM sequence: TTC
ctgagattatcatgtgtcta

SEQ ID NO: 49648 - DNA, 20 bp, Artificial Sequence
  Description of Artificial Sequence: Synthetic oligonucleotide
  Target: SCN10A; (-) strand; PAM type: YTN; PAM sequence: CTG
ttcctgagattatcatgtgt

SEQ ID NO: 49649 - DNA, 20 bp, Artificial Sequence
  Description of Artificial Sequence: Synthetic oligonucleotide
  Target: SCN10A; (-) strand; PAM type: YTN; PAM sequence: CTC
tgttcctgagattatcatgt

SEQ ID NO: 49650 - DNA, 20 bp, Artificial Sequence
  Description of Artificial Sequence: Synthetic oligonucleotide
  Target: SCN10A; (-) strand; PAM type: YTN; PAM sequence: TTC
tctgttcctgagattatcat

SEQ ID NO: 49651 - DNA, 20 bp, Artificial Sequence
  Description of Artificial Sequence: Synthetic oligonucleotide
  Target: SCN10A; (-) strand; PAM type: YTN; PAM sequence: TTT
ctctgttcctgagattatca

SEQ ID NO: 49652 - DNA, 20 bp, Artificial Sequence
  Description of Artificial Sequence: Synthetic oligonucleotide
  Target: SCN10A; (-) strand; PAM type: YTN; PAM sequence: CTT
tctctgttcctgagattatc

SEQ ID NO: 49653 - DNA, 20 bp, Artificial Sequence
  Description of Artificial Sequence: Synthetic oligonucleotide
  Target: SCN10A; (-) strand; PAM type: YTN; PAM sequence: CTC
ctttctctgttcctgagatt

SEQ ID NO: 49654 - DNA, 20 bp, Artificial Sequence
  Description of Artificial Sequence: Synthetic oligonucleotide
  Target: SCN10A; (-) strand; PAM type: YTN; PAM sequence: TTG
tgatgggcccccaccctcct

SEQ ID NO: 49655 - DNA, 20 bp, Artificial Sequence
  Description of Artificial Sequence: Synthetic oligonucleotide
  Target: SCN10A; (-) strand; PAM type: YTN; PAM sequence: CTT
gtgatgggcccccaccctcc

SEQ ID NO: 49656 - DNA, 20 bp, Artificial Sequence
  Description of Artificial Sequence: Synthetic oligonucleotide
  Target: SCN10A; (-) strand; PAM type: YTN; PAM sequence: CTC
ttgtgatgggcccccaccct

SEQ ID NO: 49657 - DNA, 20 bp, Artificial Sequence
  Description of Artificial Sequence: Synthetic oligonucleotide
  Target: SCN10A; (-) strand; PAM type: YTN; PAM sequence: CTC
tcttgtgatgggcccccacc

SEQ ID NO: 49658 - DNA, 20 bp, Artificial Sequence
  Description of Artificial Sequence: Synthetic oligonucleotide
  Target: SCN10A; (-) strand; PAM type: YTN; PAM sequence: TTA
tgcctctcttgtgatgggcc

SEQ ID NO: 49659 - DNA, 20 bp, Artificial Sequence
  Description of Artificial Sequence: Synthetic oligonucleotide
  Target: SCN10A; (-) strand; PAM type: YTN; PAM sequence: TTT
atgcctctcttgtgatgggc

SEQ ID NO: 49660 - DNA, 20 bp, Artificial Sequence
  Description of Artificial Sequence: Synthetic oligonucleotide
  Target: SCN10A; (-) strand; PAM type: YTN; PAM sequence: CTG
aaggcatttatgcctctctt

SEQ ID NO: 49661 - DNA, 20 bp, Artificial Sequence
  Description of Artificial Sequence: Synthetic oligonucleotide
  Target: SCN10A; (-) strand; PAM type: YTN; PAM sequence: CTC
actgaaggcatttatgcctc

SEQ ID NO: 49662 - DNA, 20 bp, Artificial Sequence
  Description of Artificial Sequence: Synthetic oligonucleotide
  Target: SCN10A; (-) strand; PAM type: YTN; PAM sequence: CTA
gaaaatgcctcactgaaggc

SEQ ID NO: 49663 - DNA, 20 bp, Artificial Sequence
  Description of Artificial Sequence: Synthetic oligonucleotide
  Target: SCN10A; (-) strand; PAM type: YTN; PAM sequence: CTC
tagaaaatgcctcactgaag

SEQ ID NO: 49664 - DNA, 20 bp, Artificial Sequence
  Description of Artificial Sequence: Synthetic oligonucleotide
  Target: SCN10A; (-) strand; PAM type: YTN; PAM sequence: TTA
gcactctagaaaatgcctca

SEQ ID NO: 49665 - DNA, 20 bp, Artificial Sequence
  Description of Artificial Sequence: Synthetic oligonucleotide
  Target: SCN10A; (-) strand; PAM type: YTN; PAM sequence: CTG
ggagtgcattagcactctag

SEQ ID NO: 49666 - DNA, 20 bp, Artificial Sequence
  Description of Artificial Sequence: Synthetic oligonucleotide
  Target: SCN10A; (-) strand; PAM type: YTN; PAM sequence: CTC
gctgggagtgcattagcact

SEQ ID NO: 49667 - DNA, 20 bp, Artificial Sequence
  Description of Artificial Sequence: Synthetic oligonucleotide
  Target: SCN10A; (-) strand; PAM type: YTN; PAM sequence: CTG
cagggctcgctgggagtgca

SEQ ID NO: 49668 - DNA, 20 bp, Artificial Sequence
  Description of Artificial Sequence: Synthetic oligonucleotide
  Target: SCN10A; (-) strand; PAM type: YTN; PAM sequence: TTA
aagtcaaaggcatcctgcag

SEQ ID NO: 49669 - DNA, 20 bp, Artificial Sequence
  Description of Artificial Sequence: Synthetic oligonucleotide
  Target: SCN10A; (-) strand; PAM type: YTN; PAM sequence: CTT
aaagtcaaaggcatcctgca

SEQ ID NO: 49670 - DNA, 20 bp, Artificial Sequence
  Description of Artificial Sequence: Synthetic oligonucleotide
  Target: SCN10A; (-) strand; PAM type: YTN; PAM sequence: CTC
cagggcaaatggaatcacca

SEQ ID NO: 49671 - DNA, 20 bp, Artificial Sequence
  Description of Artificial Sequence: Synthetic oligonucleotide
  Target: SCN10A; (-) strand; PAM type: YTN; PAM sequence: CTC
cccaggaacagagacagtgg

SEQ ID NO: 49672 - DNA, 20 bp, Artificial Sequence
  Description of Artificial Sequence: Synthetic oligonucleotide
  Target: SCN10A; (-) strand; PAM type: YTN; PAM sequence: CTC
cctccccaggaacagagaca

SEQ ID NO: 49673 - DNA, 20 bp, Artificial Sequence
  Description of Artificial Sequence: Synthetic oligonucleotide
  Target: SCN10A; (-) strand; PAM type: YTN; PAM sequence: TTG
tacaggtctccctccccagg

SEQ ID NO: 49674 - DNA, 20 bp, Artificial Sequence
  Description of Artificial Sequence: Synthetic oligonucleotide
  Target: SCN10A; (-) strand; PAM type: YTN; PAM sequence: TTT
gtacaggtctccctccccag

SEQ ID NO: 49675 - DNA, 20 bp, Artificial Sequence
  Description of Artificial Sequence: Synthetic oligonucleotide
  Target: SCN10A; (-) strand; PAM type: YTN; PAM sequence: TTT
tgtacaggtctccctcccca

SEQ ID NO: 49676 - DNA, 20 bp, Artificial Sequence
  Description of Artificial Sequence: Synthetic oligonucleotide
  Target: SCN10A; (-) strand; PAM type: YTN; PAM sequence: CTG
gccagaaccagagggtaagg

SEQ ID NO: 49677 - DNA, 20 bp, Artificial Sequence
  Description of Artificial Sequence: Synthetic oligonucleotide
  Target: SCN10A; (-) strand; PAM type: YTN; PAM sequence: TTA
accaaacctggccagaacca

SEQ ID NO: 49678 - DNA, 20 bp, Artificial Sequence
  Description of Artificial Sequence: Synthetic oligonucleotide
  Target: SCN10A; (-) strand; PAM type: YTN; PAM sequence: CTC
ccattaaccaaacctggcca

SEQ ID NO: 49679 - DNA, 20 bp, Artificial Sequence
  Description of Artificial Sequence: Synthetic oligonucleotide
  Target: SCN10A; (-) strand; PAM type: YTN; PAM sequence: CTA
tgtctcccattaaccaaacc

SEQ ID NO: 49680 - DNA, 20 bp, Artificial Sequence
  Description of Artificial Sequence: Synthetic oligonucleotide
  Target: SCN10A; (-) strand; PAM type: YTN; PAM sequence: CTG
cctatgtctcccattaacca

SEQ ID NO: 49681 - DNA, 20 bp, Artificial Sequence
  Description of Artificial Sequence: Synthetic oligonucleotide
  Target: SCN10A; (-) strand; PAM type: YTN; PAM sequence: TTG
aatgtcctgcctatgtctcc

SEQ ID NO: 49682 - DNA, 20 bp, Artificial Sequence
  Description of Artificial Sequence: Synthetic oligonucleotide
  Target: SCN10A; (-) strand; PAM type: YTN; PAM sequence: CTT
gaatgtcctgcctatgtctc

SEQ ID NO: 49683 - DNA, 20 bp, Artificial Sequence
  Description of Artificial Sequence: Synthetic oligonucleotide
  Target: SCN10A; (-) strand; PAM type: YTN; PAM sequence: CTA
tccttgaatgtcctgcctat

SEQ ID NO: 49684 - DNA, 20 bp, Artificial Sequence
  Description of Artificial Sequence: Synthetic oligonucleotide
  Target: SCN10A; (-) strand; PAM type: YTN; PAM sequence: TTC
tatccttgaatgtcctgcct

SEQ ID NO: 49685 - DNA, 20 bp, Artificial Sequence
  Description of Artificial Sequence: Synthetic oligonucleotide
  Target: SCN10A; (-) strand; PAM type: YTN; PAM sequence: CTT
ctatccttgaatgtcctgcc

SEQ ID NO: 49686 - DNA, 20 bp, Artificial Sequence
  Description of Artificial Sequence: Synthetic oligonucleotide
  Target: SCN10A; (-) strand; PAM type: YTN; PAM sequence: CTC
cttctatccttgaatgtcct

SEQ ID NO: 49687 - DNA, 20 bp, Artificial Sequence
  Description of Artificial Sequence: Synthetic oligonucleotide
  Target: SCN10A; (-) strand; PAM type: YTN; PAM sequence: CTC
tccttctatccttgaatgtc

SEQ ID NO: 49688 - DNA, 20 bp, Artificial Sequence
  Description of Artificial Sequence: Synthetic oligonucleotide
  Target: SCN10A; (-) strand; PAM type: YTN; PAM sequence: TTG
tctctccttctatccttgaa

SEQ ID NO: 49689 - DNA, 20 bp, Artificial Sequence
  Description of Artificial Sequence: Synthetic oligonucleotide
  Target: SCN10A; (-) strand; PAM type: YTN; PAM sequence: CTT
gtctctccttctatccttga

SEQ ID NO: 49690 - DNA, 20 bp, Artificial Sequence
  Description of Artificial Sequence: Synthetic oligonucleotide
  Target: SCN10A; (-) strand; PAM type: YTN; PAM sequence: CTG
acttgtctctccttctatcc

SEQ ID NO: 49691 - DNA, 20 bp, Artificial Sequence
  Description of Artificial Sequence: Synthetic oligonucleotide
  Target: SCN10A; (-) strand; PAM type: YTN; PAM sequence: CTC
agccatagcacaggagagaa

SEQ ID NO: 49692 - DNA, 20 bp, Artificial Sequence
  Description of Artificial Sequence: Synthetic oligonucleotide
  Target: SCN10A; (-) strand; PAM type: YTN; PAM sequence: CTA
ctcagccatagcacaggaga

SEQ ID NO: 49693 - DNA, 20 bp, Artificial Sequence
  Description of Artificial Sequence: Synthetic oligonucleotide
  Target: SCN10A; (-) strand; PAM type: YTN; PAM sequence: CTG
ctactcagccatagcacagg

SEQ ID NO: 49694 - DNA, 20 bp, Artificial Sequence
  Description of Artificial Sequence: Synthetic oligonucleotide
  Target: SCN10A; (-) strand; PAM type: YTN; PAM sequence: CTC
tgctactcagccatagcaca

SEQ ID NO: 49695 - DNA, 20 bp, Artificial Sequence
  Description of Artificial Sequence: Synthetic oligonucleotide
  Target: SCN10A; (-) strand; PAM type: YTN; PAM sequence: TTA
gtagaggatcacagctctgc

SEQ ID NO: 49696 - DNA, 20 bp, Artificial Sequence
  Description of Artificial Sequence: Synthetic oligonucleotide
  Target: SCN10A; (-) strand; PAM type: YTN; PAM sequence: CTT
agtagaggatcacagctctg

SEQ ID NO: 49697 - DNA, 20 bp, Artificial Sequence
  Description of Artificial Sequence: Synthetic oligonucleotide
  Target: SCN10A; (-) strand; PAM type: YTN; PAM sequence: TTG
tgatcttagtagaggatcac

SEQ ID NO: 49698 - DNA, 20 bp, Artificial Sequence
  Description of Artificial Sequence: Synthetic oligonucleotide
  Target: SCN10A; (-) strand; PAM type: YTN; PAM sequence: CTT
gtgatcttagtagaggatca

SEQ ID NO: 49699 - DNA, 20 bp, Artificial Sequence
  Description of Artificial Sequence: Synthetic oligonucleotide
  Target: SCN10A; (-) strand; PAM type: YTN; PAM sequence: CTG
gcagaacttgtgatcttagt

SEQ ID NO: 49700 - DNA, 20 bp, Artificial Sequence
  Description of Artificial Sequence: Synthetic oligonucleotide
  Target: SCN10A; (-) strand; PAM type: YTN; PAM sequence: CTG
cctggcagaacttgtgatct

SEQ ID NO: 49701 - DNA, 20 bp, Artificial Sequence
  Description of Artificial Sequence: Synthetic oligonucleotide
  Target: SCN10A; (-) strand; PAM type: YTN; PAM sequence: CTC
atgtgtcagagaggctgcct

SEQ ID NO: 49702 - DNA, 20 bp, Artificial Sequence
  Description of Artificial Sequence: Synthetic oligonucleotide
  Target: SCN10A; (-) strand; PAM type: YTN; PAM sequence: CTG
ccctcatgtgtcagagaggc

SEQ ID NO: 49703 - DNA, 20 bp, Artificial Sequence
  Description of Artificial Sequence: Synthetic oligonucleotide
  Target: SCN10A; (-) strand; PAM type: YTN; PAM sequence: CTA
cagcagcagctgccctcatg

SEQ ID NO: 49704 - DNA, 20 bp, Artificial Sequence
  Description of Artificial Sequence: Synthetic oligonucleotide
  Target: SCN10A; (-) strand; PAM type: YTN; PAM sequence: TTA
gactacagcagcagctgccc

SEQ ID NO: 49705 - DNA, 20 bp, Artificial Sequence
  Description of Artificial Sequence: Synthetic oligonucleotide
  Target: SCN10A; (-) strand; PAM type: YTN; PAM sequence: CTG
aagggatgaaggaaaggacc

SEQ ID NO: 49706 - DNA, 20 bp, Artificial Sequence
  Description of Artificial Sequence: Synthetic oligonucleotide
  Target: SCN10A; (-) strand; PAM type: YTN; PAM sequence: CTA
ggctgaagggatgaaggaaa

SEQ ID NO: 49707 - DNA, 20 bp, Artificial Sequence
  Description of Artificial Sequence: Synthetic oligonucleotide
  Target: SCN10A; (-) strand; PAM type: YTN; PAM sequence: TTA
catgcctaggctgaagggat

SEQ ID NO: 49708 - DNA, 20 bp, Artificial Sequence
  Description of Artificial Sequence: Synthetic oligonucleotide
  Target: SCN10A; (-) strand; PAM type: YTN; PAM sequence: CTG
ttacatgcctaggctgaagg

SEQ ID NO: 49709 - DNA, 20 bp, Artificial Sequence
  Description of Artificial Sequence: Synthetic oligonucleotide
  Target: SCN10A; (-) strand; PAM type: YTN; PAM sequence: CTA
gtaacagggggaagctgtta

SEQ ID NO: 49710 - DNA, 20 bp, Artificial Sequence
  Description of Artificial Sequence: Synthetic oligonucleotide
  Target: SCN10A; (-) strand; PAM type: YTN; PAM sequence: CTA
gaaactagtaacagggggaa

SEQ ID NO: 49711 - DNA, 20 bp, Artificial Sequence
  Description of Artificial Sequence: Synthetic oligonucleotide
  Target: SCN10A; (-) strand; PAM type: YTN; PAM sequence: TTA
gggaatgaataagggacagt

SEQ ID NO: 49712 - DNA, 20 bp, Artificial Sequence
  Description of Artificial Sequence: Synthetic oligonucleotide
  Target: SCN10A; (-) strand; PAM type: YTN; PAM sequence: CTT
agggaatgaataagggacag

SEQ ID NO: 49713 - DNA, 20 bp, Artificial Sequence
  Description of Artificial Sequence: Synthetic oligonucleotide
  Target: SCN10A; (-) strand; PAM type: YTN; PAM sequence: CTG
ggcttagggaatgaataagg

SEQ ID NO: 49714 - DNA, 20 bp, Artificial Sequence
  Description of Artificial Sequence: Synthetic oligonucleotide
  Target: SCN10A; (-) strand; PAM type: YTN; PAM sequence: TTA
cagaggtgtgggctgggctt

SEQ ID NO: 49715 - DNA, 20 bp, Artificial Sequence
  Description of Artificial Sequence: Synthetic oligonucleotide
  Target: SCN10A; (-) strand; PAM type: YTN; PAM sequence: TTT
acagaggtgtgggctgggct

SEQ ID NO: 49716 - DNA, 20 bp, Artificial Sequence
  Description of Artificial Sequence: Synthetic oligonucleotide
  Target: SCN10A; (-) strand; PAM type: YTN; PAM sequence: TTA
gtaaagtatttacagaggtg

SEQ ID NO: 49717 - DNA, 20 bp, Artificial Sequence
  Description of Artificial Sequence: Synthetic oligonucleotide
  Target: SCN10A; (-) strand; PAM type: YTN; PAM sequence: TTT
agtaaagtatttacagaggt

SEQ ID NO: 49718 - DNA, 20 bp, Artificial Sequence
  Description of Artificial Sequence: Synthetic oligonucleotide
  Target: SCN10A; (-) strand; PAM type: YTN; PAM sequence: CTA
atagagagagtttagtaaag

SEQ ID NO: 49719 - DNA, 20 bp, Artificial Sequence
  Description of Artificial Sequence: Synthetic oligonucleotide
  Target: SCN10A; (-) strand; PAM type: YTN; PAM sequence: CTC
cgatgggctaatagagagag

SEQ ID NO: 49720 - DNA, 20 bp, Artificial Sequence
  Description of Artificial Sequence: Synthetic oligonucleotide
  Target: SCN10A; (-) strand; PAM type: YTN; PAM sequence: TTC
agggtcccagcaagaaacag

SEQ ID NO: 49721 - DNA, 20 bp, Artificial Sequence
  Description of Artificial Sequence: Synthetic oligonucleotide
  Target: SCN10A; (-) strand; PAM type: YTN; PAM sequence: CTC
aatgtcatgtgattcagggt

SEQ ID NO: 49722 - DNA, 20 bp, Artificial Sequence
  Description of Artificial Sequence: Synthetic oligonucleotide
  Target: SCN10A; (-) strand; PAM type: YTN; PAM sequence: CTG
actcaatgtcatgtgattca

SEQ ID NO: 49723 - DNA, 20 bp, Artificial Sequence
  Description of Artificial Sequence: Synthetic oligonucleotide
  Target: SCN10A; (-) strand; PAM type: YTN; PAM sequence: CTC
tgactcaatgtcatgtgatt

SEQ ID NO: 49724 - DNA, 20 bp, Artificial Sequence
  Description of Artificial Sequence: Synthetic oligonucleotide
  Target: SCN10A; (-) strand; PAM type: YTN; PAM sequence: CTC
agtctctgactcaatgtcat

SEQ ID NO: 49725 - DNA, 20 bp, Artificial Sequence
  Description of Artificial Sequence: Synthetic oligonucleotide
  Target: SCN10A; (-) strand; PAM type: YTN; PAM sequence: TTA
gctcagtctctgactcaatg

SEQ ID NO: 49726 - DNA, 20 bp, Artificial Sequence
  Description of Artificial Sequence: Synthetic oligonucleotide
  Target: SCN10A; (-) strand; PAM type: YTN; PAM sequence: CTT
agctcagtctctgactcaat

SEQ ID NO: 49727 - DNA, 20 bp, Artificial Sequence
  Description of Artificial Sequence: Synthetic oligonucleotide
  Target: SCN10A; (-) strand; PAM type: YTN; PAM sequence: TTG
ccttagctcagtctctgact

SEQ ID NO: 49728 - DNA, 20 bp, Artificial Sequence
  Description of Artificial Sequence: Synthetic oligonucleotide
  Target: SCN10A; (-) strand; PAM type: YTN; PAM sequence: TTA
gagttgccttagctcagtct

SEQ ID NO: 49729 - DNA, 20 bp, Artificial Sequence
  Description of Artificial Sequence: Synthetic oligonucleotide
  Target: SCN10A; (-) strand; PAM type: YTN; PAM sequence: CTT
agagttgccttagctcagtc

SEQ ID NO: 49730 - DNA, 20 bp, Artificial Sequence
  Description of Artificial Sequence: Synthetic oligonucleotide
  Target: SCN10A; (-) strand; PAM type: YTN; PAM sequence: CTG
atacagataagtcttagagt

SEQ ID NO: 49731 - DNA, 20 bp, Artificial Sequence
  Description of Artificial Sequence: Synthetic oligonucleotide
  Target: SCN10A; (-) strand; PAM type: YTN; PAM sequence: TTC
cactgatacagataagtctt

SEQ ID NO: 49732 - DNA, 20 bp, Artificial Sequence
  Description of Artificial Sequence: Synthetic oligonucleotide
  Target: SCN10A; (-) strand; PAM type: YTN; PAM sequence: TTG
taaagagaccaataaatggt

SEQ ID NO: 49733 - DNA, 20 bp, Artificial Sequence
  Description of Artificial Sequence: Synthetic oligonucleotide
  Target: SCN10A; (-) strand; PAM type: YTN; PAM sequence: TTG
cagacagaattgtaaagaga

SEQ ID NO: 49734 - DNA, 20 bp, Artificial Sequence
  Description of Artificial Sequence: Synthetic oligonucleotide
  Target: SCN10A; (-) strand; PAM type: YTN; PAM sequence: CTA
gccagggatacagcgcaatt

SEQ ID NO: 49735 - DNA, 20 bp, Artificial Sequence
  Description of Artificial Sequence: Synthetic oligonucleotide
  Target: SCN10A; (-) strand; PAM type: YTN; PAM sequence: CTG
gctagccagggatacagcgc

SEQ ID NO: 49736 - DNA, 20 bp, Artificial Sequence
  Description of Artificial Sequence: Synthetic oligonucleotide
  Target: SCN10A; (-) strand; PAM type: YTN; PAM sequence: CTC
tggctagccagggatacagc

SEQ ID NO: 49737 - DNA, 20 bp, Artificial Sequence
  Description of Artificial Sequence: Synthetic oligonucleotide
  Target: SCN10A; (-) strand; PAM type: YTN; PAM sequence: CTC
tctggctagccagggataca

SEQ ID NO: 49738 - DNA, 20 bp, Artificial Sequence
  Description of Artificial Sequence: Synthetic oligonucleotide
  Target: SCN10A; (-) strand; PAM type: YTN; PAM sequence: TTG
ccctctctggctagccaggg

SEQ ID NO: 49739 - DNA, 20 bp, Artificial Sequence
  Description of Artificial Sequence: Synthetic oligonucleotide
  Target: SCN10A; (-) strand; PAM type: YTN; PAM sequence: TTT
gccctctctggctagccagg

SEQ ID NO: 49740 - DNA, 20 bp, Artificial Sequence
  Description of Artificial Sequence: Synthetic oligonucleotide
  Target: SCN10A; (-) strand; PAM type: YTN; PAM sequence: TTC
atttgccctctctggctagc

SEQ ID NO: 49741 - DNA, 20 bp, Artificial Sequence
  Description of Artificial Sequence: Synthetic oligonucleotide
  Target: SCN10A; (-) strand; PAM type: YTN; PAM sequence: TTT
catttgccctctctggctag

SEQ ID NO: 49742 - DNA, 20 bp, Artificial Sequence
  Description of Artificial Sequence: Synthetic oligonucleotide
  Target: SCN10A; (-) strand; PAM type: YTN; PAM sequence: TTT
tcatttgccctctctggcta

SEQ ID NO: 49743 - DNA, 20 bp, Artificial Sequence
  Description of Artificial Sequence: Synthetic oligonucleotide
  Target: SCN10A; (-) strand; PAM type: YTN; PAM sequence: TTT
ttcatttgccctctctggct

SEQ ID NO: 49744 - DNA, 20 bp, Artificial Sequence
  Description of Artificial Sequence: Synthetic oligonucleotide
  Target: SCN10A; (-) strand; PAM type: YTN; PAM sequence: CTA
gtgtttttcatttgccctct

SEQ ID NO: 49745 - DNA, 20 bp, Artificial Sequence
  Description of Artificial Sequence: Synthetic oligonucleotide
  Target: SCN10A; (-) strand; PAM type: YTN; PAM sequence: TTC
tagtgtttttcatttgccct

SEQ ID NO: 49746 - DNA, 20 bp, Artificial Sequence
  Description of Artificial Sequence: Synthetic oligonucleotide
  Target: SCN10A; (-) strand; PAM type: YTN; PAM sequence: TTT
ctagtgtttttcatttgccc

SEQ ID NO: 49747 - DNA, 20 bp, Artificial Sequence
  Description of Artificial Sequence: Synthetic oligonucleotide
  Target: SCN10A; (-) strand; PAM type: YTN; PAM sequence: TTC
agcaatgatgtttctagtgt

SEQ ID NO: 49748 - DNA, 20 bp, Artificial Sequence
  Description of Artificial Sequence: Synthetic oligonucleotide
  Target: SCN10A; (-) strand; PAM type: YTN; PAM sequence: TTT
cagcaatgatgtttctagtg

SEQ ID NO: 49749 - DNA, 20 bp, Artificial Sequence
  Description of Artificial Sequence: Synthetic oligonucleotide
  Target: SCN10A; (-) strand; PAM type: YTN; PAM sequence: CTC
cagtttcagcaatgatgttt

SEQ ID NO: 49750 - DNA, 20 bp, Artificial Sequence
  Description of Artificial Sequence: Synthetic oligonucleotide
  Target: SCN10A; (-) strand; PAM type: YTN; PAM sequence: CTC
ccctccagtttcagcaatga

SEQ ID NO: 49751 - DNA, 20 bp, Artificial Sequence
  Description of Artificial Sequence: Synthetic oligonucleotide
  Target: SCN10A; (-) strand; PAM type: YTN; PAM sequence: CTC
tcccctccagtttcagcaat

SEQ ID NO: 49752 - DNA, 20 bp, Artificial Sequence
  Description of Artificial Sequence: Synthetic oligonucleotide
  Target: SCN10A; (-) strand; PAM type: YTN; PAM sequence: TTA
atgtgagctctcccctccag

SEQ ID NO: 49753 - DNA, 20 bp, Artificial Sequence
  Description of Artificial Sequence: Synthetic oligonucleotide
  Target: SCN10A; (-) strand; PAM type: YTN; PAM sequence: CTG
tgagttaatgtgagctctcc

SEQ ID NO: 49754 - DNA, 20 bp, Artificial Sequence
  Description of Artificial Sequence: Synthetic oligonucleotide
  Target: SCN10A; (-) strand; PAM type: YTN; PAM sequence: TTG
ggagctgtgagttaatgtga

SEQ ID NO: 49755 - DNA, 20 bp, Artificial Sequence
  Description of Artificial Sequence: Synthetic oligonucleotide
  Target: SCN10A; (-) strand; PAM type: YTN; PAM sequence: TTG
gattgggagctgtgagttaa

SEQ ID NO: 49756 - DNA, 20 bp, Artificial Sequence
  Description of Artificial Sequence: Synthetic oligonucleotide
  Target: SCN10A; (-) strand; PAM type: YTN; PAM sequence: CTC
attggattgggagctgtgag

SEQ ID NO: 49757 - DNA, 20 bp, Artificial Sequence
  Description of Artificial Sequence: Synthetic oligonucleotide
  Target: SCN10A; (-) strand; PAM type: YTN; PAM sequence: TTC
ctcattggattgggagctgt

SEQ ID NO: 49758 - DNA, 20 bp, Artificial Sequence
  Description of Artificial Sequence: Synthetic oligonucleotide
  Target: SCN10A; (-) strand; PAM type: YTN; PAM sequence: TTA
atagaataatcgcagagtgt

SEQ ID NO: 49759 - DNA, 20 bp, Artificial Sequence
  Description of Artificial Sequence: Synthetic oligonucleotide
  Target: SCN10A; (-) strand; PAM type: YTN; PAM sequence: TTT
aatagaataatcgcagagtg

SEQ ID NO: 49760 - DNA, 20 bp, Artificial Sequence
  Description of Artificial Sequence: Synthetic oligonucleotide
  Target: SCN10A; (-) strand; PAM type: YTN; PAM sequence: CTT
taatagaataatcgcagagt

SEQ ID NO: 49761 - DNA, 20 bp, Artificial Sequence
  Description of Artificial Sequence: Synthetic oligonucleotide
  Target: SCN10A; (-) strand; PAM type: YTN; PAM sequence: CTC
tttaatagaataatcgcaga

SEQ ID NO: 49762 - DNA, 20 bp, Artificial Sequence
  Description of Artificial Sequence: Synthetic oligonucleotide
  Target: SCN10A; (-) strand; PAM type: YTN; PAM sequence: CTG
gccagcactctttaatagaa

SEQ ID NO: 49763 - DNA, 20 bp, Artificial Sequence
  Description of Artificial Sequence: Synthetic oligonucleotide
  Target: SCN10A; (-) strand; PAM type: YTN; PAM sequence: CTA
actggccagcactctttaat

SEQ ID NO: 49764 - DNA, 20 bp, Artificial Sequence
  Description of Artificial Sequence: Synthetic oligonucleotide
  Target: SCN10A; (-) strand; PAM type: YTN; PAM sequence: TTA
ggcaacagtgactaactggc

SEQ ID NO: 49765 - DNA, 20 bp, Artificial Sequence
  Description of Artificial Sequence: Synthetic oligonucleotide
  Target: SCN10A; (-) strand; PAM type: YTN; PAM sequence: TTG
ccaaaatgagcaaattaggc

SEQ ID NO: 49766 - DNA, 20 bp, Artificial Sequence
  Description of Artificial Sequence: Synthetic oligonucleotide
  Target: SCN10A; (-) strand; PAM type: YTN; PAM sequence: TTT
gccaaaatgagcaaattagg

SEQ ID NO: 49767 - DNA, 20 bp, Artificial Sequence
  Description of Artificial Sequence: Synthetic oligonucleotide
  Target: SCN10A; (-) strand; PAM type: YTN; PAM sequence: CTC
acagaagaaataatttgcca

SEQ ID NO: 49768 - DNA, 20 bp, Artificial Sequence
  Description of Artificial Sequence: Synthetic oligonucleotide
  Target: SCN10A; (-) strand; PAM type: YTN; PAM sequence: TTA
ctcacagaagaaataatttg

SEQ ID NO: 49769 - DNA, 20 bp, Artificial Sequence
  Description of Artificial Sequence: Synthetic oligonucleotide
  Target: SCN10A; (-) strand; PAM type: YTN; PAM sequence: TTT
actcacagaagaaataattt

SEQ ID NO: 49770 - DNA, 20 bp, Artificial Sequence
  Description of Artificial Sequence: Synthetic oligonucleotide
  Target: SCN10A; (-) strand; PAM type: YTN; PAM sequence: CTT
tactcacagaagaaataatt

SEQ ID NO: 49771 - DNA, 20 bp, Artificial Sequence
  Description of Artificial Sequence: Synthetic oligonucleotide
  Target: SCN10A; (-) strand; PAM type: YTN; PAM sequence: TTG
ctttactcacagaagaaata

SEQ ID NO: 49772 - DNA, 20 bp, Artificial Sequence
  Description of Artificial Sequence: Synthetic oligonucleotide
  Target: SCN10A; (-) strand; PAM type: YTN; PAM sequence: CTT
gctttactcacagaagaaat

SEQ ID NO: 49773 - DNA, 20 bp, Artificial Sequence
  Description of Artificial Sequence: Synthetic oligonucleotide
  Target: SCN10A; (-) strand; PAM type: YTN; PAM sequence: TTC
cttgctttactcacagaaga

SEQ ID NO: 49774 - DNA, 20 bp, Artificial Sequence
  Description of Artificial Sequence: Synthetic oligonucleotide
  Target: SCN10A; (-) strand; PAM type: YTN; PAM sequence: CTG
aatagaagcacagtattcct

SEQ ID NO: 49775 - DNA, 20 bp, Artificial Sequence
  Description of Artificial Sequence: Synthetic oligonucleotide
  Target: SCN10A; (-) strand; PAM type: YTN; PAM sequence: TTA
ggacagatctgaatagaagc

SEQ ID NO: 49776 - DNA, 20 bp, Artificial Sequence
  Description of Artificial Sequence: Synthetic oligonucleotide
  Target: SCN10A; (-) strand; PAM type: YTN; PAM sequence: CTT
aggacagatctgaatagaag

SEQ ID NO: 49777 - DNA, 20 bp, Artificial Sequence
  Description of Artificial Sequence: Synthetic oligonucleotide
  Target: SCN10A; (-) strand; PAM type: YTN; PAM sequence: TTC
ttaggacagatctgaataga

SEQ ID NO: 49778 - DNA, 20 bp, Artificial Sequence
  Description of Artificial Sequence: Synthetic oligonucleotide
  Target: SCN10A; (-) strand; PAM type: YTN; PAM sequence: TTT
cttaggacagatctgaatag

SEQ ID NO: 49779 - DNA, 20 bp, Artificial Sequence
  Description of Artificial Sequence: Synthetic oligonucleotide
  Target: SCN10A; (-) strand; PAM type: YTN; PAM sequence: TTC
aggaagtttcttaggacaga

SEQ ID NO: 49780 - DNA, 20 bp, Artificial Sequence
  Description of Artificial Sequence: Synthetic oligonucleotide
  Target: SCN10A; (-) strand; PAM type: YTN; PAM sequence: CTG
ggcaaatggcacccagagaa

SEQ ID NO: 49781 - DNA, 20 bp, Artificial Sequence
  Description of Artificial Sequence: Synthetic oligonucleotide
  Target: SCN10A; (-) strand; PAM type: YTN; PAM sequence: CTA
ggctgggcaaatggcaccca

SEQ ID NO: 49782 - DNA, 20 bp, Artificial Sequence
  Description of Artificial Sequence: Synthetic oligonucleotide
  Target: SCN10A; (-) strand; PAM type: YTN; PAM sequence: TTC
taggctgggcaaatggcacc

SEQ ID NO: 49783 - DNA, 20 bp, Artificial Sequence
  Description of Artificial Sequence: Synthetic oligonucleotide
  Target: SCN10A; (-) strand; PAM type: YTN; PAM sequence: CTT
ctaggctgggcaaatggcac

SEQ ID NO: 49784 - DNA, 20 bp, Artificial Sequence
  Description of Artificial Sequence: Synthetic oligonucleotide
  Target: SCN10A; (-) strand; PAM type: YTN; PAM sequence: CTC
ttctaggctgggcaaatggc

SEQ ID NO: 49785 - DNA, 20 bp, Artificial Sequence
  Description of Artificial Sequence: Synthetic oligonucleotide
  Target: SCN10A; (-) strand; PAM type: YTN; PAM sequence: CTA
tgcaaactcttctaggctgg

SEQ ID NO: 49786 - DNA, 20 bp, Artificial Sequence
  Description of Artificial Sequence: Synthetic oligonucleotide
  Target: SCN10A; (-) strand; PAM type: YTN; PAM sequence: CTC
tatgcaaactcttctaggct

SEQ ID NO: 49787 - DNA, 20 bp, Artificial Sequence
  Description of Artificial Sequence: Synthetic oligonucleotide
  Target: SCN10A; (-) strand; PAM type: YTN; PAM sequence: TTA
tggctctatgcaaactcttc

SEQ ID NO: 49788 - DNA, 20 bp, Artificial Sequence
  Description of Artificial Sequence: Synthetic oligonucleotide
  Target: SCN10A; (-) strand; PAM type: YTN; PAM sequence: CTT
atggctctatgcaaactctt

SEQ ID NO: 49789 - DNA, 20 bp, Artificial Sequence
  Description of Artificial Sequence: Synthetic oligonucleotide
  Target: SCN10A; (-) strand; PAM type: YTN; PAM sequence: CTG
cttatggctctatgcaaact

SEQ ID NO: 49790 - DNA, 20 bp, Artificial Sequence
  Description of Artificial Sequence: Synthetic oligonucleotide
  Target: SCN10A; (-) strand; PAM type: YTN; PAM sequence: TTC
ctgcttatggctctatgcaa

SEQ ID NO: 49791 - DNA, 20 bp, Artificial Sequence
  Description of Artificial Sequence: Synthetic oligonucleotide
  Target: SCN10A; (-) strand; PAM type: YTN; PAM sequence: CTT
cctgcttatggctctatgca

SEQ ID NO: 49792 - DNA, 20 bp, Artificial Sequence
  Description of Artificial Sequence: Synthetic oligonucleotide
  Target: SCN10A; (-) strand; PAM type: YTN; PAM sequence: CTC
ttcctgcttatggctctatg

SEQ ID NO: 49793 - DNA, 20 bp, Artificial Sequence
  Description of Artificial Sequence: Synthetic oligonucleotide
  Target: SCN10A; (-) strand; PAM type: YTN; PAM sequence: TTC
tcttcctgcttatggctcta

SEQ ID NO: 49794 - DNA, 20 bp, Artificial Sequence
  Description of Artificial Sequence: Synthetic oligonucleotide
  Target: SCN10A; (-) strand; PAM type: YTN; PAM sequence: CTT
ctcttcctgcttatggctct

SEQ ID NO: 49795 - DNA, 20 bp, Artificial Sequence
  Description of Artificial Sequence: Synthetic oligonucleotide
  Target: SCN10A; (-) strand; PAM type: YTN; PAM sequence: CTG
aaggacccttctcttcctgc

SEQ ID NO: 49796 - DNA, 20 bp, Artificial Sequence
  Description of Artificial Sequence: Synthetic oligonucleotide
  Target: SCN10A; (-) strand; PAM type: YTN; PAM sequence: TTG
gacaggtatgagaaaaactg

SEQ ID NO: 49797 - DNA, 20 bp, Artificial Sequence
  Description of Artificial Sequence: Synthetic oligonucleotide
  Target: SCN10A; (-) strand; PAM type: YTN; PAM sequence: TTG
ttggacaggtatgagaaaaa

SEQ ID NO: 49798 - DNA, 20 bp, Artificial Sequence
  Description of Artificial Sequence: Synthetic oligonucleotide
  Target: SCN10A; (-) strand; PAM type: YTN; PAM sequence: CTT
gttggacaggtatgagaaaa

SEQ ID NO: 49799 - DNA, 20 bp, Artificial Sequence
  Description of Artificial Sequence: Synthetic oligonucleotide
  Target: SCN10A; (-) strand; PAM type: YTN; PAM sequence: TTC
ttgttggacaggtatgagaa

SEQ ID NO: 49800 - DNA, 20 bp, Artificial Sequence
  Description of Artificial Sequence: Synthetic oligonucleotide
  Target: SCN10A; (-) strand; PAM type: YTN; PAM sequence: TTT
cttgttggacaggtatgaga

SEQ ID NO: 49801 - DNA, 20 bp, Artificial Sequence
  Description of Artificial Sequence: Synthetic oligonucleotide
  Target: SCN10A; (-) strand; PAM type: YTN; PAM sequence: CTT
tcttgttggacaggtatgag

SEQ ID NO: 49802 - DNA, 20 bp, Artificial Sequence
  Description of Artificial Sequence: Synthetic oligonucleotide
  Target: SCN10A; (-) strand; PAM type: YTN; PAM sequence: CTG
ctttcttgttggacaggtat

SEQ ID NO: 49803 - DNA, 20 bp, Artificial Sequence
  Description of Artificial Sequence: Synthetic oligonucleotide
  Target: SCN10A; (-) strand; PAM type: YTN; PAM sequence: CTC
agtgataggcctgctttctt

SEQ ID NO: 49804 - DNA, 20 bp, Artificial Sequence
  Description of Artificial Sequence: Synthetic oligonucleotide
  Target: SCN10A; (-) strand; PAM type: YTN; PAM sequence: CTG
cctcagtgataggcctgctt

SEQ ID NO: 49805 - DNA, 20 bp, Artificial Sequence
  Description of Artificial Sequence: Synthetic oligonucleotide
  Target: SCN10A; (-) strand; PAM type: YTN; PAM sequence: CTC
aacatcactgcctcagtgat

SEQ ID NO: 49806 - DNA, 20 bp, Artificial Sequence
  Description of Artificial Sequence: Synthetic oligonucleotide
  Target: SCN10A; (-) strand; PAM type: YTN; PAM sequence: CTG
tccccactcaacatcactgc

SEQ ID NO: 49807 - DNA, 20 bp, Artificial Sequence
  Description of Artificial Sequence: Synthetic oligonucleotide
  Target: SCN10A; (-) strand; PAM type: YTN; PAM sequence: CTC
tgtccccactcaacatcact

SEQ ID NO: 49808 - DNA, 20 bp, Artificial Sequence
  Description of Artificial Sequence: Synthetic oligonucleotide
  Target: SCN10A; (-) strand; PAM type: YTN; PAM sequence: TTC
tctgtccccactcaacatca

SEQ ID NO: 49809 - DNA, 20 bp, Artificial Sequence
  Description of Artificial Sequence: Synthetic oligonucleotide
  Target: SCN10A; (-) strand; PAM type: YTN; PAM sequence: CTT
ctctgtccccactcaacatc

SEQ ID NO: 49810 - DNA, 20 bp, Artificial Sequence
  Description of Artificial Sequence: Synthetic oligonucleotide
  Target: SCN10A; (-) strand; PAM type: YTN; PAM sequence: TTA
tcagtgcttctctgtcccca

SEQ ID NO: 49811 - DNA, 20 bp, Artificial Sequence
  Description of Artificial Sequence: Synthetic oligonucleotide
  Target: SCN10A; (-) strand; PAM type: YTN; PAM sequence: CTT
atcagtgcttctctgtcccc

SEQ ID NO: 49812 - DNA, 20 bp, Artificial Sequence
  Description of Artificial Sequence: Synthetic oligonucleotide
  Target: SCN10A; (-) strand; PAM type: YTN; PAM sequence: TTC
ttatcagtgcttctctgtcc

SEQ ID NO: 49813 - DNA, 20 bp, Artificial Sequence
  Description of Artificial Sequence: Synthetic oligonucleotide
  Target: SCN10A; (-) strand; PAM type: YTN; PAM sequence: TTT
cttatcagtgcttctctgtc

SEQ ID NO: 49814 - DNA, 20 bp, Artificial Sequence
  Description of Artificial Sequence: Synthetic oligonucleotide
  Target: SCN10A; (-) strand; PAM type: YTN; PAM sequence: TTG
accccatatttcttatcagt

SEQ ID NO: 49815 - DNA, 20 bp, Artificial Sequence
  Description of Artificial Sequence: Synthetic oligonucleotide
  Target: SCN10A; (-) strand; PAM type: YTN; PAM sequence: TTT
gaccccatatttcttatcag

SEQ ID NO: 49816 - DNA, 20 bp, Artificial Sequence
  Description of Artificial Sequence: Synthetic oligonucleotide
  Target: SCN10A; (-) strand; PAM type: YTN; PAM sequence: TTC
catttgaccccatatttctt

SEQ ID NO: 49817 - DNA, 20 bp, Artificial Sequence
  Description of Artificial Sequence: Synthetic oligonucleotide
  Target: SCN10A; (-) strand; PAM type: YTN; PAM sequence: TTA
tattccatttgaccccatat

SEQ ID NO: 49818 - DNA, 20 bp, Artificial Sequence
  Description of Artificial Sequence: Synthetic oligonucleotide
  Target: SCN10A; (-) strand; PAM type: YTN; PAM sequence: CTG
cagtagtgatgcaaattata

SEQ ID NO: 49819 - DNA, 20 bp, Artificial Sequence
  Description of Artificial Sequence: Synthetic oligonucleotide
  Target: SCN10A; (-) strand; PAM type: YTN; PAM sequence: TTC
tgcagtagtgatgcaaatta

SEQ ID NO: 49820 - DNA, 20 bp, Artificial Sequence
  Description of Artificial Sequence: Synthetic oligonucleotide
  Target: SCN10A; (-) strand; PAM type: YTN; PAM sequence: TTA
ttctgcagtagtgatgcaaa

SEQ ID NO: 49821 - DNA, 20 bp, Artificial Sequence
  Description of Artificial Sequence: Synthetic oligonucleotide
  Target: SCN10A; (-) strand; PAM type: YTN; PAM sequence: TTT
attctgcagtagtgatgcaa

SEQ ID NO: 49822 - DNA, 20 bp, Artificial Sequence
  Description of Artificial Sequence: Synthetic oligonucleotide
  Target: SCN10A; (-) strand; PAM type: YTN; PAM sequence: CTG
gtttattctgcagtagtgat

SEQ ID NO: 49823 - DNA, 20 bp, Artificial Sequence
  Description of Artificial Sequence: Synthetic oligonucleotide
  Target: SCN10A; (-) strand; PAM type: YTN; PAM sequence: TTC
ctggtttattctgcagtagt

SEQ ID NO: 49824 - DNA, 20 bp, Artificial Sequence
  Description of Artificial Sequence: Synthetic oligonucleotide
  Target: SCN10A; (-) strand; PAM type: YTN; PAM sequence: TTT
cctggtttattctgcagtag

SEQ ID NO: 49825 - DNA, 20 bp, Artificial Sequence
  Description of Artificial Sequence: Synthetic oligonucleotide
  Target: SCN10A; (-) strand; PAM type: YTN; PAM sequence: CTG
aggtcaaacaggtttcctgg

SEQ ID NO: 49826 - DNA, 20 bp, Artificial Sequence
  Description of Artificial Sequence: Synthetic oligonucleotide
  Target: SCN10A; (-) strand; PAM type: YTN; PAM sequence: TTG
gcctgaggtcaaacaggttt

SEQ ID NO: 49827 - DNA, 20 bp, Artificial Sequence
  Description of Artificial Sequence: Synthetic oligonucleotide
  Target: SCN10A; (-) strand; PAM type: YTN; PAM sequence: TTG
agttggcctgaggtcaaaca

SEQ ID NO: 49828 - DNA, 20 bp, Artificial Sequence
  Description of Artificial Sequence: Synthetic oligonucleotide
  Target: SCN10A; (-) strand; PAM type: YTN; PAM sequence: TTA
cagacatagaagatgagacc

SEQ ID NO: 49829 - DNA, 20 bp, Artificial Sequence
  Description of Artificial Sequence: Synthetic oligonucleotide
  Target: SCN10A; (-) strand; PAM type: YTN; PAM sequence: TTT
acagacatagaagatgagac

SEQ ID NO: 49830 - DNA, 20 bp, Artificial Sequence
  Description of Artificial Sequence: Synthetic oligonucleotide
  Target: SCN10A; (-) strand; PAM type: YTN; PAM sequence: TTT
tacagacatagaagatgaga

SEQ ID NO: 49831 - DNA, 20 bp, Artificial Sequence
  Description of Artificial Sequence: Synthetic oligonucleotide
  Target: SCN10A; (-) strand; PAM type: YTN; PAM sequence: TTT
ttacagacatagaagatgag

SEQ ID NO: 49832 - DNA, 20 bp, Artificial Sequence
  Description of Artificial Sequence: Synthetic oligonucleotide
  Target: SCN10A; (-) strand; PAM type: YTN; PAM sequence: TTT
tttacagacatagaagatga

SEQ ID NO: 49833 - DNA, 20 bp, Artificial Sequence
  Description of Artificial Sequence: Synthetic oligonucleotide
  Target: SCN10A; (-) strand; PAM type: YTN; PAM sequence: CTT
ttttacagacatagaagatg

SEQ ID NO: 49834 - DNA, 20 bp, Artificial Sequence
  Description of Artificial Sequence: Synthetic oligonucleotide
  Target: SCN10A; (-) strand; PAM type: YTN; PAM sequence: CTC
cttttttacagacatagaag

SEQ ID NO: 49835 - DNA, 20 bp, Artificial Sequence
  Description of Artificial Sequence: Synthetic oligonucleotide
  Target: SCN10A; (-) strand; PAM type: YTN; PAM sequence: CTA
ctccttttttacagacatag

SEQ ID NO: 49836 - DNA, 20 bp, Artificial Sequence
  Description of Artificial Sequence: Synthetic oligonucleotide
  Target: SCN10A; (-) strand; PAM type: YTN; PAM sequence: TTC
tactccttttttacagacat

SEQ ID NO: 49837 - DNA, 20 bp, Artificial Sequence
  Description of Artificial Sequence: Synthetic oligonucleotide
  Target: SCN10A; (-) strand; PAM type: YTN; PAM sequence: CTC
cccattctactcctttttta

SEQ ID NO: 49838 - DNA, 20 bp, Artificial Sequence
  Description of Artificial Sequence: Synthetic oligonucleotide
  Target: SCN10A; (-) strand; PAM type: YTN; PAM sequence: CTG
tccaatgcctccccattcta

SEQ ID NO: 49839 - DNA, 20 bp, Artificial Sequence
  Description of Artificial Sequence: Synthetic oligonucleotide
  Target: SCN10A; (-) strand; PAM type: YTN; PAM sequence: TTA
gccatcatcctgtccaatgc

SEQ ID NO: 49840 - DNA, 20 bp, Artificial Sequence
  Description of Artificial Sequence: Synthetic oligonucleotide
  Target: SCN10A; (-) strand; PAM type: YTN; PAM sequence: TTT
agccatcatcctgtccaatg

SEQ ID NO: 49841 - DNA, 20 bp, Artificial Sequence
  Description of Artificial Sequence: Synthetic oligonucleotide
  Target: SCN10A; (-) strand; PAM type: YTN; PAM sequence: CTT
tagccatcatcctgtccaat

SEQ ID NO: 49842 - DNA, 20 bp, Artificial Sequence
  Description of Artificial Sequence: Synthetic oligonucleotide
  Target: SCN10A; (-) strand; PAM type: YTN; PAM sequence: CTG
agtatcaccaatggaaggga

SEQ ID NO: 49843 - DNA, 20 bp, Artificial Sequence
  Description of Artificial Sequence: Synthetic oligonucleotide
  Target: SCN10A; (-) strand; PAM type: YTN; PAM sequence: TTG
agccaagaagcctgagtatc

SEQ ID NO: 49844 - DNA, 20 bp, Artificial Sequence
  Description of Artificial Sequence: Synthetic oligonucleotide
  Target: SCN10A; (-) strand; PAM type: YTN; PAM sequence: CTT
gagccaagaagcctgagtat

SEQ ID NO: 49845 - DNA, 20 bp, Artificial Sequence
  Description of Artificial Sequence: Synthetic oligonucleotide
  Target: SCN10A; (-) strand; PAM type: YTN; PAM sequence: CTA
gaagccttgagccaagaagc

SEQ ID NO: 49846 - DNA, 20 bp, Artificial Sequence
  Description of Artificial Sequence: Synthetic oligonucleotide
  Target: SCN10A; (-) strand; PAM type: YTN; PAM sequence: TTC
cacctagaagccttgagcca

SEQ ID NO: 49847 - DNA, 20 bp, Artificial Sequence
  Description of Artificial Sequence: Synthetic oligonucleotide
  Target: SCN10A; (-) strand; PAM type: YTN; PAM sequence: CTT
ccacctagaagccttgagcc

SEQ ID NO: 49848 - DNA, 20 bp, Artificial Sequence
  Description of Artificial Sequence: Synthetic oligonucleotide
  Target: SCN10A; (-) strand; PAM type: YTN; PAM sequence: CTG
tcttccacctagaagccttg

SEQ ID NO: 49849 - DNA, 20 bp, Artificial Sequence
  Description of Artificial Sequence: Synthetic oligonucleotide
  Target: SCN10A; (-) strand; PAM type: YTN; PAM sequence: CTC
aggctgtcttccacctagaa

SEQ ID NO: 49850 - DNA, 20 bp, Artificial Sequence
  Description of Artificial Sequence: Synthetic oligonucleotide
  Target: SCN10A; (-) strand; PAM type: YTN; PAM sequence: CTC
cctcaggctgtcttccacct

SEQ ID NO: 49851 - DNA, 20 bp, Artificial Sequence
  Description of Artificial Sequence: Synthetic oligonucleotide
  Target: SCN10A; (-) strand; PAM type: YTN; PAM sequence: TTC
agactccctcaggctgtctt

SEQ ID NO: 49852 - DNA, 20 bp, Artificial Sequence
  Description of Artificial Sequence: Synthetic oligonucleotide
  Target: SCN10A; (-) strand; PAM type: YTN; PAM sequence: CTT
cagactccctcaggctgtct

SEQ ID NO: 49853 - DNA, 20 bp, Artificial Sequence
  Description of Artificial Sequence: Synthetic oligonucleotide
  Target: SCN10A; (-) strand; PAM type: YTN; PAM sequence: TTG
tgaatgcttcagactccctc

SEQ ID NO: 49854 - DNA, 20 bp, Artificial Sequence
  Description of Artificial Sequence: Synthetic oligonucleotide
  Target: SCN10A; (-) strand; PAM type: YTN; PAM sequence: TTT
gtgaatgcttcagactccct

SEQ ID NO: 49855 - DNA, 20 bp, Artificial Sequence
  Description of Artificial Sequence: Synthetic oligonucleotide
  Target: SCN10A; (-) strand; PAM type: YTN; PAM sequence: CTC
ggtgagtttgtgaatgcttc

SEQ ID NO: 49856 - DNA, 20 bp, Artificial Sequence
  Description of Artificial Sequence: Synthetic oligonucleotide
  Target: SCN10A; (-) strand; PAM type: YTN; PAM sequence: CTG
tcgatgtctcggtgagtttg

SEQ ID NO: 49857 - DNA, 20 bp, Artificial Sequence
  Description of Artificial Sequence: Synthetic oligonucleotide
  Target: SCN10A; (-) strand; PAM type: YTN; PAM sequence: CTG
gagctgtcgatgtctcggtg

SEQ ID NO: 49858 - DNA, 20 bp, Artificial Sequence
  Description of Artificial Sequence: Synthetic oligonucleotide
  Target: SCN10A; (-) strand; PAM type: YTN; PAM sequence: TTG
cccctggagctgtcgatgtc

SEQ ID NO: 49859 - DNA, 20 bp, Artificial Sequence
  Description of Artificial Sequence: Synthetic oligonucleotide
  Target: SCN10A; (-) strand; PAM type: YTN; PAM sequence: CTT
gcccctggagctgtcgatgt

SEQ ID NO: 49860 - DNA, 20 bp, Artificial Sequence
  Description of Artificial Sequence: Synthetic oligonucleotide
  Target: SCN10A; (-) strand; PAM type: YTN; PAM sequence: CTA
gtgagcttgcccctggagct

SEQ ID NO: 49861 - DNA, 20 bp, Artificial Sequence
  Description of Artificial Sequence: Synthetic oligonucleotide
  Target: SCN10A; (-) strand; PAM type: YTN; PAM sequence: CTC
caggcatggagaagatgaac

SEQ ID NO: 49862 - DNA, 20 bp, Artificial Sequence
  Description of Artificial Sequence: Synthetic oligonucleotide
  Target: SCN10A; (-) strand; PAM type: YTN; PAM sequence: CTG
actccaggcatggagaagat

SEQ ID NO: 49863 - DNA, 20 bp, Artificial Sequence
  Description of Artificial Sequence: Synthetic oligonucleotide
  Target: SCN10A; (-) strand; PAM type: YTN; PAM sequence: CTC
aacccagcaaccctgactcc

SEQ ID NO: 49864 - DNA, 20 bp, Artificial Sequence
  Description of Artificial Sequence: Synthetic oligonucleotide
  Target: SCN10A; (-) strand; PAM type: YTN; PAM sequence: TTC
ctcaacccagcaaccctgac

SEQ ID NO: 49865 - DNA, 20 bp, Artificial Sequence
  Description of Artificial Sequence: Synthetic oligonucleotide
  Target: SCN10A; (-) strand; PAM type: YTN; PAM sequence: CTT
cctcaacccagcaaccctga

SEQ ID NO: 49866 - DNA, 20 bp, Artificial Sequence
  Description of Artificial Sequence: Synthetic oligonucleotide
  Target: SCN10A; (-) strand; PAM type: YTN; PAM sequence: CTC
ttcctcaacccagcaaccct

SEQ ID NO: 49867 - DNA, 20 bp, Artificial Sequence
  Description of Artificial Sequence: Synthetic oligonucleotide
  Target: SCN10A; (-) strand; PAM type: YTN; PAM sequence: CTA
gaagccctcttcctcaaccc

SEQ ID NO: 49868 - DNA, 20 bp, Artificial Sequence
  Description of Artificial Sequence: Synthetic oligonucleotide
  Target: SCN10A; (-) strand; PAM type: YTN; PAM sequence: CTC
cctagaagccctcttcctca

SEQ ID NO: 49869 - DNA, 20 bp, Artificial Sequence
  Description of Artificial Sequence: Synthetic oligonucleotide
  Target: SCN10A; (-) strand; PAM type: YTN; PAM sequence: CTG
gccagcaaggccccctccct

SEQ ID NO: 49870 - DNA, 20 bp, Artificial Sequence
  Description of Artificial Sequence: Synthetic oligonucleotide
  Target: SCN10A; (-) strand; PAM type: YTN; PAM sequence: CTG
ggtgggggtgctggccagca

SEQ ID NO: 49871 - DNA, 20 bp, Artificial Sequence
  Description of Artificial Sequence: Synthetic oligonucleotide
  Target: SCN10A; (-) strand; PAM type: YTN; PAM sequence: CTG
ctgggtgggggtgctggcca

SEQ ID NO: 49872 - DNA, 20 bp, Artificial Sequence
  Description of Artificial Sequence: Synthetic oligonucleotide
  Target: SCN10A; (-) strand; PAM type: YTN; PAM sequence: CTG
ctgctgggtgggggtgctgg

SEQ ID NO: 49873 - DNA, 20 bp, Artificial Sequence
  Description of Artificial Sequence: Synthetic oligonucleotide
  Target: SCN10A; (-) strand; PAM type: YTN; PAM sequence: CTC
tgctgctgggtgggggtgct

SEQ ID NO: 49874 - DNA, 20 bp, Artificial Sequence
  Description of Artificial Sequence: Synthetic oligonucleotide
  Target: SCN10A; (-) strand; PAM type: YTN; PAM sequence: CTC
tctgctgctgggtgggggtg

SEQ ID NO: 49875 - DNA, 20 bp, Artificial Sequence
  Description of Artificial Sequence: Synthetic oligonucleotide
  Target: SCN10A; (-) strand; PAM type: YTN; PAM sequence: CTG
gagaccacgaaagccatcgg

SEQ ID NO: 49876 - DNA, 20 bp, Artificial Sequence
  Description of Artificial Sequence: Synthetic oligonucleotide
  Target: SCN10A; (-) strand; PAM type: YTN; PAM sequence: TTC
ctggagaccacgaaagccat

SEQ ID NO: 49877 - DNA, 20 bp, Artificial Sequence
  Description of Artificial Sequence: Synthetic oligonucleotide
  Target: SCN10A; (-) strand; PAM type: YTN; PAM sequence: TTT
cctggagaccacgaaagcca

SEQ ID NO: 49878 - DNA, 20 bp, Artificial Sequence
  Description of Artificial Sequence: Synthetic oligonucleotide
  Target: SCN10A; (-) strand; PAM type: YTN; PAM sequence: CTT
tcctggagaccacgaaagcc

SEQ ID NO: 49879 - DNA, 20 bp, Artificial Sequence
  Description of Artificial Sequence: Synthetic oligonucleotide
  Target: SCN10A; (-) strand; PAM type: YTN; PAM sequence: CTG
agggagtcacagatgatgga

SEQ ID NO: 49880 - DNA, 20 bp, Artificial Sequence
  Description of Artificial Sequence: Synthetic oligonucleotide
  Target: SCN10A; (-) strand; PAM type: YTN; PAM sequence: CTC
cctgagggagtcacagatga

SEQ ID NO: 49881 - DNA, 20 bp, Artificial Sequence
  Description of Artificial Sequence: Synthetic oligonucleotide
  Target: SCN10A; (-) strand; PAM type: YTN; PAM sequence: CTC
actccctgagggagtcacag

SEQ ID NO: 49882 - DNA, 20 bp, Artificial Sequence
  Description of Artificial Sequence: Synthetic oligonucleotide
  Target: SCN10A; (-) strand; PAM type: YTN; PAM sequence: CTG
gccgagatatctcactccct

SEQ ID NO: 49883 - DNA, 20 bp, Artificial Sequence
  Description of Artificial Sequence: Synthetic oligonucleotide
  Target: SCN10A; (-) strand; PAM type: YTN; PAM sequence: TTC
cggtcccctggccgagatat

SEQ ID NO: 49884 - DNA, 20 bp, Artificial Sequence
  Description of Artificial Sequence: Synthetic oligonucleotide
  Target: SCN10A; (-) strand; PAM type: YTN; PAM sequence: TTT
ccggtcccctggccgagata

SEQ ID NO: 49885 - DNA, 20 bp, Artificial Sequence
  Description of Artificial Sequence: Synthetic oligonucleotide
  Target: SCN10A; (-) strand; PAM type: YTN; PAM sequence: TTC
catttccggtcccctggccg

SEQ ID NO: 49886 - DNA, 20 bp, Artificial Sequence
  Description of Artificial Sequence: Synthetic oligonucleotide
  Target: SCN10A; (-) strand; PAM type: YTN; PAM sequence: CTA
gtcatggcagtgtgttccat

SEQ ID NO: 49887 - DNA, 20 bp, Artificial Sequence
  Description of Artificial Sequence: Synthetic oligonucleotide
  Target: SCN10A; (-) strand; PAM type: YTN; PAM sequence: CTG
gaaaacgccgggctagtcat

SEQ ID NO: 49888 - DNA, 20 bp, Artificial Sequence
  Description of Artificial Sequence: Synthetic oligonucleotide
  Target: SCN10A; (-) strand; PAM type: YTN; PAM sequence: CTC
tggaaaacgccgggctagtc

SEQ ID NO: 49889 - DNA, 20 bp, Artificial Sequence
  Description of Artificial Sequence: Synthetic oligonucleotide
  Target: SCN10A; (-) strand; PAM type: YTN; PAM sequence: CTC
gcctctggaaaacgccgggc

SEQ ID NO: 49890 - DNA, 20 bp, Artificial Sequence
  Description of Artificial Sequence: Synthetic oligonucleotide
  Target: SCN10A; (-) strand; PAM type: YTN; PAM sequence: CTA
ggcctcgcctctggaaaacg

SEQ ID NO: 49891 - DNA, 20 bp, Artificial Sequence
  Description of Artificial Sequence: Synthetic oligonucleotide
  Target: SCN10A; (-) strand; PAM type: YTN; PAM sequence: TTC
taggcctcgcctctggaaaa

SEQ ID NO: 49892 - DNA, 20 bp, Artificial Sequence
  Description of Artificial Sequence: Synthetic oligonucleotide
  Target: SCN10A; (-) strand; PAM type: YTN; PAM sequence: TTT
ctaggcctcgcctctggaaa

SEQ ID NO: 49893 - DNA, 20 bp, Artificial Sequence
  Description of Artificial Sequence: Synthetic oligonucleotide
  Target: SCN10A; (-) strand; PAM type: YTN; PAM sequence: TTT
tctaggcctcgcctctggaa

SEQ ID NO: 49894 - DNA, 20 bp, Artificial Sequence
  Description of Artificial Sequence: Synthetic oligonucleotide
  Target: SCN10A; (-) strand; PAM type: YTN; PAM sequence: CTT
ttctaggcctcgcctctgga

SEQ ID NO: 49895 - DNA, 20 bp, Artificial Sequence
  Description of Artificial Sequence: Synthetic oligonucleotide
  Target: SCN10A; (-) strand; PAM type: YTN; PAM sequence: TTG
gggcaatgcccagtcttttc

SEQ ID NO: 49896 - DNA, 20 bp, Artificial Sequence
  Description of Artificial Sequence: Synthetic oligonucleotide
  Target: SCN10A; (-) strand; PAM type: YTN; PAM sequence: TTT
ggggcaatgcccagtctttt

SEQ ID NO: 49897 - DNA, 20 bp, Artificial Sequence
  Description of Artificial Sequence: Synthetic oligonucleotide
  Target: SCN10A; (-) strand; PAM type: YTN; PAM sequence: CTT
tggggcaatgcccagtcttt

SEQ ID NO: 49898 - DNA, 20 bp, Artificial Sequence
  Description of Artificial Sequence: Synthetic oligonucleotide
  Target: SCN10A; (-) strand; PAM type: YTN; PAM sequence: CTC
ctttggggcaatgcccagtc

SEQ ID NO: 49899 - DNA, 20 bp, Artificial Sequence
  Description of Artificial Sequence: Synthetic oligonucleotide
  Target: SCN10A; (-) strand; PAM type: YTN; PAM sequence: TTG
ctcctttggggcaatgccca

SEQ ID NO: 49900 - DNA, 20 bp, Artificial Sequence
  Description of Artificial Sequence: Synthetic oligonucleotide
  Target: SCN10A; (-) strand; PAM type: YTN; PAM sequence: CTT
gctcctttggggcaatgccc

SEQ ID NO: 49901 - DNA, 20 bp, Artificial Sequence
  Description of Artificial Sequence: Synthetic oligonucleotide
  Target: SCN10A; (-) strand; PAM type: YTN; PAM sequence: TTC
ttgctcctttggggcaatgc

SEQ ID NO: 49902 - DNA, 20 bp, Artificial Sequence
  Description of Artificial Sequence: Synthetic oligonucleotide
  Target: SCN10A; (-) strand; PAM type: YTN; PAM sequence: CTT
cttgctcctttggggcaatg

SEQ ID NO: 49903 - DNA, 20 bp, Artificial Sequence
  Description of Artificial Sequence: Synthetic oligonucleotide
  Target: SCN10A; (-) strand; PAM type: YTN; PAM sequence: TTC
cagccttcttgctcctttgg

SEQ ID NO: 49904 - DNA, 20 bp, Artificial Sequence
  Description of Artificial Sequence: Synthetic oligonucleotide
  Target: SCN10A; (-) strand; PAM type: YTN; PAM sequence: TTT
ccagccttcttgctcctttg

SEQ ID NO: 49905 - DNA, 20 bp, Artificial Sequence
  Description of Artificial Sequence: Synthetic oligonucleotide
  Target: SCN10A; (-) strand; PAM type: YTN; PAM sequence: TTC
ccagaggaccagtttccagc

SEQ ID NO: 49906 - DNA, 20 bp, Artificial Sequence
  Description of Artificial Sequence: Synthetic oligonucleotide
  Target: SCN10A; (-) strand; PAM type: YTN; PAM sequence: TTT
cccagaggaccagtttccag

SEQ ID NO: 49907 - DNA, 20 bp, Artificial Sequence
  Description of Artificial Sequence: Synthetic oligonucleotide
  Target: SCN10A; (-) strand; PAM type: YTN; PAM sequence: CTA
gatttcccagaggaccagtt

SEQ ID NO: 49908 - DNA, 20 bp, Artificial Sequence
  Description of Artificial Sequence: Synthetic oligonucleotide
  Target: SCN10A; (-) strand; PAM type: YTN; PAM sequence: CTC
tagatttcccagaggaccag

SEQ ID NO: 49909 - DNA, 20 bp, Artificial Sequence
  Description of Artificial Sequence: Synthetic oligonucleotide
  Target: SCN10A; (-) strand; PAM type: YTN; PAM sequence: TTG
ggctctagatttcccagagg

SEQ ID NO: 49910 - DNA, 20 bp, Artificial Sequence
  Description of Artificial Sequence: Synthetic oligonucleotide
  Target: SCN10A; (-) strand; PAM type: YTN; PAM sequence: CTG
aaaggtcataaagacagggg

SEQ ID NO: 49911 - DNA, 20 bp, Artificial Sequence
  Description of Artificial Sequence: Synthetic oligonucleotide
  Target: SCN10A; (-) strand; PAM type: YTN; PAM sequence: TTA
gtgactgaaaggtcataaag

SEQ ID NO: 49912 - DNA, 20 bp, Artificial Sequence
  Description of Artificial Sequence: Synthetic oligonucleotide
  Target: SCN10A; (-) strand; PAM type: YTN; PAM sequence: CTT
agtgactgaaaggtcataaa

SEQ ID NO: 49913 - DNA, 20 bp, Artificial Sequence
  Description of Artificial Sequence: Synthetic oligonucleotide
  Target: SCN10A; (-) strand; PAM type: YTN; PAM sequence: TTA
cttagtgactgaaaggtcat

SEQ ID NO: 49914 - DNA, 20 bp, Artificial Sequence
  Description of Artificial Sequence: Synthetic oligonucleotide
  Target: SCN10A; (-) strand; PAM type: YTN; PAM sequence: TTT
acttagtgactgaaaggtca

SEQ ID NO: 49915 - DNA, 20 bp, Artificial Sequence
  Description of Artificial Sequence: Synthetic oligonucleotide
  Target: SCN10A; (-) strand; PAM type: YTN; PAM sequence: CTT
tacttagtgactgaaaggtc

SEQ ID NO: 49916 - DNA, 20 bp, Artificial Sequence
  Description of Artificial Sequence: Synthetic oligonucleotide
  Target: SCN10A; (-) strand; PAM type: YTN; PAM sequence: TTG
tgcctttacttagtgactga

SEQ ID NO: 49917 - DNA, 20 bp, Artificial Sequence
  Description of Artificial Sequence: Synthetic oligonucleotide
  Target: SCN10A; (-) strand; PAM type: YTN; PAM sequence: TTT
gtgcctttacttagtgactg

SEQ ID NO: 49918 - DNA, 20 bp, Artificial Sequence
  Description of Artificial Sequence: Synthetic oligonucleotide
  Target: SCN10A; (-) strand; PAM type: YTN; PAM sequence: TTA
gatttgtgcctttacttagt

SEQ ID NO: 49919 - DNA, 20 bp, Artificial Sequence
  Description of Artificial Sequence: Synthetic oligonucleotide
  Target: SCN10A; (-) strand; PAM type: YTN; PAM sequence: CTT
agatttgtgcctttacttag

SEQ ID NO: 49920 - DNA, 20 bp, Artificial Sequence
  Description of Artificial Sequence: Synthetic oligonucleotide
  Target: SCN10A; (-) strand; PAM type: YTN; PAM sequence: CTA
gaataccccttagatttgtg

SEQ ID NO: 49921 - DNA, 20 bp, Artificial Sequence
  Description of Artificial Sequence: Synthetic oligonucleotide
  Target: SCN10A; (-) strand; PAM type: YTN; PAM sequence: TTC
cccaccatgcatacctagaa

SEQ ID NO: 49922 - DNA, 20 bp, Artificial Sequence
  Description of Artificial Sequence: Synthetic oligonucleotide
  Target: SCN10A; (-) strand; PAM type: YTN; PAM sequence: TTT
ccccaccatgcatacctaga

SEQ ID NO: 49923 - DNA, 20 bp, Artificial Sequence
  Description of Artificial Sequence: Synthetic oligonucleotide
  Target: SCN10A; (-) strand; PAM type: YTN; PAM sequence: TTT
tccccaccatgcatacctag

SEQ ID NO: 49924 - DNA, 20 bp, Artificial Sequence
  Description of Artificial Sequence: Synthetic oligonucleotide
  Target: SCN10A; (-) strand; PAM type: YTN; PAM sequence: TTT
ttccccaccatgcataccta

SEQ ID NO: 49925 - DNA, 20 bp, Artificial Sequence
  Description of Artificial Sequence: Synthetic oligonucleotide
  Target: SCN10A; (-) strand; PAM type: YTN; PAM sequence: CTT
tttccccaccatgcatacct

SEQ ID NO: 49926 - DNA, 20 bp, Artificial Sequence
  Description of Artificial Sequence: Synthetic oligonucleotide
  Target: SCN10A; (-) strand; PAM type: YTN; PAM sequence: TTC
tttttccccaccatgcatac

SEQ ID NO: 49927 - DNA, 20 bp, Artificial Sequence
  Description of Artificial Sequence: Synthetic oligonucleotide
  Target: SCN10A; (-) strand; PAM type: YTN; PAM sequence: TTT
ctttttccccaccatgcata

SEQ ID NO: 49928 - DNA, 20 bp, Artificial Sequence
  Description of Artificial Sequence: Synthetic oligonucleotide
  Target: SCN10A; (-) strand; PAM type: YTN; PAM sequence: TTT
tctttttccccaccatgcat

SEQ ID NO: 49929 - DNA, 20 bp, Artificial Sequence
  Description of Artificial Sequence: Synthetic oligonucleotide
  Target: SCN10A; (-) strand; PAM type: YTN; PAM sequence: TTT
ttctttttccccaccatgca

SEQ ID NO: 49930 - DNA, 20 bp, Artificial Sequence
  Description of Artificial Sequence: Synthetic oligonucleotide
  Target: SCN10A; (-) strand; PAM type: YTN; PAM sequence: TTT
tttctttttccccaccatgc

SEQ ID NO: 49931 - DNA, 20 bp, Artificial Sequence
  Description of Artificial Sequence: Synthetic oligonucleotide
  Target: SCN10A; (-) strand; PAM type: YTN; PAM sequence: CTT
ttttctttttccccaccatg

SEQ ID NO: 49932 - DNA, 20 bp, Artificial Sequence
  Description of Artificial Sequence: Synthetic oligonucleotide
  Target: SCN10A; (-) strand; PAM type: YTN; PAM sequence: CTC
cttttttctttttccccacc

SEQ ID NO: 49933 - DNA, 20 bp, Artificial Sequence
  Description of Artificial Sequence: Synthetic oligonucleotide
  Target: SCN10A; (-) strand; PAM type: YTN; PAM sequence: CTA
gagtctccttttttcttttt

SEQ ID NO: 49934 - DNA, 20 bp, Artificial Sequence
  Description of Artificial Sequence: Synthetic oligonucleotide
  Target: SCN10A; (-) strand; PAM type: YTN; PAM sequence: CTA
tctagagtctccttttttct

SEQ ID NO: 49935 - DNA, 20 bp, Artificial Sequence
  Description of Artificial Sequence: Synthetic oligonucleotide
  Target: SCN10A; (-) strand; PAM type: YTN; PAM sequence: TTC
ccggagtctatctagagtct

SEQ ID NO: 49936 - DNA, 20 bp, Artificial Sequence
  Description of Artificial Sequence: Synthetic oligonucleotide
  Target: SCN10A; (-) strand; PAM type: YTN; PAM sequence: TTT
cccggagtctatctagagtc

SEQ ID NO: 49937 - DNA, 20 bp, Artificial Sequence
  Description of Artificial Sequence: Synthetic oligonucleotide
  Target: SCN10A; (-) strand; PAM type: YTN; PAM sequence: CTT
tcccggagtctatctagagt

SEQ ID NO: 49938 - DNA, 20 bp, Artificial Sequence
  Description of Artificial Sequence: Synthetic oligonucleotide
  Target: SCN10A; (-) strand; PAM type: YTN; PAM sequence: CTG
gtctttcccggagtctatct

SEQ ID NO: 49939 - DNA, 20 bp, Artificial Sequence
  Description of Artificial Sequence: Synthetic oligonucleotide
  Target: SCN10A; (-) strand; PAM type: YTN; PAM sequence: CTC
ctggtctttcccggagtcta

SEQ ID NO: 49940 - DNA, 20 bp, Artificial Sequence
  Description of Artificial Sequence: Synthetic oligonucleotide
  Target: SCN10A; (-) strand; PAM type: YTN; PAM sequence: CTC
tcctggtctttcccggagtc

SEQ ID NO: 49941 - DNA, 20 bp, Artificial Sequence
  Description of Artificial Sequence: Synthetic oligonucleotide
  Target: SCN10A; (-) strand; PAM type: YTN; PAM sequence: CTC
tctcctggtctttcccggag

SEQ ID NO: 49942 - DNA, 20 bp, Artificial Sequence
  Description of Artificial Sequence: Synthetic oligonucleotide
  Target: SCN10A; (-) strand; PAM type: YTN; PAM sequence: CTC
ctctctcctggtctttcccg

SEQ ID NO: 49943 - DNA, 20 bp, Artificial Sequence
  Description of Artificial Sequence: Synthetic oligonucleotide
  Target: SCN10A; (-) strand; PAM type: YTN; PAM sequence: CTC
tcctctctcctggtctttcc

SEQ ID NO: 49944 - DNA, 20 bp, Artificial Sequence
  Description of Artificial Sequence: Synthetic oligonucleotide
  Target: SCN10A; (-) strand; PAM type: YTN; PAM sequence: CTG
taatctctcctctctcctgg

SEQ ID NO: 49945 - DNA, 20 bp, Artificial Sequence
  Description of Artificial Sequence: Synthetic oligonucleotide
  Target: SCN10A; (-) strand; PAM type: YTN; PAM sequence: CTG
agcatcagcacgctgtaatc

SEQ ID NO: 49946 - DNA, 20 bp, Artificial Sequence
  Description of Artificial Sequence: Synthetic oligonucleotide
  Target: SCN10A; (-) strand; PAM type: YTN; PAM sequence: TTG
ctgagcatcagcacgctgta

SEQ ID NO: 49947 - DNA, 20 bp, Artificial Sequence
  Description of Artificial Sequence: Synthetic oligonucleotide
  Target: SCN10A; (-) strand; PAM type: YTN; PAM sequence: TTT
gctgagcatcagcacgctgt

SEQ ID NO: 49948 - DNA, 20 bp, Artificial Sequence
  Description of Artificial Sequence: Synthetic oligonucleotide
  Target: SCN10A; (-) strand; PAM type: YTN; PAM sequence: CTA
tttgctgagcatcagcacgc

SEQ ID NO: 49949 - DNA, 20 bp, Artificial Sequence
  Description of Artificial Sequence: Synthetic oligonucleotide
  Target: SCN10A; (-) strand; PAM type: YTN; PAM sequence: CTG
accatgataacctatttgct

SEQ ID NO: 49950 - DNA, 20 bp, Artificial Sequence
  Description of Artificial Sequence: Synthetic oligonucleotide
  Target: SCN10A; (-) strand; PAM type: YTN; PAM sequence: TTC
ctgaccatgataacctattt

SEQ ID NO: 49951 - DNA, 20 bp, Artificial Sequence
  Description of Artificial Sequence: Synthetic oligonucleotide
  Target: SCN10A; (-) strand; PAM type: YTN; PAM sequence: CTG
acatgttcctgaccatgata

SEQ ID NO: 49952 - DNA, 20 bp, Artificial Sequence
  Description of Artificial Sequence: Synthetic oligonucleotide
  Target: SCN10A; (-) strand; PAM type: YTN; PAM sequence: CTC
tgacatgttcctgaccatga

SEQ ID NO: 49953 - DNA, 20 bp, Artificial Sequence
  Description of Artificial Sequence: Synthetic oligonucleotide
  Target: SCN10A; (-) strand; PAM type: YTN; PAM sequence: TTC
ctctgacatgttcctgacca

SEQ ID NO: 49954 - DNA, 20 bp, Artificial Sequence
  Description of Artificial Sequence: Synthetic oligonucleotide
  Target: SCN10A; (-) strand; PAM type: YTN; PAM sequence: TTT
cctctgacatgttcctgacc

SEQ ID NO: 49955 - DNA, 20 bp, Artificial Sequence
  Description of Artificial Sequence: Synthetic oligonucleotide
  Target: SCN10A; (-) strand; PAM type: YTN; PAM sequence: CTA
tccaggtgacaaggtttcct

SEQ ID NO: 49956 - DNA, 20 bp, Artificial Sequence
  Description of Artificial Sequence: Synthetic oligonucleotide
  Target: SCN10A; (-) strand; PAM type: YTN; PAM sequence: CTG
aactatccaggtgacaaggt

SEQ ID NO: 49957 - DNA, 20 bp, Artificial Sequence
  Description of Artificial Sequence: Synthetic oligonucleotide
  Target: SCN10A; (-) strand; PAM type: YTN; PAM sequence: TTG
gcaatcaactgaactatcca

SEQ ID NO: 49958 - DNA, 20 bp, Artificial Sequence
  Description of Artificial Sequence: Synthetic oligonucleotide
  Target: SCN10A; (-) strand; PAM type: YTN; PAM sequence: CTG
tggccaaaggttggcaatca

SEQ ID NO: 49959 - DNA, 20 bp, Artificial Sequence
  Description of Artificial Sequence: Synthetic oligonucleotide
  Target: SCN10A; (-) strand; PAM type: YTN; PAM sequence: CTA
gccctgtggccaaaggttgg

SEQ ID NO: 49960 - DNA, 20 bp, Artificial Sequence
  Description of Artificial Sequence: Synthetic oligonucleotide
  Target: SCN10A; (-) strand; PAM type: YTN; PAM sequence: TTG
tctagccctgtggccaaagg

SEQ ID NO: 49961 - DNA, 20 bp, Artificial Sequence
  Description of Artificial Sequence: Synthetic oligonucleotide
  Target: SCN10A; (-) strand; PAM type: YTN; PAM sequence: TTT
gtctagccctgtggccaaag

SEQ ID NO: 49962 - DNA, 20 bp, Artificial Sequence
  Description of Artificial Sequence: Synthetic oligonucleotide
  Target: SCN10A; (-) strand; PAM type: YTN; PAM sequence: CTT
tgtctagccctgtggccaaa

SEQ ID NO: 49963 - DNA, 20 bp, Artificial Sequence
  Description of Artificial Sequence: Synthetic oligonucleotide
  Target: SCN10A; (-) strand; PAM type: YTN; PAM sequence: TTA
ggacagctttgtctagccct

SEQ ID NO: 49964 - DNA, 20 bp, Artificial Sequence
  Description of Artificial Sequence: Synthetic oligonucleotide
  Target: SCN10A; (-) strand; PAM type: YTN; PAM sequence: CTT
aggacagctttgtctagccc

SEQ ID NO: 49965 - DNA, 20 bp, Artificial Sequence
  Description of Artificial Sequence: Synthetic oligonucleotide
  Target: SCN10A; (-) strand; PAM type: YTN; PAM sequence: TTG
catgtggaaaagtgaactta

SEQ ID NO: 49966 - DNA, 20 bp, Artificial Sequence
  Description of Artificial Sequence: Synthetic oligonucleotide
  Target: SCN10A; (-) strand; PAM type: YTN; PAM sequence: TTT
gcatgtggaaaagtgaactt

SEQ ID NO: 49967 - DNA, 20 bp, Artificial Sequence
  Description of Artificial Sequence: Synthetic oligonucleotide
  Target: SCN10A; (-) strand; PAM type: YTN; PAM sequence: CTT
tgcatgtggaaaagtgaact

SEQ ID NO: 49968 - DNA, 20 bp, Artificial Sequence
  Description of Artificial Sequence: Synthetic oligonucleotide
  Target: SCN10A; (-) strand; PAM type: YTN; PAM sequence: TTA
ggtcacaactttgcatgtgg

SEQ ID NO: 49969 - DNA, 20 bp, Artificial Sequence
  Description of Artificial Sequence: Synthetic oligonucleotide
  Target: SCN10A; (-) strand; PAM type: YTN; PAM sequence: CTT
aggtcacaactttgcatgtg

SEQ ID NO: 49970 - DNA, 20 bp, Artificial Sequence
  Description of Artificial Sequence: Synthetic oligonucleotide
  Target: SCN10A; (-) strand; PAM type: YTN; PAM sequence: CTC
cttaggtcacaactttgcat

SEQ ID NO: 49971 - DNA, 20 bp, Artificial Sequence
  Description of Artificial Sequence: Synthetic oligonucleotide
  Target: SCN10A; (-) strand; PAM type: YTN; PAM sequence: CTG
gtgtgcatagtagcctcctt

SEQ ID NO: 49972 - DNA, 20 bp, Artificial Sequence
  Description of Artificial Sequence: Synthetic oligonucleotide
  Target: SCN10A; (-) strand; PAM type: YTN; PAM sequence: TTC
cagtactggtgtgcatagta

SEQ ID NO: 49973 - DNA, 20 bp, Artificial Sequence
  Description of Artificial Sequence: Synthetic oligonucleotide
  Target: SCN10A; (-) strand; PAM type: YTN; PAM sequence: TTA
ccaagtatgttccagtactg

SEQ ID NO: 49974 - DNA, 20 bp, Artificial Sequence
  Description of Artificial Sequence: Synthetic oligonucleotide
  Target: SCN10A; (-) strand; PAM type: YTN; PAM sequence: CTT
accaagtatgttccagtact

SEQ ID NO: 49975 - DNA, 20 bp, Artificial Sequence
  Description of Artificial Sequence: Synthetic oligonucleotide
  Target: SCN10A; (-) strand; PAM type: YTN; PAM sequence: TTC
aacaaccacttaccaagtat

SEQ ID NO: 49976 - DNA, 20 bp, Artificial Sequence
  Description of Artificial Sequence: Synthetic oligonucleotide
  Target: SCN10A; (-) strand; PAM type: YTN; PAM sequence: TTC
attcaacaaccacttaccaa

SEQ ID NO: 49977 - DNA, 20 bp, Artificial Sequence
  Description of Artificial Sequence: Synthetic oligonucleotide
  Target: SCN10A; (-) strand; PAM type: YTN; PAM sequence: TTA
ttcattcaacaaccacttac

SEQ ID NO: 49978 - DNA, 20 bp, Artificial Sequence
  Description of Artificial Sequence: Synthetic oligonucleotide
  Target: SCN10A; (-) strand; PAM type: YTN; PAM sequence: CTT
attcattcaacaaccactta

SEQ ID NO: 49979 - DNA, 20 bp, Artificial Sequence
  Description of Artificial Sequence: Synthetic oligonucleotide
  Target: SCN10A; (-) strand; PAM type: YTN; PAM sequence: TTC
agacaatgaagtgcacttat

SEQ ID NO: 49980 - DNA, 20 bp, Artificial Sequence
  Description of Artificial Sequence: Synthetic oligonucleotide
  Target: SCN10A; (-) strand; PAM type: YTN; PAM sequence: TTT
cagacaatgaagtgcactta

SEQ ID NO: 49981 - DNA, 20 bp, Artificial Sequence
  Description of Artificial Sequence: Synthetic oligonucleotide
  Target: SCN10A; (-) strand; PAM type: YTN; PAM sequence: TTT
tcagacaatgaagtgcactt

SEQ ID NO: 49982 - DNA, 20 bp, Artificial Sequence
  Description of Artificial Sequence: Synthetic oligonucleotide
  Target: SCN10A; (-) strand; PAM type: YTN; PAM sequence: CTA
attttcagacaatgaagtgc

SEQ ID NO: 49983 - DNA, 20 bp, Artificial Sequence
  Description of Artificial Sequence: Synthetic oligonucleotide
  Target: SCN10A; (-) strand; PAM type: YTN; PAM sequence: CTA
cctaattttcagacaatgaa

SEQ ID NO: 49984 - DNA, 20 bp, Artificial Sequence
  Description of Artificial Sequence: Synthetic oligonucleotide
  Target: SCN10A; (-) strand; PAM type: YTN; PAM sequence: TTG
tactacctaattttcagaca

SEQ ID NO: 49985 - DNA, 20 bp, Artificial Sequence
  Description of Artificial Sequence: Synthetic oligonucleotide
  Target: SCN10A; (-) strand; PAM type: YTN; PAM sequence: CTA
atgaattgtactacctaatt

SEQ ID NO: 49986 - DNA, 20 bp, Artificial Sequence
  Description of Artificial Sequence: Synthetic oligonucleotide
  Target: SCN10A; (-) strand; PAM type: YTN; PAM sequence: TTC
atacagatgggatctaatga

SEQ ID NO: 49987 - DNA, 20 bp, Artificial Sequence
  Description of Artificial Sequence: Synthetic oligonucleotide
  Target: SCN10A; (-) strand; PAM type: YTN; PAM sequence: CTC
acattcatacagatgggatc

SEQ ID NO: 49988 - DNA, 20 bp, Artificial Sequence
  Description of Artificial Sequence: Synthetic oligonucleotide
  Target: SCN10A; (-) strand; PAM type: YTN; PAM sequence: CTC
tcacattcatacagatggga

SEQ ID NO: 49989 - DNA, 20 bp, Artificial Sequence
  Description of Artificial Sequence: Synthetic oligonucleotide
  Target: SCN10A; (-) strand; PAM type: YTN; PAM sequence: TTG
caacacaaactctcacattc

SEQ ID NO: 49990 - DNA, 20 bp, Artificial Sequence
  Description of Artificial Sequence: Synthetic oligonucleotide
  Target: SCN10A; (-) strand; PAM type: YTN; PAM sequence: TTT
gcaacacaaactctcacatt

SEQ ID NO: 49991 - DNA, 20 bp, Artificial Sequence
  Description of Artificial Sequence: Synthetic oligonucleotide
  Target: SCN10A; (-) strand; PAM type: YTN; PAM sequence: CTT
tgcaacacaaactctcacat

SEQ ID NO: 49992 - DNA, 20 bp, Artificial Sequence
  Description of Artificial Sequence: Synthetic oligonucleotide
  Target: SCN10A; (-) strand; PAM type: YTN; PAM sequence: CTC
ctttgcaacacaaactctca

SEQ ID NO: 49993 - DNA, 20 bp, Artificial Sequence
  Description of Artificial Sequence: Synthetic oligonucleotide
  Target: SCN10A; (-) strand; PAM type: YTN; PAM sequence: CTC
ctcctttgcaacacaaactc

SEQ ID NO: 49994 - DNA, 20 bp, Artificial Sequence
  Description of Artificial Sequence: Synthetic oligonucleotide
  Target: SCN10A; (-) strand; PAM type: YTN; PAM sequence: TTG
tctcctcctttgcaacacaa

SEQ ID NO: 49995 - DNA, 20 bp, Artificial Sequence
  Description of Artificial Sequence: Synthetic oligonucleotide
  Target: SCN10A; (-) strand; PAM type: YTN; PAM sequence: CTT
gtctcctcctttgcaacaca

SEQ ID NO: 49996 - DNA, 20 bp, Artificial Sequence
  Description of Artificial Sequence: Synthetic oligonucleotide
  Target: SCN10A; (-) strand; PAM type: YTN; PAM sequence: CTC
ttgtctcctcctttgcaaca

SEQ ID NO: 49997 - DNA, 20 bp, Artificial Sequence
  Description of Artificial Sequence: Synthetic oligonucleotide
  Target: SCN10A; (-) strand; PAM type: YTN; PAM sequence: CTG
tacagctcttgtctcctcct

SEQ ID NO: 49998 - DNA, 20 bp, Artificial Sequence
  Description of Artificial Sequence: Synthetic oligonucleotide
  Target: SCN10A; (-) strand; PAM type: YTN; PAM sequence: TTG
cactgtacagctcttgtctc

SEQ ID NO: 49999 - DNA, 20 bp, Artificial Sequence
  Description of Artificial Sequence: Synthetic oligonucleotide
  Target: SCN10A; (-) strand; PAM type: YTN; PAM sequence: CTC
attgcactgtacagctcttg

SEQ ID NO: 50000 - DNA, 20 bp, Artificial Sequence
  Description of Artificial Sequence: Synthetic oligonucleotide
  Target: SCN10A; (-) strand; PAM type: YTN; PAM sequence: CTA
gaaactcattgcactgtaca

SEQ ID NO: 50001 - DNA, 20 bp, Artificial Sequence
  Description of Artificial Sequence: Synthetic oligonucleotide
  Target: SCN10A; (-) strand; PAM type: YTN; PAM sequence: CTC
gagggatcctagaaactcat

SEQ ID NO: 50002 - DNA, 20 bp, Artificial Sequence
  Description of Artificial Sequence: Synthetic oligonucleotide
  Target: SCN10A; (-) strand; PAM type: YTN; PAM sequence: TTC
aagcctcgagggatcctaga

SEQ ID NO: 50003 - DNA, 20 bp, Artificial Sequence
  Description of Artificial Sequence: Synthetic oligonucleotide
  Target: SCN10A; (-) strand; PAM type: YTN; PAM sequence: CTG
ttcaagcctcgagggatcct

SEQ ID NO: 50004 - DNA, 20 bp, Artificial Sequence
  Description of Artificial Sequence: Synthetic oligonucleotide
  Target: SCN10A; (-) strand; PAM type: YTN; PAM sequence: TTG
actgttcaagcctcgaggga

SEQ ID NO: 50005 - DNA, 20 bp, Artificial Sequence
  Description of Artificial Sequence: Synthetic oligonucleotide
  Target: SCN10A; (-) strand; PAM type: YTN; PAM sequence: TTG
ttgactgttcaagcctcgag

SEQ ID NO: 50006 - DNA, 20 bp, Artificial Sequence
  Description of Artificial Sequence: Synthetic oligonucleotide
  Target: SCN10A; (-) strand; PAM type: YTN; PAM sequence: CTC
cattgttgactgttcaagcc

SEQ ID NO: 50007 - DNA, 20 bp, Artificial Sequence
  Description of Artificial Sequence: Synthetic oligonucleotide
  Target: SCN10A; (-) strand; PAM type: YTN; PAM sequence: CTC
tccattgttgactgttcaag

SEQ ID NO: 50008 - DNA, 20 bp, Artificial Sequence
  Description of Artificial Sequence: Synthetic oligonucleotide
  Target: SCN10A; (-) strand; PAM type: YTN; PAM sequence: TTC
agtctctccattgttgactg

SEQ ID NO: 50009 - DNA, 20 bp, Artificial Sequence
  Description of Artificial Sequence: Synthetic oligonucleotide
  Target: SCN10A; (-) strand; PAM type: YTN; PAM sequence: CTT
cagtctctccattgttgact

SEQ ID NO: 50010 - DNA, 20 bp, Artificial Sequence
  Description of Artificial Sequence: Synthetic oligonucleotide
  Target: SCN10A; (-) strand; PAM type: YTN; PAM sequence: TTC
cttcagtctctccattgttg

SEQ ID NO: 50011 - DNA, 20 bp, Artificial Sequence
  Description of Artificial Sequence: Synthetic oligonucleotide
  Target: SCN10A; (-) strand; PAM type: YTN; PAM sequence: CTT
ccttcagtctctccattgtt

SEQ ID NO: 50012 - DNA, 20 bp, Artificial Sequence
  Description of Artificial Sequence: Synthetic oligonucleotide
  Target: SCN10A; (-) strand; PAM type: YTN; PAM sequence: CTG
caacccttccttcagtctct

SEQ ID NO: 50013 - DNA, 20 bp, Artificial Sequence
  Description of Artificial Sequence: Synthetic oligonucleotide
  Target: SCN10A; (-) strand; PAM type: YTN; PAM sequence: TTA
ggctgcaacccttccttcag

SEQ ID NO: 50014 - DNA, 20 bp, Artificial Sequence
  Description of Artificial Sequence: Synthetic oligonucleotide
  Target: SCN10A; (-) strand; PAM type: YTN; PAM sequence: TTC
caggaaattaggctgcaacc

SEQ ID NO: 50015 - DNA, 20 bp, Artificial Sequence
  Description of Artificial Sequence: Synthetic oligonucleotide
  Target: SCN10A; (-) strand; PAM type: YTN; PAM sequence: CTT
ccaggaaattaggctgcaac

SEQ ID NO: 50016 - DNA, 20 bp, Artificial Sequence
  Description of Artificial Sequence: Synthetic oligonucleotide
  Target: SCN10A; (-) strand; PAM type: YTN; PAM sequence: TTC
ttccaggaaattaggctgca

SEQ ID NO: 50017 - DNA, 20 bp, Artificial Sequence
  Description of Artificial Sequence: Synthetic oligonucleotide
  Target: SCN10A; (-) strand; PAM type: YTN; PAM sequence: TTA
ttcttccaggaaattaggct

SEQ ID NO: 50018 - DNA, 20 bp, Artificial Sequence
  Description of Artificial Sequence: Synthetic oligonucleotide
  Target: SCN10A; (-) strand; PAM type: YTN; PAM sequence: TTG
gaggaatgacattattcttc

SEQ ID NO: 50019 - DNA, 20 bp, Artificial Sequence
  Description of Artificial Sequence: Synthetic oligonucleotide
  Target: SCN10A; (-) strand; PAM type: YTN; PAM sequence: TTT
ggaggaatgacattattctt

SEQ ID NO: 50020 - DNA, 20 bp, Artificial Sequence
  Description of Artificial Sequence: Synthetic oligonucleotide
  Target: SCN10A; (-) strand; PAM type: YTN; PAM sequence: TTG
atttggaggaatgacattat

SEQ ID NO: 50021 - DNA, 20 bp, Artificial Sequence
  Description of Artificial Sequence: Synthetic oligonucleotide
  Target: SCN10A; (-) strand; PAM type: YTN; PAM sequence: TTA
ttgatttggaggaatgacat

SEQ ID NO: 50022 - DNA, 20 bp, Artificial Sequence
  Description of Artificial Sequence: Synthetic oligonucleotide
  Target: SCN10A; (-) strand; PAM type: YTN; PAM sequence: TTT
attgatttggaggaatgaca

SEQ ID NO: 50023 - DNA, 20 bp, Artificial Sequence
  Description of Artificial Sequence: Synthetic oligonucleotide
  Target: SCN10A; (-) strand; PAM type: YTN; PAM sequence: TTG
atgggaaatgtttattgatt

SEQ ID NO: 50024 - DNA, 20 bp, Artificial Sequence
  Description of Artificial Sequence: Synthetic oligonucleotide
  Target: SCN10A; (-) strand; PAM type: YTN; PAM sequence: TTT
gatgggaaatgtttattgat

SEQ ID NO: 50025 - DNA, 20 bp, Artificial Sequence
  Description of Artificial Sequence: Synthetic oligonucleotide
  Target: SCN10A; (-) strand; PAM type: YTN; PAM sequence: TTT
tgatgggaaatgtttattga

SEQ ID NO: 50026 - DNA, 20 bp, Artificial Sequence
  Description of Artificial Sequence: Synthetic oligonucleotide
  Target: SCN10A; (-) strand; PAM type: YTN; PAM sequence: CTC
aatggaagattttgatggga

SEQ ID NO: 50027 - DNA, 20 bp, Artificial Sequence
  Description of Artificial Sequence: Synthetic oligonucleotide
  Target: SCN10A; (-) strand; PAM type: YTN; PAM sequence: TTC
cctcaatggaagattttgat

SEQ ID NO: 50028 - DNA, 20 bp, Artificial Sequence
  Description of Artificial Sequence: Synthetic oligonucleotide
  Target: SCN10A; (-) strand; PAM type: YTN; PAM sequence: TTA
agccacacagttccctcaat

SEQ ID NO: 50029 - DNA, 20 bp, Artificial Sequence
  Description of Artificial Sequence: Synthetic oligonucleotide
  Target: SCN10A; (-) strand; PAM type: YTN; PAM sequence: TTT
aagccacacagttccctcaa

SEQ ID NO: 50030 - DNA, 20 bp, Artificial Sequence
  Description of Artificial Sequence: Synthetic oligonucleotide
  Target: SCN10A; (-) strand; PAM type: YTN; PAM sequence: CTT
taagccacacagttccctca

SEQ ID NO: 50031 - DNA, 20 bp, Artificial Sequence
  Description of Artificial Sequence: Synthetic oligonucleotide
  Target: SCN10A; (-) strand; PAM type: YTN; PAM sequence: CTG
gcaactttaagccacacagt

SEQ ID NO: 50032 - DNA, 20 bp, Artificial Sequence
  Description of Artificial Sequence: Synthetic oligonucleotide
  Target: SCN10A; (-) strand; PAM type: YTN; PAM sequence: CTC
tggcaactttaagccacaca

SEQ ID NO: 50033 - DNA, 20 bp, Artificial Sequence
  Description of Artificial Sequence: Synthetic oligonucleotide
  Target: SCN10A; (-) strand; PAM type: YTN; PAM sequence: TTC
tctggcaactttaagccaca

SEQ ID NO: 50034 - DNA, 20 bp, Artificial Sequence
  Description of Artificial Sequence: Synthetic oligonucleotide
  Target: SCN10A; (-) strand; PAM type: YTN; PAM sequence: TTT
ctctggcaactttaagccac

SEQ ID NO: 50035 - DNA, 20 bp, Artificial Sequence
  Description of Artificial Sequence: Synthetic oligonucleotide
  Target: SCN10A; (-) strand; PAM type: YTN; PAM sequence: TTT
tctctggcaactttaagcca

SEQ ID NO: 50036 - DNA, 20 bp, Artificial Sequence
  Description of Artificial Sequence: Synthetic oligonucleotide
  Target: SCN10A; (-) strand; PAM type: YTN; PAM sequence: CTT
ttctctggcaactttaagcc

SEQ ID NO: 50037 - DNA, 20 bp, Artificial Sequence
  Description of Artificial Sequence: Synthetic oligonucleotide
  Target: SCN10A; (-) strand; PAM type: YTN; PAM sequence: CTC
ttttctctggcaactttaag

SEQ ID NO: 50038 - DNA, 20 bp, Artificial Sequence
  Description of Artificial Sequence: Synthetic oligonucleotide
  Target: SCN10A; (-) strand; PAM type: YTN; PAM sequence: TTA
gctcttttctctggcaactt

SEQ ID NO: 50039 - DNA, 20 bp, Artificial Sequence
  Description of Artificial Sequence: Synthetic oligonucleotide
  Target: SCN10A; (-) strand; PAM type: YTN; PAM sequence: TTA
tgaattagctcttttctctg

SEQ ID NO: 50040 - DNA, 20 bp, Artificial Sequence
  Description of Artificial Sequence: Synthetic oligonucleotide
  Target: SCN10A; (-) strand; PAM type: YTN; PAM sequence: TTT
atgaattagctcttttctct

SEQ ID NO: 50041 - DNA, 20 bp, Artificial Sequence
  Description of Artificial Sequence: Synthetic oligonucleotide
  Target: SCN10A; (-) strand; PAM type: YTN; PAM sequence: CTG
ggtttatgaattagctcttt

SEQ ID NO: 50042 - DNA, 20 bp, Artificial Sequence
  Description of Artificial Sequence: Synthetic oligonucleotide
  Target: SCN10A; (-) strand; PAM type: YTN; PAM sequence: CTC
tgggtttatgaattagctct

SEQ ID NO: 50043 - DNA, 20 bp, Artificial Sequence
  Description of Artificial Sequence: Synthetic oligonucleotide
  Target: SCN10A; (-) strand; PAM type: YTN; PAM sequence: CTG
agggctctgggtttatgaat

SEQ ID NO: 50044 - DNA, 20 bp, Artificial Sequence
  Description of Artificial Sequence: Synthetic oligonucleotide
  Target: SCN10A; (-) strand; PAM type: YTN; PAM sequence: CTC
tgagggctctgggtttatga

SEQ ID NO: 50045 - DNA, 20 bp, Artificial Sequence
  Description of Artificial Sequence: Synthetic oligonucleotide
  Target: SCN10A; (-) strand; PAM type: YTN; PAM sequence: TTC
tctgagggctctgggtttat

SEQ ID NO: 50046 - DNA, 20 bp, Artificial Sequence
  Description of Artificial Sequence: Synthetic oligonucleotide
  Target: SCN10A; (-) strand; PAM type: YTN; PAM sequence: CTA
attctctgagggctctgggt

SEQ ID NO: 50047 - DNA, 20 bp, Artificial Sequence
  Description of Artificial Sequence: Synthetic oligonucleotide
  Target: SCN10A; (-) strand; PAM type: YTN; PAM sequence: CTA
acccagcacactaattctct

SEQ ID NO: 50048 - DNA, 20 bp, Artificial Sequence
  Description of Artificial Sequence: Synthetic oligonucleotide
  Target: SCN10A; (-) strand; PAM type: YTN; PAM sequence: CTA
cctaacccagcacactaatt

SEQ ID NO: 50049 - DNA, 20 bp, Artificial Sequence
  Description of Artificial Sequence: Synthetic oligonucleotide
  Target: SCN10A; (-) strand; PAM type: YTN; PAM sequence: CTA
tggtcatgggaactacctaa

SEQ ID NO: 50050 - DNA, 20 bp, Artificial Sequence
  Description of Artificial Sequence: Synthetic oligonucleotide
  Target: SCN10A; (-) strand; PAM type: YTN; PAM sequence: TTC
actatggtcatgggaactac

SEQ ID NO: 50051 - DNA, 20 bp, Artificial Sequence
  Description of Artificial Sequence: Synthetic oligonucleotide
  Target: SCN10A; (-) strand; PAM type: YTN; PAM sequence: TTT
cactatggtcatgggaacta

SEQ ID NO: 50052 - DNA, 20 bp, Artificial Sequence
  Description of Artificial Sequence: Synthetic oligonucleotide
  Target: SCN10A; (-) strand; PAM type: YTN; PAM sequence: TTA
tggtcaagtttcactatggt

SEQ ID NO: 50053 - DNA, 20 bp, Artificial Sequence
  Description of Artificial Sequence: Synthetic oligonucleotide
  Target: SCN10A; (-) strand; PAM type: YTN; PAM sequence: TTA
ttatggtcaagtttcactat

SEQ ID NO: 50054 - DNA, 20 bp, Artificial Sequence
  Description of Artificial Sequence: Synthetic oligonucleotide
  Target: SCN10A; (-) strand; PAM type: YTN; PAM sequence: TTT
attatggtcaagtttcacta

SEQ ID NO: 50055 - DNA, 20 bp, Artificial Sequence
  Description of Artificial Sequence: Synthetic oligonucleotide
  Target: SCN10A; (-) strand; PAM type: YTN; PAM sequence: CTG
aggacacaaatgatggttta

SEQ ID NO: 50056 - DNA, 20 bp, Artificial Sequence
  Description of Artificial Sequence: Synthetic oligonucleotide
  Target: SCN10A; (-) strand; PAM type: YTN; PAM sequence: CTA
tagaccacctgaggacacaa

SEQ ID NO: 50057 - DNA, 20 bp, Artificial Sequence
  Description of Artificial Sequence: Synthetic oligonucleotide
  Target: SCN10A; (-) strand; PAM type: YTN; PAM sequence: TTG
tacatactatagaccacctg

SEQ ID NO: 50058 - DNA, 20 bp, Artificial Sequence
  Description of Artificial Sequence: Synthetic oligonucleotide
  Target: SCN10A; (-) strand; PAM type: YTN; PAM sequence: TTT
gtacatactatagaccacct

SEQ ID NO: 50059 - DNA, 20 bp, Artificial Sequence
  Description of Artificial Sequence: Synthetic oligonucleotide
  Target: SCN10A; (-) strand; PAM type: YTN; PAM sequence: TTT
tgtacatactatagaccacc

SEQ ID NO: 50060 - DNA, 20 bp, Artificial Sequence
  Description of Artificial Sequence: Synthetic oligonucleotide
  Target: SCN10A; (-) strand; PAM type: YTN; PAM sequence: TTA
gattttgtacatactataga

SEQ ID NO: 50061 - DNA, 20 bp, Artificial Sequence
  Description of Artificial Sequence: Synthetic oligonucleotide
  Target: SCN10A; (-) strand; PAM type: YTN; PAM sequence: TTT
agattttgtacatactatag

SEQ ID NO: 50062 - DNA, 20 bp, Artificial Sequence
  Description of Artificial Sequence: Synthetic oligonucleotide
  Target: SCN10A; (-) strand; PAM type: YTN; PAM sequence: TTG
gtatgaagtcaatgtttaga

SEQ ID NO: 50063 - DNA, 20 bp, Artificial Sequence
  Description of Artificial Sequence: Synthetic oligonucleotide
  Target: SCN10A; (-) strand; PAM type: YTN; PAM sequence: TTT
ggtatgaagtcaatgtttag

SEQ ID NO: 50064 - DNA, 20 bp, Artificial Sequence
  Description of Artificial Sequence: Synthetic oligonucleotide
  Target: SCN10A; (-) strand; PAM type: YTN; PAM sequence: TTA
aggaaggtgagtggaataaa

SEQ ID NO: 50065 - DNA, 20 bp, Artificial Sequence
  Description of Artificial Sequence: Synthetic oligonucleotide
  Target: SCN10A; (-) strand; PAM type: YTN; PAM sequence: TTA
gtaataaaaaggagttaagg

SEQ ID NO: 50066 - DNA, 20 bp, Artificial Sequence
  Description of Artificial Sequence: Synthetic oligonucleotide
  Target: SCN10A; (-) strand; PAM type: YTN; PAM sequence: CTT
agtaataaaaaggagttaag

SEQ ID NO: 50067 - DNA, 20 bp, Artificial Sequence
  Description of Artificial Sequence: Synthetic oligonucleotide
  Target: SCN10A; (-) strand; PAM type: YTN; PAM sequence: TTA
gtagcttagtaataaaaagg

SEQ ID NO: 50068 - DNA, 20 bp, Artificial Sequence
  Description of Artificial Sequence: Synthetic oligonucleotide
  Target: SCN10A; (-) strand; PAM type: YTN; PAM sequence: TTT
agtagcttagtaataaaaag

SEQ ID NO: 50069 - DNA, 20 bp, Artificial Sequence
  Description of Artificial Sequence: Synthetic oligonucleotide
  Target: SCN10A; (-) strand; PAM type: YTN; PAM sequence: CTT
tagtagcttagtaataaaaa

SEQ ID NO: 50070 - DNA, 20 bp, Artificial Sequence
  Description of Artificial Sequence: Synthetic oligonucleotide
  Target: SCN10A; (-) strand; PAM type: YTN; PAM sequence: CTC
cactttagtagcttagtaat

SEQ ID NO: 50071 - DNA, 20 bp, Artificial Sequence
  Description of Artificial Sequence: Synthetic oligonucleotide
  Target: SCN10A; (-) strand; PAM type: YTN; PAM sequence: TTC
tccactttagtagcttagta

SEQ ID NO: 50072 - DNA, 20 bp, Artificial Sequence
  Description of Artificial Sequence: Synthetic oligonucleotide
  Target: SCN10A; (-) strand; PAM type: YTN; PAM sequence: TTG
gcaagattctccactttagt

SEQ ID NO: 50073 - DNA, 20 bp, Artificial Sequence
  Description of Artificial Sequence: Synthetic oligonucleotide
  Target: SCN10A; (-) strand; PAM type: YTN; PAM sequence: TTA
gtaaggagaaccccaattgg

SEQ ID NO: 50074 - DNA, 20 bp, Artificial Sequence
  Description of Artificial Sequence: Synthetic oligonucleotide
  Target: SCN10A; (-) strand; PAM type: YTN; PAM sequence: CTG
tgagataaggggattagtaa

SEQ ID NO: 50075 - DNA, 20 bp, Artificial Sequence
  Description of Artificial Sequence: Synthetic oligonucleotide
  Target: SCN10A; (-) strand; PAM type: YTN; PAM sequence: TTC
tgtgagataaggggattagt

SEQ ID NO: 50076 - DNA, 20 bp, Artificial Sequence
  Description of Artificial Sequence: Synthetic oligonucleotide
  Target: SCN10A; (-) strand; PAM type: YTN; PAM sequence: TTC
agttctgtgagataagggga

SEQ ID NO: 50077 - DNA, 20 bp, Artificial Sequence
  Description of Artificial Sequence: Synthetic oligonucleotide
  Target: SCN10A; (-) strand; PAM type: YTN; PAM sequence: CTT
cagttctgtgagataagggg

SEQ ID NO: 50078 - DNA, 20 bp, Artificial Sequence
  Description of Artificial Sequence: Synthetic oligonucleotide
  Target: SCN10A; (-) strand; PAM type: YTN; PAM sequence: TTA
tcaagagaggaaacttcagt

SEQ ID NO: 50079 - DNA, 20 bp, Artificial Sequence
  Description of Artificial Sequence: Synthetic oligonucleotide
  Target: SCN10A; (-) strand; PAM type: YTN; PAM sequence: TTC
aaattatcaagagaggaaac

SEQ ID NO: 50080 - DNA, 20 bp, Artificial Sequence
  Description of Artificial Sequence: Synthetic oligonucleotide
  Target: SCN10A; (-) strand; PAM type: YTN; PAM sequence: CTT
caaattatcaagagaggaaa

SEQ ID NO: 50081 - DNA, 20 bp, Artificial Sequence
  Description of Artificial Sequence: Synthetic oligonucleotide
  Target: SCN10A; (-) strand; PAM type: YTN; PAM sequence: CTA
aacaggatcaggcttcaaat

SEQ ID NO: 50082 - DNA, 20 bp, Artificial Sequence
  Description of Artificial Sequence: Synthetic oligonucleotide
  Target: SCN10A; (-) strand; PAM type: YTN; PAM sequence: TTG
ctaaacaggatcaggcttca

SEQ ID NO: 50083 - DNA, 20 bp, Artificial Sequence
  Description of Artificial Sequence: Synthetic oligonucleotide
  Target: SCN10A; (-) strand; PAM type: YTN; PAM sequence: TTA
ataatggttgctaaacagga

SEQ ID NO: 50084 - DNA, 20 bp, Artificial Sequence
  Description of Artificial Sequence: Synthetic oligonucleotide
  Target: SCN10A; (-) strand; PAM type: YTN; PAM sequence: TTT
aataatggttgctaaacagg

SEQ ID NO: 50085 - DNA, 20 bp, Artificial Sequence
  Description of Artificial Sequence: Synthetic oligonucleotide
  Target: SCN10A; (-) strand; PAM type: YTN; PAM sequence: TTT
taataatggttgctaaacag

SEQ ID NO: 50086 - DNA, 20 bp, Artificial Sequence
  Description of Artificial Sequence: Synthetic oligonucleotide
  Target: SCN10A; (-) strand; PAM type: YTN; PAM sequence: CTT
ttaataatggttgctaaaca

SEQ ID NO: 50087 - DNA, 20 bp, Artificial Sequence
  Description of Artificial Sequence: Synthetic oligonucleotide
  Target: SCN10A; (-) strand; PAM type: YTN; PAM sequence: CTG
agcttttaataatggttgct

SEQ ID NO: 50088 - DNA, 20 bp, Artificial Sequence
  Description of Artificial Sequence: Synthetic oligonucleotide
  Target: SCN10A; (-) strand; PAM type: YTN; PAM sequence: TTA
taatactgagcttttaataa

SEQ ID NO: 50089 - DNA, 20 bp, Artificial Sequence
  Description of Artificial Sequence: Synthetic oligonucleotide
  Target: SCN10A; (-) strand; PAM type: YTN; PAM sequence: TTT
ataatactgagcttttaata

SEQ ID NO: 50090 - DNA, 20 bp, Artificial Sequence
  Description of Artificial Sequence: Synthetic oligonucleotide
  Target: SCN10A; (-) strand; PAM type: YTN; PAM sequence: CTA
tttataatactgagctttta

SEQ ID NO: 50091 - DNA, 20 bp, Artificial Sequence
  Description of Artificial Sequence: Synthetic oligonucleotide
  Target: SCN10A; (-) strand; PAM type: YTN; PAM sequence: CTC
tatttataatactgagcttt

SEQ ID NO: 50092 - DNA, 20 bp, Artificial Sequence
  Description of Artificial Sequence: Synthetic oligonucleotide
  Target: SCN10A; (-) strand; PAM type: YTN; PAM sequence: TTA
caggcagagagtactctatt

SEQ ID NO: 50093 - DNA, 20 bp, Artificial Sequence
  Description of Artificial Sequence: Synthetic oligonucleotide
  Target: SCN10A; (-) strand; PAM type: YTN; PAM sequence: TTG
ggcatgtattacaggcagag

SEQ ID NO: 50094 - DNA, 20 bp, Artificial Sequence
  Description of Artificial Sequence: Synthetic oligonucleotide
  Target: SCN10A; (-) strand; PAM type: YTN; PAM sequence: CTT
gggcatgtattacaggcaga

SEQ ID NO: 50095 - DNA, 20 bp, Artificial Sequence
  Description of Artificial Sequence: Synthetic oligonucleotide
  Target: SCN10A; (-) strand; PAM type: YTN; PAM sequence: CTA
tagtccttgggcatgtatta

SEQ ID NO: 50096 - DNA, 20 bp, Artificial Sequence
  Description of Artificial Sequence: Synthetic oligonucleotide
  Target: SCN10A; (-) strand; PAM type: YTN; PAM sequence: TTC
tatagtccttgggcatgtat

SEQ ID NO: 50097 - DNA, 20 bp, Artificial Sequence
  Description of Artificial Sequence: Synthetic oligonucleotide
  Target: SCN10A; (-) strand; PAM type: YTN; PAM sequence: TTA
tgagttctatagtccttggg

SEQ ID NO: 50098 - DNA, 20 bp, Artificial Sequence
  Description of Artificial Sequence: Synthetic oligonucleotide
  Target: SCN10A; (-) strand; PAM type: YTN; PAM sequence: TTT
atgagttctatagtccttgg

SEQ ID NO: 50099 - DNA, 20 bp, Artificial Sequence
  Description of Artificial Sequence: Synthetic oligonucleotide
  Target: SCN10A; (-) strand; PAM type: YTN; PAM sequence: TTT
tatgagttctatagtccttg

SEQ ID NO: 50100 - DNA, 20 bp, Artificial Sequence
  Description of Artificial Sequence: Synthetic oligonucleotide
  Target: SCN10A; (-) strand; PAM type: YTN; PAM sequence: TTG
cattttatgagttctatagt

SEQ ID NO: 50101 - DNA, 20 bp, Artificial Sequence
  Description of Artificial Sequence: Synthetic oligonucleotide
  Target: SCN10A; (-) strand; PAM type: YTN; PAM sequence: TTT
gcattttatgagttctatag

SEQ ID NO: 50102 - DNA, 20 bp, Artificial Sequence
  Description of Artificial Sequence: Synthetic oligonucleotide
  Target: SCN10A; (-) strand; PAM type: YTN; PAM sequence: TTT
tgcattttatgagttctata

SEQ ID NO: 50103 - DNA, 20 bp, Artificial Sequence
  Description of Artificial Sequence: Synthetic oligonucleotide
  Target: SCN10A; (-) strand; PAM type: YTN; PAM sequence: TTT
ttgcattttatgagttctat

SEQ ID NO: 50104 - DNA, 20 bp, Artificial Sequence
  Description of Artificial Sequence: Synthetic oligonucleotide
  Target: SCN10A; (-) strand; PAM type: YTN; PAM sequence: TTG
gaaggatttttgcattttat

SEQ ID NO: 50105 - DNA, 20 bp, Artificial Sequence
  Description of Artificial Sequence: Synthetic oligonucleotide
  Target: SCN10A; (-) strand; PAM type: YTN; PAM sequence: TTC
aaaaattggaaggatttttg

SEQ ID NO: 50106 - DNA, 20 bp, Artificial Sequence
  Description of Artificial Sequence: Synthetic oligonucleotide
  Target: SCN10A; (-) strand; PAM type: YTN; PAM sequence: CTT
caaaaattggaaggattttt

SEQ ID NO: 50107 - DNA, 20 bp, Artificial Sequence
  Description of Artificial Sequence: Synthetic oligonucleotide
  Target: SCN10A; (-) strand; PAM type: YTN; PAM sequence: TTG
cttcaaaaattggaaggatt

SEQ ID NO: 50108 - DNA, 20 bp, Artificial Sequence
  Description of Artificial Sequence: Synthetic oligonucleotide
  Target: SCN10A; (-) strand; PAM type: YTN; PAM sequence: TTT
gcttcaaaaattggaaggat

SEQ ID NO: 50109 - DNA, 20 bp, Artificial Sequence
  Description of Artificial Sequence: Synthetic oligonucleotide
  Target: SCN10A; (-) strand; PAM type: YTN; PAM sequence: CTC
atttgcttcaaaaattggaa

SEQ ID NO: 50110 - DNA, 20 bp, Artificial Sequence
  Description of Artificial Sequence: Synthetic oligonucleotide
  Target: SCN10A; (-) strand; PAM type: YTN; PAM sequence: TTC
tcatttgcttcaaaaattgg

SEQ ID NO: 50111 - DNA, 20 bp, Artificial Sequence
  Description of Artificial Sequence: Synthetic oligonucleotide
  Target: SCN10A; (-) strand; PAM type: YTN; PAM sequence: TTT
ctcatttgcttcaaaaattg

SEQ ID NO: 50112 - DNA, 20 bp, Artificial Sequence
  Description of Artificial Sequence: Synthetic oligonucleotide
  Target: SCN10A; (-) strand; PAM type: YTN; PAM sequence: TTT
tctcatttgcttcaaaaatt

SEQ ID NO: 50113 - DNA, 20 bp, Artificial Sequence
  Description of Artificial Sequence: Synthetic oligonucleotide
  Target: SCN10A; (-) strand; PAM type: YTN; PAM sequence: TTT
ttctcatttgcttcaaaaat

SEQ ID NO: 50114 - DNA, 20 bp, Artificial Sequence
  Description of Artificial Sequence: Synthetic oligonucleotide
  Target: SCN10A; (-) strand; PAM type: YTN; PAM sequence: TTA
atatggatgtgtcaattttt

SEQ ID NO: 50115 - DNA, 20 bp, Artificial Sequence
  Description of Artificial Sequence: Synthetic oligonucleotide
  Target: SCN10A; (-) strand; PAM type: YTN; PAM sequence: CTT
aatatggatgtgtcaatttt

SEQ ID NO: 50116 - DNA, 20 bp, Artificial Sequence
  Description of Artificial Sequence: Synthetic oligonucleotide
  Target: SCN10A; (-) strand; PAM type: YTN; PAM sequence: TTC
cttaatatggatgtgtcaat

SEQ ID NO: 50117 - DNA, 20 bp, Artificial Sequence
  Description of Artificial Sequence: Synthetic oligonucleotide
  Target: SCN10A; (-) strand; PAM type: YTN; PAM sequence: CTT
ccttaatatggatgtgtcaa

SEQ ID NO: 50118 - DNA, 20 bp, Artificial Sequence
  Description of Artificial Sequence: Synthetic oligonucleotide
  Target: SCN10A; (-) strand; PAM type: YTN; PAM sequence: TTC
ccttccttaatatggatgtg

SEQ ID NO: 50119 - DNA, 20 bp, Artificial Sequence
  Description of Artificial Sequence: Synthetic oligonucleotide
  Target: SCN10A; (-) strand; PAM type: YTN; PAM sequence: CTC
aagtgcaaataatgtagtat

SEQ ID NO: 50120 - DNA, 20 bp, Artificial Sequence
  Description of Artificial Sequence: Synthetic oligonucleotide
  Target: SCN10A; (-) strand; PAM type: YTN; PAM sequence: TTG
gtgctcaagtgcaaataatg

SEQ ID NO: 50121 - DNA, 20 bp, Artificial Sequence
  Description of Artificial Sequence: Synthetic oligonucleotide
  Target: SCN10A; (-) strand; PAM type: YTN; PAM sequence: CTT
ggtgctcaagtgcaaataat

SEQ ID NO: 50122 - DNA, 20 bp, Artificial Sequence
  Description of Artificial Sequence: Synthetic oligonucleotide
  Target: SCN10A; (-) strand; PAM type: YTN; PAM sequence: TTG
cttggtgctcaagtgcaaat

SEQ ID NO: 50123 - DNA, 20 bp, Artificial Sequence
  Description of Artificial Sequence: Synthetic oligonucleotide
  Target: SCN10A; (-) strand; PAM type: YTN; PAM sequence: TTT
gcttggtgctcaagtgcaaa

SEQ ID NO: 50124 - DNA, 20 bp, Artificial Sequence
  Description of Artificial Sequence: Synthetic oligonucleotide
  Target: SCN10A; (-) strand; PAM type: YTN; PAM sequence: TTG
gtttgcttggtgctcaagtg

SEQ ID NO: 50125 - DNA, 20 bp, Artificial Sequence
  Description of Artificial Sequence: Synthetic oligonucleotide
  Target: SCN10A; (-) strand; PAM type: YTN; PAM sequence: TTC
attggtttgcttggtgctca

SEQ ID NO: 50126 - DNA, 20 bp, Artificial Sequence
  Description of Artificial Sequence: Synthetic oligonucleotide
  Target: SCN10A; (-) strand; PAM type: YTN; PAM sequence: CTT
cattggtttgcttggtgctc

SEQ ID NO: 50127 - DNA, 20 bp, Artificial Sequence
  Description of Artificial Sequence: Synthetic oligonucleotide
  Target: SCN10A; (-) strand; PAM type: YTN; PAM sequence: TTC
ttcattggtttgcttggtgc

SEQ ID NO: 50128 - DNA, 20 bp, Artificial Sequence
  Description of Artificial Sequence: Synthetic oligonucleotide
  Target: SCN10A; (-) strand; PAM type: YTN; PAM sequence: TTT
cttcattggtttgcttggtg

SEQ ID NO: 50129 - DNA, 20 bp, Artificial Sequence
  Description of Artificial Sequence: Synthetic oligonucleotide
  Target: SCN10A; (-) strand; PAM type: YTN; PAM sequence: CTC
agtttcttcattggtttgct

SEQ ID NO: 50130 - DNA, 20 bp, Artificial Sequence
  Description of Artificial Sequence: Synthetic oligonucleotide
  Target: SCN10A; (-) strand; PAM type: YTN; PAM sequence: TTC
tcagtttcttcattggtttg

SEQ ID NO: 50131 - DNA, 20 bp, Artificial Sequence
  Description of Artificial Sequence: Synthetic oligonucleotide
  Target: SCN10A; (-) strand; PAM type: YTN; PAM sequence: CTT
ctcagtttcttcattggttt

SEQ ID NO: 50132 - DNA, 20 bp, Artificial Sequence
  Description of Artificial Sequence: Synthetic oligonucleotide
  Target: SCN10A; (-) strand; PAM type: YTN; PAM sequence: TTC
ttctcagtttcttcattggt

SEQ ID NO: 50133 - DNA, 20 bp, Artificial Sequence
  Description of Artificial Sequence: Synthetic oligonucleotide
  Target: SCN10A; (-) strand; PAM type: YTN; PAM sequence: TTT
cttctcagtttcttcattgg

SEQ ID NO: 50134 - DNA, 20 bp, Artificial Sequence
  Description of Artificial Sequence: Synthetic oligonucleotide
  Target: SCN10A; (-) strand; PAM type: YTN; PAM sequence: TTT
tcttctcagtttcttcattg

SEQ ID NO: 50135 - DNA, 20 bp, Artificial Sequence
  Description of Artificial Sequence: Synthetic oligonucleotide
  Target: SCN10A; (-) strand; PAM type: YTN; PAM sequence: CTG
tcaaatatgcaaccaaaatt

SEQ ID NO: 50136 - DNA, 20 bp, Artificial Sequence
  Description of Artificial Sequence: Synthetic oligonucleotide
  Target: SCN10A; (-) strand; PAM type: YTN; PAM sequence: CTG
ctgtcaaatatgcaaccaaa

SEQ ID NO: 50137 - DNA, 20 bp, Artificial Sequence
  Description of Artificial Sequence: Synthetic oligonucleotide
  Target: SCN10A; (-) strand; PAM type: YTN; PAM sequence: CTC
gtggccaaggagacactgct

SEQ ID NO: 50138 - DNA, 20 bp, Artificial Sequence
  Description of Artificial Sequence: Synthetic oligonucleotide
  Target: SCN10A; (-) strand; PAM type: YTN; PAM sequence: CTA
aaataactcgtggccaagga

SEQ ID NO: 50139 - DNA, 20 bp, Artificial Sequence
  Description of Artificial Sequence: Synthetic oligonucleotide
  Target: SCN10A; (-) strand; PAM type: YTN; PAM sequence: TTC
taaaataactcgtggccaag

SEQ ID NO: 50140 - DNA, 20 bp, Artificial Sequence
  Description of Artificial Sequence: Synthetic oligonucleotide
  Target: SCN10A; (-) strand; PAM type: YTN; PAM sequence: TTA
attctaaaataactcgtggc

SEQ ID NO: 50141 - DNA, 20 bp, Artificial Sequence
  Description of Artificial Sequence: Synthetic oligonucleotide
  Target: SCN10A; (-) strand; PAM type: YTN; PAM sequence: CTT
aattctaaaataactcgtgg

SEQ ID NO: 50142 - DNA, 20 bp, Artificial Sequence
  Description of Artificial Sequence: Synthetic oligonucleotide
  Target: SCN10A; (-) strand; PAM type: YTN; PAM sequence: TTG
tcaaaaccttaattctaaaa

SEQ ID NO: 50143 - DNA, 20 bp, Artificial Sequence
  Description of Artificial Sequence: Synthetic oligonucleotide
  Target: SCN10A; (-) strand; PAM type: YTN; PAM sequence: TTT
gtcaaaaccttaattctaaa

SEQ ID NO: 50144 - DNA, 20 bp, Artificial Sequence
  Description of Artificial Sequence: Synthetic oligonucleotide
  Target: SCN10A; (-) strand; PAM type: YTN; PAM sequence: TTG
cccaccatttgtcaaaacct

SEQ ID NO: 50145 - DNA, 20 bp, Artificial Sequence
  Description of Artificial Sequence: Synthetic oligonucleotide
  Target: SCN10A; (-) strand; PAM type: YTN; PAM sequence: CTC
agaagacattgcccaccatt

SEQ ID NO: 50146 - DNA, 20 bp, Artificial Sequence
  Description of Artificial Sequence: Synthetic oligonucleotide
  Target: SCN10A; (-) strand; PAM type: YTN; PAM sequence: TTA
tactcagaagacattgccca

SEQ ID NO: 50147 - DNA, 20 bp, Artificial Sequence
  Description of Artificial Sequence: Synthetic oligonucleotide
  Target: SCN10A; (-) strand; PAM type: YTN; PAM sequence: CTT
atactcagaagacattgccc

SEQ ID NO: 50148 - DNA, 20 bp, Artificial Sequence
  Description of Artificial Sequence: Synthetic oligonucleotide
  Target: SCN10A; (-) strand; PAM type: YTN; PAM sequence: CTA
atgcttatactcagaagaca

SEQ ID NO: 50149 - DNA, 20 bp, Artificial Sequence
  Description of Artificial Sequence: Synthetic oligonucleotide
  Target: SCN10A; (-) strand; PAM type: YTN; PAM sequence: TTC
taatgcttatactcagaaga

SEQ ID NO: 50150 - DNA, 20 bp, Artificial Sequence
  Description of Artificial Sequence: Synthetic oligonucleotide
  Target: SCN10A; (-) strand; PAM type: YTN; PAM sequence: TTA
aagcaattctaatgcttata

SEQ ID NO: 50151 - DNA, 20 bp, Artificial Sequence
  Description of Artificial Sequence: Synthetic oligonucleotide
  Target: SCN10A; (-) strand; PAM type: YTN; PAM sequence: TTT
aaagcaattctaatgcttat

SEQ ID NO: 50152 - DNA, 20 bp, Artificial Sequence
  Description of Artificial Sequence: Synthetic oligonucleotide
  Target: SCN10A; (-) strand; PAM type: YTN; PAM sequence: TTT
taaagcaattctaatgctta

SEQ ID NO: 50153 - DNA, 20 bp, Artificial Sequence
  Description of Artificial Sequence: Synthetic oligonucleotide
  Target: SCN10A; (-) strand; PAM type: YTN; PAM sequence: TTA
gaggatgaattttaaagcaa

SEQ ID NO: 50154 - DNA, 20 bp, Artificial Sequence
  Description of Artificial Sequence: Synthetic oligonucleotide
  Target: SCN10A; (-) strand; PAM type: YTN; PAM sequence: CTC
gttagaggatgaattttaaa

SEQ ID NO: 50155 - DNA, 20 bp, Artificial Sequence
  Description of Artificial Sequence: Synthetic oligonucleotide
  Target: SCN10A; (-) strand; PAM type: YTN; PAM sequence: TTG
gtctcgttagaggatgaatt

SEQ ID NO: 50156 - DNA, 20 bp, Artificial Sequence
  Description of Artificial Sequence: Synthetic oligonucleotide
  Target: SCN10A; (-) strand; PAM type: YTN; PAM sequence: TTG
tggaaaatcacagaccagtt

SEQ ID NO: 50157 - DNA, 20 bp, Artificial Sequence
  Description of Artificial Sequence: Synthetic oligonucleotide
  Target: SCN10A; (-) strand; PAM type: YTN; PAM sequence: TTT
gtggaaaatcacagaccagt

SEQ ID NO: 50158 - DNA, 20 bp, Artificial Sequence
  Description of Artificial Sequence: Synthetic oligonucleotide
  Target: SCN10A; (-) strand; PAM type: YTN; PAM sequence: TTT
tgtggaaaatcacagaccag

SEQ ID NO: 50159 - DNA, 20 bp, Artificial Sequence
  Description of Artificial Sequence: Synthetic oligonucleotide
  Target: SCN10A; (-) strand; PAM type: YTN; PAM sequence: TTT
ttgtggaaaatcacagacca

SEQ ID NO: 50160 - DNA, 20 bp, Artificial Sequence
  Description of Artificial Sequence: Synthetic oligonucleotide
  Target: SCN10A; (-) strand; PAM type: YTN; PAM sequence: TTA
aatagaggaatatatagaag

SEQ ID NO: 50161 - DNA, 20 bp, Artificial Sequence
  Description of Artificial Sequence: Synthetic oligonucleotide
  Target: SCN10A; (-) strand; PAM type: YTN; PAM sequence: TTA
taaccaatagaaattaaata

SEQ ID NO: 50162 - DNA, 20 bp, Artificial Sequence
  Description of Artificial Sequence: Synthetic oligonucleotide
  Target: SCN10A; (-) strand; PAM type: YTN; PAM sequence: TTT
ataaccaatagaaattaaat

SEQ ID NO: 50163 - DNA, 20 bp, Artificial Sequence
  Description of Artificial Sequence: Synthetic oligonucleotide
  Target: SCN10A; (-) strand; PAM type: YTN; PAM sequence: TTT
tataaccaatagaaattaaa

SEQ ID NO: 50164 - DNA, 20 bp, Artificial Sequence
  Description of Artificial Sequence: Synthetic oligonucleotide
  Target: SCN10A; (-) strand; PAM type: YTN; PAM sequence: CTA
aagccattttataaccaata

SEQ ID NO: 50165 - DNA, 20 bp, Artificial Sequence
  Description of Artificial Sequence: Synthetic oligonucleotide
  Target: SCN10A; (-) strand; PAM type: YTN; PAM sequence: TTA
tctaaagccattttataacc

SEQ ID NO: 50166 - DNA, 20 bp, Artificial Sequence
  Description of Artificial Sequence: Synthetic oligonucleotide
  Target: SCN10A; (-) strand; PAM type: YTN; PAM sequence: TTT
atctaaagccattttataac

SEQ ID NO: 50167 - DNA, 20 bp, Artificial Sequence
  Description of Artificial Sequence: Synthetic oligonucleotide
  Target: SCN10A; (-) strand; PAM type: YTN; PAM sequence: TTT
tatctaaagccattttataa

SEQ ID NO: 50168 - DNA, 20 bp, Artificial Sequence
  Description of Artificial Sequence: Synthetic oligonucleotide
  Target: SCN10A; (-) strand; PAM type: YTN; PAM sequence: TTT
ttatctaaagccattttata

SEQ ID NO: 50169 - DNA, 20 bp, Artificial Sequence
  Description of Artificial Sequence: Synthetic oligonucleotide
  Target: SCN10A; (-) strand; PAM type: YTN; PAM sequence: CTA
atgcagtttttatctaaagc

SEQ ID NO: 50170 - DNA, 20 bp, Artificial Sequence
  Description of Artificial Sequence: Synthetic oligonucleotide
  Target: SCN10A; (-) strand; PAM type: YTN; PAM sequence: TTC
atgtggtaaatagacctaat

SEQ ID NO: 50171 - DNA, 20 bp, Artificial Sequence
  Description of Artificial Sequence: Synthetic oligonucleotide
  Target: SCN10A; (-) strand; PAM type: YTN; PAM sequence: TTC
ccaggtacattcatgtggta

SEQ ID NO: 50172 - DNA, 20 bp, Artificial Sequence
  Description of Artificial Sequence: Synthetic oligonucleotide
  Target: SCN10A; (-) strand; PAM type: YTN; PAM sequence: TTT
cccaggtacattcatgtggt

SEQ ID NO: 50173 - DNA, 20 bp, Artificial Sequence
  Description of Artificial Sequence: Synthetic oligonucleotide
  Target: SCN10A; (-) strand; PAM type: YTN; PAM sequence: TTT
tcccaggtacattcatgtgg

SEQ ID NO: 50174 - DNA, 20 bp, Artificial Sequence
  Description of Artificial Sequence: Synthetic oligonucleotide
  Target: SCN10A; (-) strand; PAM type: YTN; PAM sequence: CTT
ttcccaggtacattcatgtg

SEQ ID NO: 50175 - DNA, 20 bp, Artificial Sequence
  Description of Artificial Sequence: Synthetic oligonucleotide
  Target: SCN10A; (-) strand; PAM type: YTN; PAM sequence: CTC
ttttcccaggtacattcatg

SEQ ID NO: 50176 - DNA, 20 bp, Artificial Sequence
  Description of Artificial Sequence: Synthetic oligonucleotide
  Target: SCN10A; (-) strand; PAM type: YTN; PAM sequence: CTC
cctcttttcccaggtacatt

SEQ ID NO: 50177 - DNA, 20 bp, Artificial Sequence
  Description of Artificial Sequence: Synthetic oligonucleotide
  Target: SCN10A; (-) strand; PAM type: YTN; PAM sequence: CTC
tccctcttttcccaggtaca

SEQ ID NO: 50178 - DNA, 20 bp, Artificial Sequence
  Description of Artificial Sequence: Synthetic oligonucleotide
  Target: SCN10A; (-) strand; PAM type: YTN; PAM sequence: CTC
aggaaggcatcctctccctc

SEQ ID NO: 50179 - DNA, 20 bp, Artificial Sequence
  Description of Artificial Sequence: Synthetic oligonucleotide
  Target: SCN10A; (-) strand; PAM type: YTN; PAM sequence: TTG
gagcccactcaggaaggcat

SEQ ID NO: 50180 - DNA, 20 bp, Artificial Sequence
  Description of Artificial Sequence: Synthetic oligonucleotide
  Target: SCN10A; (-) strand; PAM type: YTN; PAM sequence: TTA
ttggagcccactcaggaagg

SEQ ID NO: 50181 - DNA, 20 bp, Artificial Sequence
  Description of Artificial Sequence: Synthetic oligonucleotide
  Target: SCN10A; (-) strand; PAM type: YTN; PAM sequence: TTT
attggagcccactcaggaag

SEQ ID NO: 50182 - DNA, 20 bp, Artificial Sequence
  Description of Artificial Sequence: Synthetic oligonucleotide
  Target: SCN10A; (-) strand; PAM type: YTN; PAM sequence: TTG
atttattggagcccactcag

SEQ ID NO: 50183 - DNA, 20 bp, Artificial Sequence
  Description of Artificial Sequence: Synthetic oligonucleotide
  Target: SCN10A; (-) strand; PAM type: YTN; PAM sequence: CTA
attgatttattggagcccac

SEQ ID NO: 50184 - DNA, 20 bp, Artificial Sequence
  Description of Artificial Sequence: Synthetic oligonucleotide
  Target: SCN10A; (-) strand; PAM type: YTN; PAM sequence: TTA
atgctaattgatttattgga

SEQ ID NO: 50185 - DNA, 20 bp, Artificial Sequence
  Description of Artificial Sequence: Synthetic oligonucleotide
  Target: SCN10A; (-) strand; PAM type: YTN; PAM sequence: TTT
aatgctaattgatttattgg

SEQ ID NO: 50186 - DNA, 20 bp, Artificial Sequence
  Description of Artificial Sequence: Synthetic oligonucleotide
  Target: SCN10A; (-) strand; PAM type: YTN; PAM sequence: CTT
taatgctaattgatttattg

SEQ ID NO: 50187 - DNA, 20 bp, Artificial Sequence
  Description of Artificial Sequence: Synthetic oligonucleotide
  Target: SCN10A; (-) strand; PAM type: YTN; PAM sequence: TTC
tttaatgctaattgatttat

SEQ ID NO: 50188 - DNA, 20 bp, Artificial Sequence
  Description of Artificial Sequence: Synthetic oligonucleotide
  Target: SCN10A; (-) strand; PAM type: YTN; PAM sequence: CTT
ctttaatgctaattgattta

SEQ ID NO: 50189 - DNA, 20 bp, Artificial Sequence
  Description of Artificial Sequence: Synthetic oligonucleotide
  Target: SCN10A; (-) strand; PAM type: YTN; PAM sequence: TTA
agtacttctttaatgctaat

SEQ ID NO: 50190 - DNA, 20 bp, Artificial Sequence
  Description of Artificial Sequence: Synthetic oligonucleotide
  Target: SCN10A; (-) strand; PAM type: YTN; PAM sequence: TTT
aagtacttctttaatgctaa

SEQ ID NO: 50191 - DNA, 20 bp, Artificial Sequence
  Description of Artificial Sequence: Synthetic oligonucleotide
  Target: SCN10A; (-) strand; PAM type: YTN; PAM sequence: CTG
gcagaaagaacaacatgtat

SEQ ID NO: 50192 - DNA, 20 bp, Artificial Sequence
  Description of Artificial Sequence: Synthetic oligonucleotide
  Target: SCN10A; (-) strand; PAM type: YTN; PAM sequence: TTC
ctggcagaaagaacaacatg

SEQ ID NO: 50193 - DNA, 20 bp, Artificial Sequence
  Description of Artificial Sequence: Synthetic oligonucleotide
  Target: SCN10A; (-) strand; PAM type: YTN; PAM sequence: TTT
cctggcagaaagaacaacat

SEQ ID NO: 50194 - DNA, 20 bp, Artificial Sequence
  Description of Artificial Sequence: Synthetic oligonucleotide
  Target: SCN10A; (-) strand; PAM type: YTN; PAM sequence: TTT
tcctggcagaaagaacaaca

SEQ ID NO: 50195 - DNA, 20 bp, Artificial Sequence
  Description of Artificial Sequence: Synthetic oligonucleotide
  Target: SCN10A; (-) strand; PAM type: YTN; PAM sequence: TTG
gggaggagtattttcctggc

SEQ ID NO: 50196 - DNA, 20 bp, Artificial Sequence
  Description of Artificial Sequence: Synthetic oligonucleotide
  Target: SCN10A; (-) strand; PAM type: YTN; PAM sequence: TTT
ggggaggagtattttcctgg

SEQ ID NO: 50197 - DNA, 20 bp, Artificial Sequence
  Description of Artificial Sequence: Synthetic oligonucleotide
  Target: SCN10A; (-) strand; PAM type: YTN; PAM sequence: TTG
agagagtttggggaggagta

SEQ ID NO: 50198 - DNA, 20 bp, Artificial Sequence
  Description of Artificial Sequence: Synthetic oligonucleotide
  Target: SCN10A; (-) strand; PAM type: YTN; PAM sequence: CTT
gagagagtttggggaggagt

SEQ ID NO: 50199 - DNA, 20 bp, Artificial Sequence
  Description of Artificial Sequence: Synthetic oligonucleotide
  Target: SCN10A; (-) strand; PAM type: YTN; PAM sequence: TTG
aagacttgagagagtttggg

SEQ ID NO: 50200 - DNA, 20 bp, Artificial Sequence
  Description of Artificial Sequence: Synthetic oligonucleotide
  Target: SCN10A; (-) strand; PAM type: YTN; PAM sequence: CTA
gtaattgaagacttgagaga

SEQ ID NO: 50201 - DNA, 20 bp, Artificial Sequence
  Description of Artificial Sequence: Synthetic oligonucleotide
  Target: SCN10A; (-) strand; PAM type: YTN; PAM sequence: TTC
tagtaattgaagacttgaga

SEQ ID NO: 50202 - DNA, 20 bp, Artificial Sequence
  Description of Artificial Sequence: Synthetic oligonucleotide
  Target: SCN10A; (-) strand; PAM type: YTN; PAM sequence: CTT
ctagtaattgaagacttgag

SEQ ID NO: 50203 - DNA, 20 bp, Artificial Sequence
  Description of Artificial Sequence: Synthetic oligonucleotide
  Target: SCN10A; (-) strand; PAM type: YTN; PAM sequence: TTC
ttctagtaattgaagacttg

SEQ ID NO: 50204 - DNA, 20 bp, Artificial Sequence
  Description of Artificial Sequence: Synthetic oligonucleotide
  Target: SCN10A; (-) strand; PAM type: YTN; PAM sequence: TTG
ggatcaacaataaatagcat

SEQ ID NO: 50205 - DNA, 20 bp, Artificial Sequence
  Description of Artificial Sequence: Synthetic oligonucleotide
  Target: SCN10A; (-) strand; PAM type: YTN; PAM sequence: CTG
gaggaaggcataattgggat

SEQ ID NO: 50206 - DNA, 20 bp, Artificial Sequence
  Description of Artificial Sequence: Synthetic oligonucleotide
  Target: SCN10A; (-) strand; PAM type: YTN; PAM sequence: TTC
ctggaggaaggcataattgg

SEQ ID NO: 50207 - DNA, 20 bp, Artificial Sequence
  Description of Artificial Sequence: Synthetic oligonucleotide
  Target: SCN10A; (-) strand; PAM type: YTN; PAM sequence: CTT
cctggaggaaggcataattg

SEQ ID NO: 50208 - DNA, 20 bp, Artificial Sequence
  Description of Artificial Sequence: Synthetic oligonucleotide
  Target: SCN10A; (-) strand; PAM type: YTN; PAM sequence: CTG
gataggtatcagaaaaggct

SEQ ID NO: 50209 - DNA, 20 bp, Artificial Sequence
  Description of Artificial Sequence: Synthetic oligonucleotide
  Target: SCN10A; (-) strand; PAM type: YTN; PAM sequence: TTA
tggggctggataggtatcag

SEQ ID NO: 50210 - DNA, 20 bp, Artificial Sequence
  Description of Artificial Sequence: Synthetic oligonucleotide
  Target: SCN10A; (-) strand; PAM type: YTN; PAM sequence: CTT
atggggctggataggtatca

SEQ ID NO: 50211 - DNA, 20 bp, Artificial Sequence
  Description of Artificial Sequence: Synthetic oligonucleotide
  Target: SCN10A; (-) strand; PAM type: YTN; PAM sequence: CTC
ttatggggctggataggtat

SEQ ID NO: 50212 - DNA, 20 bp, Artificial Sequence
  Description of Artificial Sequence: Synthetic oligonucleotide
  Target: SCN10A; (-) strand; PAM type: YTN; PAM sequence: TTG
agaatcagggaagaaacatc

SEQ ID NO: 50213 - DNA, 20 bp, Artificial Sequence
  Description of Artificial Sequence: Synthetic oligonucleotide
  Target: SCN10A; (-) strand; PAM type: YTN; PAM sequence: TTT
gagaatcagggaagaaacat

SEQ ID NO: 50214 - DNA, 20 bp, Artificial Sequence
  Description of Artificial Sequence: Synthetic oligonucleotide
  Target: SCN10A; (-) strand; PAM type: YTN; PAM sequence: TTT
tgagaatcagggaagaaaca

SEQ ID NO: 50215 - DNA, 20 bp, Artificial Sequence
  Description of Artificial Sequence: Synthetic oligonucleotide
  Target: SCN10A; (-) strand; PAM type: YTN; PAM sequence: TTA
gagacacatacatggtgttt

SEQ ID NO: 50216 - DNA, 20 bp, Artificial Sequence
  Description of Artificial Sequence: Synthetic oligonucleotide
  Target: SCN10A; (-) strand; PAM type: YTN; PAM sequence: TTA
aatagtgtattagagacaca

SEQ ID NO: 50217 - DNA, 20 bp, Artificial Sequence
  Description of Artificial Sequence: Synthetic oligonucleotide
  Target: SCN10A; (-) strand; PAM type: YTN; PAM sequence: CTA
tgtgttaaatagtgtattag

SEQ ID NO: 50218 - DNA, 20 bp, Artificial Sequence
  Description of Artificial Sequence: Synthetic oligonucleotide
  Target: SCN10A; (-) strand; PAM type: YTN; PAM sequence: TTG
ggtggaggaggcagatataa

SEQ ID NO: 50219 - DNA, 20 bp, Artificial Sequence
  Description of Artificial Sequence: Synthetic oligonucleotide
  Target: SCN10A; (-) strand; PAM type: YTN; PAM sequence: TTT
gggtggaggaggcagatata

SEQ ID NO: 50220 - DNA, 20 bp, Artificial Sequence
  Description of Artificial Sequence: Synthetic oligonucleotide
  Target: SCN10A; (-) strand; PAM type: YTN; PAM sequence: TTC
catttgggtggaggaggcag

SEQ ID NO: 50221 - DNA, 20 bp, Artificial Sequence
  Description of Artificial Sequence: Synthetic oligonucleotide
  Target: SCN10A; (-) strand; PAM type: YTN; PAM sequence: TTT
ccatttgggtggaggaggca

SEQ ID NO: 50222 - DNA, 20 bp, Artificial Sequence
  Description of Artificial Sequence: Synthetic oligonucleotide
  Target: SCN10A; (-) strand; PAM type: YTN; PAM sequence: CTA
aggatttccatttgggtgga

SEQ ID NO: 50223 - DNA, 20 bp, Artificial Sequence
  Description of Artificial Sequence: Synthetic oligonucleotide
  Target: SCN10A; (-) strand; PAM type: YTN; PAM sequence: TTC
cctaaggatttccatttggg

SEQ ID NO: 50224 - DNA, 20 bp, Artificial Sequence
  Description of Artificial Sequence: Synthetic oligonucleotide
  Target: SCN10A; (-) strand; PAM type: YTN; PAM sequence: TTT
ccctaaggatttccatttgg

SEQ ID NO: 50225 - DNA, 20 bp, Artificial Sequence
  Description of Artificial Sequence: Synthetic oligonucleotide
  Target: SCN10A; (-) strand; PAM type: YTN; PAM sequence: TTT
tccctaaggatttccatttg

SEQ ID NO: 50226 - DNA, 20 bp, Artificial Sequence
  Description of Artificial Sequence: Synthetic oligonucleotide
  Target: SCN10A; (-) strand; PAM type: YTN; PAM sequence: CTT
ttccctaaggatttccattt

SEQ ID NO: 50227 - DNA, 20 bp, Artificial Sequence
  Description of Artificial Sequence: Synthetic oligonucleotide
  Target: SCN10A; (-) strand; PAM type: YTN; PAM sequence: TTC
ttttccctaaggatttccat

SEQ ID NO: 50228 - DNA, 20 bp, Artificial Sequence
  Description of Artificial Sequence: Synthetic oligonucleotide
  Target: SCN10A; (-) strand; PAM type: YTN; PAM sequence: CTA
gaacatgttcttttccctaa

SEQ ID NO: 50229 - DNA, 20 bp, Artificial Sequence
  Description of Artificial Sequence: Synthetic oligonucleotide
  Target: SCN10A; (-) strand; PAM type: YTN; PAM sequence: TTG
gtataaagagatgactagaa

SEQ ID NO: 50230 - DNA, 20 bp, Artificial Sequence
  Description of Artificial Sequence: Synthetic oligonucleotide
  Target: SCN10A; (-) strand; PAM type: YTN; PAM sequence: CTT
ggtataaagagatgactaga

SEQ ID NO: 50231 - DNA, 20 bp, Artificial Sequence
  Description of Artificial Sequence: Synthetic oligonucleotide
  Target: SCN10A; (-) strand; PAM type: YTN; PAM sequence: CTA
ggtgcttggtataaagagat

SEQ ID NO: 50232 - DNA, 20 bp, Artificial Sequence
  Description of Artificial Sequence: Synthetic oligonucleotide
  Target: SCN10A; (-) strand; PAM type: YTN; PAM sequence: TTC
aacaatactaggtgcttggt

SEQ ID NO: 50233 - DNA, 20 bp, Artificial Sequence
  Description of Artificial Sequence: Synthetic oligonucleotide
  Target: SCN10A; (-) strand; PAM type: YTN; PAM sequence: TTC
attcaacaatactaggtgct

SEQ ID NO: 50234 - DNA, 20 bp, Artificial Sequence
  Description of Artificial Sequence: Synthetic oligonucleotide
  Target: SCN10A; (-) strand; PAM type: YTN; PAM sequence: TTG
ttcattcaacaatactaggt

SEQ ID NO: 50235 - DNA, 20 bp, Artificial Sequence
  Description of Artificial Sequence: Synthetic oligonucleotide
  Target: SCN10A; (-) strand; PAM type: YTN; PAM sequence: CTT
gttcattcaacaatactagg

SEQ ID NO: 50236 - DNA, 20 bp, Artificial Sequence
  Description of Artificial Sequence: Synthetic oligonucleotide
  Target: SCN10A; (-) strand; PAM type: YTN; PAM sequence: CTG
taacttgttcattcaacaat

SEQ ID NO: 50237 - DNA, 20 bp, Artificial Sequence
  Description of Artificial Sequence: Synthetic oligonucleotide
  Target: SCN10A; (-) strand; PAM type: YTN; PAM sequence: TTC
aaagggaaaaaagaggagct

SEQ ID NO: 50238 - DNA, 20 bp, Artificial Sequence
  Description of Artificial Sequence: Synthetic oligonucleotide
  Target: SCN10A; (-) strand; PAM type: YTN; PAM sequence: TTT
caaagggaaaaaagaggagc

SEQ ID NO: 50239 - DNA, 20 bp, Artificial Sequence
  Description of Artificial Sequence: Synthetic oligonucleotide
  Target: SCN10A; (-) strand; PAM type: YTN; PAM sequence: CTT
tcaaagggaaaaaagaggag

SEQ ID NO: 50240 - DNA, 20 bp, Artificial Sequence
  Description of Artificial Sequence: Synthetic oligonucleotide
  Target: SCN10A; (-) strand; PAM type: YTN; PAM sequence: TTA
ctttcaaagggaaaaaagag

SEQ ID NO: 50241 - DNA, 20 bp, Artificial Sequence
  Description of Artificial Sequence: Synthetic oligonucleotide
  Target: SCN10A; (-) strand; PAM type: YTN; PAM sequence: CTT
actttcaaagggaaaaaaga

SEQ ID NO: 50242 - DNA, 20 bp, Artificial Sequence
  Description of Artificial Sequence: Synthetic oligonucleotide
  Target: SCN10A; (-) strand; PAM type: YTN; PAM sequence: CTC
cagtgatgcttactttcaaa

SEQ ID NO: 50243 - DNA, 20 bp, Artificial Sequence
  Description of Artificial Sequence: Synthetic oligonucleotide
  Target: SCN10A; (-) strand; PAM type: YTN; PAM sequence: CTC
tccagtgatgcttactttca

SEQ ID NO: 50244 - DNA, 20 bp, Artificial Sequence
  Description of Artificial Sequence: Synthetic oligonucleotide
  Target: SCN10A; (-) strand; PAM type: YTN; PAM sequence: TTG
tctctccagtgatgcttact

SEQ ID NO: 50245 - DNA, 20 bp, Artificial Sequence
  Description of Artificial Sequence: Synthetic oligonucleotide
  Target: SCN10A; (-) strand; PAM type: YTN; PAM sequence: CTT
gtctctccagtgatgcttac

SEQ ID NO: 50246 - DNA, 20 bp, Artificial Sequence
  Description of Artificial Sequence: Synthetic oligonucleotide
  Target: SCN10A; (-) strand; PAM type: YTN; PAM sequence: TTG
gtatgtgtgcttgtctctcc

SEQ ID NO: 50247 - DNA, 20 bp, Artificial Sequence
  Description of Artificial Sequence: Synthetic oligonucleotide
  Target: SCN10A; (-) strand; PAM type: YTN; PAM sequence: TTG
gatgtccaataattggtatg

SEQ ID NO: 50248 - DNA, 20 bp, Artificial Sequence
  Description of Artificial Sequence: Synthetic oligonucleotide
  Target: SCN10A; (-) strand; PAM type: YTN; PAM sequence: CTT
ggatgtccaataattggtat

SEQ ID NO: 50249 - DNA, 20 bp, Artificial Sequence
  Description of Artificial Sequence: Synthetic oligonucleotide
  Target: SCN10A; (-) strand; PAM type: YTN; PAM sequence: TTA
gcacttggatgtccaataat

SEQ ID NO: 50250 - DNA, 20 bp, Artificial Sequence
  Description of Artificial Sequence: Synthetic oligonucleotide
  Target: SCN10A; (-) strand; PAM type: YTN; PAM sequence: CTG
tcagccccacacagattagc

SEQ ID NO: 50251 - DNA, 20 bp, Artificial Sequence
  Description of Artificial Sequence: Synthetic oligonucleotide
  Target: SCN10A; (-) strand; PAM type: YTN; PAM sequence: TTC
tgtcagccccacacagatta

SEQ ID NO: 50252 - DNA, 20 bp, Artificial Sequence
  Description of Artificial Sequence: Synthetic oligonucleotide
  Target: SCN10A; (-) strand; PAM type: YTN; PAM sequence: TTC
ccccattctgtcagccccac

SEQ ID NO: 50253 - DNA, 20 bp, Artificial Sequence
  Description of Artificial Sequence: Synthetic oligonucleotide
  Target: SCN10A; (-) strand; PAM type: YTN; PAM sequence: TTT
cccccattctgtcagcccca

SEQ ID NO: 50254 - DNA, 20 bp, Artificial Sequence
  Description of Artificial Sequence: Synthetic oligonucleotide
  Target: SCN10A; (-) strand; PAM type: YTN; PAM sequence: TTA
atttcccccattctgtcagc

SEQ ID NO: 50255 - DNA, 20 bp, Artificial Sequence
  Description of Artificial Sequence: Synthetic oligonucleotide
  Target: SCN10A; (-) strand; PAM type: YTN; PAM sequence: TTT
aatttcccccattctgtcag

SEQ ID NO: 50256 - DNA, 20 bp, Artificial Sequence
  Description of Artificial Sequence: Synthetic oligonucleotide
  Target: SCN10A; (-) strand; PAM type: YTN; PAM sequence: CTT
taatttcccccattctgtca

SEQ ID NO: 50257 - DNA, 20 bp, Artificial Sequence
  Description of Artificial Sequence: Synthetic oligonucleotide
  Target: SCN10A; (-) strand; PAM type: YTN; PAM sequence: TTG
ggctttaatttcccccattc

SEQ ID NO: 50258 - DNA, 20 bp, Artificial Sequence
  Description of Artificial Sequence: Synthetic oligonucleotide
  Target: SCN10A; (-) strand; PAM type: YTN; PAM sequence: CTG
aattgggctttaatttcccc

SEQ ID NO: 50259 - DNA, 20 bp, Artificial Sequence
  Description of Artificial Sequence: Synthetic oligonucleotide
  Target: SCN10A; (-) strand; PAM type: YTN; PAM sequence: TTC
catggaaatgtcaatgacac

SEQ ID NO: 50260 - DNA, 20 bp, Artificial Sequence
  Description of Artificial Sequence: Synthetic oligonucleotide
  Target: SCN10A; (-) strand; PAM type: YTN; PAM sequence: CTT
ccatggaaatgtcaatgaca

SEQ ID NO: 50261 - DNA, 20 bp, Artificial Sequence
  Description of Artificial Sequence: Synthetic oligonucleotide
  Target: SCN10A; (-) strand; PAM type: YTN; PAM sequence: TTC
agacaatcacagaacaggat

SEQ ID NO: 50262 - DNA, 20 bp, Artificial Sequence
  Description of Artificial Sequence: Synthetic oligonucleotide
  Target: SCN10A; (-) strand; PAM type: YTN; PAM sequence: CTG
gcatacatggggcacagttc

SEQ ID NO: 50263 - DNA, 20 bp, Artificial Sequence
  Description of Artificial Sequence: Synthetic oligonucleotide
  Target: SCN10A; (-) strand; PAM type: YTN; PAM sequence: TTG
agcagcacctggcatacatg

SEQ ID NO: 50264 - DNA, 20 bp, Artificial Sequence
  Description of Artificial Sequence: Synthetic oligonucleotide
  Target: SCN10A; (-) strand; PAM type: YTN; PAM sequence: TTT
gagcagcacctggcatacat

SEQ ID NO: 50265 - DNA, 20 bp, Artificial Sequence
  Description of Artificial Sequence: Synthetic oligonucleotide
  Target: SCN10A; (-) strand; PAM type: YTN; PAM sequence: TTT
tgagcagcacctggcataca

SEQ ID NO: 50266 - DNA, 20 bp, Artificial Sequence
  Description of Artificial Sequence: Synthetic oligonucleotide
  Target: SCN10A; (-) strand; PAM type: YTN; PAM sequence: CTT
ttgagcagcacctggcatac

SEQ ID NO: 50267 - DNA, 20 bp, Artificial Sequence
  Description of Artificial Sequence: Synthetic oligonucleotide
  Target: SCN10A; (-) strand; PAM type: YTN; PAM sequence: TTG
ccccttttgagcagcacctg

SEQ ID NO: 50268 - DNA, 20 bp, Artificial Sequence
  Description of Artificial Sequence: Synthetic oligonucleotide
  Target: SCN10A; (-) strand; PAM type: YTN; PAM sequence: TTT
gccccttttgagcagcacct

SEQ ID NO: 50269 - DNA, 20 bp, Artificial Sequence
  Description of Artificial Sequence: Synthetic oligonucleotide
  Target: SCN10A; (-) strand; PAM type: YTN; PAM sequence: CTT
tgccccttttgagcagcacc

SEQ ID NO: 50270 - DNA, 20 bp, Artificial Sequence
  Description of Artificial Sequence: Synthetic oligonucleotide
  Target: SCN10A; (-) strand; PAM type: YTN; PAM sequence: TTG
ctttgccccttttgagcagc

SEQ ID NO: 50271 - DNA, 20 bp, Artificial Sequence
  Description of Artificial Sequence: Synthetic oligonucleotide
  Target: SCN10A; (-) strand; PAM type: YTN; PAM sequence: CTT
gctttgccccttttgagcag

SEQ ID NO: 50272 - DNA, 20 bp, Artificial Sequence
  Description of Artificial Sequence: Synthetic oligonucleotide
  Target: SCN10A; (-) strand; PAM type: YTN; PAM sequence: TTC
ttgctttgccccttttgagc

SEQ ID NO: 50273 - DNA, 20 bp, Artificial Sequence
  Description of Artificial Sequence: Synthetic oligonucleotide
  Target: SCN10A; (-) strand; PAM type: YTN; PAM sequence: TTT
cttgctttgccccttttgag

SEQ ID NO: 50274 - DNA, 20 bp, Artificial Sequence
  Description of Artificial Sequence: Synthetic oligonucleotide
  Target: SCN10A; (-) strand; PAM type: YTN; PAM sequence: CTT
tcttgctttgccccttttga

SEQ ID NO: 50275 - DNA, 20 bp, Artificial Sequence
  Description of Artificial Sequence: Synthetic oligonucleotide
  Target: SCN10A; (-) strand; PAM type: YTN; PAM sequence: CTC
tttcttgctttgcccctttt

SEQ ID NO: 50276 - DNA, 20 bp, Artificial Sequence
  Description of Artificial Sequence: Synthetic oligonucleotide
  Target: SCN10A; (-) strand; PAM type: YTN; PAM sequence: CTC
ctctttcttgctttgcccct

SEQ ID NO: 50277 - DNA, 20 bp, Artificial Sequence
  Description of Artificial Sequence: Synthetic oligonucleotide
  Target: SCN10A; (-) strand; PAM type: YTN; PAM sequence: CTG
tgccctcctctttcttgctt

SEQ ID NO: 50278 - DNA, 20 bp, Artificial Sequence
  Description of Artificial Sequence: Synthetic oligonucleotide
  Target: SCN10A; (-) strand; PAM type: YTN; PAM sequence: CTG
catctgtgccctcctctttc

SEQ ID NO: 50279 - DNA, 20 bp, Artificial Sequence
  Description of Artificial Sequence: Synthetic oligonucleotide
  Target: SCN10A; (-) strand; PAM type: YTN; PAM sequence: TTA
tctgcatctgtgccctcctc

SEQ ID NO: 50280 - DNA, 20 bp, Artificial Sequence
  Description of Artificial Sequence: Synthetic oligonucleotide
  Target: SCN10A; (-) strand; PAM type: YTN; PAM sequence: TTT
atctgcatctgtgccctcct

SEQ ID NO: 50281 - DNA, 20 bp, Artificial Sequence
  Description of Artificial Sequence: Synthetic oligonucleotide
  Target: SCN10A; (-) strand; PAM type: YTN; PAM sequence: TTC
agcatttatctgcatctgtg

SEQ ID NO: 50282 - DNA, 20 bp, Artificial Sequence
  Description of Artificial Sequence: Synthetic oligonucleotide
  Target: SCN10A; (-) strand; PAM type: YTN; PAM sequence: CTT
cagcatttatctgcatctgt

SEQ ID NO: 50283 - DNA, 20 bp, Artificial Sequence
  Description of Artificial Sequence: Synthetic oligonucleotide
  Target: SCN10A; (-) strand; PAM type: YTN; PAM sequence: CTC
atgacacatccacacttcag

SEQ ID NO: 50284 - DNA, 20 bp, Artificial Sequence
  Description of Artificial Sequence: Synthetic oligonucleotide
  Target: SCN10A; (-) strand; PAM type: YTN; PAM sequence: CTG
acctcatgacacatccacac

SEQ ID NO: 50285 - DNA, 20 bp, Artificial Sequence
  Description of Artificial Sequence: Synthetic oligonucleotide
  Target: SCN10A; (-) strand; PAM type: YTN; PAM sequence: TTG
catgcacactgacctcatga

SEQ ID NO: 50286 - DNA, 20 bp, Artificial Sequence
  Description of Artificial Sequence: Synthetic oligonucleotide
  Target: SCN10A; (-) strand; PAM type: YTN; PAM sequence: CTT
gcatgcacactgacctcatg

SEQ ID NO: 50287 - DNA, 20 bp, Artificial Sequence
  Description of Artificial Sequence: Synthetic oligonucleotide
  Target: SCN10A; (-) strand; PAM type: YTN; PAM sequence: TTA
tgtgtgcatatacaaacaca

SEQ ID NO: 50288 - DNA, 20 bp, Artificial Sequence
  Description of Artificial Sequence: Synthetic oligonucleotide
  Target: SCN10A; (-) strand; PAM type: YTN; PAM sequence: TTT
atgtgtgcatatacaaacac

SEQ ID NO: 50289 - DNA, 20 bp, Artificial Sequence
  Description of Artificial Sequence: Synthetic oligonucleotide
  Target: SCN10A; (-) strand; PAM type: YTN; PAM sequence: CTC
agatttatgtgtgcatatac

SEQ ID NO: 50290 - DNA, 20 bp, Artificial Sequence
  Description of Artificial Sequence: Synthetic oligonucleotide
  Target: SCN10A; (-) strand; PAM type: YTN; PAM sequence: CTC
caaccctcagatttatgtgt

SEQ ID NO: 50291 - DNA, 20 bp, Artificial Sequence
  Description of Artificial Sequence: Synthetic oligonucleotide
  Target: SCN10A; (-) strand; PAM type: YTN; PAM sequence: CTC
tccaaccctcagatttatgt

SEQ ID NO: 50292 - DNA, 20 bp, Artificial Sequence
  Description of Artificial Sequence: Synthetic oligonucleotide
  Target: SCN10A; (-) strand; PAM type: YTN; PAM sequence: TTG
caataccatctctccaaccc

SEQ ID NO: 50293 - DNA, 20 bp, Artificial Sequence
  Description of Artificial Sequence: Synthetic oligonucleotide
  Target: SCN10A; (-) strand; PAM type: YTN; PAM sequence: TTT
gcaataccatctctccaacc

SEQ ID NO: 50294 - DNA, 20 bp, Artificial Sequence
  Description of Artificial Sequence: Synthetic oligonucleotide
  Target: SCN10A; (-) strand; PAM type: YTN; PAM sequence: TTT
tgcaataccatctctccaac

SEQ ID NO: 50295 - DNA, 20 bp, Artificial Sequence
  Description of Artificial Sequence: Synthetic oligonucleotide
  Target: SCN10A; (-) strand; PAM type: YTN; PAM sequence: TTT
ttgcaataccatctctccaa

SEQ ID NO: 50296 - DNA, 20 bp, Artificial Sequence
  Description of Artificial Sequence: Synthetic oligonucleotide
  Target: SCN10A; (-) strand; PAM type: YTN; PAM sequence: TTT
tttgcaataccatctctcca

SEQ ID NO: 50297 - DNA, 20 bp, Artificial Sequence
  Description of Artificial Sequence: Synthetic oligonucleotide
  Target: SCN10A; (-) strand; PAM type: YTN; PAM sequence: CTT
ttttgcaataccatctctcc

SEQ ID NO: 50298 - DNA, 20 bp, Artificial Sequence
  Description of Artificial Sequence: Synthetic oligonucleotide
  Target: SCN10A; (-) strand; PAM type: YTN; PAM sequence: TTA
cttttttgcaataccatctc

SEQ ID NO: 50299 - DNA, 20 bp, Artificial Sequence
  Description of Artificial Sequence: Synthetic oligonucleotide
  Target: SCN10A; (-) strand; PAM type: YTN; PAM sequence: TTT
acttttttgcaataccatct

SEQ ID NO: 50300 - DNA, 20 bp, Artificial Sequence
  Description of Artificial Sequence: Synthetic oligonucleotide
  Target: SCN10A; (-) strand; PAM type: YTN; PAM sequence: TTT
tacttttttgcaataccatc

SEQ ID NO: 50301 - DNA, 20 bp, Artificial Sequence
  Description of Artificial Sequence: Synthetic oligonucleotide
  Target: SCN10A; (-) strand; PAM type: YTN; PAM sequence: CTA
agccgaaggatattttactt

SEQ ID NO: 50302 - DNA, 20 bp, Artificial Sequence
  Description of Artificial Sequence: Synthetic oligonucleotide
  Target: SCN10A; (-) strand; PAM type: YTN; PAM sequence: CTG
tgctaagccgaaggatattt

SEQ ID NO: 50303 - DNA, 20 bp, Artificial Sequence
  Description of Artificial Sequence: Synthetic oligonucleotide
  Target: SCN10A; (-) strand; PAM type: YTN; PAM sequence: TTC
ctgtgctaagccgaaggata

SEQ ID NO: 50304 - DNA, 20 bp, Artificial Sequence
  Description of Artificial Sequence: Synthetic oligonucleotide
  Target: SCN10A; (-) strand; PAM type: YTN; PAM sequence: TTT
cctgtgctaagccgaaggat

SEQ ID NO: 50305 - DNA, 20 bp, Artificial Sequence
  Description of Artificial Sequence: Synthetic oligonucleotide
  Target: SCN10A; (-) strand; PAM type: YTN; PAM sequence: TTT
tcctgtgctaagccgaagga

SEQ ID NO: 50306 - DNA, 20 bp, Artificial Sequence
  Description of Artificial Sequence: Synthetic oligonucleotide
  Target: SCN10A; (-) strand; PAM type: YTN; PAM sequence: CTT
ttcctgtgctaagccgaagg

SEQ ID NO: 50307 - DNA, 20 bp, Artificial Sequence
  Description of Artificial Sequence: Synthetic oligonucleotide
  Target: SCN10A; (-) strand; PAM type: YTN; PAM sequence: CTC
ttttcctgtgctaagccgaa

SEQ ID NO: 50308 - DNA, 20 bp, Artificial Sequence
  Description of Artificial Sequence: Synthetic oligonucleotide
  Target: SCN10A; (-) strand; PAM type: YTN; PAM sequence: CTC
aatctcttttcctgtgctaa

SEQ ID NO: 50309 - DNA, 20 bp, Artificial Sequence
  Description of Artificial Sequence: Synthetic oligonucleotide
  Target: SCN10A; (-) strand; PAM type: YTN; PAM sequence: CTC
tcaatctcttttcctgtgct

SEQ ID NO: 50310 - DNA, 20 bp, Artificial Sequence
  Description of Artificial Sequence: Synthetic oligonucleotide
  Target: SCN10A; (-) strand; PAM type: YTN; PAM sequence: TTC
cctctcaatctcttttcctg

SEQ ID NO: 50311 - DNA, 20 bp, Artificial Sequence
  Description of Artificial Sequence: Synthetic oligonucleotide
  Target: SCN10A; (-) strand; PAM type: YTN; PAM sequence: CTT
ccctctcaatctcttttcct

SEQ ID NO: 50312 - DNA, 20 bp, Artificial Sequence
  Description of Artificial Sequence: Synthetic oligonucleotide
  Target: SCN10A; (-) strand; PAM type: YTN; PAM sequence: CTC
acttccctctcaatctcttt

SEQ ID NO: 50313 - DNA, 20 bp, Artificial Sequence
  Description of Artificial Sequence: Synthetic oligonucleotide
  Target: SCN10A; (-) strand; PAM type: YTN; PAM sequence: CTC
tcacttccctctcaatctct

SEQ ID NO: 50314 - DNA, 20 bp, Artificial Sequence
  Description of Artificial Sequence: Synthetic oligonucleotide
  Target: SCN10A; (-) strand; PAM type: YTN; PAM sequence: TTA
tacctctcacttccctctca

SEQ ID NO: 50315 - DNA, 20 bp, Artificial Sequence
  Description of Artificial Sequence: Synthetic oligonucleotide
  Target: SCN10A; (-) strand; PAM type: YTN; PAM sequence: TTT
atacctctcacttccctctc

SEQ ID NO: 50316 - DNA, 20 bp, Artificial Sequence
  Description of Artificial Sequence: Synthetic oligonucleotide
  Target: SCN10A; (-) strand; PAM type: YTN; PAM sequence: CTT
tatacctctcacttccctct

SEQ ID NO: 50317 - DNA, 20 bp, Artificial Sequence
  Description of Artificial Sequence: Synthetic oligonucleotide
  Target: SCN10A; (-) strand; PAM type: YTN; PAM sequence: TTA
tgctttatacctctcacttc

SEQ ID NO: 50318 - DNA, 20 bp, Artificial Sequence
  Description of Artificial Sequence: Synthetic oligonucleotide
  Target: SCN10A; (-) strand; PAM type: YTN; PAM sequence: TTT
atgctttatacctctcactt

SEQ ID NO: 50319 - DNA, 20 bp, Artificial Sequence
  Description of Artificial Sequence: Synthetic oligonucleotide
  Target: SCN10A; (-) strand; PAM type: YTN; PAM sequence: TTT
tatgctttatacctctcact

SEQ ID NO: 50320 - DNA, 20 bp, Artificial Sequence
  Description of Artificial Sequence: Synthetic oligonucleotide
  Target: SCN10A; (-) strand; PAM type: YTN; PAM sequence: TTT
ttatgctttatacctctcac

SEQ ID NO: 50321 - DNA, 20 bp, Artificial Sequence
  Description of Artificial Sequence: Synthetic oligonucleotide
  Target: SCN10A; (-) strand; PAM type: YTN; PAM sequence: TTT
tttatgctttatacctctca

SEQ ID NO: 50322 - DNA, 20 bp, Artificial Sequence
  Description of Artificial Sequence: Synthetic oligonucleotide
  Target: SCN10A; (-) strand; PAM type: YTN; PAM sequence: TTT
ttttatgctttatacctctc

SEQ ID NO: 50323 - DNA, 20 bp, Artificial Sequence
  Description of Artificial Sequence: Synthetic oligonucleotide
  Target: SCN10A; (-) strand; PAM type: YTN; PAM sequence: CTA
tttttttatgctttatacct

SEQ ID NO: 50324 - DNA, 20 bp, Artificial Sequence
  Description of Artificial Sequence: Synthetic oligonucleotide
  Target: SCN10A; (-) strand; PAM type: YTN; PAM sequence: CTA
acagtgtggaaaaggggatc

SEQ ID NO: 50325 - DNA, 20 bp, Artificial Sequence
  Description of Artificial Sequence: Synthetic oligonucleotide
  Target: SCN10A; (-) strand; PAM type: YTN; PAM sequence: CTC
cacactaacagtgtggaaaa

SEQ ID NO: 50326 - DNA, 20 bp, Artificial Sequence
  Description of Artificial Sequence: Synthetic oligonucleotide
  Target: SCN10A; (-) strand; PAM type: YTN; PAM sequence: CTG
tgtgggagggtggctccaca

SEQ ID NO: 50327 - DNA, 20 bp, Artificial Sequence
  Description of Artificial Sequence: Synthetic oligonucleotide
  Target: SCN10A; (-) strand; PAM type: YTN; PAM sequence: CTG
ctgtgtgggagggtggctcc

SEQ ID NO: 50328 - DNA, 20 bp, Artificial Sequence
  Description of Artificial Sequence: Synthetic oligonucleotide
  Target: SCN10A; (-) strand; PAM type: YTN; PAM sequence: CTG
acagataatatctgctgtgt

SEQ ID NO: 50329 - DNA, 20 bp, Artificial Sequence
  Description of Artificial Sequence: Synthetic oligonucleotide
  Target: SCN10A; (-) strand; PAM type: YTN; PAM sequence: CTA
taggtctgacagataatatc

SEQ ID NO: 50330 - DNA, 20 bp, Artificial Sequence
  Description of Artificial Sequence: Synthetic oligonucleotide
  Target: SCN10A; (-) strand; PAM type: YTN; PAM sequence: TTC
tataggtctgacagataata

SEQ ID NO: 50331 - DNA, 20 bp, Artificial Sequence
  Description of Artificial Sequence: Synthetic oligonucleotide
  Target: SCN10A; (-) strand; PAM type: YTN; PAM sequence: TTT
ctataggtctgacagataat

SEQ ID NO: 50332 - DNA, 20 bp, Artificial Sequence
  Description of Artificial Sequence: Synthetic oligonucleotide
  Target: SCN10A; (-) strand; PAM type: YTN; PAM sequence: CTT
tctataggtctgacagataa

SEQ ID NO: 50333 - DNA, 20 bp, Artificial Sequence
  Description of Artificial Sequence: Synthetic oligonucleotide
  Target: SCN10A; (-) strand; PAM type: YTN; PAM sequence: TTA
ccccaaatatgccctttcta

SEQ ID NO: 50334 - DNA, 20 bp, Artificial Sequence
  Description of Artificial Sequence: Synthetic oligonucleotide
  Target: SCN10A; (-) strand; PAM type: YTN; PAM sequence: TTT
accccaaatatgccctttct

SEQ ID NO: 50335 - DNA, 20 bp, Artificial Sequence
  Description of Artificial Sequence: Synthetic oligonucleotide
  Target: SCN10A; (-) strand; PAM type: YTN; PAM sequence: TTT
taccccaaatatgccctttc

SEQ ID NO: 50336 - DNA, 20 bp, Artificial Sequence
  Description of Artificial Sequence: Synthetic oligonucleotide
  Target: SCN10A; (-) strand; PAM type: YTN; PAM sequence: CTT
ttaccccaaatatgcccttt

SEQ ID NO: 50337 - DNA, 20 bp, Artificial Sequence
  Description of Artificial Sequence: Synthetic oligonucleotide
  Target: SCN10A; (-) strand; PAM type: YTN; PAM sequence: TTG
aaagtccttttaccccaaat

SEQ ID NO: 50338 - DNA, 20 bp, Artificial Sequence
  Description of Artificial Sequence: Synthetic oligonucleotide
  Target: SCN10A; (-) strand; PAM type: YTN; PAM sequence: CTT
gaaagtccttttaccccaaa

SEQ ID NO: 50339 - DNA, 20 bp, Artificial Sequence
  Description of Artificial Sequence: Synthetic oligonucleotide
  Target: SCN10A; (-) strand; PAM type: YTN; PAM sequence: CTG
ccccttgaaagtccttttac

SEQ ID NO: 50340 - DNA, 20 bp, Artificial Sequence
  Description of Artificial Sequence: Synthetic oligonucleotide
  Target: SCN10A; (-) strand; PAM type: YTN; PAM sequence: TTC
ctgccccttgaaagtccttt

SEQ ID NO: 50341 - DNA, 20 bp, Artificial Sequence
  Description of Artificial Sequence: Synthetic oligonucleotide
  Target: SCN10A; (-) strand; PAM type: YTN; PAM sequence: CTT
cctgccccttgaaagtcctt

SEQ ID NO: 50342 - DNA, 20 bp, Artificial Sequence
  Description of Artificial Sequence: Synthetic oligonucleotide
  Target: SCN10A; (-) strand; PAM type: YTN; PAM sequence: CTC
ccaccaccttcctgcccctt

SEQ ID NO: 50343 - DNA, 20 bp, Artificial Sequence
  Description of Artificial Sequence: Synthetic oligonucleotide
  Target: SCN10A; (-) strand; PAM type: YTN; PAM sequence: TTC
ctcccaccaccttcctgccc

SEQ ID NO: 50344 - DNA, 20 bp, Artificial Sequence
  Description of Artificial Sequence: Synthetic oligonucleotide
  Target: SCN10A; (-) strand; PAM type: YTN; PAM sequence: CTT
cctcccaccaccttcctgcc

SEQ ID NO: 50345 - DNA, 20 bp, Artificial Sequence
  Description of Artificial Sequence: Synthetic oligonucleotide
  Target: SCN10A; (-) strand; PAM type: YTN; PAM sequence: CTC
gccacgcttcctcccaccac

SEQ ID NO: 50346 - DNA, 20 bp, Artificial Sequence
  Description of Artificial Sequence: Synthetic oligonucleotide
  Target: SCN10A; (-) strand; PAM type: YTN; PAM sequence: TTC
ctcgccacgcttcctcccac

SEQ ID NO: 50347 - DNA, 20 bp, Artificial Sequence
  Description of Artificial Sequence: Synthetic oligonucleotide
  Target: SCN10A; (-) strand; PAM type: YTN; PAM sequence: TTT
cctcgccacgcttcctccca

SEQ ID NO: 50348 - DNA, 20 bp, Artificial Sequence
  Description of Artificial Sequence: Synthetic oligonucleotide
  Target: SCN10A; (-) strand; PAM type: YTN; PAM sequence: CTT
tcctcgccacgcttcctccc

SEQ ID NO: 50349 - DNA, 20 bp, Artificial Sequence
  Description of Artificial Sequence: Synthetic oligonucleotide
  Target: SCN10A; (-) strand; PAM type: YTN; PAM sequence: CTG
caactttcctcgccacgctt

SEQ ID NO: 50350 - DNA, 20 bp, Artificial Sequence
  Description of Artificial Sequence: Synthetic oligonucleotide
  Target: SCN10A; (-) strand; PAM type: YTN; PAM sequence: TTG
cactgcaactttcctcgcca

SEQ ID NO: 50351 - DNA, 20 bp, Artificial Sequence
  Description of Artificial Sequence: Synthetic oligonucleotide
  Target: SCN10A; (-) strand; PAM type: YTN; PAM sequence: TTT
gcactgcaactttcctcgcc

SEQ ID NO: 50352 - DNA, 20 bp, Artificial Sequence
  Description of Artificial Sequence: Synthetic oligonucleotide
  Target: SCN10A; (-) strand; PAM type: YTN; PAM sequence: CTA
aaatttgcactgcaactttc

SEQ ID NO: 50353 - DNA, 20 bp, Artificial Sequence
  Description of Artificial Sequence: Synthetic oligonucleotide
  Target: SCN10A; (-) strand; PAM type: YTN; PAM sequence: CTC
taaaatttgcactgcaactt

SEQ ID NO: 50354 - DNA, 20 bp, Artificial Sequence
  Description of Artificial Sequence: Synthetic oligonucleotide
  Target: SCN10A; (-) strand; PAM type: YTN; PAM sequence: CTC
ccactctaaaatttgcactg

SEQ ID NO: 50355 - DNA, 20 bp, Artificial Sequence
  Description of Artificial Sequence: Synthetic oligonucleotide
  Target: SCN10A; (-) strand; PAM type: YTN; PAM sequence: CTG
cctcccactctaaaatttgc

SEQ ID NO: 50356 - DNA, 20 bp, Artificial Sequence
  Description of Artificial Sequence: Synthetic oligonucleotide
  Target: SCN10A; (-) strand; PAM type: YTN; PAM sequence: TTC
tgcctcccactctaaaattt

SEQ ID NO: 50357 - DNA, 20 bp, Artificial Sequence
  Description of Artificial Sequence: Synthetic oligonucleotide
  Target: SCN10A; (-) strand; PAM type: YTN; PAM sequence: TTT
ctgcctcccactctaaaatt

SEQ ID NO: 50358 - DNA, 20 bp, Artificial Sequence
  Description of Artificial Sequence: Synthetic oligonucleotide
  Target: SCN10A; (-) strand; PAM type: YTN; PAM sequence: CTT
tctgcctcccactctaaaat

SEQ ID NO: 50359 - DNA, 20 bp, Artificial Sequence
  Description of Artificial Sequence: Synthetic oligonucleotide
  Target: SCN10A; (-) strand; PAM type: YTN; PAM sequence: TTC
cccccataataactttctgc

SEQ ID NO: 50360 - DNA, 20 bp, Artificial Sequence
  Description of Artificial Sequence: Synthetic oligonucleotide
  Target: SCN10A; (-) strand; PAM type: YTN; PAM sequence: TTT
ccccccataataactttctg

SEQ ID NO: 50361 - DNA, 20 bp, Artificial Sequence
  Description of Artificial Sequence: Synthetic oligonucleotide
  Target: SCN10A; (-) strand; PAM type: YTN; PAM sequence: TTT
tccccccataataactttct

SEQ ID NO: 50362 - DNA, 20 bp, Artificial Sequence
  Description of Artificial Sequence: Synthetic oligonucleotide
  Target: SCN10A; (-) strand; PAM type: YTN; PAM sequence: CTT
ttccccccataataactttc

SEQ ID NO: 50363 - DNA, 20 bp, Artificial Sequence
  Description of Artificial Sequence: Synthetic oligonucleotide
  Target: SCN10A; (-) strand; PAM type: YTN; PAM sequence: TTC
ttttccccccataataactt

SEQ ID NO: 50364 - DNA, 20 bp, Artificial Sequence
  Description of Artificial Sequence: Synthetic oligonucleotide
  Target: SCN10A; (-) strand; PAM type: YTN; PAM sequence: CTG
tagcaattcttttcccccca

SEQ ID NO: 50365 - DNA, 20 bp, Artificial Sequence
  Description of Artificial Sequence: Synthetic oligonucleotide
  Target: SCN10A; (-) strand; PAM type: YTN; PAM sequence: CTC
agaccctgtagcaattcttt

SEQ ID NO: 50366 - DNA, 20 bp, Artificial Sequence
  Description of Artificial Sequence: Synthetic oligonucleotide
  Target: SCN10A; (-) strand; PAM type: YTN; PAM sequence: CTC
acctcagaccctgtagcaat

SEQ ID NO: 50367 - DNA, 20 bp, Artificial Sequence
  Description of Artificial Sequence: Synthetic oligonucleotide
  Target: SCN10A; (-) strand; PAM type: YTN; PAM sequence: TTC
agcacctcacctcagaccct

SEQ ID NO: 50368 - DNA, 20 bp, Artificial Sequence
  Description of Artificial Sequence: Synthetic oligonucleotide
  Target: SCN10A; (-) strand; PAM type: YTN; PAM sequence: CTT
cagcacctcacctcagaccc

SEQ ID NO: 50369 - DNA, 20 bp, Artificial Sequence
  Description of Artificial Sequence: Synthetic oligonucleotide
  Target: SCN10A; (-) strand; PAM type: YTN; PAM sequence: CTG
ggaatggcttcagcacctca

SEQ ID NO: 50370 - DNA, 20 bp, Artificial Sequence
  Description of Artificial Sequence: Synthetic oligonucleotide
  Target: SCN10A; (-) strand; PAM type: YTN; PAM sequence: CTG
tgacacaatccagcctggga

SEQ ID NO: 50371 - DNA, 20 bp, Artificial Sequence
  Description of Artificial Sequence: Synthetic oligonucleotide
  Target: SCN10A; (-) strand; PAM type: YTN; PAM sequence: CTC
tgtgacacaatccagcctgg

SEQ ID NO: 50372 - DNA, 20 bp, Artificial Sequence
  Description of Artificial Sequence: Synthetic oligonucleotide
  Target: SCN10A; (-) strand; PAM type: YTN; PAM sequence: TTC
cagcacccatctctgtgaca

SEQ ID NO: 50373 - DNA, 20 bp, Artificial Sequence
  Description of Artificial Sequence: Synthetic oligonucleotide
  Target: SCN10A; (-) strand; PAM type: YTN; PAM sequence: TTT
ccagcacccatctctgtgac

SEQ ID NO: 50374 - DNA, 20 bp, Artificial Sequence
  Description of Artificial Sequence: Synthetic oligonucleotide
  Target: SCN10A; (-) strand; PAM type: YTN; PAM sequence: TTA
tcagaaaagtttccagcacc

SEQ ID NO: 50375 - DNA, 20 bp, Artificial Sequence
  Description of Artificial Sequence: Synthetic oligonucleotide
  Target: SCN10A; (-) strand; PAM type: YTN; PAM sequence: TTG
ttatcagaaaagtttccagc

SEQ ID NO: 50376 - DNA, 20 bp, Artificial Sequence
  Description of Artificial Sequence: Synthetic oligonucleotide
  Target: SCN10A; (-) strand; PAM type: YTN; PAM sequence: CTG
ttgttatcagaaaagtttcc

SEQ ID NO: 50377 - DNA, 20 bp, Artificial Sequence
  Description of Artificial Sequence: Synthetic oligonucleotide
  Target: SCN10A; (-) strand; PAM type: YTN; PAM sequence: CTG
tcacctgttgttatcagaaa

SEQ ID NO: 50378 - DNA, 20 bp, Artificial Sequence
  Description of Artificial Sequence: Synthetic oligonucleotide
  Target: SCN10A; (-) strand; PAM type: YTN; PAM sequence: TTC
aagctgtcacctgttgttat

SEQ ID NO: 50379 - DNA, 20 bp, Artificial Sequence
  Description of Artificial Sequence: Synthetic oligonucleotide
  Target: SCN10A; (-) strand; PAM type: YTN; PAM sequence: CTG
caattcaagctgtcacctgt

SEQ ID NO: 50380 - DNA, 20 bp, Artificial Sequence
  Description of Artificial Sequence: Synthetic oligonucleotide
  Target: SCN10A; (-) strand; PAM type: YTN; PAM sequence: CTA
aggtcctgcaattcaagctg

SEQ ID NO: 50381 - DNA, 20 bp, Artificial Sequence
  Description of Artificial Sequence: Synthetic oligonucleotide
  Target: SCN10A; (-) strand; PAM type: YTN; PAM sequence: TTC
ctaaggtcctgcaattcaag

SEQ ID NO: 50382 - DNA, 20 bp, Artificial Sequence
  Description of Artificial Sequence: Synthetic oligonucleotide
  Target: SCN10A; (-) strand; PAM type: YTN; PAM sequence: CTT
cctaaggtcctgcaattcaa

SEQ ID NO: 50383 - DNA, 20 bp, Artificial Sequence
  Description of Artificial Sequence: Synthetic oligonucleotide
  Target: SCN10A; (-) strand; PAM type: YTN; PAM sequence: CTC
cttcctaaggtcctgcaatt

SEQ ID NO: 50384 - DNA, 20 bp, Artificial Sequence
  Description of Artificial Sequence: Synthetic oligonucleotide
  Target: SCN10A; (-) strand; PAM type: YTN; PAM sequence: CTG
acctccttcctaaggtcctg

SEQ ID NO: 50385 - DNA, 20 bp, Artificial Sequence
  Description of Artificial Sequence: Synthetic oligonucleotide
  Target: SCN10A; (-) strand; PAM type: YTN; PAM sequence: TTC
tgacctccttcctaaggtcc

SEQ ID NO: 50386 - DNA, 20 bp, Artificial Sequence
  Description of Artificial Sequence: Synthetic oligonucleotide
  Target: SCN10A; (-) strand; PAM type: YTN; PAM sequence: TTT
ctgacctccttcctaaggtc

SEQ ID NO: 50387 - DNA, 20 bp, Artificial Sequence
  Description of Artificial Sequence: Synthetic oligonucleotide
  Target: SCN10A; (-) strand; PAM type: YTN; PAM sequence: TTG
ggtataatttctgacctcct

SEQ ID NO: 50388 - DNA, 20 bp, Artificial Sequence
  Description of Artificial Sequence: Synthetic oligonucleotide
  Target: SCN10A; (-) strand; PAM type: YTN; PAM sequence: TTA
ttgggtataatttctgacct

SEQ ID NO: 50389 - DNA, 20 bp, Artificial Sequence
  Description of Artificial Sequence: Synthetic oligonucleotide
  Target: SCN10A; (-) strand; PAM type: YTN; PAM sequence: TTA
tataattattgggtataatt

SEQ ID NO: 50390 - DNA, 20 bp, Artificial Sequence
  Description of Artificial Sequence: Synthetic oligonucleotide
  Target: SCN10A; (-) strand; PAM type: YTN; PAM sequence: TTT
atataattattgggtataat

SEQ ID NO: 50391 - DNA, 20 bp, Artificial Sequence
  Description of Artificial Sequence: Synthetic oligonucleotide
  Target: SCN10A; (-) strand; PAM type: YTN; PAM sequence: TTT
tatataattattgggtataa

SEQ ID NO: 50392 - DNA, 20 bp, Artificial Sequence
  Description of Artificial Sequence: Synthetic oligonucleotide
  Target: SCN10A; (-) strand; PAM type: YTN; PAM sequence: TTC
acaattttatataattattg

SEQ ID NO: 50393 - DNA, 20 bp, Artificial Sequence
  Description of Artificial Sequence: Synthetic oligonucleotide
  Target: SCN10A; (-) strand; PAM type: YTN; PAM sequence: CTT
cacaattttatataattatt

SEQ ID NO: 50394 - DNA, 20 bp, Artificial Sequence
  Description of Artificial Sequence: Synthetic oligonucleotide
  Target: SCN10A; (-) strand; PAM type: YTN; PAM sequence: TTG
acacttcacaattttatata

SEQ ID NO: 50395 - DNA, 20 bp, Artificial Sequence
  Description of Artificial Sequence: Synthetic oligonucleotide
  Target: SCN10A; (-) strand; PAM type: YTN; PAM sequence: TTA
attgacacttcacaatttta

SEQ ID NO: 50396 - DNA, 20 bp, Artificial Sequence
  Description of Artificial Sequence: Synthetic oligonucleotide
  Target: SCN10A; (-) strand; PAM type: YTN; PAM sequence: TTT
aattgacacttcacaatttt

SEQ ID NO: 50397 - DNA, 20 bp, Artificial Sequence
  Description of Artificial Sequence: Synthetic oligonucleotide
  Target: SCN10A; (-) strand; PAM type: YTN; PAM sequence: TTT
taattgacacttcacaattt

SEQ ID NO: 50398 - DNA, 20 bp, Artificial Sequence
  Description of Artificial Sequence: Synthetic oligonucleotide
  Target: SCN10A; (-) strand; PAM type: YTN; PAM sequence: TTT
ttaattgacacttcacaatt

SEQ ID NO: 50399 - DNA, 20 bp, Artificial Sequence
  Description of Artificial Sequence: Synthetic oligonucleotide
  Target: SCN10A; (-) strand; PAM type: YTN; PAM sequence: TTT
tttaattgacacttcacaat

SEQ ID NO: 50400 - DNA, 20 bp, Artificial Sequence
  Description of Artificial Sequence: Synthetic oligonucleotide
  Target: SCN10A; (-) strand; PAM type: YTN; PAM sequence: TTT
ttttaattgacacttcacaa

SEQ ID NO: 50401 - DNA, 20 bp, Artificial Sequence
  Description of Artificial Sequence: Synthetic oligonucleotide
  Target: SCN10A; (-) strand; PAM type: YTN; PAM sequence: TTT
tttttaattgacacttcaca

SEQ ID NO: 50402 - DNA, 20 bp, Artificial Sequence
  Description of Artificial Sequence: Synthetic oligonucleotide
  Target: SCN10A; (-) strand; PAM type: YTN; PAM sequence: TTA
gttttttttaattgacactt

SEQ ID NO: 50403 - DNA, 20 bp, Artificial Sequence
  Description of Artificial Sequence: Synthetic oligonucleotide
  Target: SCN10A; (-) strand; PAM type: YTN; PAM sequence: CTT
agttttttttaattgacact

SEQ ID NO: 50404 - DNA, 20 bp, Artificial Sequence
  Description of Artificial Sequence: Synthetic oligonucleotide
  Target: SCN10A; (-) strand; PAM type: YTN; PAM sequence: TTA
cttagttttttttaattgac

SEQ ID NO: 50405 - DNA, 20 bp, Artificial Sequence
  Description of Artificial Sequence: Synthetic oligonucleotide
  Target: SCN10A; (-) strand; PAM type: YTN; PAM sequence: TTT
acttagttttttttaattga

SEQ ID NO: 50406 - DNA, 20 bp, Artificial Sequence
  Description of Artificial Sequence: Synthetic oligonucleotide
  Target: SCN10A; (-) strand; PAM type: YTN; PAM sequence: TTT
tacttagttttttttaattg

SEQ ID NO: 50407 - DNA, 20 bp, Artificial Sequence
  Description of Artificial Sequence: Synthetic oligonucleotide
  Target: SCN10A; (-) strand; PAM type: YTN; PAM sequence: TTT
ttacttagttttttttaatt

SEQ ID NO: 50408 - DNA, 20 bp, Artificial Sequence
  Description of Artificial Sequence: Synthetic oligonucleotide
  Target: SCN10A; (-) strand; PAM type: YTN; PAM sequence: TTT
tttacttagttttttttaat

SEQ ID NO: 50409 - DNA, 20 bp, Artificial Sequence
  Description of Artificial Sequence: Synthetic oligonucleotide
  Target: SCN10A; (-) strand; PAM type: YTN; PAM sequence: TTT
ttttacttagttttttttaa

SEQ ID NO: 50410 - DNA, 20 bp, Artificial Sequence
  Description of Artificial Sequence: Synthetic oligonucleotide
  Target: SCN10A; (-) strand; PAM type: YTN; PAM sequence: TTA
tttttttacttagttttttt

SEQ ID NO: 50411 - DNA, 20 bp, Artificial Sequence
  Description of Artificial Sequence: Synthetic oligonucleotide
  Target: SCN10A; (-) strand; PAM type: YTN; PAM sequence: TTT
atttttttacttagtttttt

SEQ ID NO: 50412 - DNA, 20 bp, Artificial Sequence
  Description of Artificial Sequence: Synthetic oligonucleotide
  Target: SCN10A; (-) strand; PAM type: YTN; PAM sequence: TTT
tatttttttacttagttttt

SEQ ID NO: 50413 - DNA, 20 bp, Artificial Sequence
  Description of Artificial Sequence: Synthetic oligonucleotide
  Target: SCN10A; (-) strand; PAM type: YTN; PAM sequence: TTT
ttatttttttacttagtttt

SEQ ID NO: 50414 - DNA, 20 bp, Artificial Sequence
  Description of Artificial Sequence: Synthetic oligonucleotide
  Target: SCN10A; (-) strand; PAM type: YTN; PAM sequence: CTG
atgcgtcgaggtggttttta

SEQ ID NO: 50415 - DNA, 20 bp, Artificial Sequence
  Description of Artificial Sequence: Synthetic oligonucleotide
  Target: SCN10A; (-) strand; PAM type: YTN; PAM sequence: TTC
tgatgcgtcgaggtggtttt

SEQ ID NO: 50416 - DNA, 20 bp, Artificial Sequence
  Description of Artificial Sequence: Synthetic oligonucleotide
  Target: SCN10A; (-) strand; PAM type: YTN; PAM sequence: TTT
ctgatgcgtcgaggtggttt

SEQ ID NO: 50417 - DNA, 20 bp, Artificial Sequence
  Description of Artificial Sequence: Synthetic oligonucleotide
  Target: SCN10A; (-) strand; PAM type: YTN; PAM sequence: TTT
tctgatgcgtcgaggtggtt

SEQ ID NO: 50418 - DNA, 20 bp, Artificial Sequence
  Description of Artificial Sequence: Synthetic oligonucleotide
  Target: SCN10A; (-) strand; PAM type: YTN; PAM sequence: TTT
ttctgatgcgtcgaggtggt

SEQ ID NO: 50419 - DNA, 20 bp, Artificial Sequence
  Description of Artificial Sequence: Synthetic oligonucleotide
  Target: SCN10A; (-) strand; PAM type: YTN; PAM sequence: TTT
tttctgatgcgtcgaggtgg

SEQ ID NO: 50420 - DNA, 20 bp, Artificial Sequence
  Description of Artificial Sequence: Synthetic oligonucleotide
  Target: SCN10A; (-) strand; PAM type: YTN; PAM sequence: TTT
ttttctgatgcgtcgaggtg

SEQ ID NO: 50421 - DNA, 20 bp, Artificial Sequence
  Description of Artificial Sequence: Synthetic oligonucleotide
  Target: SCN10A; (-) strand; PAM type: YTN; PAM sequence: TTT
tttttctgatgcgtcgaggt

SEQ ID NO: 50422 - DNA, 20 bp, Artificial Sequence
  Description of Artificial Sequence: Synthetic oligonucleotide
  Target: SCN10A; (-) strand; PAM type: YTN; PAM sequence: TTT
ttttttctgatgcgtcgagg

SEQ ID NO: 50423 - DNA, 20 bp, Artificial Sequence
  Description of Artificial Sequence: Synthetic oligonucleotide
  Target: SCN10A; (-) strand; PAM type: YTN; PAM sequence: TTT
tttttttctgatgcgtcgag

SEQ ID NO: 50424 - DNA, 20 bp, Artificial Sequence
  Description of Artificial Sequence: Synthetic oligonucleotide
  Target: SCN10A; (-) strand; PAM type: YTN; PAM sequence: CTT
ttttttttctgatgcgtcga

SEQ ID NO: 50425 - DNA, 20 bp, Artificial Sequence
  Description of Artificial Sequence: Synthetic oligonucleotide
  Target: SCN10A; (-) strand; PAM type: YTN; PAM sequence: TTC
atgcaccttttttttttctg

SEQ ID NO: 50426 - DNA, 20 bp, Artificial Sequence
  Description of Artificial Sequence: Synthetic oligonucleotide
  Target: SCN10A; (-) strand; PAM type: YTN; PAM sequence: CTT
catgcaccttttttttttct

SEQ ID NO: 50427 - DNA, 20 bp, Artificial Sequence
  Description of Artificial Sequence: Synthetic oligonucleotide
  Target: SCN10A; (-) strand; PAM type: YTN; PAM sequence: CTG
agatccttcatgcacctttt

SEQ ID NO: 50428 - DNA, 20 bp, Artificial Sequence
  Description of Artificial Sequence: Synthetic oligonucleotide
  Target: SCN10A; (-) strand; PAM type: YTN; PAM sequence: CTG
tccgtggtgctgagatcctt

SEQ ID NO: 50429 - DNA, 20 bp, Artificial Sequence
  Description of Artificial Sequence: Synthetic oligonucleotide
  Target: SCN10A; (-) strand; PAM type: YTN; PAM sequence: TTC
cctgtccgtggtgctgagat

SEQ ID NO: 50430 - DNA, 20 bp, Artificial Sequence
  Description of Artificial Sequence: Synthetic oligonucleotide
  Target: SCN10A; (-) strand; PAM type: YTN; PAM sequence: CTA
gagtgcaaggttccctgtcc

SEQ ID NO: 50431 - DNA, 20 bp, Artificial Sequence
  Description of Artificial Sequence: Synthetic oligonucleotide
  Target: SCN10A; (-) strand; PAM type: YTN; PAM sequence: TTC
tagagtgcaaggttccctgt

SEQ ID NO: 50432 - DNA, 20 bp, Artificial Sequence
  Description of Artificial Sequence: Synthetic oligonucleotide
  Target: SCN10A; (-) strand; PAM type: YTN; PAM sequence: CTG
cagttctagagtgcaaggtt

SEQ ID NO: 50433 - DNA, 20 bp, Artificial Sequence
  Description of Artificial Sequence: Synthetic oligonucleotide
  Target: SCN10A; (-) strand; PAM type: YTN; PAM sequence: CTG
gtctgcagttctagagtgca

SEQ ID NO: 50434 - DNA, 20 bp, Artificial Sequence
  Description of Artificial Sequence: Synthetic oligonucleotide
  Target: SCN10A; (-) strand; PAM type: YTN; PAM sequence: CTC
tggtctgcagttctagagtg

SEQ ID NO: 50435 - DNA, 20 bp, Artificial Sequence
  Description of Artificial Sequence: Synthetic oligonucleotide
  Target: SCN10A; (-) strand; PAM type: YTN; PAM sequence: CTG
aggctctggtctgcagttct

SEQ ID NO: 50436 - DNA, 20 bp, Artificial Sequence
  Description of Artificial Sequence: Synthetic oligonucleotide
  Target: SCN10A; (-) strand; PAM type: YTN; PAM sequence: TTC
tgaggctctggtctgcagtt

SEQ ID NO: 50437 - DNA, 20 bp, Artificial Sequence
  Description of Artificial Sequence: Synthetic oligonucleotide
  Target: SCN10A; (-) strand; PAM type: YTN; PAM sequence: CTT
ctgaggctctggtctgcagt

SEQ ID NO: 50438 - DNA, 20 bp, Artificial Sequence
  Description of Artificial Sequence: Synthetic oligonucleotide
  Target: SCN10A; (-) strand; PAM type: YTN; PAM sequence: TTC
cttctgaggctctggtctgc

SEQ ID NO: 50439 - DNA, 20 bp, Artificial Sequence
  Description of Artificial Sequence: Synthetic oligonucleotide
  Target: SCN10A; (-) strand; PAM type: YTN; PAM sequence: CTT
ccttctgaggctctggtctg

SEQ ID NO: 50440 - DNA, 20 bp, Artificial Sequence
  Description of Artificial Sequence: Synthetic oligonucleotide
  Target: SCN10A; (-) strand; PAM type: YTN; PAM sequence: CTG
cggacatcaaaggtcagctt

SEQ ID NO: 50441 - DNA, 20 bp, Artificial Sequence
  Description of Artificial Sequence: Synthetic oligonucleotide
  Target: SCN10A; (-) strand; PAM type: YTN; PAM sequence: TTA
aggtgtctgcggacatcaaa

SEQ ID NO: 50442 - DNA, 20 bp, Artificial Sequence
  Description of Artificial Sequence: Synthetic oligonucleotide
  Target: SCN10A; (-) strand; PAM type: YTN; PAM sequence: CTT
aaggtgtctgcggacatcaa

SEQ ID NO: 50443 - DNA, 20 bp, Artificial Sequence
  Description of Artificial Sequence: Synthetic oligonucleotide
  Target: SCN10A; (-) strand; PAM type: YTN; PAM sequence: CTG
aacatgccaatcttaaggtg

SEQ ID NO: 50444 - DNA, 20 bp, Artificial Sequence
  Description of Artificial Sequence: Synthetic oligonucleotide
  Target: SCN10A; (-) strand; PAM type: YTN; PAM sequence: TTG
taggaaaggtgggaagccca

SEQ ID NO: 50445 - DNA, 20 bp, Artificial Sequence
  Description of Artificial Sequence: Synthetic oligonucleotide
  Target: SCN10A; (-) strand; PAM type: YTN; PAM sequence: TTT
gtaggaaaggtgggaagccc

SEQ ID NO: 50446 - DNA, 20 bp, Artificial Sequence
  Description of Artificial Sequence: Synthetic oligonucleotide
  Target: SCN10A; (-) strand; PAM type: YTN; PAM sequence: CTG
gaggaagaaccccggtttgt

SEQ ID NO: 50447 - DNA, 20 bp, Artificial Sequence
  Description of Artificial Sequence: Synthetic oligonucleotide
  Target: SCN10A; (-) strand; PAM type: YTN; PAM sequence: TTC
caagatgaggacactggagg

SEQ ID NO: 50448 - DNA, 20 bp, Artificial Sequence
  Description of Artificial Sequence: Synthetic oligonucleotide
  Target: SCN10A; (-) strand; PAM type: YTN; PAM sequence: TTG
ggcaatcaaatgggtggtga

SEQ ID NO: 50449 - DNA, 20 bp, Artificial Sequence
  Description of Artificial Sequence: Synthetic oligonucleotide
  Target: SCN10A; (-) strand; PAM type: YTN; PAM sequence: TTC
aggattgggcaatcaaatgg

SEQ ID NO: 50450 - DNA, 20 bp, Artificial Sequence
  Description of Artificial Sequence: Synthetic oligonucleotide
  Target: SCN10A; (-) strand; PAM type: YTN; PAM sequence: TTT
caggattgggcaatcaaatg

SEQ ID NO: 50451 - DNA, 20 bp, Artificial Sequence
  Description of Artificial Sequence: Synthetic oligonucleotide
  Target: SCN10A; (-) strand; PAM type: YTN; PAM sequence: CTC
ccaggtttcaggattgggca

SEQ ID NO: 50452 - DNA, 20 bp, Artificial Sequence
  Description of Artificial Sequence: Synthetic oligonucleotide
  Target: SCN10A; (-) strand; PAM type: YTN; PAM sequence: TTG
actcccaggtttcaggattg

SEQ ID NO: 50453 - DNA, 20 bp, Artificial Sequence
  Description of Artificial Sequence: Synthetic oligonucleotide
  Target: SCN10A; (-) strand; PAM type: YTN; PAM sequence: TTT
gactcccaggtttcaggatt

SEQ ID NO: 50454 - DNA, 20 bp, Artificial Sequence
  Description of Artificial Sequence: Synthetic oligonucleotide
  Target: SCN10A; (-) strand; PAM type: YTN; PAM sequence: CTG
tggaaaaaggaaaggggagt

SEQ ID NO: 50455 - DNA, 20 bp, Artificial Sequence
  Description of Artificial Sequence: Synthetic oligonucleotide
  Target: SCN10A; (-) strand; PAM type: YTN; PAM sequence: TTG
tggactgtggaaaaaggaaa

SEQ ID NO: 50456 - DNA, 20 bp, Artificial Sequence
  Description of Artificial Sequence: Synthetic oligonucleotide
  Target: SCN10A; (-) strand; PAM type: YTN; PAM sequence: TTG
ggattgtggactgtggaaaa

SEQ ID NO: 50457 - DNA, 20 bp, Artificial Sequence
  Description of Artificial Sequence: Synthetic oligonucleotide
  Target: SCN10A; (-) strand; PAM type: YTN; PAM sequence: TTA
gggaagtggatcaacaagat

SEQ ID NO: 50458 - DNA, 20 bp, Artificial Sequence
  Description of Artificial Sequence: Synthetic oligonucleotide
  Target: SCN10A; (-) strand; PAM type: YTN; PAM sequence: CTT
agggaagtggatcaacaaga

SEQ ID NO: 50459 - DNA, 20 bp, Artificial Sequence
  Description of Artificial Sequence: Synthetic oligonucleotide
  Target: SCN10A; (-) strand; PAM type: YTN; PAM sequence: TTA
taaggacaccttagggaagt

SEQ ID NO: 50460 - DNA, 20 bp, Artificial Sequence
  Description of Artificial Sequence: Synthetic oligonucleotide
  Target: SCN10A; (-) strand; PAM type: YTN; PAM sequence: TTA
tagatggggaaaaggggtga

SEQ ID NO: 50461 - DNA, 20 bp, Artificial Sequence
  Description of Artificial Sequence: Synthetic oligonucleotide
  Target: SCN10A; (-) strand; PAM type: YTN; PAM sequence: CTA
ggaaagtgtaattatagatg

SEQ ID NO: 50462 - DNA, 20 bp, Artificial Sequence
  Description of Artificial Sequence: Synthetic oligonucleotide
  Target: SCN10A; (-) strand; PAM type: YTN; PAM sequence: TTA
aactaggaaagtgtaattat

SEQ ID NO: 50463 - DNA, 20 bp, Artificial Sequence
  Description of Artificial Sequence: Synthetic oligonucleotide
  Target: SCN10A; (-) strand; PAM type: YTN; PAM sequence: CTT
aaactaggaaagtgtaatta

SEQ ID NO: 50464 - DNA, 20 bp, Artificial Sequence
  Description of Artificial Sequence: Synthetic oligonucleotide
  Target: SCN10A; (-) strand; PAM type: YTN; PAM sequence: CTC
caaaatggtgtcttaaacta

SEQ ID NO: 50465 - DNA, 20 bp, Artificial Sequence
  Description of Artificial Sequence: Synthetic oligonucleotide
  Target: SCN10A; (-) strand; PAM type: YTN; PAM sequence: CTA
aaaggatccagacacccctc

SEQ ID NO: 50466 - DNA, 20 bp, Artificial Sequence
  Description of Artificial Sequence: Synthetic oligonucleotide
  Target: SCN10A; (-) strand; PAM type: YTN; PAM sequence: CTG
gaggcatagagcctaaaagg

SEQ ID NO: 50467 - DNA, 20 bp, Artificial Sequence
  Description of Artificial Sequence: Synthetic oligonucleotide
  Target: SCN10A; (-) strand; PAM type: YTN; PAM sequence: TTG
gagtgggaagaggtgtgtgg

SEQ ID NO: 50468 - DNA, 20 bp, Artificial Sequence
  Description of Artificial Sequence: Synthetic oligonucleotide
  Target: SCN10A; (-) strand; PAM type: YTN; PAM sequence: CTG
ccgtagacaatgagttggag

SEQ ID NO: 50469 - DNA, 20 bp, Artificial Sequence
  Description of Artificial Sequence: Synthetic oligonucleotide
  Target: SCN10A; (-) strand; PAM type: YTN; PAM sequence: TTG
cagctgccgtagacaatgag

SEQ ID NO: 50470 - DNA, 20 bp, Artificial Sequence
  Description of Artificial Sequence: Synthetic oligonucleotide
  Target: SCN10A; (-) strand; PAM type: YTN; PAM sequence: TTA
cccaccattgcagctgccgt

SEQ ID NO: 50471 - DNA, 20 bp, Artificial Sequence
  Description of Artificial Sequence: Synthetic oligonucleotide
  Target: SCN10A; (-) strand; PAM type: YTN; PAM sequence: CTA
aagattacccaccattgcag

SEQ ID NO: 50472 - DNA, 20 bp, Artificial Sequence
  Description of Artificial Sequence: Synthetic oligonucleotide
  Target: SCN10A; (-) strand; PAM type: YTN; PAM sequence: CTC
taaagattacccaccattgc

SEQ ID NO: 50473 - DNA, 20 bp, Artificial Sequence
  Description of Artificial Sequence: Synthetic oligonucleotide
  Target: SCN10A; (-) strand; PAM type: YTN; PAM sequence: TTG
tgctctaaagattacccacc

SEQ ID NO: 50474 - DNA, 20 bp, Artificial Sequence
  Description of Artificial Sequence: Synthetic oligonucleotide
  Target: SCN10A; (-) strand; PAM type: YTN; PAM sequence: TTT
gtgctctaaagattacccac

SEQ ID NO: 50475 - DNA, 20 bp, Artificial Sequence
  Description of Artificial Sequence: Synthetic oligonucleotide
  Target: SCN10A; (-) strand; PAM type: YTN; PAM sequence: CTC
aggtttgtgctctaaagatt

SEQ ID NO: 50476 - DNA, 20 bp, Artificial Sequence
  Description of Artificial Sequence: Synthetic oligonucleotide
  Target: SCN10A; (-) strand; PAM type: YTN; PAM sequence: TTA
caaccagcgcaggatggtaa

SEQ ID NO: 50477 - DNA, 20 bp, Artificial Sequence
  Description of Artificial Sequence: Synthetic oligonucleotide
  Target: SCN10A; (-) strand; PAM type: YTN; PAM sequence: CTT
acaaccagcgcaggatggta

SEQ ID NO: 50478 - DNA, 20 bp, Artificial Sequence
  Description of Artificial Sequence: Synthetic oligonucleotide
  Target: SCN10A; (-) strand; PAM type: YTN; PAM sequence: CTG
atccttacaaccagcgcagg

SEQ ID NO: 50479 - DNA, 20 bp, Artificial Sequence
  Description of Artificial Sequence: Synthetic oligonucleotide
  Target: SCN10A; (-) strand; PAM type: YTN; PAM sequence: CTC
tgatccttacaaccagcgca

SEQ ID NO: 50480 - DNA, 20 bp, Artificial Sequence
  Description of Artificial Sequence: Synthetic oligonucleotide
  Target: SCN10A; (-) strand; PAM type: YTN; PAM sequence: CTC
cacagaagacaacaaatcac

SEQ ID NO: 50481 - DNA, 20 bp, Artificial Sequence
  Description of Artificial Sequence: Synthetic oligonucleotide
  Target: SCN10A; (-) strand; PAM type: YTN; PAM sequence: CTC
caaaaatgccagtgagagaa

SEQ ID NO: 50482 - DNA, 20 bp, Artificial Sequence
  Description of Artificial Sequence: Synthetic oligonucleotide
  Target: SCN10A; (-) strand; PAM type: YTN; PAM sequence: TTA
acctccaaaaatgccagtga

SEQ ID NO: 50483 - DNA, 20 bp, Artificial Sequence
  Description of Artificial Sequence: Synthetic oligonucleotide
  Target: SCN10A; (-) strand; PAM type: YTN; PAM sequence: TTT
aacctccaaaaatgccagtg

SEQ ID NO: 50484 - DNA, 20 bp, Artificial Sequence
  Description of Artificial Sequence: Synthetic oligonucleotide
  Target: SCN10A; (-) strand; PAM type: YTN; PAM sequence: CTT
taacctccaaaaatgccagt

SEQ ID NO: 50485 - DNA, 20 bp, Artificial Sequence
  Description of Artificial Sequence: Synthetic oligonucleotide
  Target: SCN10A; (-) strand; PAM type: YTN; PAM sequence: CTC
ccacaatggatcacctttaa

SEQ ID NO: 50486 - DNA, 20 bp, Artificial Sequence
  Description of Artificial Sequence: Synthetic oligonucleotide
  Target: SCN10A; (-) strand; PAM type: YTN; PAM sequence: CTC
cactcccacaatggatcacc

SEQ ID NO: 50487 - DNA, 20 bp, Artificial Sequence
  Description of Artificial Sequence: Synthetic oligonucleotide
  Target: SCN10A; (-) strand; PAM type: YTN; PAM sequence: CTC
tccactcccacaatggatca

SEQ ID NO: 50488 - DNA, 20 bp, Artificial Sequence
  Description of Artificial Sequence: Synthetic oligonucleotide
  Target: SCN10A; (-) strand; PAM type: YTN; PAM sequence: CTC
tctccactcccacaatggat

SEQ ID NO: 50489 - DNA, 20 bp, Artificial Sequence
  Description of Artificial Sequence: Synthetic oligonucleotide
  Target: SCN10A; (-) strand; PAM type: YTN; PAM sequence: TTG
acacaacctctctccactcc

SEQ ID NO: 50490 - DNA, 20 bp, Artificial Sequence
  Description of Artificial Sequence: Synthetic oligonucleotide
  Target: SCN10A; (-) strand; PAM type: YTN; PAM sequence: CTA
gggattgacacaacctctct

SEQ ID NO: 50491 - DNA, 20 bp, Artificial Sequence
  Description of Artificial Sequence: Synthetic oligonucleotide
  Target: SCN10A; (-) strand; PAM type: YTN; PAM sequence: CTA
gcagcactagggattgacac

SEQ ID NO: 50492 - DNA, 20 bp, Artificial Sequence
  Description of Artificial Sequence: Synthetic oligonucleotide
  Target: SCN10A; (-) strand; PAM type: YTN; PAM sequence: TTC
gcaggtgctagcagcactag

SEQ ID NO: 50493 - DNA, 20 bp, Artificial Sequence
  Description of Artificial Sequence: Synthetic oligonucleotide
  Target: SCN10A; (-) strand; PAM type: YTN; PAM sequence: CTT
cgcaggtgctagcagcacta

SEQ ID NO: 50494 - DNA, 20 bp, Artificial Sequence
  Description of Artificial Sequence: Synthetic oligonucleotide
  Target: SCN10A; (-) strand; PAM type: YTN; PAM sequence: CTC
ttcgcaggtgctagcagcac

SEQ ID NO: 50495 - DNA, 20 bp, Artificial Sequence
  Description of Artificial Sequence: Synthetic oligonucleotide
  Target: SCN10A; (-) strand; PAM type: YTN; PAM sequence: CTC
tcttcgcaggtgctagcagc

SEQ ID NO: 50496 - DNA, 20 bp, Artificial Sequence
  Description of Artificial Sequence: Synthetic oligonucleotide
  Target: SCN10A; (-) strand; PAM type: YTN; PAM sequence: TTC
tctcttcgcaggtgctagca

SEQ ID NO: 50497 - DNA, 20 bp, Artificial Sequence
  Description of Artificial Sequence: Synthetic oligonucleotide
  Target: SCN10A; (-) strand; PAM type: YTN; PAM sequence: CTG
ttctctcttcgcaggtgcta

SEQ ID NO: 50498 - DNA, 20 bp, Artificial Sequence
  Description of Artificial Sequence: Synthetic oligonucleotide
  Target: SCN10A; (-) strand; PAM type: YTN; PAM sequence: CTG
ctgttctctcttcgcaggtg

SEQ ID NO: 50499 - DNA, 20 bp, Artificial Sequence
  Description of Artificial Sequence: Synthetic oligonucleotide
  Target: SCN10A; (-) strand; PAM type: YTN; PAM sequence: CTA
cacctgctgttctctcttcg

SEQ ID NO: 50500 - DNA, 20 bp, Artificial Sequence
  Description of Artificial Sequence: Synthetic oligonucleotide
  Target: SCN10A; (-) strand; PAM type: YTN; PAM sequence: TTG
gctacacctgctgttctctc

SEQ ID NO: 50501 - DNA, 20 bp, Artificial Sequence
  Description of Artificial Sequence: Synthetic oligonucleotide
  Target: SCN10A; (-) strand; PAM type: YTN; PAM sequence: CTA
ttggctacacctgctgttct

SEQ ID NO: 50502 - DNA, 20 bp, Artificial Sequence
  Description of Artificial Sequence: Synthetic oligonucleotide
  Target: SCN10A; (-) strand; PAM type: YTN; PAM sequence: CTA
agtccaagcaaatactattg

SEQ ID NO: 50503 - DNA, 20 bp, Artificial Sequence
  Description of Artificial Sequence: Synthetic oligonucleotide
  Target: SCN10A; (-) strand; PAM type: YTN; PAM sequence: TTC
atgctaagtccaagcaaata

SEQ ID NO: 50504 - DNA, 20 bp, Artificial Sequence
  Description of Artificial Sequence: Synthetic oligonucleotide
  Target: SCN10A; (-) strand; PAM type: YTN; PAM sequence: CTG
ggggacacattcatgctaag

SEQ ID NO: 50505 - DNA, 20 bp, Artificial Sequence
  Description of Artificial Sequence: Synthetic oligonucleotide
  Target: SCN10A; (-) strand; PAM type: YTN; PAM sequence: CTG
gcaccccatgtctgggggac

SEQ ID NO: 50506 - DNA, 20 bp, Artificial Sequence
  Description of Artificial Sequence: Synthetic oligonucleotide
  Target: SCN10A; (-) strand; PAM type: YTN; PAM sequence: CTC
acccctggcaccccatgtct

SEQ ID NO: 50507 - DNA, 20 bp, Artificial Sequence
  Description of Artificial Sequence: Synthetic oligonucleotide
  Target: SCN10A; (-) strand; PAM type: YTN; PAM sequence: CTC
tcacccctggcaccccatgt

SEQ ID NO: 50508 - DNA, 20 bp, Artificial Sequence
  Description of Artificial Sequence: Synthetic oligonucleotide
  Target: SCN10A; (-) strand; PAM type: YTN; PAM sequence: TTC
agatctctcacccctggcac

SEQ ID NO: 50509 - DNA, 20 bp, Artificial Sequence
  Description of Artificial Sequence: Synthetic oligonucleotide
  Target: SCN10A; (-) strand; PAM type: YTN; PAM sequence: TTT
cagatctctcacccctggca

SEQ ID NO: 50510 - DNA, 20 bp, Artificial Sequence
  Description of Artificial Sequence: Synthetic oligonucleotide
  Target: SCN10A; (-) strand; PAM type: YTN; PAM sequence: CTG
tttcagatctctcacccctg

SEQ ID NO: 50511 - DNA, 20 bp, Artificial Sequence
  Description of Artificial Sequence: Synthetic oligonucleotide
  Target: SCN10A; (-) strand; PAM type: YTN; PAM sequence: CTC
tgtttcagatctctcacccc

SEQ ID NO: 50512 - DNA, 20 bp, Artificial Sequence
  Description of Artificial Sequence: Synthetic oligonucleotide
  Target: SCN10A; (-) strand; PAM type: YTN; PAM sequence: TTC
tctgtttcagatctctcacc

SEQ ID NO: 50513 - DNA, 20 bp, Artificial Sequence
  Description of Artificial Sequence: Synthetic oligonucleotide
  Target: SCN10A; (-) strand; PAM type: YTN; PAM sequence: CTT
ctctgtttcagatctctcac

SEQ ID NO: 50514 - DNA, 20 bp, Artificial Sequence
  Description of Artificial Sequence: Synthetic oligonucleotide
  Target: SCN10A; (-) strand; PAM type: YTN; PAM sequence: TTC
agcttctctgtttcagatct

SEQ ID NO: 50515 - DNA, 20 bp, Artificial Sequence
  Description of Artificial Sequence: Synthetic oligonucleotide
  Target: SCN10A; (-) strand; PAM type: YTN; PAM sequence: CTT
cagcttctctgtttcagatc

SEQ ID NO: 50516 - DNA, 20 bp, Artificial Sequence
  Description of Artificial Sequence: Synthetic oligonucleotide
  Target: SCN10A; (-) strand; PAM type: YTN; PAM sequence: CTA
acccttcagcttctctgttt

SEQ ID NO: 50517 - DNA, 20 bp, Artificial Sequence
  Description of Artificial Sequence: Synthetic oligonucleotide
  Target: SCN10A; (-) strand; PAM type: YTN; PAM sequence: CTG
gtcctaacccttcagcttct

SEQ ID NO: 50518 - DNA, 20 bp, Artificial Sequence
  Description of Artificial Sequence: Synthetic oligonucleotide
  Target: SCN10A; (-) strand; PAM type: YTN; PAM sequence: CTA
atcccaccaccaccctggtc

SEQ ID NO: 50519 - DNA, 20 bp, Artificial Sequence
  Description of Artificial Sequence: Synthetic oligonucleotide
  Target: SCN10A; (-) strand; PAM type: YTN; PAM sequence: CTG
ccatggcctaatcccaccac

SEQ ID NO: 50520 - DNA, 20 bp, Artificial Sequence
  Description of Artificial Sequence: Synthetic oligonucleotide
  Target: SCN10A; (-) strand; PAM type: YTN; PAM sequence: TTC
ctgccatggcctaatcccac

SEQ ID NO: 50521 - DNA, 20 bp, Artificial Sequence
  Description of Artificial Sequence: Synthetic oligonucleotide
  Target: SCN10A; (-) strand; PAM type: YTN; PAM sequence: CTG
ttcctgccatggcctaatcc

SEQ ID NO: 50522 - DNA, 20 bp, Artificial Sequence
  Description of Artificial Sequence: Synthetic oligonucleotide
  Target: SCN10A; (-) strand; PAM type: YTN; PAM sequence: CTG
ggtggggcaccaacagagta

SEQ ID NO: 50523 - DNA, 20 bp, Artificial Sequence
  Description of Artificial Sequence: Synthetic oligonucleotide
  Target: SCN10A; (-) strand; PAM type: YTN; PAM sequence: CTG
gtgaaagggatctgggtggg

SEQ ID NO: 50524 - DNA, 20 bp, Artificial Sequence
  Description of Artificial Sequence: Synthetic oligonucleotide
  Target: SCN10A; (-) strand; PAM type: YTN; PAM sequence: CTG
acctggtgaaagggatctgg

SEQ ID NO: 50525 - DNA, 20 bp, Artificial Sequence
  Description of Artificial Sequence: Synthetic oligonucleotide
  Target: SCN10A; (-) strand; PAM type: YTN; PAM sequence: CTG
tgctgacctggtgaaaggga

SEQ ID NO: 50526 - DNA, 20 bp, Artificial Sequence
  Description of Artificial Sequence: Synthetic oligonucleotide
  Target: SCN10A; (-) strand; PAM type: YTN; PAM sequence: CTC
gggatagctgtgctgacctg

SEQ ID NO: 50527 - DNA, 20 bp, Artificial Sequence
  Description of Artificial Sequence: Synthetic oligonucleotide
  Target: SCN10A; (-) strand; PAM type: YTN; PAM sequence: CTG
ccatgcaagcagctcgggat

SEQ ID NO: 50528 - DNA, 20 bp, Artificial Sequence
  Description of Artificial Sequence: Synthetic oligonucleotide
  Target: SCN10A; (-) strand; PAM type: YTN; PAM sequence: CTG
ctgccatgcaagcagctcgg

SEQ ID NO: 50529 - DNA, 20 bp, Artificial Sequence
  Description of Artificial Sequence: Synthetic oligonucleotide
  Target: SCN10A; (-) strand; PAM type: YTN; PAM sequence: CTG
caagtatgagccatcagctg

SEQ ID NO: 50530 - DNA, 20 bp, Artificial Sequence
  Description of Artificial Sequence: Synthetic oligonucleotide
  Target: SCN10A; (-) strand; PAM type: YTN; PAM sequence: TTG
tagaatgctgcaagtatgag

SEQ ID NO: 50531 - DNA, 20 bp, Artificial Sequence
  Description of Artificial Sequence: Synthetic oligonucleotide
  Target: SCN10A; (-) strand; PAM type: YTN; PAM sequence: TTT
gtagaatgctgcaagtatga

SEQ ID NO: 50532 - DNA, 20 bp, Artificial Sequence
  Description of Artificial Sequence: Synthetic oligonucleotide
  Target: SCN10A; (-) strand; PAM type: YTN; PAM sequence: TTT
tgtagaatgctgcaagtatg

SEQ ID NO: 50533 - DNA, 20 bp, Artificial Sequence
  Description of Artificial Sequence: Synthetic oligonucleotide
  Target: SCN10A; (-) strand; PAM type: YTN; PAM sequence: TTT
ttgtagaatgctgcaagtat

SEQ ID NO: 50534 - DNA, 20 bp, Artificial Sequence
  Description of Artificial Sequence: Synthetic oligonucleotide
  Target: SCN10A; (-) strand; PAM type: YTN; PAM sequence: TTT
tttgtagaatgctgcaagta

SEQ ID NO: 50535 - DNA, 20 bp, Artificial Sequence
  Description of Artificial Sequence: Synthetic oligonucleotide
  Target: SCN10A; (-) strand; PAM type: YTN; PAM sequence: TTT
ttttgtagaatgctgcaagt

SEQ ID NO: 50536 - DNA, 20 bp, Artificial Sequence
  Description of Artificial Sequence: Synthetic oligonucleotide
  Target: SCN10A; (-) strand; PAM type: YTN; PAM sequence: CTT
tttttgtagaatgctgcaag

SEQ ID NO: 50537 - DNA, 20 bp, Artificial Sequence
  Description of Artificial Sequence: Synthetic oligonucleotide
  Target: SCN10A; (-) strand; PAM type: YTN; PAM sequence: CTA
tcccagaagcaggcagccaa

SEQ ID NO: 50538 - DNA, 20 bp, Artificial Sequence
  Description of Artificial Sequence: Synthetic oligonucleotide
  Target: SCN10A; (-) strand; PAM type: YTN; PAM sequence: CTC
cccatacctatcccagaagc

SEQ ID NO: 50539 - DNA, 20 bp, Artificial Sequence
  Description of Artificial Sequence: Synthetic oligonucleotide
  Target: SCN10A; (-) strand; PAM type: YTN; PAM sequence: TTA
ccctccccatacctatccca

SEQ ID NO: 50540 - DNA, 20 bp, Artificial Sequence
  Description of Artificial Sequence: Synthetic oligonucleotide
  Target: SCN10A; (-) strand; PAM type: YTN; PAM sequence: TTT
accctccccatacctatccc

SEQ ID NO: 50541 - DNA, 20 bp, Artificial Sequence
  Description of Artificial Sequence: Synthetic oligonucleotide
  Target: SCN10A; (-) strand; PAM type: YTN; PAM sequence: TTT
taccctccccatacctatcc

SEQ ID NO: 50542 - DNA, 20 bp, Artificial Sequence
  Description of Artificial Sequence: Synthetic oligonucleotide
  Target: SCN10A; (-) strand; PAM type: YTN; PAM sequence: TTT
ttaccctccccatacctatc

SEQ ID NO: 50543 - DNA, 20 bp, Artificial Sequence
  Description of Artificial Sequence: Synthetic oligonucleotide
  Target: SCN10A; (-) strand; PAM type: YTN; PAM sequence: TTT
tttaccctccccatacctat

SEQ ID NO: 50544 - DNA, 20 bp, Artificial Sequence
  Description of Artificial Sequence: Synthetic oligonucleotide
  Target: SCN10A; (-) strand; PAM type: YTN; PAM sequence: TTT
ttttaccctccccataccta

SEQ ID NO: 50545 - DNA, 20 bp, Artificial Sequence
  Description of Artificial Sequence: Synthetic oligonucleotide
  Target: SCN10A; (-) strand; PAM type: YTN; PAM sequence: TTT
tttttaccctccccatacct

SEQ ID NO: 50546 - DNA, 20 bp, Artificial Sequence
  Description of Artificial Sequence: Synthetic oligonucleotide
  Target: SCN10A; (-) strand; PAM type: YTN; PAM sequence: TTT
ttttttaccctccccatacc

SEQ ID NO: 50547 - DNA, 20 bp, Artificial Sequence
  Description of Artificial Sequence: Synthetic oligonucleotide
  Target: SCN10A; (-) strand; PAM type: YTN; PAM sequence: TTT
tttttttaccctccccatac

SEQ ID NO: 50548 - DNA, 20 bp, Artificial Sequence
  Description of Artificial Sequence: Synthetic oligonucleotide
  Target: SCN10A; (-) strand; PAM type: YTN; PAM sequence: TTT
ttttttttaccctccccata

SEQ ID NO: 50549 - DNA, 20 bp, Artificial Sequence
  Description of Artificial Sequence: Synthetic oligonucleotide
  Target: SCN10A; (-) strand; PAM type: YTN; PAM sequence: CTT
tttttttttaccctccccat

SEQ ID NO: 50550 - DNA, 20 bp, Artificial Sequence
  Description of Artificial Sequence: Synthetic oligonucleotide
  Target: SCN10A; (-) strand; PAM type: YTN; PAM sequence: TTG
aggcaagggggccagctttt

SEQ ID NO: 50551 - DNA, 20 bp, Artificial Sequence
  Description of Artificial Sequence: Synthetic oligonucleotide
  Target: SCN10A; (-) strand; PAM type: YTN; PAM sequence: CTT
gaggcaagggggccagcttt

SEQ ID NO: 50552 - DNA, 20 bp, Artificial Sequence
  Description of Artificial Sequence: Synthetic oligonucleotide
  Target: SCN10A; (-) strand; PAM type: YTN; PAM sequence: CTA
ccttgaggcaagggggccag

SEQ ID NO: 50553 - DNA, 20 bp, Artificial Sequence
  Description of Artificial Sequence: Synthetic oligonucleotide
  Target: SCN10A; (-) strand; PAM type: YTN; PAM sequence: TTA
gtcctaccttgaggcaaggg

SEQ ID NO: 50554 - DNA, 20 bp, Artificial Sequence
  Description of Artificial Sequence: Synthetic oligonucleotide
  Target: SCN10A; (-) strand; PAM type: YTN; PAM sequence: CTG
taccacagttagtcctacct

SEQ ID NO: 50555 - DNA, 20 bp, Artificial Sequence
  Description of Artificial Sequence: Synthetic oligonucleotide
  Target: SCN10A; (-) strand; PAM type: YTN; PAM sequence: CTG
gggcatgacctgtaccacag

SEQ ID NO: 50556 - DNA, 20 bp, Artificial Sequence
  Description of Artificial Sequence: Synthetic oligonucleotide
  Target: SCN10A; (-) strand; PAM type: YTN; PAM sequence: CTC
tggggcatgacctgtaccac

SEQ ID NO: 50557 - DNA, 20 bp, Artificial Sequence
  Description of Artificial Sequence: Synthetic oligonucleotide
  Target: SCN10A; (-) strand; PAM type: YTN; PAM sequence: TTG
atcccatggggaactctggg

SEQ ID NO: 50558 - DNA, 20 bp, Artificial Sequence
  Description of Artificial Sequence: Synthetic oligonucleotide
  Target: SCN10A; (-) strand; PAM type: YTN; PAM sequence: CTT
gatcccatggggaactctgg

SEQ ID NO: 50559 - DNA, 20 bp, Artificial Sequence
  Description of Artificial Sequence: Synthetic oligonucleotide
  Target: SCN10A; (-) strand; PAM type: YTN; PAM sequence: TTC
agcttgatcccatggggaac

SEQ ID NO: 50560 - DNA, 20 bp, Artificial Sequence
  Description of Artificial Sequence: Synthetic oligonucleotide
  Target: SCN10A; (-) strand; PAM type: YTN; PAM sequence: CTT
cagcttgatcccatggggaa

SEQ ID NO: 50561 - DNA, 20 bp, Artificial Sequence
  Description of Artificial Sequence: Synthetic oligonucleotide
  Target: SCN10A; (-) strand; PAM type: YTN; PAM sequence: CTA
gagaccagcttcagcttgat

SEQ ID NO: 50562 - DNA, 20 bp, Artificial Sequence
  Description of Artificial Sequence: Synthetic oligonucleotide
  Target: SCN10A; (-) strand; PAM type: YTN; PAM sequence: CTC
agctagagaccagcttcagc

SEQ ID NO: 50563 - DNA, 20 bp, Artificial Sequence
  Description of Artificial Sequence: Synthetic oligonucleotide
  Target: SCN10A; (-) strand; PAM type: YTN; PAM sequence: TTC
tcagctagagaccagcttca

SEQ ID NO: 50564 - DNA, 20 bp, Artificial Sequence
  Description of Artificial Sequence: Synthetic oligonucleotide
  Target: SCN10A; (-) strand; PAM type: YTN; PAM sequence: CTA
aacaaggagtgttctcagct

SEQ ID NO: 50565 - DNA, 20 bp, Artificial Sequence
  Description of Artificial Sequence: Synthetic oligonucleotide
  Target: SCN10A; (-) strand; PAM type: YTN; PAM sequence: CTC
aggagaaagcgaatgaagca

SEQ ID NO: 50566 - DNA, 20 bp, Artificial Sequence
  Description of Artificial Sequence: Synthetic oligonucleotide
  Target: SCN10A; (-) strand; PAM type: YTN; PAM sequence: CTC
tcaggagaaagcgaatgaag

SEQ ID NO: 50567 - DNA, 20 bp, Artificial Sequence
  Description of Artificial Sequence: Synthetic oligonucleotide
  Target: SCN10A; (-) strand; PAM type: YTN; PAM sequence: TTG
agggagtgctctcaggagaa

SEQ ID NO: 50568 - DNA, 20 bp, Artificial Sequence
  Description of Artificial Sequence: Synthetic oligonucleotide
  Target: SCN10A; (-) strand; PAM type: YTN; PAM sequence: CTA
ttgagggagtgctctcagga

SEQ ID NO: 50569 - DNA, 20 bp, Artificial Sequence
  Description of Artificial Sequence: Synthetic oligonucleotide
  Target: SCN10A; (-) strand; PAM type: YTN; PAM sequence: TTG
tgcaagtgacctattgaggg

SEQ ID NO: 50570 - DNA, 20 bp, Artificial Sequence
  Description of Artificial Sequence: Synthetic oligonucleotide
  Target: SCN10A; (-) strand; PAM type: YTN; PAM sequence: CTT
gtgcaagtgacctattgagg

SEQ ID NO: 50571 - DNA, 20 bp, Artificial Sequence
  Description of Artificial Sequence: Synthetic oligonucleotide
  Target: SCN10A; (-) strand; PAM type: YTN; PAM sequence: TTC
ttgtgcaagtgacctattga

SEQ ID NO: 50572 - DNA, 20 bp, Artificial Sequence
  Description of Artificial Sequence: Synthetic oligonucleotide
  Target: SCN10A; (-) strand; PAM type: YTN; PAM sequence: CTA
agtgaggattcttgtgcaag

SEQ ID NO: 50573 - DNA, 20 bp, Artificial Sequence
  Description of Artificial Sequence: Synthetic oligonucleotide
  Target: SCN10A; (-) strand; PAM type: YTN; PAM sequence: CTC
aaagaagaagctaagtgagg

SEQ ID NO: 50574 - DNA, 20 bp, Artificial Sequence
  Description of Artificial Sequence: Synthetic oligonucleotide
  Target: SCN10A; (-) strand; PAM type: YTN; PAM sequence: TTC
tcaaagaagaagctaagtga

SEQ ID NO: 50575 - DNA, 20 bp, Artificial Sequence
  Description of Artificial Sequence: Synthetic oligonucleotide
  Target: SCN10A; (-) strand; PAM type: YTN; PAM sequence: TTT
ctcaaagaagaagctaagtg

SEQ ID NO: 50576 - DNA, 20 bp, Artificial Sequence
  Description of Artificial Sequence: Synthetic oligonucleotide
  Target: SCN10A; (-) strand; PAM type: YTN; PAM sequence: TTT
tctcaaagaagaagctaagt

SEQ ID NO: 50577 - DNA, 20 bp, Artificial Sequence
  Description of Artificial Sequence: Synthetic oligonucleotide
  Target: SCN10A; (-) strand; PAM type: YTN; PAM sequence: TTA
gatcaggttttctcaaagaa

SEQ ID NO: 50578 - DNA, 20 bp, Artificial Sequence
  Description of Artificial Sequence: Synthetic oligonucleotide
  Target: SCN10A; (-) strand; PAM type: YTN; PAM sequence: CTC
agggaccatattagatcagg

SEQ ID NO: 50579 - DNA, 20 bp, Artificial Sequence
  Description of Artificial Sequence: Synthetic oligonucleotide
  Target: SCN10A; (-) strand; PAM type: YTN; PAM sequence: TTG
cctcagggaccatattagat

SEQ ID NO: 50580 - DNA, 20 bp, Artificial Sequence
  Description of Artificial Sequence: Synthetic oligonucleotide
  Target: SCN10A; (-) strand; PAM type: YTN; PAM sequence: CTT
gcctcagggaccatattaga

SEQ ID NO: 50581 - DNA, 20 bp, Artificial Sequence
  Description of Artificial Sequence: Synthetic oligonucleotide
  Target: SCN10A; (-) strand; PAM type: YTN; PAM sequence: CTA
taggaggaatcatcttgcct

SEQ ID NO: 50582 - DNA, 20 bp, Artificial Sequence
  Description of Artificial Sequence: Synthetic oligonucleotide
  Target: SCN10A; (-) strand; PAM type: YTN; PAM sequence: TTA
gggagctataggaggaatca

SEQ ID NO: 50583 - DNA, 20 bp, Artificial Sequence
  Description of Artificial Sequence: Synthetic oligonucleotide
  Target: SCN10A; (-) strand; PAM type: YTN; PAM sequence: TTT
agggagctataggaggaatc

SEQ ID NO: 50584 - DNA, 20 bp, Artificial Sequence
  Description of Artificial Sequence: Synthetic oligonucleotide
  Target: SCN10A; (-) strand; PAM type: YTN; PAM sequence: TTA
gggcaccgtttagggagcta

SEQ ID NO: 50585 - DNA, 20 bp, Artificial Sequence
  Description of Artificial Sequence: Synthetic oligonucleotide
  Target: SCN10A; (-) strand; PAM type: YTN; PAM sequence: TTC
aattagggcaccgtttaggg

SEQ ID NO: 50586 - DNA, 20 bp, Artificial Sequence
  Description of Artificial Sequence: Synthetic oligonucleotide
  Target: SCN10A; (-) strand; PAM type: YTN; PAM sequence: CTT
caattagggcaccgtttagg

SEQ ID NO: 50587 - DNA, 20 bp, Artificial Sequence
  Description of Artificial Sequence: Synthetic oligonucleotide
  Target: SCN10A; (-) strand; PAM type: YTN; PAM sequence: CTA
gccacttcaattagggcacc

SEQ ID NO: 50588 - DNA, 20 bp, Artificial Sequence
  Description of Artificial Sequence: Synthetic oligonucleotide
  Target: SCN10A; (-) strand; PAM type: YTN; PAM sequence: CTG
gactagccacttcaattagg

SEQ ID NO: 50589 - DNA, 20 bp, Artificial Sequence
  Description of Artificial Sequence: Synthetic oligonucleotide
  Target: SCN10A; (-) strand; PAM type: YTN; PAM sequence: TTC
tggactagccacttcaatta

SEQ ID NO: 50590 - DNA, 20 bp, Artificial Sequence
  Description of Artificial Sequence: Synthetic oligonucleotide
  Target: SCN10A; (-) strand; PAM type: YTN; PAM sequence: CTG
ttctggactagccacttcaa

SEQ ID NO: 50591 - DNA, 20 bp, Artificial Sequence
  Description of Artificial Sequence: Synthetic oligonucleotide
  Target: SCN10A; (-) strand; PAM type: YTN; PAM sequence: TTG
gatactgttctggactagcc

SEQ ID NO: 50592 - DNA, 20 bp, Artificial Sequence
  Description of Artificial Sequence: Synthetic oligonucleotide
  Target: SCN10A; (-) strand; PAM type: YTN; PAM sequence: CTT
ggatactgttctggactagc

SEQ ID NO: 50593 - DNA, 20 bp, Artificial Sequence
  Description of Artificial Sequence: Synthetic oligonucleotide
  Target: SCN10A; (-) strand; PAM type: YTN; PAM sequence: TTC
ttggatactgttctggacta

SEQ ID NO: 50594 - DNA, 20 bp, Artificial Sequence
  Description of Artificial Sequence: Synthetic oligonucleotide
  Target: SCN10A; (-) strand; PAM type: YTN; PAM sequence: CTG
tccattcttggatactgttc

SEQ ID NO: 50595 - DNA, 20 bp, Artificial Sequence
  Description of Artificial Sequence: Synthetic oligonucleotide
  Target: SCN10A; (-) strand; PAM type: YTN; PAM sequence: TTG
cagactgtccattcttggat

SEQ ID NO: 50596 - DNA, 20 bp, Artificial Sequence
  Description of Artificial Sequence: Synthetic oligonucleotide
  Target: SCN10A; (-) strand; PAM type: YTN; PAM sequence: TTG
tgaagaaggttgcagactgt

SEQ ID NO: 50597 - DNA, 20 bp, Artificial Sequence
  Description of Artificial Sequence: Synthetic oligonucleotide
  Target: SCN10A; (-) strand; PAM type: YTN; PAM sequence: TTT
gtgaagaaggttgcagactg

SEQ ID NO: 50598 - DNA, 20 bp, Artificial Sequence
  Description of Artificial Sequence: Synthetic oligonucleotide
  Target: SCN10A; (-) strand; PAM type: YTN; PAM sequence: CTT
tgtgaagaaggttgcagact

SEQ ID NO: 50599 - DNA, 20 bp, Artificial Sequence
  Description of Artificial Sequence: Synthetic oligonucleotide
  Target: SCN10A; (-) strand; PAM type: YTN; PAM sequence: TTG
tgaggagtggaagctttgtg

SEQ ID NO: 50600 - DNA, 20 bp, Artificial Sequence
  Description of Artificial Sequence: Synthetic oligonucleotide
  Target: SCN10A; (-) strand; PAM type: YTN; PAM sequence: TTT
gtgaggagtggaagctttgt

SEQ ID NO: 50601 - DNA, 20 bp, Artificial Sequence
  Description of Artificial Sequence: Synthetic oligonucleotide
  Target: SCN10A; (-) strand; PAM type: YTN; PAM sequence: CTC
cggaaggagcaggaggtttg

SEQ ID NO: 50602 - DNA, 20 bp, Artificial Sequence
  Description of Artificial Sequence: Synthetic oligonucleotide
  Target: SCN10A; (-) strand; PAM type: YTN; PAM sequence: CTC
gagatgctccggaaggagca

SEQ ID NO: 50603 - DNA, 20 bp, Artificial Sequence
  Description of Artificial Sequence: Synthetic oligonucleotide
  Target: SCN10A; (-) strand; PAM type: YTN; PAM sequence: TTC
caggaggccctcgagatgct

SEQ ID NO: 50604 - DNA, 20 bp, Artificial Sequence
  Description of Artificial Sequence: Synthetic oligonucleotide
  Target: SCN10A; (-) strand; PAM type: YTN; PAM sequence: TTG
aagcaaaggagaagaagttc

SEQ ID NO: 50605 - DNA, 20 bp, Artificial Sequence
  Description of Artificial Sequence: Synthetic oligonucleotide
  Target: SCN10A; (-) strand; PAM type: YTN; PAM sequence: CTG
atgaaattgaagcaaaggag

SEQ ID NO: 50606 - DNA, 20 bp, Artificial Sequence
  Description of Artificial Sequence: Synthetic oligonucleotide
  Target: SCN10A; (-) strand; PAM type: YTN; PAM sequence: CTG
tagtcaccatggcgtatgag

SEQ ID NO: 50607 - DNA, 20 bp, Artificial Sequence
  Description of Artificial Sequence: Synthetic oligonucleotide
  Target: SCN10A; (-) strand; PAM type: YTN; PAM sequence: TTG
gctgtagtcaccatggcgta

SEQ ID NO: 50608 - DNA, 20 bp, Artificial Sequence
  Description of Artificial Sequence: Synthetic oligonucleotide
  Target: SCN10A; (-) strand; PAM type: YTN; PAM sequence: CTT
ggctgtagtcaccatggcgt

SEQ ID NO: 50609 - DNA, 20 bp, Artificial Sequence
  Description of Artificial Sequence: Synthetic oligonucleotide
  Target: SCN10A; (-) strand; PAM type: YTN; PAM sequence: TTG
atcttggctgtagtcaccat

SEQ ID NO: 50610 - DNA, 20 bp, Artificial Sequence
  Description of Artificial Sequence: Synthetic oligonucleotide
  Target: SCN10A; (-) strand; PAM type: YTN; PAM sequence: CTT
gatcttggctgtagtcacca

SEQ ID NO: 50611 - DNA, 20 bp, Artificial Sequence
  Description of Artificial Sequence: Synthetic oligonucleotide
  Target: SCN10A; (-) strand; PAM type: YTN; PAM sequence: CTG
gtcaacttgatcttggctgt

SEQ ID NO: 50612 - DNA, 20 bp, Artificial Sequence
  Description of Artificial Sequence: Synthetic oligonucleotide
  Target: SCN10A; (-) strand; PAM type: YTN; PAM sequence: CTA
cctggtcaacttgatcttgg

SEQ ID NO: 50613 - DNA, 20 bp, Artificial Sequence
  Description of Artificial Sequence: Synthetic oligonucleotide
  Target: SCN10A; (-) strand; PAM type: YTN; PAM sequence: TTC
tacctggtcaacttgatctt

SEQ ID NO: 50614 - DNA, 20 bp, Artificial Sequence
  Description of Artificial Sequence: Synthetic oligonucleotide
  Target: SCN10A; (-) strand; PAM type: YTN; PAM sequence: TTT
ctacctggtcaacttgatct

SEQ ID NO: 50615 - DNA, 20 bp, Artificial Sequence
  Description of Artificial Sequence: Synthetic oligonucleotide
  Target: SCN10A; (-) strand; PAM type: YTN; PAM sequence: CTT
tctacctggtcaacttgatc

SEQ ID NO: 50616 - DNA, 20 bp, Artificial Sequence
  Description of Artificial Sequence: Synthetic oligonucleotide
  Target: SCN10A; (-) strand; PAM type: YTN; PAM sequence: CTG
ggatctttctacctggtcaa

SEQ ID NO: 50617 - DNA, 20 bp, Artificial Sequence
  Description of Artificial Sequence: Synthetic oligonucleotide
  Target: SCN10A; (-) strand; PAM type: YTN; PAM sequence: TTC
ctgggatctttctacctggt

SEQ ID NO: 50618 - DNA, 20 bp, Artificial Sequence
  Description of Artificial Sequence: Synthetic oligonucleotide
  Target: SCN10A; (-) strand; PAM type: YTN; PAM sequence: CTT
cctgggatctttctacctgg

SEQ ID NO: 50619 - DNA, 20 bp, Artificial Sequence
  Description of Artificial Sequence: Synthetic oligonucleotide
  Target: SCN10A; (-) strand; PAM type: YTN; PAM sequence: CTC
gtaatcttcctgggatcttt

SEQ ID NO: 50620 - DNA, 20 bp, Artificial Sequence
  Description of Artificial Sequence: Synthetic oligonucleotide
  Target: SCN10A; (-) strand; PAM type: YTN; PAM sequence: TTG
tgctcgtaatcttcctggga

SEQ ID NO: 50621 - DNA, 20 bp, Artificial Sequence
  Description of Artificial Sequence: Synthetic oligonucleotide
  Target: SCN10A; (-) strand; PAM type: YTN; PAM sequence: TTT
gtgctcgtaatcttcctggg

SEQ ID NO: 50622 - DNA, 20 bp, Artificial Sequence
  Description of Artificial Sequence: Synthetic oligonucleotide
  Target: SCN10A; (-) strand; PAM type: YTN; PAM sequence: TTT
tgtgctcgtaatcttcctgg

SEQ ID NO: 50623 - DNA, 20 bp, Artificial Sequence
  Description of Artificial Sequence: Synthetic oligonucleotide
  Target: SCN10A; (-) strand; PAM type: YTN; PAM sequence: TTT
ttgtgctcgtaatcttcctg

SEQ ID NO: 50624 - DNA, 20 bp, Artificial Sequence
  Description of Artificial Sequence: Synthetic oligonucleotide
  Target: SCN10A; (-) strand; PAM type: YTN; PAM sequence: TTT
tttgtgctcgtaatcttcct

SEQ ID NO: 50625 - DNA, 20 bp, Artificial Sequence
  Description of Artificial Sequence: Synthetic oligonucleotide
  Target: SCN10A; (-) strand; PAM type: YTN; PAM sequence: CTT
ttttgtgctcgtaatcttcc

SEQ ID NO: 50626 - DNA, 20 bp, Artificial Sequence
  Description of Artificial Sequence: Synthetic oligonucleotide
  Target: SCN10A; (-) strand; PAM type: YTN; PAM sequence: CTA
tatgatcttttttgtgctcg

SEQ ID NO: 50627 - DNA, 20 bp, Artificial Sequence
  Description of Artificial Sequence: Synthetic oligonucleotide
  Target: SCN10A; (-) strand; PAM type: YTN; PAM sequence: CTG
ggaaaatctatatgatcttt

SEQ ID NO: 50628 - DNA, 20 bp, Artificial Sequence
  Description of Artificial Sequence: Synthetic oligonucleotide
  Target: SCN10A; (-) strand; PAM type: YTN; PAM sequence: TTC
tgggaaaatctatatgatct

SEQ ID NO: 50629 - DNA, 20 bp, Artificial Sequence
  Description of Artificial Sequence: Synthetic oligonucleotide
  Target: SCN10A; (-) strand; PAM type: YTN; PAM sequence: CTT
ctgggaaaatctatatgatc

SEQ ID NO: 50630 - DNA, 20 bp, Artificial Sequence
  Description of Artificial Sequence: Synthetic oligonucleotide
  Target: SCN10A; (-) strand; PAM type: YTN; PAM sequence: CTG
aggacttctgggaaaatcta

SEQ ID NO: 50631 - DNA, 20 bp, Artificial Sequence
  Description of Artificial Sequence: Synthetic oligonucleotide
  Target: SCN10A; (-) strand; PAM type: YTN; PAM sequence: CTG
cagaccctgaggacttctgg

SEQ ID NO: 50632 - DNA, 20 bp, Artificial Sequence
  Description of Artificial Sequence: Synthetic oligonucleotide
  Target: SCN10A; (-) strand; PAM type: YTN; PAM sequence: TTG
aacctgcagaccctgaggac

SEQ ID NO: 50633 - DNA, 20 bp, Artificial Sequence
  Description of Artificial Sequence: Synthetic oligonucleotide
  Target: SCN10A; (-) strand; PAM type: YTN; PAM sequence: CTT
gaacctgcagaccctgagga

SEQ ID NO: 50634 - DNA, 20 bp, Artificial Sequence
  Description of Artificial Sequence: Synthetic oligonucleotide
  Target: SCN10A; (-) strand; PAM type: YTN; PAM sequence: TTC
ccttgaacctgcagaccctg

SEQ ID NO: 50635 - DNA, 20 bp, Artificial Sequence
  Description of Artificial Sequence: Synthetic oligonucleotide
  Target: SCN10A; (-) strand; PAM type: YTN; PAM sequence: TTT
cccttgaacctgcagaccct

SEQ ID NO: 50636 - DNA, 20 bp, Artificial Sequence
  Description of Artificial Sequence: Synthetic oligonucleotide
  Target: SCN10A; (-) strand; PAM type: YTN; PAM sequence: CTT
tcccttgaacctgcagaccc

SEQ ID NO: 50637 - DNA, 20 bp, Artificial Sequence
  Description of Artificial Sequence: Synthetic oligonucleotide
  Target: SCN10A; (-) strand; PAM type: YTN; PAM sequence: TTC
tttcccttgaacctgcagac

SEQ ID NO: 50638 - DNA, 20 bp, Artificial Sequence
  Description of Artificial Sequence: Synthetic oligonucleotide
  Target: SCN10A; (-) strand; PAM type: YTN; PAM sequence: CTT
ctttcccttgaacctgcaga

SEQ ID NO: 50639 - DNA, 20 bp, Artificial Sequence
  Description of Artificial Sequence: Synthetic oligonucleotide
  Target: SCN10A; (-) strand; PAM type: YTN; PAM sequence: CTC
ttctttcccttgaacctgca

SEQ ID NO: 50640 - DNA, 20 bp, Artificial Sequence
  Description of Artificial Sequence: Synthetic oligonucleotide
  Target: SCN10A; (-) strand; PAM type: YTN; PAM sequence: TTC
tcttctttcccttgaacctg

SEQ ID NO: 50641 - DNA, 20 bp, Artificial Sequence
  Description of Artificial Sequence: Synthetic oligonucleotide
  Target: SCN10A; (-) strand; PAM type: YTN; PAM sequence: TTT
ctcttctttcccttgaacct

SEQ ID NO: 50642 - DNA, 20 bp, Artificial Sequence
  Description of Artificial Sequence: Synthetic oligonucleotide
  Target: SCN10A; (-) strand; PAM type: YTN; PAM sequence: CTA
tgggtacaggtttctcttct

SEQ ID NO: 50643 - DNA, 20 bp, Artificial Sequence
  Description of Artificial Sequence: Synthetic oligonucleotide
  Target: SCN10A; (-) strand; PAM type: YTN; PAM sequence: TTC
aggggtccatgtgctatggg

SEQ ID NO: 50644 - DNA, 20 bp, Artificial Sequence
  Description of Artificial Sequence: Synthetic oligonucleotide
  Target: SCN10A; (-) strand; PAM type: YTN; PAM sequence: TTA
aattcaggggtccatgtgct

SEQ ID NO: 50645 - DNA, 20 bp, Artificial Sequence
  Description of Artificial Sequence: Synthetic oligonucleotide
  Target: SCN10A; (-) strand; PAM type: YTN; PAM sequence: CTT
aaattcaggggtccatgtgc

SEQ ID NO: 50646 - DNA, 20 bp, Artificial Sequence
  Description of Artificial Sequence: Synthetic oligonucleotide
  Target: SCN10A; (-) strand; PAM type: YTN; PAM sequence: CTG
acttaaattcaggggtccat

SEQ ID NO: 50647 - DNA, 20 bp, Artificial Sequence
  Description of Artificial Sequence: Synthetic oligonucleotide
  Target: SCN10A; (-) strand; PAM type: YTN; PAM sequence: CTG
gaggaggctgacttaaattc

SEQ ID NO: 50648 - DNA, 20 bp, Artificial Sequence
  Description of Artificial Sequence: Synthetic oligonucleotide
  Target: SCN10A; (-) strand; PAM type: YTN; PAM sequence: TTC
ctggaggaggctgacttaaa

SEQ ID NO: 50649 - DNA, 20 bp, Artificial Sequence
  Description of Artificial Sequence: Synthetic oligonucleotide
  Target: SCN10A; (-) strand; PAM type: YTN; PAM sequence: TTT
cctggaggaggctgacttaa

SEQ ID NO: 50650 - DNA, 20 bp, Artificial Sequence
  Description of Artificial Sequence: Synthetic oligonucleotide
  Target: SCN10A; (-) strand; PAM type: YTN; PAM sequence: TTT
tcctggaggaggctgactta

SEQ ID NO: 50651 - DNA, 20 bp, Artificial Sequence
  Description of Artificial Sequence: Synthetic oligonucleotide
  Target: SCN10A; (-) strand; PAM type: YTN; PAM sequence: CTT
ttcctggaggaggctgactt

SEQ ID NO: 50652 - DNA, 20 bp, Artificial Sequence
  Description of Artificial Sequence: Synthetic oligonucleotide
  Target: SCN10A; (-) strand; PAM type: YTN; PAM sequence: CTG
tgcttttcctggaggaggct

SEQ ID NO: 50653 - DNA, 20 bp, Artificial Sequence
  Description of Artificial Sequence: Synthetic oligonucleotide
  Target: SCN10A; (-) strand; PAM type: YTN; PAM sequence: CTG
catggctgtgcttttcctgg

SEQ ID NO: 50654 - DNA, 20 bp, Artificial Sequence
  Description of Artificial Sequence: Synthetic oligonucleotide
  Target: SCN10A; (-) strand; PAM type: YTN; PAM sequence: CTG
gtgggtcagctgcatggctg

SEQ ID NO: 50655 - DNA, 20 bp, Artificial Sequence
  Description of Artificial Sequence: Synthetic oligonucleotide
  Target: SCN10A; (-) strand; PAM type: YTN; PAM sequence: TTG
gaggctggtgggtcagctgc

SEQ ID NO: 50656 - DNA, 20 bp, Artificial Sequence
  Description of Artificial Sequence: Synthetic oligonucleotide
  Target: SCN10A; (-) strand; PAM type: YTN; PAM sequence: TTG
gttggaggctggtgggtcag

SEQ ID NO: 50657 - DNA, 20 bp, Artificial Sequence
  Description of Artificial Sequence: Synthetic oligonucleotide
  Target: SCN10A; (-) strand; PAM type: YTN; PAM sequence: CTT
ggttggaggctggtgggtca

SEQ ID NO: 50658 - DNA, 20 bp, Artificial Sequence
  Description of Artificial Sequence: Synthetic oligonucleotide
  Target: SCN10A; (-) strand; PAM type: YTN; PAM sequence: TTC
ccccacgcagacttggttgg

SEQ ID NO: 50659 - DNA, 20 bp, Artificial Sequence
  Description of Artificial Sequence: Synthetic oligonucleotide
  Target: SCN10A; (-) strand; PAM type: YTN; PAM sequence: CTG
cattcccccacgcagacttg

SEQ ID NO: 50660 - DNA, 20 bp, Artificial Sequence
  Description of Artificial Sequence: Synthetic oligonucleotide
  Target: SCN10A; (-) strand; PAM type: YTN; PAM sequence: CTG
agctgcattcccccacgcag

SEQ ID NO: 50661 - DNA, 20 bp, Artificial Sequence
  Description of Artificial Sequence: Synthetic oligonucleotide
  Target: SCN10A; (-) strand; PAM type: YTN; PAM sequence: CTA
ccagcaggtactgagctgca

SEQ ID NO: 50662 - DNA, 20 bp, Artificial Sequence
  Description of Artificial Sequence: Synthetic oligonucleotide
  Target: SCN10A; (-) strand; PAM type: YTN; PAM sequence: CTC
taccagcaggtactgagctg

SEQ ID NO: 50663 - DNA, 20 bp, Artificial Sequence
  Description of Artificial Sequence: Synthetic oligonucleotide
  Target: SCN10A; (-) strand; PAM type: YTN; PAM sequence: CTG
ggaacgcctctaccagcagg

SEQ ID NO: 50664 - DNA, 20 bp, Artificial Sequence
  Description of Artificial Sequence: Synthetic oligonucleotide
  Target: SCN10A; (-) strand; PAM type: YTN; PAM sequence: TTC
ctgggaacgcctctaccagc

SEQ ID NO: 50665 - DNA, 20 bp, Artificial Sequence
  Description of Artificial Sequence: Synthetic oligonucleotide
  Target: SCN10A; (-) strand; PAM type: YTN; PAM sequence: CTC
atgacacaggattcctggga

SEQ ID NO: 50666 - DNA, 20 bp, Artificial Sequence
  Description of Artificial Sequence: Synthetic oligonucleotide
  Target: SCN10A; (-) strand; PAM type: YTN; PAM sequence: TTC
cgcctcatgacacaggattc

SEQ ID NO: 50667 - DNA, 20 bp, Artificial Sequence
  Description of Artificial Sequence: Synthetic oligonucleotide
  Target: SCN10A; (-) strand; PAM type: YTN; PAM sequence: CTG
ttccgcctcatgacacagga

SEQ ID NO: 50668 - DNA, 20 bp, Artificial Sequence
  Description of Artificial Sequence: Synthetic oligonucleotide
  Target: SCN10A; (-) strand; PAM type: YTN; PAM sequence: CTC
actgttccgcctcatgacac

SEQ ID NO: 50669 - DNA, 20 bp, Artificial Sequence
  Description of Artificial Sequence: Synthetic oligonucleotide
  Target: SCN10A; (-) strand; PAM type: YTN; PAM sequence: CTC
tcactgttccgcctcatgac

SEQ ID NO: 50670 - DNA, 20 bp, Artificial Sequence
  Description of Artificial Sequence: Synthetic oligonucleotide
  Target: SCN10A; (-) strand; PAM type: YTN; PAM sequence: TTC
ctctcactgttccgcctcat

SEQ ID NO: 50671 - DNA, 20 bp, Artificial Sequence
  Description of Artificial Sequence: Synthetic oligonucleotide
  Target: SCN10A; (-) strand; PAM type: YTN; PAM sequence: TTT
cctctcactgttccgcctca

SEQ ID NO: 50672 - DNA, 20 bp, Artificial Sequence
  Description of Artificial Sequence: Synthetic oligonucleotide
  Target: SCN10A; (-) strand; PAM type: YTN; PAM sequence: CTT
tcctctcactgttccgcctc

SEQ ID NO: 50673 - DNA, 20 bp, Artificial Sequence
  Description of Artificial Sequence: Synthetic oligonucleotide
  Target: SCN10A; (-) strand; PAM type: YTN; PAM sequence: TTG
ggctttcctctcactgttcc

SEQ ID NO: 50674 - DNA, 20 bp, Artificial Sequence
  Description of Artificial Sequence: Synthetic oligonucleotide
  Target: SCN10A; (-) strand; PAM type: YTN; PAM sequence: CTT
gggctttcctctcactgttc

SEQ ID NO: 50675 - DNA, 20 bp, Artificial Sequence
  Description of Artificial Sequence: Synthetic oligonucleotide
  Target: SCN10A; (-) strand; PAM type: YTN; PAM sequence: TTG
cttgggctttcctctcactg

SEQ ID NO: 50676 - DNA, 20 bp, Artificial Sequence
  Description of Artificial Sequence: Synthetic oligonucleotide
  Target: SCN10A; (-) strand; PAM type: YTN; PAM sequence: TTT
gcttgggctttcctctcact

SEQ ID NO: 50677 - DNA, 20 bp, Artificial Sequence
  Description of Artificial Sequence: Synthetic oligonucleotide
  Target: SCN10A; (-) strand; PAM type: YTN; PAM sequence: CTT
tgcttgggctttcctctcac

SEQ ID NO: 50678 - DNA, 20 bp, Artificial Sequence
  Description of Artificial Sequence: Synthetic oligonucleotide
  Target: SCN10A; (-) strand; PAM type: YTN; PAM sequence: TTC
ctttgcttgggctttcctct

SEQ ID NO: 50679 - DNA, 20 bp, Artificial Sequence
  Description of Artificial Sequence: Synthetic oligonucleotide
  Target: SCN10A; (-) strand; PAM type: YTN; PAM sequence: TTG
attcctttgcttgggctttc

SEQ ID NO: 50680 - DNA, 20 bp, Artificial Sequence
  Description of Artificial Sequence: Synthetic oligonucleotide
  Target: SCN10A; (-) strand; PAM type: YTN; PAM sequence: TTT
gattcctttgcttgggcttt

SEQ ID NO: 50681 - DNA, 20 bp, Artificial Sequence
  Description of Artificial Sequence: Synthetic oligonucleotide
  Target: SCN10A; (-) strand; PAM type: YTN; PAM sequence: CTT
tgattcctttgcttgggctt

SEQ ID NO: 50682 - DNA, 20 bp, Artificial Sequence
  Description of Artificial Sequence: Synthetic oligonucleotide
  Target: SCN10A; (-) strand; PAM type: YTN; PAM sequence: CTA
caccagctttgattcctttg

SEQ ID NO: 50683 - DNA, 20 bp, Artificial Sequence
  Description of Artificial Sequence: Synthetic oligonucleotide
  Target: SCN10A; (-) strand; PAM type: YTN; PAM sequence: TTA
actacaccagctttgattcc

SEQ ID NO: 50684 - DNA, 20 bp, Artificial Sequence
  Description of Artificial Sequence: Synthetic oligonucleotide
  Target: SCN10A; (-) strand; PAM type: YTN; PAM sequence: TTT
aactacaccagctttgattc

SEQ ID NO: 50685 - DNA, 20 bp, Artificial Sequence
  Description of Artificial Sequence: Synthetic oligonucleotide
  Target: SCN10A; (-) strand; PAM type: YTN; PAM sequence: TTT
taactacaccagctttgatt

SEQ ID NO: 50686 - DNA, 20 bp, Artificial Sequence
  Description of Artificial Sequence: Synthetic oligonucleotide
  Target: SCN10A; (-) strand; PAM type: YTN; PAM sequence: CTG
acaacccggattttaactac

SEQ ID NO: 50687 - DNA, 20 bp, Artificial Sequence
  Description of Artificial Sequence: Synthetic oligonucleotide
  Target: SCN10A; (-) strand; PAM type: YTN; PAM sequence: TTC
tgacaacccggattttaact

SEQ ID NO: 50688 - DNA, 20 bp, Artificial Sequence
  Description of Artificial Sequence: Synthetic oligonucleotide
  Target: SCN10A; (-) strand; PAM type: YTN; PAM sequence: CTT
ctgacaacccggattttaac

SEQ ID NO: 50689 - DNA, 20 bp, Artificial Sequence
  Description of Artificial Sequence: Synthetic oligonucleotide
  Target: SCN10A; (-) strand; PAM type: YTN; PAM sequence: TTA
aaacttctgacaacccggat

SEQ ID NO: 50690 - DNA, 20 bp, Artificial Sequence
  Description of Artificial Sequence: Synthetic oligonucleotide
  Target: SCN10A; (-) strand; PAM type: YTN; PAM sequence: CTT
aaaacttctgacaacccgga

SEQ ID NO: 50691 - DNA, 20 bp, Artificial Sequence
  Description of Artificial Sequence: Synthetic oligonucleotide
  Target: SCN10A; (-) strand; PAM type: YTN; PAM sequence: CTG
ccttaaaacttctgacaacc

SEQ ID NO: 50692 - DNA, 20 bp, Artificial Sequence
  Description of Artificial Sequence: Synthetic oligonucleotide
  Target: SCN10A; (-) strand; PAM type: YTN; PAM sequence: TTA
tatctgccttaaaacttctg

SEQ ID NO: 50693 - DNA, 20 bp, Artificial Sequence
  Description of Artificial Sequence: Synthetic oligonucleotide
  Target: SCN10A; (-) strand; PAM type: YTN; PAM sequence: CTG
atggttatatctgccttaaa

SEQ ID NO: 50694 - DNA, 20 bp, Artificial Sequence
  Description of Artificial Sequence: Synthetic oligonucleotide
  Target: SCN10A; (-) strand; PAM type: YTN; PAM sequence: CTG
ccctgatggttatatctgcc

SEQ ID NO: 50695 - DNA, 20 bp, Artificial Sequence
  Description of Artificial Sequence: Synthetic oligonucleotide
  Target: SCN10A; (-) strand; PAM type: YTN; PAM sequence: CTG
cagccactgccctgatggtt

SEQ ID NO: 50696 - DNA, 20 bp, Artificial Sequence
  Description of Artificial Sequence: Synthetic oligonucleotide
  Target: SCN10A; (-) strand; PAM type: YTN; PAM sequence: TTG
ctgcagccactgccctgatg

SEQ ID NO: 50697 - DNA, 20 bp, Artificial Sequence
  Description of Artificial Sequence: Synthetic oligonucleotide
  Target: SCN10A; (-) strand; PAM type: YTN; PAM sequence: CTT
gctgcagccactgccctgat

SEQ ID NO: 50698 - DNA, 20 bp, Artificial Sequence
  Description of Artificial Sequence: Synthetic oligonucleotide
  Target: SCN10A; (-) strand; PAM type: YTN; PAM sequence: TTC
ttgctgcagccactgccctg

SEQ ID NO: 50699 - DNA, 20 bp, Artificial Sequence
  Description of Artificial Sequence: Synthetic oligonucleotide
  Target: SCN10A; (-) strand; PAM type: YTN; PAM sequence: CTG
ttcttgctgcagccactgcc

SEQ ID NO: 50700 - DNA, 20 bp, Artificial Sequence
  Description of Artificial Sequence: Synthetic oligonucleotide
  Target: SCN10A; (-) strand; PAM type: YTN; PAM sequence: CTC
tgttcttgctgcagccactg

SEQ ID NO: 50701 - DNA, 20 bp, Artificial Sequence
  Description of Artificial Sequence: Synthetic oligonucleotide
  Target: SCN10A; (-) strand; PAM type: YTN; PAM sequence: TTC
tctgttcttgctgcagccac

SEQ ID NO: 50702 - DNA, 20 bp, Artificial Sequence
  Description of Artificial Sequence: Synthetic oligonucleotide
  Target: SCN10A; (-) strand; PAM type: YTN; PAM sequence: CTT
ctctgttcttgctgcagcca

SEQ ID NO: 50703 - DNA, 20 bp, Artificial Sequence
  Description of Artificial Sequence: Synthetic oligonucleotide
  Target: SCN10A; (-) strand; PAM type: YTN; PAM sequence: CTG
caataagcaggggatgacct

SEQ ID NO: 50704 - DNA, 20 bp, Artificial Sequence
  Description of Artificial Sequence: Synthetic oligonucleotide
  Target: SCN10A; (-) strand; PAM type: YTN; PAM sequence: TTG
tctgcaataagcaggggatg

SEQ ID NO: 50705 - DNA, 20 bp, Artificial Sequence
  Description of Artificial Sequence: Synthetic oligonucleotide
  Target: SCN10A; (-) strand; PAM type: YTN; PAM sequence: CTT
gtctgcaataagcaggggat

SEQ ID NO: 50706 - DNA, 20 bp, Artificial Sequence
  Description of Artificial Sequence: Synthetic oligonucleotide
  Target: SCN10A; (-) strand; PAM type: YTN; PAM sequence: CTA
ccttgtctgcaataagcagg

SEQ ID NO: 50707 - DNA, 20 bp, Artificial Sequence
  Description of Artificial Sequence: Synthetic oligonucleotide
  Target: SCN10A; (-) strand; PAM type: YTN; PAM sequence: CTG
ggctaccttgtctgcaataa

SEQ ID NO: 50708 - DNA, 20 bp, Artificial Sequence
  Description of Artificial Sequence: Synthetic oligonucleotide
  Target: SCN10A; (-) strand; PAM type: YTN; PAM sequence: CTC
gcagccctgggctaccttgt

SEQ ID NO: 50709 - DNA, 20 bp, Artificial Sequence
  Description of Artificial Sequence: Synthetic oligonucleotide
  Target: SCN10A; (-) strand; PAM type: YTN; PAM sequence: TTG
tctcgcagccctgggctacc

SEQ ID NO: 50710 - DNA, 20 bp, Artificial Sequence
  Description of Artificial Sequence: Synthetic oligonucleotide
  Target: SCN10A; (-) strand; PAM type: YTN; PAM sequence: CTG
tggttgtctcgcagccctgg

SEQ ID NO: 50711 - DNA, 20 bp, Artificial Sequence
  Description of Artificial Sequence: Synthetic oligonucleotide
  Target: SCN10A; (-) strand; PAM type: YTN; PAM sequence: CTC
tgtggttgtctcgcagccct

SEQ ID NO: 50712 - DNA, 20 bp, Artificial Sequence
  Description of Artificial Sequence: Synthetic oligonucleotide
  Target: SCN10A; (-) strand; PAM type: YTN; PAM sequence: CTG
acataaaactctgtggttgt

SEQ ID NO: 50713 - DNA, 20 bp, Artificial Sequence
  Description of Artificial Sequence: Synthetic oligonucleotide
  Target: SCN10A; (-) strand; PAM type: YTN; PAM sequence: CTC
tgacataaaactctgtggtt

SEQ ID NO: 50714 - DNA, 20 bp, Artificial Sequence
  Description of Artificial Sequence: Synthetic oligonucleotide
  Target: SCN10A; (-) strand; PAM type: YTN; PAM sequence: CTG
atctctgacataaaactctg

SEQ ID NO: 50715 - DNA, 20 bp, Artificial Sequence
  Description of Artificial Sequence: Synthetic oligonucleotide
  Target: SCN10A; (-) strand; PAM type: YTN; PAM sequence: CTC
tgatctctgacataaaactc

SEQ ID NO: 50716 - DNA, 20 bp, Artificial Sequence
  Description of Artificial Sequence: Synthetic oligonucleotide
  Target: SCN10A; (-) strand; PAM type: YTN; PAM sequence: TTG
aactctgatctctgacataa

SEQ ID NO: 50717 - DNA, 20 bp, Artificial Sequence
  Description of Artificial Sequence: Synthetic oligonucleotide
  Target: SCN10A; (-) strand; PAM type: YTN; PAM sequence: CTT
gaactctgatctctgacata

SEQ ID NO: 50718 - DNA, 20 bp, Artificial Sequence
  Description of Artificial Sequence: Synthetic oligonucleotide
  Target: SCN10A; (-) strand; PAM type: YTN; PAM sequence: CTA
ggtcttgaactctgatctct

SEQ ID NO: 50719 - DNA, 20 bp, Artificial Sequence
  Description of Artificial Sequence: Synthetic oligonucleotide
  Target: SCN10A; (-) strand; PAM type: YTN; PAM sequence: CTA
ataagaggaagactaggtct

SEQ ID NO: 50720 - DNA, 20 bp, Artificial Sequence
  Description of Artificial Sequence: Synthetic oligonucleotide
  Target: SCN10A; (-) strand; PAM type: YTN; PAM sequence: CTG
ctaataagaggaagactagg

SEQ ID NO: 50721 - DNA, 20 bp, Artificial Sequence
  Description of Artificial Sequence: Synthetic oligonucleotide
  Target: SCN10A; (-) strand; PAM type: YTN; PAM sequence: CTA
aacagaccaagtgtccaaga

SEQ ID NO: 50722 - DNA, 20 bp, Artificial Sequence
  Description of Artificial Sequence: Synthetic oligonucleotide
  Target: SCN10A; (-) strand; PAM type: YTN; PAM sequence: TTA
tggataacagaaaccaatac

SEQ ID NO: 50723 - DNA, 20 bp, Artificial Sequence
  Description of Artificial Sequence: Synthetic oligonucleotide
  Target: SCN10A; (-) strand; PAM type: YTN; PAM sequence: TTT
atggataacagaaaccaata

SEQ ID NO: 50724 - DNA, 20 bp, Artificial Sequence
  Description of Artificial Sequence: Synthetic oligonucleotide
  Target: SCN10A; (-) strand; PAM type: YTN; PAM sequence: TTT
tatggataacagaaaccaat

SEQ ID NO: 50725 - DNA, 20 bp, Artificial Sequence
  Description of Artificial Sequence: Synthetic oligonucleotide
  Target: SCN10A; (-) strand; PAM type: YTN; PAM sequence: TTA
gcgtccccgttttatggata

SEQ ID NO: 50726 - DNA, 20 bp, Artificial Sequence
  Description of Artificial Sequence: Synthetic oligonucleotide
  Target: SCN10A; (-) strand; PAM type: YTN; PAM sequence: CTG
acgtgaaagtattagcgtcc

SEQ ID NO: 50727 - DNA, 20 bp, Artificial Sequence
  Description of Artificial Sequence: Synthetic oligonucleotide
  Target: SCN10A; (-) strand; PAM type: YTN; PAM sequence: TTC
tgacgtgaaagtattagcgt

SEQ ID NO: 50728 - DNA, 20 bp, Artificial Sequence
  Description of Artificial Sequence: Synthetic oligonucleotide
  Target: SCN10A; (-) strand; PAM type: YTN; PAM sequence: CTG
tgtatgaaattctgacgtga

SEQ ID NO: 50729 - DNA, 20 bp, Artificial Sequence
  Description of Artificial Sequence: Synthetic oligonucleotide
  Target: SCN10A; (-) strand; PAM type: YTN; PAM sequence: CTC
ccctgtgtatgaaattctga

SEQ ID NO: 50730 - DNA, 20 bp, Artificial Sequence
  Description of Artificial Sequence: Synthetic oligonucleotide
  Target: SCN10A; (-) strand; PAM type: YTN; PAM sequence: TTC
cccaggccactcccctgtgt

SEQ ID NO: 50731 - DNA, 20 bp, Artificial Sequence
  Description of Artificial Sequence: Synthetic oligonucleotide
  Target: SCN10A; (-) strand; PAM type: YTN; PAM sequence: CTT
ccccaggccactcccctgtg

SEQ ID NO: 50732 - DNA, 20 bp, Artificial Sequence
  Description of Artificial Sequence: Synthetic oligonucleotide
  Target: SCN10A; (-) strand; PAM type: YTN; PAM sequence: CTG
ccttccccaggccactcccc

SEQ ID NO: 50733 - DNA, 20 bp, Artificial Sequence
  Description of Artificial Sequence: Synthetic oligonucleotide
  Target: SCN10A; (-) strand; PAM type: YTN; PAM sequence: CTG
ggcagtcagctgccttcccc

SEQ ID NO: 50734 - DNA, 20 bp, Artificial Sequence
  Description of Artificial Sequence: Synthetic oligonucleotide
  Target: SCN10A; (-) strand; PAM type: YTN; PAM sequence: TTA
tagtatcgtgtctgggcagt

SEQ ID NO: 50735 - DNA, 20 bp, Artificial Sequence
  Description of Artificial Sequence: Synthetic oligonucleotide
  Target: SCN10A; (-) strand; PAM type: YTN; PAM sequence: CTT
atagtatcgtgtctgggcag

SEQ ID NO: 50736 - DNA, 20 bp, Artificial Sequence
  Description of Artificial Sequence: Synthetic oligonucleotide
  Target: SCN10A; (-) strand; PAM type: YTN; PAM sequence: CTG
gcaaagagcttatagtatcg

SEQ ID NO: 50737 - DNA, 20 bp, Artificial Sequence
  Description of Artificial Sequence: Synthetic oligonucleotide
  Target: SCN10A; (-) strand; PAM type: YTN; PAM sequence: CTG
gtatgaactggcaaagagct

SEQ ID NO: 50738 - DNA, 20 bp, Artificial Sequence
  Description of Artificial Sequence: Synthetic oligonucleotide
  Target: SCN10A; (-) strand; PAM type: YTN; PAM sequence: TTC
cctggtatgaactggcaaag

SEQ ID NO: 50739 - DNA, 20 bp, Artificial Sequence
  Description of Artificial Sequence: Synthetic oligonucleotide
  Target: SCN10A; (-) strand; PAM type: YTN; PAM sequence: TTT
ccctggtatgaactggcaaa

SEQ ID NO: 50740 - DNA, 20 bp, Artificial Sequence
  Description of Artificial Sequence: Synthetic oligonucleotide
  Target: SCN10A; (-) strand; PAM type: YTN; PAM sequence: CTC
atttccctggtatgaactgg

SEQ ID NO: 50741 - DNA, 20 bp, Artificial Sequence
  Description of Artificial Sequence: Synthetic oligonucleotide
  Target: SCN10A; (-) strand; PAM type: YTN; PAM sequence: CTC
tcatttccctggtatgaact

SEQ ID NO: 50742 - DNA, 20 bp, Artificial Sequence
  Description of Artificial Sequence: Synthetic oligonucleotide
  Target: SCN10A; (-) strand; PAM type: YTN; PAM sequence: CTG
actctcatttccctggtatg

SEQ ID NO: 50743 - DNA, 20 bp, Artificial Sequence
  Description of Artificial Sequence: Synthetic oligonucleotide
  Target: SCN10A; (-) strand; PAM type: YTN; PAM sequence: CTA
ctgactctcatttccctggt

SEQ ID NO: 50744 - DNA, 20 bp, Artificial Sequence
  Description of Artificial Sequence: Synthetic oligonucleotide
  Target: SCN10A; (-) strand; PAM type: YTN; PAM sequence: TTG
ctactgactctcatttccct

SEQ ID NO: 50745 - DNA, 20 bp, Artificial Sequence
  Description of Artificial Sequence: Synthetic oligonucleotide
  Target: SCN10A; (-) strand; PAM type: YTN; PAM sequence: TTA
ttgctactgactctcatttc

SEQ ID NO: 50746 - DNA, 20 bp, Artificial Sequence
  Description of Artificial Sequence: Synthetic oligonucleotide
  Target: SCN10A; (-) strand; PAM type: YTN; PAM sequence: CTG
cgttattgctactgactctc

SEQ ID NO: 50747 - DNA, 20 bp, Artificial Sequence
  Description of Artificial Sequence: Synthetic oligonucleotide
  Target: SCN10A; (-) strand; PAM type: YTN; PAM sequence: TTA
agtctgcgttattgctactg

SEQ ID NO: 50748 - DNA, 20 bp, Artificial Sequence
  Description of Artificial Sequence: Synthetic oligonucleotide
  Target: SCN10A; (-) strand; PAM type: YTN; PAM sequence: TTT
aagtctgcgttattgctact

SEQ ID NO: 50749 - DNA, 20 bp, Artificial Sequence
  Description of Artificial Sequence: Synthetic oligonucleotide
  Target: SCN10A; (-) strand; PAM type: YTN; PAM sequence: TTT
taagtctgcgttattgctac

SEQ ID NO: 50750 - DNA, 20 bp, Artificial Sequence
  Description of Artificial Sequence: Synthetic oligonucleotide
  Target: SCN10A; (-) strand; PAM type: YTN; PAM sequence: CTC
aggttttaagtctgcgttat

SEQ ID NO: 50751 - DNA, 20 bp, Artificial Sequence
  Description of Artificial Sequence: Synthetic oligonucleotide
  Target: SCN10A; (-) strand; PAM type: YTN; PAM sequence: CTG
cagatgatgccaacaggctc

SEQ ID NO: 50752 - DNA, 20 bp, Artificial Sequence
  Description of Artificial Sequence: Synthetic oligonucleotide
  Target: SCN10A; (-) strand; PAM type: YTN; PAM sequence: CTC
tgcagatgatgccaacaggc

SEQ ID NO: 50753 - DNA, 20 bp, Artificial Sequence
  Description of Artificial Sequence: Synthetic oligonucleotide
  Target: SCN10A; (-) strand; PAM type: YTN; PAM sequence: TTG
atagacaactctgcagatga

SEQ ID NO: 50754 - DNA, 20 bp, Artificial Sequence
  Description of Artificial Sequence: Synthetic oligonucleotide
  Target: SCN10A; (-) strand; PAM type: YTN; PAM sequence: CTT
gatagacaactctgcagatg

SEQ ID NO: 50755 - DNA, 20 bp, Artificial Sequence
  Description of Artificial Sequence: Synthetic oligonucleotide
  Target: SCN10A; (-) strand; PAM type: YTN; PAM sequence: CTC
ccttgatagacaactctgca

SEQ ID NO: 50756 - DNA, 20 bp, Artificial Sequence
  Description of Artificial Sequence: Synthetic oligonucleotide
  Target: SCN10A; (-) strand; PAM type: YTN; PAM sequence: CTA
atgtgagacctcccttgata

SEQ ID NO: 50757 - DNA, 20 bp, Artificial Sequence
  Description of Artificial Sequence: Synthetic oligonucleotide
  Target: SCN10A; (-) strand; PAM type: YTN; PAM sequence: TTG
gctaatgtgagacctccctt

SEQ ID NO: 50758 - DNA, 20 bp, Artificial Sequence
  Description of Artificial Sequence: Synthetic oligonucleotide
  Target: SCN10A; (-) strand; PAM type: YTN; PAM sequence: CTT
ggctaatgtgagacctccct

SEQ ID NO: 50759 - DNA, 20 bp, Artificial Sequence
  Description of Artificial Sequence: Synthetic oligonucleotide
  Target: SCN10A; (-) strand; PAM type: YTN; PAM sequence: TTA
atcagtgaacttggctaatg

SEQ ID NO: 50760 - DNA, 20 bp, Artificial Sequence
  Description of Artificial Sequence: Synthetic oligonucleotide
  Target: SCN10A; (-) strand; PAM type: YTN; PAM sequence: TTA
catataattaatcagtgaac

SEQ ID NO: 50761 - DNA, 20 bp, Artificial Sequence
  Description of Artificial Sequence: Synthetic oligonucleotide
  Target: SCN10A; (-) strand; PAM type: YTN; PAM sequence: CTG
ttacatataattaatcagtg

SEQ ID NO: 50762 - DNA, 20 bp, Artificial Sequence
  Description of Artificial Sequence: Synthetic oligonucleotide
  Target: SCN10A; (-) strand; PAM type: YTN; PAM sequence: TTC
cactgttacatataattaat

SEQ ID NO: 50763 - DNA, 20 bp, Artificial Sequence
  Description of Artificial Sequence: Synthetic oligonucleotide
  Target: SCN10A; (-) strand; PAM type: YTN; PAM sequence: TTT
ccactgttacatataattaa

SEQ ID NO: 50764 - DNA, 20 bp, Artificial Sequence
  Description of Artificial Sequence: Synthetic oligonucleotide
  Target: SCN10A; (-) strand; PAM type: YTN; PAM sequence: TTA
tttccactgttacatataat

SEQ ID NO: 50765 - DNA, 20 bp, Artificial Sequence
  Description of Artificial Sequence: Synthetic oligonucleotide
  Target: SCN10A; (-) strand; PAM type: YTN; PAM sequence: CTC
agtaagtggaaagtgttatt

SEQ ID NO: 50766 - DNA, 20 bp, Artificial Sequence
  Description of Artificial Sequence: Synthetic oligonucleotide
  Target: SCN10A; (-) strand; PAM type: YTN; PAM sequence: TTA
aagggagagagaagaacaca

SEQ ID NO: 50767 - DNA, 20 bp, Artificial Sequence
  Description of Artificial Sequence: Synthetic oligonucleotide
  Target: SCN10A; (-) strand; PAM type: YTN; PAM sequence: CTT
aaagggagagagaagaacac

SEQ ID NO: 50768 - DNA, 20 bp, Artificial Sequence
  Description of Artificial Sequence: Synthetic oligonucleotide
  Target: SCN10A; (-) strand; PAM type: YTN; PAM sequence: TTG
taaagcacttaaagggagag

SEQ ID NO: 50769 - DNA, 20 bp, Artificial Sequence
  Description of Artificial Sequence: Synthetic oligonucleotide
  Target: SCN10A; (-) strand; PAM type: YTN; PAM sequence: TTT
gtaaagcacttaaagggaga

SEQ ID NO: 50770 - DNA, 20 bp, Artificial Sequence
  Description of Artificial Sequence: Synthetic oligonucleotide
  Target: SCN10A; (-) strand; PAM type: YTN; PAM sequence: TTA
tagtgtttgtaaagcactta

SEQ ID NO: 50771 - DNA, 20 bp, Artificial Sequence
  Description of Artificial Sequence: Synthetic oligonucleotide
  Target: SCN10A; (-) strand; PAM type: YTN; PAM sequence: TTA
aattatagtgtttgtaaagc

SEQ ID NO: 50772 - DNA, 20 bp, Artificial Sequence
  Description of Artificial Sequence: Synthetic oligonucleotide
  Target: SCN10A; (-) strand; PAM type: YTN; PAM sequence: TTG
agtgattaaattatagtgtt

SEQ ID NO: 50773 - DNA, 20 bp, Artificial Sequence
  Description of Artificial Sequence: Synthetic oligonucleotide
  Target: SCN10A; (-) strand; PAM type: YTN; PAM sequence: CTG
taaagaaagaacattgagtg

SEQ ID NO: 50774 - DNA, 20 bp, Artificial Sequence
  Description of Artificial Sequence: Synthetic oligonucleotide
  Target: SCN10A; (-) strand; PAM type: YTN; PAM sequence: TTA
tctgtaaagaaagaacattg

SEQ ID NO: 50775 - DNA, 20 bp, Artificial Sequence
  Description of Artificial Sequence: Synthetic oligonucleotide
  Target: SCN10A; (-) strand; PAM type: YTN; PAM sequence: CTT
atctgtaaagaaagaacatt

SEQ ID NO: 50776 - DNA, 20 bp, Artificial Sequence
  Description of Artificial Sequence: Synthetic oligonucleotide
  Target: SCN10A; (-) strand; PAM type: YTN; PAM sequence: TTC
cttatctgtaaagaaagaac

SEQ ID NO: 50777 - DNA, 20 bp, Artificial Sequence
  Description of Artificial Sequence: Synthetic oligonucleotide
  Target: SCN10A; (-) strand; PAM type: YTN; PAM sequence: CTG
acccccagattccttatctg

SEQ ID NO: 50778 - DNA, 20 bp, Artificial Sequence
  Description of Artificial Sequence: Synthetic oligonucleotide
  Target: SCN10A; (-) strand; PAM type: YTN; PAM sequence: TTC
tgacccccagattccttatc

SEQ ID NO: 50779 - DNA, 20 bp, Artificial Sequence
  Description of Artificial Sequence: Synthetic oligonucleotide
  Target: SCN10A; (-) strand; PAM type: YTN; PAM sequence: TTT
ctgacccccagattccttat

SEQ ID NO: 50780 - DNA, 20 bp, Artificial Sequence
  Description of Artificial Sequence: Synthetic oligonucleotide
  Target: SCN10A; (-) strand; PAM type: YTN; PAM sequence: CTT
tctgacccccagattcctta

SEQ ID NO: 50781 - DNA, 20 bp, Artificial Sequence
  Description of Artificial Sequence: Synthetic oligonucleotide
  Target: SCN10A; (-) strand; PAM type: YTN; PAM sequence: TTC
tttctgacccccagattcct

SEQ ID NO: 50782 - DNA, 20 bp, Artificial Sequence
  Description of Artificial Sequence: Synthetic oligonucleotide
  Target: SCN10A; (-) strand; PAM type: YTN; PAM sequence: CTT
ctttctgacccccagattcc

SEQ ID NO: 50783 - DNA, 20 bp, Artificial Sequence
  Description of Artificial Sequence: Synthetic oligonucleotide
  Target: SCN10A; (-) strand; PAM type: YTN; PAM sequence: CTG
acttctttctgacccccaga

SEQ ID NO: 50784 - DNA, 20 bp, Artificial Sequence
  Description of Artificial Sequence: Synthetic oligonucleotide
  Target: SCN10A; (-) strand; PAM type: YTN; PAM sequence: TTA
ggcaactgacttctttctga

SEQ ID NO: 50785 - DNA, 20 bp, Artificial Sequence
  Description of Artificial Sequence: Synthetic oligonucleotide
  Target: SCN10A; (-) strand; PAM type: YTN; PAM sequence: TTT
aggcaactgacttctttctg

SEQ ID NO: 50786 - DNA, 20 bp, Artificial Sequence
  Description of Artificial Sequence: Synthetic oligonucleotide
  Target: SCN10A; (-) strand; PAM type: YTN; PAM sequence: TTT
taggcaactgacttctttct

SEQ ID NO: 50787 - DNA, 20 bp, Artificial Sequence
  Description of Artificial Sequence: Synthetic oligonucleotide
  Target: SCN10A; (-) strand; PAM type: YTN; PAM sequence: CTG
cgtagttttaggcaactgac

SEQ ID NO: 50788 - DNA, 20 bp, Artificial Sequence
  Description of Artificial Sequence: Synthetic oligonucleotide
  Target: SCN10A; (-) strand; PAM type: YTN; PAM sequence: TTG
acacctgcgtagttttaggc

SEQ ID NO: 50789 - DNA, 20 bp, Artificial Sequence
  Description of Artificial Sequence: Synthetic oligonucleotide
  Target: SCN10A; (-) strand; PAM type: YTN; PAM sequence: TTA
ataaatatattgacacctgc

SEQ ID NO: 50790 - DNA, 20 bp, Artificial Sequence
  Description of Artificial Sequence: Synthetic oligonucleotide
  Target: SCN10A; (-) strand; PAM type: YTN; PAM sequence: TTT
aataaatatattgacacctg

SEQ ID NO: 50791 - DNA, 20 bp, Artificial Sequence
  Description of Artificial Sequence: Synthetic oligonucleotide
  Target: SCN10A; (-) strand; PAM type: YTN; PAM sequence: TTT
taataaatatattgacacct

SEQ ID NO: 50792 - DNA, 20 bp, Artificial Sequence
  Description of Artificial Sequence: Synthetic oligonucleotide
  Target: SCN10A; (-) strand; PAM type: YTN; PAM sequence: CTT
ttaataaatatattgacacc

SEQ ID NO: 50793 - DNA, 20 bp, Artificial Sequence
  Description of Artificial Sequence: Synthetic oligonucleotide
  Target: SCN10A; (-) strand; PAM type: YTN; PAM sequence: CTC
cttttaataaatatattgac

SEQ ID NO: 50794 - DNA, 20 bp, Artificial Sequence
  Description of Artificial Sequence: Synthetic oligonucleotide
  Target: SCN10A; (-) strand; PAM type: YTN; PAM sequence: TTC
tccttttaataaatatattg

SEQ ID NO: 50795 - DNA, 20 bp, Artificial Sequence
  Description of Artificial Sequence: Synthetic oligonucleotide
  Target: SCN10A; (-) strand; PAM type: YTN; PAM sequence: TTT
ctccttttaataaatatatt

SEQ ID NO: 50796 - DNA, 20 bp, Artificial Sequence
  Description of Artificial Sequence: Synthetic oligonucleotide
  Target: SCN10A; (-) strand; PAM type: YTN; PAM sequence: TTA
tatttctccttttaataaat

SEQ ID NO: 50797 - DNA, 20 bp, Artificial Sequence
  Description of Artificial Sequence: Synthetic oligonucleotide
  Target: SCN10A; (-) strand; PAM type: YTN; PAM sequence: TTG
acagttatatttctcctttt

SEQ ID NO: 50798 - DNA, 20 bp, Artificial Sequence
  Description of Artificial Sequence: Synthetic oligonucleotide
  Target: SCN10A; (-) strand; PAM type: YTN; PAM sequence: CTT
gacagttatatttctccttt

SEQ ID NO: 50799 - DNA, 20 bp, Artificial Sequence
  Description of Artificial Sequence: Synthetic oligonucleotide
  Target: SCN10A; (-) strand; PAM type: YTN; PAM sequence: CTA
cttgacagttatatttctcc

SEQ ID NO: 50800 - DNA, 20 bp, Artificial Sequence
  Description of Artificial Sequence: Synthetic oligonucleotide
  Target: SCN10A; (-) strand; PAM type: YTN; PAM sequence: TTG
ggctacttgacagttatatt

SEQ ID NO: 50801 - DNA, 20 bp, Artificial Sequence
  Description of Artificial Sequence: Synthetic oligonucleotide
  Target: SCN10A; (-) strand; PAM type: YTN; PAM sequence: CTC
aagtattgggctacttgaca

SEQ ID NO: 50802 - DNA, 20 bp, Artificial Sequence
  Description of Artificial Sequence: Synthetic oligonucleotide
  Target: SCN10A; (-) strand; PAM type: YTN; PAM sequence: CTG
actcaagtattgggctactt

SEQ ID NO: 50803 - DNA, 20 bp, Artificial Sequence
  Description of Artificial Sequence: Synthetic oligonucleotide
  Target: SCN10A; (-) strand; PAM type: YTN; PAM sequence: CTA
ggctgactcaagtattgggc

SEQ ID NO: 50804 - DNA, 20 bp, Artificial Sequence
  Description of Artificial Sequence: Synthetic oligonucleotide
  Target: SCN10A; (-) strand; PAM type: YTN; PAM sequence: TTC
aggaggaggctaggctgact

SEQ ID NO: 50805 - DNA, 20 bp, Artificial Sequence
  Description of Artificial Sequence: Synthetic oligonucleotide
  Target: SCN10A; (-) strand; PAM type: YTN; PAM sequence: CTT
caggaggaggctaggctgac

SEQ ID NO: 50806 - DNA, 20 bp, Artificial Sequence
  Description of Artificial Sequence: Synthetic oligonucleotide
  Target: SCN10A; (-) strand; PAM type: YTN; PAM sequence: TTC
ataggccatcttcaggagga

SEQ ID NO: 50807 - DNA, 20 bp, Artificial Sequence
  Description of Artificial Sequence: Synthetic oligonucleotide
  Target: SCN10A; (-) strand; PAM type: YTN; PAM sequence: CTT
cataggccatcttcaggagg

SEQ ID NO: 50808 - DNA, 20 bp, Artificial Sequence
  Description of Artificial Sequence: Synthetic oligonucleotide
  Target: SCN10A; (-) strand; PAM type: YTN; PAM sequence: TTC
cttcataggccatcttcagg

SEQ ID NO: 50809 - DNA, 20 bp, Artificial Sequence
  Description of Artificial Sequence: Synthetic oligonucleotide
  Target: SCN10A; (-) strand; PAM type: YTN; PAM sequence: CTT
ccttcataggccatcttcag

SEQ ID NO: 50810 - DNA, 20 bp, Artificial Sequence
  Description of Artificial Sequence: Synthetic oligonucleotide
  Target: SCN10A; (-) strand; PAM type: YTN; PAM sequence: CTG
gccttccttcataggccatc

SEQ ID NO: 50811 - DNA, 20 bp, Artificial Sequence
  Description of Artificial Sequence: Synthetic oligonucleotide
  Target: SCN10A; (-) strand; PAM type: YTN; PAM sequence: TTA
atctggccttccttcatagg

SEQ ID NO: 50812 - DNA, 20 bp, Artificial Sequence
  Description of Artificial Sequence: Synthetic oligonucleotide
  Target: SCN10A; (-) strand; PAM type: YTN; PAM sequence: TTT
aatctggccttccttcatag

SEQ ID NO: 50813 - DNA, 20 bp, Artificial Sequence
  Description of Artificial Sequence: Synthetic oligonucleotide
  Target: SCN10A; (-) strand; PAM type: YTN; PAM sequence: TTT
taatctggccttccttcata

SEQ ID NO: 50814 - DNA, 20 bp, Artificial Sequence
  Description of Artificial Sequence: Synthetic oligonucleotide
  Target: SCN10A; (-) strand; PAM type: YTN; PAM sequence: TTT
ttaatctggccttccttcat

SEQ ID NO: 50815 - DNA, 20 bp, Artificial Sequence
  Description of Artificial Sequence: Synthetic oligonucleotide
  Target: SCN10A; (-) strand; PAM type: YTN; PAM sequence: CTC
accaggcagtcatttttaat

SEQ ID NO: 50816 - DNA, 20 bp, Artificial Sequence
  Description of Artificial Sequence: Synthetic oligonucleotide
  Target: SCN10A; (-) strand; PAM type: YTN; PAM sequence: CTC
aatactcaccaggcagtcat

SEQ ID NO: 50817 - DNA, 20 bp, Artificial Sequence
  Description of Artificial Sequence: Synthetic oligonucleotide
  Target: SCN10A; (-) strand; PAM type: YTN; PAM sequence: TTC
ccacctcaatactcaccagg

SEQ ID NO: 50818 - DNA, 20 bp, Artificial Sequence
  Description of Artificial Sequence: Synthetic oligonucleotide
  Target: SCN10A; (-) strand; PAM type: YTN; PAM sequence: TTC
agcattcccacctcaatact

SEQ ID NO: 50819 - DNA, 20 bp, Artificial Sequence
  Description of Artificial Sequence: Synthetic oligonucleotide
  Target: SCN10A; (-) strand; PAM type: YTN; PAM sequence: TTA
tgagagagaggaaggagttc

SEQ ID NO: 50820 - DNA, 20 bp, Artificial Sequence
  Description of Artificial Sequence: Synthetic oligonucleotide
  Target: SCN10A; (-) strand; PAM type: YTN; PAM sequence: CTA
ttatgagagagaggaaggag

SEQ ID NO: 50821 - DNA, 20 bp, Artificial Sequence
  Description of Artificial Sequence: Synthetic oligonucleotide
  Target: SCN10A; (-) strand; PAM type: YTN; PAM sequence: CTC
ctattatgagagagaggaag

SEQ ID NO: 50822 - DNA, 20 bp, Artificial Sequence
  Description of Artificial Sequence: Synthetic oligonucleotide
  Target: SCN10A; (-) strand; PAM type: YTN; PAM sequence: CTC
atcctcctattatgagagag

SEQ ID NO: 50823 - DNA, 20 bp, Artificial Sequence
  Description of Artificial Sequence: Synthetic oligonucleotide
  Target: SCN10A; (-) strand; PAM type: YTN; PAM sequence: TTG
acatcgactcatcctcctat

SEQ ID NO: 50824 - DNA, 20 bp, Artificial Sequence
  Description of Artificial Sequence: Synthetic oligonucleotide
  Target: SCN10A; (-) strand; PAM type: YTN; PAM sequence: CTT
gacatcgactcatcctccta

SEQ ID NO: 50825 - DNA, 20 bp, Artificial Sequence
  Description of Artificial Sequence: Synthetic oligonucleotide
  Target: SCN10A; (-) strand; PAM type: YTN; PAM sequence: TTC
ttgacatcgactcatcctcc

SEQ ID NO: 50826 - DNA, 20 bp, Artificial Sequence
  Description of Artificial Sequence: Synthetic oligonucleotide
  Target: SCN10A; (-) strand; PAM type: YTN; PAM sequence: CTT
cttgacatcgactcatcctc

SEQ ID NO: 50827 - DNA, 20 bp, Artificial Sequence
  Description of Artificial Sequence: Synthetic oligonucleotide
  Target: SCN10A; (-) strand; PAM type: YTN; PAM sequence: CTG
acagatgcttcttgacatcg

SEQ ID NO: 50828 - DNA, 20 bp, Artificial Sequence
  Description of Artificial Sequence: Synthetic oligonucleotide
  Target: SCN10A; (-) strand; PAM type: YTN; PAM sequence: CTG
agctgacagatgcttcttga

SEQ ID NO: 50829 - DNA, 20 bp, Artificial Sequence
  Description of Artificial Sequence: Synthetic oligonucleotide
  Target: SCN10A; (-) strand; PAM type: YTN; PAM sequence: CTC
cctgagctgacagatgcttc

SEQ ID NO: 50830 - DNA, 20 bp, Artificial Sequence
  Description of Artificial Sequence: Synthetic oligonucleotide
  Target: SCN10A; (-) strand; PAM type: YTN; PAM sequence: TTA
cgctccctgagctgacagat

SEQ ID NO: 50831 - DNA, 20 bp, Artificial Sequence
  Description of Artificial Sequence: Synthetic oligonucleotide
  Target: SCN10A; (-) strand; PAM type: YTN; PAM sequence: TTT
acgctccctgagctgacaga

SEQ ID NO: 50832 - DNA, 20 bp, Artificial Sequence
  Description of Artificial Sequence: Synthetic oligonucleotide
  Target: SCN10A; (-) strand; PAM type: YTN; PAM sequence: CTT
tacgctccctgagctgacag

SEQ ID NO: 50833 - DNA, 20 bp, Artificial Sequence
  Description of Artificial Sequence: Synthetic oligonucleotide
  Target: SCN10A; (-) strand; PAM type: YTN; PAM sequence: CTA
gggtggatgagagcacttta

SEQ ID NO: 50834 - DNA, 20 bp, Artificial Sequence
  Description of Artificial Sequence: Synthetic oligonucleotide
  Target: SCN10A; (-) strand; PAM type: YTN; PAM sequence: CTG
ctagggtggatgagagcact

SEQ ID NO: 50835 - DNA, 20 bp, Artificial Sequence
  Description of Artificial Sequence: Synthetic oligonucleotide
  Target: SCN10A; (-) strand; PAM type: YTN; PAM sequence: CTC
tgctagggtggatgagagca

SEQ ID NO: 50836 - DNA, 20 bp, Artificial Sequence
  Description of Artificial Sequence: Synthetic oligonucleotide
  Target: SCN10A; (-) strand; PAM type: YTN; PAM sequence: TTG
atcaggccatctctgctagg

SEQ ID NO: 50837 - DNA, 20 bp, Artificial Sequence
  Description of Artificial Sequence: Synthetic oligonucleotide
  Target: SCN10A; (-) strand; PAM type: YTN; PAM sequence: TTC
attgatcaggccatctctgc

SEQ ID NO: 50838 - DNA, 20 bp, Artificial Sequence
  Description of Artificial Sequence: Synthetic oligonucleotide
  Target: SCN10A; (-) strand; PAM type: YTN; PAM sequence: TTT
cattgatcaggccatctctg

SEQ ID NO: 50839 - DNA, 20 bp, Artificial Sequence
  Description of Artificial Sequence: Synthetic oligonucleotide
  Target: SCN10A; (-) strand; PAM type: YTN; PAM sequence: CTG
tttcattgatcaggccatct

SEQ ID NO: 50840 - DNA, 20 bp, Artificial Sequence
  Description of Artificial Sequence: Synthetic oligonucleotide
  Target: SCN10A; (-) strand; PAM type: YTN; PAM sequence: TTG
ctgtttcattgatcaggcca

SEQ ID NO: 50841 - DNA, 20 bp, Artificial Sequence
  Description of Artificial Sequence: Synthetic oligonucleotide
  Target: SCN10A; (-) strand; PAM type: YTN; PAM sequence: TTC
aaacgaggcattgctgtttc

SEQ ID NO: 50842 - DNA, 20 bp, Artificial Sequence
  Description of Artificial Sequence: Synthetic oligonucleotide
  Target: SCN10A; (-) strand; PAM type: YTN; PAM sequence: CTT
caaacgaggcattgctgttt

SEQ ID NO: 50843 - DNA, 20 bp, Artificial Sequence
  Description of Artificial Sequence: Synthetic oligonucleotide
  Target: SCN10A; (-) strand; PAM type: YTN; PAM sequence: CTG
gacttcaaacgaggcattgc

SEQ ID NO: 50844 - DNA, 20 bp, Artificial Sequence
  Description of Artificial Sequence: Synthetic oligonucleotide
  Target: SCN10A; (-) strand; PAM type: YTN; PAM sequence: TTC
tggacttcaaacgaggcatt

SEQ ID NO: 50845 - DNA, 20 bp, Artificial Sequence
  Description of Artificial Sequence: Synthetic oligonucleotide
  Target: SCN10A; (-) strand; PAM type: YTN; PAM sequence: TTA
aaaaaataattctggacttc

SEQ ID NO: 50846 - DNA, 20 bp, Artificial Sequence
  Description of Artificial Sequence: Synthetic oligonucleotide
  Target: SCN10A; (-) strand; PAM type: YTN; PAM sequence: TTT
aaaaaaataattctggactt

SEQ ID NO: 50847 - DNA, 20 bp, Artificial Sequence
  Description of Artificial Sequence: Synthetic oligonucleotide
  Target: SCN10A; (-) strand; PAM type: YTN; PAM sequence: TTC
acaaggaatgcaggtaaata

SEQ ID NO: 50848 - DNA, 20 bp, Artificial Sequence
  Description of Artificial Sequence: Synthetic oligonucleotide
  Target: SCN10A; (-) strand; PAM type: YTN; PAM sequence: TTC
catgtattcacaaggaatgc

SEQ ID NO: 50849 - DNA, 20 bp, Artificial Sequence
  Description of Artificial Sequence: Synthetic oligonucleotide
  Target: SCN10A; (-) strand; PAM type: YTN; PAM sequence: CTG
ggagtaaaagaattccatgt

SEQ ID NO: 50850 - DNA, 20 bp, Artificial Sequence
  Description of Artificial Sequence: Synthetic oligonucleotide
  Target: SCN10A; (-) strand; PAM type: YTN; PAM sequence: TTC
atggagaaatcctgggagta

SEQ ID NO: 50851 - DNA, 20 bp, Artificial Sequence
  Description of Artificial Sequence: Synthetic oligonucleotide
  Target: SCN10A; (-) strand; PAM type: YTN; PAM sequence: TTG
gagttcatggagaaatcctg

SEQ ID NO: 50852 - DNA, 20 bp, Artificial Sequence
  Description of Artificial Sequence: Synthetic oligonucleotide
  Target: SCN10A; (-) strand; PAM type: YTN; PAM sequence: CTG
ggataaggagagccccagag

SEQ ID NO: 50853 - DNA, 20 bp, Artificial Sequence
  Description of Artificial Sequence: Synthetic oligonucleotide
  Target: SCN10A; (-) strand; PAM type: YTN; PAM sequence: TTC
acatggatgtctgggataag

SEQ ID NO: 50854 - DNA, 20 bp, Artificial Sequence
  Description of Artificial Sequence: Synthetic oligonucleotide
  Target: SCN10A; (-) strand; PAM type: YTN; PAM sequence: TTG
ttcacatggatgtctgggat

SEQ ID NO: 50855 - DNA, 20 bp, Artificial Sequence
  Description of Artificial Sequence: Synthetic oligonucleotide
  Target: SCN10A; (-) strand; PAM type: YTN; PAM sequence: CTA
atccatggtatgggttgttc

SEQ ID NO: 50856 - DNA, 20 bp, Artificial Sequence
  Description of Artificial Sequence: Synthetic oligonucleotide
  Target: SCN10A; (-) strand; PAM type: YTN; PAM sequence: CTC
taatccatggtatgggttgt

SEQ ID NO: 50857 - DNA, 20 bp, Artificial Sequence
  Description of Artificial Sequence: Synthetic oligonucleotide
  Target: SCN10A; (-) strand; PAM type: YTN; PAM sequence: TTG
tcagagctctaatccatggt

SEQ ID NO: 50858 - DNA, 20 bp, Artificial Sequence
  Description of Artificial Sequence: Synthetic oligonucleotide
  Target: SCN10A; (-) strand; PAM type: YTN; PAM sequence: TTA
agttgtcagagctctaatcc

SEQ ID NO: 50859 - DNA, 20 bp, Artificial Sequence
  Description of Artificial Sequence: Synthetic oligonucleotide
  Target: SCN10A; (-) strand; PAM type: YTN; PAM sequence: TTA
gaattaagttgtcagagctc

SEQ ID NO: 50860 - DNA, 20 bp, Artificial Sequence
  Description of Artificial Sequence: Synthetic oligonucleotide
  Target: SCN10A; (-) strand; PAM type: YTN; PAM sequence: CTG
attagaattaagttgtcaga

SEQ ID NO: 50861 - DNA, 20 bp, Artificial Sequence
  Description of Artificial Sequence: Synthetic oligonucleotide
  Target: SCN10A; (-) strand; PAM type: YTN; PAM sequence: TTG
gaactgattagaattaagtt

SEQ ID NO: 50862 - DNA, 20 bp, Artificial Sequence
  Description of Artificial Sequence: Synthetic oligonucleotide
  Target: SCN10A; (-) strand; PAM type: YTN; PAM sequence: CTT
ggaactgattagaattaagt

SEQ ID NO: 50863 - DNA, 20 bp, Artificial Sequence
  Description of Artificial Sequence: Synthetic oligonucleotide
  Target: SCN10A; (-) strand; PAM type: YTN; PAM sequence: TTC
aatcgaagtggagatagact

SEQ ID NO: 50864 - DNA, 20 bp, Artificial Sequence
  Description of Artificial Sequence: Synthetic oligonucleotide
  Target: SCN10A; (-) strand; PAM type: YTN; PAM sequence: CTT
caatcgaagtggagatagac

SEQ ID NO: 50865 - DNA, 20 bp, Artificial Sequence
  Description of Artificial Sequence: Synthetic oligonucleotide
  Target: SCN10A; (-) strand; PAM type: YTN; PAM sequence: TTG
caatcttcaatcgaagtgga

SEQ ID NO: 50866 - DNA, 20 bp, Artificial Sequence
  Description of Artificial Sequence: Synthetic oligonucleotide
  Target: SCN10A; (-) strand; PAM type: YTN; PAM sequence: CTT
gcaatcttcaatcgaagtgg

SEQ ID NO: 50867 - DNA, 20 bp, Artificial Sequence
  Description of Artificial Sequence: Synthetic oligonucleotide
  Target: SCN10A; (-) strand; PAM type: YTN; PAM sequence: CTA
caaagccagggaacttgcaa

SEQ ID NO: 50868 - DNA, 20 bp, Artificial Sequence
  Description of Artificial Sequence: Synthetic oligonucleotide
  Target: SCN10A; (-) strand; PAM type: YTN; PAM sequence: TTA
aatgtgggtctacaaagcca

SEQ ID NO: 50869 - DNA, 20 bp, Artificial Sequence
  Description of Artificial Sequence: Synthetic oligonucleotide
  Target: SCN10A; (-) strand; PAM type: YTN; PAM sequence: TTT
aaatgtgggtctacaaagcc

SEQ ID NO: 50870 - DNA, 20 bp, Artificial Sequence
  Description of Artificial Sequence: Synthetic oligonucleotide
  Target: SCN10A; (-) strand; PAM type: YTN; PAM sequence: CTT
taaatgtgggtctacaaagc

SEQ ID NO: 50871 - DNA, 20 bp, Artificial Sequence
  Description of Artificial Sequence: Synthetic oligonucleotide
  Target: SCN10A; (-) strand; PAM type: YTN; PAM sequence: CTA
tctttaaatgtgggtctaca

SEQ ID NO: 50872 - DNA, 20 bp, Artificial Sequence
  Description of Artificial Sequence: Synthetic oligonucleotide
  Target: SCN10A; (-) strand; PAM type: YTN; PAM sequence: TTG
gaagagcaaaccaagagcct

SEQ ID NO: 50873 - DNA, 20 bp, Artificial Sequence
  Description of Artificial Sequence: Synthetic oligonucleotide
  Target: SCN10A; (-) strand; PAM type: YTN; PAM sequence: CTT
ggaagagcaaaccaagagcc

SEQ ID NO: 50874 - DNA, 20 bp, Artificial Sequence
  Description of Artificial Sequence: Synthetic oligonucleotide
  Target: SCN10A; (-) strand; PAM type: YTN; PAM sequence: CTA
gccccttggaagagcaaacc

SEQ ID NO: 50875 - DNA, 20 bp, Artificial Sequence
  Description of Artificial Sequence: Synthetic oligonucleotide
  Target: SCN10A; (-) strand; PAM type: YTN; PAM sequence: TTG
cctagccccttggaagagca

SEQ ID NO: 50876 - DNA, 20 bp, Artificial Sequence
  Description of Artificial Sequence: Synthetic oligonucleotide
  Target: SCN10A; (-) strand; PAM type: YTN; PAM sequence: CTA
caggaaatgggttgcctagc

SEQ ID NO: 50877 - DNA, 20 bp, Artificial Sequence
  Description of Artificial Sequence: Synthetic oligonucleotide
  Target: SCN10A; (-) strand; PAM type: YTN; PAM sequence: TTA
agaaacctacaggaaatggg

SEQ ID NO: 50878 - DNA, 20 bp, Artificial Sequence
  Description of Artificial Sequence: Synthetic oligonucleotide
  Target: SCN10A; (-) strand; PAM type: YTN; PAM sequence: TTA
attaagaaacctacaggaaa

SEQ ID NO: 50879 - DNA, 20 bp, Artificial Sequence
  Description of Artificial Sequence: Synthetic oligonucleotide
  Target: SCN10A; (-) strand; PAM type: YTN; PAM sequence: CTC
agagttaattaagaaaccta

SEQ ID NO: 50880 - DNA, 20 bp, Artificial Sequence
  Description of Artificial Sequence: Synthetic oligonucleotide
  Target: SCN10A; (-) strand; PAM type: YTN; PAM sequence: CTG
ccctcagagttaattaagaa

SEQ ID NO: 50881 - DNA, 20 bp, Artificial Sequence
  Description of Artificial Sequence: Synthetic oligonucleotide
  Target: SCN10A; (-) strand; PAM type: YTN; PAM sequence: CTA
cagaagacatagaaacaagg

SEQ ID NO: 50882 - DNA, 20 bp, Artificial Sequence
  Description of Artificial Sequence: Synthetic oligonucleotide
  Target: SCN10A; (-) strand; PAM type: YTN; PAM sequence: TTC
tacagaagacatagaaacaa

SEQ ID NO: 50883 - DNA, 20 bp, Artificial Sequence
  Description of Artificial Sequence: Synthetic oligonucleotide
  Target: SCN10A; (-) strand; PAM type: YTN; PAM sequence: TTT
ctacagaagacatagaaaca

SEQ ID NO: 50884 - DNA, 20 bp, Artificial Sequence
  Description of Artificial Sequence: Synthetic oligonucleotide
  Target: SCN10A; (-) strand; PAM type: YTN; PAM sequence: CTA
tggtggatttctacagaaga

SEQ ID NO: 50885 - DNA, 20 bp, Artificial Sequence
  Description of Artificial Sequence: Synthetic oligonucleotide
  Target: SCN10A; (-) strand; PAM type: YTN; PAM sequence: TTA
tatgcagtggctatggtgga

SEQ ID NO: 50886 - DNA, 20 bp, Artificial Sequence
  Description of Artificial Sequence: Synthetic oligonucleotide
  Target: SCN10A; (-) strand; PAM type: YTN; PAM sequence: TTT
atatgcagtggctatggtgg

SEQ ID NO: 50887 - DNA, 20 bp, Artificial Sequence
  Description of Artificial Sequence: Synthetic oligonucleotide
  Target: SCN10A; (-) strand; PAM type: YTN; PAM sequence: CTG
tttatatgcagtggctatgg

SEQ ID NO: 50888 - DNA, 20 bp, Artificial Sequence
  Description of Artificial Sequence: Synthetic oligonucleotide
  Target: SCN10A; (-) strand; PAM type: YTN; PAM sequence: CTC
agagcagtgaactgtttata

SEQ ID NO: 50889 - DNA, 20 bp, Artificial Sequence
  Description of Artificial Sequence: Synthetic oligonucleotide
  Target: SCN10A; (-) strand; PAM type: YTN; PAM sequence: TTA
atcctcagagcagtgaactg

SEQ ID NO: 50890 - DNA, 20 bp, Artificial Sequence
  Description of Artificial Sequence: Synthetic oligonucleotide
  Target: SCN10A; (-) strand; PAM type: YTN; PAM sequence: TTT
aatcctcagagcagtgaact

SEQ ID NO: 50891 - DNA, 20 bp, Artificial Sequence
  Description of Artificial Sequence: Synthetic oligonucleotide
  Target: SCN10A; (-) strand; PAM type: YTN; PAM sequence: CTC
atttaatcctcagagcagtg

SEQ ID NO: 50892 - DNA, 20 bp, Artificial Sequence
  Description of Artificial Sequence: Synthetic oligonucleotide
  Target: SCN10A; (-) strand; PAM type: YTN; PAM sequence: CTA
tacagtgatctcatttaatc

SEQ ID NO: 50893 - DNA, 20 bp, Artificial Sequence
  Description of Artificial Sequence: Synthetic oligonucleotide
  Target: SCN10A; (-) strand; PAM type: YTN; PAM sequence: CTA
tgcagaagtgcaagacacta

SEQ ID NO: 50894 - DNA, 20 bp, Artificial Sequence
  Description of Artificial Sequence: Synthetic oligonucleotide
  Target: SCN10A; (-) strand; PAM type: YTN; PAM sequence: TTA
ctatgcagaagtgcaagaca

SEQ ID NO: 50895 - DNA, 20 bp, Artificial Sequence
  Description of Artificial Sequence: Synthetic oligonucleotide
  Target: SCN10A; (-) strand; PAM type: YTN; PAM sequence: TTT
actatgcagaagtgcaagac

SEQ ID NO: 50896 - DNA, 20 bp, Artificial Sequence
  Description of Artificial Sequence: Synthetic oligonucleotide
  Target: SCN10A; (-) strand; PAM type: YTN; PAM sequence: TTA
tatacaatatttactatgca

SEQ ID NO: 50897 - DNA, 20 bp, Artificial Sequence
  Description of Artificial Sequence: Synthetic oligonucleotide
  Target: SCN10A; (-) strand; PAM type: YTN; PAM sequence: TTT
atatacaatatttactatgc

SEQ ID NO: 50898 - DNA, 20 bp, Artificial Sequence
  Description of Artificial Sequence: Synthetic oligonucleotide
  Target: SCN10A; (-) strand; PAM type: YTN; PAM sequence: TTG
cagtttatatacaatattta

SEQ ID NO: 50899 - DNA, 20 bp, Artificial Sequence
  Description of Artificial Sequence: Synthetic oligonucleotide
  Target: SCN10A; (-) strand; PAM type: YTN; PAM sequence: TTT
gcagtttatatacaatattt

SEQ ID NO: 50900 - DNA, 20 bp, Artificial Sequence
  Description of Artificial Sequence: Synthetic oligonucleotide
  Target: SCN10A; (-) strand; PAM type: YTN; PAM sequence: CTT
tgcagtttatatacaatatt

SEQ ID NO: 50901 - DNA, 20 bp, Artificial Sequence
  Description of Artificial Sequence: Synthetic oligonucleotide
  Target: SCN10A; (-) strand; PAM type: YTN; PAM sequence: TTC
ctttgcagtttatatacaat

SEQ ID NO: 50902 - DNA, 20 bp, Artificial Sequence
  Description of Artificial Sequence: Synthetic oligonucleotide
  Target: SCN10A; (-) strand; PAM type: YTN; PAM sequence: TTT
cctttgcagtttatatacaa

SEQ ID NO: 50903 - DNA, 20 bp, Artificial Sequence
  Description of Artificial Sequence: Synthetic oligonucleotide
  Target: SCN10A; (-) strand; PAM type: YTN; PAM sequence: TTT
tcctttgcagtttatataca

SEQ ID NO: 50904 - DNA, 20 bp, Artificial Sequence
  Description of Artificial Sequence: Synthetic oligonucleotide
  Target: SCN10A; (-) strand; PAM type: YTN; PAM sequence: TTA
aaaacaataggaattttcct

SEQ ID NO: 50905 - DNA, 20 bp, Artificial Sequence
  Description of Artificial Sequence: Synthetic oligonucleotide
  Target: SCN10A; (-) strand; PAM type: YTN; PAM sequence: TTC
caaggttaaaaacaatagga

SEQ ID NO: 50906 - DNA, 20 bp, Artificial Sequence
  Description of Artificial Sequence: Synthetic oligonucleotide
  Target: SCN10A; (-) strand; PAM type: YTN; PAM sequence: CTT
ccaaggttaaaaacaatagg

SEQ ID NO: 50907 - DNA, 20 bp, Artificial Sequence
  Description of Artificial Sequence: Synthetic oligonucleotide
  Target: SCN10A; (-) strand; PAM type: YTN; PAM sequence: TTC
agcagcttccaaggttaaaa

SEQ ID NO: 50908 - DNA, 20 bp, Artificial Sequence
  Description of Artificial Sequence: Synthetic oligonucleotide
  Target: SCN10A; (-) strand; PAM type: YTN; PAM sequence: TTT
cagcagcttccaaggttaaa

SEQ ID NO: 50909 - DNA, 20 bp, Artificial Sequence
  Description of Artificial Sequence: Synthetic oligonucleotide
  Target: SCN10A; (-) strand; PAM type: YTN; PAM sequence: CTT
tcagcagcttccaaggttaa

SEQ ID NO: 50910 - DNA, 20 bp, Artificial Sequence
  Description of Artificial Sequence: Synthetic oligonucleotide
  Target: SCN10A; (-) strand; PAM type: YTN; PAM sequence: TTA
tcctttcagcagcttccaag

SEQ ID NO: 50911 - DNA, 20 bp, Artificial Sequence
  Description of Artificial Sequence: Synthetic oligonucleotide
  Target: SCN10A; (-) strand; PAM type: YTN; PAM sequence: TTT
atcctttcagcagcttccaa

SEQ ID NO: 50912 - DNA, 20 bp, Artificial Sequence
  Description of Artificial Sequence: Synthetic oligonucleotide
  Target: SCN10A; (-) strand; PAM type: YTN; PAM sequence: TTC
cagtttatcctttcagcagc

SEQ ID NO: 50913 - DNA, 20 bp, Artificial Sequence
  Description of Artificial Sequence: Synthetic oligonucleotide
  Target: SCN10A; (-) strand; PAM type: YTN; PAM sequence: TTA
ttccagtttatcctttcagc

SEQ ID NO: 50914 - DNA, 20 bp, Artificial Sequence
  Description of Artificial Sequence: Synthetic oligonucleotide
  Target: SCN10A; (-) strand; PAM type: YTN; PAM sequence: TTC
cacatatattattccagttt

SEQ ID NO: 50915 - DNA, 20 bp, Artificial Sequence
  Description of Artificial Sequence: Synthetic oligonucleotide
  Target: SCN10A; (-) strand; PAM type: YTN; PAM sequence: CTT
ccacatatattattccagtt

SEQ ID NO: 50916 - DNA, 20 bp, Artificial Sequence
  Description of Artificial Sequence: Synthetic oligonucleotide
  Target: SCN10A; (-) strand; PAM type: YTN; PAM sequence: TTC
ttccacatatattattccag

SEQ ID NO: 50917 - DNA, 20 bp, Artificial Sequence
  Description of Artificial Sequence: Synthetic oligonucleotide
  Target: SCN10A; (-) strand; PAM type: YTN; PAM sequence: TTC
agtgttcttccacatatatt

SEQ ID NO: 50918 - DNA, 20 bp, Artificial Sequence
  Description of Artificial Sequence: Synthetic oligonucleotide
  Target: SCN10A; (-) strand; PAM type: YTN; PAM sequence: TTT
cagtgttcttccacatatat

SEQ ID NO: 50919 - DNA, 20 bp, Artificial Sequence
  Description of Artificial Sequence: Synthetic oligonucleotide
  Target: SCN10A; (-) strand; PAM type: YTN; PAM sequence: TTT
tcagtgttcttccacatata

SEQ ID NO: 50920 - DNA, 20 bp, Artificial Sequence
  Description of Artificial Sequence: Synthetic oligonucleotide
  Target: SCN10A; (-) strand; PAM type: YTN; PAM sequence: TTG
ataattttcagtgttcttcc

SEQ ID NO: 50921 - DNA, 20 bp, Artificial Sequence
  Description of Artificial Sequence: Synthetic oligonucleotide
  Target: SCN10A; (-) strand; PAM type: YTN; PAM sequence: CTC
aaggcagaaaatggatacca

SEQ ID NO: 50922 - DNA, 20 bp, Artificial Sequence
  Description of Artificial Sequence: Synthetic oligonucleotide
  Target: SCN10A; (-) strand; PAM type: YTN; PAM sequence: CTG
tgggaggaaggtcaggggtc

SEQ ID NO: 50923 - DNA, 20 bp, Artificial Sequence
  Description of Artificial Sequence: Synthetic oligonucleotide
  Target: SCN10A; (-) strand; PAM type: YTN; PAM sequence: TTG
gccaatggcactgtgggagg

SEQ ID NO: 50924 - DNA, 20 bp, Artificial Sequence
  Description of Artificial Sequence: Synthetic oligonucleotide
  Target: SCN10A; (-) strand; PAM type: YTN; PAM sequence: CTG
aggaaaggcccacattggcc

SEQ ID NO: 50925 - DNA, 20 bp, Artificial Sequence
  Description of Artificial Sequence: Synthetic oligonucleotide
  Target: SCN10A; (-) strand; PAM type: YTN; PAM sequence: CTG
cagagaagccagagtcctga

SEQ ID NO: 50926 - DNA, 20 bp, Artificial Sequence
  Description of Artificial Sequence: Synthetic oligonucleotide
  Target: SCN10A; (-) strand; PAM type: YTN; PAM sequence: CTG
tggggctgcagagaagccag

SEQ ID NO: 50927 - DNA, 20 bp, Artificial Sequence
  Description of Artificial Sequence: Synthetic oligonucleotide
  Target: SCN10A; (-) strand; PAM type: YTN; PAM sequence: CTC
tgtggggctgcagagaagcc

SEQ ID NO: 50928 - DNA, 20 bp, Artificial Sequence
  Description of Artificial Sequence: Synthetic oligonucleotide
  Target: SCN10A; (-) strand; PAM type: YTN; PAM sequence: CTG
ggtcctctgtggggctgcag

SEQ ID NO: 50929 - DNA, 20 bp, Artificial Sequence
  Description of Artificial Sequence: Synthetic oligonucleotide
  Target: SCN10A; (-) strand; PAM type: YTN; PAM sequence: CTA
aacctgggtcctctgtgggg

SEQ ID NO: 50930 - DNA, 20 bp, Artificial Sequence
  Description of Artificial Sequence: Synthetic oligonucleotide
  Target: SCN10A; (-) strand; PAM type: YTN; PAM sequence: CTG
ccggggcatgccgtgaaagc

SEQ ID NO: 50931 - DNA, 20 bp, Artificial Sequence
  Description of Artificial Sequence: Synthetic oligonucleotide
  Target: SCN10A; (-) strand; PAM type: YTN; PAM sequence: CTC
aggataacggacagagtgaa

SEQ ID NO: 50932 - DNA, 20 bp, Artificial Sequence
  Description of Artificial Sequence: Synthetic oligonucleotide
  Target: SCN10A; (-) strand; PAM type: YTN; PAM sequence: CTG
ggatggcagagagaggccag

SEQ ID NO: 50933 - DNA, 20 bp, Artificial Sequence
  Description of Artificial Sequence: Synthetic oligonucleotide
  Target: SCN10A; (-) strand; PAM type: YTN; PAM sequence: TTG
ggcaggtgccagccaggcag

SEQ ID NO: 50934 - DNA, 20 bp, Artificial Sequence
  Description of Artificial Sequence: Synthetic oligonucleotide
  Target: SCN10A; (-) strand; PAM type: YTN; PAM sequence: CTA
ttgggcaggtgccagccagg

SEQ ID NO: 50935 - DNA, 20 bp, Artificial Sequence
  Description of Artificial Sequence: Synthetic oligonucleotide
  Target: SCN10A; (-) strand; PAM type: YTN; PAM sequence: CTG
ctattgggcaggtgccagcc

SEQ ID NO: 50936 - DNA, 20 bp, Artificial Sequence
  Description of Artificial Sequence: Synthetic oligonucleotide
  Target: SCN10A; (-) strand; PAM type: YTN; PAM sequence: CTG
agaggccaggcctgctattg

SEQ ID NO: 50937 - DNA, 20 bp, Artificial Sequence
  Description of Artificial Sequence: Synthetic oligonucleotide
  Target: SCN10A; (-) strand; PAM type: YTN; PAM sequence: CTC
cctgagaggccaggcctgct

SEQ ID NO: 50938 - DNA, 20 bp, Artificial Sequence
  Description of Artificial Sequence: Synthetic oligonucleotide
  Target: SCN10A; (-) strand; PAM type: YTN; PAM sequence: CTC
agctccctgagaggccaggc

SEQ ID NO: 50939 - DNA, 20 bp, Artificial Sequence
  Description of Artificial Sequence: Synthetic oligonucleotide
  Target: SCN10A; (-) strand; PAM type: YTN; PAM sequence: CTA
cagctcagctccctgagagg

SEQ ID NO: 50940 - DNA, 20 bp, Artificial Sequence
  Description of Artificial Sequence: Synthetic oligonucleotide
  Target: SCN10A; (-) strand; PAM type: YTN; PAM sequence: CTC
tacagctcagctccctgaga

SEQ ID NO: 50941 - DNA, 20 bp, Artificial Sequence
  Description of Artificial Sequence: Synthetic oligonucleotide
  Target: SCN10A; (-) strand; PAM type: YTN; PAM sequence: CTA
cacacctctacagctcagct

SEQ ID NO: 50942 - DNA, 20 bp, Artificial Sequence
  Description of Artificial Sequence: Synthetic oligonucleotide
  Target: SCN10A; (-) strand; PAM type: YTN; PAM sequence: TTG
ggtccatctacacacctcta

SEQ ID NO: 50943 - DNA, 20 bp, Artificial Sequence
  Description of Artificial Sequence: Synthetic oligonucleotide
  Target: SCN10A; (-) strand; PAM type: YTN; PAM sequence: TTG
ttgggtccatctacacacct

SEQ ID NO: 50944 - DNA, 20 bp, Artificial Sequence
  Description of Artificial Sequence: Synthetic oligonucleotide
  Target: SCN10A; (-) strand; PAM type: YTN; PAM sequence: TTG
tggtaaagttgttgggtcca

SEQ ID NO: 50945 - DNA, 20 bp, Artificial Sequence
  Description of Artificial Sequence: Synthetic oligonucleotide
  Target: SCN10A; (-) strand; PAM type: YTN; PAM sequence: TTT
gtggtaaagttgttgggtcc

SEQ ID NO: 50946 - DNA, 20 bp, Artificial Sequence
  Description of Artificial Sequence: Synthetic oligonucleotide
  Target: SCN10A; (-) strand; PAM type: YTN; PAM sequence: TTT
tgtggtaaagttgttgggtc

SEQ ID NO: 50947 - DNA, 20 bp, Artificial Sequence
  Description of Artificial Sequence: Synthetic oligonucleotide
  Target: SCN10A; (-) strand; PAM type: YTN; PAM sequence: TTT
ttgtggtaaagttgttgggt

SEQ ID NO: 50948 - DNA, 20 bp, Artificial Sequence
  Description of Artificial Sequence: Synthetic oligonucleotide
  Target: SCN10A; (-) strand; PAM type: YTN; PAM sequence: CTT
tttgtggtaaagttgttggg

SEQ ID NO: 50949 - DNA, 20 bp, Artificial Sequence
  Description of Artificial Sequence: Synthetic oligonucleotide
  Target: SCN10A; (-) strand; PAM type: YTN; PAM sequence: CTC
aagtcctttttgtggtaaag

SEQ ID NO: 50950 - DNA, 20 bp, Artificial Sequence
  Description of Artificial Sequence: Synthetic oligonucleotide
  Target: SCN10A; (-) strand; PAM type: YTN; PAM sequence: CTC
cagagcagctcaagtccttt

SEQ ID NO: 50951 - DNA, 20 bp, Artificial Sequence
  Description of Artificial Sequence: Synthetic oligonucleotide
  Target: SCN10A; (-) strand; PAM type: YTN; PAM sequence: CTC
aaggcaatggctccagagca

SEQ ID NO: 50952 - DNA, 20 bp, Artificial Sequence
  Description of Artificial Sequence: Synthetic oligonucleotide
  Target: SCN10A; (-) strand; PAM type: YTN; PAM sequence: TTC
tcaaggcaatggctccagag

SEQ ID NO: 50953 - DNA, 20 bp, Artificial Sequence
  Description of Artificial Sequence: Synthetic oligonucleotide
  Target: SCN10A; (-) strand; PAM type: YTN; PAM sequence: TTT
ctcaaggcaatggctccaga

SEQ ID NO: 50954 - DNA, 20 bp, Artificial Sequence
  Description of Artificial Sequence: Synthetic oligonucleotide
  Target: SCN10A; (-) strand; PAM type: YTN; PAM sequence: CTA
gataatggcatttctcaagg

SEQ ID NO: 50955 - DNA, 20 bp, Artificial Sequence
  Description of Artificial Sequence: Synthetic oligonucleotide
  Target: SCN10A; (-) strand; PAM type: YTN; PAM sequence: CTG
tctagataatggcatttctc

SEQ ID NO: 50956 - DNA, 20 bp, Artificial Sequence
  Description of Artificial Sequence: Synthetic oligonucleotide
  Target: SCN10A; (-) strand; PAM type: YTN; PAM sequence: TTC
tgtctagataatggcatttc

SEQ ID NO: 50957 - DNA, 20 bp, Artificial Sequence
  Description of Artificial Sequence: Synthetic oligonucleotide
  Target: SCN10A; (-) strand; PAM type: YTN; PAM sequence: CTT
ctgtctagataatggcattt

SEQ ID NO: 50958 - DNA, 20 bp, Artificial Sequence
  Description of Artificial Sequence: Synthetic oligonucleotide
  Target: SCN10A; (-) strand; PAM type: YTN; PAM sequence: CTC
agcatccttctgtctagata

SEQ ID NO: 50959 - DNA, 20 bp, Artificial Sequence
  Description of Artificial Sequence: Synthetic oligonucleotide
  Target: SCN10A; (-) strand; PAM type: YTN; PAM sequence: TTA
aatgtaaaccaagagcccct

SEQ ID NO: 50960 - DNA, 20 bp, Artificial Sequence
  Description of Artificial Sequence: Synthetic oligonucleotide
  Target: SCN10A; (-) strand; PAM type: YTN; PAM sequence: CTT
aaatgtaaaccaagagcccc

SEQ ID NO: 50961 - DNA, 20 bp, Artificial Sequence
  Description of Artificial Sequence: Synthetic oligonucleotide
  Target: SCN10A; (-) strand; PAM type: YTN; PAM sequence: TTG
acttaaatgtaaaccaagag

SEQ ID NO: 50962 - DNA, 20 bp, Artificial Sequence
  Description of Artificial Sequence: Synthetic oligonucleotide
  Target: SCN10A; (-) strand; PAM type: YTN; PAM sequence: TTT
gacttaaatgtaaaccaaga

SEQ ID NO: 50963 - DNA, 20 bp, Artificial Sequence
  Description of Artificial Sequence: Synthetic oligonucleotide
  Target: SCN10A; (-) strand; PAM type: YTN; PAM sequence: CTT
tgacttaaatgtaaaccaag

SEQ ID NO: 50964 - DNA, 20 bp, Artificial Sequence
  Description of Artificial Sequence: Synthetic oligonucleotide
  Target: SCN10A; (-) strand; PAM type: YTN; PAM sequence: TTG
cctttgacttaaatgtaaac

SEQ ID NO: 50965 - DNA, 20 bp, Artificial Sequence
  Description of Artificial Sequence: Synthetic oligonucleotide
  Target: SCN10A; (-) strand; PAM type: YTN; PAM sequence: TTT
gcctttgacttaaatgtaaa

SEQ ID NO: 50966 - DNA, 20 bp, Artificial Sequence
  Description of Artificial Sequence: Synthetic oligonucleotide
  Target: SCN10A; (-) strand; PAM type: YTN; PAM sequence: TTC
atttgcctttgacttaaatg

SEQ ID NO: 50967 - DNA, 20 bp, Artificial Sequence
  Description of Artificial Sequence: Synthetic oligonucleotide
  Target: SCN10A; (-) strand; PAM type: YTN; PAM sequence: TTT
catttgcctttgacttaaat

SEQ ID NO: 50968 - DNA, 20 bp, Artificial Sequence
  Description of Artificial Sequence: Synthetic oligonucleotide
  Target: SCN10A; (-) strand; PAM type: YTN; PAM sequence: TTT
tcatttgcctttgacttaaa

SEQ ID NO: 50969 - DNA, 20 bp, Artificial Sequence
  Description of Artificial Sequence: Synthetic oligonucleotide
  Target: SCN10A; (-) strand; PAM type: YTN; PAM sequence: CTG
acatcagttttcatttgcct

SEQ ID NO: 50970 - DNA, 20 bp, Artificial Sequence
  Description of Artificial Sequence: Synthetic oligonucleotide
  Target: SCN10A; (-) strand; PAM type: YTN; PAM sequence: TTC
tgacatcagttttcatttgc

SEQ ID NO: 50971 - DNA, 20 bp, Artificial Sequence
  Description of Artificial Sequence: Synthetic oligonucleotide
  Target: SCN10A; (-) strand; PAM type: YTN; PAM sequence: TTG
ttctgacatcagttttcatt

SEQ ID NO: 50972 - DNA, 20 bp, Artificial Sequence
  Description of Artificial Sequence: Synthetic oligonucleotide
  Target: SCN10A; (-) strand; PAM type: YTN; PAM sequence: CTC
atgagagggttgttctgaca

SEQ ID NO: 50973 - DNA, 20 bp, Artificial Sequence
  Description of Artificial Sequence: Synthetic oligonucleotide
  Target: SCN10A; (-) strand; PAM type: YTN; PAM sequence: TTG
gctcatgagagggttgttct

SEQ ID NO: 50974 - DNA, 20 bp, Artificial Sequence
  Description of Artificial Sequence: Synthetic oligonucleotide
  Target: SCN10A; (-) strand; PAM type: YTN; PAM sequence: TTT
ggctcatgagagggttgttc

SEQ ID NO: 50975 - DNA, 20 bp, Artificial Sequence
  Description of Artificial Sequence: Synthetic oligonucleotide
  Target: SCN10A; (-) strand; PAM type: YTN; PAM sequence: CTT
tggctcatgagagggttgtt

SEQ ID NO: 50976 - DNA, 20 bp, Artificial Sequence
  Description of Artificial Sequence: Synthetic oligonucleotide
  Target: SCN10A; (-) strand; PAM type: YTN; PAM sequence: TTC
tttggctcatgagagggttg

SEQ ID NO: 50977 - DNA, 20 bp, Artificial Sequence
  Description of Artificial Sequence: Synthetic oligonucleotide
  Target: SCN10A; (-) strand; PAM type: YTN; PAM sequence: TTG
gttctttggctcatgagagg

SEQ ID NO: 50978 - DNA, 20 bp, Artificial Sequence
  Description of Artificial Sequence: Synthetic oligonucleotide
  Target: SCN10A; (-) strand; PAM type: YTN; PAM sequence: TTT
ggttctttggctcatgagag

SEQ ID NO: 50979 - DNA, 20 bp, Artificial Sequence
  Description of Artificial Sequence: Synthetic oligonucleotide
  Target: SCN10A; (-) strand; PAM type: YTN; PAM sequence: TTG
gcatttggttctttggctca

SEQ ID NO: 50980 - DNA, 20 bp, Artificial Sequence
  Description of Artificial Sequence: Synthetic oligonucleotide
  Target: SCN10A; (-) strand; PAM type: YTN; PAM sequence: CTT
ggcatttggttctttggctc

SEQ ID NO: 50981 - DNA, 20 bp, Artificial Sequence
  Description of Artificial Sequence: Synthetic oligonucleotide
  Target: SCN10A; (-) strand; PAM type: YTN; PAM sequence: TTC
acaaatgcacttggcatttg

SEQ ID NO: 50982 - DNA, 20 bp, Artificial Sequence
  Description of Artificial Sequence: Synthetic oligonucleotide
  Target: SCN10A; (-) strand; PAM type: YTN; PAM sequence: TTT
cacaaatgcacttggcattt

SEQ ID NO: 50983 - DNA, 20 bp, Artificial Sequence
  Description of Artificial Sequence: Synthetic oligonucleotide
  Target: SCN10A; (-) strand; PAM type: YTN; PAM sequence: CTT
tcacaaatgcacttggcatt

SEQ ID NO: 50984 - DNA, 20 bp, Artificial Sequence
  Description of Artificial Sequence: Synthetic oligonucleotide
  Target: SCN10A; (-) strand; PAM type: YTN; PAM sequence: TTC
tttcacaaatgcacttggca

SEQ ID NO: 50985 - DNA, 20 bp, Artificial Sequence
  Description of Artificial Sequence: Synthetic oligonucleotide
  Target: SCN10A; (-) strand; PAM type: YTN; PAM sequence: CTG
ttctttcacaaatgcacttg

SEQ ID NO: 50986 - DNA, 20 bp, Artificial Sequence
  Description of Artificial Sequence: Synthetic oligonucleotide
  Target: SCN10A; (-) strand; PAM type: YTN; PAM sequence: TTG
gactgttctttcacaaatgc

SEQ ID NO: 50987 - DNA, 20 bp, Artificial Sequence
  Description of Artificial Sequence: Synthetic oligonucleotide
  Target: SCN10A; (-) strand; PAM type: YTN; PAM sequence: CTT
ggactgttctttcacaaatg

SEQ ID NO: 50988 - DNA, 20 bp, Artificial Sequence
  Description of Artificial Sequence: Synthetic oligonucleotide
  Target: SCN10A; (-) strand; PAM type: YTN; PAM sequence: TTC
cttggactgttctttcacaa

SEQ ID NO: 50989 - DNA, 20 bp, Artificial Sequence
  Description of Artificial Sequence: Synthetic oligonucleotide
  Target: SCN10A; (-) strand; PAM type: YTN; PAM sequence: TTG
gtcaacatcaggttccttgg

SEQ ID NO: 50990 - DNA, 20 bp, Artificial Sequence
  Description of Artificial Sequence: Synthetic oligonucleotide
  Target: SCN10A; (-) strand; PAM type: YTN; PAM sequence: TTT
ggtcaacatcaggttccttg

SEQ ID NO: 50991 - DNA, 20 bp, Artificial Sequence
  Description of Artificial Sequence: Synthetic oligonucleotide
  Target: SCN10A; (-) strand; PAM type: YTN; PAM sequence: CTG
gaaacaagcaggagcatttg

SEQ ID NO: 50992 - DNA, 20 bp, Artificial Sequence
  Description of Artificial Sequence: Synthetic oligonucleotide
  Target: SCN10A; (-) strand; PAM type: YTN; PAM sequence: CTG
aggactggaaacaagcagga

SEQ ID NO: 50993 - DNA, 20 bp, Artificial Sequence
  Description of Artificial Sequence: Synthetic oligonucleotide
  Target: SCN10A; (-) strand; PAM type: YTN; PAM sequence: TTG
gagctgaggactggaaacaa

SEQ ID NO: 50994 - DNA, 20 bp, Artificial Sequence
  Description of Artificial Sequence: Synthetic oligonucleotide
  Target: SCN10A; (-) strand; PAM type: YTN; PAM sequence: CTC
agttggagctgaggactgga

SEQ ID NO: 50995 - DNA, 20 bp, Artificial Sequence
  Description of Artificial Sequence: Synthetic oligonucleotide
  Target: SCN10A; (-) strand; PAM type: YTN; PAM sequence: CTA
tctcagttggagctgaggac

SEQ ID NO: 50996 - DNA, 20 bp, Artificial Sequence
  Description of Artificial Sequence: Synthetic oligonucleotide
  Target: SCN10A; (-) strand; PAM type: YTN; PAM sequence: CTA
ggaaaactatctcagttgga

SEQ ID NO: 50997 - DNA, 20 bp, Artificial Sequence
  Description of Artificial Sequence: Synthetic oligonucleotide
  Target: SCN10A; (-) strand; PAM type: YTN; PAM sequence: CTC
actaggaaaactatctcagt

SEQ ID NO: 50998 - DNA, 20 bp, Artificial Sequence
  Description of Artificial Sequence: Synthetic oligonucleotide
  Target: SCN10A; (-) strand; PAM type: YTN; PAM sequence: TTC
atcagctcactaggaaaact

SEQ ID NO: 50999 - DNA, 20 bp, Artificial Sequence
  Description of Artificial Sequence: Synthetic oligonucleotide
  Target: SCN10A; (-) strand; PAM type: YTN; PAM sequence: CTT
catcagctcactaggaaaac

SEQ ID NO: 51000 - DNA, 20 bp, Artificial Sequence
  Description of Artificial Sequence: Synthetic oligonucleotide
  Target: SCN10A; (-) strand; PAM type: YTN; PAM sequence: CTC
caccttcatcagctcactag

SEQ ID NO: 51001 - DNA, 20 bp, Artificial Sequence
  Description of Artificial Sequence: Synthetic oligonucleotide
  Target: SCN10A; (-) strand; PAM type: YTN; PAM sequence: CTG
catgaggctccaccttcatc

SEQ ID NO: 51002 - DNA, 20 bp, Artificial Sequence
  Description of Artificial Sequence: Synthetic oligonucleotide
  Target: SCN10A; (-) strand; PAM type: YTN; PAM sequence: CTG
tgtggagcctgcatgaggct

SEQ ID NO: 51003 - DNA, 20 bp, Artificial Sequence
  Description of Artificial Sequence: Synthetic oligonucleotide
  Target: SCN10A; (-) strand; PAM type: YTN; PAM sequence: TTG
cccaggtcgacctgtgtgga

SEQ ID NO: 51004 - DNA, 20 bp, Artificial Sequence
  Description of Artificial Sequence: Synthetic oligonucleotide
  Target: SCN10A; (-) strand; PAM type: YTN; PAM sequence: CTC
catgttgcccaggtcgacct

SEQ ID NO: 51005 - DNA, 20 bp, Artificial Sequence
  Description of Artificial Sequence: Synthetic oligonucleotide
  Target: SCN10A; (-) strand; PAM type: YTN; PAM sequence: CTG
acggctccatgttgcccagg

SEQ ID NO: 51006 - DNA, 20 bp, Artificial Sequence
  Description of Artificial Sequence: Synthetic oligonucleotide
  Target: SCN10A; (-) strand; PAM type: YTN; PAM sequence: CTG
agaggctgacggctccatgt

SEQ ID NO: 51007 - DNA, 20 bp, Artificial Sequence
  Description of Artificial Sequence: Synthetic oligonucleotide
  Target: SCN10A; (-) strand; PAM type: YTN; PAM sequence: CTC
acaacacccccagtgcctga

SEQ ID NO: 51008 - DNA, 20 bp, Artificial Sequence
  Description of Artificial Sequence: Synthetic oligonucleotide
  Target: SCN10A; (-) strand; PAM type: YTN; PAM sequence: TTG
gaaaagcagagctcacaaca

SEQ ID NO: 51009 - DNA, 20 bp, Artificial Sequence
  Description of Artificial Sequence: Synthetic oligonucleotide
  Target: SCN10A; (-) strand; PAM type: YTN; PAM sequence: CTT
ggaaaagcagagctcacaac

SEQ ID NO: 51010 - DNA, 20 bp, Artificial Sequence
  Description of Artificial Sequence: Synthetic oligonucleotide
  Target: SCN10A; (-) strand; PAM type: YTN; PAM sequence: CTG
agagcttggaaaagcagagc

SEQ ID NO: 51011 - DNA, 20 bp, Artificial Sequence
  Description of Artificial Sequence: Synthetic oligonucleotide
  Target: SCN10A; (-) strand; PAM type: YTN; PAM sequence: CTC
catggctgagagcttggaaa

SEQ ID NO: 51012 - DNA, 20 bp, Artificial Sequence
  Description of Artificial Sequence: Synthetic oligonucleotide
  Target: SCN10A; (-) strand; PAM type: YTN; PAM sequence: CTC
acccacctccatggctgaga

SEQ ID NO: 51013 - DNA, 20 bp, Artificial Sequence
  Description of Artificial Sequence: Synthetic oligonucleotide
  Target: SCN10A; (-) strand; PAM type: YTN; PAM sequence: TTA
ggcaaaagatcaaaaaggcc

SEQ ID NO: 51014 - DNA, 20 bp, Artificial Sequence
  Description of Artificial Sequence: Synthetic oligonucleotide
  Target: SCN10A; (-) strand; PAM type: YTN; PAM sequence: TTT
aggcaaaagatcaaaaaggc

SEQ ID NO: 51015 - DNA, 20 bp, Artificial Sequence
  Description of Artificial Sequence: Synthetic oligonucleotide
  Target: SCN10A; (-) strand; PAM type: YTN; PAM sequence: CTT
taggcaaaagatcaaaaagg

SEQ ID NO: 51016 - DNA, 20 bp, Artificial Sequence
  Description of Artificial Sequence: Synthetic oligonucleotide
  Target: SCN10A; (-) strand; PAM type: YTN; PAM sequence: CTG
gaggaaggcatgagcagaaa

SEQ ID NO: 51017 - DNA, 20 bp, Artificial Sequence
  Description of Artificial Sequence: Synthetic oligonucleotide
  Target: SCN10A; (-) strand; PAM type: YTN; PAM sequence: TTG
gccactggaggaaggcatga

SEQ ID NO: 51018 - DNA, 20 bp, Artificial Sequence
  Description of Artificial Sequence: Synthetic oligonucleotide
  Target: SCN10A; (-) strand; PAM type: YTN; PAM sequence: TTT
ggccactggaggaaggcatg

SEQ ID NO: 51019 - DNA, 20 bp, Artificial Sequence
  Description of Artificial Sequence: Synthetic oligonucleotide
  Target: SCN10A; (-) strand; PAM type: YTN; PAM sequence: CTT
tggccactggaggaaggcat

SEQ ID NO: 51020 - DNA, 20 bp, Artificial Sequence
  Description of Artificial Sequence: Synthetic oligonucleotide
  Target: SCN10A; (-) strand; PAM type: YTN; PAM sequence: CTG
ctttggccactggaggaagg

SEQ ID NO: 51021 - DNA, 20 bp, Artificial Sequence
  Description of Artificial Sequence: Synthetic oligonucleotide
  Target: SCN10A; (-) strand; PAM type: YTN; PAM sequence: CTG
ctgctttggccactggagga

SEQ ID NO: 51022 - DNA, 20 bp, Artificial Sequence
  Description of Artificial Sequence: Synthetic oligonucleotide
  Target: SCN10A; (-) strand; PAM type: YTN; PAM sequence: CTG
cctgctgctttggccactgg

SEQ ID NO: 51023 - DNA, 20 bp, Artificial Sequence
  Description of Artificial Sequence: Synthetic oligonucleotide
  Target: SCN10A; (-) strand; PAM type: YTN; PAM sequence: CTC
tgcctgctgctttggccact

SEQ ID NO: 51024 - DNA, 20 bp, Artificial Sequence
  Description of Artificial Sequence: Synthetic oligonucleotide
  Target: SCN10A; (-) strand; PAM type: YTN; PAM sequence: CTC
agctctgcctgctgctttgg

SEQ ID NO: 51025 - DNA, 20 bp, Artificial Sequence
  Description of Artificial Sequence: Synthetic oligonucleotide
  Target: SCN10A; (-) strand; PAM type: YTN; PAM sequence: CTA
agggatgaggacccctcagc

SEQ ID NO: 51026 - DNA, 20 bp, Artificial Sequence
  Description of Artificial Sequence: Synthetic oligonucleotide
  Target: SCN10A; (-) strand; PAM type: YTN; PAM sequence: TTC
caggtggcagaacagaatgt

SEQ ID NO: 51027 - DNA, 20 bp, Artificial Sequence
  Description of Artificial Sequence: Synthetic oligonucleotide
  Target: SCN10A; (-) strand; PAM type: YTN; PAM sequence: TTC
agcgaagaccattccaggtg

SEQ ID NO: 51028 - DNA, 20 bp, Artificial Sequence
  Description of Artificial Sequence: Synthetic oligonucleotide
  Target: SCN10A; (-) strand; PAM type: YTN; PAM sequence: TTT
cagcgaagaccattccaggt

SEQ ID NO: 51029 - DNA, 20 bp, Artificial Sequence
  Description of Artificial Sequence: Synthetic oligonucleotide
  Target: SCN10A; (-) strand; PAM type: YTN; PAM sequence: CTG
ggtgaatacgagatagtttc

SEQ ID NO: 51030 - DNA, 20 bp, Artificial Sequence
  Description of Artificial Sequence: Synthetic oligonucleotide
  Target: SCN10A; (-) strand; PAM type: YTN; PAM sequence: CTC
caggctgggtgaatacgaga

SEQ ID NO: 51031 - DNA, 20 bp, Artificial Sequence
  Description of Artificial Sequence: Synthetic oligonucleotide
  Target: SCN10A; (-) strand; PAM type: YTN; PAM sequence: TTC
aagggcaggtaggatgtctc

SEQ ID NO: 51032 - DNA, 20 bp, Artificial Sequence
  Description of Artificial Sequence: Synthetic oligonucleotide
  Target: SCN10A; (-) strand; PAM type: YTN; PAM sequence: TTT
caagggcaggtaggatgtct

SEQ ID NO: 51033 - DNA, 20 bp, Artificial Sequence
  Description of Artificial Sequence: Synthetic oligonucleotide
  Target: SCN10A; (-) strand; PAM type: YTN; PAM sequence: CTT
tcaagggcaggtaggatgtc

SEQ ID NO: 51034 - DNA, 20 bp, Artificial Sequence
  Description of Artificial Sequence: Synthetic oligonucleotide
  Target: SCN10A; (-) strand; PAM type: YTN; PAM sequence: TTG
aggtgagctttcaagggcag

SEQ ID NO: 51035 - DNA, 20 bp, Artificial Sequence
  Description of Artificial Sequence: Synthetic oligonucleotide
  Target: SCN10A; (-) strand; PAM type: YTN; PAM sequence: TTT
gaggtgagctttcaagggca

SEQ ID NO: 51036 - DNA, 20 bp, Artificial Sequence
  Description of Artificial Sequence: Synthetic oligonucleotide
  Target: SCN10A; (-) strand; PAM type: YTN; PAM sequence: CTG
gaggtggtgtttgaggtgag

SEQ ID NO: 51037 - DNA, 20 bp, Artificial Sequence
  Description of Artificial Sequence: Synthetic oligonucleotide
  Target: SCN10A; (-) strand; PAM type: YTN; PAM sequence: TTC
ctggaggtggtgtttgaggt

SEQ ID NO: 51038 - DNA, 20 bp, Artificial Sequence
  Description of Artificial Sequence: Synthetic oligonucleotide
  Target: SCN10A; (-) strand; PAM type: YTN; PAM sequence: CTT
cctggaggtggtgtttgagg

SEQ ID NO: 51039 - DNA, 20 bp, Artificial Sequence
  Description of Artificial Sequence: Synthetic oligonucleotide
  Target: SCN10A; (-) strand; PAM type: YTN; PAM sequence: CTG
ggcaaacacagtgaggtggc

SEQ ID NO: 51040 - DNA, 20 bp, Artificial Sequence
  Description of Artificial Sequence: Synthetic oligonucleotide
  Target: SCN10A; (-) strand; PAM type: YTN; PAM sequence: TTC
ataggctgggcaaacacagt

SEQ ID NO: 51041 - DNA, 20 bp, Artificial Sequence
  Description of Artificial Sequence: Synthetic oligonucleotide
  Target: SCN10A; (-) strand; PAM type: YTN; PAM sequence: CTT
cataggctgggcaaacacag

SEQ ID NO: 51042 - DNA, 20 bp, Artificial Sequence
  Description of Artificial Sequence: Synthetic oligonucleotide
  Target: SCN10A; (-) strand; PAM type: YTN; PAM sequence: CTA
gaggcttcataggctgggca

SEQ ID NO: 51043 - DNA, 20 bp, Artificial Sequence
  Description of Artificial Sequence: Synthetic oligonucleotide
  Target: SCN10A; (-) strand; PAM type: YTN; PAM sequence: TTA
ctagaggcttcataggctgg

SEQ ID NO: 51044 - DNA, 20 bp, Artificial Sequence
  Description of Artificial Sequence: Synthetic oligonucleotide
  Target: SCN10A; (-) strand; PAM type: YTN; PAM sequence: TTT
actagaggcttcataggctg

SEQ ID NO: 51045 - DNA, 20 bp, Artificial Sequence
  Description of Artificial Sequence: Synthetic oligonucleotide
  Target: SCN10A; (-) strand; PAM type: YTN; PAM sequence: CTT
tactagaggcttcataggct

SEQ ID NO: 51046 - DNA, 20 bp, Artificial Sequence
  Description of Artificial Sequence: Synthetic oligonucleotide
  Target: SCN10A; (-) strand; PAM type: YTN; PAM sequence: TTC
tttactagaggcttcatagg

SEQ ID NO: 51047 - DNA, 20 bp, Artificial Sequence
  Description of Artificial Sequence: Synthetic oligonucleotide
  Target: SCN10A; (-) strand; PAM type: YTN; PAM sequence: CTG
tggaaaacaagttctttact

SEQ ID NO: 51048 - DNA, 20 bp, Artificial Sequence
  Description of Artificial Sequence: Synthetic oligonucleotide
  Target: SCN10A; (-) strand; PAM type: YTN; PAM sequence: CTA
ccctgtggaaaacaagttct

SEQ ID NO: 51049 - DNA, 20 bp, Artificial Sequence
  Description of Artificial Sequence: Synthetic oligonucleotide
  Target: SCN10A; (-) strand; PAM type: YTN; PAM sequence: TTC
atagacataaagatgctacc

SEQ ID NO: 51050 - DNA, 20 bp, Artificial Sequence
  Description of Artificial Sequence: Synthetic oligonucleotide
  Target: SCN10A; (-) strand; PAM type: YTN; PAM sequence: CTC
attcatagacataaagatgc

SEQ ID NO: 51051 - DNA, 20 bp, Artificial Sequence
  Description of Artificial Sequence: Synthetic oligonucleotide
  Target: SCN10A; (-) strand; PAM type: YTN; PAM sequence: TTC
tcattcatagacataaagat

SEQ ID NO: 51052 - DNA, 20 bp, Artificial Sequence
  Description of Artificial Sequence: Synthetic oligonucleotide
  Target: SCN10A; (-) strand; PAM type: YTN; PAM sequence: TTT
ctcattcatagacataaaga

SEQ ID NO: 51053 - DNA, 20 bp, Artificial Sequence
  Description of Artificial Sequence: Synthetic oligonucleotide
  Target: SCN10A; (-) strand; PAM type: YTN; PAM sequence: TTG
caatttctcattcatagaca

SEQ ID NO: 51054 - DNA, 20 bp, Artificial Sequence
  Description of Artificial Sequence: Synthetic oligonucleotide
  Target: SCN10A; (-) strand; PAM type: YTN; PAM sequence: TTT
gcaatttctcattcatagac

SEQ ID NO: 51055 - DNA, 20 bp, Artificial Sequence
  Description of Artificial Sequence: Synthetic oligonucleotide
  Target: SCN10A; (-) strand; PAM type: YTN; PAM sequence: CTA
gtttgcaatttctcattcat

SEQ ID NO: 51056 - DNA, 20 bp, Artificial Sequence
  Description of Artificial Sequence: Synthetic oligonucleotide
  Target: SCN10A; (-) strand; PAM type: YTN; PAM sequence: CTG
ctagtttgcaatttctcatt

SEQ ID NO: 51057 - DNA, 20 bp, Artificial Sequence
  Description of Artificial Sequence: Synthetic oligonucleotide
  Target: SCN10A; (-) strand; PAM type: YTN; PAM sequence: CTA
taagctgctagtttgcaatt

SEQ ID NO: 51058 - DNA, 20 bp, Artificial Sequence
  Description of Artificial Sequence: Synthetic oligonucleotide
  Target: SCN10A; (-) strand; PAM type: YTN; PAM sequence: CTG
tgggccaaatccagcctata

SEQ ID NO: 51059 - DNA, 20 bp, Artificial Sequence
  Description of Artificial Sequence: Synthetic oligonucleotide
  Target: SCN10A; (-) strand; PAM type: YTN; PAM sequence: TTC
tgtgggccaaatccagccta

SEQ ID NO: 51060 - DNA, 20 bp, Artificial Sequence
  Description of Artificial Sequence: Synthetic oligonucleotide
  Target: SCN10A; (-) strand; PAM type: YTN; PAM sequence: TTT
ctgtgggccaaatccagcct

SEQ ID NO: 51061 - DNA, 20 bp, Artificial Sequence
  Description of Artificial Sequence: Synthetic oligonucleotide
  Target: SCN10A; (-) strand; PAM type: YTN; PAM sequence: TTG
ggccaaacaaaatatttctg

SEQ ID NO: 51062 - DNA, 20 bp, Artificial Sequence
  Description of Artificial Sequence: Synthetic oligonucleotide
  Target: SCN10A; (-) strand; PAM type: YTN; PAM sequence: TTG
ttgggccaaacaaaatattt

SEQ ID NO: 51063 - DNA, 20 bp, Artificial Sequence
  Description of Artificial Sequence: Synthetic oligonucleotide
  Target: SCN10A; (-) strand; PAM type: YTN; PAM sequence: CTA
catattgttgggccaaacaa

SEQ ID NO: 51064 - DNA, 20 bp, Artificial Sequence
  Description of Artificial Sequence: Synthetic oligonucleotide
  Target: SCN10A; (-) strand; PAM type: YTN; PAM sequence: TTC
caaaaaatgtctacatattg

SEQ ID NO: 51065 - DNA, 20 bp, Artificial Sequence
  Description of Artificial Sequence: Synthetic oligonucleotide
  Target: SCN10A; (-) strand; PAM type: YTN; PAM sequence: CTA
ttccaaaaaatgtctacata

SEQ ID NO: 51066 - DNA, 20 bp, Artificial Sequence
  Description of Artificial Sequence: Synthetic oligonucleotide
  Target: SCN10A; (-) strand; PAM type: YTN; PAM sequence: CTA
cctattccaaaaaatgtcta

SEQ ID NO: 51067 - DNA, 20 bp, Artificial Sequence
  Description of Artificial Sequence: Synthetic oligonucleotide
  Target: SCN10A; (-) strand; PAM type: YTN; PAM sequence: TTG
gctacctattccaaaaaatg

SEQ ID NO: 51068 - DNA, 20 bp, Artificial Sequence
  Description of Artificial Sequence: Synthetic oligonucleotide
  Target: SCN10A; (-) strand; PAM type: YTN; PAM sequence: CTC
ccaaccgtaaacattggcta

SEQ ID NO: 51069 - DNA, 20 bp, Artificial Sequence
  Description of Artificial Sequence: Synthetic oligonucleotide
  Target: SCN10A; (-) strand; PAM type: YTN; PAM sequence: TTA
tataaaatctcccaaccgta

SEQ ID NO: 51070 - DNA, 20 bp, Artificial Sequence
  Description of Artificial Sequence: Synthetic oligonucleotide
  Target: SCN10A; (-) strand; PAM type: YTN; PAM sequence: TTT
atataaaatctcccaaccgt

SEQ ID NO: 51071 - DNA, 20 bp, Artificial Sequence
  Description of Artificial Sequence: Synthetic oligonucleotide
  Target: SCN10A; (-) strand; PAM type: YTN; PAM sequence: TTT
tatataaaatctcccaaccg

SEQ ID NO: 51072 - DNA, 20 bp, Artificial Sequence
  Description of Artificial Sequence: Synthetic oligonucleotide
  Target: SCN10A; (-) strand; PAM type: YTN; PAM sequence: TTT
ttatataaaatctcccaacc

SEQ ID NO: 51073 - DNA, 20 bp, Artificial Sequence
  Description of Artificial Sequence: Synthetic oligonucleotide
  Target: SCN10A; (-) strand; PAM type: YTN; PAM sequence: TTA
gatttttatataaaatctcc

SEQ ID NO: 51074 - DNA, 20 bp, Artificial Sequence
  Description of Artificial Sequence: Synthetic oligonucleotide
  Target: SCN10A; (-) strand; PAM type: YTN; PAM sequence: TTT
agatttttatataaaatctc

SEQ ID NO: 51075 - DNA, 20 bp, Artificial Sequence
  Description of Artificial Sequence: Synthetic oligonucleotide
  Target: SCN10A; (-) strand; PAM type: YTN; PAM sequence: TTA
aaatagagataggaaattta

SEQ ID NO: 51076 - DNA, 20 bp, Artificial Sequence
  Description of Artificial Sequence: Synthetic oligonucleotide
  Target: SCN10A; (-) strand; PAM type: YTN; PAM sequence: TTT
aaaatagagataggaaattt

SEQ ID NO: 51077 - DNA, 20 bp, Artificial Sequence
  Description of Artificial Sequence: Synthetic oligonucleotide
  Target: SCN10A; (-) strand; PAM type: YTN; PAM sequence: TTT
taaaatagagataggaaatt

SEQ ID NO: 51078 - DNA, 20 bp, Artificial Sequence
  Description of Artificial Sequence: Synthetic oligonucleotide
  Target: SCN10A; (-) strand; PAM type: YTN; PAM sequence: CTT
ttaaaatagagataggaaat

SEQ ID NO: 51079 - DNA, 20 bp, Artificial Sequence
  Description of Artificial Sequence: Synthetic oligonucleotide
  Target: SCN10A; (-) strand; PAM type: YTN; PAM sequence: TTC
caacttttaaaatagagata

SEQ ID NO: 51080 - DNA, 20 bp, Artificial Sequence
  Description of Artificial Sequence: Synthetic oligonucleotide
  Target: SCN10A; (-) strand; PAM type: YTN; PAM sequence: CTT
ccaacttttaaaatagagat

SEQ ID NO: 51081 - DNA, 20 bp, Artificial Sequence
  Description of Artificial Sequence: Synthetic oligonucleotide
  Target: SCN10A; (-) strand; PAM type: YTN; PAM sequence: CTC
ttccaacttttaaaatagag

SEQ ID NO: 51082 - DNA, 20 bp, Artificial Sequence
  Description of Artificial Sequence: Synthetic oligonucleotide
  Target: SCN10A; (-) strand; PAM type: YTN; PAM sequence: TTC
cagctcttccaacttttaaa

SEQ ID NO: 51083 - DNA, 20 bp, Artificial Sequence
  Description of Artificial Sequence: Synthetic oligonucleotide
  Target: SCN10A; (-) strand; PAM type: YTN; PAM sequence: TTT
ccagctcttccaacttttaa

SEQ ID NO: 51084 - DNA, 20 bp, Artificial Sequence
  Description of Artificial Sequence: Synthetic oligonucleotide
  Target: SCN10A; (-) strand; PAM type: YTN; PAM sequence: CTG
tttccagctcttccaacttt

SEQ ID NO: 51085 - DNA, 20 bp, Artificial Sequence
  Description of Artificial Sequence: Synthetic oligonucleotide
  Target: SCN10A; (-) strand; PAM type: YTN; PAM sequence: TTC
actgtttccagctcttccaa

SEQ ID NO: 51086 - DNA, 20 bp, Artificial Sequence
  Description of Artificial Sequence: Synthetic oligonucleotide
  Target: SCN10A; (-) strand; PAM type: YTN; PAM sequence: TTG
ccatgtggaaatgtgggttc

SEQ ID NO: 51087 - DNA, 20 bp, Artificial Sequence
  Description of Artificial Sequence: Synthetic oligonucleotide
  Target: SCN10A; (-) strand; PAM type: YTN; PAM sequence: TTG
gttgccatgtggaaatgtgg

SEQ ID NO: 51088 - DNA, 20 bp, Artificial Sequence
  Description of Artificial Sequence: Synthetic oligonucleotide
  Target: SCN10A; (-) strand; PAM type: YTN; PAM sequence: TTT
ggttgccatgtggaaatgtg

SEQ ID NO: 51089 - DNA, 20 bp, Artificial Sequence
  Description of Artificial Sequence: Synthetic oligonucleotide
  Target: SCN10A; (-) strand; PAM type: YTN; PAM sequence: TTT
tggttgccatgtggaaatgt

SEQ ID NO: 51090 - DNA, 20 bp, Artificial Sequence
  Description of Artificial Sequence: Synthetic oligonucleotide
  Target: SCN10A; (-) strand; PAM type: YTN; PAM sequence: CTT
ttggttgccatgtggaaatg

SEQ ID NO: 51091 - DNA, 20 bp, Artificial Sequence
  Description of Artificial Sequence: Synthetic oligonucleotide
  Target: SCN10A; (-) strand; PAM type: YTN; PAM sequence: CTC
ggtccagcttttggttgcca

SEQ ID NO: 51092 - DNA, 20 bp, Artificial Sequence
  Description of Artificial Sequence: Synthetic oligonucleotide
  Target: SCN10A; (-) strand; PAM type: YTN; PAM sequence: CTG
ctcggtccagcttttggttg

SEQ ID NO: 51093 - DNA, 20 bp, Artificial Sequence
  Description of Artificial Sequence: Synthetic oligonucleotide
  Target: SCN10A; (-) strand; PAM type: YTN; PAM sequence: CTA
aaggggacagccccactgct

SEQ ID NO: 51094 - DNA, 20 bp, Artificial Sequence
  Description of Artificial Sequence: Synthetic oligonucleotide
  Target: SCN10A; (-) strand; PAM type: YTN; PAM sequence: CTC
taaaggggacagccccactg

SEQ ID NO: 51095 - DNA, 20 bp, Artificial Sequence
  Description of Artificial Sequence: Synthetic oligonucleotide
  Target: SCN10A; (-) strand; PAM type: YTN; PAM sequence: CTC
ctctaaaggggacagcccca

SEQ ID NO: 51096 - DNA, 20 bp, Artificial Sequence
  Description of Artificial Sequence: Synthetic oligonucleotide
  Target: SCN10A; (-) strand; PAM type: YTN; PAM sequence: TTC
atgcctcctctaaaggggac

SEQ ID NO: 51097 - DNA, 20 bp, Artificial Sequence
  Description of Artificial Sequence: Synthetic oligonucleotide
  Target: SCN10A; (-) strand; PAM type: YTN; PAM sequence: CTG
agagttcatgcctcctctaa

SEQ ID NO: 51098 - DNA, 20 bp, Artificial Sequence
  Description of Artificial Sequence: Synthetic oligonucleotide
  Target: SCN10A; (-) strand; PAM type: YTN; PAM sequence: CTA
ggagctgagagttcatgcct

SEQ ID NO: 51099 - DNA, 20 bp, Artificial Sequence
  Description of Artificial Sequence: Synthetic oligonucleotide
  Target: SCN10A; (-) strand; PAM type: YTN; PAM sequence: TTC
ataacaacaaatgagtggag

SEQ ID NO: 51100 - DNA, 20 bp, Artificial Sequence
  Description of Artificial Sequence: Synthetic oligonucleotide
  Target: SCN10A; (-) strand; PAM type: YTN; PAM sequence: TTA
cagaggccagattcataaca

SEQ ID NO: 51101 - DNA, 20 bp, Artificial Sequence
  Description of Artificial Sequence: Synthetic oligonucleotide
  Target: SCN10A; (-) strand; PAM type: YTN; PAM sequence: CTT
acagaggccagattcataac

SEQ ID NO: 51102 - DNA, 20 bp, Artificial Sequence
  Description of Artificial Sequence: Synthetic oligonucleotide
  Target: SCN10A; (-) strand; PAM type: YTN; PAM sequence: TTC
ttacagaggccagattcata

SEQ ID NO: 51103 - DNA, 20 bp, Artificial Sequence
  Description of Artificial Sequence: Synthetic oligonucleotide
  Target: SCN10A; (-) strand; PAM type: YTN; PAM sequence: TTC
gaattcttacagaggccaga

SEQ ID NO: 51104 - DNA, 20 bp, Artificial Sequence
  Description of Artificial Sequence: Synthetic oligonucleotide
  Target: SCN10A; (-) strand; PAM type: YTN; PAM sequence: TTT
cgaattcttacagaggccag

SEQ ID NO: 51105 - DNA, 20 bp, Artificial Sequence
  Description of Artificial Sequence: Synthetic oligonucleotide
  Target: SCN10A; (-) strand; PAM type: YTN; PAM sequence: TTG
caatttcgaattcttacaga

SEQ ID NO: 51106 - DNA, 20 bp, Artificial Sequence
  Description of Artificial Sequence: Synthetic oligonucleotide
  Target: SCN10A; (-) strand; PAM type: YTN; PAM sequence: TTT
gcaatttcgaattcttacag

SEQ ID NO: 51107 - DNA, 20 bp, Artificial Sequence
  Description of Artificial Sequence: Synthetic oligonucleotide
  Target: SCN10A; (-) strand; PAM type: YTN; PAM sequence: CTT
tgcaatttcgaattcttaca

SEQ ID NO: 51108 - DNA, 20 bp, Artificial Sequence
  Description of Artificial Sequence: Synthetic oligonucleotide
  Target: SCN10A; (-) strand; PAM type: YTN; PAM sequence: CTC
acaagtagaggaaaaaacac

SEQ ID NO: 51109 - DNA, 20 bp, Artificial Sequence
  Description of Artificial Sequence: Synthetic oligonucleotide
  Target: SCN10A; (-) strand; PAM type: YTN; PAM sequence: TTA
ccctcacaagtagaggaaaa

SEQ ID NO: 51110 - DNA, 20 bp, Artificial Sequence
  Description of Artificial Sequence: Synthetic oligonucleotide
  Target: SCN10A; (-) strand; PAM type: YTN; PAM sequence: CTA
tagccacattaccctcacaa

SEQ ID NO: 51111 - DNA, 20 bp, Artificial Sequence
  Description of Artificial Sequence: Synthetic oligonucleotide
  Target: SCN10A; (-) strand; PAM type: YTN; PAM sequence: TTC
tatagccacattaccctcac

SEQ ID NO: 51112 - DNA, 20 bp, Artificial Sequence
  Description of Artificial Sequence: Synthetic oligonucleotide
  Target: SCN10A; (-) strand; PAM type: YTN; PAM sequence: CTC
cattctatagccacattacc

SEQ ID NO: 51113 - DNA, 20 bp, Artificial Sequence
  Description of Artificial Sequence: Synthetic oligonucleotide
  Target: SCN10A; (-) strand; PAM type: YTN; PAM sequence: CTA
actccattctatagccacat

SEQ ID NO: 51114 - DNA, 20 bp, Artificial Sequence
  Description of Artificial Sequence: Synthetic oligonucleotide
  Target: SCN10A; (-) strand; PAM type: YTN; PAM sequence: TTA
atcatcacagctaactccat

SEQ ID NO: 51115 - DNA, 20 bp, Artificial Sequence
  Description of Artificial Sequence: Synthetic oligonucleotide
  Target: SCN10A; (-) strand; PAM type: YTN; PAM sequence: CTT
aatcatcacagctaactcca

SEQ ID NO: 51116 - DNA, 20 bp, Artificial Sequence
  Description of Artificial Sequence: Synthetic oligonucleotide
  Target: SCN10A; (-) strand; PAM type: YTN; PAM sequence: CTA
cacttaatcatcacagctaa

SEQ ID NO: 51117 - DNA, 20 bp, Artificial Sequence
  Description of Artificial Sequence: Synthetic oligonucleotide
  Target: SCN10A; (-) strand; PAM type: YTN; PAM sequence: CTC
tacacttaatcatcacagct

SEQ ID NO: 51118 - DNA, 20 bp, Artificial Sequence
  Description of Artificial Sequence: Synthetic oligonucleotide
  Target: SCN10A; (-) strand; PAM type: YTN; PAM sequence: TTG
tgtcaaatgctctacactta

SEQ ID NO: 51119 - DNA, 20 bp, Artificial Sequence
  Description of Artificial Sequence: Synthetic oligonucleotide
  Target: SCN10A; (-) strand; PAM type: YTN; PAM sequence: TTT
gtgtcaaatgctctacactt

SEQ ID NO: 51120 - DNA, 20 bp, Artificial Sequence
  Description of Artificial Sequence: Synthetic oligonucleotide
  Target: SCN10A; (-) strand; PAM type: YTN; PAM sequence: TTA
tttgtgtcaaatgctctaca

SEQ ID NO: 51121 - DNA, 20 bp, Artificial Sequence
  Description of Artificial Sequence: Synthetic oligonucleotide
  Target: SCN10A; (-) strand; PAM type: YTN; PAM sequence: CTT
atttgtgtcaaatgctctac

SEQ ID NO: 51122 - DNA, 20 bp, Artificial Sequence
  Description of Artificial Sequence: Synthetic oligonucleotide
  Target: SCN10A; (-) strand; PAM type: YTN; PAM sequence: CTA
ccccaggaaggaaccaatac

SEQ ID NO: 51123 - DNA, 20 bp, Artificial Sequence
  Description of Artificial Sequence: Synthetic oligonucleotide
  Target: SCN10A; (-) strand; PAM type: YTN; PAM sequence: TTA
ataaataatctaccccagga

SEQ ID NO: 51124 - DNA, 20 bp, Artificial Sequence
  Description of Artificial Sequence: Synthetic oligonucleotide
  Target: SCN10A; (-) strand; PAM type: YTN; PAM sequence: TTT
aataaataatctaccccagg

SEQ ID NO: 51125 - DNA, 20 bp, Artificial Sequence
  Description of Artificial Sequence: Synthetic oligonucleotide
  Target: SCN10A; (-) strand; PAM type: YTN; PAM sequence: TTT
taataaataatctaccccag

SEQ ID NO: 51126 - DNA, 20 bp, Artificial Sequence
  Description of Artificial Sequence: Synthetic oligonucleotide
  Target: SCN10A; (-) strand; PAM type: YTN; PAM sequence: TTA
tagccattttaataaataat

SEQ ID NO: 51127 - DNA, 20 bp, Artificial Sequence
  Description of Artificial Sequence: Synthetic oligonucleotide
  Target: SCN10A; (-) strand; PAM type: YTN; PAM sequence: TTG
gaaagggtgtggatacatag

SEQ ID NO: 51128 - DNA, 20 bp, Artificial Sequence
  Description of Artificial Sequence: Synthetic oligonucleotide
  Target: SCN10A; (-) strand; PAM type: YTN; PAM sequence: CTG
aaaagtcacattggaaaggg

SEQ ID NO: 51129 - DNA, 20 bp, Artificial Sequence
  Description of Artificial Sequence: Synthetic oligonucleotide
  Target: SCN10A; (-) strand; PAM type: YTN; PAM sequence: CTC
aatggaaagagctgaaaagt

SEQ ID NO: 51130 - DNA, 20 bp, Artificial Sequence
  Description of Artificial Sequence: Synthetic oligonucleotide
  Target: SCN10A; (-) strand; PAM type: YTN; PAM sequence: TTC
atcactcaatggaaagagct

SEQ ID NO: 51131 - DNA, 20 bp, Artificial Sequence
  Description of Artificial Sequence: Synthetic oligonucleotide
  Target: SCN10A; (-) strand; PAM type: YTN; PAM sequence: CTT
catcactcaatggaaagagc

SEQ ID NO: 51132 - DNA, 20 bp, Artificial Sequence
  Description of Artificial Sequence: Synthetic oligonucleotide
  Target: SCN10A; (-) strand; PAM type: YTN; PAM sequence: TTG
cagtccagtagagatccaag

SEQ ID NO: 51133 - DNA, 20 bp, Artificial Sequence
  Description of Artificial Sequence: Synthetic oligonucleotide
  Target: SCN10A; (-) strand; PAM type: YTN; PAM sequence: CTA
aagcaagttgcagtccagta

SEQ ID NO: 51134 - DNA, 20 bp, Artificial Sequence
  Description of Artificial Sequence: Synthetic oligonucleotide
  Target: SCN10A; (-) strand; PAM type: YTN; PAM sequence: TTG
actaaagcaagttgcagtcc

SEQ ID NO: 51135 - DNA, 20 bp, Artificial Sequence
  Description of Artificial Sequence: Synthetic oligonucleotide
  Target: SCN10A; (-) strand; PAM type: YTN; PAM sequence: CTT
gactaaagcaagttgcagtc

SEQ ID NO: 51136 - DNA, 20 bp, Artificial Sequence
  Description of Artificial Sequence: Synthetic oligonucleotide
  Target: SCN10A; (-) strand; PAM type: YTN; PAM sequence: TTC
ttgactaaagcaagttgcag

SEQ ID NO: 51137 - DNA, 20 bp, Artificial Sequence
  Description of Artificial Sequence: Synthetic oligonucleotide
  Target: SCN10A; (-) strand; PAM type: YTN; PAM sequence: CTG
atacattcttgactaaagca

SEQ ID NO: 51138 - DNA, 20 bp, Artificial Sequence
  Description of Artificial Sequence: Synthetic oligonucleotide
  Target: SCN10A; (-) strand; PAM type: YTN; PAM sequence: TTC
tgatacattcttgactaaag

SEQ ID NO: 51139 - DNA, 20 bp, Artificial Sequence
  Description of Artificial Sequence: Synthetic oligonucleotide
  Target: SCN10A; (-) strand; PAM type: YTN; PAM sequence: TTG
tacattctgatacattcttg

SEQ ID NO: 51140 - DNA, 20 bp, Artificial Sequence
  Description of Artificial Sequence: Synthetic oligonucleotide
  Target: SCN10A; (-) strand; PAM type: YTN; PAM sequence: TTT
gtacattctgatacattctt

SEQ ID NO: 51141 - DNA, 20 bp, Artificial Sequence
  Description of Artificial Sequence: Synthetic oligonucleotide
  Target: SCN10A; (-) strand; PAM type: YTN; PAM sequence: TTT
tgtacattctgatacattct

SEQ ID NO: 51142 - DNA, 20 bp, Artificial Sequence
  Description of Artificial Sequence: Synthetic oligonucleotide
  Target: SCN10A; (-) strand; PAM type: YTN; PAM sequence: CTT
ttgtacattctgatacattc

SEQ ID NO: 51143 - DNA, 20 bp, Artificial Sequence
  Description of Artificial Sequence: Synthetic oligonucleotide
  Target: SCN10A; (-) strand; PAM type: YTN; PAM sequence: TTA
gaaccaacacaatgtacctt

SEQ ID NO: 51144 - DNA, 20 bp, Artificial Sequence
  Description of Artificial Sequence: Synthetic oligonucleotide
  Target: SCN10A; (-) strand; PAM type: YTN; PAM sequence: CTT
agaaccaacacaatgtacct

SEQ ID NO: 51145 - DNA, 20 bp, Artificial Sequence
  Description of Artificial Sequence: Synthetic oligonucleotide
  Target: SCN10A; (-) strand; PAM type: YTN; PAM sequence: CTA
ggcttagaaccaacacaatg

SEQ ID NO: 51146 - DNA, 20 bp, Artificial Sequence
  Description of Artificial Sequence: Synthetic oligonucleotide
  Target: SCN10A; (-) strand; PAM type: YTN; PAM sequence: TTC
aggcctaggcttagaaccaa

SEQ ID NO: 51147 - DNA, 20 bp, Artificial Sequence
  Description of Artificial Sequence: Synthetic oligonucleotide
  Target: SCN10A; (-) strand; PAM type: YTN; PAM sequence: CTT
caggcctaggcttagaacca

SEQ ID NO: 51148 - DNA, 20 bp, Artificial Sequence
  Description of Artificial Sequence: Synthetic oligonucleotide
  Target: SCN10A; (-) strand; PAM type: YTN; PAM sequence: TTC
ttcaggcctaggcttagaac

SEQ ID NO: 51149 - DNA, 20 bp, Artificial Sequence
  Description of Artificial Sequence: Synthetic oligonucleotide
  Target: SCN10A; (-) strand; PAM type: YTN; PAM sequence: CTT
cttcaggcctaggcttagaa

SEQ ID NO: 51150 - DNA, 20 bp, Artificial Sequence
  Description of Artificial Sequence: Synthetic oligonucleotide
  Target: SCN10A; (-) strand; PAM type: YTN; PAM sequence: TTG
caaggcttcttcaggcctag

SEQ ID NO: 51151 - DNA, 20 bp, Artificial Sequence
  Description of Artificial Sequence: Synthetic oligonucleotide
  Target: SCN10A; (-) strand; PAM type: YTN; PAM sequence: TTT
gcaaggcttcttcaggccta

SEQ ID NO: 51152 - DNA, 20 bp, Artificial Sequence
  Description of Artificial Sequence: Synthetic oligonucleotide
  Target: SCN10A; (-) strand; PAM type: YTN; PAM sequence: TTC
ccagaaaaacagtggaagtt

SEQ ID NO: 51153 - DNA, 20 bp, Artificial Sequence
  Description of Artificial Sequence: Synthetic oligonucleotide
  Target: SCN10A; (-) strand; PAM type: YTN; PAM sequence: CTC
atggcagtgttcccagaaaa

SEQ ID NO: 51154 - DNA, 20 bp, Artificial Sequence
  Description of Artificial Sequence: Synthetic oligonucleotide
  Target: SCN10A; (-) strand; PAM type: YTN; PAM sequence: TTC
tcatggcagtgttcccagaa

SEQ ID NO: 51155 - DNA, 20 bp, Artificial Sequence
  Description of Artificial Sequence: Synthetic oligonucleotide
  Target: SCN10A; (-) strand; PAM type: YTN; PAM sequence: CTG
ttctcatggcagtgttccca

SEQ ID NO: 51156 - DNA, 20 bp, Artificial Sequence
  Description of Artificial Sequence: Synthetic oligonucleotide
  Target: SCN10A; (-) strand; PAM type: YTN; PAM sequence: CTG
ggcctgttctcatggcagtg

SEQ ID NO: 51157 - DNA, 20 bp, Artificial Sequence
  Description of Artificial Sequence: Synthetic oligonucleotide
  Target: SCN10A; (-) strand; PAM type: YTN; PAM sequence: TTA
gcctgggcctgttctcatgg

SEQ ID NO: 51158 - DNA, 20 bp, Artificial Sequence
  Description of Artificial Sequence: Synthetic oligonucleotide
  Target: SCN10A; (-) strand; PAM type: YTN; PAM sequence: CTC
acccccaaacaggttagcct

SEQ ID NO: 51159 - DNA, 20 bp, Artificial Sequence
  Description of Artificial Sequence: Synthetic oligonucleotide
  Target: SCN10A; (-) strand; PAM type: YTN; PAM sequence: CTC
tcacccccaaacaggttagc

SEQ ID NO: 51160 - DNA, 20 bp, Artificial Sequence
  Description of Artificial Sequence: Synthetic oligonucleotide
  Target: SCN10A; (-) strand; PAM type: YTN; PAM sequence: CTC
atgtggcctctcacccccaa

SEQ ID NO: 51161 - DNA, 20 bp, Artificial Sequence
  Description of Artificial Sequence: Synthetic oligonucleotide
  Target: SCN10A; (-) strand; PAM type: YTN; PAM sequence: CTG
ctcatgtggcctctcacccc

SEQ ID NO: 51162 - DNA, 20 bp, Artificial Sequence
  Description of Artificial Sequence: Synthetic oligonucleotide
  Target: SCN10A; (-) strand; PAM type: YTN; PAM sequence: CTC
tgctcatgtggcctctcacc

SEQ ID NO: 51163 - DNA, 20 bp, Artificial Sequence
  Description of Artificial Sequence: Synthetic oligonucleotide
  Target: SCN10A; (-) strand; PAM type: YTN; PAM sequence: CTG
tctctgctcatgtggcctct

SEQ ID NO: 51164 - DNA, 20 bp, Artificial Sequence
  Description of Artificial Sequence: Synthetic oligonucleotide
  Target: SCN10A; (-) strand; PAM type: YTN; PAM sequence: CTA
ggacgtcctgtctctgctca

SEQ ID NO: 51165 - DNA, 20 bp, Artificial Sequence
  Description of Artificial Sequence: Synthetic oligonucleotide
  Target: SCN10A; (-) strand; PAM type: YTN; PAM sequence: CTG
gtctaggacgtcctgtctct

SEQ ID NO: 51166 - DNA, 20 bp, Artificial Sequence
  Description of Artificial Sequence: Synthetic oligonucleotide
  Target: SCN10A; (-) strand; PAM type: YTN; PAM sequence: TTG
gagatggctggtctaggacg

SEQ ID NO: 51167 - DNA, 20 bp, Artificial Sequence
  Description of Artificial Sequence: Synthetic oligonucleotide
  Target: SCN10A; (-) strand; PAM type: YTN; PAM sequence: CTT
ggagatggctggtctaggac

SEQ ID NO: 51168 - DNA, 20 bp, Artificial Sequence
  Description of Artificial Sequence: Synthetic oligonucleotide
  Target: SCN10A; (-) strand; PAM type: YTN; PAM sequence: TTA
acttggagatggctggtcta

SEQ ID NO: 51169 - DNA, 20 bp, Artificial Sequence
  Description of Artificial Sequence: Synthetic oligonucleotide
  Target: SCN10A; (-) strand; PAM type: YTN; PAM sequence: TTC
atgcatatgcagacagcata

SEQ ID NO: 51170 - DNA, 20 bp, Artificial Sequence
  Description of Artificial Sequence: Synthetic oligonucleotide
  Target: SCN10A; (-) strand; PAM type: YTN; PAM sequence: CTC
attcatgcatatgcagacag

SEQ ID NO: 51171 - DNA, 20 bp, Artificial Sequence
  Description of Artificial Sequence: Synthetic oligonucleotide
  Target: SCN10A; (-) strand; PAM type: YTN; PAM sequence: CTA
ggctcattcatgcatatgca

SEQ ID NO: 51172 - DNA, 20 bp, Artificial Sequence
  Description of Artificial Sequence: Synthetic oligonucleotide
  Target: SCN10A; (-) strand; PAM type: YTN; PAM sequence: TTG
actaggctcattcatgcata

SEQ ID NO: 51173 - DNA, 20 bp, Artificial Sequence
  Description of Artificial Sequence: Synthetic oligonucleotide
  Target: SCN10A; (-) strand; PAM type: YTN; PAM sequence: TTG
ggtgacattgactaggctca

SEQ ID NO: 51174 - DNA, 20 bp, Artificial Sequence
  Description of Artificial Sequence: Synthetic oligonucleotide
  Target: SCN10A; (-) strand; PAM type: YTN; PAM sequence: CTG
ggatcagatgggcattgggt

SEQ ID NO: 51175 - DNA, 20 bp, Artificial Sequence
  Description of Artificial Sequence: Synthetic oligonucleotide
  Target: SCN10A; (-) strand; PAM type: YTN; PAM sequence: TTG
gactgggatcagatgggcat

SEQ ID NO: 51176 - DNA, 20 bp, Artificial Sequence
  Description of Artificial Sequence: Synthetic oligonucleotide
  Target: SCN10A; (-) strand; PAM type: YTN; PAM sequence: TTT
ggactgggatcagatgggca

SEQ ID NO: 51177 - DNA, 20 bp, Artificial Sequence
  Description of Artificial Sequence: Synthetic oligonucleotide
  Target: SCN10A; (-) strand; PAM type: YTN; PAM sequence: TTT
tggactgggatcagatgggc

SEQ ID NO: 51178 - DNA, 20 bp, Artificial Sequence
  Description of Artificial Sequence: Synthetic oligonucleotide
  Target: SCN10A; (-) strand; PAM type: YTN; PAM sequence: CTG
tgcatcagcattttggactg

SEQ ID NO: 51179 - DNA, 20 bp, Artificial Sequence
  Description of Artificial Sequence: Synthetic oligonucleotide
  Target: SCN10A; (-) strand; PAM type: YTN; PAM sequence: TTC
tgtgcatcagcattttggac

SEQ ID NO: 51180 - DNA, 20 bp, Artificial Sequence
  Description of Artificial Sequence: Synthetic oligonucleotide
  Target: SCN10A; (-) strand; PAM type: YTN; PAM sequence: TTC
atgattctgtgcatcagcat

SEQ ID NO: 51181 - DNA, 20 bp, Artificial Sequence
  Description of Artificial Sequence: Synthetic oligonucleotide
  Target: SCN10A; (-) strand; PAM type: YTN; PAM sequence: TTA
attcatgattctgtgcatca

SEQ ID NO: 51182 - DNA, 20 bp, Artificial Sequence
  Description of Artificial Sequence: Synthetic oligonucleotide
  Target: SCN10A; (-) strand; PAM type: YTN; PAM sequence: TTT
aattcatgattctgtgcatc

SEQ ID NO: 51183 - DNA, 20 bp, Artificial Sequence
  Description of Artificial Sequence: Synthetic oligonucleotide
  Target: SCN10A; (-) strand; PAM type: YTN; PAM sequence: TTA
aaacaacaatgtatttaatt

SEQ ID NO: 51184 - DNA, 20 bp, Artificial Sequence
  Description of Artificial Sequence: Synthetic oligonucleotide
  Target: SCN10A; (-) strand; PAM type: YTN; PAM sequence: TTG
tgaattaaaacaacaatgta

SEQ ID NO: 51185 - DNA, 20 bp, Artificial Sequence
  Description of Artificial Sequence: Synthetic oligonucleotide
  Target: SCN10A; (-) strand; PAM type: YTN; PAM sequence: TTT
gtgaattaaaacaacaatgt

SEQ ID NO: 51186 - DNA, 20 bp, Artificial Sequence
  Description of Artificial Sequence: Synthetic oligonucleotide
  Target: SCN10A; (-) strand; PAM type: YTN; PAM sequence: TTT
tgtgaattaaaacaacaatg

SEQ ID NO: 51187 - DNA, 20 bp, Artificial Sequence
  Description of Artificial Sequence: Synthetic oligonucleotide
  Target: SCN10A; (-) strand; PAM type: YTN; PAM sequence: CTG
tgtaacaaatgaccccaaaa

SEQ ID NO: 51188 - DNA, 20 bp, Artificial Sequence
  Description of Artificial Sequence: Synthetic oligonucleotide
  Target: SCN10A; (-) strand; PAM type: YTN; PAM sequence: TTC
gctgtgtaacaaatgacccc

SEQ ID NO: 51189 - DNA, 20 bp, Artificial Sequence
  Description of Artificial Sequence: Synthetic oligonucleotide
  Target: SCN10A; (-) strand; PAM type: YTN; PAM sequence: TTT
cgctgtgtaacaaatgaccc

SEQ ID NO: 51190 - DNA, 20 bp, Artificial Sequence
  Description of Artificial Sequence: Synthetic oligonucleotide
  Target: SCN10A; (-) strand; PAM type: YTN; PAM sequence: CTT
tcgctgtgtaacaaatgacc

SEQ ID NO: 51191 - DNA, 20 bp, Artificial Sequence
  Description of Artificial Sequence: Synthetic oligonucleotide
  Target: SCN10A; (-) strand; PAM type: YTN; PAM sequence: TTA
gctttcgctgtgtaacaaat

SEQ ID NO: 51192 - DNA, 20 bp, Artificial Sequence
  Description of Artificial Sequence: Synthetic oligonucleotide
  Target: SCN10A; (-) strand; PAM type: YTN; PAM sequence: CTC
atggggagggaatgtatgag

SEQ ID NO: 51193 - DNA, 20 bp, Artificial Sequence
  Description of Artificial Sequence: Synthetic oligonucleotide
  Target: SCN10A; (-) strand; PAM type: YTN; PAM sequence: TTG
ccaacccagagctcatgggg

SEQ ID NO: 51194 - DNA, 20 bp, Artificial Sequence
  Description of Artificial Sequence: Synthetic oligonucleotide
  Target: SCN10A; (-) strand; PAM type: YTN; PAM sequence: TTT
gccaacccagagctcatggg

SEQ ID NO: 51195 - DNA, 20 bp, Artificial Sequence
  Description of Artificial Sequence: Synthetic oligonucleotide
  Target: SCN10A; (-) strand; PAM type: YTN; PAM sequence: CTT
tgccaacccagagctcatgg

SEQ ID NO: 51196 - DNA, 20 bp, Artificial Sequence
  Description of Artificial Sequence: Synthetic oligonucleotide
  Target: SCN10A; (-) strand; PAM type: YTN; PAM sequence: CTG
ggaaagatgtataaataaat

SEQ ID NO: 51197 - DNA, 20 bp, Artificial Sequence
  Description of Artificial Sequence: Synthetic oligonucleotide
  Target: SCN10A; (-) strand; PAM type: YTN; PAM sequence: TTG
caggtcctgggaaagatgta

SEQ ID NO: 51198 - DNA, 20 bp, Artificial Sequence
  Description of Artificial Sequence: Synthetic oligonucleotide
  Target: SCN10A; (-) strand; PAM type: YTN; PAM sequence: TTA
tgggcacagatggggttgca

SEQ ID NO: 51199 - DNA, 20 bp, Artificial Sequence
  Description of Artificial Sequence: Synthetic oligonucleotide
  Target: SCN10A; (-) strand; PAM type: YTN; PAM sequence: TTG
gcatattatgggcacagatg

SEQ ID NO: 51200 - DNA, 20 bp, Artificial Sequence
  Description of Artificial Sequence: Synthetic oligonucleotide
  Target: SCN10A; (-) strand; PAM type: YTN; PAM sequence: CTT
ggcatattatgggcacagat

SEQ ID NO: 51201 - DNA, 20 bp, Artificial Sequence
  Description of Artificial Sequence: Synthetic oligonucleotide
  Target: SCN10A; (-) strand; PAM type: YTN; PAM sequence: TTG
tccttggcatattatgggca

SEQ ID NO: 51202 - DNA, 20 bp, Artificial Sequence
  Description of Artificial Sequence: Synthetic oligonucleotide
  Target: SCN10A; (-) strand; PAM type: YTN; PAM sequence: CTT
gtccttggcatattatgggc

SEQ ID NO: 51203 - DNA, 20 bp, Artificial Sequence
  Description of Artificial Sequence: Synthetic oligonucleotide
  Target: SCN10A; (-) strand; PAM type: YTN; PAM sequence: CTC
catcttgtccttggcatatt

SEQ ID NO: 51204 - DNA, 20 bp, Artificial Sequence
  Description of Artificial Sequence: Synthetic oligonucleotide
  Target: SCN10A; (-) strand; PAM type: YTN; PAM sequence: TTC
tccatcttgtccttggcata

SEQ ID NO: 51205 - DNA, 20 bp, Artificial Sequence
  Description of Artificial Sequence: Synthetic oligonucleotide
  Target: SCN10A; (-) strand; PAM type: YTN; PAM sequence: CTT
ctccatcttgtccttggcat

SEQ ID NO: 51206 - DNA, 20 bp, Artificial Sequence
  Description of Artificial Sequence: Synthetic oligonucleotide
  Target: SCN10A; (-) strand; PAM type: YTN; PAM sequence: TTC
cttctccatcttgtccttgg

SEQ ID NO: 51207 - DNA, 20 bp, Artificial Sequence
  Description of Artificial Sequence: Synthetic oligonucleotide
  Target: SCN10A; (-) strand; PAM type: YTN; PAM sequence: TTA
tgacaaagcacgagtgccca

SEQ ID NO: 51208 - DNA, 20 bp, Artificial Sequence
  Description of Artificial Sequence: Synthetic oligonucleotide
  Target: SCN10A; (-) strand; PAM type: YTN; PAM sequence: CTT
atgacaaagcacgagtgccc

SEQ ID NO: 51209 - DNA, 20 bp, Artificial Sequence
  Description of Artificial Sequence: Synthetic oligonucleotide
  Target: SCN10A; (-) strand; PAM type: YTN; PAM sequence: TTC
ccaacttatgacaaagcacg

SEQ ID NO: 51210 - DNA, 20 bp, Artificial Sequence
  Description of Artificial Sequence: Synthetic oligonucleotide
  Target: SCN10A; (-) strand; PAM type: YTN; PAM sequence: CTC
agggtgagttcccaacttat

SEQ ID NO: 51211 - DNA, 20 bp, Artificial Sequence
  Description of Artificial Sequence: Synthetic oligonucleotide
  Target: SCN10A; (-) strand; PAM type: YTN; PAM sequence: CTG
actcagggtgagttcccaac

SEQ ID NO: 51212 - DNA, 20 bp, Artificial Sequence
  Description of Artificial Sequence: Synthetic oligonucleotide
  Target: SCN10A; (-) strand; PAM type: YTN; PAM sequence: CTG
tgtggcaatggatctgactc

SEQ ID NO: 51213 - DNA, 20 bp, Artificial Sequence
  Description of Artificial Sequence: Synthetic oligonucleotide
  Target: SCN10A; (-) strand; PAM type: YTN; PAM sequence: TTA
ctgtgtggcaatggatctga

SEQ ID NO: 51214 - DNA, 20 bp, Artificial Sequence
  Description of Artificial Sequence: Synthetic oligonucleotide
  Target: SCN10A; (-) strand; PAM type: YTN; PAM sequence: CTT
actgtgtggcaatggatctg

SEQ ID NO: 51215 - DNA, 20 bp, Artificial Sequence
  Description of Artificial Sequence: Synthetic oligonucleotide
  Target: SCN10A; (-) strand; PAM type: YTN; PAM sequence: CTG
accccttactgtgtggcaat

SEQ ID NO: 51216 - DNA, 20 bp, Artificial Sequence
  Description of Artificial Sequence: Synthetic oligonucleotide
  Target: SCN10A; (-) strand; PAM type: YTN; PAM sequence: TTC
tgaccccttactgtgtggca

SEQ ID NO: 51217 - DNA, 20 bp, Artificial Sequence
  Description of Artificial Sequence: Synthetic oligonucleotide
  Target: SCN10A; (-) strand; PAM type: YTN; PAM sequence: CTT
ctgaccccttactgtgtggc

SEQ ID NO: 51218 - DNA, 20 bp, Artificial Sequence
  Description of Artificial Sequence: Synthetic oligonucleotide
  Target: SCN10A; (-) strand; PAM type: YTN; PAM sequence: CTA
cataaataagcgaggcactt

SEQ ID NO: 51219 - DNA, 20 bp, Artificial Sequence
  Description of Artificial Sequence: Synthetic oligonucleotide
  Target: SCN10A; (-) strand; PAM type: YTN; PAM sequence: TTC
agcagatatctacataaata

SEQ ID NO: 51220 - DNA, 20 bp, Artificial Sequence
  Description of Artificial Sequence: Synthetic oligonucleotide
  Target: SCN10A; (-) strand; PAM type: YTN; PAM sequence: CTT
cagcagatatctacataaat

SEQ ID NO: 51221 - DNA, 20 bp, Artificial Sequence
  Description of Artificial Sequence: Synthetic oligonucleotide
  Target: SCN10A; (-) strand; PAM type: YTN; PAM sequence: TTC
ttcagcagatatctacataa

SEQ ID NO: 51222 - DNA, 20 bp, Artificial Sequence
  Description of Artificial Sequence: Synthetic oligonucleotide
  Target: SCN10A; (-) strand; PAM type: YTN; PAM sequence: TTT
cttcagcagatatctacata

SEQ ID NO: 51223 - DNA, 20 bp, Artificial Sequence
  Description of Artificial Sequence: Synthetic oligonucleotide
  Target: SCN10A; (-) strand; PAM type: YTN; PAM sequence: CTT
tcttcagcagatatctacat

SEQ ID NO: 51224 - DNA, 20 bp, Artificial Sequence
  Description of Artificial Sequence: Synthetic oligonucleotide
  Target: SCN10A; (-) strand; PAM type: YTN; PAM sequence: TTC
ctttcttcagcagatatcta

SEQ ID NO: 51225 - DNA, 20 bp, Artificial Sequence
  Description of Artificial Sequence: Synthetic oligonucleotide
  Target: SCN10A; (-) strand; PAM type: YTN; PAM sequence: CTT
cctttcttcagcagatatct

SEQ ID NO: 51226 - DNA, 20 bp, Artificial Sequence
  Description of Artificial Sequence: Synthetic oligonucleotide
  Target: SCN10A; (-) strand; PAM type: YTN; PAM sequence: TTC
ttcctttcttcagcagatat

SEQ ID NO: 51227 - DNA, 20 bp, Artificial Sequence
  Description of Artificial Sequence: Synthetic oligonucleotide
  Target: SCN10A; (-) strand; PAM type: YTN; PAM sequence: TTT
cttcctttcttcagcagata

SEQ ID NO: 51228 - DNA, 20 bp, Artificial Sequence
  Description of Artificial Sequence: Synthetic oligonucleotide
  Target: SCN10A; (-) strand; PAM type: YTN; PAM sequence: TTT
tcttcctttcttcagcagat

SEQ ID NO: 51229 - DNA, 20 bp, Artificial Sequence
  Description of Artificial Sequence: Synthetic oligonucleotide
  Target: SCN10A; (-) strand; PAM type: YTN; PAM sequence: CTT
ttcttcctttcttcagcaga

SEQ ID NO: 51230 - DNA, 20 bp, Artificial Sequence
  Description of Artificial Sequence: Synthetic oligonucleotide
  Target: SCN10A; (-) strand; PAM type: YTN; PAM sequence: TTC
ttttcttcctttcttcagca

SEQ ID NO: 51231 - DNA, 20 bp, Artificial Sequence
  Description of Artificial Sequence: Synthetic oligonucleotide
  Target: SCN10A; (-) strand; PAM type: YTN; PAM sequence: TTT
cttttcttcctttcttcagc

SEQ ID NO: 51232 - DNA, 20 bp, Artificial Sequence
  Description of Artificial Sequence: Synthetic oligonucleotide
  Target: SCN10A; (-) strand; PAM type: YTN; PAM sequence: CTT
tcttttcttcctttcttcag

SEQ ID NO: 51233 - DNA, 20 bp, Artificial Sequence
  Description of Artificial Sequence: Synthetic oligonucleotide
  Target: SCN10A; (-) strand; PAM type: YTN; PAM sequence: CTG
tgaggctttcttttcttcct

SEQ ID NO: 51234 - DNA, 20 bp, Artificial Sequence
  Description of Artificial Sequence: Synthetic oligonucleotide
  Target: SCN10A; (-) strand; PAM type: YTN; PAM sequence: TTC
agaaccatctgtgaggcttt

SEQ ID NO: 51235 - DNA, 20 bp, Artificial Sequence
  Description of Artificial Sequence: Synthetic oligonucleotide
  Target: SCN10A; (-) strand; PAM type: YTN; PAM sequence: TTG
gagggttcagaaccatctgt

SEQ ID NO: 51236 - DNA, 20 bp, Artificial Sequence
  Description of Artificial Sequence: Synthetic oligonucleotide
  Target: SCN10A; (-) strand; PAM type: YTN; PAM sequence: TTG
ggttggagggttcagaacca

SEQ ID NO: 51237 - DNA, 20 bp, Artificial Sequence
  Description of Artificial Sequence: Synthetic oligonucleotide
  Target: SCN10A; (-) strand; PAM type: YTN; PAM sequence: CTT
gggttggagggttcagaacc

SEQ ID NO: 51238 - DNA, 20 bp, Artificial Sequence
  Description of Artificial Sequence: Synthetic oligonucleotide
  Target: SCN10A; (-) strand; PAM type: YTN; PAM sequence: TTC
accacacaaggcttgggttg

SEQ ID NO: 51239 - DNA, 20 bp, Artificial Sequence
  Description of Artificial Sequence: Synthetic oligonucleotide
  Target: SCN10A; (-) strand; PAM type: YTN; PAM sequence: TTG
cattcaccacacaaggcttg

SEQ ID NO: 51240 - DNA, 20 bp, Artificial Sequence
  Description of Artificial Sequence: Synthetic oligonucleotide
  Target: SCN10A; (-) strand; PAM type: YTN; PAM sequence: TTG
ggaatattgcattcaccaca

SEQ ID NO: 51241 - DNA, 20 bp, Artificial Sequence
  Description of Artificial Sequence: Synthetic oligonucleotide
  Target: SCN10A; (-) strand; PAM type: YTN; PAM sequence: CTT
gggaatattgcattcaccac

SEQ ID NO: 51242 - DNA, 20 bp, Artificial Sequence
  Description of Artificial Sequence: Synthetic oligonucleotide
  Target: SCN10A; (-) strand; PAM type: YTN; PAM sequence: TTG
gaagacttgggaatattgca

SEQ ID NO: 51243 - DNA, 20 bp, Artificial Sequence
  Description of Artificial Sequence: Synthetic oligonucleotide
  Target: SCN10A; (-) strand; PAM type: YTN; PAM sequence: TTT
ggaagacttgggaatattgc

SEQ ID NO: 51244 - DNA, 20 bp, Artificial Sequence
  Description of Artificial Sequence: Synthetic oligonucleotide
  Target: SCN10A; (-) strand; PAM type: YTN; PAM sequence: CTT
tggaagacttgggaatattg

SEQ ID NO: 51245 - DNA, 20 bp, Artificial Sequence
  Description of Artificial Sequence: Synthetic oligonucleotide
  Target: SCN10A; (-) strand; PAM type: YTN; PAM sequence: CTC
actttggaagacttgggaat

SEQ ID NO: 51246 - DNA, 20 bp, Artificial Sequence
  Description of Artificial Sequence: Synthetic oligonucleotide
  Target: SCN10A; (-) strand; PAM type: YTN; PAM sequence: CTG
agtacatgtagccaaaggag

SEQ ID NO: 51247 - DNA, 20 bp, Artificial Sequence
  Description of Artificial Sequence: Synthetic oligonucleotide
  Target: SCN10A; (-) strand; PAM type: YTN; PAM sequence: TTC
catgtggcccagcatgccca

SEQ ID NO: 51248 - DNA, 20 bp, Artificial Sequence
  Description of Artificial Sequence: Synthetic oligonucleotide
  Target: SCN10A; (-) strand; PAM type: YTN; PAM sequence: CTT
ccatgtggcccagcatgccc

SEQ ID NO: 51249 - DNA, 20 bp, Artificial Sequence
  Description of Artificial Sequence: Synthetic oligonucleotide
  Target: SCN10A; (-) strand; PAM type: YTN; PAM sequence: TTA
caacttccatgtggcccagc

SEQ ID NO: 51250 - DNA, 20 bp, Artificial Sequence
  Description of Artificial Sequence: Synthetic oligonucleotide
  Target: SCN10A; (-) strand; PAM type: YTN; PAM sequence: TTT
acaacttccatgtggcccag

SEQ ID NO: 51251 - DNA, 20 bp, Artificial Sequence
  Description of Artificial Sequence: Synthetic oligonucleotide
  Target: SCN10A; (-) strand; PAM type: YTN; PAM sequence: CTT
tacaacttccatgtggccca

SEQ ID NO: 51252 - DNA, 20 bp, Artificial Sequence
  Description of Artificial Sequence: Synthetic oligonucleotide
  Target: SCN10A; (-) strand; PAM type: YTN; PAM sequence: TTC
agatgtgactttacaacttc

SEQ ID NO: 51253 - DNA, 20 bp, Artificial Sequence
  Description of Artificial Sequence: Synthetic oligonucleotide
  Target: SCN10A; (-) strand; PAM type: YTN; PAM sequence: TTT
cagatgtgactttacaactt

SEQ ID NO: 51254 - DNA, 20 bp, Artificial Sequence
  Description of Artificial Sequence: Synthetic oligonucleotide
  Target: SCN10A; (-) strand; PAM type: YTN; PAM sequence: TTT
tcagatgtgactttacaact

SEQ ID NO: 51255 - DNA, 20 bp, Artificial Sequence
  Description of Artificial Sequence: Synthetic oligonucleotide
  Target: SCN10A; (-) strand; PAM type: YTN; PAM sequence: CTT
ttcagatgtgactttacaac

SEQ ID NO: 51256 - DNA, 20 bp, Artificial Sequence
  Description of Artificial Sequence: Synthetic oligonucleotide
  Target: SCN10A; (-) strand; PAM type: YTN; PAM sequence: CTC
ttttcagatgtgactttaca

SEQ ID NO: 51257 - DNA, 20 bp, Artificial Sequence
  Description of Artificial Sequence: Synthetic oligonucleotide
  Target: SCN10A; (-) strand; PAM type: YTN; PAM sequence: TTC
tcttttcagatgtgacttta

SEQ ID NO: 51258 - DNA, 20 bp, Artificial Sequence
  Description of Artificial Sequence: Synthetic oligonucleotide
  Target: SCN10A; (-) strand; PAM type: YTN; PAM sequence: CTT
ctcttttcagatgtgacttt

SEQ ID NO: 51259 - DNA, 20 bp, Artificial Sequence
  Description of Artificial Sequence: Synthetic oligonucleotide
  Target: SCN10A; (-) strand; PAM type: YTN; PAM sequence: CTC
ttctcttttcagatgtgact

SEQ ID NO: 51260 - DNA, 20 bp, Artificial Sequence
  Description of Artificial Sequence: Synthetic oligonucleotide
  Target: SCN10A; (-) strand; PAM type: YTN; PAM sequence: TTA
gctcttctcttttcagatgt

SEQ ID NO: 51261 - DNA, 20 bp, Artificial Sequence
  Description of Artificial Sequence: Synthetic oligonucleotide
  Target: SCN10A; (-) strand; PAM type: YTN; PAM sequence: CTT
agctcttctcttttcagatg

SEQ ID NO: 51262 - DNA, 20 bp, Artificial Sequence
  Description of Artificial Sequence: Synthetic oligonucleotide
  Target: SCN10A; (-) strand; PAM type: YTN; PAM sequence: CTG
cttagctcttctcttttcag

SEQ ID NO: 51263 - DNA, 20 bp, Artificial Sequence
  Description of Artificial Sequence: Synthetic oligonucleotide
  Target: SCN10A; (-) strand; PAM type: YTN; PAM sequence: TTG
agagccgaagtcactgctta

SEQ ID NO: 51264 - DNA, 20 bp, Artificial Sequence
  Description of Artificial Sequence: Synthetic oligonucleotide
  Target: SCN10A; (-) strand; PAM type: YTN; PAM sequence: CTG
ggggagattgagagccgaag

SEQ ID NO: 51265 - DNA, 20 bp, Artificial Sequence
  Description of Artificial Sequence: Synthetic oligonucleotide
  Target: SCN10A; (-) strand; PAM type: YTN; PAM sequence: CTG
ctgggggagattgagagccg

SEQ ID NO: 51266 - DNA, 20 bp, Artificial Sequence
  Description of Artificial Sequence: Synthetic oligonucleotide
  Target: SCN10A; (-) strand; PAM type: YTN; PAM sequence: CTC
tgctgggggagattgagagc

SEQ ID NO: 51267 - DNA, 20 bp, Artificial Sequence
  Description of Artificial Sequence: Synthetic oligonucleotide
  Target: SCN10A; (-) strand; PAM type: YTN; PAM sequence: CTA
cctctgctgggggagattga

SEQ ID NO: 51268 - DNA, 20 bp, Artificial Sequence
  Description of Artificial Sequence: Synthetic oligonucleotide
  Target: SCN10A; (-) strand; PAM type: YTN; PAM sequence: TTC
tacctctgctgggggagatt

SEQ ID NO: 51269 - DNA, 20 bp, Artificial Sequence
  Description of Artificial Sequence: Synthetic oligonucleotide
  Target: SCN10A; (-) strand; PAM type: YTN; PAM sequence: CTA
gaggcaagtcattctacctc

SEQ ID NO: 51270 - DNA, 20 bp, Artificial Sequence
  Description of Artificial Sequence: Synthetic oligonucleotide
  Target: SCN10A; (-) strand; PAM type: YTN; PAM sequence: TTG
caaggaaatgagccataaat

SEQ ID NO: 51271 - DNA, 20 bp, Artificial Sequence
  Description of Artificial Sequence: Synthetic oligonucleotide
  Target: SCN10A; (-) strand; PAM type: YTN; PAM sequence: CTT
gcaaggaaatgagccataaa

SEQ ID NO: 51272 - DNA, 20 bp, Artificial Sequence
  Description of Artificial Sequence: Synthetic oligonucleotide
  Target: SCN10A; (-) strand; PAM type: YTN; PAM sequence: CTC
ttgcaaggaaatgagccata

SEQ ID NO: 51273 - DNA, 20 bp, Artificial Sequence
  Description of Artificial Sequence: Synthetic oligonucleotide
  Target: SCN10A; (-) strand; PAM type: YTN; PAM sequence: CTC
agcatccctcttgcaaggaa

SEQ ID NO: 51274 - DNA, 20 bp, Artificial Sequence
  Description of Artificial Sequence: Synthetic oligonucleotide
  Target: SCN10A; (-) strand; PAM type: YTN; PAM sequence: TTG
ctcagcatccctcttgcaag

SEQ ID NO: 51275 - DNA, 20 bp, Artificial Sequence
  Description of Artificial Sequence: Synthetic oligonucleotide
  Target: SCN10A; (-) strand; PAM type: YTN; PAM sequence: CTG
ttgctcagcatccctcttgc

SEQ ID NO: 51276 - DNA, 20 bp, Artificial Sequence
  Description of Artificial Sequence: Synthetic oligonucleotide
  Target: SCN10A; (-) strand; PAM type: YTN; PAM sequence: TTC
ctgttgctcagcatccctct

SEQ ID NO: 51277 - DNA, 20 bp, Artificial Sequence
  Description of Artificial Sequence: Synthetic oligonucleotide
  Target: SCN10A; (-) strand; PAM type: YTN; PAM sequence: TTT
cctgttgctcagcatccctc

SEQ ID NO: 51278 - DNA, 20 bp, Artificial Sequence
  Description of Artificial Sequence: Synthetic oligonucleotide
  Target: SCN10A; (-) strand; PAM type: YTN; PAM sequence: CTA
tttcctgttgctcagcatcc

SEQ ID NO: 51279 - DNA, 20 bp, Artificial Sequence
  Description of Artificial Sequence: Synthetic oligonucleotide
  Target: SCN10A; (-) strand; PAM type: YTN; PAM sequence: TTC
tatttcctgttgctcagcat

SEQ ID NO: 51280 - DNA, 20 bp, Artificial Sequence
  Description of Artificial Sequence: Synthetic oligonucleotide
  Target: SCN10A; (-) strand; PAM type: YTN; PAM sequence: TTG
ggtattctatttcctgttgc

SEQ ID NO: 51281 - DNA, 20 bp, Artificial Sequence
  Description of Artificial Sequence: Synthetic oligonucleotide
  Target: SCN10A; (-) strand; PAM type: YTN; PAM sequence: TTT
gggtattctatttcctgttg

SEQ ID NO: 51282 - DNA, 20 bp, Artificial Sequence
  Description of Artificial Sequence: Synthetic oligonucleotide
  Target: SCN10A; (-) strand; PAM type: YTN; PAM sequence: TTT
tgggtattctatttcctgtt

SEQ ID NO: 51283 - DNA, 20 bp, Artificial Sequence
  Description of Artificial Sequence: Synthetic oligonucleotide
  Target: SCN10A; (-) strand; PAM type: YTN; PAM sequence: CTT
ttgggtattctatttcctgt

SEQ ID NO: 51284 - DNA, 20 bp, Artificial Sequence
  Description of Artificial Sequence: Synthetic oligonucleotide
  Target: SCN10A; (-) strand; PAM type: YTN; PAM sequence: TTA
cttttgggtattctatttcc

SEQ ID NO: 51285 - DNA, 20 bp, Artificial Sequence
  Description of Artificial Sequence: Synthetic oligonucleotide
  Target: SCN10A; (-) strand; PAM type: YTN; PAM sequence: TTT
acttttgggtattctatttc

SEQ ID NO: 51286 - DNA, 20 bp, Artificial Sequence
  Description of Artificial Sequence: Synthetic oligonucleotide
  Target: SCN10A; (-) strand; PAM type: YTN; PAM sequence: TTT
tacttttgggtattctattt

SEQ ID NO: 51287 - DNA, 20 bp, Artificial Sequence
  Description of Artificial Sequence: Synthetic oligonucleotide
  Target: SCN10A; (-) strand; PAM type: YTN; PAM sequence: TTG
tgttttacttttgggtattc

SEQ ID NO: 51288 - DNA, 20 bp, Artificial Sequence
  Description of Artificial Sequence: Synthetic oligonucleotide
  Target: SCN10A; (-) strand; PAM type: YTN; PAM sequence: TTG
agttgtgttttacttttggg

SEQ ID NO: 51289 - DNA, 20 bp, Artificial Sequence
  Description of Artificial Sequence: Synthetic oligonucleotide
  Target: SCN10A; (-) strand; PAM type: YTN; PAM sequence: CTT
gagttgtgttttacttttgg

SEQ ID NO: 51290 - DNA, 20 bp, Artificial Sequence
  Description of Artificial Sequence: Synthetic oligonucleotide
  Target: SCN10A; (-) strand; PAM type: YTN; PAM sequence: CTC
ttgagttgtgttttactttt

SEQ ID NO: 51291 - DNA, 20 bp, Artificial Sequence
  Description of Artificial Sequence: Synthetic oligonucleotide
  Target: SCN10A; (-) strand; PAM type: YTN; PAM sequence: TTC
tcttgagttgtgttttactt

SEQ ID NO: 51292 - DNA, 20 bp, Artificial Sequence
  Description of Artificial Sequence: Synthetic oligonucleotide
  Target: SCN10A; (-) strand; PAM type: YTN; PAM sequence: CTG
ccaaaatggttctcttgagt

SEQ ID NO: 51293 - DNA, 20 bp, Artificial Sequence
  Description of Artificial Sequence: Synthetic oligonucleotide
  Target: SCN10A; (-) strand; PAM type: YTN; PAM sequence: TTC
ctgccaaaatggttctcttg

SEQ ID NO: 51294 - DNA, 20 bp, Artificial Sequence
  Description of Artificial Sequence: Synthetic oligonucleotide
  Target: SCN10A; (-) strand; PAM type: YTN; PAM sequence: TTT
cctgccaaaatggttctctt

SEQ ID NO: 51295 - DNA, 20 bp, Artificial Sequence
  Description of Artificial Sequence: Synthetic oligonucleotide
  Target: SCN10A; (-) strand; PAM type: YTN; PAM sequence: CTT
tcctgccaaaatggttctct

SEQ ID NO: 51296 - DNA, 20 bp, Artificial Sequence
  Description of Artificial Sequence: Synthetic oligonucleotide
  Target: SCN10A; (-) strand; PAM type: YTN; PAM sequence: CTC
ccctttcctgccaaaatggt

SEQ ID NO: 51297 - DNA, 20 bp, Artificial Sequence
  Description of Artificial Sequence: Synthetic oligonucleotide
  Target: SCN10A; (-) strand; PAM type: YTN; PAM sequence: TTG
actcccctttcctgccaaaa

SEQ ID NO: 51298 - DNA, 20 bp, Artificial Sequence
  Description of Artificial Sequence: Synthetic oligonucleotide
  Target: SCN10A; (-) strand; PAM type: YTN; PAM sequence: TTT
gactcccctttcctgccaaa

SEQ ID NO: 51299 - DNA, 20 bp, Artificial Sequence
  Description of Artificial Sequence: Synthetic oligonucleotide
  Target: SCN10A; (-) strand; PAM type: YTN; PAM sequence: TTT
tgactcccctttcctgccaa

SEQ ID NO: 51300 - DNA, 20 bp, Artificial Sequence
  Description of Artificial Sequence: Synthetic oligonucleotide
  Target: SCN10A; (-) strand; PAM type: YTN; PAM sequence: CTG
tgtgtgtgtatagacatata

SEQ ID NO: 51301 - DNA, 20 bp, Artificial Sequence
  Description of Artificial Sequence: Synthetic oligonucleotide
  Target: SCN10A; (-) strand; PAM type: YTN; PAM sequence: TTG
gtatcatatagggacagggg

SEQ ID NO: 51302 - DNA, 20 bp, Artificial Sequence
  Description of Artificial Sequence: Synthetic oligonucleotide
  Target: SCN10A; (-) strand; PAM type: YTN; PAM sequence: CTT
ggtatcatatagggacaggg

SEQ ID NO: 51303 - DNA, 20 bp, Artificial Sequence
  Description of Artificial Sequence: Synthetic oligonucleotide
  Target: SCN10A; (-) strand; PAM type: YTN; PAM sequence: TTG
gacccttggtatcatatagg

SEQ ID NO: 51304 - DNA, 20 bp, Artificial Sequence
  Description of Artificial Sequence: Synthetic oligonucleotide
  Target: SCN10A; (-) strand; PAM type: YTN; PAM sequence: CTG
gttggacccttggtatcata

SEQ ID NO: 51305 - DNA, 20 bp, Artificial Sequence
  Description of Artificial Sequence: Synthetic oligonucleotide
  Target: SCN10A; (-) strand; PAM type: YTN; PAM sequence: TTC
catagggaccaaggtctggt

SEQ ID NO: 51306 - DNA, 20 bp, Artificial Sequence
  Description of Artificial Sequence: Synthetic oligonucleotide
  Target: SCN10A; (-) strand; PAM type: YTN; PAM sequence: CTT
ccatagggaccaaggtctgg

SEQ ID NO: 51307 - DNA, 20 bp, Artificial Sequence
  Description of Artificial Sequence: Synthetic oligonucleotide
  Target: SCN10A; (-) strand; PAM type: YTN; PAM sequence: CTC
ttccatagggaccaaggtct

SEQ ID NO: 51308 - DNA, 20 bp, Artificial Sequence
  Description of Artificial Sequence: Synthetic oligonucleotide
  Target: SCN10A; (-) strand; PAM type: YTN; PAM sequence: CTC
acagaaaacgtgagtggagt

SEQ ID NO: 51309 - DNA, 20 bp, Artificial Sequence
  Description of Artificial Sequence: Synthetic oligonucleotide
  Target: SCN10A; (-) strand; PAM type: YTN; PAM sequence: CTC
atctcacagaaaacgtgagt

SEQ ID NO: 51310 - DNA, 20 bp, Artificial Sequence
  Description of Artificial Sequence: Synthetic oligonucleotide
  Target: SCN10A; (-) strand; PAM type: YTN; PAM sequence: CTA
ctcatctcacagaaaacgtg

SEQ ID NO: 51311 - DNA, 20 bp, Artificial Sequence
  Description of Artificial Sequence: Synthetic oligonucleotide
  Target: SCN10A; (-) strand; PAM type: YTN; PAM sequence: CTG
tcaatgagacaaccaactac

SEQ ID NO: 51312 - DNA, 20 bp, Artificial Sequence
  Description of Artificial Sequence: Synthetic oligonucleotide
  Target: SCN10A; (-) strand; PAM type: YTN; PAM sequence: CTC
aaaaataaatgtgtcaagaa

SEQ ID NO: 51313 - DNA, 20 bp, Artificial Sequence
  Description of Artificial Sequence: Synthetic oligonucleotide
  Target: SCN10A; (-) strand; PAM type: YTN; PAM sequence: TTC
aagggcaacctcaaaaataa

SEQ ID NO: 51314 - DNA, 20 bp, Artificial Sequence
  Description of Artificial Sequence: Synthetic oligonucleotide
  Target: SCN10A; (-) strand; PAM type: YTN; PAM sequence: CTT
caagggcaacctcaaaaata

SEQ ID NO: 51315 - DNA, 20 bp, Artificial Sequence
  Description of Artificial Sequence: Synthetic oligonucleotide
  Target: SCN10A; (-) strand; PAM type: YTN; PAM sequence: CTC
ttcaagggcaacctcaaaaa

SEQ ID NO: 51316 - DNA, 20 bp, Artificial Sequence
  Description of Artificial Sequence: Synthetic oligonucleotide
  Target: SCN10A; (-) strand; PAM type: YTN; PAM sequence: CTG
caactcttcaagggcaacct

SEQ ID NO: 51317 - DNA, 20 bp, Artificial Sequence
  Description of Artificial Sequence: Synthetic oligonucleotide
  Target: SCN10A; (-) strand; PAM type: YTN; PAM sequence: TTG
gtggggctgcaactcttcaa

SEQ ID NO: 51318 - DNA, 20 bp, Artificial Sequence
  Description of Artificial Sequence: Synthetic oligonucleotide
  Target: SCN10A; (-) strand; PAM type: YTN; PAM sequence: CTT
ggtggggctgcaactcttca

SEQ ID NO: 51319 - DNA, 20 bp, Artificial Sequence
  Description of Artificial Sequence: Synthetic oligonucleotide
  Target: SCN10A; (-) strand; PAM type: YTN; PAM sequence: TTG
ccttggtggggctgcaactc

SEQ ID NO: 51320 - DNA, 20 bp, Artificial Sequence
  Description of Artificial Sequence: Synthetic oligonucleotide
  Target: SCN10A; (-) strand; PAM type: YTN; PAM sequence: TTT
gccttggtggggctgcaact

SEQ ID NO: 51321 - DNA, 20 bp, Artificial Sequence
  Description of Artificial Sequence: Synthetic oligonucleotide
  Target: SCN10A; (-) strand; PAM type: YTN; PAM sequence: TTT
tgccttggtggggctgcaac

SEQ ID NO: 51322 - DNA, 20 bp, Artificial Sequence
  Description of Artificial Sequence: Synthetic oligonucleotide
  Target: SCN10A; (-) strand; PAM type: YTN; PAM sequence: TTT
ttgccttggtggggctgcaa

SEQ ID NO: 51323 - DNA, 20 bp, Artificial Sequence
  Description of Artificial Sequence: Synthetic oligonucleotide
  Target: SCN10A; (-) strand; PAM type: YTN; PAM sequence: CTA
agtgtttttgccttggtggg

SEQ ID NO: 51324 - DNA, 20 bp, Artificial Sequence
  Description of Artificial Sequence: Synthetic oligonucleotide
  Target: SCN10A; (-) strand; PAM type: YTN; PAM sequence: CTG
cctaagtgtttttgccttgg

SEQ ID NO: 51325 - DNA, 20 bp, Artificial Sequence
  Description of Artificial Sequence: Synthetic oligonucleotide
  Target: SCN10A; (-) strand; PAM type: YTN; PAM sequence: TTC
tgcctaagtgtttttgcctt

SEQ ID NO: 51326 - DNA, 20 bp, Artificial Sequence
  Description of Artificial Sequence: Synthetic oligonucleotide
  Target: SCN10A; (-) strand; PAM type: YTN; PAM sequence: CTT
ctgcctaagtgtttttgcct

SEQ ID NO: 51327 - DNA, 20 bp, Artificial Sequence
  Description of Artificial Sequence: Synthetic oligonucleotide
  Target: SCN10A; (-) strand; PAM type: YTN; PAM sequence: CTC
accatcttctgcctaagtgt

SEQ ID NO: 51328 - DNA, 20 bp, Artificial Sequence
  Description of Artificial Sequence: Synthetic oligonucleotide
  Target: SCN10A; (-) strand; PAM type: YTN; PAM sequence: CTG
atgtgaccatcctcaccatc

SEQ ID NO: 51329 - DNA, 20 bp, Artificial Sequence
  Description of Artificial Sequence: Synthetic oligonucleotide
  Target: SCN10A; (-) strand; PAM type: YTN; PAM sequence: CTG
gctgatgtgaccatcctcac

SEQ ID NO: 51330 - DNA, 20 bp, Artificial Sequence
  Description of Artificial Sequence: Synthetic oligonucleotide
  Target: SCN10A; (-) strand; PAM type: YTN; PAM sequence: CTC
agtgaagaaactggctgatg

SEQ ID NO: 51331 - DNA, 20 bp, Artificial Sequence
  Description of Artificial Sequence: Synthetic oligonucleotide
  Target: SCN10A; (-) strand; PAM type: YTN; PAM sequence: TTC
actcagtgaagaaactggct

SEQ ID NO: 51332 - DNA, 20 bp, Artificial Sequence
  Description of Artificial Sequence: Synthetic oligonucleotide
  Target: SCN10A; (-) strand; PAM type: YTN; PAM sequence: CTG
attcactcagtgaagaaact

SEQ ID NO: 51333 - DNA, 20 bp, Artificial Sequence
  Description of Artificial Sequence: Synthetic oligonucleotide
  Target: SCN10A; (-) strand; PAM type: YTN; PAM sequence: TTG
tgggggccctgattcactca

SEQ ID NO: 51334 - DNA, 20 bp, Artificial Sequence
  Description of Artificial Sequence: Synthetic oligonucleotide
  Target: SCN10A; (-) strand; PAM type: YTN; PAM sequence: CTG
aaggtcattgtgggggccct

SEQ ID NO: 51335 - DNA, 20 bp, Artificial Sequence
  Description of Artificial Sequence: Synthetic oligonucleotide
  Target: SCN10A; (-) strand; PAM type: YTN; PAM sequence: TTC
ccgcaggcctgaaggtcatt

SEQ ID NO: 51336 - DNA, 20 bp, Artificial Sequence
  Description of Artificial Sequence: Synthetic oligonucleotide
  Target: SCN10A; (-) strand; PAM type: YTN; PAM sequence: CTT
cccgcaggcctgaaggtcat

SEQ ID NO: 51337 - DNA, 20 bp, Artificial Sequence
  Description of Artificial Sequence: Synthetic oligonucleotide
  Target: SCN10A; (-) strand; PAM type: YTN; PAM sequence: CTG
tcatcttcccgcaggcctga

SEQ ID NO: 51338 - DNA, 20 bp, Artificial Sequence
  Description of Artificial Sequence: Synthetic oligonucleotide
  Target: SCN10A; (-) strand; PAM type: YTN; PAM sequence: CTC
atccatgtggtcataccact

SEQ ID NO: 51339 - DNA, 20 bp, Artificial Sequence
  Description of Artificial Sequence: Synthetic oligonucleotide
  Target: SCN10A; (-) strand; PAM type: YTN; PAM sequence: CTA
cctcatccatgtggtcatac

SEQ ID NO: 51340 - DNA, 20 bp, Artificial Sequence
  Description of Artificial Sequence: Synthetic oligonucleotide
  Target: SCN10A; (-) strand; PAM type: YTN; PAM sequence: CTC
cgtgtgtgctacctcatcca

SEQ ID NO: 51341 - DNA, 20 bp, Artificial Sequence
  Description of Artificial Sequence: Synthetic oligonucleotide
  Target: SCN10A; (-) strand; PAM type: YTN; PAM sequence: CTA
agatgaagaagtgtgctccg

SEQ ID NO: 51342 - DNA, 20 bp, Artificial Sequence
  Description of Artificial Sequence: Synthetic oligonucleotide
  Target: SCN10A; (-) strand; PAM type: YTN; PAM sequence: CTG
tatgtagagatgaaggagga

SEQ ID NO: 51343 - DNA, 20 bp, Artificial Sequence
  Description of Artificial Sequence: Synthetic oligonucleotide
  Target: SCN10A; (-) strand; PAM type: YTN; PAM sequence: CTC
ctgtatgtagagatgaagga

SEQ ID NO: 51344 - DNA, 20 bp, Artificial Sequence
  Description of Artificial Sequence: Synthetic oligonucleotide
  Target: SCN10A; (-) strand; PAM type: YTN; PAM sequence: TTC
actcctgtatgtagagatga

SEQ ID NO: 51345 - DNA, 20 bp, Artificial Sequence
  Description of Artificial Sequence: Synthetic oligonucleotide
  Target: SCN10A; (-) strand; PAM type: YTN; PAM sequence: CTT
cactcctgtatgtagagatg

SEQ ID NO: 51346 - DNA, 20 bp, Artificial Sequence
  Description of Artificial Sequence: Synthetic oligonucleotide
  Target: SCN10A; (-) strand; PAM type: YTN; PAM sequence: CTG
gagtgtgtacatacttcact

SEQ ID NO: 51347 - DNA, 20 bp, Artificial Sequence
  Description of Artificial Sequence: Synthetic oligonucleotide
  Target: SCN10A; (-) strand; PAM type: YTN; PAM sequence: CTG
ccctggagtgtgtacatact

SEQ ID NO: 51348 - DNA, 20 bp, Artificial Sequence
  Description of Artificial Sequence: Synthetic oligonucleotide
  Target: SCN10A; (-) strand; PAM type: YTN; PAM sequence: TTG
gaactgccctggagtgtgta

SEQ ID NO: 51349 - DNA, 20 bp, Artificial Sequence
  Description of Artificial Sequence: Synthetic oligonucleotide
  Target: SCN10A; (-) strand; PAM type: YTN; PAM sequence: CTT
ggaactgccctggagtgtgt

SEQ ID NO: 51350 - DNA, 20 bp, Artificial Sequence
  Description of Artificial Sequence: Synthetic oligonucleotide
  Target: SCN10A; (-) strand; PAM type: YTN; PAM sequence: TTC
ggatgagaaaggtcttggaa

SEQ ID NO: 51351 - DNA, 20 bp, Artificial Sequence
  Description of Artificial Sequence: Synthetic oligonucleotide
  Target: SCN10A; (-) strand; PAM type: YTN; PAM sequence: CTT
cggatgagaaaggtcttgga

SEQ ID NO: 51352 - DNA, 20 bp, Artificial Sequence
  Description of Artificial Sequence: Synthetic oligonucleotide
  Target: SCN10A; (-) strand; PAM type: YTN; PAM sequence: CTC
agagtaaatgcaagcttcgg

SEQ ID NO: 51353 - DNA, 20 bp, Artificial Sequence
  Description of Artificial Sequence: Synthetic oligonucleotide
  Target: SCN10A; (-) strand; PAM type: YTN; PAM sequence: CTC
tcagagtaaatgcaagcttc

SEQ ID NO: 51354 - DNA, 20 bp, Artificial Sequence
  Description of Artificial Sequence: Synthetic oligonucleotide
  Target: SCN10A; (-) strand; PAM type: YTN; PAM sequence: CTG
cctctcagagtaaatgcaag

SEQ ID NO: 51355 - DNA, 20 bp, Artificial Sequence
  Description of Artificial Sequence: Synthetic oligonucleotide
  Target: SCN10A; (-) strand; PAM type: YTN; PAM sequence: CTG
cctgcctctcagagtaaatg

SEQ ID NO: 51356 - DNA, 20 bp, Artificial Sequence
  Description of Artificial Sequence: Synthetic oligonucleotide
  Target: SCN10A; (-) strand; PAM type: YTN; PAM sequence: CTC
tgcctgcctctcagagtaaa

SEQ ID NO: 51357 - DNA, 20 bp, Artificial Sequence
  Description of Artificial Sequence: Synthetic oligonucleotide
  Target: SCN10A; (-) strand; PAM type: YTN; PAM sequence: CTC
tctgcctgcctctcagagta

SEQ ID NO: 51358 - DNA, 20 bp, Artificial Sequence
  Description of Artificial Sequence: Synthetic oligonucleotide
  Target: SCN10A; (-) strand; PAM type: YTN; PAM sequence: CTG
actctctgcctgcctctcag

SEQ ID NO: 51359 - DNA, 20 bp, Artificial Sequence
  Description of Artificial Sequence: Synthetic oligonucleotide
  Target: SCN10A; (-) strand; PAM type: YTN; PAM sequence: TTA
taatgagaatagcccctgac

SEQ ID NO: 51360 - DNA, 20 bp, Artificial Sequence
  Description of Artificial Sequence: Synthetic oligonucleotide
  Target: SCN10A; (-) strand; PAM type: YTN; PAM sequence: TTT
ataatgagaatagcccctga

SEQ ID NO: 51361 - DNA, 20 bp, Artificial Sequence
  Description of Artificial Sequence: Synthetic oligonucleotide
  Target: SCN10A; (-) strand; PAM type: YTN; PAM sequence: CTT
tataatgagaatagcccctg

SEQ ID NO: 51362 - DNA, 20 bp, Artificial Sequence
  Description of Artificial Sequence: Synthetic oligonucleotide
  Target: SCN10A; (-) strand; PAM type: YTN; PAM sequence: TTG
catcgtctttataatgagaa

SEQ ID NO: 51363 - DNA, 20 bp, Artificial Sequence
  Description of Artificial Sequence: Synthetic oligonucleotide
  Target: SCN10A; (-) strand; PAM type: YTN; PAM sequence: CTC
agttgcatcgtctttataat

SEQ ID NO: 51364 - DNA, 20 bp, Artificial Sequence
  Description of Artificial Sequence: Synthetic oligonucleotide
  Target: SCN10A; (-) strand; PAM type: YTN; PAM sequence: CTG
ggtctcagttgcatcgtctt

SEQ ID NO: 51365 - DNA, 20 bp, Artificial Sequence
  Description of Artificial Sequence: Synthetic oligonucleotide
  Target: SCN10A; (-) strand; PAM type: YTN; PAM sequence: TTG
cctgggtctcagttgcatcg

SEQ ID NO: 51366 - DNA, 20 bp, Artificial Sequence
  Description of Artificial Sequence: Synthetic oligonucleotide
  Target: SCN10A; (-) strand; PAM type: YTN; PAM sequence: CTC
aagatgataaaaaatgcatt

SEQ ID NO: 51367 - DNA, 20 bp, Artificial Sequence
  Description of Artificial Sequence: Synthetic oligonucleotide
  Target: SCN10A; (-) strand; PAM type: YTN; PAM sequence: TTA
gcctcaagatgataaaaaat

SEQ ID NO: 51368 - DNA, 20 bp, Artificial Sequence
  Description of Artificial Sequence: Synthetic oligonucleotide
  Target: SCN10A; (-) strand; PAM type: YTN; PAM sequence: TTA
ttagcctcaagatgataaaa

SEQ ID NO: 51369 - DNA, 20 bp, Artificial Sequence
  Description of Artificial Sequence: Synthetic oligonucleotide
  Target: SCN10A; (-) strand; PAM type: YTN; PAM sequence: TTT
attagcctcaagatgataaa

SEQ ID NO: 51370 - DNA, 20 bp, Artificial Sequence
  Description of Artificial Sequence: Synthetic oligonucleotide
  Target: SCN10A; (-) strand; PAM type: YTN; PAM sequence: TTT
tattagcctcaagatgataa

SEQ ID NO: 51371 - DNA, 20 bp, Artificial Sequence
  Description of Artificial Sequence: Synthetic oligonucleotide
  Target: SCN10A; (-) strand; PAM type: YTN; PAM sequence: CTA
gtgtcaggaattttattagc

SEQ ID NO: 51372 - DNA, 20 bp, Artificial Sequence
  Description of Artificial Sequence: Synthetic oligonucleotide
  Target: SCN10A; (-) strand; PAM type: YTN; PAM sequence: TTG
ctagtgtcaggaattttatt

SEQ ID NO: 51373 - DNA, 20 bp, Artificial Sequence
  Description of Artificial Sequence: Synthetic oligonucleotide
  Target: SCN10A; (-) strand; PAM type: YTN; PAM sequence: TTG
aattgctagtgtcaggaatt

SEQ ID NO: 51374 - DNA, 20 bp, Artificial Sequence
  Description of Artificial Sequence: Synthetic oligonucleotide
  Target: SCN10A; (-) strand; PAM type: YTN; PAM sequence: TTA
aattgaattgctagtgtcag

SEQ ID NO: 51375 - DNA, 20 bp, Artificial Sequence
  Description of Artificial Sequence: Synthetic oligonucleotide
  Target: SCN10A; (-) strand; PAM type: YTN; PAM sequence: TTT
aaattgaattgctagtgtca

SEQ ID NO: 51376 - DNA, 20 bp, Artificial Sequence
  Description of Artificial Sequence: Synthetic oligonucleotide
  Target: SCN10A; (-) strand; PAM type: YTN; PAM sequence: TTA
tttaaattgaattgctagtg

SEQ ID NO: 51377 - DNA, 20 bp, Artificial Sequence
  Description of Artificial Sequence: Synthetic oligonucleotide
  Target: SCN10A; (-) strand; PAM type: YTN; PAM sequence: CTC
agcataaattatttaaattg

SEQ ID NO: 51378 - DNA, 20 bp, Artificial Sequence
  Description of Artificial Sequence: Synthetic oligonucleotide
  Target: SCN10A; (-) strand; PAM type: YTN; PAM sequence: CTG
gaaaaagtaggtactcagca

SEQ ID NO: 51379 - DNA, 20 bp, Artificial Sequence
  Description of Artificial Sequence: Synthetic oligonucleotide
  Target: SCN10A; (-) strand; PAM type: YTN; PAM sequence: CTA
gcacagtgcctggaaaaagt

SEQ ID NO: 51380 - DNA, 20 bp, Artificial Sequence
  Description of Artificial Sequence: Synthetic oligonucleotide
  Target: SCN10A; (-) strand; PAM type: YTN; PAM sequence: TTC
atgcctagcacagtgcctgg

SEQ ID NO: 51381 - DNA, 20 bp, Artificial Sequence
  Description of Artificial Sequence: Synthetic oligonucleotide
  Target: SCN10A; (-) strand; PAM type: YTN; PAM sequence: CTT
catgcctagcacagtgcctg

SEQ ID NO: 51382 - DNA, 20 bp, Artificial Sequence
  Description of Artificial Sequence: Synthetic oligonucleotide
  Target: SCN10A; (-) strand; PAM type: YTN; PAM sequence: TTA
gtagcttcatgcctagcaca

SEQ ID NO: 51383 - DNA, 20 bp, Artificial Sequence
  Description of Artificial Sequence: Synthetic oligonucleotide
  Target: SCN10A; (-) strand; PAM type: YTN; PAM sequence: CTG
gggtgaagttagtagcttca

SEQ ID NO: 51384 - DNA, 20 bp, Artificial Sequence
  Description of Artificial Sequence: Synthetic oligonucleotide
  Target: SCN10A; (-) strand; PAM type: YTN; PAM sequence: TTA
ctggggtgaagttagtagct

SEQ ID NO: 51385 - DNA, 20 bp, Artificial Sequence
  Description of Artificial Sequence: Synthetic oligonucleotide
  Target: SCN10A; (-) strand; PAM type: YTN; PAM sequence: CTC
ccagatgcatgcagaaagac

SEQ ID NO: 51386 - DNA, 20 bp, Artificial Sequence
  Description of Artificial Sequence: Synthetic oligonucleotide
  Target: SCN10A; (-) strand; PAM type: YTN; PAM sequence: CTG
cctcccagatgcatgcagaa

SEQ ID NO: 51387 - DNA, 20 bp, Artificial Sequence
  Description of Artificial Sequence: Synthetic oligonucleotide
  Target: SCN10A; (-) strand; PAM type: YTN; PAM sequence: CTC
aagctgcctcccagatgcat

SEQ ID NO: 51388 - DNA, 20 bp, Artificial Sequence
  Description of Artificial Sequence: Synthetic oligonucleotide
  Target: SCN10A; (-) strand; PAM type: YTN; PAM sequence: TTC
atgtgtcccaagtctcaagc

SEQ ID NO: 51389 - DNA, 20 bp, Artificial Sequence
  Description of Artificial Sequence: Synthetic oligonucleotide
  Target: SCN10A; (-) strand; PAM type: YTN; PAM sequence: CTC
acacacagtgaggttcatgt

SEQ ID NO: 51390 - DNA, 20 bp, Artificial Sequence
  Description of Artificial Sequence: Synthetic oligonucleotide
  Target: SCN10A; (-) strand; PAM type: YTN; PAM sequence: CTC
acacacacacacacacacac

SEQ ID NO: 51391 - DNA, 20 bp, Artificial Sequence
  Description of Artificial Sequence: Synthetic oligonucleotide
  Target: SCN10A; (-) strand; PAM type: YTN; PAM sequence: CTC
tcacacacacacacacacac

SEQ ID NO: 51392 - DNA, 20 bp, Artificial Sequence
  Description of Artificial Sequence: Synthetic oligonucleotide
  Target: SCN10A; (-) strand; PAM type: YTN; PAM sequence: CTC
tctcacacacacacacacac

SEQ ID NO: 51393 - DNA, 20 bp, Artificial Sequence
  Description of Artificial Sequence: Synthetic oligonucleotide
  Target: SCN10A; (-) strand; PAM type: YTN; PAM sequence: CTC
tctctcacacacacacacac

SEQ ID NO: 51394 - DNA, 20 bp, Artificial Sequence
  Description of Artificial Sequence: Synthetic oligonucleotide
  Target: SCN10A; (-) strand; PAM type: YTN; PAM sequence: CTC
tctctctcacacacacacac

SEQ ID NO: 51395 - DNA, 20 bp, Artificial Sequence
  Description of Artificial Sequence: Synthetic oligonucleotide
  Target: SCN10A; (-) strand; PAM type: YTN; PAM sequence: CTC
tctctctctcacacacacac

SEQ ID NO: 51396 - DNA, 20 bp, Artificial Sequence
  Description of Artificial Sequence: Synthetic oligonucleotide
  Target: SCN10A; (-) strand; PAM type: YTN; PAM sequence: CTC
tctctctctctcacacacac

SEQ ID NO: 51397 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctcacacac

SEQ ID NO: 51398 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctctcacac

SEQ ID NO: 51399 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctctctcac

SEQ ID NO: 51400 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctctctctc

SEQ ID NO: 51401 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctctctctc

SEQ ID NO: 51402 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctctctctc

SEQ ID NO: 51403 - DNA, 20 bp, Artificial Sequence
  Description of Artificial Sequence: Synthetic oligonucleotide
  Target: SCN10A; (-) strand; PAM type: YTN; PAM sequence: TTC
tctctctctctctctctctc

SEQ ID NO: 51404 - DNA, 20 bp, Artificial Sequence
  Description of Artificial Sequence: Synthetic oligonucleotide
  Target: SCN10A; (-) strand; PAM type: YTN; PAM sequence: TTT
ctctctctctctctctctct

SEQ ID NO: 51405 - DNA, 20 bp, Artificial Sequence
  Description of Artificial Sequence: Synthetic oligonucleotide
  Target: SCN10A; (-) strand; PAM type: YTN; PAM sequence: CTT
tctctctctctctctctctc

SEQ ID NO: 51406 - DNA, 20 bp, Artificial Sequence
  Description of Artificial Sequence: Synthetic oligonucleotide
  Target: SCN10A; (-) strand; PAM type: YTN; PAM sequence: CTC
tttctctctctctctctctc

SEQ ID NO: 51407 - DNA, 20 bp, Artificial Sequence
  Description of Artificial Sequence: Synthetic oligonucleotide
  Target: SCN10A; (-) strand; PAM type: YTN; PAM sequence: CTC
tctttctctctctctctctc

SEQ ID NO: 51408 - DNA, 20 bp, Artificial Sequence
  Description of Artificial Sequence: Synthetic oligonucleotide
  Target: SCN10A; (-) strand; PAM type: YTN; PAM sequence: CTC
tctctttctctctctctctc

SEQ ID NO: 51409 - DNA, 20 bp, Artificial Sequence
  Description of Artificial Sequence: Synthetic oligonucleotide
  Target: SCN10A; (-) strand; PAM type: YTN; PAM sequence: CTC
tctctctttctctctctctc

SEQ ID NO: 51410 - DNA, 20 bp, Artificial Sequence
  Description of Artificial Sequence: Synthetic oligonucleotide
  Target: SCN10A; (-) strand; PAM type: YTN; PAM sequence: CTC
tctctctctttctctctctc

SEQ ID NO: 51411 - DNA, 20 bp, Artificial Sequence
  Description of Artificial Sequence: Synthetic oligonucleotide
  Target: SCN10A; (-) strand; PAM type: YTN; PAM sequence: CTC
tctctctctctttctctctc

SEQ ID NO: 51412 - DNA, 20 bp, Artificial Sequence
  Description of Artificial Sequence: Synthetic oligonucleotide
  Target: SCN10A; (-) strand; PAM type: YTN; PAM sequence: CTC
tctctctctctctttctctc

SEQ ID NO: 51413 - DNA, 20 bp, Artificial Sequence
  Description of Artificial Sequence: Synthetic oligonucleotide
  Target: SCN10A; (-) strand; PAM type: YTN; PAM sequence: TTG
catctctctctctctctctt

SEQ ID NO: 51414 - DNA, 20 bp, Artificial Sequence
  Description of Artificial Sequence: Synthetic oligonucleotide
  Target: SCN10A; (-) strand; PAM type: YTN; PAM sequence: CTT
gcatctctctctctctctct

SEQ ID NO: 51415 - DNA, 20 bp, Artificial Sequence
  Description of Artificial Sequence: Synthetic oligonucleotide
  Target: SCN10A; (-) strand; PAM type: YTN; PAM sequence: CTC
ttgcatctctctctctctct

SEQ ID NO: 51416 - DNA, 20 bp, Artificial Sequence
  Description of Artificial Sequence: Synthetic oligonucleotide
  Target: SCN10A; (-) strand; PAM type: YTN; PAM sequence: CTC
tcttgcatctctctctctct

SEQ ID NO: 51417 - DNA, 20 bp, Artificial Sequence
  Description of Artificial Sequence: Synthetic oligonucleotide
  Target: SCN10A; (-) strand; PAM type: YTN; PAM sequence: CTA
tctctcttgcatctctctct

SEQ ID NO: 51418 - DNA, 20 bp, Artificial Sequence
  Description of Artificial Sequence: Synthetic oligonucleotide
  Target: SCN10A; (-) strand; PAM type: YTN; PAM sequence: CTC
tatctctcttgcatctctct

SEQ ID NO: 51419 - DNA, 20 bp, Artificial Sequence
  Description of Artificial Sequence: Synthetic oligonucleotide
  Target: SCN10A; (-) strand; PAM type: YTN; PAM sequence: TTC
actctatctctcttgcatct

SEQ ID NO: 51420 - DNA, 20 bp, Artificial Sequence
  Description of Artificial Sequence: Synthetic oligonucleotide
  Target: SCN10A; (-) strand; PAM type: YTN; PAM sequence: TTT
cactctatctctcttgcatc

SEQ ID NO: 51421 - DNA, 20 bp, Artificial Sequence
  Description of Artificial Sequence: Synthetic oligonucleotide
  Target: SCN10A; (-) strand; PAM type: YTN; PAM sequence: TTG
tttcactctatctctcttgc

SEQ ID NO: 51422 - DNA, 20 bp, Artificial Sequence
  Description of Artificial Sequence: Synthetic oligonucleotide
  Target: SCN10A; (-) strand; PAM type: YTN; PAM sequence: TTT
gtttcactctatctctcttg

SEQ ID NO: 51423 - DNA, 20 bp, Artificial Sequence
  Description of Artificial Sequence: Synthetic oligonucleotide
  Target: SCN10A; (-) strand; PAM type: YTN; PAM sequence: TTT
tgtttcactctatctctctt

SEQ ID NO: 51424 - DNA, 20 bp, Artificial Sequence
  Description of Artificial Sequence: Synthetic oligonucleotide
  Target: SCN10A; (-) strand; PAM type: YTN; PAM sequence: TTT
ttgtttcactctatctctct

SEQ ID NO: 51425 - DNA, 20 bp, Artificial Sequence
  Description of Artificial Sequence: Synthetic oligonucleotide
  Target: SCN10A; (-) strand; PAM type: YTN; PAM sequence: CTA
tttttgtttcactctatctc

SEQ ID NO: 51426 - DNA, 20 bp, Artificial Sequence
  Description of Artificial Sequence: Synthetic oligonucleotide
  Target: SCN10A; (-) strand; PAM type: YTN; PAM sequence: TTG
gtctatttttgtttcactct

SEQ ID NO: 51427 - DNA, 20 bp, Artificial Sequence
  Description of Artificial Sequence: Synthetic oligonucleotide
  Target: SCN10A; (-) strand; PAM type: YTN; PAM sequence: CTT
ggtctatttttgtttcactc

SEQ ID NO: 51428 - DNA, 20 bp, Artificial Sequence
  Description of Artificial Sequence: Synthetic oligonucleotide
  Target: SCN10A; (-) strand; PAM type: YTN; PAM sequence: CTC
ttggtctatttttgtttcac

SEQ ID NO: 51429 - DNA, 20 bp, Artificial Sequence
  Description of Artificial Sequence: Synthetic oligonucleotide
  Target: SCN10A; (-) strand; PAM type: YTN; PAM sequence: TTC
tcttggtctatttttgtttc

SEQ ID NO: 51430 - DNA, 20 bp, Artificial Sequence
  Description of Artificial Sequence: Synthetic oligonucleotide
  Target: SCN10A; (-) strand; PAM type: YTN; PAM sequence: TTT
ctcttggtctatttttgttt

SEQ ID NO: 51431 - DNA, 20 bp, Artificial Sequence
  Description of Artificial Sequence: Synthetic oligonucleotide
  Target: SCN10A; (-) strand; PAM type: YTN; PAM sequence: CTT
tctcttggtctatttttgtt

SEQ ID NO: 51432 - DNA, 20 bp, Artificial Sequence
  Description of Artificial Sequence: Synthetic oligonucleotide
  Target: SCN10A; (-) strand; PAM type: YTN; PAM sequence: TTC
tttctcttggtctatttttg

SEQ ID NO: 51433 - DNA, 20 bp, Artificial Sequence
  Description of Artificial Sequence: Synthetic oligonucleotide
  Target: SCN10A; (-) strand; PAM type: YTN; PAM sequence: TTT
ctttctcttggtctattttt

SEQ ID NO: 51434 - DNA, 20 bp, Artificial Sequence
  Description of Artificial Sequence: Synthetic oligonucleotide
  Target: SCN10A; (-) strand; PAM type: YTN; PAM sequence: TTT
tctttctcttggtctatttt

SEQ ID NO: 51435 - DNA, 20 bp, Artificial Sequence
  Description of Artificial Sequence: Synthetic oligonucleotide
  Target: SCN10A; (-) strand; PAM type: YTN; PAM sequence: TTT
ttctttctcttggtctattt

SEQ ID NO: 51436 - DNA, 20 bp, Artificial Sequence
  Description of Artificial Sequence: Synthetic oligonucleotide
  Target: SCN10A; (-) strand; PAM type: YTN; PAM sequence: CTT
tttctttctcttggtctatt

SEQ ID NO: 51437 - DNA, 20 bp, Artificial Sequence
  Description of Artificial Sequence: Synthetic oligonucleotide
  Target: SCN10A; (-) strand; PAM type: YTN; PAM sequence: TTC
tttttctttctcttggtcta

SEQ ID NO: 51438 - DNA, 20 bp, Artificial Sequence
  Description of Artificial Sequence: Synthetic oligonucleotide
  Target: SCN10A; (-) strand; PAM type: YTN; PAM sequence: TTT
ctttttctttctcttggtct

SEQ ID NO: 51439 - DNA, 20 bp, Artificial Sequence
  Description of Artificial Sequence: Synthetic oligonucleotide
  Target: SCN10A; (-) strand; PAM type: YTN; PAM sequence: CTT
tctttttctttctcttggtc

SEQ ID NO: 51440 - DNA, 20 bp, Artificial Sequence
  Description of Artificial Sequence: Synthetic oligonucleotide
  Target: SCN10A; (-) strand; PAM type: YTN; PAM sequence: CTC
tttctttttctttctcttgg

SEQ ID NO: 51441 - DNA, 20 bp, Artificial Sequence
  Description of Artificial Sequence: Synthetic oligonucleotide
  Target: SCN10A; (-) strand; PAM type: YTN; PAM sequence: CTG
tgtctctttctttttctttc

SEQ ID NO: 51442 - DNA, 20 bp, Artificial Sequence
  Description of Artificial Sequence: Synthetic oligonucleotide
  Target: SCN10A; (-) strand; PAM type: YTN; PAM sequence: CTC
tgtgtctctttctttttctt

SEQ ID NO: 51443 - DNA, 20 bp, Artificial Sequence
  Description of Artificial Sequence: Synthetic oligonucleotide
  Target: SCN10A; (-) strand; PAM type: YTN; PAM sequence: TTC
tctgtgtctctttctttttc

SEQ ID NO: 51444 - DNA, 20 bp, Artificial Sequence
  Description of Artificial Sequence: Synthetic oligonucleotide
  Target: SCN10A; (-) strand; PAM type: YTN; PAM sequence: TTT
ctctgtgtctctttcttttt

SEQ ID NO: 51445 - DNA, 20 bp, Artificial Sequence
  Description of Artificial Sequence: Synthetic oligonucleotide
  Target: SCN10A; (-) strand; PAM type: YTN; PAM sequence: CTG
tttctctgtgtctctttctt

SEQ ID NO: 51446 - DNA, 20 bp, Artificial Sequence
  Description of Artificial Sequence: Synthetic oligonucleotide
  Target: SCN10A; (-) strand; PAM type: YTN; PAM sequence: CTC
tgtttctctgtgtctctttc

SEQ ID NO: 51447 - DNA, 20 bp, Artificial Sequence
  Description of Artificial Sequence: Synthetic oligonucleotide
  Target: SCN10A; (-) strand; PAM type: YTN; PAM sequence: CTC
tctgtttctctgtgtctctt

SEQ ID NO: 51448 - DNA, 20 bp, Artificial Sequence
  Description of Artificial Sequence: Synthetic oligonucleotide
  Target: SCN10A; (-) strand; PAM type: YTN; PAM sequence: CTC
acctctctgtttctctgtgt

SEQ ID NO: 51449 - DNA, 20 bp, Artificial Sequence
  Description of Artificial Sequence: Synthetic oligonucleotide
  Target: SCN10A; (-) strand; PAM type: YTN; PAM sequence: CTA
aactcacctctctgtttctc

SEQ ID NO: 51450 - DNA, 20 bp, Artificial Sequence
  Description of Artificial Sequence: Synthetic oligonucleotide
  Target: SCN10A; (-) strand; PAM type: YTN; PAM sequence: TTG
ctaaactcacctctctgttt

SEQ ID NO: 51451 - DNA, 20 bp, Artificial Sequence
  Description of Artificial Sequence: Synthetic oligonucleotide
  Target: SCN10A; (-) strand; PAM type: YTN; PAM sequence: CTA
ttgctaaactcacctctctg

SEQ ID NO: 51452 - DNA, 20 bp, Artificial Sequence
  Description of Artificial Sequence: Synthetic oligonucleotide
  Target: SCN10A; (-) strand; PAM type: YTN; PAM sequence: TTC
tattgctaaactcacctctc

SEQ ID NO: 51453 - DNA, 20 bp, Artificial Sequence
  Description of Artificial Sequence: Synthetic oligonucleotide
  Target: SCN10A; (-) strand; PAM type: YTN; PAM sequence: TTT
ctattgctaaactcacctct

SEQ ID NO: 51454 - DNA, 20 bp, Artificial Sequence
  Description of Artificial Sequence: Synthetic oligonucleotide
  Target: SCN10A; (-) strand; PAM type: YTN; PAM sequence: CTT
tctattgctaaactcacctc

SEQ ID NO: 51455 - DNA, 20 bp, Artificial Sequence
  Description of Artificial Sequence: Synthetic oligonucleotide
  Target: SCN10A; (-) strand; PAM type: YTN; PAM sequence: CTC
tttctattgctaaactcacc

SEQ ID NO: 51456 - DNA, 20 bp, Artificial Sequence
  Description of Artificial Sequence: Synthetic oligonucleotide
  Target: SCN10A; (-) strand; PAM type: YTN; PAM sequence: TTA
tagtctctttctattgctaa

SEQ ID NO: 51457 - DNA, 20 bp, Artificial Sequence
  Description of Artificial Sequence: Synthetic oligonucleotide
  Target: SCN10A; (-) strand; PAM type: YTN; PAM sequence: CTT
atagtctctttctattgcta

SEQ ID NO: 51458 - DNA, 20 bp, Artificial Sequence
  Description of Artificial Sequence: Synthetic oligonucleotide
  Target: SCN10A; (-) strand; PAM type: YTN; PAM sequence: TTC
ttatagtctctttctattgc

SEQ ID NO: 51459 - DNA, 20 bp, Artificial Sequence
  Description of Artificial Sequence: Synthetic oligonucleotide
  Target: SCN10A; (-) strand; PAM type: YTN; PAM sequence: TTT
cttatagtctctttctattg

SEQ ID NO: 51460 - DNA, 20 bp, Artificial Sequence
  Description of Artificial Sequence: Synthetic oligonucleotide
  Target: SCN10A; (-) strand; PAM type: YTN; PAM sequence: CTC
agtgtttcttatagtctctt

SEQ ID NO: 51461 - DNA, 20 bp, Artificial Sequence
  Description of Artificial Sequence: Synthetic oligonucleotide
  Target: SCN10A; (-) strand; PAM type: YTN; PAM sequence: CTG
tctcagtgtttcttatagtc

SEQ ID NO: 51462 - DNA, 20 bp, Artificial Sequence
  Description of Artificial Sequence: Synthetic oligonucleotide
  Target: SCN10A; (-) strand; PAM type: YTN; PAM sequence: TTA
tgccccagtgactgtctcag

SEQ ID NO: 51463 - DNA, 20 bp, Artificial Sequence
  Description of Artificial Sequence: Synthetic oligonucleotide
  Target: SCN10A; (-) strand; PAM type: YTN; PAM sequence: TTT
atgccccagtgactgtctca

SEQ ID NO: 51464 - DNA, 20 bp, Artificial Sequence
  Description of Artificial Sequence: Synthetic oligonucleotide
  Target: SCN10A; (-) strand; PAM type: YTN; PAM sequence: CTA
tttatgccccagtgactgtc

SEQ ID NO: 51465 - DNA, 20 bp, Artificial Sequence
  Description of Artificial Sequence: Synthetic oligonucleotide
  Target: SCN10A; (-) strand; PAM type: YTN; PAM sequence: TTC
tatttatgccccagtgactg

SEQ ID NO: 51466 - DNA, 20 bp, Artificial Sequence
  Description of Artificial Sequence: Synthetic oligonucleotide
  Target: SCN10A; (-) strand; PAM type: YTN; PAM sequence: TTG
gcacaagttctatttatgcc

SEQ ID NO: 51467 - DNA, 20 bp, Artificial Sequence
  Description of Artificial Sequence: Synthetic oligonucleotide
  Target: SCN10A; (-) strand; PAM type: YTN; PAM sequence: CTT
ggcacaagttctatttatgc

SEQ ID NO: 51468 - DNA, 20 bp, Artificial Sequence
  Description of Artificial Sequence: Synthetic oligonucleotide
  Target: SCN10A; (-) strand; PAM type: YTN; PAM sequence: CTG
tgcttggcacaagttctatt

SEQ ID NO: 51469 - DNA, 20 bp, Artificial Sequence
  Description of Artificial Sequence: Synthetic oligonucleotide
  Target: SCN10A; (-) strand; PAM type: YTN; PAM sequence: CTG
ccagctgtgcttggcacaag

SEQ ID NO: 51470 - DNA, 20 bp, Artificial Sequence
  Description of Artificial Sequence: Synthetic oligonucleotide
  Target: SCN10A; (-) strand; PAM type: YTN; PAM sequence: TTG
ctgccagctgtgcttggcac

SEQ ID NO: 51471 - DNA, 20 bp, Artificial Sequence
  Description of Artificial Sequence: Synthetic oligonucleotide
  Target: SCN10A; (-) strand; PAM type: YTN; PAM sequence: TTT
gctgccagctgtgcttggca

SEQ ID NO: 51472 - DNA, 20 bp, Artificial Sequence
  Description of Artificial Sequence: Synthetic oligonucleotide
  Target: SCN10A; (-) strand; PAM type: YTN; PAM sequence: CTT
tgctgccagctgtgcttggc

SEQ ID NO: 51473 - DNA, 20 bp, Artificial Sequence
  Description of Artificial Sequence: Synthetic oligonucleotide
  Target: SCN10A; (-) strand; PAM type: YTN; PAM sequence: TTC
tttgctgccagctgtgcttg

SEQ ID NO: 51474 - DNA, 20 bp, Artificial Sequence
  Description of Artificial Sequence: Synthetic oligonucleotide
  Target: SCN10A; (-) strand; PAM type: YTN; PAM sequence: CTT
ctttgctgccagctgtgctt

SEQ ID NO: 51475 - DNA, 20 bp, Artificial Sequence
  Description of Artificial Sequence: Synthetic oligonucleotide
  Target: SCN10A; (-) strand; PAM type: YTN; PAM sequence: TTA
aacaagcaggtgtatccttc

SEQ ID NO: 51476 - DNA, 20 bp, Artificial Sequence
  Description of Artificial Sequence: Synthetic oligonucleotide
  Target: SCN10A; (-) strand; PAM type: YTN; PAM sequence: CTT
aaacaagcaggtgtatcctt

SEQ ID NO: 51477 - DNA, 20 bp, Artificial Sequence
  Description of Artificial Sequence: Synthetic oligonucleotide
  Target: SCN10A; (-) strand; PAM type: YTN; PAM sequence: CTC
cttaaacaagcaggtgtatc

SEQ ID NO: 51478 - DNA, 20 bp, Artificial Sequence
  Description of Artificial Sequence: Synthetic oligonucleotide
  Target: SCN10A; (-) strand; PAM type: YTN; PAM sequence: TTA
ccagagcaacaaatcatccc

SEQ ID NO: 51479 - DNA, 20 bp, Artificial Sequence
  Description of Artificial Sequence: Synthetic oligonucleotide
  Target: SCN10A; (-) strand; PAM type: YTN; PAM sequence: CTT
accagagcaacaaatcatcc

SEQ ID NO: 51480 - DNA, 20 bp, Artificial Sequence
  Description of Artificial Sequence: Synthetic oligonucleotide
  Target: SCN10A; (-) strand; PAM type: YTN; PAM sequence: TTA
cttaccagagcaacaaatca

SEQ ID NO: 51481 - DNA, 20 bp, Artificial Sequence
  Description of Artificial Sequence: Synthetic oligonucleotide
  Target: SCN10A; (-) strand; PAM type: YTN; PAM sequence: TTT
acttaccagagcaacaaatc

SEQ ID NO: 51482 - DNA, 20 bp, Artificial Sequence
  Description of Artificial Sequence: Synthetic oligonucleotide
  Target: SCN10A; (-) strand; PAM type: YTN; PAM sequence: TTT
tacttaccagagcaacaaat

SEQ ID NO: 51483 - DNA, 20 bp, Artificial Sequence
  Description of Artificial Sequence: Synthetic oligonucleotide
  Target: SCN10A; (-) strand; PAM type: YTN; PAM sequence: TTG
attttacttaccagagcaac

SEQ ID NO: 51484 - DNA, 20 bp, Artificial Sequence
  Description of Artificial Sequence: Synthetic oligonucleotide
  Target: SCN10A; (-) strand; PAM type: YTN; PAM sequence: CTC
ccaaagaagttgattttact

SEQ ID NO: 51485 - DNA, 20 bp, Artificial Sequence
  Description of Artificial Sequence: Synthetic oligonucleotide
  Target: SCN10A; (-) strand; PAM type: YTN; PAM sequence: CTC
tcccaaagaagttgatttta

SEQ ID NO: 51486 - DNA, 20 bp, Artificial Sequence
  Description of Artificial Sequence: Synthetic oligonucleotide
  Target: SCN10A; (-) strand; PAM type: YTN; PAM sequence: CTG
ctctcccaaagaagttgatt

SEQ ID NO: 51487 - DNA, 20 bp, Artificial Sequence
  Description of Artificial Sequence: Synthetic oligonucleotide
  Target: SCN10A; (-) strand; PAM type: YTN; PAM sequence: CTG
cgaagctgctctcccaaaga

SEQ ID NO: 51488 - DNA, 20 bp, Artificial Sequence
  Description of Artificial Sequence: Synthetic oligonucleotide
  Target: SCN10A; (-) strand; PAM type: YTN; PAM sequence: CTA
cctgcgaagctgctctccca

SEQ ID NO: 51489 - DNA, 20 bp, Artificial Sequence
  Description of Artificial Sequence: Synthetic oligonucleotide
  Target: SCN10A; (-) strand; PAM type: YTN; PAM sequence: CTG
ctacctgcgaagctgctctc

SEQ ID NO: 51490 - DNA, 20 bp, Artificial Sequence
  Description of Artificial Sequence: Synthetic oligonucleotide
  Target: SCN10A; (-) strand; PAM type: YTN; PAM sequence: TTC
tgctacctgcgaagctgctc

SEQ ID NO: 51491 - DNA, 20 bp, Artificial Sequence
  Description of Artificial Sequence: Synthetic oligonucleotide
  Target: SCN10A; (-) strand; PAM type: YTN; PAM sequence: TTT
ctgctacctgcgaagctgct

SEQ ID NO: 51492 - DNA, 20 bp, Artificial Sequence
  Description of Artificial Sequence: Synthetic oligonucleotide
  Target: SCN10A; (-) strand; PAM type: YTN; PAM sequence: CTT
tctgctacctgcgaagctgc

SEQ ID NO: 51493 - DNA, 20 bp, Artificial Sequence
  Description of Artificial Sequence: Synthetic oligonucleotide
  Target: SCN10A; (-) strand; PAM type: YTN; PAM sequence: CTC
tttctgctacctgcgaagct

SEQ ID NO: 51494 - DNA, 20 bp, Artificial Sequence
  Description of Artificial Sequence: Synthetic oligonucleotide
  Target: SCN10A; (-) strand; PAM type: YTN; PAM sequence: CTG
gtcagagctctttctgctac

SEQ ID NO: 51495 - DNA, 20 bp, Artificial Sequence
  Description of Artificial Sequence: Synthetic oligonucleotide
  Target: SCN10A; (-) strand; PAM type: YTN; PAM sequence: TTC
cctggtcagagctctttctg

SEQ ID NO: 51496 - DNA, 20 bp, Artificial Sequence
  Description of Artificial Sequence: Synthetic oligonucleotide
  Target: SCN10A; (-) strand; PAM type: YTN; PAM sequence: CTT
ccctggtcagagctctttct

SEQ ID NO: 51497 - DNA, 20 bp, Artificial Sequence
  Description of Artificial Sequence: Synthetic oligonucleotide
  Target: SCN10A; (-) strand; PAM type: YTN; PAM sequence: TTG
cttccctggtcagagctctt

SEQ ID NO: 51498 - DNA, 20 bp, Artificial Sequence
  Description of Artificial Sequence: Synthetic oligonucleotide
  Target: SCN10A; (-) strand; PAM type: YTN; PAM sequence: CTA
gattgcttccctggtcagag

SEQ ID NO: 51499 - DNA, 20 bp, Artificial Sequence
  Description of Artificial Sequence: Synthetic oligonucleotide
  Target: SCN10A; (-) strand; PAM type: YTN; PAM sequence: CTA
accaaaaataaatcctagat

SEQ ID NO: 51500 - DNA, 20 bp, Artificial Sequence
  Description of Artificial Sequence: Synthetic oligonucleotide
  Target: SCN10A; (-) strand; PAM type: YTN; PAM sequence: CTG
accaaaatgactaaccaaaa

SEQ ID NO: 51501 - DNA, 20 bp, Artificial Sequence
  Description of Artificial Sequence: Synthetic oligonucleotide
  Target: SCN10A; (-) strand; PAM type: YTN; PAM sequence: TTG
ctgaccaaaatgactaacca

SEQ ID NO: 51502 - DNA, 20 bp, Artificial Sequence
  Description of Artificial Sequence: Synthetic oligonucleotide
  Target: SCN10A; (-) strand; PAM type: YTN; PAM sequence: TTT
gctgaccaaaatgactaacc

SEQ ID NO: 51503 - DNA, 20 bp, Artificial Sequence
  Description of Artificial Sequence: Synthetic oligonucleotide
  Target: SCN10A; (-) strand; PAM type: YTN; PAM sequence: TTA
tttgctgaccaaaatgacta

SEQ ID NO: 51504 - DNA, 20 bp, Artificial Sequence
  Description of Artificial Sequence: Synthetic oligonucleotide
  Target: SCN10A; (-) strand; PAM type: YTN; PAM sequence: CTC
agtggattatttgctgacca

SEQ ID NO: 51505 - DNA, 20 bp, Artificial Sequence
  Description of Artificial Sequence: Synthetic oligonucleotide
  Target: SCN10A; (-) strand; PAM type: YTN; PAM sequence: CTG
acacatgtagtgctcagtgg

SEQ ID NO: 51506 - DNA, 20 bp, Artificial Sequence
  Description of Artificial Sequence: Synthetic oligonucleotide
  Target: SCN10A; (-) strand; PAM type: YTN; PAM sequence: CTC
ccagtccagggactgacaca

SEQ ID NO: 51507 - DNA, 20 bp, Artificial Sequence
  Description of Artificial Sequence: Synthetic oligonucleotide
  Target: SCN10A; (-) strand; PAM type: YTN; PAM sequence: CTC
agctcccagtccagggactg

SEQ ID NO: 51508 - DNA, 20 bp, Artificial Sequence
  Description of Artificial Sequence: Synthetic oligonucleotide
  Target: SCN10A; (-) strand; PAM type: YTN; PAM sequence: TTA
gccatcactcagctcccagt

SEQ ID NO: 51509 - DNA, 20 bp, Artificial Sequence
  Description of Artificial Sequence: Synthetic oligonucleotide
  Target: SCN10A; (-) strand; PAM type: YTN; PAM sequence: CTT
agccatcactcagctcccag

SEQ ID NO: 51510 - DNA, 20 bp, Artificial Sequence
  Description of Artificial Sequence: Synthetic oligonucleotide
  Target: SCN10A; (-) strand; PAM type: YTN; PAM sequence: CTG
ccttagccatcactcagctc

SEQ ID NO: 51511 - DNA, 20 bp, Artificial Sequence
  Description of Artificial Sequence: Synthetic oligonucleotide
  Target: SCN10A; (-) strand; PAM type: YTN; PAM sequence: CTG
ctgccttagccatcactcag

SEQ ID NO: 51512 - DNA, 20 bp, Artificial Sequence
  Description of Artificial Sequence: Synthetic oligonucleotide
  Target: SCN10A; (-) strand; PAM type: YTN; PAM sequence: CTC
gacatgctgctgccttagcc

SEQ ID NO: 51513 - DNA, 20 bp, Artificial Sequence
  Description of Artificial Sequence: Synthetic oligonucleotide
  Target: SCN10A; (-) strand; PAM type: YTN; PAM sequence: TTG
tcagacaacggcactcgaca

SEQ ID NO: 51514 - DNA, 20 bp, Artificial Sequence
  Description of Artificial Sequence: Synthetic oligonucleotide
  Target: SCN10A; (-) strand; PAM type: YTN; PAM sequence: CTC
aattgtcagacaacggcact

SEQ ID NO: 51515 - DNA, 20 bp, Artificial Sequence
  Description of Artificial Sequence: Synthetic oligonucleotide
  Target: SCN10A; (-) strand; PAM type: YTN; PAM sequence: TTC
ccctcaattgtcagacaacg

SEQ ID NO: 51516 - DNA, 20 bp, Artificial Sequence
  Description of Artificial Sequence: Synthetic oligonucleotide
  Target: SCN10A; (-) strand; PAM type: YTN; PAM sequence: TTT
cccctcaattgtcagacaac

SEQ ID NO: 51517 - DNA, 20 bp, Artificial Sequence
  Description of Artificial Sequence: Synthetic oligonucleotide
  Target: SCN10A; (-) strand; PAM type: YTN; PAM sequence: CTT
tcccctcaattgtcagacaa

SEQ ID NO: 51518 - DNA, 20 bp, Artificial Sequence
  Description of Artificial Sequence: Synthetic oligonucleotide
  Target: SCN10A; (-) strand; PAM type: YTN; PAM sequence: CTA
cagactttcccctcaattgt

SEQ ID NO: 51519 - DNA, 20 bp, Artificial Sequence
  Description of Artificial Sequence: Synthetic oligonucleotide
  Target: SCN10A; (-) strand; PAM type: YTN; PAM sequence: CTC
agtaatgctacagactttcc

SEQ ID NO: 51520 - DNA, 20 bp, Artificial Sequence
  Description of Artificial Sequence: Synthetic oligonucleotide
  Target: SCN10A; (-) strand; PAM type: YTN; PAM sequence: CTG
ctcagtaatgctacagactt

SEQ ID NO: 51521 - DNA, 20 bp, Artificial Sequence
  Description of Artificial Sequence: Synthetic oligonucleotide
  Target: SCN10A; (-) strand; PAM type: YTN; PAM sequence: CTG
tgtgcccatctgctcagtaa

SEQ ID NO: 51522 - DNA, 20 bp, Artificial Sequence
  Description of Artificial Sequence: Synthetic oligonucleotide
  Target: SCN10A; (-) strand; PAM type: YTN; PAM sequence: CTC
ccctgtgtgcccatctgctc

SEQ ID NO: 51523 - DNA, 20 bp, Artificial Sequence
  Description of Artificial Sequence: Synthetic oligonucleotide
  Target: SCN10A; (-) strand; PAM type: YTN; PAM sequence: CTG
ctcccctgtgtgcccatctg

SEQ ID NO: 51524 - DNA, 20 bp, Artificial Sequence
  Description of Artificial Sequence: Synthetic oligonucleotide
  Target: SCN10A; (-) strand; PAM type: YTN; PAM sequence: TTA
agggctgctcccctgtgtgc

SEQ ID NO: 51525 - DNA, 20 bp, Artificial Sequence
  Description of Artificial Sequence: Synthetic oligonucleotide
  Target: SCN10A; (-) strand; PAM type: YTN; PAM sequence: TTC
agttaagggctgctcccctg

SEQ ID NO: 51526 - DNA, 20 bp, Artificial Sequence
  Description of Artificial Sequence: Synthetic oligonucleotide
  Target: SCN10A; (-) strand; PAM type: YTN; PAM sequence: CTT
cagttaagggctgctcccct

SEQ ID NO: 51527 - DNA, 20 bp, Artificial Sequence
  Description of Artificial Sequence: Synthetic oligonucleotide
  Target: SCN10A; (-) strand; PAM type: YTN; PAM sequence: CTG
gaacttcagttaagggctgc

SEQ ID NO: 51528 - DNA, 20 bp, Artificial Sequence
  Description of Artificial Sequence: Synthetic oligonucleotide
  Target: SCN10A; (-) strand; PAM type: YTN; PAM sequence: CTC
tggaacttcagttaagggct

SEQ ID NO: 51529 - DNA, 20 bp, Artificial Sequence
  Description of Artificial Sequence: Synthetic oligonucleotide
  Target: SCN10A; (-) strand; PAM type: YTN; PAM sequence: TTC
ccacctctggaacttcagtt

SEQ ID NO: 51530 - DNA, 20 bp, Artificial Sequence
  Description of Artificial Sequence: Synthetic oligonucleotide
  Target: SCN10A; (-) strand; PAM type: YTN; PAM sequence: CTC
cacccaccccattcccacct

SEQ ID NO: 51531 - DNA, 20 bp, Artificial Sequence
  Description of Artificial Sequence: Synthetic oligonucleotide
  Target: SCN10A; (-) strand; PAM type: YTN; PAM sequence: CTC
acactccacccaccccattc

SEQ ID NO: 51532 - DNA, 20 bp, Artificial Sequence
  Description of Artificial Sequence: Synthetic oligonucleotide
  Target: SCN10A; (-) strand; PAM type: YTN; PAM sequence: TTC
ctcacactccacccacccca

SEQ ID NO: 51533 - DNA, 20 bp, Artificial Sequence
  Description of Artificial Sequence: Synthetic oligonucleotide
  Target: SCN10A; (-) strand; PAM type: YTN; PAM sequence: CTT
cctcacactccacccacccc

SEQ ID NO: 51534 - DNA, 20 bp, Artificial Sequence
  Description of Artificial Sequence: Synthetic oligonucleotide
  Target: SCN10A; (-) strand; PAM type: YTN; PAM sequence: TTC
ccaccttcctcacactccac

SEQ ID NO: 51535 - DNA, 20 bp, Artificial Sequence
  Description of Artificial Sequence: Synthetic oligonucleotide
  Target: SCN10A; (-) strand; PAM type: YTN; PAM sequence: TTT
cccaccttcctcacactcca

SEQ ID NO: 51536 - DNA, 20 bp, Artificial Sequence
  Description of Artificial Sequence: Synthetic oligonucleotide
  Target: SCN10A; (-) strand; PAM type: YTN; PAM sequence: TTT
tcccaccttcctcacactcc

SEQ ID NO: 51537 - DNA, 20 bp, Artificial Sequence
  Description of Artificial Sequence: Synthetic oligonucleotide
  Target: SCN10A; (-) strand; PAM type: YTN; PAM sequence: CTG
gttttcccaccttcctcaca

SEQ ID NO: 51538 - DNA, 20 bp, Artificial Sequence
  Description of Artificial Sequence: Synthetic oligonucleotide
  Target: SCN10A; (-) strand; PAM type: YTN; PAM sequence: CTC
cctggttttcccaccttcct

SEQ ID NO: 51539 - DNA, 20 bp, Artificial Sequence
  Description of Artificial Sequence: Synthetic oligonucleotide
  Target: SCN10A; (-) strand; PAM type: YTN; PAM sequence: CTC
ctccctggttttcccacctt

SEQ ID NO: 51540 - DNA, 20 bp, Artificial Sequence
  Description of Artificial Sequence: Synthetic oligonucleotide
  Target: SCN10A; (-) strand; PAM type: YTN; PAM sequence: TTA
cctcctccctggttttccca

SEQ ID NO: 51541 - DNA, 20 bp, Artificial Sequence
  Description of Artificial Sequence: Synthetic oligonucleotide
  Target: SCN10A; (-) strand; PAM type: YTN; PAM sequence: TTT
acctcctccctggttttccc

SEQ ID NO: 51542 - DNA, 20 bp, Artificial Sequence
  Description of Artificial Sequence: Synthetic oligonucleotide
  Target: SCN10A; (-) strand; PAM type: YTN; PAM sequence: TTT
tacctcctccctggttttcc

SEQ ID NO: 51543 - DNA, 20 bp, Artificial Sequence
  Description of Artificial Sequence: Synthetic oligonucleotide
  Target: SCN10A; (-) strand; PAM type: YTN; PAM sequence: CTG
ccaaggttttacctcctccc

SEQ ID NO: 51544 - DNA, 20 bp, Artificial Sequence
  Description of Artificial Sequence: Synthetic oligonucleotide
  Target: SCN10A; (-) strand; PAM type: YTN; PAM sequence: CTC
tgccaaggttttacctcctc

SEQ ID NO: 51545 - DNA, 20 bp, Artificial Sequence
  Description of Artificial Sequence: Synthetic oligonucleotide
  Target: SCN10A; (-) strand; PAM type: YTN; PAM sequence: CTC
agggctctgccaaggtttta

SEQ ID NO: 51546 - DNA, 20 bp, Artificial Sequence
  Description of Artificial Sequence: Synthetic oligonucleotide
  Target: SCN10A; (-) strand; PAM type: YTN; PAM sequence: TTC
ctcagggctctgccaaggtt

SEQ ID NO: 51547 - DNA, 20 bp, Artificial Sequence
  Description of Artificial Sequence: Synthetic oligonucleotide
  Target: SCN10A; (-) strand; PAM type: YTN; PAM sequence: CTC
attcctcagggctctgccaa

SEQ ID NO: 51548 - DNA, 20 bp, Artificial Sequence
  Description of Artificial Sequence: Synthetic oligonucleotide
  Target: SCN10A; (-) strand; PAM type: YTN; PAM sequence: CTC
acactcattcctcagggctc

SEQ ID NO: 51549 - DNA, 20 bp, Artificial Sequence
  Description of Artificial Sequence: Synthetic oligonucleotide
  Target: SCN10A; (-) strand; PAM type: YTN; PAM sequence: CTC
aactcacactcattcctcag

SEQ ID NO: 51550 - DNA, 20 bp, Artificial Sequence
  Description of Artificial Sequence: Synthetic oligonucleotide
  Target: SCN10A; (-) strand; PAM type: YTN; PAM sequence: TTA
ctcaactcacactcattcct

SEQ ID NO: 51551 - DNA, 20 bp, Artificial Sequence
  Description of Artificial Sequence: Synthetic oligonucleotide
  Target: SCN10A; (-) strand; PAM type: YTN; PAM sequence: TTT
actcaactcacactcattcc

SEQ ID NO: 51552 - DNA, 20 bp, Artificial Sequence
  Description of Artificial Sequence: Synthetic oligonucleotide
  Target: SCN10A; (-) strand; PAM type: YTN; PAM sequence: CTT
tactcaactcacactcattc

SEQ ID NO: 51553 - DNA, 20 bp, Artificial Sequence
  Description of Artificial Sequence: Synthetic oligonucleotide
  Target: SCN10A; (-) strand; PAM type: YTN; PAM sequence: CTC
tttactcaactcacactcat

SEQ ID NO: 51554 - DNA, 20 bp, Artificial Sequence
  Description of Artificial Sequence: Synthetic oligonucleotide
  Target: SCN10A; (-) strand; PAM type: YTN; PAM sequence: CTC
tctttactcaactcacactc

SEQ ID NO: 51555 - DNA, 20 bp, Artificial Sequence
  Description of Artificial Sequence: Synthetic oligonucleotide
  Target: SCN10A; (-) strand; PAM type: YTN; PAM sequence: CTC
ctctctttactcaactcaca

SEQ ID NO: 51556 - DNA, 20 bp, Artificial Sequence
  Description of Artificial Sequence: Synthetic oligonucleotide
  Target: SCN10A; (-) strand; PAM type: YTN; PAM sequence: TTC
ctcctctctttactcaactc

SEQ ID NO: 51557 - DNA, 20 bp, Artificial Sequence
  Description of Artificial Sequence: Synthetic oligonucleotide
  Target: SCN10A; (-) strand; PAM type: YTN; PAM sequence: CTT
cctcctctctttactcaact

SEQ ID NO: 51558 - DNA, 20 bp, Artificial Sequence
  Description of Artificial Sequence: Synthetic oligonucleotide
  Target: SCN10A; (-) strand; PAM type: YTN; PAM sequence: CTG
ggatatccttcctcctctct

SEQ ID NO: 51559 - DNA, 20 bp, Artificial Sequence
  Description of Artificial Sequence: Synthetic oligonucleotide
  Target: SCN10A; (-) strand; PAM type: YTN; PAM sequence: TTC
tgggatatccttcctcctct

SEQ ID NO: 51560 - DNA, 20 bp, Artificial Sequence
  Description of Artificial Sequence: Synthetic oligonucleotide
  Target: SCN10A; (-) strand; PAM type: YTN; PAM sequence: CTT
ctgggatatccttcctcctc

SEQ ID NO: 51561 - DNA, 20 bp, Artificial Sequence
  Description of Artificial Sequence: Synthetic oligonucleotide
  Target: SCN10A; (-) strand; PAM type: YTN; PAM sequence: TTC
ttctgggatatccttcctcc

SEQ ID NO: 51562 - DNA, 20 bp, Artificial Sequence
  Description of Artificial Sequence: Synthetic oligonucleotide
  Target: SCN10A; (-) strand; PAM type: YTN; PAM sequence: CTT
cttctgggatatccttcctc

SEQ ID NO: 51563 - DNA, 20 bp, Artificial Sequence
  Description of Artificial Sequence: Synthetic oligonucleotide
  Target: SCN10A; (-) strand; PAM type: YTN; PAM sequence: CTG
ccccttcttctgggatatcc

SEQ ID NO: 51564 - DNA, 20 bp, Artificial Sequence
  Description of Artificial Sequence: Synthetic oligonucleotide
  Target: SCN10A; (-) strand; PAM type: YTN; PAM sequence: CTG
tgctgccccttcttctggga

SEQ ID NO: 51565 - DNA, 20 bp, Artificial Sequence
  Description of Artificial Sequence: Synthetic oligonucleotide
  Target: SCN10A; (-) strand; PAM type: YTN; PAM sequence: CTA
ctgtgctgccccttcttctg

SEQ ID NO: 51566 - DNA, 20 bp, Artificial Sequence
  Description of Artificial Sequence: Synthetic oligonucleotide
  Target: SCN10A; (-) strand; PAM type: YTN; PAM sequence: TTC
tactgtgctgccccttcttc

SEQ ID NO: 51567 - DNA, 20 bp, Artificial Sequence
  Description of Artificial Sequence: Synthetic oligonucleotide
  Target: SCN10A; (-) strand; PAM type: YTN; PAM sequence: CTT
ctactgtgctgccccttctt

SEQ ID NO: 51568 - DNA, 20 bp, Artificial Sequence
  Description of Artificial Sequence: Synthetic oligonucleotide
  Target: SCN10A; (-) strand; PAM type: YTN; PAM sequence: CTC
ccagccttctactgtgctgc

SEQ ID NO: 51569 - DNA, 20 bp, Artificial Sequence
  Description of Artificial Sequence: Synthetic oligonucleotide
  Target: SCN10A; (-) strand; PAM type: YTN; PAM sequence: CTC
acctcccagccttctactgt

SEQ ID NO: 51570 - DNA, 20 bp, Artificial Sequence
  Description of Artificial Sequence: Synthetic oligonucleotide
  Target: SCN10A; (-) strand; PAM type: YTN; PAM sequence: TTG
ctcacctcccagccttctac

SEQ ID NO: 51571 - DNA, 20 bp, Artificial Sequence
  Description of Artificial Sequence: Synthetic oligonucleotide
  Target: SCN10A; (-) strand; PAM type: YTN; PAM sequence: CTC
cacaccattgctcacctccc

SEQ ID NO: 51572 - DNA, 20 bp, Artificial Sequence
  Description of Artificial Sequence: Synthetic oligonucleotide
  Target: SCN10A; (-) strand; PAM type: YTN; PAM sequence: CTG
caaatactccacaccattgc

SEQ ID NO: 51573 - DNA, 20 bp, Artificial Sequence
  Description of Artificial Sequence: Synthetic oligonucleotide
  Target: SCN10A; (-) strand; PAM type: YTN; PAM sequence: TTC
tgcaaatactccacaccatt

SEQ ID NO: 51574 - DNA, 20 bp, Artificial Sequence
  Description of Artificial Sequence: Synthetic oligonucleotide
  Target: SCN10A; (-) strand; PAM type: YTN; PAM sequence: CTA
cggttctgcaaatactccac

SEQ ID NO: 51575 - DNA, 20 bp, Artificial Sequence
  Description of Artificial Sequence: Synthetic oligonucleotide
  Target: SCN10A; (-) strand; PAM type: YTN; PAM sequence: CTG
gaatccacctacggttctgc

SEQ ID NO: 51576 - DNA, 20 bp, Artificial Sequence
  Description of Artificial Sequence: Synthetic oligonucleotide
  Target: SCN10A; (-) strand; PAM type: YTN; PAM sequence: CTC
tggaatccacctacggttct

SEQ ID NO: 51577 - DNA, 20 bp, Artificial Sequence
  Description of Artificial Sequence: Synthetic oligonucleotide
  Target: SCN10A; (-) strand; PAM type: YTN; PAM sequence: CTC
accatgctctggaatccacc

SEQ ID NO: 51578 - DNA, 20 bp, Artificial Sequence
  Description of Artificial Sequence: Synthetic oligonucleotide
  Target: SCN10A; (-) strand; PAM type: YTN; PAM sequence: CTC
acatctcaccatgctctgga

SEQ ID NO: 51579 - DNA, 20 bp, Artificial Sequence
  Description of Artificial Sequence: Synthetic oligonucleotide
  Target: SCN10A; (-) strand; PAM type: YTN; PAM sequence: CTC
ctcacatctcaccatgctct

SEQ ID NO: 51580 - DNA, 20 bp, Artificial Sequence
  Description of Artificial Sequence: Synthetic oligonucleotide
  Target: SCN10A; (-) strand; PAM type: YTN; PAM sequence: CTC
tcctcacatctcaccatgct

SEQ ID NO: 51581 - DNA, 20 bp, Artificial Sequence
  Description of Artificial Sequence: Synthetic oligonucleotide
  Target: SCN10A; (-) strand; PAM type: YTN; PAM sequence: CTC
acctctcctcacatctcacc

SEQ ID NO: 51582 - DNA, 20 bp, Artificial Sequence
  Description of Artificial Sequence: Synthetic oligonucleotide
  Target: SCN10A; (-) strand; PAM type: YTN; PAM sequence: CTC
tcacctctcctcacatctca

SEQ ID NO: 51583 - DNA, 20 bp, Artificial Sequence
  Description of Artificial Sequence: Synthetic oligonucleotide
  Target: SCN10A; (-) strand; PAM type: YTN; PAM sequence: CTC
atctctcacctctcctcaca

SEQ ID NO: 51584 - DNA, 20 bp, Artificial Sequence
  Description of Artificial Sequence: Synthetic oligonucleotide
  Target: SCN10A; (-) strand; PAM type: YTN; PAM sequence: CTG
cctcatctctcacctctcct

SEQ ID NO: 51585 - DNA, 20 bp, Artificial Sequence
  Description of Artificial Sequence: Synthetic oligonucleotide
  Target: SCN10A; (-) strand; PAM type: YTN; PAM sequence: TTC
tgcctcatctctcacctctc

SEQ ID NO: 51586 - DNA, 20 bp, Artificial Sequence
  Description of Artificial Sequence: Synthetic oligonucleotide
  Target: SCN10A; (-) strand; PAM type: YTN; PAM sequence: CTT
ctgcctcatctctcacctct

SEQ ID NO: 51587 - DNA, 20 bp, Artificial Sequence
  Description of Artificial Sequence: Synthetic oligonucleotide
  Target: SCN10A; (-) strand; PAM type: YTN; PAM sequence: CTC
ttctgcctcatctctcacct

SEQ ID NO: 51588 - DNA, 20 bp, Artificial Sequence
  Description of Artificial Sequence: Synthetic oligonucleotide
  Target: SCN10A; (-) strand; PAM type: YTN; PAM sequence: CTG
tctcttctgcctcatctctc

SEQ ID NO: 51589 - DNA, 20 bp, Artificial Sequence
  Description of Artificial Sequence: Synthetic oligonucleotide
  Target: SCN10A; (-) strand; PAM type: YTN; PAM sequence: CTG
tccatactgtctcttctgcc

SEQ ID NO: 51590 - DNA, 20 bp, Artificial Sequence
  Description of Artificial Sequence: Synthetic oligonucleotide
  Target: SCN10A; (-) strand; PAM type: YTN; PAM sequence: CTG
gtctgtccatactgtctctt

SEQ ID NO: 51591 - DNA, 20 bp, Artificial Sequence
  Description of Artificial Sequence: Synthetic oligonucleotide
  Target: SCN10A; (-) strand; PAM type: YTN; PAM sequence: TTG
caagacctggtctgtccata

SEQ ID NO: 51592 - DNA, 20 bp, Artificial Sequence
  Description of Artificial Sequence: Synthetic oligonucleotide
  Target: SCN10A; (-) strand; PAM type: YTN; PAM sequence: TTT
gcaagacctggtctgtccat

SEQ ID NO: 51593 - DNA, 20 bp, Artificial Sequence
  Description of Artificial Sequence: Synthetic oligonucleotide
  Target: SCN10A; (-) strand; PAM type: YTN; PAM sequence: TTA
tttgcaagacctggtctgtc

SEQ ID NO: 51594 - DNA, 20 bp, Artificial Sequence
  Description of Artificial Sequence: Synthetic oligonucleotide
  Target: SCN10A; (-) strand; PAM type: YTN; PAM sequence: CTT
atttgcaagacctggtctgt

SEQ ID NO: 51595 - DNA, 20 bp, Artificial Sequence
  Description of Artificial Sequence: Synthetic oligonucleotide
  Target: SCN10A; (-) strand; PAM type: YTN; PAM sequence: CTG
agtcttatttgcaagacctg

SEQ ID NO: 51596 - DNA, 20 bp, Artificial Sequence
  Description of Artificial Sequence: Synthetic oligonucleotide
  Target: SCN10A; (-) strand; PAM type: YTN; PAM sequence: CTG
ggaagaccctgagtcttatt

SEQ ID NO: 51597 - DNA, 20 bp, Artificial Sequence
  Description of Artificial Sequence: Synthetic oligonucleotide
  Target: SCN10A; (-) strand; PAM type: YTN; PAM sequence: CTC
aactgggaagaccctgagtc

SEQ ID NO: 51598 - DNA, 20 bp, Artificial Sequence
  Description of Artificial Sequence: Synthetic oligonucleotide
  Target: SCN10A; (-) strand; PAM type: YTN; PAM sequence: CTC
tcaactgggaagaccctgag

SEQ ID NO: 51599 - DNA, 20 bp, Artificial Sequence
  Description of Artificial Sequence: Synthetic oligonucleotide
  Target: SCN10A; (-) strand; PAM type: YTN; PAM sequence: TTA
ctctcaactgggaagaccct

SEQ ID NO: 51600 - DNA, 20 bp, Artificial Sequence
  Description of Artificial Sequence: Synthetic oligonucleotide
  Target: SCN10A; (-) strand; PAM type: YTN; PAM sequence: CTT
actctcaactgggaagaccc

SEQ ID NO: 51601 - DNA, 20 bp, Artificial Sequence
  Description of Artificial Sequence: Synthetic oligonucleotide
  Target: SCN10A; (-) strand; PAM type: YTN; PAM sequence: CTC
acttactctcaactgggaag

SEQ ID NO: 51602 - DNA, 20 bp, Artificial Sequence
  Description of Artificial Sequence: Synthetic oligonucleotide
  Target: SCN10A; (-) strand; PAM type: YTN; PAM sequence: CTC
tcacttactctcaactggga

SEQ ID NO: 51603 - DNA, 20 bp, Artificial Sequence
  Description of Artificial Sequence: Synthetic oligonucleotide
  Target: SCN10A; (-) strand; PAM type: YTN; PAM sequence: CTC
tctcacttactctcaactgg

SEQ ID NO: 51604 - DNA, 20 bp, Artificial Sequence
  Description of Artificial Sequence: Synthetic oligonucleotide
  Target: SCN10A; (-) strand; PAM type: YTN; PAM sequence: TTC
atatctctctcacttactct

SEQ ID NO: 51605 - DNA, 20 bp, Artificial Sequence
  Description of Artificial Sequence: Synthetic oligonucleotide
  Target: SCN10A; (-) strand; PAM type: YTN; PAM sequence: CTT
catatctctctcacttactc

SEQ ID NO: 51606 - DNA, 20 bp, Artificial Sequence
  Description of Artificial Sequence: Synthetic oligonucleotide
  Target: SCN10A; (-) strand; PAM type: YTN; PAM sequence: CTG
ccccttcatatctctctcac

SEQ ID NO: 51607 - DNA, 20 bp, Artificial Sequence
  Description of Artificial Sequence: Synthetic oligonucleotide
  Target: SCN10A; (-) strand; PAM type: YTN; PAM sequence: CTG
gtcctgccccttcatatctc

SEQ ID NO: 51608 - DNA, 20 bp, Artificial Sequence
  Description of Artificial Sequence: Synthetic oligonucleotide
  Target: SCN10A; (-) strand; PAM type: YTN; PAM sequence: TTG
aagagagccctggtcctgcc

SEQ ID NO: 51609 - DNA, 20 bp, Artificial Sequence
  Description of Artificial Sequence: Synthetic oligonucleotide
  Target: SCN10A; (-) strand; PAM type: YTN; PAM sequence: CTT
gaagagagccctggtcctgc

SEQ ID NO: 51610 - DNA, 20 bp, Artificial Sequence
  Description of Artificial Sequence: Synthetic oligonucleotide
  Target: SCN10A; (-) strand; PAM type: YTN; PAM sequence: CTC
ttgaagagagccctggtcct

SEQ ID NO: 51611 - DNA, 20 bp, Artificial Sequence
  Description of Artificial Sequence: Synthetic oligonucleotide
  Target: SCN10A; (-) strand; PAM type: YTN; PAM sequence: CTG
gacacacctcttgaagagag

SEQ ID NO: 51612 - DNA, 20 bp, Artificial Sequence
  Description of Artificial Sequence: Synthetic oligonucleotide
  Target: SCN10A; (-) strand; PAM type: YTN; PAM sequence: TTC
ccactggacacacctcttga

SEQ ID NO: 51613 - DNA, 20 bp, Artificial Sequence
  Description of Artificial Sequence: Synthetic oligonucleotide
  Target: SCN10A; (-) strand; PAM type: YTN; PAM sequence: CTG
ccaattcccactggacacac

SEQ ID NO: 51614 - DNA, 20 bp, Artificial Sequence
  Description of Artificial Sequence: Synthetic oligonucleotide
  Target: SCN10A; (-) strand; PAM type: YTN; PAM sequence: CTC
tgccaattcccactggacac

SEQ ID NO: 51615 - DNA, 20 bp, Artificial Sequence
  Description of Artificial Sequence: Synthetic oligonucleotide
  Target: SCN10A; (-) strand; PAM type: YTN; PAM sequence: CTC
tctgccaattcccactggac

SEQ ID NO: 51616 - DNA, 20 bp, Artificial Sequence
  Description of Artificial Sequence: Synthetic oligonucleotide
  Target: SCN10A; (-) strand; PAM type: YTN; PAM sequence: CTG
cagggaaagataggaaactc

SEQ ID NO: 51617 - DNA, 20 bp, Artificial Sequence
  Description of Artificial Sequence: Synthetic oligonucleotide
  Target: SCN10A; (-) strand; PAM type: YTN; PAM sequence: CTC
tgcagggaaagataggaaac

SEQ ID NO: 51618 - DNA, 20 bp, Artificial Sequence
  Description of Artificial Sequence: Synthetic oligonucleotide
  Target: SCN10A; (-) strand; PAM type: YTN; PAM sequence: CTG
gctctgcagggaaagatagg

SEQ ID NO: 51619 - DNA, 20 bp, Artificial Sequence
  Description of Artificial Sequence: Synthetic oligonucleotide
  Target: SCN10A; (-) strand; PAM type: YTN; PAM sequence: TTG
tctggctctgcagggaaaga

SEQ ID NO: 51620 - DNA, 20 bp, Artificial Sequence
  Description of Artificial Sequence: Synthetic oligonucleotide
  Target: SCN10A; (-) strand; PAM type: YTN; PAM sequence: CTT
gtctggctctgcagggaaag

SEQ ID NO: 51621 - DNA, 20 bp, Artificial Sequence
  Description of Artificial Sequence: Synthetic oligonucleotide
  Target: SCN10A; (-) strand; PAM type: YTN; PAM sequence: TTC
ttgtctggctctgcagggaa

SEQ ID NO: 51622 - DNA, 20 bp, Artificial Sequence
  Description of Artificial Sequence: Synthetic oligonucleotide
  Target: SCN10A; (-) strand; PAM type: YTN; PAM sequence: TTT
cttgtctggctctgcaggga

SEQ ID NO: 51623 - DNA, 20 bp, Artificial Sequence
  Description of Artificial Sequence: Synthetic oligonucleotide
  Target: SCN10A; (-) strand; PAM type: YTN; PAM sequence: CTA
ccatttcttgtctggctctg

SEQ ID NO: 51624 - DNA, 20 bp, Artificial Sequence
  Description of Artificial Sequence: Synthetic oligonucleotide
  Target: SCN10A; (-) strand; PAM type: YTN; PAM sequence: TTC
taccatttcttgtctggctc

SEQ ID NO: 51625 - DNA, 20 bp, Artificial Sequence
  Description of Artificial Sequence: Synthetic oligonucleotide
  Target: SCN10A; (-) strand; PAM type: YTN; PAM sequence: TTT
ctaccatttcttgtctggct

SEQ ID NO: 51626 - DNA, 20 bp, Artificial Sequence
  Description of Artificial Sequence: Synthetic oligonucleotide
  Target: SCN10A; (-) strand; PAM type: YTN; PAM sequence: TTT
tctaccatttcttgtctggc

SEQ ID NO: 51627 - DNA, 20 bp, Artificial Sequence
  Description of Artificial Sequence: Synthetic oligonucleotide
  Target: SCN10A; (-) strand; PAM type: YTN; PAM sequence: CTT
ttctaccatttcttgtctgg

SEQ ID NO: 51628 - DNA, 20 bp, Artificial Sequence
  Description of Artificial Sequence: Synthetic oligonucleotide
  Target: SCN10A; (-) strand; PAM type: YTN; PAM sequence: CTA
gagtggaagtcttttctacc

SEQ ID NO: 51629 - DNA, 20 bp, Artificial Sequence
  Description of Artificial Sequence: Synthetic oligonucleotide
  Target: SCN10A; (-) strand; PAM type: YTN; PAM sequence: TTC
tagagtggaagtcttttcta

SEQ ID NO: 51630 - DNA, 20 bp, Artificial Sequence
  Description of Artificial Sequence: Synthetic oligonucleotide
  Target: SCN10A; (-) strand; PAM type: YTN; PAM sequence: CTG
taaacagaaacacccattct

SEQ ID NO: 51631 - DNA, 20 bp, Artificial Sequence
  Description of Artificial Sequence: Synthetic oligonucleotide
  Target: SCN10A; (-) strand; PAM type: YTN; PAM sequence: TTA
tctgtaaacagaaacaccca

SEQ ID NO: 51632 - DNA, 20 bp, Artificial Sequence
  Description of Artificial Sequence: Synthetic oligonucleotide
  Target: SCN10A; (-) strand; PAM type: YTN; PAM sequence: CTT
atctgtaaacagaaacaccc

SEQ ID NO: 51633 - DNA, 20 bp, Artificial Sequence
  Description of Artificial Sequence: Synthetic oligonucleotide
  Target: SCN10A; (-) strand; PAM type: YTN; PAM sequence: CTC
ttatctgtaaacagaaacac

SEQ ID NO: 51634 - DNA, 20 bp, Artificial Sequence
  Description of Artificial Sequence: Synthetic oligonucleotide
  Target: SCN10A; (-) strand; PAM type: YTN; PAM sequence: TTC
tcttatctgtaaacagaaac

SEQ ID NO: 51635 - DNA, 20 bp, Artificial Sequence
  Description of Artificial Sequence: Synthetic oligonucleotide
  Target: SCN10A; (-) strand; PAM type: YTN; PAM sequence: TTC
gttctcttatctgtaaacag

SEQ ID NO: 51636 - DNA, 20 bp, Artificial Sequence
  Description of Artificial Sequence: Synthetic oligonucleotide
  Target: SCN10A; (-) strand; PAM type: YTN; PAM sequence: CTC
accccaagaattcgttctct

SEQ ID NO: 51637 - DNA, 20 bp, Artificial Sequence
  Description of Artificial Sequence: Synthetic oligonucleotide
  Target: SCN10A; (-) strand; PAM type: YTN; PAM sequence: CTC
tcaccccaagaattcgttct

SEQ ID NO: 51638 - DNA, 20 bp, Artificial Sequence
  Description of Artificial Sequence: Synthetic oligonucleotide
  Target: SCN10A; (-) strand; PAM type: YTN; PAM sequence: CTC
ctctcaccccaagaattcgt

SEQ ID NO: 51639 - DNA, 20 bp, Artificial Sequence
  Description of Artificial Sequence: Synthetic oligonucleotide
  Target: SCN10A; (-) strand; PAM type: YTN; PAM sequence: CTC
tcctctcaccccaagaattc

SEQ ID NO: 51640 - DNA, 20 bp, Artificial Sequence
  Description of Artificial Sequence: Synthetic oligonucleotide
  Target: SCN10A; (-) strand; PAM type: YTN; PAM sequence: TTC
tctcctctcaccccaagaat

SEQ ID NO: 51641 - DNA, 20 bp, Artificial Sequence
  Description of Artificial Sequence: Synthetic oligonucleotide
  Target: SCN10A; (-) strand; PAM type: YTN; PAM sequence: CTG
ataggttctctcctctcacc

SEQ ID NO: 51642 - DNA, 20 bp, Artificial Sequence
  Description of Artificial Sequence: Synthetic oligonucleotide
  Target: SCN10A; (-) strand; PAM type: YTN; PAM sequence: CTG
tggcctgataggttctctcc

SEQ ID NO: 51643 - DNA, 20 bp, Artificial Sequence
  Description of Artificial Sequence: Synthetic oligonucleotide
  Target: SCN10A; (-) strand; PAM type: YTN; PAM sequence: CTC
tgtggcctgataggttctct

SEQ ID NO: 51644 - DNA, 20 bp, Artificial Sequence
  Description of Artificial Sequence: Synthetic oligonucleotide
  Target: SCN10A; (-) strand; PAM type: YTN; PAM sequence: TTC
ccctctgtggcctgataggt

SEQ ID NO: 51645 - DNA, 20 bp, Artificial Sequence
  Description of Artificial Sequence: Synthetic oligonucleotide
  Target: SCN10A; (-) strand; PAM type: YTN; PAM sequence: CTT
cccctctgtggcctgatagg

SEQ ID NO: 51646 - DNA, 20 bp, Artificial Sequence
  Description of Artificial Sequence: Synthetic oligonucleotide
  Target: SCN10A; (-) strand; PAM type: YTN; PAM sequence: TTG
atgcttcccctctgtggcct

SEQ ID NO: 51647 - DNA, 20 bp, Artificial Sequence
  Description of Artificial Sequence: Synthetic oligonucleotide
  Target: SCN10A; (-) strand; PAM type: YTN; PAM sequence: CTT
gatgcttcccctctgtggcc

SEQ ID NO: 51648 - DNA, 20 bp, Artificial Sequence
  Description of Artificial Sequence: Synthetic oligonucleotide
  Target: SCN10A; (-) strand; PAM type: YTN; PAM sequence: CTG
aaatgggacttgatgcttcc

SEQ ID NO: 51649 - DNA, 20 bp, Artificial Sequence
  Description of Artificial Sequence: Synthetic oligonucleotide
  Target: SCN10A; (-) strand; PAM type: YTN; PAM sequence: TTC
tgaaatgggacttgatgctt

SEQ ID NO: 51650 - DNA, 20 bp, Artificial Sequence
  Description of Artificial Sequence: Synthetic oligonucleotide
  Target: SCN10A; (-) strand; PAM type: YTN; PAM sequence: TTT
ctgaaatgggacttgatgct

SEQ ID NO: 51651 - DNA, 20 bp, Artificial Sequence
  Description of Artificial Sequence: Synthetic oligonucleotide
  Target: SCN10A; (-) strand; PAM type: YTN; PAM sequence: CTT
tctgaaatgggacttgatgc

SEQ ID NO: 51652 - DNA, 20 bp, Artificial Sequence
  Description of Artificial Sequence: Synthetic oligonucleotide
  Target: SCN10A; (-) strand; PAM type: YTN; PAM sequence: TTG
atggtgaggatggggaggcc

SEQ ID NO: 51653 - DNA, 20 bp, Artificial Sequence
  Description of Artificial Sequence: Synthetic oligonucleotide
  Target: SCN10A; (-) strand; PAM type: YTN; PAM sequence: TTC
agcccccatgaggttgatgg

SEQ ID NO: 51654 - DNA, 20 bp, Artificial Sequence
  Description of Artificial Sequence: Synthetic oligonucleotide
  Target: SCN10A; (-) strand; PAM type: YTN; PAM sequence: CTT
cagcccccatgaggttgatg

SEQ ID NO: 51655 - DNA, 20 bp, Artificial Sequence
  Description of Artificial Sequence: Synthetic oligonucleotide
  Target: SCN10A; (-) strand; PAM type: YTN; PAM sequence: CTC
ttcagcccccatgaggttga

SEQ ID NO: 51656 - DNA, 20 bp, Artificial Sequence
  Description of Artificial Sequence: Synthetic oligonucleotide
  Target: SCN10A; (-) strand; PAM type: YTN; PAM sequence: CTA
ctcttcagcccccatgaggt

SEQ ID NO: 51657 - DNA, 20 bp, Artificial Sequence
  Description of Artificial Sequence: Synthetic oligonucleotide
  Target: SCN10A; (-) strand; PAM type: YTN; PAM sequence: CTG
tcaccagtagcccagcgact

SEQ ID NO: 51658 - DNA, 20 bp, Artificial Sequence
  Description of Artificial Sequence: Synthetic oligonucleotide
  Target: SCN10A; (-) strand; PAM type: YTN; PAM sequence: CTC
cactgtcaccagtagcccag

SEQ ID NO: 51659 - DNA, 20 bp, Artificial Sequence
  Description of Artificial Sequence: Synthetic oligonucleotide
  Target: SCN10A; (-) strand; PAM type: YTN; PAM sequence: CTA
agatctccactgtcaccagt

SEQ ID NO: 51660 - DNA, 20 bp, Artificial Sequence
  Description of Artificial Sequence: Synthetic oligonucleotide
  Target: SCN10A; (-) strand; PAM type: YTN; PAM sequence: CTC
taagatctccactgtcacca

SEQ ID NO: 51661 - DNA, 20 bp, Artificial Sequence
  Description of Artificial Sequence: Synthetic oligonucleotide
  Target: SCN10A; (-) strand; PAM type: YTN; PAM sequence: TTG
tgtggggcctctaagatctc

SEQ ID NO: 51662 - DNA, 20 bp, Artificial Sequence
  Description of Artificial Sequence: Synthetic oligonucleotide
  Target: SCN10A; (-) strand; PAM type: YTN; PAM sequence: CTC
attgtgtggggcctctaaga

SEQ ID NO: 51663 - DNA, 20 bp, Artificial Sequence
  Description of Artificial Sequence: Synthetic oligonucleotide
  Target: SCN10A; (-) strand; PAM type: YTN; PAM sequence: TTC
agaaacaaaagtagtccatc

SEQ ID NO: 51664 - DNA, 20 bp, Artificial Sequence
  Description of Artificial Sequence: Synthetic oligonucleotide
  Target: SCN10A; (-) strand; PAM type: YTN; PAM sequence: CTG
agaattcagaaacaaaagta

SEQ ID NO: 51665 - DNA, 20 bp, Artificial Sequence
  Description of Artificial Sequence: Synthetic oligonucleotide
  Target: SCN10A; (-) strand; PAM type: YTN; PAM sequence: TTA
ctgagaattcagaaacaaaa

SEQ ID NO: 51666 - DNA, 20 bp, Artificial Sequence
  Description of Artificial Sequence: Synthetic oligonucleotide
  Target: SCN10A; (-) strand; PAM type: YTN; PAM sequence: TTG
attactgagaattcagaaac

SEQ ID NO: 51667 - DNA, 20 bp, Artificial Sequence
  Description of Artificial Sequence: Synthetic oligonucleotide
  Target: SCN10A; (-) strand; PAM type: YTN; PAM sequence: CTT
gattactgagaattcagaaa

SEQ ID NO: 51668 - DNA, 20 bp, Artificial Sequence
  Description of Artificial Sequence: Synthetic oligonucleotide
  Target: SCN10A; (-) strand; PAM type: YTN; PAM sequence: TTC
ttgattactgagaattcaga

SEQ ID NO: 51669 - DNA, 20 bp, Artificial Sequence
  Description of Artificial Sequence: Synthetic oligonucleotide
  Target: SCN10A; (-) strand; PAM type: YTN; PAM sequence: TTA
ggcaattcttgattactgag

SEQ ID NO: 51670 - DNA, 20 bp, Artificial Sequence
  Description of Artificial Sequence: Synthetic oligonucleotide
  Target: SCN10A; (-) strand; PAM type: YTN; PAM sequence: TTA
gacacccagaggaaaaaaga

SEQ ID NO: 51671 - DNA, 20 bp, Artificial Sequence
  Description of Artificial Sequence: Synthetic oligonucleotide
  Target: SCN10A; (-) strand; PAM type: YTN; PAM sequence: TTT
agacacccagaggaaaaaag

SEQ ID NO: 51672 - DNA, 20 bp, Artificial Sequence
  Description of Artificial Sequence: Synthetic oligonucleotide
  Target: SCN10A; (-) strand; PAM type: YTN; PAM sequence: CTT
tagacacccagaggaaaaaa

SEQ ID NO: 51673 - DNA, 20 bp, Artificial Sequence
  Description of Artificial Sequence: Synthetic oligonucleotide
  Target: SCN10A; (-) strand; PAM type: YTN; PAM sequence: CTG
tctttagacacccagaggaa

SEQ ID NO: 51674 - DNA, 20 bp, Artificial Sequence
  Description of Artificial Sequence: Synthetic oligonucleotide
  Target: SCN10A; (-) strand; PAM type: YTN; PAM sequence: CTA
aaatcctgtctttagacacc

SEQ ID NO: 51675 - DNA, 20 bp, Artificial Sequence
  Description of Artificial Sequence: Synthetic oligonucleotide
  Target: SCN10A; (-) strand; PAM type: YTN; PAM sequence: TTC
cgtaggtctaaaatcctgtc

SEQ ID NO: 51676 - DNA, 20 bp, Artificial Sequence
  Description of Artificial Sequence: Synthetic oligonucleotide
  Target: SCN10A; (-) strand; PAM type: YTN; PAM sequence: TTT
ccgtaggtctaaaatcctgt

SEQ ID NO: 51677 - DNA, 20 bp, Artificial Sequence
  Description of Artificial Sequence: Synthetic oligonucleotide
  Target: SCN10A; (-) strand; PAM type: YTN; PAM sequence: CTG
tttccgtaggtctaaaatcc

SEQ ID NO: 51678 - DNA, 20 bp, Artificial Sequence
  Description of Artificial Sequence: Synthetic oligonucleotide
  Target: SCN10A; (-) strand; PAM type: YTN; PAM sequence: TTC
actgtttccgtaggtctaaa

SEQ ID NO: 51679 - DNA, 20 bp, Artificial Sequence
  Description of Artificial Sequence: Synthetic oligonucleotide
  Target: SCN10A; (-) strand; PAM type: YTN; PAM sequence: CTT
cactgtttccgtaggtctaa

SEQ ID NO: 51680 - DNA, 20 bp, Artificial Sequence
  Description of Artificial Sequence: Synthetic oligonucleotide
  Target: SCN10A; (-) strand; PAM type: YTN; PAM sequence: TTG
gaaatggggaggaagggaga

SEQ ID NO: 51681 - DNA, 20 bp, Artificial Sequence
  Description of Artificial Sequence: Synthetic oligonucleotide
  Target: SCN10A; (-) strand; PAM type: YTN; PAM sequence: CTT
ggaaatggggaggaagggag

SEQ ID NO: 51682 - DNA, 20 bp, Artificial Sequence
  Description of Artificial Sequence: Synthetic oligonucleotide
  Target: SCN10A; (-) strand; PAM type: YTN; PAM sequence: TTA
aacttggaaatggggaggaa

SEQ ID NO: 51683 - DNA, 20 bp, Artificial Sequence
  Description of Artificial Sequence: Synthetic oligonucleotide
  Target: SCN10A; (-) strand; PAM type: YTN; PAM sequence: CTA
aaggattaaacttggaaatg

SEQ ID NO: 51684 - DNA, 20 bp, Artificial Sequence
  Description of Artificial Sequence: Synthetic oligonucleotide
  Target: SCN10A; (-) strand; PAM type: YTN; PAM sequence: TTA
aactaaaggattaaacttgg

SEQ ID NO: 51685 - DNA, 20 bp, Artificial Sequence
  Description of Artificial Sequence: Synthetic oligonucleotide
  Target: SCN10A; (-) strand; PAM type: YTN; PAM sequence: CTT
aaactaaaggattaaacttg

SEQ ID NO: 51686 - DNA, 20 bp, Artificial Sequence
  Description of Artificial Sequence: Synthetic oligonucleotide
  Target: SCN10A; (-) strand; PAM type: YTN; PAM sequence: TTA
taccttaaactaaaggatta

SEQ ID NO: 51687 - DNA, 20 bp, Artificial Sequence
  Description of Artificial Sequence: Synthetic oligonucleotide
  Target: SCN10A; (-) strand; PAM type: YTN; PAM sequence: TTT
ataccttaaactaaaggatt

SEQ ID NO: 51688 - DNA, 20 bp, Artificial Sequence
  Description of Artificial Sequence: Synthetic oligonucleotide
  Target: SCN10A; (-) strand; PAM type: YTN; PAM sequence: TTA
tttataccttaaactaaagg

SEQ ID NO: 51689 - DNA, 20 bp, Artificial Sequence
  Description of Artificial Sequence: Synthetic oligonucleotide
  Target: SCN10A; (-) strand; PAM type: YTN; PAM sequence: TTT
atttataccttaaactaaag

SEQ ID NO: 51690 - DNA, 20 bp, Artificial Sequence
  Description of Artificial Sequence: Synthetic oligonucleotide
  Target: SCN10A; (-) strand; PAM type: YTN; PAM sequence: TTT
tatttataccttaaactaaa

SEQ ID NO: 51691 - DNA, 20 bp, Artificial Sequence
  Description of Artificial Sequence: Synthetic oligonucleotide
  Target: SCN10A; (-) strand; PAM type: YTN; PAM sequence: TTT
ttatttataccttaaactaa

SEQ ID NO: 51692 - DNA, 20 bp, Artificial Sequence
  Description of Artificial Sequence: Synthetic oligonucleotide
  Target: SCN10A; (-) strand; PAM type: YTN; PAM sequence: TTG
aatttttatttataccttaa

SEQ ID NO: 51693 - DNA, 20 bp, Artificial Sequence
  Description of Artificial Sequence: Synthetic oligonucleotide
  Target: SCN10A; (-) strand; PAM type: YTN; PAM sequence: CTC
agttgaatttttatttatac

SEQ ID NO: 51694 - DNA, 20 bp, Artificial Sequence
  Description of Artificial Sequence: Synthetic oligonucleotide
  Target: SCN10A; (-) strand; PAM type: YTN; PAM sequence: TTC
aggcaagacccctcagttga

SEQ ID NO: 51695 - DNA, 20 bp, Artificial Sequence
  Description of Artificial Sequence: Synthetic oligonucleotide
  Target: SCN10A; (-) strand; PAM type: YTN; PAM sequence: TTG
tgggattcaggcaagacccc

SEQ ID NO: 51696 - DNA, 20 bp, Artificial Sequence
  Description of Artificial Sequence: Synthetic oligonucleotide
  Target: SCN10A; (-) strand; PAM type: YTN; PAM sequence: CTG
gttgtgggattcaggcaaga

SEQ ID NO: 51697 - DNA, 20 bp, Artificial Sequence
  Description of Artificial Sequence: Synthetic oligonucleotide
  Target: SCN10A; (-) strand; PAM type: YTN; PAM sequence: TTC
tggttgtgggattcaggcaa

SEQ ID NO: 51698 - DNA, 20 bp, Artificial Sequence
  Description of Artificial Sequence: Synthetic oligonucleotide
  Target: SCN10A; (-) strand; PAM type: YTN; PAM sequence: CTG
ttctggttgtgggattcagg

SEQ ID NO: 51699 - DNA, 20 bp, Artificial Sequence
  Description of Artificial Sequence: Synthetic oligonucleotide
  Target: SCN10A; (-) strand; PAM type: YTN; PAM sequence: TTC
tgttctggttgtgggattca

SEQ ID NO: 51700 - DNA, 20 bp, Artificial Sequence
  Description of Artificial Sequence: Synthetic oligonucleotide
  Target: SCN10A; (-) strand; PAM type: YTN; PAM sequence: TTT
ctgttctggttgtgggattc

SEQ ID NO: 51701 - DNA, 20 bp, Artificial Sequence
  Description of Artificial Sequence: Synthetic oligonucleotide
  Target: SCN10A; (-) strand; PAM type: YTN; PAM sequence: CTT
tctgttctggttgtgggatt

SEQ ID NO: 51702 - DNA, 20 bp, Artificial Sequence
  Description of Artificial Sequence: Synthetic oligonucleotide
  Target: SCN10A; (-) strand; PAM type: YTN; PAM sequence: TTC
actttctgttctggttgtgg

SEQ ID NO: 51703 - DNA, 20 bp, Artificial Sequence
  Description of Artificial Sequence: Synthetic oligonucleotide
  Target: SCN10A; (-) strand; PAM type: YTN; PAM sequence: CTT
cactttctgttctggttgtg

SEQ ID NO: 51704 - DNA, 20 bp, Artificial Sequence
  Description of Artificial Sequence: Synthetic oligonucleotide
  Target: SCN10A; (-) strand; PAM type: YTN; PAM sequence: CTC
acaatcaatacgtaacagga

SEQ ID NO: 51705 - DNA, 20 bp, Artificial Sequence
  Description of Artificial Sequence: Synthetic oligonucleotide
  Target: SCN10A; (-) strand; PAM type: YTN; PAM sequence: TTC
ccacataccacatggcctca

SEQ ID NO: 51706 - DNA, 20 bp, Artificial Sequence
  Description of Artificial Sequence: Synthetic oligonucleotide
  Target: SCN10A; (-) strand; PAM type: YTN; PAM sequence: CTT
cccacataccacatggcctc

SEQ ID NO: 51707 - DNA, 20 bp, Artificial Sequence
  Description of Artificial Sequence: Synthetic oligonucleotide
  Target: SCN10A; (-) strand; PAM type: YTN; PAM sequence: CTC
ttcccacataccacatggcc

SEQ ID NO: 51708 - DNA, 20 bp, Artificial Sequence
  Description of Artificial Sequence: Synthetic oligonucleotide
  Target: SCN10A; (-) strand; PAM type: YTN; PAM sequence: CTA
ggccagtgctcttcccacat

SEQ ID NO: 51709 - DNA, 20 bp, Artificial Sequence
  Description of Artificial Sequence: Synthetic oligonucleotide
  Target: SCN10A; (-) strand; PAM type: YTN; PAM sequence: CTC
ctaggccagtgctcttccca

SEQ ID NO: 51710 - DNA, 20 bp, Artificial Sequence
  Description of Artificial Sequence: Synthetic oligonucleotide
  Target: SCN10A; (-) strand; PAM type: YTN; PAM sequence: TTG
tcccaactcctaggccagtg

SEQ ID NO: 51711 - DNA, 20 bp, Artificial Sequence
  Description of Artificial Sequence: Synthetic oligonucleotide
  Target: SCN10A; (-) strand; PAM type: YTN; PAM sequence: CTA
ttgtcccaactcctaggcca

SEQ ID NO: 51712 - DNA, 20 bp, Artificial Sequence
  Description of Artificial Sequence: Synthetic oligonucleotide
  Target: SCN10A; (-) strand; PAM type: YTN; PAM sequence: CTG
gaagcctattgtcccaactc

SEQ ID NO: 51713 - DNA, 20 bp, Artificial Sequence
  Description of Artificial Sequence: Synthetic oligonucleotide
  Target: SCN10A; (-) strand; PAM type: YTN; PAM sequence: CTA
gtaagagacagtgtgacctg

SEQ ID NO: 51714 - DNA, 20 bp, Artificial Sequence
  Description of Artificial Sequence: Synthetic oligonucleotide
  Target: SCN10A; (-) strand; PAM type: YTN; PAM sequence: TTC
actagtaagagacagtgtga

SEQ ID NO: 51715 - DNA, 20 bp, Artificial Sequence
  Description of Artificial Sequence: Synthetic oligonucleotide
  Target: SCN10A; (-) strand; PAM type: YTN; PAM sequence: CTT
cactagtaagagacagtgtg

SEQ ID NO: 51716 - DNA, 20 bp, Artificial Sequence
  Description of Artificial Sequence: Synthetic oligonucleotide
  Target: SCN10A; (-) strand; PAM type: YTN; PAM sequence: CTC
ttcactagtaagagacagtg

SEQ ID NO: 51717 - DNA, 20 bp, Artificial Sequence
  Description of Artificial Sequence: Synthetic oligonucleotide
  Target: SCN10A; (-) strand; PAM type: YTN; PAM sequence: CTG
gagtataggaaacataaacc

SEQ ID NO: 51718 - DNA, 20 bp, Artificial Sequence
  Description of Artificial Sequence: Synthetic oligonucleotide
  Target: SCN10A; (-) strand; PAM type: YTN; PAM sequence: CTG
aggcctggagtataggaaac

SEQ ID NO: 51719 - DNA, 20 bp, Artificial Sequence
  Description of Artificial Sequence: Synthetic oligonucleotide
  Target: SCN10A; (-) strand; PAM type: YTN; PAM sequence: TTA
caagacaaaggaactgaggc

SEQ ID NO: 51720 - DNA, 20 bp, Artificial Sequence
  Description of Artificial Sequence: Synthetic oligonucleotide
  Target: SCN10A; (-) strand; PAM type: YTN; PAM sequence: CTT
acaagacaaaggaactgagg

SEQ ID NO: 51721 - DNA, 20 bp, Artificial Sequence
  Description of Artificial Sequence: Synthetic oligonucleotide
  Target: SCN10A; (-) strand; PAM type: YTN; PAM sequence: TTG
tccccacttacaagacaaag

SEQ ID NO: 51722 - DNA, 20 bp, Artificial Sequence
  Description of Artificial Sequence: Synthetic oligonucleotide
  Target: SCN10A; (-) strand; PAM type: YTN; PAM sequence: CTA
ttgtccccacttacaagaca

SEQ ID NO: 51723 - DNA, 20 bp, Artificial Sequence
  Description of Artificial Sequence: Synthetic oligonucleotide
  Target: SCN10A; (-) strand; PAM type: YTN; PAM sequence: TTC
cagggcaaagactattgtcc

SEQ ID NO: 51724 - DNA, 20 bp, Artificial Sequence
  Description of Artificial Sequence: Synthetic oligonucleotide
  Target: SCN10A; (-) strand; PAM type: YTN; PAM sequence: CTG
taaggttccagggcaaagac

SEQ ID NO: 51725 - DNA, 20 bp, Artificial Sequence
  Description of Artificial Sequence: Synthetic oligonucleotide
  Target: SCN10A; (-) strand; PAM type: YTN; PAM sequence: TTC
acaagaaccctgtaaggttc

SEQ ID NO: 51726 - DNA, 20 bp, Artificial Sequence
  Description of Artificial Sequence: Synthetic oligonucleotide
  Target: SCN10A; (-) strand; PAM type: YTN; PAM sequence: TTT
cacaagaaccctgtaaggtt

SEQ ID NO: 51727 - DNA, 20 bp, Artificial Sequence
  Description of Artificial Sequence: Synthetic oligonucleotide
  Target: SCN10A; (-) strand; PAM type: YTN; PAM sequence: TTT
tcacaagaaccctgtaaggt

SEQ ID NO: 51728 - DNA, 20 bp, Artificial Sequence
  Description of Artificial Sequence: Synthetic oligonucleotide
  Target: SCN10A; (-) strand; PAM type: YTN; PAM sequence: CTA
attttcacaagaaccctgta

SEQ ID NO: 51729 - DNA, 20 bp, Artificial Sequence
  Description of Artificial Sequence: Synthetic oligonucleotide
  Target: SCN10A; (-) strand; PAM type: YTN; PAM sequence: CTC
taattttcacaagaaccctg

SEQ ID NO: 51730 - DNA, 20 bp, Artificial Sequence
  Description of Artificial Sequence: Synthetic oligonucleotide
  Target: SCN10A; (-) strand; PAM type: YTN; PAM sequence: TTC
tctaattttcacaagaaccc

SEQ ID NO: 51731 - DNA, 20 bp, Artificial Sequence
  Description of Artificial Sequence: Synthetic oligonucleotide
  Target: SCN10A; (-) strand; PAM type: YTN; PAM sequence: CTT
ctctaattttcacaagaacc

SEQ ID NO: 51732 - DNA, 20 bp, Artificial Sequence
  Description of Artificial Sequence: Synthetic oligonucleotide
  Target: SCN10A; (-) strand; PAM type: YTN; PAM sequence: CTC
ccttctctaattttcacaag

SEQ ID NO: 51733 - DNA, 20 bp, Artificial Sequence
  Description of Artificial Sequence: Synthetic oligonucleotide
  Target: SCN10A; (-) strand; PAM type: YTN; PAM sequence: CTA
actcccttctctaattttca

SEQ ID NO: 51734 - DNA, 20 bp, Artificial Sequence
  Description of Artificial Sequence: Synthetic oligonucleotide
  Target: SCN10A; (-) strand; PAM type: YTN; PAM sequence: TTC
acagcctaactcccttctct

SEQ ID NO: 51735 - DNA, 20 bp, Artificial Sequence
  Description of Artificial Sequence: Synthetic oligonucleotide
  Target: SCN10A; (-) strand; PAM type: YTN; PAM sequence: TTT
cacagcctaactcccttctc

SEQ ID NO: 51736 - DNA, 20 bp, Artificial Sequence
  Description of Artificial Sequence: Synthetic oligonucleotide
  Target: SCN10A; (-) strand; PAM type: YTN; PAM sequence: TTT
tcacagcctaactcccttct

SEQ ID NO: 51737 - DNA, 20 bp, Artificial Sequence
  Description of Artificial Sequence: Synthetic oligonucleotide
  Target: SCN10A; (-) strand; PAM type: YTN; PAM sequence: TTG
gttttcacagcctaactccc

SEQ ID NO: 51738 - DNA, 20 bp, Artificial Sequence
  Description of Artificial Sequence: Synthetic oligonucleotide
  Target: SCN10A; (-) strand; PAM type: YTN; PAM sequence: TTC
acagagcatatgttggtttt

SEQ ID NO: 51739 - DNA, 20 bp, Artificial Sequence
  Description of Artificial Sequence: Synthetic oligonucleotide
  Target: SCN10A; (-) strand; PAM type: YTN; PAM sequence: TTA
ttcacagagcatatgttggt

SEQ ID NO: 51740 - DNA, 20 bp, Artificial Sequence
  Description of Artificial Sequence: Synthetic oligonucleotide
  Target: SCN10A; (-) strand; PAM type: YTN; PAM sequence: TTT
attcacagagcatatgttgg

SEQ ID NO: 51741 - DNA, 20 bp, Artificial Sequence
  Description of Artificial Sequence: Synthetic oligonucleotide
  Target: SCN10A; (-) strand; PAM type: YTN; PAM sequence: CTG
tgatcccaggtgagcattta

SEQ ID NO: 51742 - DNA, 20 bp, Artificial Sequence
  Description of Artificial Sequence: Synthetic oligonucleotide
  Target: SCN10A; (-) strand; PAM type: YTN; PAM sequence: TTC
tgtgatcccaggtgagcatt

SEQ ID NO: 51743 - DNA, 20 bp, Artificial Sequence
  Description of Artificial Sequence: Synthetic oligonucleotide
  Target: SCN10A; (-) strand; PAM type: YTN; PAM sequence: TTT
ctgtgatcccaggtgagcat

SEQ ID NO: 51744 - DNA, 20 bp, Artificial Sequence
  Description of Artificial Sequence: Synthetic oligonucleotide
  Target: SCN10A; (-) strand; PAM type: YTN; PAM sequence: TTA
aaaacagtttctgtgatccc

SEQ ID NO: 51745 - DNA, 20 bp, Artificial Sequence
  Description of Artificial Sequence: Synthetic oligonucleotide
  Target: SCN10A; (-) strand; PAM type: YTN; PAM sequence: TTA
gagcattaaaaacagtttct

SEQ ID NO: 51746 - DNA, 20 bp, Artificial Sequence
  Description of Artificial Sequence: Synthetic oligonucleotide
  Target: SCN10A; (-) strand; PAM type: YTN; PAM sequence: CTT
agagcattaaaaacagtttc

SEQ ID NO: 51747 - DNA, 20 bp, Artificial Sequence
  Description of Artificial Sequence: Synthetic oligonucleotide
  Target: SCN10A; (-) strand; PAM type: YTN; PAM sequence: TTC
ttagagcattaaaaacagtt

SEQ ID NO: 51748 - DNA, 20 bp, Artificial Sequence
  Description of Artificial Sequence: Synthetic oligonucleotide
  Target: SCN10A; (-) strand; PAM type: YTN; PAM sequence: TTC
agagttcttagagcattaaa

SEQ ID NO: 51749 - DNA, 20 bp, Artificial Sequence
  Description of Artificial Sequence: Synthetic oligonucleotide
  Target: SCN10A; (-) strand; PAM type: YTN; PAM sequence: CTG
cggacattcagagttcttag

SEQ ID NO: 51750 - DNA, 20 bp, Artificial Sequence
  Description of Artificial Sequence: Synthetic oligonucleotide
  Target: SCN10A; (-) strand; PAM type: YTN; PAM sequence: CTC
aggcctgcggacattcagag

SEQ ID NO: 51751 - DNA, 20 bp, Artificial Sequence
  Description of Artificial Sequence: Synthetic oligonucleotide
  Target: SCN10A; (-) strand; PAM type: YTN; PAM sequence: CTC
cgtgggatctcaggcctgcg

SEQ ID NO: 51752 - DNA, 20 bp, Artificial Sequence
  Description of Artificial Sequence: Synthetic oligonucleotide
  Target: SCN10A; (-) strand; PAM type: YTN; PAM sequence: TTG
gcacagcaatagatctccgt

SEQ ID NO: 51753 - DNA, 20 bp, Artificial Sequence
  Description of Artificial Sequence: Synthetic oligonucleotide
  Target: SCN10A; (-) strand; PAM type: YTN; PAM sequence: CTA
cagatatgttggcacagcaa

SEQ ID NO: 51754 - DNA, 20 bp, Artificial Sequence
  Description of Artificial Sequence: Synthetic oligonucleotide
  Target: SCN10A; (-) strand; PAM type: YTN; PAM sequence: CTG
gtcctacagatatgttggca

SEQ ID NO: 51755 - DNA, 20 bp, Artificial Sequence
  Description of Artificial Sequence: Synthetic oligonucleotide
  Target: SCN10A; (-) strand; PAM type: YTN; PAM sequence: TTC
tggtcctacagatatgttgg

SEQ ID NO: 51756 - DNA, 20 bp, Artificial Sequence
  Description of Artificial Sequence: Synthetic oligonucleotide
  Target: SCN10A; (-) strand; PAM type: YTN; PAM sequence: CTT
ctggtcctacagatatgttg

SEQ ID NO: 51757 - DNA, 20 bp, Artificial Sequence
  Description of Artificial Sequence: Synthetic oligonucleotide
  Target: SCN10A; (-) strand; PAM type: YTN; PAM sequence: CTA
acttctggtcctacagatat

SEQ ID NO: 51758 - DNA, 20 bp, Artificial Sequence
  Description of Artificial Sequence: Synthetic oligonucleotide
  Target: SCN10A; (-) strand; PAM type: YTN; PAM sequence: CTG
actaacttctggtcctacag

SEQ ID NO: 51759 - DNA, 20 bp, Artificial Sequence
  Description of Artificial Sequence: Synthetic oligonucleotide
  Target: SCN10A; (-) strand; PAM type: YTN; PAM sequence: TTG
cagagatgctgactaacttc

SEQ ID NO: 51760 - DNA, 20 bp, Artificial Sequence
  Description of Artificial Sequence: Synthetic oligonucleotide
  Target: SCN10A; (-) strand; PAM type: YTN; PAM sequence: CTT
gcagagatgctgactaactt

SEQ ID NO: 51761 - DNA, 20 bp, Artificial Sequence
  Description of Artificial Sequence: Synthetic oligonucleotide
  Target: SCN10A; (-) strand; PAM type: YTN; PAM sequence: TTG
cttgcagagatgctgactaa

SEQ ID NO: 51762 - DNA, 20 bp, Artificial Sequence
  Description of Artificial Sequence: Synthetic oligonucleotide
  Target: SCN10A; (-) strand; PAM type: YTN; PAM sequence: CTT
gcttgcagagatgctgacta

SEQ ID NO: 51763 - DNA, 20 bp, Artificial Sequence
  Description of Artificial Sequence: Synthetic oligonucleotide
  Target: SCN10A; (-) strand; PAM type: YTN; PAM sequence: CTG
catgcatccccaggaccctt

SEQ ID NO: 51764 - DNA, 20 bp, Artificial Sequence
  Description of Artificial Sequence: Synthetic oligonucleotide
  Target: SCN10A; (-) strand; PAM type: YTN; PAM sequence: TTA
tgctgcatgcatccccagga

SEQ ID NO: 51765 - DNA, 20 bp, Artificial Sequence
  Description of Artificial Sequence: Synthetic oligonucleotide
  Target: SCN10A; (-) strand; PAM type: YTN; PAM sequence: TTT
atgctgcatgcatccccagg

SEQ ID NO: 51766 - DNA, 20 bp, Artificial Sequence
  Description of Artificial Sequence: Synthetic oligonucleotide
  Target: SCN10A; (-) strand; PAM type: YTN; PAM sequence: TTA
tttatgctgcatgcatcccc

SEQ ID NO: 51767 - DNA, 20 bp, Artificial Sequence
  Description of Artificial Sequence: Synthetic oligonucleotide
  Target: SCN10A; (-) strand; PAM type: YTN; PAM sequence: CTT
atttatgctgcatgcatccc

SEQ ID NO: 51768 - DNA, 20 bp, Artificial Sequence
  Description of Artificial Sequence: Synthetic oligonucleotide
  Target: SCN10A; (-) strand; PAM type: YTN; PAM sequence: TTA
tccttatttatgctgcatgc

SEQ ID NO: 51769 - DNA, 20 bp, Artificial Sequence
  Description of Artificial Sequence: Synthetic oligonucleotide
  Target: SCN10A; (-) strand; PAM type: YTN; PAM sequence: CTA
atgataccccaggttatcct

SEQ ID NO: 51770 - DNA, 20 bp, Artificial Sequence
  Description of Artificial Sequence: Synthetic oligonucleotide
  Target: SCN10A; (-) strand; PAM type: YTN; PAM sequence: CTA
ggctaatgataccccaggtt

SEQ ID NO: 51771 - DNA, 20 bp, Artificial Sequence
  Description of Artificial Sequence: Synthetic oligonucleotide
  Target: SCN10A; (-) strand; PAM type: YTN; PAM sequence: TTC
taggctaatgataccccagg

SEQ ID NO: 51772 - DNA, 20 bp, Artificial Sequence
  Description of Artificial Sequence: Synthetic oligonucleotide
  Target: SCN10A; (-) strand; PAM type: YTN; PAM sequence: TTT
ctaggctaatgataccccag

SEQ ID NO: 51773 - DNA, 20 bp, Artificial Sequence
  Description of Artificial Sequence: Synthetic oligonucleotide
  Target: SCN10A; (-) strand; PAM type: YTN; PAM sequence: CTT
tctaggctaatgatacccca

SEQ ID NO: 51774 - DNA, 20 bp, Artificial Sequence
  Description of Artificial Sequence: Synthetic oligonucleotide
  Target: SCN10A; (-) strand; PAM type: YTN; PAM sequence: CTG
catcctttctaggctaatga

SEQ ID NO: 51775 - DNA, 20 bp, Artificial Sequence
  Description of Artificial Sequence: Synthetic oligonucleotide
  Target: SCN10A; (-) strand; PAM type: YTN; PAM sequence: TTC
tgcatcctttctaggctaat

SEQ ID NO: 51776 - DNA, 20 bp, Artificial Sequence
  Description of Artificial Sequence: Synthetic oligonucleotide
  Target: SCN10A; (-) strand; PAM type: YTN; PAM sequence: CTA
agtgtccattctgcatcctt

SEQ ID NO: 51777 - DNA, 20 bp, Artificial Sequence
  Description of Artificial Sequence: Synthetic oligonucleotide
  Target: SCN10A; (-) strand; PAM type: YTN; PAM sequence: TTC
taagtgtccattctgcatcc

SEQ ID NO: 51778 - DNA, 20 bp, Artificial Sequence
  Description of Artificial Sequence: Synthetic oligonucleotide
  Target: SCN10A; (-) strand; PAM type: YTN; PAM sequence: CTA
gattctaagtgtccattctg

SEQ ID NO: 51779 - DNA, 20 bp, Artificial Sequence
  Description of Artificial Sequence: Synthetic oligonucleotide
  Target: SCN10A; (-) strand; PAM type: YTN; PAM sequence: CTA
tagatggcagtgtcactaga

SEQ ID NO: 51780 - DNA, 20 bp, Artificial Sequence
  Description of Artificial Sequence: Synthetic oligonucleotide
  Target: SCN10A; (-) strand; PAM type: YTN; PAM sequence: TTG
caataatgaaatcagtgtca

SEQ ID NO: 51781 - DNA, 20 bp, Artificial Sequence
  Description of Artificial Sequence: Synthetic oligonucleotide
  Target: SCN10A; (-) strand; PAM type: YTN; PAM sequence: CTG
aaagatgttgcaataatgaa

SEQ ID NO: 51782 - DNA, 20 bp, Artificial Sequence
  Description of Artificial Sequence: Synthetic oligonucleotide
  Target: SCN10A; (-) strand; PAM type: YTN; PAM sequence: CTC
tgaaagatgttgcaataatg

SEQ ID NO: 51783 - DNA, 20 bp, Artificial Sequence
  Description of Artificial Sequence: Synthetic oligonucleotide
  Target: SCN10A; (-) strand; PAM type: YTN; PAM sequence: CTC
aaagggtccactctgaaaga

SEQ ID NO: 51784 - DNA, 20 bp, Artificial Sequence
  Description of Artificial Sequence: Synthetic oligonucleotide
  Target: SCN10A; (-) strand; PAM type: YTN; PAM sequence: TTC
tcaaagggtccactctgaaa

SEQ ID NO: 51785 - DNA, 20 bp, Artificial Sequence
  Description of Artificial Sequence: Synthetic oligonucleotide
  Target: SCN10A; (-) strand; PAM type: YTN; PAM sequence: CTT
ctcaaagggtccactctgaa

SEQ ID NO: 51786 - DNA, 20 bp, Artificial Sequence
  Description of Artificial Sequence: Synthetic oligonucleotide
  Target: SCN10A; (-) strand; PAM type: YTN; PAM sequence: CTA
gatcacaatgcatcttctca

SEQ ID NO: 51787 - DNA, 20 bp, Artificial Sequence
  Description of Artificial Sequence: Synthetic oligonucleotide
  Target: SCN10A; (-) strand; PAM type: YTN; PAM sequence: TTG
cctagatcacaatgcatctt

SEQ ID NO: 51788 - DNA, 20 bp, Artificial Sequence
  Description of Artificial Sequence: Synthetic oligonucleotide
  Target: SCN10A; (-) strand; PAM type: YTN; PAM sequence: TTG
aagatccgtccacatgcagt

SEQ ID NO: 51789 - DNA, 20 bp, Artificial Sequence
  Description of Artificial Sequence: Synthetic oligonucleotide
  Target: SCN10A; (-) strand; PAM type: YTN; PAM sequence: TTT
gaagatccgtccacatgcag

SEQ ID NO: 51790 - DNA, 20 bp, Artificial Sequence
  Description of Artificial Sequence: Synthetic oligonucleotide
  Target: SCN10A; (-) strand; PAM type: YTN; PAM sequence: CTG
tgtttgaagatccgtccaca

SEQ ID NO: 51791 - DNA, 20 bp, Artificial Sequence
  Description of Artificial Sequence: Synthetic oligonucleotide
  Target: SCN10A; (-) strand; PAM type: YTN; PAM sequence: CTC
ctgtgtttgaagatccgtcc

SEQ ID NO: 51792 - DNA, 20 bp, Artificial Sequence
  Description of Artificial Sequence: Synthetic oligonucleotide
  Target: SCN10A; (-) strand; PAM type: YTN; PAM sequence: TTG
gtcaaactcctgtgtttgaa

SEQ ID NO: 51793 - DNA, 20 bp, Artificial Sequence
  Description of Artificial Sequence: Synthetic oligonucleotide
  Target: SCN10A; (-) strand; PAM type: YTN; PAM sequence: CTG
gttggtcaaactcctgtgtt

SEQ ID NO: 51794 - DNA, 20 bp, Artificial Sequence
  Description of Artificial Sequence: Synthetic oligonucleotide
  Target: SCN10A; (-) strand; PAM type: YTN; PAM sequence: CTG
aggagactggttggtcaaac

SEQ ID NO: 51795 - DNA, 20 bp, Artificial Sequence
  Description of Artificial Sequence: Synthetic oligonucleotide
  Target: SCN10A; (-) strand; PAM type: YTN; PAM sequence: CTG
agaaatcagtgtctgaggag

SEQ ID NO: 51796 - DNA, 20 bp, Artificial Sequence
  Description of Artificial Sequence: Synthetic oligonucleotide
  Target: SCN10A; (-) strand; PAM type: YTN; PAM sequence: TTC
tgagaaatcagtgtctgagg

SEQ ID NO: 51797 - DNA, 20 bp, Artificial Sequence
  Description of Artificial Sequence: Synthetic oligonucleotide
  Target: SCN10A; (-) strand; PAM type: YTN; PAM sequence: CTT
ctgagaaatcagtgtctgag

SEQ ID NO: 51798 - DNA, 20 bp, Artificial Sequence
  Description of Artificial Sequence: Synthetic oligonucleotide
  Target: SCN10A; (-) strand; PAM type: YTN; PAM sequence: CTC
cttctgagaaatcagtgtct

SEQ ID NO: 51799 - DNA, 20 bp, Artificial Sequence
  Description of Artificial Sequence: Synthetic oligonucleotide
  Target: SCN10A; (-) strand; PAM type: YTN; PAM sequence: CTG
acatggcggtctccttctga

SEQ ID NO: 51800 - DNA, 20 bp, Artificial Sequence
  Description of Artificial Sequence: Synthetic oligonucleotide
  Target: SCN10A; (-) strand; PAM type: YTN; PAM sequence: TTG
tacccccctgacatggcggt

SEQ ID NO: 51801 - DNA, 20 bp, Artificial Sequence
  Description of Artificial Sequence: Synthetic oligonucleotide
  Target: SCN10A; (-) strand; PAM type: YTN; PAM sequence: CTT
gtacccccctgacatggcgg

SEQ ID NO: 51802 - DNA, 20 bp, Artificial Sequence
  Description of Artificial Sequence: Synthetic oligonucleotide
  Target: SCN10A; (-) strand; PAM type: YTN; PAM sequence: CTG
tcacagtggatcagaaaagg

SEQ ID NO: 51803 - DNA, 20 bp, Artificial Sequence
  Description of Artificial Sequence: Synthetic oligonucleotide
  Target: SCN10A; (-) strand; PAM type: YTN; PAM sequence: TTA
gcctgtcacagtggatcaga

SEQ ID NO: 51804 - DNA, 20 bp, Artificial Sequence
  Description of Artificial Sequence: Synthetic oligonucleotide
  Target: SCN10A; (-) strand; PAM type: YTN; PAM sequence: CTG
agataacagttagcctgtca

SEQ ID NO: 51805 - DNA, 20 bp, Artificial Sequence
  Description of Artificial Sequence: Synthetic oligonucleotide
  Target: SCN10A; (-) strand; PAM type: YTN; PAM sequence: CTC
aaatctgagataacagttag

SEQ ID NO: 51806 - DNA, 20 bp, Artificial Sequence
  Description of Artificial Sequence: Synthetic oligonucleotide
  Target: SCN10A; (-) strand; PAM type: YTN; PAM sequence: TTA
gtcccatgcccatgaggaga

SEQ ID NO: 51807 - DNA, 20 bp, Artificial Sequence
  Description of Artificial Sequence: Synthetic oligonucleotide
  Target: SCN10A; (-) strand; PAM type: YTN; PAM sequence: TTC
caagattagtcccatgccca

SEQ ID NO: 51808 - DNA, 20 bp, Artificial Sequence
  Description of Artificial Sequence: Synthetic oligonucleotide
  Target: SCN10A; (-) strand; PAM type: YTN; PAM sequence: TTT
ccaagattagtcccatgccc

SEQ ID NO: 51809 - DNA, 20 bp, Artificial Sequence
  Description of Artificial Sequence: Synthetic oligonucleotide
  Target: SCN10A; (-) strand; PAM type: YTN; PAM sequence: CTT
tccaagattagtcccatgcc

SEQ ID NO: 51810 - DNA, 20 bp, Artificial Sequence
  Description of Artificial Sequence: Synthetic oligonucleotide
  Target: SCN10A; (-) strand; PAM type: YTN; PAM sequence: TTG
ctttccaagattagtcccat

SEQ ID NO: 51811 - DNA, 20 bp, Artificial Sequence
  Description of Artificial Sequence: Synthetic oligonucleotide
  Target: SCN10A; (-) strand; PAM type: YTN; PAM sequence: TTC
gggggttgctttccaagatt

SEQ ID NO: 51812 - DNA, 20 bp, Artificial Sequence
  Description of Artificial Sequence: Synthetic oligonucleotide
  Target: SCN10A; (-) strand; PAM type: YTN; PAM sequence: CTT
cgggggttgctttccaagat

SEQ ID NO: 51813 - DNA, 20 bp, Artificial Sequence
  Description of Artificial Sequence: Synthetic oligonucleotide
  Target: SCN10A; (-) strand; PAM type: YTN; PAM sequence: TTG
ccacagagtaccgcttcggg

SEQ ID NO: 51814 - DNA, 20 bp, Artificial Sequence
  Description of Artificial Sequence: Synthetic oligonucleotide
  Target: SCN10A; (-) strand; PAM type: YTN; PAM sequence: CTT
gccacagagtaccgcttcgg

SEQ ID NO: 51815 - DNA, 20 bp, Artificial Sequence
  Description of Artificial Sequence: Synthetic oligonucleotide
  Target: SCN10A; (-) strand; PAM type: YTN; PAM sequence: TTC
ttgccacagagtaccgcttc

SEQ ID NO: 51816 - DNA, 20 bp, Artificial Sequence
  Description of Artificial Sequence: Synthetic oligonucleotide
  Target: SCN10A; (-) strand; PAM type: YTN; PAM sequence: CTG
gggttcttgccacagagtac

SEQ ID NO: 51817 - DNA, 20 bp, Artificial Sequence
  Description of Artificial Sequence: Synthetic oligonucleotide
  Target: SCN10A; (-) strand; PAM type: YTN; PAM sequence: TTG
tatggcctggggttcttgcc

SEQ ID NO: 51818 - DNA, 20 bp, Artificial Sequence
  Description of Artificial Sequence: Synthetic oligonucleotide
  Target: SCN10A; (-) strand; PAM type: YTN; PAM sequence: TTG
gaattgtatggcctggggtt

SEQ ID NO: 51819 - DNA, 20 bp, Artificial Sequence
  Description of Artificial Sequence: Synthetic oligonucleotide
  Target: SCN10A; (-) strand; PAM type: YTN; PAM sequence: TTT
ggaattgtatggcctggggt

SEQ ID NO: 51820 - DNA, 20 bp, Artificial Sequence
  Description of Artificial Sequence: Synthetic oligonucleotide
  Target: SCN10A; (-) strand; PAM type: YTN; PAM sequence: CTC
atttggaattgtatggcctg

SEQ ID NO: 51821 - DNA, 20 bp, Artificial Sequence
  Description of Artificial Sequence: Synthetic oligonucleotide
  Target: SCN10A; (-) strand; PAM type: YTN; PAM sequence: TTC
ctcatttggaattgtatggc

SEQ ID NO: 51822 - DNA, 20 bp, Artificial Sequence
  Description of Artificial Sequence: Synthetic oligonucleotide
  Target: SCN10A; (-) strand; PAM type: YTN; PAM sequence: CTT
cctcatttggaattgtatgg

SEQ ID NO: 51823 - DNA, 20 bp, Artificial Sequence
  Description of Artificial Sequence: Synthetic oligonucleotide
  Target: SCN10A; (-) strand; PAM type: YTN; PAM sequence: TTC
agcttcctcatttggaattg

SEQ ID NO: 51824 - DNA, 20 bp, Artificial Sequence
  Description of Artificial Sequence: Synthetic oligonucleotide
  Target: SCN10A; (-) strand; PAM type: YTN; PAM sequence: CTC
agttcagcttcctcatttgg

SEQ ID NO: 51825 - DNA, 20 bp, Artificial Sequence
  Description of Artificial Sequence: Synthetic oligonucleotide
  Target: SCN10A; (-) strand; PAM type: YTN; PAM sequence: TTC
atctcagttcagcttcctca

SEQ ID NO: 51826 - DNA, 20 bp, Artificial Sequence
  Description of Artificial Sequence: Synthetic oligonucleotide
  Target: SCN10A; (-) strand; PAM type: YTN; PAM sequence: CTT
catctcagttcagcttcctc

SEQ ID NO: 51827 - DNA, 20 bp, Artificial Sequence
  Description of Artificial Sequence: Synthetic oligonucleotide
  Target: SCN10A; (-) strand; PAM type: YTN; PAM sequence: TTC
ttcatctcagttcagcttcc

SEQ ID NO: 51828 - DNA, 20 bp, Artificial Sequence
  Description of Artificial Sequence: Synthetic oligonucleotide
  Target: SCN10A; (-) strand; PAM type: YTN; PAM sequence: CTG
aagaaggttcttcatctcag

SEQ ID NO: 51829 - DNA, 20 bp, Artificial Sequence
  Description of Artificial Sequence: Synthetic oligonucleotide
  Target: SCN10A; (-) strand; PAM type: YTN; PAM sequence: CTC
tgaagaaggttcttcatctc

SEQ ID NO: 51830 - DNA, 20 bp, Artificial Sequence
  Description of Artificial Sequence: Synthetic oligonucleotide
  Target: SCN10A; (-) strand; PAM type: YTN; PAM sequence: CTC
acactctgaagaaggttctt

SEQ ID NO: 51831 - DNA, 20 bp, Artificial Sequence
  Description of Artificial Sequence: Synthetic oligonucleotide
  Target: SCN10A; (-) strand; PAM type: YTN; PAM sequence: TTA
tgggtgtatccaggctcaca

SEQ ID NO: 51832 - DNA, 20 bp, Artificial Sequence
  Description of Artificial Sequence: Synthetic oligonucleotide
  Target: SCN10A; (-) strand; PAM type: YTN; PAM sequence: CTT
atgggtgtatccaggctcac

SEQ ID NO: 51833 - DNA, 20 bp, Artificial Sequence
  Description of Artificial Sequence: Synthetic oligonucleotide
  Target: SCN10A; (-) strand; PAM type: YTN; PAM sequence: TTG
catgggtgtccatgtggggc

SEQ ID NO: 51834 - DNA, 20 bp, Artificial Sequence
  Description of Artificial Sequence: Synthetic oligonucleotide
  Target: SCN10A; (-) strand; PAM type: YTN; PAM sequence: TTT
gcatgggtgtccatgtgggg

SEQ ID NO: 51835 - DNA, 20 bp, Artificial Sequence
  Description of Artificial Sequence: Synthetic oligonucleotide
  Target: SCN10A; (-) strand; PAM type: YTN; PAM sequence: TTG
aaataaaataaaataaaaag

SEQ ID NO: 51836 - DNA, 20 bp, Artificial Sequence
  Description of Artificial Sequence: Synthetic oligonucleotide
  Target: SCN10A; (-) strand; PAM type: YTN; PAM sequence: CTA
ttgaaataaaataaaataaa

SEQ ID NO: 51837 - DNA, 20 bp, Artificial Sequence
  Description of Artificial Sequence: Synthetic oligonucleotide
  Target: SCN10A; (-) strand; PAM type: YTN; PAM sequence: CTC
aaaactattgaaataaaata

SEQ ID NO: 51838 - DNA, 20 bp, Artificial Sequence
  Description of Artificial Sequence: Synthetic oligonucleotide
  Target: SCN10A; (-) strand; PAM type: YTN; PAM sequence: TTC
cctcaaaactattgaaataa

SEQ ID NO: 51839 - DNA, 20 bp, Artificial Sequence
  Description of Artificial Sequence: Synthetic oligonucleotide
  Target: SCN10A; (-) strand; PAM type: YTN; PAM sequence: CTG
ttccctcaaaactattgaaa

SEQ ID NO: 51840 - DNA, 20 bp, Artificial Sequence
  Description of Artificial Sequence: Synthetic oligonucleotide
  Target: SCN10A; (-) strand; PAM type: YTN; PAM sequence: TTC
atgtaaccaaaaaccacctg

SEQ ID NO: 51841 - DNA, 20 bp, Artificial Sequence
  Description of Artificial Sequence: Synthetic oligonucleotide
  Target: SCN10A; (-) strand; PAM type: YTN; PAM sequence: TTA
ttcatgtaaccaaaaaccac

SEQ ID NO: 51842 - DNA, 20 bp, Artificial Sequence
  Description of Artificial Sequence: Synthetic oligonucleotide
  Target: SCN10A; (-) strand; PAM type: YTN; PAM sequence: CTT
attcatgtaaccaaaaacca

SEQ ID NO: 51843 - DNA, 20 bp, Artificial Sequence
  Description of Artificial Sequence: Synthetic oligonucleotide
  Target: SCN10A; (-) strand; PAM type: YTN; PAM sequence: TTG
aaatacaaataaagaactta

SEQ ID NO: 51844 - DNA, 20 bp, Artificial Sequence
  Description of Artificial Sequence: Synthetic oligonucleotide
  Target: SCN10A; (-) strand; PAM type: YTN; PAM sequence: CTA
ttgaaatacaaataaagaac

SEQ ID NO: 51845 - DNA, 20 bp, Artificial Sequence
  Description of Artificial Sequence: Synthetic oligonucleotide
  Target: SCN10A; (-) strand; PAM type: YTN; PAM sequence: TTC
ccaaaactattgaaatacaa

SEQ ID NO: 51846 - DNA, 20 bp, Artificial Sequence
  Description of Artificial Sequence: Synthetic oligonucleotide
  Target: SCN10A; (-) strand; PAM type: YTN; PAM sequence: TTT
cccaaaactattgaaataca

SEQ ID NO: 51847 - DNA, 20 bp, Artificial Sequence
  Description of Artificial Sequence: Synthetic oligonucleotide
  Target: SCN10A; (-) strand; PAM type: YTN; PAM sequence: CTG
tttcccaaaactattgaaat

SEQ ID NO: 51848 - DNA, 20 bp, Artificial Sequence
  Description of Artificial Sequence: Synthetic oligonucleotide
  Target: SCN10A; (-) strand; PAM type: YTN; PAM sequence: CTG
tgcaacccaacaccacctgt

SEQ ID NO: 51849 - DNA, 20 bp, Artificial Sequence
  Description of Artificial Sequence: Synthetic oligonucleotide
  Target: SCN10A; (-) strand; PAM type: YTN; PAM sequence: TTC
tgtgcaacccaacaccacct

SEQ ID NO: 51850 - DNA, 20 bp, Artificial Sequence
  Description of Artificial Sequence: Synthetic oligonucleotide
  Target: SCN10A; (-) strand; PAM type: YTN; PAM sequence: TTT
ctgtgcaacccaacaccacc

SEQ ID NO: 51851 - DNA, 20 bp, Artificial Sequence
  Description of Artificial Sequence: Synthetic oligonucleotide
  Target: SCN10A; (-) strand; PAM type: YTN; PAM sequence: TTT
tctgtgcaacccaacaccac

SEQ ID NO: 51852 - DNA, 20 bp, Artificial Sequence
  Description of Artificial Sequence: Synthetic oligonucleotide
  Target: SCN10A; (-) strand; PAM type: YTN; PAM sequence: TTT
ttctgtgcaacccaacacca

SEQ ID NO: 51853 - DNA, 20 bp, Artificial Sequence
  Description of Artificial Sequence: Synthetic oligonucleotide
  Target: SCN10A; (-) strand; PAM type: YTN; PAM sequence: TTA
aagaatttttctgtgcaacc

SEQ ID NO: 51854 - DNA, 20 bp, Artificial Sequence
  Description of Artificial Sequence: Synthetic oligonucleotide
  Target: SCN10A; (-) strand; PAM type: YTN; PAM sequence: CTC
agaaatcagcgttaaagaat

SEQ ID NO: 51855 - DNA, 20 bp, Artificial Sequence
  Description of Artificial Sequence: Synthetic oligonucleotide
  Target: SCN10A; (-) strand; PAM type: YTN; PAM sequence: CTC
gggtgatggtgcaccaaaat

SEQ ID NO: 51856 - DNA, 20 bp, Artificial Sequence
  Description of Artificial Sequence: Synthetic oligonucleotide
  Target: SCN10A; (-) strand; PAM type: YTN; PAM sequence: CTG
ctcgggtgatggtgcaccaa

SEQ ID NO: 51857 - DNA, 20 bp, Artificial Sequence
  Description of Artificial Sequence: Synthetic oligonucleotide
  Target: SCN10A; (-) strand; PAM type: YTN; PAM sequence: CTG
ggtacagtgtacactgctcg

SEQ ID NO: 51858 - DNA, 20 bp, Artificial Sequence
  Description of Artificial Sequence: Synthetic oligonucleotide
  Target: SCN10A; (-) strand; PAM type: YTN; PAM sequence: CTA
cacactgggtacagtgtaca

SEQ ID NO: 51859 - DNA, 20 bp, Artificial Sequence
  Description of Artificial Sequence: Synthetic oligonucleotide
  Target: SCN10A; (-) strand; PAM type: YTN; PAM sequence: TTG
ggaggaaaggtgagacgaag

SEQ ID NO: 51860 - DNA, 20 bp, Artificial Sequence
  Description of Artificial Sequence: Synthetic oligonucleotide
  Target: SCN10A; (-) strand; PAM type: YTN; PAM sequence: CTT
gggaggaaaggtgagacgaa

SEQ ID NO: 51861 - DNA, 20 bp, Artificial Sequence
  Description of Artificial Sequence: Synthetic oligonucleotide
  Target: SCN10A; (-) strand; PAM type: YTN; PAM sequence: TTG
gggacttgggaggaaaggtg

SEQ ID NO: 51862 - DNA, 20 bp, Artificial Sequence
  Description of Artificial Sequence: Synthetic oligonucleotide
  Target: SCN10A; (-) strand; PAM type: YTN; PAM sequence: TTT
ggggacttgggaggaaaggt

SEQ ID NO: 51863 - DNA, 20 bp, Artificial Sequence
  Description of Artificial Sequence: Synthetic oligonucleotide
  Target: SCN10A; (-) strand; PAM type: YTN; PAM sequence: CTT
tggggacttgggaggaaagg

SEQ ID NO: 51864 - DNA, 20 bp, Artificial Sequence
  Description of Artificial Sequence: Synthetic oligonucleotide
  Target: SCN10A; (-) strand; PAM type: YTN; PAM sequence: CTG
tgaggatgcaaaggcataac

SEQ ID NO: 51865 - DNA, 20 bp, Artificial Sequence
  Description of Artificial Sequence: Synthetic oligonucleotide
  Target: SCN10A; (-) strand; PAM type: YTN; PAM sequence: CTA
agctgtgaggatgcaaaggc

SEQ ID NO: 51866 - DNA, 20 bp, Artificial Sequence
  Description of Artificial Sequence: Synthetic oligonucleotide
  Target: SCN10A; (-) strand; PAM type: YTN; PAM sequence: TTA
caagcaggagctaagctgtg

SEQ ID NO: 51867 - DNA, 20 bp, Artificial Sequence
  Description of Artificial Sequence: Synthetic oligonucleotide
  Target: SCN10A; (-) strand; PAM type: YTN; PAM sequence: TTA
attacaagcaggagctaagc

SEQ ID NO: 51868 - DNA, 20 bp, Artificial Sequence
  Description of Artificial Sequence: Synthetic oligonucleotide
  Target: SCN10A; (-) strand; PAM type: YTN; PAM sequence: CTT
aattacaagcaggagctaag

SEQ ID NO: 51869 - DNA, 20 bp, Artificial Sequence
  Description of Artificial Sequence: Synthetic oligonucleotide
  Target: SCN10A; (-) strand; PAM type: YTN; PAM sequence: TTC
ttaattacaagcaggagcta

SEQ ID NO: 51870 - DNA, 20 bp, Artificial Sequence
  Description of Artificial Sequence: Synthetic oligonucleotide
  Target: SCN10A; (-) strand; PAM type: YTN; PAM sequence: CTC
aggaatagaaagtcaagcat

SEQ ID NO: 51871 - DNA, 20 bp, Artificial Sequence
  Description of Artificial Sequence: Synthetic oligonucleotide
  Target: SCN10A; (-) strand; PAM type: YTN; PAM sequence: CTA
aatgaagtaactcaggaata

SEQ ID NO: 51872 - DNA, 20 bp, Artificial Sequence
  Description of Artificial Sequence: Synthetic oligonucleotide
  Target: SCN10A; (-) strand; PAM type: YTN; PAM sequence: TTC
taaatgaagtaactcaggaa

SEQ ID NO: 51873 - DNA, 20 bp, Artificial Sequence
  Description of Artificial Sequence: Synthetic oligonucleotide
  Target: SCN10A; (-) strand; PAM type: YTN; PAM sequence: TTA
ttctaaatgaagtaactcag

SEQ ID NO: 51874 - DNA, 20 bp, Artificial Sequence
  Description of Artificial Sequence: Synthetic oligonucleotide
  Target: SCN10A; (-) strand; PAM type: YTN; PAM sequence: CTA
ttattctaaatgaagtaact

SEQ ID NO: 51875 - DNA, 20 bp, Artificial Sequence
  Description of Artificial Sequence: Synthetic oligonucleotide
  Target: SCN10A; (-) strand; PAM type: YTN; PAM sequence: TTG
gagactattattctaaatga

SEQ ID NO: 51876 - DNA, 20 bp, Artificial Sequence
  Description of Artificial Sequence: Synthetic oligonucleotide
  Target: SCN10A; (-) strand; PAM type: YTN; PAM sequence: CTG
gatggagttggagactatta

SEQ ID NO: 51877 - DNA, 20 bp, Artificial Sequence
  Description of Artificial Sequence: Synthetic oligonucleotide
  Target: SCN10A; (-) strand; PAM type: YTN; PAM sequence: TTG
gcagcaagctggatggagtt

SEQ ID NO: 51878 - DNA, 20 bp, Artificial Sequence
  Description of Artificial Sequence: Synthetic oligonucleotide
  Target: SCN10A; (-) strand; PAM type: YTN; PAM sequence: TTG
taaaaaggaatgaaataatg

SEQ ID NO: 51879 - DNA, 20 bp, Artificial Sequence
  Description of Artificial Sequence: Synthetic oligonucleotide
  Target: SCN10A; (-) strand; PAM type: YTN; PAM sequence: CTC
agttgtaaaaaggaatgaaa

SEQ ID NO: 51880 - DNA, 20 bp, Artificial Sequence
  Description of Artificial Sequence: Synthetic oligonucleotide
  Target: SCN10A; (-) strand; PAM type: YTN; PAM sequence: CTA
ctcagttgtaaaaaggaatg

SEQ ID NO: 51881 - DNA, 20 bp, Artificial Sequence
  Description of Artificial Sequence: Synthetic oligonucleotide
  Target: SCN10A; (-) strand; PAM type: YTN; PAM sequence: CTA
aatgcccatcaaccaacaag

SEQ ID NO: 51882 - DNA, 20 bp, Artificial Sequence
  Description of Artificial Sequence: Synthetic oligonucleotide
  Target: SCN10A; (-) strand; PAM type: YTN; PAM sequence: CTG
caaaaatatggaaccagcct

SEQ ID NO: 51883 - DNA, 20 bp, Artificial Sequence
  Description of Artificial Sequence: Synthetic oligonucleotide
  Target: SCN10A; (-) strand; PAM type: YTN; PAM sequence: TTA
caactgcaaaaatatggaac

SEQ ID NO: 51884 - DNA, 20 bp, Artificial Sequence
  Description of Artificial Sequence: Synthetic oligonucleotide
  Target: SCN10A; (-) strand; PAM type: YTN; PAM sequence: TTT
acaactgcaaaaatatggaa

SEQ ID NO: 51885 - DNA, 20 bp, Artificial Sequence
  Description of Artificial Sequence: Synthetic oligonucleotide
  Target: SCN10A; (-) strand; PAM type: YTN; PAM sequence: TTA
tagcagcacagtttacaact

SEQ ID NO: 51886 - DNA, 20 bp, Artificial Sequence
  Description of Artificial Sequence: Synthetic oligonucleotide
  Target: SCN10A; (-) strand; PAM type: YTN; PAM sequence: CTT
atagcagcacagtttacaac

SEQ ID NO: 51887 - DNA, 20 bp, Artificial Sequence
  Description of Artificial Sequence: Synthetic oligonucleotide
  Target: SCN10A; (-) strand; PAM type: YTN; PAM sequence: TTG
catatgcatgcttatagcag

SEQ ID NO: 51888 - DNA, 20 bp, Artificial Sequence
  Description of Artificial Sequence: Synthetic oligonucleotide
  Target: SCN10A; (-) strand; PAM type: YTN; PAM sequence: CTT
gcatatgcatgcttatagca

SEQ ID NO: 51889 - DNA, 20 bp, Artificial Sequence
  Description of Artificial Sequence: Synthetic oligonucleotide
  Target: SCN10A; (-) strand; PAM type: YTN; PAM sequence: TTA
aaaagacacttgcatatgca

SEQ ID NO: 51890 - DNA, 20 bp, Artificial Sequence
  Description of Artificial Sequence: Synthetic oligonucleotide
  Target: SCN10A; (-) strand; PAM type: YTN; PAM sequence: TTA
ttaaaaagacacttgcatat

SEQ ID NO: 51891 - DNA, 20 bp, Artificial Sequence
  Description of Artificial Sequence: Synthetic oligonucleotide
  Target: SCN10A; (-) strand; PAM type: YTN; PAM sequence: CTA
cccagaggaaaataagccat

SEQ ID NO: 51892 - DNA, 20 bp, Artificial Sequence
  Description of Artificial Sequence: Synthetic oligonucleotide
  Target: SCN10A; (-) strand; PAM type: YTN; PAM sequence: CTG
ggtatctacccagaggaaaa

SEQ ID NO: 51893 - DNA, 20 bp, Artificial Sequence
  Description of Artificial Sequence: Synthetic oligonucleotide
  Target: SCN10A; (-) strand; PAM type: YTN; PAM sequence: CTA
ctgggtatctacccagagga

SEQ ID NO: 51894 - DNA, 20 bp, Artificial Sequence
  Description of Artificial Sequence: Synthetic oligonucleotide
  Target: SCN10A; (-) strand; PAM type: YTN; PAM sequence: TTG
gtccagcaatcccactactg

SEQ ID NO: 51895 - DNA, 20 bp, Artificial Sequence
  Description of Artificial Sequence: Synthetic oligonucleotide
  Target: SCN10A; (-) strand; PAM type: YTN; PAM sequence: TTT
ggtccagcaatcccactact

SEQ ID NO: 51896 - DNA, 20 bp, Artificial Sequence
  Description of Artificial Sequence: Synthetic oligonucleotide
  Target: SCN10A; (-) strand; PAM type: YTN; PAM sequence: CTA
ccatttggtccagcaatccc

SEQ ID NO: 51897 - DNA, 20 bp, Artificial Sequence
  Description of Artificial Sequence: Synthetic oligonucleotide
  Target: SCN10A; (-) strand; PAM type: YTN; PAM sequence: CTA
aaagtagaactaccatttgg

SEQ ID NO: 51898 - DNA, 20 bp, Artificial Sequence
  Description of Artificial Sequence: Synthetic oligonucleotide
  Target: SCN10A; (-) strand; PAM type: YTN; PAM sequence: TTA
aagaactaaaagtagaacta

SEQ ID NO: 51899 - DNA, 20 bp, Artificial Sequence
  Description of Artificial Sequence: Synthetic oligonucleotide
  Target: SCN10A; (-) strand; PAM type: YTN; PAM sequence: CTT
aaagaactaaaagtagaact

SEQ ID NO: 51900 - DNA, 20 bp, Artificial Sequence
  Description of Artificial Sequence: Synthetic oligonucleotide
  Target: SCN10A; (-) strand; PAM type: YTN; PAM sequence: TTC
cttaaagaactaaaagtaga

SEQ ID NO: 51901 - DNA, 20 bp, Artificial Sequence
  Description of Artificial Sequence: Synthetic oligonucleotide
  Target: SCN10A; (-) strand; PAM type: YTN; PAM sequence: TTA
tggagattccttaaagaact

SEQ ID NO: 51902 - DNA, 20 bp, Artificial Sequence
  Description of Artificial Sequence: Synthetic oligonucleotide
  Target: SCN10A; (-) strand; PAM type: YTN; PAM sequence: CTA
aggaaaacgttatggagatt

SEQ ID NO: 51903 - DNA, 20 bp, Artificial Sequence
  Description of Artificial Sequence: Synthetic oligonucleotide
  Target: SCN10A; (-) strand; PAM type: YTN; PAM sequence: CTA
gtacaaccactaaggaaaac

SEQ ID NO: 51904 - DNA, 20 bp, Artificial Sequence
  Description of Artificial Sequence: Synthetic oligonucleotide
  Target: SCN10A; (-) strand; PAM type: YTN; PAM sequence: CTG
gtgggaatgtaaactagtac

SEQ ID NO: 51905 - DNA, 20 bp, Artificial Sequence
  Description of Artificial Sequence: Synthetic oligonucleotide
  Target: SCN10A; (-) strand; PAM type: YTN; PAM sequence: CTG
ctggtgggaatgtaaactag

SEQ ID NO: 51906 - DNA, 20 bp, Artificial Sequence
  Description of Artificial Sequence: Synthetic oligonucleotide
  Target: SCN10A; (-) strand; PAM type: YTN; PAM sequence: TTA
cactgctggtgggaatgtaa

SEQ ID NO: 51907 - DNA, 20 bp, Artificial Sequence
  Description of Artificial Sequence: Synthetic oligonucleotide
  Target: SCN10A; (-) strand; PAM type: YTN; PAM sequence: TTT
acactgctggtgggaatgta

SEQ ID NO: 51908 - DNA, 20 bp, Artificial Sequence
  Description of Artificial Sequence: Synthetic oligonucleotide
  Target: SCN10A; (-) strand; PAM type: YTN; PAM sequence: TTT
tacactgctggtgggaatgt

SEQ ID NO: 51909 - DNA, 20 bp, Artificial Sequence
  Description of Artificial Sequence: Synthetic oligonucleotide
  Target: SCN10A; (-) strand; PAM type: YTN; PAM sequence: TTG
gcatggatgtaatgaaaagg

SEQ ID NO: 51910 - DNA, 20 bp, Artificial Sequence
  Description of Artificial Sequence: Synthetic oligonucleotide
  Target: SCN10A; (-) strand; PAM type: YTN; PAM sequence: CTG
caagaatggccataaccaaa

SEQ ID NO: 51911 - DNA, 20 bp, Artificial Sequence
  Description of Artificial Sequence: Synthetic oligonucleotide
  Target: SCN10A; (-) strand; PAM type: YTN; PAM sequence: CTC
ctgcaagaatggccataacc

SEQ ID NO: 51912 - DNA, 20 bp, Artificial Sequence
  Description of Artificial Sequence: Synthetic oligonucleotide
  Target: SCN10A; (-) strand; PAM type: YTN; PAM sequence: TTA
ctcctgcaagaatggccata

SEQ ID NO: 51913 - DNA, 20 bp, Artificial Sequence
  Description of Artificial Sequence: Synthetic oligonucleotide
  Target: SCN10A; (-) strand; PAM type: YTN; PAM sequence: CTT
actcctgcaagaatggccat

SEQ ID NO: 51914 - DNA, 20 bp, Artificial Sequence
  Description of Artificial Sequence: Synthetic oligonucleotide
  Target: SCN10A; (-) strand; PAM type: YTN; PAM sequence: TTA
aaaccacaatgagataccac

SEQ ID NO: 51915 - DNA, 20 bp, Artificial Sequence
  Description of Artificial Sequence: Synthetic oligonucleotide
  Target: SCN10A; (-) strand; PAM type: YTN; PAM sequence: TTA
tcagggaaatgcaaattaaa

SEQ ID NO: 51916 - DNA, 20 bp, Artificial Sequence
  Description of Artificial Sequence: Synthetic oligonucleotide
  Target: SCN10A; (-) strand; PAM type: YTN; PAM sequence: TTA
attatcagggaaatgcaaat

SEQ ID NO: 51917 - DNA, 20 bp, Artificial Sequence
  Description of Artificial Sequence: Synthetic oligonucleotide
  Target: SCN10A; (-) strand; PAM type: YTN; PAM sequence: CTC
aacatcattaattatcaggg

SEQ ID NO: 51918 - DNA, 20 bp, Artificial Sequence
  Description of Artificial Sequence: Synthetic oligonucleotide
  Target: SCN10A; (-) strand; PAM type: YTN; PAM sequence: CTC
aaaagaagatatataaatgg

SEQ ID NO: 51919 - DNA, 20 bp, Artificial Sequence
  Description of Artificial Sequence: Synthetic oligonucleotide
  Target: SCN10A; (-) strand; PAM type: YTN; PAM sequence: TTC
tcaaaagaagatatataaat

SEQ ID NO: 51920 - DNA, 20 bp, Artificial Sequence
  Description of Artificial Sequence: Synthetic oligonucleotide
  Target: SCN10A; (-) strand; PAM type: YTN; PAM sequence: CTA
taagaaacacaaataaatca

SEQ ID NO: 51921 - DNA, 20 bp, Artificial Sequence
  Description of Artificial Sequence: Synthetic oligonucleotide
  Target: SCN10A; (-) strand; PAM type: YTN; PAM sequence: CTA
atatccagcatctataagaa

SEQ ID NO: 51922 - DNA, 20 bp, Artificial Sequence
  Description of Artificial Sequence: Synthetic oligonucleotide
  Target: SCN10A; (-) strand; PAM type: YTN; PAM sequence: TTC
cagcaaaagactaatatcca

SEQ ID NO: 51923 - DNA, 20 bp, Artificial Sequence
  Description of Artificial Sequence: Synthetic oligonucleotide
  Target: SCN10A; (-) strand; PAM type: YTN; PAM sequence: CTT
ccagcaaaagactaatatcc

SEQ ID NO: 51924 - DNA, 20 bp, Artificial Sequence
  Description of Artificial Sequence: Synthetic oligonucleotide
  Target: SCN10A; (-) strand; PAM type: YTN; PAM sequence: CTA
tgcttccagcaaaagactaa

SEQ ID NO: 51925 - DNA, 20 bp, Artificial Sequence
  Description of Artificial Sequence: Synthetic oligonucleotide
  Target: SCN10A; (-) strand; PAM type: YTN; PAM sequence: TTA
tctatgcttccagcaaaaga

SEQ ID NO: 51926 - DNA, 20 bp, Artificial Sequence
  Description of Artificial Sequence: Synthetic oligonucleotide
  Target: SCN10A; (-) strand; PAM type: YTN; PAM sequence: TTG
ttatctatgcttccagcaaa

SEQ ID NO: 51927 - DNA, 20 bp, Artificial Sequence
  Description of Artificial Sequence: Synthetic oligonucleotide
  Target: SCN10A; (-) strand; PAM type: YTN; PAM sequence: TTT
gttatctatgcttccagcaa

SEQ ID NO: 51928 - DNA, 20 bp, Artificial Sequence
  Description of Artificial Sequence: Synthetic oligonucleotide
  Target: SCN10A; (-) strand; PAM type: YTN; PAM sequence: CTT
tgttatctatgcttccagca

SEQ ID NO: 51929 - DNA, 20 bp, Artificial Sequence
  Description of Artificial Sequence: Synthetic oligonucleotide
  Target: SCN10A; (-) strand; PAM type: YTN; PAM sequence: TTG
cacagcaagagaaataatca

SEQ ID NO: 51930 - DNA, 20 bp, Artificial Sequence
  Description of Artificial Sequence: Synthetic oligonucleotide
  Target: SCN10A; (-) strand; PAM type: YTN; PAM sequence: CTG
ttgcacagcaagagaaataa

SEQ ID NO: 51931 - DNA, 20 bp, Artificial Sequence
  Description of Artificial Sequence: Synthetic oligonucleotide
  Target: SCN10A; (-) strand; PAM type: YTN; PAM sequence: CTA
aaaagctgttgcacagcaag

SEQ ID NO: 51932 - DNA, 20 bp, Artificial Sequence
  Description of Artificial Sequence: Synthetic oligonucleotide
  Target: SCN10A; (-) strand; PAM type: YTN; PAM sequence: TTA
aactaaaaagctgttgcaca

SEQ ID NO: 51933 - DNA, 20 bp, Artificial Sequence
  Description of Artificial Sequence: Synthetic oligonucleotide
  Target: SCN10A; (-) strand; PAM type: YTN; PAM sequence: CTA
attaaactaaaaagctgttg

SEQ ID NO: 51934 - DNA, 20 bp, Artificial Sequence
  Description of Artificial Sequence: Synthetic oligonucleotide
  Target: SCN10A; (-) strand; PAM type: YTN; PAM sequence: CTG
accaaggacccaaagcaaat

SEQ ID NO: 51935 - DNA, 20 bp, Artificial Sequence
  Description of Artificial Sequence: Synthetic oligonucleotide
  Target: SCN10A; (-) strand; PAM type: YTN; PAM sequence: TTC
ctgaccaaggacccaaagca

SEQ ID NO: 51936 - DNA, 20 bp, Artificial Sequence
  Description of Artificial Sequence: Synthetic oligonucleotide
  Target: SCN10A; (-) strand; PAM type: YTN; PAM sequence: TTA
ggcaaaacgttcctgaccaa

SEQ ID NO: 51937 - DNA, 20 bp, Artificial Sequence
  Description of Artificial Sequence: Synthetic oligonucleotide
  Target: SCN10A; (-) strand; PAM type: YTN; PAM sequence: CTT
aggcaaaacgttcctgacca

SEQ ID NO: 51938 - DNA, 20 bp, Artificial Sequence
  Description of Artificial Sequence: Synthetic oligonucleotide
  Target: SCN10A; (-) strand; PAM type: YTN; PAM sequence: TTG
gcttaggcaaaacgttcctg

SEQ ID NO: 51939 - DNA, 20 bp, Artificial Sequence
  Description of Artificial Sequence: Synthetic oligonucleotide
  Target: SCN10A; (-) strand; PAM type: YTN; PAM sequence: CTA
gacattggcttaggcaaaac

SEQ ID NO: 51940 - DNA, 20 bp, Artificial Sequence
  Description of Artificial Sequence: Synthetic oligonucleotide
  Target: SCN10A; (-) strand; PAM type: YTN; PAM sequence: TTC
tagacattggcttaggcaaa

SEQ ID NO: 51941 - DNA, 20 bp, Artificial Sequence
  Description of Artificial Sequence: Synthetic oligonucleotide
  Target: SCN10A; (-) strand; PAM type: YTN; PAM sequence: CTT
ctagacattggcttaggcaa

SEQ ID NO: 51942 - DNA, 20 bp, Artificial Sequence
  Description of Artificial Sequence: Synthetic oligonucleotide
  Target: SCN10A; (-) strand; PAM type: YTN; PAM sequence: CTC
ttctagacattggcttaggc

SEQ ID NO: 51943 - DNA, 20 bp, Artificial Sequence
  Description of Artificial Sequence: Synthetic oligonucleotide
  Target: SCN10A; (-) strand; PAM type: YTN; PAM sequence: TTG
gaaaaactcttctagacatt

SEQ ID NO: 51944 - DNA, 20 bp, Artificial Sequence
  Description of Artificial Sequence: Synthetic oligonucleotide
  Target: SCN10A; (-) strand; PAM type: YTN; PAM sequence: CTA
gaagataacattggaaaaac

SEQ ID NO: 51945 - DNA, 20 bp, Artificial Sequence
  Description of Artificial Sequence: Synthetic oligonucleotide
  Target: SCN10A; (-) strand; PAM type: YTN; PAM sequence: TTC
tagaagataacattggaaaa

SEQ ID NO: 51946 - DNA, 20 bp, Artificial Sequence
  Description of Artificial Sequence: Synthetic oligonucleotide
  Target: SCN10A; (-) strand; PAM type: YTN; PAM sequence: TTA
taaaaaattctagaagataa

SEQ ID NO: 51947 - DNA, 20 bp, Artificial Sequence
  Description of Artificial Sequence: Synthetic oligonucleotide
  Target: SCN10A; (-) strand; PAM type: YTN; PAM sequence: CTG
aaattataaaaaattctaga

SEQ ID NO: 51948 - DNA, 20 bp, Artificial Sequence
  Description of Artificial Sequence: Synthetic oligonucleotide
  Target: SCN10A; (-) strand; PAM type: YTN; PAM sequence: CTA
agacctgaaattataaaaaa

SEQ ID NO: 51949 - DNA, 20 bp, Artificial Sequence
  Description of Artificial Sequence: Synthetic oligonucleotide
  Target: SCN10A; (-) strand; PAM type: YTN; PAM sequence: TTA
aatctaagacctgaaattat

SEQ ID NO: 51950 - DNA, 20 bp, Artificial Sequence
  Description of Artificial Sequence: Synthetic oligonucleotide
  Target: SCN10A; (-) strand; PAM type: YTN; PAM sequence: CTT
aaatctaagacctgaaatta

SEQ ID NO: 51951 - DNA, 20 bp, Artificial Sequence
  Description of Artificial Sequence: Synthetic oligonucleotide
  Target: SCN10A; (-) strand; PAM type: YTN; PAM sequence: TTC
aagatggataaaaggcttaa

SEQ ID NO: 51952 - DNA, 20 bp, Artificial Sequence
  Description of Artificial Sequence: Synthetic oligonucleotide
  Target: SCN10A; (-) strand; PAM type: YTN; PAM sequence: TTA
tacaaaaatcaattcaagat

SEQ ID NO: 51953 - DNA, 20 bp, Artificial Sequence
  Description of Artificial Sequence: Synthetic oligonucleotide
  Target: SCN10A; (-) strand; PAM type: YTN; PAM sequence: CTT
atacaaaaatcaattcaaga

SEQ ID NO: 51954 - DNA, 20 bp, Artificial Sequence
  Description of Artificial Sequence: Synthetic oligonucleotide
  Target: SCN10A; (-) strand; PAM type: YTN; PAM sequence: CTC
accttatacaaaaatcaatt

SEQ ID NO: 51955 - DNA, 20 bp, Artificial Sequence
  Description of Artificial Sequence: Synthetic oligonucleotide
  Target: SCN10A; (-) strand; PAM type: YTN; PAM sequence: CTC
tcaccttatacaaaaatcaa

SEQ ID NO: 51956 - DNA, 20 bp, Artificial Sequence
  Description of Artificial Sequence: Synthetic oligonucleotide
  Target: SCN10A; (-) strand; PAM type: YTN; PAM sequence: TTC
atctctcaccttatacaaaa

SEQ ID NO: 51957 - DNA, 20 bp, Artificial Sequence
  Description of Artificial Sequence: Synthetic oligonucleotide
  Target: SCN10A; (-) strand; PAM type: YTN; PAM sequence: CTT
catctctcaccttatacaaa

SEQ ID NO: 51958 - DNA, 20 bp, Artificial Sequence
  Description of Artificial Sequence: Synthetic oligonucleotide
  Target: SCN10A; (-) strand; PAM type: YTN; PAM sequence: CTG
aatcttcatctctcacctta

SEQ ID NO: 51959 - DNA, 20 bp, Artificial Sequence
  Description of Artificial Sequence: Synthetic oligonucleotide
  Target: SCN10A; (-) strand; PAM type: YTN; PAM sequence: TTA
gcaagccacatgtggaagaa

SEQ ID NO: 51960 - DNA, 20 bp, Artificial Sequence
  Description of Artificial Sequence: Synthetic oligonucleotide
  Target: SCN10A; (-) strand; PAM type: YTN; PAM sequence: CTG
ggataattagcaagccacat

SEQ ID NO: 51961 - DNA, 20 bp, Artificial Sequence
  Description of Artificial Sequence: Synthetic oligonucleotide
  Target: SCN10A; (-) strand; PAM type: YTN; PAM sequence: TTC
aacaaatggtgctgggataa

SEQ ID NO: 51962 - DNA, 20 bp, Artificial Sequence
  Description of Artificial Sequence: Synthetic oligonucleotide
  Target: SCN10A; (-) strand; PAM type: YTN; PAM sequence: CTA
ttcaacaaatggtgctggga

SEQ ID NO: 51963 - DNA, 20 bp, Artificial Sequence
  Description of Artificial Sequence: Synthetic oligonucleotide
  Target: SCN10A; (-) strand; PAM type: YTN; PAM sequence: TTG
aaaaagcaaacaaaaacgta

SEQ ID NO: 51964 - DNA, 20 bp, Artificial Sequence
  Description of Artificial Sequence: Synthetic oligonucleotide
  Target: SCN10A; (-) strand; PAM type: YTN; PAM sequence: TTT
gaaaaagcaaacaaaaacgt

SEQ ID NO: 51965 - DNA, 20 bp, Artificial Sequence
  Description of Artificial Sequence: Synthetic oligonucleotide
  Target: SCN10A; (-) strand; PAM type: YTN; PAM sequence: CTT
tgaaaaagcaaacaaaaacg

SEQ ID NO: 51966 - DNA, 20 bp, Artificial Sequence
  Description of Artificial Sequence: Synthetic oligonucleotide
  Target: SCN10A; (-) strand; PAM type: YTN; PAM sequence: CTG
atctttgaaaaagcaaacaa

SEQ ID NO: 51967 - DNA, 20 bp, Artificial Sequence
  Description of Artificial Sequence: Synthetic oligonucleotide
  Target: SCN10A; (-) strand; PAM type: YTN; PAM sequence: TTA
caagcaactgatctttgaaa

SEQ ID NO: 51968 - DNA, 20 bp, Artificial Sequence
  Description of Artificial Sequence: Synthetic oligonucleotide
  Target: SCN10A; (-) strand; PAM type: YTN; PAM sequence: CTT
acaagcaactgatctttgaa

SEQ ID NO: 51969 - DNA, 20 bp, Artificial Sequence
  Description of Artificial Sequence: Synthetic oligonucleotide
  Target: SCN10A; (-) strand; PAM type: YTN; PAM sequence: CTC
agaaataaagccaaatactt

SEQ ID NO: 51970 - DNA, 20 bp, Artificial Sequence
  Description of Artificial Sequence: Synthetic oligonucleotide
  Target: SCN10A; (-) strand; PAM type: YTN; PAM sequence: CTG
gtataaaaataagcacatag

SEQ ID NO: 51971 - DNA, 20 bp, Artificial Sequence
  Description of Artificial Sequence: Synthetic oligonucleotide
  Target: SCN10A; (-) strand; PAM type: YTN; PAM sequence: CTG
taccaaaacagcatgatact

SEQ ID NO: 51972 - DNA, 20 bp, Artificial Sequence
  Description of Artificial Sequence: Synthetic oligonucleotide
  Target: SCN10A; (-) strand; PAM type: YTN; PAM sequence: CTA
tagtatagcctgtaccaaaa

SEQ ID NO: 51973 - DNA, 20 bp, Artificial Sequence
  Description of Artificial Sequence: Synthetic oligonucleotide
  Target: SCN10A; (-) strand; PAM type: YTN; PAM sequence: CTA
caaggctatagtatagcctg

SEQ ID NO: 51974 - DNA, 20 bp, Artificial Sequence
  Description of Artificial Sequence: Synthetic oligonucleotide
  Target: SCN10A; (-) strand; PAM type: YTN; PAM sequence: CTA
tactacaaggctatagtata

SEQ ID NO: 51975 - DNA, 20 bp, Artificial Sequence
  Description of Artificial Sequence: Synthetic oligonucleotide
  Target: SCN10A; (-) strand; PAM type: YTN; PAM sequence: TTC
aaactatactacaaggctat

SEQ ID NO: 51976 - DNA, 20 bp, Artificial Sequence
  Description of Artificial Sequence: Synthetic oligonucleotide
  Target: SCN10A; (-) strand; PAM type: YTN; PAM sequence: TTT
caaactatactacaaggcta

SEQ ID NO: 51977 - DNA, 20 bp, Artificial Sequence
  Description of Artificial Sequence: Synthetic oligonucleotide
  Target: SCN10A; (-) strand; PAM type: YTN; PAM sequence: CTG
atttcaaactatactacaag

SEQ ID NO: 51978 - DNA, 20 bp, Artificial Sequence
  Description of Artificial Sequence: Synthetic oligonucleotide
  Target: SCN10A; (-) strand; PAM type: YTN; PAM sequence: TTA
gctgatttcaaactatacta

SEQ ID NO: 51979 - DNA, 20 bp, Artificial Sequence
  Description of Artificial Sequence: Synthetic oligonucleotide
  Target: SCN10A; (-) strand; PAM type: YTN; PAM sequence: CTT
agctgatttcaaactatact

SEQ ID NO: 51980 - DNA, 20 bp, Artificial Sequence
  Description of Artificial Sequence: Synthetic oligonucleotide
  Target: SCN10A; (-) strand; PAM type: YTN; PAM sequence: CTG
gaggcatcaccttagctgat

SEQ ID NO: 51981 - DNA, 20 bp, Artificial Sequence
  Description of Artificial Sequence: Synthetic oligonucleotide
  Target: SCN10A; (-) strand; PAM type: YTN; PAM sequence: CTA
agcaagaataacaaatctgg

SEQ ID NO: 51982 - DNA, 20 bp, Artificial Sequence
  Description of Artificial Sequence: Synthetic oligonucleotide
  Target: SCN10A; (-) strand; PAM type: YTN; PAM sequence: TTC
atagggaaccaaaaaggaat

SEQ ID NO: 51983 - DNA, 20 bp, Artificial Sequence
  Description of Artificial Sequence: Synthetic oligonucleotide
  Target: SCN10A; (-) strand; PAM type: YTN; PAM sequence: CTA
aaattcatagggaaccaaaa

SEQ ID NO: 51984 - DNA, 20 bp, Artificial Sequence
  Description of Artificial Sequence: Synthetic oligonucleotide
  Target: SCN10A; (-) strand; PAM type: YTN; PAM sequence: TTC
acagaaatagaaataacaac

SEQ ID NO: 51985 - DNA, 20 bp, Artificial Sequence
  Description of Artificial Sequence: Synthetic oligonucleotide
  Target: SCN10A; (-) strand; PAM type: YTN; PAM sequence: CTT
cacagaaatagaaataacaa

SEQ ID NO: 51986 - DNA, 20 bp, Artificial Sequence
  Description of Artificial Sequence: Synthetic oligonucleotide
  Target: SCN10A; (-) strand; PAM type: YTN; PAM sequence: TTC
ttcacagaaatagaaataac

SEQ ID NO: 51987 - DNA, 20 bp, Artificial Sequence
  Description of Artificial Sequence: Synthetic oligonucleotide
  Target: SCN10A; (-) strand; PAM type: YTN; PAM sequence: TTG
aagtaccacatcattcttca

SEQ ID NO: 51988 - DNA, 20 bp, Artificial Sequence
  Description of Artificial Sequence: Synthetic oligonucleotide
  Target: SCN10A; (-) strand; PAM type: YTN; PAM sequence: TTC
cattgaagtaccacatcatt

SEQ ID NO: 51989 - DNA, 20 bp, Artificial Sequence
  Description of Artificial Sequence: Synthetic oligonucleotide
  Target: SCN10A; (-) strand; PAM type: YTN; PAM sequence: TTT
ccattgaagtaccacatcat

SEQ ID NO: 51990 - DNA, 20 bp, Artificial Sequence
  Description of Artificial Sequence: Synthetic oligonucleotide
  Target: SCN10A; (-) strand; PAM type: YTN; PAM sequence: TTC
aatacaatttccattgaagt

SEQ ID NO: 51991 - DNA, 20 bp, Artificial Sequence
  Description of Artificial Sequence: Synthetic oligonucleotide
  Target: SCN10A; (-) strand; PAM type: YTN; PAM sequence: CTG
ccaaaagcaatatacagatt

SEQ ID NO: 51992 - DNA, 20 bp, Artificial Sequence
  Description of Artificial Sequence: Synthetic oligonucleotide
  Target: SCN10A; (-) strand; PAM type: YTN; PAM sequence: TTA
ctgccaaaagcaatatacag

SEQ ID NO: 51993 - DNA, 20 bp, Artificial Sequence
  Description of Artificial Sequence: Synthetic oligonucleotide
  Target: SCN10A; (-) strand; PAM type: YTN; PAM sequence: CTT
actgccaaaagcaatataca

SEQ ID NO: 51994 - DNA, 20 bp, Artificial Sequence
  Description of Artificial Sequence: Synthetic oligonucleotide
  Target: SCN10A; (-) strand; PAM type: YTN; PAM sequence: TTG
tgaaaatgaccttactgcca

SEQ ID NO: 51995 - DNA, 20 bp, Artificial Sequence
  Description of Artificial Sequence: Synthetic oligonucleotide
  Target: SCN10A; (-) strand; PAM type: YTN; PAM sequence: CTC
atggatggataaaatcaata

SEQ ID NO: 51996 - DNA, 20 bp, Artificial Sequence
  Description of Artificial Sequence: Synthetic oligonucleotide
  Target: SCN10A; (-) strand; PAM type: YTN; PAM sequence: CTA
aaataaatcacagatgacac

SEQ ID NO: 51997 - DNA, 20 bp, Artificial Sequence
  Description of Artificial Sequence: Synthetic oligonucleotide
  Target: SCN10A; (-) strand; PAM type: YTN; PAM sequence: CTG
ctaaaataaatcacagatga

SEQ ID NO: 51998 - DNA, 20 bp, Artificial Sequence
  Description of Artificial Sequence: Synthetic oligonucleotide
  Target: SCN10A; (-) strand; PAM type: YTN; PAM sequence: CTA
caaaacactgctaaaataaa

SEQ ID NO: 51999 - DNA, 20 bp, Artificial Sequence
  Description of Artificial Sequence: Synthetic oligonucleotide
  Target: SCN10A; (-) strand; PAM type: YTN; PAM sequence: CTA
caaggaaaactacaaaacac

SEQ ID NO: 52000 - DNA, 20 bp, Artificial Sequence
  Description of Artificial Sequence: Synthetic oligonucleotide
  Target: SCN10A; (-) strand; PAM type: YTN; PAM sequence: TTC
tacaaggaaaactacaaaac

SEQ ID NO: 52001 - DNA, 20 bp, Artificial Sequence
  Description of Artificial Sequence: Synthetic oligonucleotide
  Target: SCN10A; (-) strand; PAM type: YTN; PAM sequence: TTT
ctacaaggaaaactacaaaa

SEQ ID NO: 52002 - DNA, 20 bp, Artificial Sequence
  Description of Artificial Sequence: Synthetic oligonucleotide
  Target: SCN10A; (-) strand; PAM type: YTN; PAM sequence: CTA
accaaaaaggtgaaagattt

SEQ ID NO: 52003 - DNA, 20 bp, Artificial Sequence
  Description of Artificial Sequence: Synthetic oligonucleotide
  Target: SCN10A; (-) strand; PAM type: YTN; PAM sequence: TTA
ggaatatacctaaccaaaaa

SEQ ID NO: 52004 - DNA, 20 bp, Artificial Sequence
  Description of Artificial Sequence: Synthetic oligonucleotide
  Target: SCN10A; (-) strand; PAM type: YTN; PAM sequence: CTT
aggaatatacctaaccaaaa

SEQ ID NO: 52005 - DNA, 20 bp, Artificial Sequence
  Description of Artificial Sequence: Synthetic oligonucleotide
  Target: SCN10A; (-) strand; PAM type: YTN; PAM sequence: CTG
caaaaaaaaaacaaaaataa

SEQ ID NO: 52006 - DNA, 20 bp, Artificial Sequence
  Description of Artificial Sequence: Synthetic oligonucleotide
  Target: SCN10A; (-) strand; PAM type: YTN; PAM sequence: TTA
caacagctgcaaaaaaaaaa

SEQ ID NO: 52007 - DNA, 20 bp, Artificial Sequence
  Description of Artificial Sequence: Synthetic oligonucleotide
  Target: SCN10A; (-) strand; PAM type: YTN; PAM sequence: TTT
acaacagctgcaaaaaaaaa

SEQ ID NO: 52008 - DNA, 20 bp, Artificial Sequence
  Description of Artificial Sequence: Synthetic oligonucleotide
  Target: SCN10A; (-) strand; PAM type: YTN; PAM sequence: TTT
tacaacagctgcaaaaaaaa

SEQ ID NO: 52009 - DNA, 20 bp, Artificial Sequence
  Description of Artificial Sequence: Synthetic oligonucleotide
  Target: SCN10A; (-) strand; PAM type: YTN; PAM sequence: CTT
ttacaacagctgcaaaaaaa

SEQ ID NO: 52010 - DNA, 20 bp, Artificial Sequence
  Description of Artificial Sequence: Synthetic oligonucleotide
  Target: SCN10A; (-) strand; PAM type: YTN; PAM sequence: CTC
aatcccttttacaacagctg

SEQ ID NO: 52011 - DNA, 20 bp, Artificial Sequence
  Description of Artificial Sequence: Synthetic oligonucleotide
  Target: SCN10A; (-) strand; PAM type: YTN; PAM sequence: CTG
aggaacaaatcaagaactca

SEQ ID NO: 52012 - DNA, 20 bp, Artificial Sequence
  Description of Artificial Sequence: Synthetic oligonucleotide
  Target: SCN10A; (-) strand; PAM type: YTN; PAM sequence: CTG
tacaccaccagaaaccaagc

SEQ ID NO: 52013 - DNA, 20 bp, Artificial Sequence
  Description of Artificial Sequence: Synthetic oligonucleotide
  Target: SCN10A; (-) strand; PAM type: YTN; PAM sequence: CTA
ctgtacaccaccagaaacca

SEQ ID NO: 52014 - DNA, 20 bp, Artificial Sequence
  Description of Artificial Sequence: Synthetic oligonucleotide
  Target: SCN10A; (-) strand; PAM type: YTN; PAM sequence: TTC
aggatacaaaaacaatgtat

SEQ ID NO: 52015 - DNA, 20 bp, Artificial Sequence
  Description of Artificial Sequence: Synthetic oligonucleotide
  Target: SCN10A; (-) strand; PAM type: YTN; PAM sequence: TTT
caggatacaaaaacaatgta

SEQ ID NO: 52016 - DNA, 20 bp, Artificial Sequence
  Description of Artificial Sequence: Synthetic oligonucleotide
  Target: SCN10A; (-) strand; PAM type: YTN; PAM sequence: TTC
agtaaagtttcaggatacaa

SEQ ID NO: 52017 - DNA, 20 bp, Artificial Sequence
  Description of Artificial Sequence: Synthetic oligonucleotide
  Target: SCN10A; (-) strand; PAM type: YTN; PAM sequence: CTA
ataaatgaattcagtaaagt

SEQ ID NO: 52018 - DNA, 20 bp, Artificial Sequence
  Description of Artificial Sequence: Synthetic oligonucleotide
  Target: SCN10A; (-) strand; PAM type: YTN; PAM sequence: CTA
gatctaataaatgaattcag

SEQ ID NO: 52019 - DNA, 20 bp, Artificial Sequence
  Description of Artificial Sequence: Synthetic oligonucleotide
  Target: SCN10A; (-) strand; PAM type: YTN; PAM sequence: CTC
ctagatctaataaatgaatt

SEQ ID NO: 52020 - DNA, 20 bp, Artificial Sequence
  Description of Artificial Sequence: Synthetic oligonucleotide
  Target: SCN10A; (-) strand; PAM type: YTN; PAM sequence: CTC
atccaaaaagctcctagatc

SEQ ID NO: 52021 - DNA, 20 bp, Artificial Sequence
  Description of Artificial Sequence: Synthetic oligonucleotide
  Target: SCN10A; (-) strand; PAM type: YTN; PAM sequence: CTA
aagactcatccaaaaagctc

SEQ ID NO: 52022 - DNA, 20 bp, Artificial Sequence
  Description of Artificial Sequence: Synthetic oligonucleotide
  Target: SCN10A; (-) strand; PAM type: YTN; PAM sequence: CTA
ggaaaccctaaagactcatc

SEQ ID NO: 52023 - DNA, 20 bp, Artificial Sequence
  Description of Artificial Sequence: Synthetic oligonucleotide
  Target: SCN10A; (-) strand; PAM type: YTN; PAM sequence: TTC
accaatgatatgatcgtatg

SEQ ID NO: 52024 - DNA, 20 bp, Artificial Sequence
  Description of Artificial Sequence: Synthetic oligonucleotide
  Target: SCN10A; (-) strand; PAM type: YTN; PAM sequence: CTG
ttcaccaatgatatgatcgt

SEQ ID NO: 52025 - DNA, 20 bp, Artificial Sequence
  Description of Artificial Sequence: Synthetic oligonucleotide
  Target: SCN10A; (-) strand; PAM type: YTN; PAM sequence: TTG
ctgttcaccaatgatatgat

SEQ ID NO: 52026 - DNA, 20 bp, Artificial Sequence
  Description of Artificial Sequence: Synthetic oligonucleotide
  Target: SCN10A; (-) strand; PAM type: YTN; PAM sequence: CTG
ttgctgttcaccaatgatat

SEQ ID NO: 52027 - DNA, 20 bp, Artificial Sequence
  Description of Artificial Sequence: Synthetic oligonucleotide
  Target: SCN10A; (-) strand; PAM type: YTN; PAM sequence: CTA
gccagagcaatcagacaaga

SEQ ID NO: 52028 - DNA, 20 bp, Artificial Sequence
  Description of Artificial Sequence: Synthetic oligonucleotide
  Target: SCN10A; (-) strand; PAM type: YTN; PAM sequence: CTG
gaagtcctagccagagcaat

SEQ ID NO: 52029 - DNA, 20 bp, Artificial Sequence
  Description of Artificial Sequence: Synthetic oligonucleotide
  Target: SCN10A; (-) strand; PAM type: YTN; PAM sequence: CTA
tccaacatagtactggaagt

SEQ ID NO: 52030 - DNA, 20 bp, Artificial Sequence
  Description of Artificial Sequence: Synthetic oligonucleotide
  Target: SCN10A; (-) strand; PAM type: YTN; PAM sequence: TTC
tatccaacatagtactggaa

SEQ ID NO: 52031 - DNA, 20 bp, Artificial Sequence
  Description of Artificial Sequence: Synthetic oligonucleotide
  Target: SCN10A; (-) strand; PAM type: YTN; PAM sequence: TTT
ctatccaacatagtactgga

SEQ ID NO: 52032 - DNA, 20 bp, Artificial Sequence
  Description of Artificial Sequence: Synthetic oligonucleotide
  Target: SCN10A; (-) strand; PAM type: YTN; PAM sequence: TTC
accatttctatccaacatag

SEQ ID NO: 52033 - DNA, 20 bp, Artificial Sequence
  Description of Artificial Sequence: Synthetic oligonucleotide
  Target: SCN10A; (-) strand; PAM type: YTN; PAM sequence: TTT
caccatttctatccaacata

SEQ ID NO: 52034 - DNA, 20 bp, Artificial Sequence
  Description of Artificial Sequence: Synthetic oligonucleotide
  Target: SCN10A; (-) strand; PAM type: YTN; PAM sequence: CTT
tcaccatttctatccaacat

SEQ ID NO: 52035 - DNA, 20 bp, Artificial Sequence
  Description of Artificial Sequence: Synthetic oligonucleotide
  Target: SCN10A; (-) strand; PAM type: YTN; PAM sequence: CTG
aaacaagacaaggatgccca

SEQ ID NO: 52036 - DNA, 20 bp, Artificial Sequence
  Description of Artificial Sequence: Synthetic oligonucleotide
  Target: SCN10A; (-) strand; PAM type: YTN; PAM sequence: CTG
agaactgaaacaagacaagg

SEQ ID NO: 52037 - DNA, 20 bp, Artificial Sequence
  Description of Artificial Sequence: Synthetic oligonucleotide
  Target: SCN10A; (-) strand; PAM type: YTN; PAM sequence: TTC
cccctgagaactgaaacaag

SEQ ID NO: 52038 - DNA, 20 bp, Artificial Sequence
  Description of Artificial Sequence: Synthetic oligonucleotide
  Target: SCN10A; (-) strand; PAM type: YTN; PAM sequence: TTG
aaagcattccccctgagaac

SEQ ID NO: 52039 - DNA, 20 bp, Artificial Sequence
  Description of Artificial Sequence: Synthetic oligonucleotide
  Target: SCN10A; (-) strand; PAM type: YTN; PAM sequence: TTA
taccaaacagggaaaagttg

SEQ ID NO: 52040 - DNA, 20 bp, Artificial Sequence
  Description of Artificial Sequence: Synthetic oligonucleotide
  Target: SCN10A; (-) strand; PAM type: YTN; PAM sequence: CTA
tgacaaatccacagccaaca

SEQ ID NO: 52041 - DNA, 20 bp, Artificial Sequence
  Description of Artificial Sequence: Synthetic oligonucleotide
  Target: SCN10A; (-) strand; PAM type: YTN; PAM sequence: CTC
caaggtaataaaagccatct

SEQ ID NO: 52042 - DNA, 20 bp, Artificial Sequence
  Description of Artificial Sequence: Synthetic oligonucleotide
  Target: SCN10A; (-) strand; PAM type: YTN; PAM sequence: TTG
gcatagaagggacatactcc

SEQ ID NO: 52043 - DNA, 20 bp, Artificial Sequence
  Description of Artificial Sequence: Synthetic oligonucleotide
  Target: SCN10A; (-) strand; PAM type: YTN; PAM sequence: CTC
aaccaaattggcatagaagg

SEQ ID NO: 52044 - DNA, 20 bp, Artificial Sequence
  Description of Artificial Sequence: Synthetic oligonucleotide
  Target: SCN10A; (-) strand; PAM type: YTN; PAM sequence: TTA
aaaccctcaaccaaattggc

SEQ ID NO: 52045 - DNA, 20 bp, Artificial Sequence
  Description of Artificial Sequence: Synthetic oligonucleotide
  Target: SCN10A; (-) strand; PAM type: YTN; PAM sequence: TTA
tgattaaaaccctcaaccaa

SEQ ID NO: 52046 - DNA, 20 bp, Artificial Sequence
  Description of Artificial Sequence: Synthetic oligonucleotide
  Target: SCN10A; (-) strand; PAM type: YTN; PAM sequence: TTG
acaaaatccagcatcccatt

SEQ ID NO: 52047 - DNA, 20 bp, Artificial Sequence
  Description of Artificial Sequence: Synthetic oligonucleotide
  Target: SCN10A; (-) strand; PAM type: YTN; PAM sequence: TTT
gacaaaatccagcatcccat

SEQ ID NO: 52048 - DNA, 20 bp, Artificial Sequence
  Description of Artificial Sequence: Synthetic oligonucleotide
  Target: SCN10A; (-) strand; PAM type: YTN; PAM sequence: CTC
aataggtgcaggaaaagcat

SEQ ID NO: 52049 - DNA, 20 bp, Artificial Sequence
  Description of Artificial Sequence: Synthetic oligonucleotide
  Target: SCN10A; (-) strand; PAM type: YTN; PAM sequence: TTA
aaaacaaaaatcatatgatc

SEQ ID NO: 52050 - DNA, 20 bp, Artificial Sequence
  Description of Artificial Sequence: Synthetic oligonucleotide
  Target: SCN10A; (-) strand; PAM type: YTN; PAM sequence: CTG
cacgtcacataaacagaatt

SEQ ID NO: 52051 - DNA, 20 bp, Artificial Sequence
  Description of Artificial Sequence: Synthetic oligonucleotide
  Target: SCN10A; (-) strand; PAM type: YTN; PAM sequence: TTA
acatacacaagtcaataaat

SEQ ID NO: 52052 - DNA, 20 bp, Artificial Sequence
  Description of Artificial Sequence: Synthetic oligonucleotide
  Target: SCN10A; (-) strand; PAM type: YTN; PAM sequence: TTT
aacatacacaagtcaataaa

SEQ ID NO: 52053 - DNA, 20 bp, Artificial Sequence
  Description of Artificial Sequence: Synthetic oligonucleotide
  Target: SCN10A; (-) strand; PAM type: YTN; PAM sequence: TTC
ataccagggaggtagggatg

SEQ ID NO: 52054 - DNA, 20 bp, Artificial Sequence
  Description of Artificial Sequence: Synthetic oligonucleotide
  Target: SCN10A; (-) strand; PAM type: YTN; PAM sequence: TTT
cataccagggaggtagggat

SEQ ID NO: 52055 - DNA, 20 bp, Artificial Sequence
  Description of Artificial Sequence: Synthetic oligonucleotide
  Target: SCN10A; (-) strand; PAM type: YTN; PAM sequence: TTG
aatccaacacatatccaaaa

SEQ ID NO: 52056 - DNA, 20 bp, Artificial Sequence
  Description of Artificial Sequence: Synthetic oligonucleotide
  Target: SCN10A; (-) strand; PAM type: YTN; PAM sequence: CTA
attgaatccaacacatatcc

SEQ ID NO: 52057 - DNA, 20 bp, Artificial Sequence
  Description of Artificial Sequence: Synthetic oligonucleotide
  Target: SCN10A; (-) strand; PAM type: YTN; PAM sequence: CTA
gctaattgaatccaacacat

SEQ ID NO: 52058 - DNA, 20 bp, Artificial Sequence
  Description of Artificial Sequence: Synthetic oligonucleotide
  Target: SCN10A; (-) strand; PAM type: YTN; PAM sequence: CTC
aacaaaatgctagctaattg

SEQ ID NO: 52059 - DNA, 20 bp, Artificial Sequence
  Description of Artificial Sequence: Synthetic oligonucleotide
  Target: SCN10A; (-) strand; PAM type: YTN; PAM sequence: CTG
atgaacatagatgcaaaaat

SEQ ID NO: 52060 - DNA, 20 bp, Artificial Sequence
  Description of Artificial Sequence: Synthetic oligonucleotide
  Target: SCN10A; (-) strand; PAM type: YTN; PAM sequence: CTA
cagacaatatccctgatgaa

SEQ ID NO: 52061 - DNA, 20 bp, Artificial Sequence
  Description of Artificial Sequence: Synthetic oligonucleotide
  Target: SCN10A; (-) strand; PAM type: YTN; PAM sequence: TTA
aaaaagaactacagacaata

SEQ ID NO: 52062 - DNA, 20 bp, Artificial Sequence
  Description of Artificial Sequence: Synthetic oligonucleotide
  Target: SCN10A; (-) strand; PAM type: YTN; PAM sequence: TTT
aaaaaagaactacagacaat

SEQ ID NO: 52063 - DNA, 20 bp, Artificial Sequence
  Description of Artificial Sequence: Synthetic oligonucleotide
  Target: SCN10A; (-) strand; PAM type: YTN; PAM sequence: TTT
taaaaaagaactacagacaa

SEQ ID NO: 52064 - DNA, 20 bp, Artificial Sequence
  Description of Artificial Sequence: Synthetic oligonucleotide
  Target: SCN10A; (-) strand; PAM type: YTN; PAM sequence: CTT
ttaaaaaagaactacagaca

SEQ ID NO: 52065 - DNA, 20 bp, Artificial Sequence
  Description of Artificial Sequence: Synthetic oligonucleotide
  Target: SCN10A; (-) strand; PAM type: YTN; PAM sequence: CTA
ataccaaaaccagaaaagga

SEQ ID NO: 52066 - DNA, 20 bp, Artificial Sequence
  Description of Artificial Sequence: Synthetic oligonucleotide
  Target: SCN10A; (-) strand; PAM type: YTN; PAM sequence: TTA
tgaagccagtatcaccctaa

SEQ ID NO: 52067 - DNA, 20 bp, Artificial Sequence
  Description of Artificial Sequence: Synthetic oligonucleotide
  Target: SCN10A; (-) strand; PAM type: YTN; PAM sequence: TTT
atgaagccagtatcacccta

SEQ ID NO: 52068 - DNA, 20 bp, Artificial Sequence
  Description of Artificial Sequence: Synthetic oligonucleotide
  Target: SCN10A; (-) strand; PAM type: YTN; PAM sequence: TTT
tatgaagccagtatcaccct

SEQ ID NO: 52069 - DNA, 20 bp, Artificial Sequence
  Description of Artificial Sequence: Synthetic oligonucleotide
  Target: SCN10A; (-) strand; PAM type: YTN; PAM sequence: CTA
aatcattttatgaagccagt

SEQ ID NO: 52070 - DNA, 20 bp, Artificial Sequence
  Description of Artificial Sequence: Synthetic oligonucleotide
  Target: SCN10A; (-) strand; PAM type: YTN; PAM sequence: CTC
ctaaatcattttatgaagcc

SEQ ID NO: 52071 - DNA, 20 bp, Artificial Sequence
  Description of Artificial Sequence: Synthetic oligonucleotide
  Target: SCN10A; (-) strand; PAM type: YTN; PAM sequence: TTC
caaaagatgcagaaagaggg

SEQ ID NO: 52072 - DNA, 20 bp, Artificial Sequence
  Description of Artificial Sequence: Synthetic oligonucleotide
  Target: SCN10A; (-) strand; PAM type: YTN; PAM sequence: CTA
ttccaaaagatgcagaaaga

SEQ ID NO: 52073 - DNA, 20 bp, Artificial Sequence
  Description of Artificial Sequence: Synthetic oligonucleotide
  Target: SCN10A; (-) strand; PAM type: YTN; PAM sequence: TTG
aaactattccaaaagatgca

SEQ ID NO: 52074 - DNA, 20 bp, Artificial Sequence
  Description of Artificial Sequence: Synthetic oligonucleotide
  Target: SCN10A; (-) strand; PAM type: YTN; PAM sequence: TTA
ttgaaactattccaaaagat

SEQ ID NO: 52075 - DNA, 20 bp, Artificial Sequence
  Description of Artificial Sequence: Synthetic oligonucleotide
  Target: SCN10A; (-) strand; PAM type: YTN; PAM sequence: TTT
attgaaactattccaaaaga

SEQ ID NO: 52076 - DNA, 20 bp, Artificial Sequence
  Description of Artificial Sequence: Synthetic oligonucleotide
  Target: SCN10A; (-) strand; PAM type: YTN; PAM sequence: TTT
tattgaaactattccaaaag

SEQ ID NO: 52077 - DNA, 20 bp, Artificial Sequence
  Description of Artificial Sequence: Synthetic oligonucleotide
  Target: SCN10A; (-) strand; PAM type: YTN; PAM sequence: TTG
gtaccaattttattgaaact

SEQ ID NO: 52078 - DNA, 20 bp, Artificial Sequence
  Description of Artificial Sequence: Synthetic oligonucleotide
  Target: SCN10A; (-) strand; PAM type: YTN; PAM sequence: TTC
aaagaagaattggtaccaat

SEQ ID NO: 52079 - DNA, 20 bp, Artificial Sequence
  Description of Artificial Sequence: Synthetic oligonucleotide
  Target: SCN10A; (-) strand; PAM type: YTN; PAM sequence: CTA
tcagacattcaaagaagaat

SEQ ID NO: 52080 - DNA, 20 bp, Artificial Sequence
  Description of Artificial Sequence: Synthetic oligonucleotide
  Target: SCN10A; (-) strand; PAM type: YTN; PAM sequence: TTC
tatcagacattcaaagaaga

SEQ ID NO: 52081 - DNA, 20 bp, Artificial Sequence
  Description of Artificial Sequence: Synthetic oligonucleotide
  Target: SCN10A; (-) strand; PAM type: YTN; PAM sequence: CTG
aattctatcagacattcaaa

SEQ ID NO: 52082 - DNA, 20 bp, Artificial Sequence
  Description of Artificial Sequence: Synthetic oligonucleotide
  Target: SCN10A; (-) strand; PAM type: YTN; PAM sequence: TTC
acagctgaattctatcagac

SEQ ID NO: 52083 - DNA, 20 bp, Artificial Sequence
  Description of Artificial Sequence: Synthetic oligonucleotide
  Target: SCN10A; (-) strand; PAM type: YTN; PAM sequence: CTG
gattcacagctgaattctat

SEQ ID NO: 52084 - DNA, 20 bp, Artificial Sequence
  Description of Artificial Sequence: Synthetic oligonucleotide
  Target: SCN10A; (-) strand; PAM type: YTN; PAM sequence: TTG
ccaaggaaaaaaagtccagg

SEQ ID NO: 52085 - DNA, 20 bp, Artificial Sequence
  Description of Artificial Sequence: Synthetic oligonucleotide
  Target: SCN10A; (-) strand; PAM type: YTN; PAM sequence: TTC
aaaaattgccaaggaaaaaa

SEQ ID NO: 52086 - DNA, 20 bp, Artificial Sequence
  Description of Artificial Sequence: Synthetic oligonucleotide
  Target: SCN10A; (-) strand; PAM type: YTN; PAM sequence: TTG
aaacagtaattcaaaaattg

SEQ ID NO: 52087 - DNA, 20 bp, Artificial Sequence
  Description of Artificial Sequence: Synthetic oligonucleotide
  Target: SCN10A; (-) strand; PAM type: YTN; PAM sequence: CTA
aacagaccaataacaagtag

SEQ ID NO: 52088 - DNA, 20 bp, Artificial Sequence
  Description of Artificial Sequence: Synthetic oligonucleotide
  Target: SCN10A; (-) strand; PAM type: YTN; PAM sequence: CTC
taaacagaccaataacaagt

SEQ ID NO: 52089 - DNA, 20 bp, Artificial Sequence
  Description of Artificial Sequence: Synthetic oligonucleotide
  Target: SCN10A; (-) strand; PAM type: YTN; PAM sequence: TTA
aatcagaaagtaatagaaac

SEQ ID NO: 52090 - DNA, 20 bp, Artificial Sequence
  Description of Artificial Sequence: Synthetic oligonucleotide
  Target: SCN10A; (-) strand; PAM type: YTN; PAM sequence: TTA
gattaaatcagaaagtaata

SEQ ID NO: 52091 - DNA, 20 bp, Artificial Sequence
  Description of Artificial Sequence: Synthetic oligonucleotide
  Target: SCN10A; (-) strand; PAM type: YTN; PAM sequence: CTT
agattaaatcagaaagtaat

SEQ ID NO: 52092 - DNA, 20 bp, Artificial Sequence
  Description of Artificial Sequence: Synthetic oligonucleotide
  Target: SCN10A; (-) strand; PAM type: YTN; PAM sequence: CTG
tcttagattaaatcagaaag

SEQ ID NO: 52093 - DNA, 20 bp, Artificial Sequence
  Description of Artificial Sequence: Synthetic oligonucleotide
  Target: SCN10A; (-) strand; PAM type: YTN; PAM sequence: CTG
gaaatatacaactgtcttag

SEQ ID NO: 52094 - DNA, 20 bp, Artificial Sequence
  Description of Artificial Sequence: Synthetic oligonucleotide
  Target: SCN10A; (-) strand; PAM type: YTN; PAM sequence: TTC
ctggaaatatacaactgtct

SEQ ID NO: 52095 - DNA, 20 bp, Artificial Sequence
  Description of Artificial Sequence: Synthetic oligonucleotide
  Target: SCN10A; (-) strand; PAM type: YTN; PAM sequence: TTA
gaggagatgaataaattcct

SEQ ID NO: 52096 - DNA, 20 bp, Artificial Sequence
  Description of Artificial Sequence: Synthetic oligonucleotide
  Target: SCN10A; (-) strand; PAM type: YTN; PAM sequence: TTT
agaggagatgaataaattcc

SEQ ID NO: 52097 - DNA, 20 bp, Artificial Sequence
  Description of Artificial Sequence: Synthetic oligonucleotide
  Target: SCN10A; (-) strand; PAM type: YTN; PAM sequence: CTA
gaaaatttagaggagatgaa

SEQ ID NO: 52098 - DNA, 20 bp, Artificial Sequence
  Description of Artificial Sequence: Synthetic oligonucleotide
  Target: SCN10A; (-) strand; PAM type: YTN; PAM sequence: TTG
cacaaactagaaaatttaga

SEQ ID NO: 52099 - DNA, 20 bp, Artificial Sequence
  Description of Artificial Sequence: Synthetic oligonucleotide
  Target: SCN10A; (-) strand; PAM type: YTN; PAM sequence: TTT
gcacaaactagaaaatttag

SEQ ID NO: 52100 - DNA, 20 bp, Artificial Sequence
  Description of Artificial Sequence: Synthetic oligonucleotide
  Target: SCN10A; (-) strand; PAM type: YTN; PAM sequence: TTA
tttgcacaaactagaaaatt

SEQ ID NO: 52101 - DNA, 20 bp, Artificial Sequence
  Description of Artificial Sequence: Synthetic oligonucleotide
  Target: SCN10A; (-) strand; PAM type: YTN; PAM sequence: TTT
atttgcacaaactagaaaat

SEQ ID NO: 52102 - DNA, 20 bp, Artificial Sequence
  Description of Artificial Sequence: Synthetic oligonucleotide
  Target: SCN10A; (-) strand; PAM type: YTN; PAM sequence: CTT
tatttgcacaaactagaaaa

SEQ ID NO: 52103 - DNA, 20 bp, Artificial Sequence
  Description of Artificial Sequence: Synthetic oligonucleotide
  Target: SCN10A; (-) strand; PAM type: YTN; PAM sequence: CTA
tgaacacctttatttgcaca

SEQ ID NO: 52104 - DNA, 20 bp, Artificial Sequence
  Description of Artificial Sequence: Synthetic oligonucleotide
  Target: SCN10A; (-) strand; PAM type: YTN; PAM sequence: CTA
ctatgaacacctttatttgc

SEQ ID NO: 52105 - DNA, 20 bp, Artificial Sequence
  Description of Artificial Sequence: Synthetic oligonucleotide
  Target: SCN10A; (-) strand; PAM type: YTN; PAM sequence: TTC
aaggctactatgaacacctt

SEQ ID NO: 52106 - DNA, 20 bp, Artificial Sequence
  Description of Artificial Sequence: Synthetic oligonucleotide
  Target: SCN10A; (-) strand; PAM type: YTN; PAM sequence: CTG
ataccacagaaatacaaaaa

SEQ ID NO: 52107 - DNA, 20 bp, Artificial Sequence
  Description of Artificial Sequence: Synthetic oligonucleotide
  Target: SCN10A; (-) strand; PAM type: YTN; PAM sequence: TTA
caactgataccacagaaata

SEQ ID NO: 52108 - DNA, 20 bp, Artificial Sequence
  Description of Artificial Sequence: Synthetic oligonucleotide
  Target: SCN10A; (-) strand; PAM type: YTN; PAM sequence: TTA
gaaataaaatgggagatatt

SEQ ID NO: 52109 - DNA, 20 bp, Artificial Sequence
  Description of Artificial Sequence: Synthetic oligonucleotide
  Target: SCN10A; (-) strand; PAM type: YTN; PAM sequence: CTC
aattagaaataaaatgggag

SEQ ID NO: 52110 - DNA, 20 bp, Artificial Sequence
  Description of Artificial Sequence: Synthetic oligonucleotide
  Target: SCN10A; (-) strand; PAM type: YTN; PAM sequence: TTA
accaagaaaagaagagagaa

SEQ ID NO: 52111 - DNA, 20 bp, Artificial Sequence
  Description of Artificial Sequence: Synthetic oligonucleotide
  Target: SCN10A; (-) strand; PAM type: YTN; PAM sequence: TTG
gcaagattaaccaagaaaag

SEQ ID NO: 52112 - DNA, 20 bp, Artificial Sequence
  Description of Artificial Sequence: Synthetic oligonucleotide
  Target: SCN10A; (-) strand; PAM type: YTN; PAM sequence: TTG
accattggcaagattaacca

SEQ ID NO: 52113 - DNA, 20 bp, Artificial Sequence
  Description of Artificial Sequence: Synthetic oligonucleotide
  Target: SCN10A; (-) strand; PAM type: YTN; PAM sequence: TTG
attgaccattggcaagatta

SEQ ID NO: 52114 - DNA, 20 bp, Artificial Sequence
  Description of Artificial Sequence: Synthetic oligonucleotide
  Target: SCN10A; (-) strand; PAM type: YTN; PAM sequence: TTA
aaaagatatagaaaattgat

SEQ ID NO: 52115 - DNA, 20 bp, Artificial Sequence
  Description of Artificial Sequence: Synthetic oligonucleotide
  Target: SCN10A; (-) strand; PAM type: YTN; PAM sequence: TTT
aaaaagatatagaaaattga

SEQ ID NO: 52116 - DNA, 20 bp, Artificial Sequence
  Description of Artificial Sequence: Synthetic oligonucleotide
  Target: SCN10A; (-) strand; PAM type: YTN; PAM sequence: CTT
taaaaagatatagaaaattg

SEQ ID NO: 52117 - DNA, 20 bp, Artificial Sequence
  Description of Artificial Sequence: Synthetic oligonucleotide
  Target: SCN10A; (-) strand; PAM type: YTN; PAM sequence: TTC
tttaaaaagatatagaaaat

SEQ ID NO: 52118 - DNA, 20 bp, Artificial Sequence
  Description of Artificial Sequence: Synthetic oligonucleotide
  Target: SCN10A; (-) strand; PAM type: YTN; PAM sequence: TTC
aaataaaaataataataata

SEQ ID NO: 52119 - DNA, 20 bp, Artificial Sequence
  Description of Artificial Sequence: Synthetic oligonucleotide
  Target: SCN10A; (-) strand; PAM type: YTN; PAM sequence: CTA
aatgaaattcaaataaaaat

SEQ ID NO: 52120 - DNA, 20 bp, Artificial Sequence
  Description of Artificial Sequence: Synthetic oligonucleotide
  Target: SCN10A; (-) strand; PAM type: YTN; PAM sequence: TTA
gagaaacaagaacaaaacag

SEQ ID NO: 52121 - DNA, 20 bp, Artificial Sequence
  Description of Artificial Sequence: Synthetic oligonucleotide
  Target: SCN10A; (-) strand; PAM type: YTN; PAM sequence: CTC
aaggaattagagaaacaaga

SEQ ID NO: 52122 - DNA, 20 bp, Artificial Sequence
  Description of Artificial Sequence: Synthetic oligonucleotide
  Target: SCN10A; (-) strand; PAM type: YTN; PAM sequence: CTA
aggtcacacctcaaggaatt

SEQ ID NO: 52123 - DNA, 20 bp, Artificial Sequence
  Description of Artificial Sequence: Synthetic oligonucleotide
  Target: SCN10A; (-) strand; PAM type: YTN; PAM sequence: CTA
catcaaaaagtatgaaagag

SEQ ID NO: 52124 - DNA, 20 bp, Artificial Sequence
  Description of Artificial Sequence: Synthetic oligonucleotide
  Target: SCN10A; (-) strand; PAM type: YTN; PAM sequence: TTA
aatacctacatcaaaaagta

SEQ ID NO: 52125 - DNA, 20 bp, Artificial Sequence
  Description of Artificial Sequence: Synthetic oligonucleotide
  Target: SCN10A; (-) strand; PAM type: YTN; PAM sequence: CTC
atagcattaaatacctacat

SEQ ID NO: 52126 - DNA, 20 bp, Artificial Sequence
  Description of Artificial Sequence: Synthetic oligonucleotide
  Target: SCN10A; (-) strand; PAM type: YTN; PAM sequence: CTA
agaggaaagctcatagcatt

SEQ ID NO: 52127 - DNA, 20 bp, Artificial Sequence
  Description of Artificial Sequence: Synthetic oligonucleotide
  Target: SCN10A; (-) strand; PAM type: YTN; PAM sequence: CTA
aagcagtgctaagaggaaag

SEQ ID NO: 52128 - DNA, 20 bp, Artificial Sequence
  Description of Artificial Sequence: Synthetic oligonucleotide
  Target: SCN10A; (-) strand; PAM type: YTN; PAM sequence: CTG
ggatacagctaaagcagtgc

SEQ ID NO: 52129 - DNA, 20 bp, Artificial Sequence
  Description of Artificial Sequence: Synthetic oligonucleotide
  Target: SCN10A; (-) strand; PAM type: YTN; PAM sequence: CTC
tgggatacagctaaagcagt

SEQ ID NO: 52130 - DNA, 20 bp, Artificial Sequence
  Description of Artificial Sequence: Synthetic oligonucleotide
  Target: SCN10A; (-) strand; PAM type: YTN; PAM sequence: TTA
tcaaaacctctgggatacag

SEQ ID NO: 52131 - DNA, 20 bp, Artificial Sequence
  Description of Artificial Sequence: Synthetic oligonucleotide
  Target: SCN10A; (-) strand; PAM type: YTN; PAM sequence: CTT
atcaaaacctctgggataca

SEQ ID NO: 52132 - DNA, 20 bp, Artificial Sequence
  Description of Artificial Sequence: Synthetic oligonucleotide
  Target: SCN10A; (-) strand; PAM type: YTN; PAM sequence: CTG
aatgataatagtcacacaac

SEQ ID NO: 52133 - DNA, 20 bp, Artificial Sequence
  Description of Artificial Sequence: Synthetic oligonucleotide
  Target: SCN10A; (-) strand; PAM type: YTN; PAM sequence: TTG
aactgaatgataatagtcac

SEQ ID NO: 52134 - DNA, 20 bp, Artificial Sequence
  Description of Artificial Sequence: Synthetic oligonucleotide
  Target: SCN10A; (-) strand; PAM type: YTN; PAM sequence: TTT
gaactgaatgataatagtca

SEQ ID NO: 52135 - DNA, 20 bp, Artificial Sequence
  Description of Artificial Sequence: Synthetic oligonucleotide
  Target: SCN10A; (-) strand; PAM type: YTN; PAM sequence: TTT
tgaactgaatgataatagtc

SEQ ID NO: 52136 - DNA, 20 bp, Artificial Sequence
  Description of Artificial Sequence: Synthetic oligonucleotide
  Target: SCN10A; (-) strand; PAM type: YTN; PAM sequence: TTT
ttgaactgaatgataatagt

SEQ ID NO: 52137 - DNA, 20 bp, Artificial Sequence
  Description of Artificial Sequence: Synthetic oligonucleotide
  Target: SCN10A; (-) strand; PAM type: YTN; PAM sequence: TTT
tttgaactgaatgataatag

SEQ ID NO: 52138 - DNA, 20 bp, Artificial Sequence
  Description of Artificial Sequence: Synthetic oligonucleotide
  Target: SCN10A; (-) strand; PAM type: YTN; PAM sequence: TTA
aaaattttttgaactgaatg

SEQ ID NO: 52139 - DNA, 20 bp, Artificial Sequence
  Description of Artificial Sequence: Synthetic oligonucleotide
  Target: SCN10A; (-) strand; PAM type: YTN; PAM sequence: TTT
aaaaattttttgaactgaat

SEQ ID NO: 52140 - DNA, 20 bp, Artificial Sequence
  Description of Artificial Sequence: Synthetic oligonucleotide
  Target: SCN10A; (-) strand; PAM type: YTN; PAM sequence: TTG
ggtcaacaatgaaatcaaga

SEQ ID NO: 52141 - DNA, 20 bp, Artificial Sequence
  Description of Artificial Sequence: Synthetic oligonucleotide
  Target: SCN10A; (-) strand; PAM type: YTN; PAM sequence: TTT
gggtcaacaatgaaatcaag

SEQ ID NO: 52142 - DNA, 20 bp, Artificial Sequence
  Description of Artificial Sequence: Synthetic oligonucleotide
  Target: SCN10A; (-) strand; PAM type: YTN; PAM sequence: CTT
tgggtcaacaatgaaatcaa

SEQ ID NO: 52143 - DNA, 20 bp, Artificial Sequence
  Description of Artificial Sequence: Synthetic oligonucleotide
  Target: SCN10A; (-) strand; PAM type: YTN; PAM sequence: TTG
aatgatctttgggtcaacaa

SEQ ID NO: 52144 - DNA, 20 bp, Artificial Sequence
  Description of Artificial Sequence: Synthetic oligonucleotide
  Target: SCN10A; (-) strand; PAM type: YTN; PAM sequence: CTT
gaatgatctttgggtcaaca

SEQ ID NO: 52145 - DNA, 20 bp, Artificial Sequence
  Description of Artificial Sequence: Synthetic oligonucleotide
  Target: SCN10A; (-) strand; PAM type: YTN; PAM sequence: CTC
ttgaatgatctttgggtcaa

SEQ ID NO: 52146 - DNA, 20 bp, Artificial Sequence
  Description of Artificial Sequence: Synthetic oligonucleotide
  Target: SCN10A; (-) strand; PAM type: YTN; PAM sequence: CTG
ctcttgaatgatctttgggt

SEQ ID NO: 52147 - DNA, 20 bp, Artificial Sequence
  Description of Artificial Sequence: Synthetic oligonucleotide
  Target: SCN10A; (-) strand; PAM type: YTN; PAM sequence: CTA
aacaatctgctcttgaatga

SEQ ID NO: 52148 - DNA, 20 bp, Artificial Sequence
  Description of Artificial Sequence: Synthetic oligonucleotide
  Target: SCN10A; (-) strand; PAM type: YTN; PAM sequence: CTA
tacaaatacatgaaaactaa

SEQ ID NO: 52149 - DNA, 20 bp, Artificial Sequence
  Description of Artificial Sequence: Synthetic oligonucleotide
  Target: SCN10A; (-) strand; PAM type: YTN; PAM sequence: CTC
aaaactatacaaatacatga

SEQ ID NO: 52150 - DNA, 20 bp, Artificial Sequence
  Description of Artificial Sequence: Synthetic oligonucleotide
  Target: SCN10A; (-) strand; PAM type: YTN; PAM sequence: CTC
caaaagaaaccctcaaaact

SEQ ID NO: 52151 - DNA, 20 bp, Artificial Sequence
  Description of Artificial Sequence: Synthetic oligonucleotide
  Target: SCN10A; (-) strand; PAM type: YTN; PAM sequence: TTA
actccaaaagaaaccctcaa

SEQ ID NO: 52152 - DNA, 20 bp, Artificial Sequence
  Description of Artificial Sequence: Synthetic oligonucleotide
  Target: SCN10A; (-) strand; PAM type: YTN; PAM sequence: CTC
ggagttaactccaaaagaaa

SEQ ID NO: 52153 - DNA, 20 bp, Artificial Sequence
  Description of Artificial Sequence: Synthetic oligonucleotide
  Target: SCN10A; (-) strand; PAM type: YTN; PAM sequence: CTC
agagcacagtcgaataaacc

SEQ ID NO: 52154 - DNA, 20 bp, Artificial Sequence
  Description of Artificial Sequence: Synthetic oligonucleotide
  Target: SCN10A; (-) strand; PAM type: YTN; PAM sequence: CTC
tcagagcacagtcgaataaa

SEQ ID NO: 52155 - DNA, 20 bp, Artificial Sequence
  Description of Artificial Sequence: Synthetic oligonucleotide
  Target: SCN10A; (-) strand; PAM type: YTN; PAM sequence: TTA
tgtcaggtatcctctcagag

SEQ ID NO: 52156 - DNA, 20 bp, Artificial Sequence
  Description of Artificial Sequence: Synthetic oligonucleotide
  Target: SCN10A; (-) strand; PAM type: YTN; PAM sequence: TTA
agaaaatagaaattatgtca

SEQ ID NO: 52157 - DNA, 20 bp, Artificial Sequence
  Description of Artificial Sequence: Synthetic oligonucleotide
  Target: SCN10A; (-) strand; PAM type: YTN; PAM sequence: TTT
aagaaaatagaaattatgtc

SEQ ID NO: 52158 - DNA, 20 bp, Artificial Sequence
  Description of Artificial Sequence: Synthetic oligonucleotide
  Target: SCN10A; (-) strand; PAM type: YTN; PAM sequence: CTC
aataaatttaagaaaataga

SEQ ID NO: 52159 - DNA, 20 bp, Artificial Sequence
  Description of Artificial Sequence: Synthetic oligonucleotide
  Target: SCN10A; (-) strand; PAM type: YTN; PAM sequence: CTA
agatagaccacgtgatagat

SEQ ID NO: 52160 - DNA, 20 bp, Artificial Sequence
  Description of Artificial Sequence: Synthetic oligonucleotide
  Target: SCN10A; (-) strand; PAM type: YTN; PAM sequence: CTC
taagatagaccacgtgatag

SEQ ID NO: 52161 - DNA, 20 bp, Artificial Sequence
  Description of Artificial Sequence: Synthetic oligonucleotide
  Target: SCN10A; (-) strand; PAM type: YTN; PAM sequence: TTC
tctaagatagaccacgtgat

SEQ ID NO: 52162 - DNA, 20 bp, Artificial Sequence
  Description of Artificial Sequence: Synthetic oligonucleotide
  Target: SCN10A; (-) strand; PAM type: YTN; PAM sequence: TTC
atcagcacatggaatattct

SEQ ID NO: 52163 - DNA, 20 bp, Artificial Sequence
  Description of Artificial Sequence: Synthetic oligonucleotide
  Target: SCN10A; (-) strand; PAM type: YTN; PAM sequence: TTT
catcagcacatggaatattc

SEQ ID NO: 52164 - DNA, 20 bp, Artificial Sequence
  Description of Artificial Sequence: Synthetic oligonucleotide
  Target: SCN10A; (-) strand; PAM type: YTN; PAM sequence: TTT
tcatcagcacatggaatatt

SEQ ID NO: 52165 - DNA, 20 bp, Artificial Sequence
  Description of Artificial Sequence: Synthetic oligonucleotide
  Target: SCN10A; (-) strand; PAM type: YTN; PAM sequence: CTT
ttcatcagcacatggaatat

SEQ ID NO: 52166 - DNA, 20 bp, Artificial Sequence
  Description of Artificial Sequence: Synthetic oligonucleotide
  Target: SCN10A; (-) strand; PAM type: YTN; PAM sequence: TTC
ttttcatcagcacatggaat

SEQ ID NO: 52167 - DNA, 20 bp, Artificial Sequence
  Description of Artificial Sequence: Synthetic oligonucleotide
  Target: SCN10A; (-) strand; PAM type: YTN; PAM sequence: CTG
cagaatatacattcttttca

SEQ ID NO: 52168 - DNA, 20 bp, Artificial Sequence
  Description of Artificial Sequence: Synthetic oligonucleotide
  Target: SCN10A; (-) strand; PAM type: YTN; PAM sequence: CTA
ccaaacaactgcagaatata

SEQ ID NO: 52169 - DNA, 20 bp, Artificial Sequence
  Description of Artificial Sequence: Synthetic oligonucleotide
  Target: SCN10A; (-) strand; PAM type: YTN; PAM sequence: TTC
taccaaacaactgcagaata

SEQ ID NO: 52170 - DNA, 20 bp, Artificial Sequence
  Description of Artificial Sequence: Synthetic oligonucleotide
  Target: SCN10A; (-) strand; PAM type: YTN; PAM sequence: TTA
aaaaacattctaccaaacaa

SEQ ID NO: 52171 - DNA, 20 bp, Artificial Sequence
  Description of Artificial Sequence: Synthetic oligonucleotide
  Target: SCN10A; (-) strand; PAM type: YTN; PAM sequence: TTT
aaaaaacattctaccaaaca

SEQ ID NO: 52172 - DNA, 20 bp, Artificial Sequence
  Description of Artificial Sequence: Synthetic oligonucleotide
  Target: SCN10A; (-) strand; PAM type: YTN; PAM sequence: TTA
acagatatttaaaaaacatt

SEQ ID NO: 52173 - DNA, 20 bp, Artificial Sequence
  Description of Artificial Sequence: Synthetic oligonucleotide
  Target: SCN10A; (-) strand; PAM type: YTN; PAM sequence: CTT
aacagatatttaaaaaacat

SEQ ID NO: 52174 - DNA, 20 bp, Artificial Sequence
  Description of Artificial Sequence: Synthetic oligonucleotide
  Target: SCN10A; (-) strand; PAM type: YTN; PAM sequence: CTA
gaacaaatggacttaacaga

SEQ ID NO: 52175 - DNA, 20 bp, Artificial Sequence
  Description of Artificial Sequence: Synthetic oligonucleotide
  Target: SCN10A; (-) strand; PAM type: YTN; PAM sequence: CTG
taacctagaacaaatggact

SEQ ID NO: 52176 - DNA, 20 bp, Artificial Sequence
  Description of Artificial Sequence: Synthetic oligonucleotide
  Target: SCN10A; (-) strand; PAM type: YTN; PAM sequence: TTA
aactgtaacctagaacaaat

SEQ ID NO: 52177 - DNA, 20 bp, Artificial Sequence
  Description of Artificial Sequence: Synthetic oligonucleotide
  Target: SCN10A; (-) strand; PAM type: YTN; PAM sequence: CTT
aaactgtaacctagaacaaa

SEQ ID NO: 52178 - DNA, 20 bp, Artificial Sequence
  Description of Artificial Sequence: Synthetic oligonucleotide
  Target: SCN10A; (-) strand; PAM type: YTN; PAM sequence: CTA
gacaggtcatcaagacagaa

SEQ ID NO: 52179 - DNA, 20 bp, Artificial Sequence
  Description of Artificial Sequence: Synthetic oligonucleotide
  Target: SCN10A; (-) strand; PAM type: YTN; PAM sequence: CTG
acagcactagacaggtcatc

SEQ ID NO: 52180 - DNA, 20 bp, Artificial Sequence
  Description of Artificial Sequence: Synthetic oligonucleotide
  Target: SCN10A; (-) strand; PAM type: YTN; PAM sequence: TTC
cactgacagcactagacagg

SEQ ID NO: 52181 - DNA, 20 bp, Artificial Sequence
  Description of Artificial Sequence: Synthetic oligonucleotide
  Target: SCN10A; (-) strand; PAM type: YTN; PAM sequence: CTA
agaaatgaaatagacagcaa

SEQ ID NO: 52182 - DNA, 20 bp, Artificial Sequence
  Description of Artificial Sequence: Synthetic oligonucleotide
  Target: SCN10A; (-) strand; PAM type: YTN; PAM sequence: CTA
gacctaagaaatgaaataga

SEQ ID NO: 52183 - DNA, 20 bp, Artificial Sequence
  Description of Artificial Sequence: Synthetic oligonucleotide
  Target: SCN10A; (-) strand; PAM type: YTN; PAM sequence: CTA
ctagacctaagaaatgaaat

SEQ ID NO: 52184 - DNA, 20 bp, Artificial Sequence
  Description of Artificial Sequence: Synthetic oligonucleotide
  Target: SCN10A; (-) strand; PAM type: YTN; PAM sequence: TTA
ctactagacctaagaaatga

SEQ ID NO: 52185 - DNA, 20 bp, Artificial Sequence
  Description of Artificial Sequence: Synthetic oligonucleotide
  Target: SCN10A; (-) strand; PAM type: YTN; PAM sequence: TTA
taaaacaattactactagac

SEQ ID NO: 52186 - DNA, 20 bp, Artificial Sequence
  Description of Artificial Sequence: Synthetic oligonucleotide
  Target: SCN10A; (-) strand; PAM type: YTN; PAM sequence: TTT
ataaaacaattactactaga

SEQ ID NO: 52187 - DNA, 20 bp, Artificial Sequence
  Description of Artificial Sequence: Synthetic oligonucleotide
  Target: SCN10A; (-) strand; PAM type: YTN; PAM sequence: CTC
ccaaatttataaaacaatta

SEQ ID NO: 52188 - DNA, 20 bp, Artificial Sequence
  Description of Artificial Sequence: Synthetic oligonucleotide
  Target: SCN10A; (-) strand; PAM type: YTN; PAM sequence: CTG
gagctcccaaatttataaaa

SEQ ID NO: 52189 - DNA, 20 bp, Artificial Sequence
  Description of Artificial Sequence: Synthetic oligonucleotide
  Target: SCN10A; (-) strand; PAM type: YTN; PAM sequence: CTA
acactggagctcccaaattt

SEQ ID NO: 52190 - DNA, 20 bp, Artificial Sequence
  Description of Artificial Sequence: Synthetic oligonucleotide
  Target: SCN10A; (-) strand; PAM type: YTN; PAM sequence: CTA
aatacatatgcacctaacac

SEQ ID NO: 52191 - DNA, 20 bp, Artificial Sequence
  Description of Artificial Sequence: Synthetic oligonucleotide
  Target: SCN10A; (-) strand; PAM type: YTN; PAM sequence: CTA
atggaaaaatatcataatcc

SEQ ID NO: 52192 - DNA, 20 bp, Artificial Sequence
  Description of Artificial Sequence: Synthetic oligonucleotide
  Target: SCN10A; (-) strand; PAM type: YTN; PAM sequence: TTG
gtctaatggaaaaatatcat

SEQ ID NO: 52193 - DNA, 20 bp, Artificial Sequence
  Description of Artificial Sequence: Synthetic oligonucleotide
  Target: SCN10A; (-) strand; PAM type: YTN; PAM sequence: TTA
aaaaaagacaaagagggaca

SEQ ID NO: 52194 - DNA, 20 bp, Artificial Sequence
  Description of Artificial Sequence: Synthetic oligonucleotide
  Target: SCN10A; (-) strand; PAM type: YTN; PAM sequence: TTA
aagcaacaacagttaaaaaa

SEQ ID NO: 52195 - DNA, 20 bp, Artificial Sequence
  Description of Artificial Sequence: Synthetic oligonucleotide
  Target: SCN10A; (-) strand; PAM type: YTN; PAM sequence: CTT
aaagcaacaacagttaaaaa

SEQ ID NO: 52196 - DNA, 20 bp, Artificial Sequence
  Description of Artificial Sequence: Synthetic oligonucleotide
  Target: SCN10A; (-) strand; PAM type: YTN; PAM sequence: TTA
tatcagagaaaacagacctt

SEQ ID NO: 52197 - DNA, 20 bp, Artificial Sequence
  Description of Artificial Sequence: Synthetic oligonucleotide
  Target: SCN10A; (-) strand; PAM type: YTN; PAM sequence: CTT
atatcagagaaaacagacct

SEQ ID NO: 52198 - DNA, 20 bp, Artificial Sequence
  Description of Artificial Sequence: Synthetic oligonucleotide
  Target: SCN10A; (-) strand; PAM type: YTN; PAM sequence: TTC
ttatatcagagaaaacagac

SEQ ID NO: 52199 - DNA, 20 bp, Artificial Sequence
  Description of Artificial Sequence: Synthetic oligonucleotide
  Target: SCN10A; (-) strand; PAM type: YTN; PAM sequence: CTA
ttcttatatcagagaaaaca

SEQ ID NO: 52200 - DNA, 20 bp, Artificial Sequence
  Description of Artificial Sequence: Synthetic oligonucleotide
  Target: SCN10A; (-) strand; PAM type: YTN; PAM sequence: TTC
catgcaaatggaaaccaaaa

SEQ ID NO: 52201 - DNA, 20 bp, Artificial Sequence
  Description of Artificial Sequence: Synthetic oligonucleotide
  Target: SCN10A; (-) strand; PAM type: YTN; PAM sequence: TTA
aggtaaagagatgggaaaag

SEQ ID NO: 52202 - DNA, 20 bp, Artificial Sequence
  Description of Artificial Sequence: Synthetic oligonucleotide
  Target: SCN10A; (-) strand; PAM type: YTN; PAM sequence: CTT
aaggtaaagagatgggaaaa

SEQ ID NO: 52203 - DNA, 20 bp, Artificial Sequence
  Description of Artificial Sequence: Synthetic oligonucleotide
  Target: SCN10A; (-) strand; PAM type: YTN; PAM sequence: CTA
acacataaggagccacataa

SEQ ID NO: 52204 - DNA, 20 bp, Artificial Sequence
  Description of Artificial Sequence: Synthetic oligonucleotide
  Target: SCN10A; (-) strand; PAM type: YTN; PAM sequence: CTC
acctaacacataaggagcca

SEQ ID NO: 52205 - DNA, 20 bp, Artificial Sequence
  Description of Artificial Sequence: Synthetic oligonucleotide
  Target: SCN10A; (-) strand; PAM type: YTN; PAM sequence: TTC
aagagactcacctaacacat

SEQ ID NO: 52206 - DNA, 20 bp, Artificial Sequence
  Description of Artificial Sequence: Synthetic oligonucleotide
  Target: SCN10A; (-) strand; PAM type: YTN; PAM sequence: CTT
caagagactcacctaacaca

SEQ ID NO: 52207 - DNA, 20 bp, Artificial Sequence
  Description of Artificial Sequence: Synthetic oligonucleotide
  Target: SCN10A; (-) strand; PAM type: YTN; PAM sequence: CTG
tcttcaagagactcacctaa

SEQ ID NO: 52208 - DNA, 20 bp, Artificial Sequence
  Description of Artificial Sequence: Synthetic oligonucleotide
  Target: SCN10A; (-) strand; PAM type: YTN; PAM sequence: CTA
ctgtcttcaagagactcacc

SEQ ID NO: 52209 - DNA, 20 bp, Artificial Sequence
  Description of Artificial Sequence: Synthetic oligonucleotide
  Target: SCN10A; (-) strand; PAM type: YTN; PAM sequence: TTA
aaatatacagaagggcagaa

SEQ ID NO: 52210 - DNA, 20 bp, Artificial Sequence
  Description of Artificial Sequence: Synthetic oligonucleotide
  Target: SCN10A; (-) strand; PAM type: YTN; PAM sequence: CTT
aaaatatacagaagggcaga

SEQ ID NO: 52211 - DNA, 20 bp, Artificial Sequence
  Description of Artificial Sequence: Synthetic oligonucleotide
  Target: SCN10A; (-) strand; PAM type: YTN; PAM sequence: CTA
aatgatccacttaaaatata

SEQ ID NO: 52212 - DNA, 20 bp, Artificial Sequence
  Description of Artificial Sequence: Synthetic oligonucleotide
  Target: SCN10A; (-) strand; PAM type: YTN; PAM sequence: TTG
agtgtaaatgccctaaatga

SEQ ID NO: 52213 - DNA, 20 bp, Artificial Sequence
  Description of Artificial Sequence: Synthetic oligonucleotide
  Target: SCN10A; (-) strand; PAM type: YTN; PAM sequence: CTG
atgttgagtgtaaatgccct

SEQ ID NO: 52214 - DNA, 20 bp, Artificial Sequence
  Description of Artificial Sequence: Synthetic oligonucleotide
  Target: SCN10A; (-) strand; PAM type: YTN; PAM sequence: CTC
aatactgatgttgagtgtaa

SEQ ID NO: 52215 - DNA, 20 bp, Artificial Sequence
  Description of Artificial Sequence: Synthetic oligonucleotide
  Target: SCN10A; (-) strand; PAM type: YTN; PAM sequence: CTC
acatctcaatactgatgttg

SEQ ID NO: 52216 - DNA, 20 bp, Artificial Sequence
  Description of Artificial Sequence: Synthetic oligonucleotide
  Target: SCN10A; (-) strand; PAM type: YTN; PAM sequence: CTA
gcataatgaatagaagagta

SEQ ID NO: 52217 - DNA, 20 bp, Artificial Sequence
  Description of Artificial Sequence: Synthetic oligonucleotide
  Target: SCN10A; (-) strand; PAM type: YTN; PAM sequence: TTA
aggcaataactagcataatg

SEQ ID NO: 52218 - DNA, 20 bp, Artificial Sequence
  Description of Artificial Sequence: Synthetic oligonucleotide
  Target: SCN10A; (-) strand; PAM type: YTN; PAM sequence: CTA
taaaacaataacacaataaa

SEQ ID NO: 52219 - DNA, 20 bp, Artificial Sequence
  Description of Artificial Sequence: Synthetic oligonucleotide
  Target: SCN10A; (-) strand; PAM type: YTN; PAM sequence: TTA
aagcataaatatcaaaggac

SEQ ID NO: 52220 - DNA, 20 bp, Artificial Sequence
  Description of Artificial Sequence: Synthetic oligonucleotide
  Target: SCN10A; (-) strand; PAM type: YTN; PAM sequence: CTT
aaagcataaatatcaaagga

SEQ ID NO: 52221 - DNA, 20 bp, Artificial Sequence
  Description of Artificial Sequence: Synthetic oligonucleotide
  Target: SCN10A; (-) strand; PAM type: YTN; PAM sequence: CTC
cttaaagcataaatatcaaa

SEQ ID NO: 52222 - DNA, 20 bp, Artificial Sequence
  Description of Artificial Sequence: Synthetic oligonucleotide
  Target: SCN10A; (-) strand; PAM type: YTN; PAM sequence: TTA
aaatacaccaaaatagaacc

SEQ ID NO: 52223 - DNA, 20 bp, Artificial Sequence
  Description of Artificial Sequence: Synthetic oligonucleotide
  Target: SCN10A; (-) strand; PAM type: YTN; PAM sequence: CTT
aaaatacaccaaaatagaac

SEQ ID NO: 52224 - DNA, 20 bp, Artificial Sequence
  Description of Artificial Sequence: Synthetic oligonucleotide
  Target: SCN10A; (-) strand; PAM type: YTN; PAM sequence: TTG
aaataaaaccttaaaataca

SEQ ID NO: 52225 - DNA, 20 bp, Artificial Sequence
  Description of Artificial Sequence: Synthetic oligonucleotide
  Target: SCN10A; (-) strand; PAM type: YTN; PAM sequence: CTT
gaaataaaaccttaaaatac

SEQ ID NO: 52226 - DNA, 20 bp, Artificial Sequence
  Description of Artificial Sequence: Synthetic oligonucleotide
  Target: SCN10A; (-) strand; PAM type: YTN; PAM sequence: CTA
aatcttgaaataaaacctta

SEQ ID NO: 52227 - DNA, 20 bp, Artificial Sequence
  Description of Artificial Sequence: Synthetic oligonucleotide
  Target: SCN10A; (-) strand; PAM type: YTN; PAM sequence: TTC
taaatcttgaaataaaacct

SEQ ID NO: 52228 - DNA, 20 bp, Artificial Sequence
  Description of Artificial Sequence: Synthetic oligonucleotide
  Target: SCN10A; (-) strand; PAM type: YTN; PAM sequence: CTA
aaaggaattctaaatcttga

SEQ ID NO: 52229 - DNA, 20 bp, Artificial Sequence
  Description of Artificial Sequence: Synthetic oligonucleotide
  Target: SCN10A; (-) strand; PAM type: YTN; PAM sequence: CTA
caagaaatgctaaaaggaat

SEQ ID NO: 52230 - DNA, 20 bp, Artificial Sequence
  Description of Artificial Sequence: Synthetic oligonucleotide
  Target: SCN10A; (-) strand; PAM type: YTN; PAM sequence: CTA
ccaagccagcactacaagaa

SEQ ID NO: 52231 - DNA, 20 bp, Artificial Sequence
  Description of Artificial Sequence: Synthetic oligonucleotide
  Target: SCN10A; (-) strand; PAM type: YTN; PAM sequence: TTC
cactaccaagccagcactac

SEQ ID NO: 52232 - DNA, 20 bp, Artificial Sequence
  Description of Artificial Sequence: Synthetic oligonucleotide
  Target: SCN10A; (-) strand; PAM type: YTN; PAM sequence: TTT
ccactaccaagccagcacta

SEQ ID NO: 52233 - DNA, 20 bp, Artificial Sequence
  Description of Artificial Sequence: Synthetic oligonucleotide
  Target: SCN10A; (-) strand; PAM type: YTN; PAM sequence: TTT
tccactaccaagccagcact

SEQ ID NO: 52234 - DNA, 20 bp, Artificial Sequence
  Description of Artificial Sequence: Synthetic oligonucleotide
  Target: SCN10A; (-) strand; PAM type: YTN; PAM sequence: TTC
agacaaacaaatggtgagag

SEQ ID NO: 52235 - DNA, 20 bp, Artificial Sequence
  Description of Artificial Sequence: Synthetic oligonucleotide
  Target: SCN10A; (-) strand; PAM type: YTN; PAM sequence: TTT
cagacaaacaaatggtgaga

SEQ ID NO: 52236 - DNA, 20 bp, Artificial Sequence
  Description of Artificial Sequence: Synthetic oligonucleotide
  Target: SCN10A; (-) strand; PAM type: YTN; PAM sequence: TTT
tcagacaaacaaatggtgag

SEQ ID NO: 52237 - DNA, 20 bp, Artificial Sequence
  Description of Artificial Sequence: Synthetic oligonucleotide
  Target: SCN10A; (-) strand; PAM type: YTN; PAM sequence: TTT
ttcagacaaacaaatggtga

SEQ ID NO: 52238 - DNA, 20 bp, Artificial Sequence
  Description of Artificial Sequence: Synthetic oligonucleotide
  Target: SCN10A; (-) strand; PAM type: YTN; PAM sequence: TTT
tttcagacaaacaaatggtg

SEQ ID NO: 52239 - DNA, 20 bp, Artificial Sequence
  Description of Artificial Sequence: Synthetic oligonucleotide
  Target: SCN10A; (-) strand; PAM type: YTN; PAM sequence: TTT
ttttcagacaaacaaatggt

SEQ ID NO: 52240 - DNA, 20 bp, Artificial Sequence
  Description of Artificial Sequence: Synthetic oligonucleotide
  Target: SCN10A; (-) strand; PAM type: YTN; PAM sequence: TTC
ataagtgaagacaagataaa

SEQ ID NO: 52241 - DNA, 20 bp, Artificial Sequence
  Description of Artificial Sequence: Synthetic oligonucleotide
  Target: SCN10A; (-) strand; PAM type: YTN; PAM sequence: CTT
cataagtgaagacaagataa

SEQ ID NO: 52242 - DNA, 20 bp, Artificial Sequence
  Description of Artificial Sequence: Synthetic oligonucleotide
  Target: SCN10A; (-) strand; PAM type: YTN; PAM sequence: CTA
agcttcataagtgaagacaa

SEQ ID NO: 52243 - DNA, 20 bp, Artificial Sequence
  Description of Artificial Sequence: Synthetic oligonucleotide
  Target: SCN10A; (-) strand; PAM type: YTN; PAM sequence: TTG
tatgaagagaaactaagctt

SEQ ID NO: 52244 - DNA, 20 bp, Artificial Sequence
  Description of Artificial Sequence: Synthetic oligonucleotide
  Target: SCN10A; (-) strand; PAM type: YTN; PAM sequence: TTG
ccagccaagaatattgtatg

SEQ ID NO: 52245 - DNA, 20 bp, Artificial Sequence
  Description of Artificial Sequence: Synthetic oligonucleotide
  Target: SCN10A; (-) strand; PAM type: YTN; PAM sequence: CTG
aaacaaaataattgccagcc

SEQ ID NO: 52246 - DNA, 20 bp, Artificial Sequence
  Description of Artificial Sequence: Synthetic oligonucleotide
  Target: SCN10A; (-) strand; PAM type: YTN; PAM sequence: CTC
ctgaaacaaaataattgcca

SEQ ID NO: 52247 - DNA, 20 bp, Artificial Sequence
  Description of Artificial Sequence: Synthetic oligonucleotide
  Target: SCN10A; (-) strand; PAM type: YTN; PAM sequence: TTA
gcctcctgaaacaaaataat

SEQ ID NO: 52248 - DNA, 20 bp, Artificial Sequence
  Description of Artificial Sequence: Synthetic oligonucleotide
  Target: SCN10A; (-) strand; PAM type: YTN; PAM sequence: TTT
agcctcctgaaacaaaataa

SEQ ID NO: 52249 - DNA, 20 bp, Artificial Sequence
  Description of Artificial Sequence: Synthetic oligonucleotide
  Target: SCN10A; (-) strand; PAM type: YTN; PAM sequence: CTT
tagcctcctgaaacaaaata

SEQ ID NO: 52250 - DNA, 20 bp, Artificial Sequence
  Description of Artificial Sequence: Synthetic oligonucleotide
  Target: SCN10A; (-) strand; PAM type: YTN; PAM sequence: TTA
gggtcccatctttagcctcc

SEQ ID NO: 52251 - DNA, 20 bp, Artificial Sequence
  Description of Artificial Sequence: Synthetic oligonucleotide
  Target: SCN10A; (-) strand; PAM type: YTN; PAM sequence: TTG
caagccagaagggattaggg

SEQ ID NO: 52252 - DNA, 20 bp, Artificial Sequence
  Description of Artificial Sequence: Synthetic oligonucleotide
  Target: SCN10A; (-) strand; PAM type: YTN; PAM sequence: CTT
gcaagccagaagggattagg

SEQ ID NO: 52253 - DNA, 20 bp, Artificial Sequence
  Description of Artificial Sequence: Synthetic oligonucleotide
  Target: SCN10A; (-) strand; PAM type: YTN; PAM sequence: CTG
aaaccttgcaagccagaagg

SEQ ID NO: 52254 - DNA, 20 bp, Artificial Sequence
  Description of Artificial Sequence: Synthetic oligonucleotide
  Target: SCN10A; (-) strand; PAM type: YTN; PAM sequence: CTC
aactgaaaccttgcaagcca

SEQ ID NO: 52255 - DNA, 20 bp, Artificial Sequence
  Description of Artificial Sequence: Synthetic oligonucleotide
  Target: SCN10A; (-) strand; PAM type: YTN; PAM sequence: TTC
tcaactgaaaccttgcaagc

SEQ ID NO: 52256 - DNA, 20 bp, Artificial Sequence
  Description of Artificial Sequence: Synthetic oligonucleotide
  Target: SCN10A; (-) strand; PAM type: YTN; PAM sequence: TTT
ctcaactgaaaccttgcaag

SEQ ID NO: 52257 - DNA, 20 bp, Artificial Sequence
  Description of Artificial Sequence: Synthetic oligonucleotide
  Target: SCN10A; (-) strand; PAM type: YTN; PAM sequence: TTA
acagcagatttctcaactga

SEQ ID NO: 52258 - DNA, 20 bp, Artificial Sequence
  Description of Artificial Sequence: Synthetic oligonucleotide
  Target: SCN10A; (-) strand; PAM type: YTN; PAM sequence: TTA
cataagattaacagcagatt

SEQ ID NO: 52259 - DNA, 20 bp, Artificial Sequence
  Description of Artificial Sequence: Synthetic oligonucleotide
  Target: SCN10A; (-) strand; PAM type: YTN; PAM sequence: TTT
acataagattaacagcagat

SEQ ID NO: 52260 - DNA, 20 bp, Artificial Sequence
  Description of Artificial Sequence: Synthetic oligonucleotide
  Target: SCN10A; (-) strand; PAM type: YTN; PAM sequence: CTG
atttacataagattaacagc

SEQ ID NO: 52261 - DNA, 20 bp, Artificial Sequence
  Description of Artificial Sequence: Synthetic oligonucleotide
  Target: SCN10A; (-) strand; PAM type: YTN; PAM sequence: TTA
tctgatttacataagattaa

SEQ ID NO: 52262 - DNA, 20 bp, Artificial Sequence
  Description of Artificial Sequence: Synthetic oligonucleotide
  Target: SCN10A; (-) strand; PAM type: YTN; PAM sequence: CTA
taaaggaaaggttatctgat

SEQ ID NO: 52263 - DNA, 20 bp, Artificial Sequence
  Description of Artificial Sequence: Synthetic oligonucleotide
  Target: SCN10A; (-) strand; PAM type: YTN; PAM sequence: CTC
agataacctataaaggaaag

SEQ ID NO: 52264 - DNA, 20 bp, Artificial Sequence
  Description of Artificial Sequence: Synthetic oligonucleotide
  Target: SCN10A; (-) strand; PAM type: YTN; PAM sequence: CTG
tgagacaaaagcctcagata

SEQ ID NO: 52265 - DNA, 20 bp, Artificial Sequence
  Description of Artificial Sequence: Synthetic oligonucleotide
  Target: SCN10A; (-) strand; PAM type: YTN; PAM sequence: TTA
agagctgtgagacaaaagcc

SEQ ID NO: 52266 - DNA, 20 bp, Artificial Sequence
  Description of Artificial Sequence: Synthetic oligonucleotide
  Target: SCN10A; (-) strand; PAM type: YTN; PAM sequence: CTT
aagagctgtgagacaaaagc

SEQ ID NO: 52267 - DNA, 20 bp, Artificial Sequence
  Description of Artificial Sequence: Synthetic oligonucleotide
  Target: SCN10A; (-) strand; PAM type: YTN; PAM sequence: CTA
aagtcaagacaaagaaaaga

SEQ ID NO: 52268 - DNA, 20 bp, Artificial Sequence
  Description of Artificial Sequence: Synthetic oligonucleotide
  Target: SCN10A; (-) strand; PAM type: YTN; PAM sequence: TTA
tctaaagtcaagacaaagaa

SEQ ID NO: 52269 - DNA, 20 bp, Artificial Sequence
  Description of Artificial Sequence: Synthetic oligonucleotide
  Target: SCN10A; (-) strand; PAM type: YTN; PAM sequence: CTA
ggcaaatagacatcaggtta

SEQ ID NO: 52270 - DNA, 20 bp, Artificial Sequence
  Description of Artificial Sequence: Synthetic oligonucleotide
  Target: SCN10A; (-) strand; PAM type: YTN; PAM sequence: CTG
aaatgtgtcacaaaaaagat

SEQ ID NO: 52271 - DNA, 20 bp, Artificial Sequence
  Description of Artificial Sequence: Synthetic oligonucleotide
  Target: SCN10A; (-) strand; PAM type: YTN; PAM sequence: CTC
tgaaatgtgtcacaaaaaag

SEQ ID NO: 52272 - DNA, 20 bp, Artificial Sequence
  Description of Artificial Sequence: Synthetic oligonucleotide
  Target: SCN10A; (-) strand; PAM type: YTN; PAM sequence: CTC
aaagaatacctctgaaatgt

SEQ ID NO: 52273 - DNA, 20 bp, Artificial Sequence
  Description of Artificial Sequence: Synthetic oligonucleotide
  Target: SCN10A; (-) strand; PAM type: YTN; PAM sequence: TTA
gaaatatagatatccaaata

SEQ ID NO: 52274 - DNA, 20 bp, Artificial Sequence
  Description of Artificial Sequence: Synthetic oligonucleotide
  Target: SCN10A; (-) strand; PAM type: YTN; PAM sequence: TTG
ttagaaatatagatatccaa

SEQ ID NO: 52275 - DNA, 20 bp, Artificial Sequence
  Description of Artificial Sequence: Synthetic oligonucleotide
  Target: SCN10A; (-) strand; PAM type: YTN; PAM sequence: CTT
gttagaaatatagatatcca

SEQ ID NO: 52276 - DNA, 20 bp, Artificial Sequence
  Description of Artificial Sequence: Synthetic oligonucleotide
  Target: SCN10A; (-) strand; PAM type: YTN; PAM sequence: CTG
gccttgttagaaatatagat

SEQ ID NO: 52277 - DNA, 20 bp, Artificial Sequence
  Description of Artificial Sequence: Synthetic oligonucleotide
  Target: SCN10A; (-) strand; PAM type: YTN; PAM sequence: TTC
cctggccttgttagaaatat

SEQ ID NO: 52278 - DNA, 20 bp, Artificial Sequence
  Description of Artificial Sequence: Synthetic oligonucleotide
  Target: SCN10A; (-) strand; PAM type: YTN; PAM sequence: CTT
ccctggccttgttagaaata

SEQ ID NO: 52279 - DNA, 20 bp, Artificial Sequence
  Description of Artificial Sequence: Synthetic oligonucleotide
  Target: SCN10A; (-) strand; PAM type: YTN; PAM sequence: TTG
aggaaaacttccctggcctt

SEQ ID NO: 52280 - DNA, 20 bp, Artificial Sequence
  Description of Artificial Sequence: Synthetic oligonucleotide
  Target: SCN10A; (-) strand; PAM type: YTN; PAM sequence: TTG
agggaataattgaggaaaac

SEQ ID NO: 52281 - DNA, 20 bp, Artificial Sequence
  Description of Artificial Sequence: Synthetic oligonucleotide
  Target: SCN10A; (-) strand; PAM type: YTN; PAM sequence: TTT
gagggaataattgaggaaaa

SEQ ID NO: 52282 - DNA, 20 bp, Artificial Sequence
  Description of Artificial Sequence: Synthetic oligonucleotide
  Target: SCN10A; (-) strand; PAM type: YTN; PAM sequence: TTA
tttgagggaataattgagga

SEQ ID NO: 52283 - DNA, 20 bp, Artificial Sequence
  Description of Artificial Sequence: Synthetic oligonucleotide
  Target: SCN10A; (-) strand; PAM type: YTN; PAM sequence: CTT
atttgagggaataattgagg

SEQ ID NO: 52284 - DNA, 20 bp, Artificial Sequence
  Description of Artificial Sequence: Synthetic oligonucleotide
  Target: SCN10A; (-) strand; PAM type: YTN; PAM sequence: TTG
gaaaacttatttgagggaat

SEQ ID NO: 52285 - DNA, 20 bp, Artificial Sequence
  Description of Artificial Sequence: Synthetic oligonucleotide
  Target: SCN10A; (-) strand; PAM type: YTN; PAM sequence: TTT
ggaaaacttatttgagggaa

SEQ ID NO: 52286 - DNA, 20 bp, Artificial Sequence
  Description of Artificial Sequence: Synthetic oligonucleotide
  Target: SCN10A; (-) strand; PAM type: YTN; PAM sequence: CTA
aaagtttggaaaacttattt

SEQ ID NO: 52287 - DNA, 20 bp, Artificial Sequence
  Description of Artificial Sequence: Synthetic oligonucleotide
  Target: SCN10A; (-) strand; PAM type: YTN; PAM sequence: TTC
ccaaggaagaatagaaatct

SEQ ID NO: 52288 - DNA, 20 bp, Artificial Sequence
  Description of Artificial Sequence: Synthetic oligonucleotide
  Target: SCN10A; (-) strand; PAM type: YTN; PAM sequence: CTA
agaataatgggtgttcccaa

SEQ ID NO: 52289 - DNA, 20 bp, Artificial Sequence
  Description of Artificial Sequence: Synthetic oligonucleotide
  Target: SCN10A; (-) strand; PAM type: YTN; PAM sequence: TTG
gaatcatgtgaaacaaccaa

SEQ ID NO: 52290 - DNA, 20 bp, Artificial Sequence
  Description of Artificial Sequence: Synthetic oligonucleotide
  Target: SCN10A; (-) strand; PAM type: YTN; PAM sequence: TTT
ggaatcatgtgaaacaacca

SEQ ID NO: 52291 - DNA, 20 bp, Artificial Sequence
  Description of Artificial Sequence: Synthetic oligonucleotide
  Target: SCN10A; (-) strand; PAM type: YTN; PAM sequence: TTA
aaaaaatgacaaatcggcca

SEQ ID NO: 52292 - DNA, 20 bp, Artificial Sequence
  Description of Artificial Sequence: Synthetic oligonucleotide
  Target: SCN10A; (-) strand; PAM type: YTN; PAM sequence: TTT
aaaaaaatgacaaatcggcc

SEQ ID NO: 52293 - DNA, 20 bp, Artificial Sequence
  Description of Artificial Sequence: Synthetic oligonucleotide
  Target: SCN10A; (-) strand; PAM type: YTN; PAM sequence: TTT
taaaaaaatgacaaatcggc

SEQ ID NO: 52294 - DNA, 20 bp, Artificial Sequence
  Description of Artificial Sequence: Synthetic oligonucleotide
  Target: SCN10A; (-) strand; PAM type: YTN; PAM sequence: TTT
ttaaaaaaatgacaaatcgg

SEQ ID NO: 52295 - DNA, 20 bp, Artificial Sequence
  Description of Artificial Sequence: Synthetic oligonucleotide
  Target: SCN10A; (-) strand; PAM type: YTN; PAM sequence: CTA
agacacacaaaaagaaagaa

SEQ ID NO: 52296 - DNA, 20 bp, Artificial Sequence
  Description of Artificial Sequence: Synthetic oligonucleotide
  Target: SCN10A; (-) strand; PAM type: YTN; PAM sequence: TTA
atagacccaaactaagacac

SEQ ID NO: 52297 - DNA, 20 bp, Artificial Sequence
  Description of Artificial Sequence: Synthetic oligonucleotide
  Target: SCN10A; (-) strand; PAM type: YTN; PAM sequence: TTT
aatagacccaaactaagaca

SEQ ID NO: 52298 - DNA, 20 bp, Artificial Sequence
  Description of Artificial Sequence: Synthetic oligonucleotide
  Target: SCN10A; (-) strand; PAM type: YTN; PAM sequence: TTT
taatagacccaaactaagac

SEQ ID NO: 52299 - DNA, 20 bp, Artificial Sequence
  Description of Artificial Sequence: Synthetic oligonucleotide
  Target: SCN10A; (-) strand; PAM type: YTN; PAM sequence: CTT
ttaatagacccaaactaaga

SEQ ID NO: 52300 - DNA, 20 bp, Artificial Sequence
  Description of Artificial Sequence: Synthetic oligonucleotide
  Target: SCN10A; (-) strand; PAM type: YTN; PAM sequence: CTC
gaagacaaagcttttaatag

SEQ ID NO: 52301 - DNA, 20 bp, Artificial Sequence
  Description of Artificial Sequence: Synthetic oligonucleotide
  Target: SCN10A; (-) strand; PAM type: YTN; PAM sequence: TTC
agagctcgaagacaaagctt

SEQ ID NO: 52302 - DNA, 20 bp, Artificial Sequence
  Description of Artificial Sequence: Synthetic oligonucleotide
  Target: SCN10A; (-) strand; PAM type: YTN; PAM sequence: CTT
cagagctcgaagacaaagct

SEQ ID NO: 52303 - DNA, 20 bp, Artificial Sequence
  Description of Artificial Sequence: Synthetic oligonucleotide
  Target: SCN10A; (-) strand; PAM type: YTN; PAM sequence: CTA
gaacaagtagaagaaagaac

SEQ ID NO: 52304 - DNA, 20 bp, Artificial Sequence
  Description of Artificial Sequence: Synthetic oligonucleotide
  Target: SCN10A; (-) strand; PAM type: YTN; PAM sequence: TTC
aacaatagactagaacaagt

SEQ ID NO: 52305 - DNA, 20 bp, Artificial Sequence
  Description of Artificial Sequence: Synthetic oligonucleotide
  Target: SCN10A; (-) strand; PAM type: YTN; PAM sequence: TTT
caacaatagactagaacaag

SEQ ID NO: 52306 - DNA, 20 bp, Artificial Sequence
  Description of Artificial Sequence: Synthetic oligonucleotide
  Target: SCN10A; (-) strand; PAM type: YTN; PAM sequence: TTA
gagaaatacaaaatgcagtg

SEQ ID NO: 52307 - DNA, 20 bp, Artificial Sequence
  Description of Artificial Sequence: Synthetic oligonucleotide
  Target: SCN10A; (-) strand; PAM type: YTN; PAM sequence: CTT
agagaaatacaaaatgcagt

SEQ ID NO: 52308 - DNA, 20 bp, Artificial Sequence
  Description of Artificial Sequence: Synthetic oligonucleotide
  Target: SCN10A; (-) strand; PAM type: YTN; PAM sequence: CTC
acttagagaaatacaaaatg

SEQ ID NO: 52309 - DNA, 20 bp, Artificial Sequence
  Description of Artificial Sequence: Synthetic oligonucleotide
  Target: SCN10A; (-) strand; PAM type: YTN; PAM sequence: CTG
gaaatggaagactcacttag

SEQ ID NO: 52310 - DNA, 20 bp, Artificial Sequence
  Description of Artificial Sequence: Synthetic oligonucleotide
  Target: SCN10A; (-) strand; PAM type: YTN; PAM sequence: TTC
tggaaatggaagactcactt

SEQ ID NO: 52311 - DNA, 20 bp, Artificial Sequence
  Description of Artificial Sequence: Synthetic oligonucleotide
  Target: SCN10A; (-) strand; PAM type: YTN; PAM sequence: CTT
ctggaaatggaagactcact

SEQ ID NO: 52312 - DNA, 20 bp, Artificial Sequence
  Description of Artificial Sequence: Synthetic oligonucleotide
  Target: SCN10A; (-) strand; PAM type: YTN; PAM sequence: CTC
cagagaaatagatataaaga

SEQ ID NO: 52313 - DNA, 20 bp, Artificial Sequence
  Description of Artificial Sequence: Synthetic oligonucleotide
  Target: SCN10A; (-) strand; PAM type: YTN; PAM sequence: TTC
tccagagaaatagatataaa

SEQ ID NO: 52314 - DNA, 20 bp, Artificial Sequence
  Description of Artificial Sequence: Synthetic oligonucleotide
  Target: SCN10A; (-) strand; PAM type: YTN; PAM sequence: TTA
aaacaacaagatatggatgg

SEQ ID NO: 52315 - DNA, 20 bp, Artificial Sequence
  Description of Artificial Sequence: Synthetic oligonucleotide
  Target: SCN10A; (-) strand; PAM type: YTN; PAM sequence: TTT
aaaacaacaagatatggatg

SEQ ID NO: 52316 - DNA, 20 bp, Artificial Sequence
  Description of Artificial Sequence: Synthetic oligonucleotide
  Target: SCN10A; (-) strand; PAM type: YTN; PAM sequence: TTT
taaaacaacaagatatggat

SEQ ID NO: 52317 - DNA, 20 bp, Artificial Sequence
  Description of Artificial Sequence: Synthetic oligonucleotide
  Target: SCN10A; (-) strand; PAM type: YTN; PAM sequence: TTT
ttaaaacaacaagatatgga

SEQ ID NO: 52318 - DNA, 20 bp, Artificial Sequence
  Description of Artificial Sequence: Synthetic oligonucleotide
  Target: SCN10A; (-) strand; PAM type: YTN; PAM sequence: TTA
aagaaatttttaaaacaaca

SEQ ID NO: 52319 - DNA, 20 bp, Artificial Sequence
  Description of Artificial Sequence: Synthetic oligonucleotide
  Target: SCN10A; (-) strand; PAM type: YTN; PAM sequence: CTT
aaagaaatttttaaaacaac

SEQ ID NO: 52320 - DNA, 20 bp, Artificial Sequence
  Description of Artificial Sequence: Synthetic oligonucleotide
  Target: SCN10A; (-) strand; PAM type: YTN; PAM sequence: TTC
aaggagacaccagagaaaga

SEQ ID NO: 52321 - DNA, 20 bp, Artificial Sequence
  Description of Artificial Sequence: Synthetic oligonucleotide
  Target: SCN10A; (-) strand; PAM type: YTN; PAM sequence: TTA
agtgattcaaggagacacca

SEQ ID NO: 52322 - DNA, 20 bp, Artificial Sequence
  Description of Artificial Sequence: Synthetic oligonucleotide
  Target: SCN10A; (-) strand; PAM type: YTN; PAM sequence: TTA
ttaagtgattcaaggagaca

SEQ ID NO: 52323 - DNA, 20 bp, Artificial Sequence
  Description of Artificial Sequence: Synthetic oligonucleotide
  Target: SCN10A; (-) strand; PAM type: YTN; PAM sequence: CTG
attattaagtgattcaagga

SEQ ID NO: 52324 - DNA, 20 bp, Artificial Sequence
  Description of Artificial Sequence: Synthetic oligonucleotide
  Target: SCN10A; (-) strand; PAM type: YTN; PAM sequence: TTC
agaaggctgattattaagtg

SEQ ID NO: 52325 - DNA, 20 bp, Artificial Sequence
  Description of Artificial Sequence: Synthetic oligonucleotide
  Target: SCN10A; (-) strand; PAM type: YTN; PAM sequence: CTC
aaaaaaaaaaaaaaaagaat

SEQ ID NO: 52326 - DNA, 20 bp, Artificial Sequence
  Description of Artificial Sequence: Synthetic oligonucleotide
  Target: SCN10A; (-) strand; PAM type: YTN; PAM sequence: CTG
ggcaacaagagtgaaaatcc

SEQ ID NO: 52327 - DNA, 20 bp, Artificial Sequence
  Description of Artificial Sequence: Synthetic oligonucleotide
  Target: SCN10A; (-) strand; PAM type: YTN; PAM sequence: CTC
cagcctgggcaacaagagtg

SEQ ID NO: 52328 - DNA, 20 bp, Artificial Sequence
  Description of Artificial Sequence: Synthetic oligonucleotide
  Target: SCN10A; (-) strand; PAM type: YTN; PAM sequence: TTG
cactccagcctgggcaacaa

SEQ ID NO: 52329 - DNA, 20 bp, Artificial Sequence
  Description of Artificial Sequence: Synthetic oligonucleotide
  Target: SCN10A; (-) strand; PAM type: YTN; PAM sequence: CTG
agatcgcgccattgcactcc

SEQ ID NO: 52330 - DNA, 20 bp, Artificial Sequence
  Description of Artificial Sequence: Synthetic oligonucleotide
  Target: SCN10A; (-) strand; PAM type: YTN; PAM sequence: TTG
cggtgagctgagatcgcgcc

SEQ ID NO: 52331 - DNA, 20 bp, Artificial Sequence
  Description of Artificial Sequence: Synthetic oligonucleotide
  Target: SCN10A; (-) strand; PAM type: YTN; PAM sequence: CTG
ggaggcagaggttgcggtga

SEQ ID NO: 52332 - DNA, 20 bp, Artificial Sequence
  Description of Artificial Sequence: Synthetic oligonucleotide
  Target: SCN10A; (-) strand; PAM type: YTN; PAM sequence: TTG
aacctgggaggcagaggttg

SEQ ID NO: 52333 - DNA, 20 bp, Artificial Sequence
  Description of Artificial Sequence: Synthetic oligonucleotide
  Target: SCN10A; (-) strand; PAM type: YTN; PAM sequence: CTT
gaacctgggaggcagaggtt

SEQ ID NO: 52334 - DNA, 20 bp, Artificial Sequence
  Description of Artificial Sequence: Synthetic oligonucleotide
  Target: SCN10A; (-) strand; PAM type: YTN; PAM sequence: TTG
cttgaacctgggaggcagag

SEQ ID NO: 52335 - DNA, 20 bp, Artificial Sequence
  Description of Artificial Sequence: Synthetic oligonucleotide
  Target: SCN10A; (-) strand; PAM type: YTN; PAM sequence: CTG
aggcaggagaattgcttgaa

SEQ ID NO: 52336 - DNA, 20 bp, Artificial Sequence
  Description of Artificial Sequence: Synthetic oligonucleotide
  Target: SCN10A; (-) strand; PAM type: YTN; PAM sequence: CTC
aggagactgaggcaggagaa

SEQ ID NO: 52337 - DNA, 20 bp, Artificial Sequence
  Description of Artificial Sequence: Synthetic oligonucleotide
  Target: SCN10A; (-) strand; PAM type: YTN; PAM sequence: CTA
ctcaggagactgaggcagga

SEQ ID NO: 52338 - DNA, 20 bp, Artificial Sequence
  Description of Artificial Sequence: Synthetic oligonucleotide
  Target: SCN10A; (-) strand; PAM type: YTN; PAM sequence: CTG
taatcccagctactcaggag

SEQ ID NO: 52339 - DNA, 20 bp, Artificial Sequence
  Description of Artificial Sequence: Synthetic oligonucleotide
  Target: SCN10A; (-) strand; PAM type: YTN; PAM sequence: CTA
gatgtggtggtgcatgcctg

SEQ ID NO: 52340 - DNA, 20 bp, Artificial Sequence
  Description of Artificial Sequence: Synthetic oligonucleotide
  Target: SCN10A; (-) strand; PAM type: YTN; PAM sequence: TTA
gctagatgtggtggtgcatg

SEQ ID NO: 52341 - DNA, 20 bp, Artificial Sequence
  Description of Artificial Sequence: Synthetic oligonucleotide
  Target: SCN10A; (-) strand; PAM type: YTN; PAM sequence: CTA
aaaaatacaaaattagctag

SEQ ID NO: 52342 - DNA, 20 bp, Artificial Sequence
  Description of Artificial Sequence: Synthetic oligonucleotide
  Target: SCN10A; (-) strand; PAM type: YTN; PAM sequence: CTA
ctaaaaaatacaaaattagc

SEQ ID NO: 52343 - DNA, 20 bp, Artificial Sequence
  Description of Artificial Sequence: Synthetic oligonucleotide
  Target: SCN10A; (-) strand; PAM type: YTN; PAM sequence: CTC
tactaaaaaatacaaaatta

SEQ ID NO: 52344 - DNA, 20 bp, Artificial Sequence
  Description of Artificial Sequence: Synthetic oligonucleotide
  Target: SCN10A; (-) strand; PAM type: YTN; PAM sequence: CTG
aagccaacatggagaaaccc

SEQ ID NO: 52345 - DNA, 20 bp, Artificial Sequence
  Description of Artificial Sequence: Synthetic oligonucleotide
  Target: SCN10A; (-) strand; PAM type: YTN; PAM sequence: TTC
aagaccagcctgaagccaac

SEQ ID NO: 52346 - DNA, 20 bp, Artificial Sequence
  Description of Artificial Sequence: Synthetic oligonucleotide
  Target: SCN10A; (-) strand; PAM type: YTN; PAM sequence: CTG
aggtcagaagttcaagacca

SEQ ID NO: 52347 - DNA, 20 bp, Artificial Sequence
  Description of Artificial Sequence: Synthetic oligonucleotide
  Target: SCN10A; (-) strand; PAM type: YTN; PAM sequence: TTG
ggaggccaaggtgggcagat

SEQ ID NO: 52348 - DNA, 20 bp, Artificial Sequence
  Description of Artificial Sequence: Synthetic oligonucleotide
  Target: SCN10A; (-) strand; PAM type: YTN; PAM sequence: TTT
gggaggccaaggtgggcaga

SEQ ID NO: 52349 - DNA, 20 bp, Artificial Sequence
  Description of Artificial Sequence: Synthetic oligonucleotide
  Target: SCN10A; (-) strand; PAM type: YTN; PAM sequence: CTT
tgggaggccaaggtgggcag

SEQ ID NO: 52350 - DNA, 20 bp, Artificial Sequence
  Description of Artificial Sequence: Synthetic oligonucleotide
  Target: SCN10A; (-) strand; PAM type: YTN; PAM sequence: CTC
agcactttgggaggccaagg

SEQ ID NO: 52351 - DNA, 20 bp, Artificial Sequence
  Description of Artificial Sequence: Synthetic oligonucleotide
  Target: SCN10A; (-) strand; PAM type: YTN; PAM sequence: CTG
taatctcagcactttgggag

SEQ ID NO: 52352 - DNA, 20 bp, Artificial Sequence
  Description of Artificial Sequence: Synthetic oligonucleotide
  Target: SCN10A; (-) strand; PAM type: YTN; PAM sequence: CTC
acgcctgtaatctcagcact

SEQ ID NO: 52353 - DNA, 20 bp, Artificial Sequence
  Description of Artificial Sequence: Synthetic oligonucleotide
  Target: SCN10A; (-) strand; PAM type: YTN; PAM sequence: CTG
ggcacagtagctcacgcctg

SEQ ID NO: 52354 - DNA, 20 bp, Artificial Sequence
  Description of Artificial Sequence: Synthetic oligonucleotide
  Target: SCN10A; (-) strand; PAM type: YTN; PAM sequence: TTC
agggctgggcacagtagctc

SEQ ID NO: 52355 - DNA, 20 bp, Artificial Sequence
  Description of Artificial Sequence: Synthetic oligonucleotide
  Target: SCN10A; (-) strand; PAM type: YTN; PAM sequence: TTG
ccagataaagaattcagggc

SEQ ID NO: 52356 - DNA, 20 bp, Artificial Sequence
  Description of Artificial Sequence: Synthetic oligonucleotide
  Target: SCN10A; (-) strand; PAM type: YTN; PAM sequence: CTG
aattgccagataaagaattc

SEQ ID NO: 52357 - DNA, 20 bp, Artificial Sequence
  Description of Artificial Sequence: Synthetic oligonucleotide
  Target: SCN10A; (-) strand; PAM type: YTN; PAM sequence: CTC
tgaattgccagataaagaat

SEQ ID NO: 52358 - DNA, 20 bp, Artificial Sequence
  Description of Artificial Sequence: Synthetic oligonucleotide
  Target: SCN10A; (-) strand; PAM type: YTN; PAM sequence: CTA
agaagaaatctctgaattgc

SEQ ID NO: 52359 - DNA, 20 bp, Artificial Sequence
  Description of Artificial Sequence: Synthetic oligonucleotide
  Target: SCN10A; (-) strand; PAM type: YTN; PAM sequence: CTC
cccaacaatggatccaaact

SEQ ID NO: 52360 - DNA, 20 bp, Artificial Sequence
  Description of Artificial Sequence: Synthetic oligonucleotide
  Target: SCN10A; (-) strand; PAM type: YTN; PAM sequence: CTA
gctccccaacaatggatcca

SEQ ID NO: 52361 - DNA, 20 bp, Artificial Sequence
  Description of Artificial Sequence: Synthetic oligonucleotide
  Target: SCN10A; (-) strand; PAM type: YTN; PAM sequence: CTC
aaaagatcaaactagctccc

SEQ ID NO: 52362 - DNA, 20 bp, Artificial Sequence
  Description of Artificial Sequence: Synthetic oligonucleotide
  Target: SCN10A; (-) strand; PAM type: YTN; PAM sequence: TTC
aataacacccctcaaaagat

SEQ ID NO: 52363 - DNA, 20 bp, Artificial Sequence
  Description of Artificial Sequence: Synthetic oligonucleotide
  Target: SCN10A; (-) strand; PAM type: YTN; PAM sequence: CTG
gtaatatgacaaaagagggt

SEQ ID NO: 52364 - DNA, 20 bp, Artificial Sequence
  Description of Artificial Sequence: Synthetic oligonucleotide
  Target: SCN10A; (-) strand; PAM type: YTN; PAM sequence: TTC
tggtaatatgacaaaagagg

SEQ ID NO: 52365 - DNA, 20 bp, Artificial Sequence
  Description of Artificial Sequence: Synthetic oligonucleotide
  Target: SCN10A; (-) strand; PAM type: YTN; PAM sequence: CTC
aaatgagaaggaaccagaaa

SEQ ID NO: 52366 - DNA, 20 bp, Artificial Sequence
  Description of Artificial Sequence: Synthetic oligonucleotide
  Target: SCN10A; (-) strand; PAM type: YTN; PAM sequence: CTA
ctcaaatgagaaggaaccag

SEQ ID NO: 52367 - DNA, 20 bp, Artificial Sequence
  Description of Artificial Sequence: Synthetic oligonucleotide
  Target: SCN10A; (-) strand; PAM type: YTN; PAM sequence: CTG
aaatagtctactcaaatgag

SEQ ID NO: 52368 - DNA, 20 bp, Artificial Sequence
  Description of Artificial Sequence: Synthetic oligonucleotide
  Target: SCN10A; (-) strand; PAM type: YTN; PAM sequence: CTC
tgaaatagtctactcaaatg

SEQ ID NO: 52369 - DNA, 20 bp, Artificial Sequence
  Description of Artificial Sequence: Synthetic oligonucleotide
  Target: SCN10A; (-) strand; PAM type: YTN; PAM sequence: TTC
tctgaaatagtctactcaaa

SEQ ID NO: 52370 - DNA, 20 bp, Artificial Sequence
  Description of Artificial Sequence: Synthetic oligonucleotide
  Target: SCN10A; (-) strand; PAM type: YTN; PAM sequence: TTT
ctctgaaatagtctactcaa

SEQ ID NO: 52371 - DNA, 20 bp, Artificial Sequence
  Description of Artificial Sequence: Synthetic oligonucleotide
  Target: SCN10A; (-) strand; PAM type: YTN; PAM sequence: TTT
tctctgaaatagtctactca

SEQ ID NO: 52372 - DNA, 20 bp, Artificial Sequence
  Description of Artificial Sequence: Synthetic oligonucleotide
  Target: SCN10A; (-) strand; PAM type: YTN; PAM sequence: CTT
ttctctgaaatagtctactc

SEQ ID NO: 52373 - DNA, 20 bp, Artificial Sequence
  Description of Artificial Sequence: Synthetic oligonucleotide
  Target: SCN10A; (-) strand; PAM type: YTN; PAM sequence: TTC
cagatcttttctctgaaata

SEQ ID NO: 52374 - DNA, 20 bp, Artificial Sequence
  Description of Artificial Sequence: Synthetic oligonucleotide
  Target: SCN10A; (-) strand; PAM type: YTN; PAM sequence: TTC
agttccagatcttttctctg

SEQ ID NO: 52375 - DNA, 20 bp, Artificial Sequence
  Description of Artificial Sequence: Synthetic oligonucleotide
  Target: SCN10A; (-) strand; PAM type: YTN; PAM sequence: CTG
cacaacagccattcagttcc

SEQ ID NO: 52376 - DNA, 20 bp, Artificial Sequence
  Description of Artificial Sequence: Synthetic oligonucleotide
  Target: SCN10A; (-) strand; PAM type: YTN; PAM sequence: TTG
gggagagcaccacatcaaga

SEQ ID NO: 52377 - DNA, 20 bp, Artificial Sequence
  Description of Artificial Sequence: Synthetic oligonucleotide
  Target: SCN10A; (-) strand; PAM type: YTN; PAM sequence: CTC
aggaagccccatccccaggg

SEQ ID NO: 52378 - DNA, 20 bp, Artificial Sequence
  Description of Artificial Sequence: Synthetic oligonucleotide
  Target: SCN10A; (-) strand; PAM type: YTN; PAM sequence: CTC
tcaggaagccccatccccag

SEQ ID NO: 52379 - DNA, 20 bp, Artificial Sequence
  Description of Artificial Sequence: Synthetic oligonucleotide
  Target: SCN10A; (-) strand; PAM type: YTN; PAM sequence: CTG
cagtccagctctcaggaagc

SEQ ID NO: 52380 - DNA, 20 bp, Artificial Sequence
  Description of Artificial Sequence: Synthetic oligonucleotide
  Target: SCN10A; (-) strand; PAM type: YTN; PAM sequence: CTA
ggcccagaagaacaataacg

SEQ ID NO: 52381 - DNA, 20 bp, Artificial Sequence
  Description of Artificial Sequence: Synthetic oligonucleotide
  Target: SCN10A; (-) strand; PAM type: YTN; PAM sequence: CTG
tgtggctaggcccagaagaa

SEQ ID NO: 52382 - DNA, 20 bp, Artificial Sequence
  Description of Artificial Sequence: Synthetic oligonucleotide
  Target: SCN10A; (-) strand; PAM type: YTN; PAM sequence: CTC
tgtgtggctaggcccagaag

SEQ ID NO: 52383 - DNA, 20 bp, Artificial Sequence
  Description of Artificial Sequence: Synthetic oligonucleotide
  Target: SCN10A; (-) strand; PAM type: YTN; PAM sequence: CTG
gtagcccctctgtgtggcta

SEQ ID NO: 52384 - DNA, 20 bp, Artificial Sequence
  Description of Artificial Sequence: Synthetic oligonucleotide
  Target: SCN10A; (-) strand; PAM type: YTN; PAM sequence: CTA
ccccagagcctggtagcccc

SEQ ID NO: 52385 - DNA, 20 bp, Artificial Sequence
  Description of Artificial Sequence: Synthetic oligonucleotide
  Target: SCN10A; (-) strand; PAM type: YTN; PAM sequence: TTC
ccagtactaccccagagcct

SEQ ID NO: 52386 - DNA, 20 bp, Artificial Sequence
  Description of Artificial Sequence: Synthetic oligonucleotide
  Target: SCN10A; (-) strand; PAM type: YTN; PAM sequence: TTT
cccagtactaccccagagcc

SEQ ID NO: 52387 - DNA, 20 bp, Artificial Sequence
  Description of Artificial Sequence: Synthetic oligonucleotide
  Target: SCN10A; (-) strand; PAM type: YTN; PAM sequence: TTG
caggcatttcccagtactac

SEQ ID NO: 52388 - DNA, 20 bp, Artificial Sequence
  Description of Artificial Sequence: Synthetic oligonucleotide
  Target: SCN10A; (-) strand; PAM type: YTN; PAM sequence: CTT
gcaggcatttcccagtacta

SEQ ID NO: 52389 - DNA, 20 bp, Artificial Sequence
  Description of Artificial Sequence: Synthetic oligonucleotide
  Target: SCN10A; (-) strand; PAM type: YTN; PAM sequence: CTC
ttgcaggcatttcccagtac

SEQ ID NO: 52390 - DNA, 20 bp, Artificial Sequence
  Description of Artificial Sequence: Synthetic oligonucleotide
  Target: SCN10A; (-) strand; PAM type: YTN; PAM sequence: TTC
aagatcaatcacatcacagg

SEQ ID NO: 52391 - DNA, 20 bp, Artificial Sequence
  Description of Artificial Sequence: Synthetic oligonucleotide
  Target: SCN10A; (-) strand; PAM type: YTN; PAM sequence: CTT
caagatcaatcacatcacag

SEQ ID NO: 52392 - DNA, 20 bp, Artificial Sequence
  Description of Artificial Sequence: Synthetic oligonucleotide
  Target: SCN10A; (-) strand; PAM type: YTN; PAM sequence: CTG
ggagacttcaagatcaatca

SEQ ID NO: 52393 - DNA, 20 bp, Artificial Sequence
  Description of Artificial Sequence: Synthetic oligonucleotide
  Target: SCN10A; (-) strand; PAM type: YTN; PAM sequence: CTG
atatccatggctgggagact

SEQ ID NO: 52394 - DNA, 20 bp, Artificial Sequence
  Description of Artificial Sequence: Synthetic oligonucleotide
  Target: SCN10A; (-) strand; PAM type: YTN; PAM sequence: TTC
accagaacagatgctgatat

SEQ ID NO: 52395 - DNA, 20 bp, Artificial Sequence
  Description of Artificial Sequence: Synthetic oligonucleotide
  Target: SCN10A; (-) strand; PAM type: YTN; PAM sequence: CTT
caccagaacagatgctgata

SEQ ID NO: 52396 - DNA, 20 bp, Artificial Sequence
  Description of Artificial Sequence: Synthetic oligonucleotide
  Target: SCN10A; (-) strand; PAM type: YTN; PAM sequence: CTG
ccaccttcaccagaacagat

SEQ ID NO: 52397 - DNA, 20 bp, Artificial Sequence
  Description of Artificial Sequence: Synthetic oligonucleotide
  Target: SCN10A; (-) strand; PAM type: YTN; PAM sequence: CTC
tgccaccttcaccagaacag

SEQ ID NO: 52398 - DNA, 20 bp, Artificial Sequence
  Description of Artificial Sequence: Synthetic oligonucleotide
  Target: SCN10A; (-) strand; PAM type: YTN; PAM sequence: TTC
ctctgccaccttcaccagaa

SEQ ID NO: 52399 - DNA, 20 bp, Artificial Sequence
  Description of Artificial Sequence: Synthetic oligonucleotide
  Target: SCN10A; (-) strand; PAM type: YTN; PAM sequence: TTC
attcctctgccaccttcacc

SEQ ID NO: 52400 - DNA, 20 bp, Artificial Sequence
  Description of Artificial Sequence: Synthetic oligonucleotide
  Target: SCN10A; (-) strand; PAM type: YTN; PAM sequence: CTT
cattcctctgccaccttcac

SEQ ID NO: 52401 - DNA, 20 bp, Artificial Sequence
  Description of Artificial Sequence: Synthetic oligonucleotide
  Target: SCN10A; (-) strand; PAM type: YTN; PAM sequence: CTA
cttcattcctctgccacctt

SEQ ID NO: 52402 - DNA, 20 bp, Artificial Sequence
  Description of Artificial Sequence: Synthetic oligonucleotide
  Target: SCN10A; (-) strand; PAM type: YTN; PAM sequence: CTC
tacttcattcctctgccacc

SEQ ID NO: 52403 - DNA, 20 bp, Artificial Sequence
  Description of Artificial Sequence: Synthetic oligonucleotide
  Target: SCN10A; (-) strand; PAM type: YTN; PAM sequence: CTC
acagactctacttcattcct

SEQ ID NO: 52404 - DNA, 20 bp, Artificial Sequence
  Description of Artificial Sequence: Synthetic oligonucleotide
  Target: SCN10A; (-) strand; PAM type: YTN; PAM sequence: CTC
tcacagactctacttcattc

SEQ ID NO: 52405 - DNA, 20 bp, Artificial Sequence
  Description of Artificial Sequence: Synthetic oligonucleotide
  Target: SCN10A; (-) strand; PAM type: YTN; PAM sequence: CTA
ggactctcacagactctact

SEQ ID NO: 52406 - DNA, 20 bp, Artificial Sequence
  Description of Artificial Sequence: Synthetic oligonucleotide
  Target: SCN10A; (-) strand; PAM type: YTN; PAM sequence: CTA
cagcctaggactctcacaga

SEQ ID NO: 52407 - DNA, 20 bp, Artificial Sequence
  Description of Artificial Sequence: Synthetic oligonucleotide
  Target: SCN10A; (-) strand; PAM type: YTN; PAM sequence: CTA
tctacagcctaggactctca

SEQ ID NO: 52408 - DNA, 20 bp, Artificial Sequence
  Description of Artificial Sequence: Synthetic oligonucleotide
  Target: SCN10A; (-) strand; PAM type: YTN; PAM sequence: CTA
aatctatctacagcctagga

SEQ ID NO: 52409 - DNA, 20 bp, Artificial Sequence
  Description of Artificial Sequence: Synthetic oligonucleotide
  Target: SCN10A; (-) strand; PAM type: YTN; PAM sequence: TTC
aagaaagccagcacactaaa

SEQ ID NO: 52410 - DNA, 20 bp, Artificial Sequence
  Description of Artificial Sequence: Synthetic oligonucleotide
  Target: SCN10A; (-) strand; PAM type: YTN; PAM sequence: CTA
gcattcaagaaagccagcac

SEQ ID NO: 52411 - DNA, 20 bp, Artificial Sequence
  Description of Artificial Sequence: Synthetic oligonucleotide
  Target: SCN10A; (-) strand; PAM type: YTN; PAM sequence: CTA
acataactagcattcaagaa

SEQ ID NO: 52412 - DNA, 20 bp, Artificial Sequence
  Description of Artificial Sequence: Synthetic oligonucleotide
  Target: SCN10A; (-) strand; PAM type: YTN; PAM sequence: CTG
ctaacataactagcattcaa

SEQ ID NO: 52413 - DNA, 20 bp, Artificial Sequence
  Description of Artificial Sequence: Synthetic oligonucleotide
  Target: SCN10A; (-) strand; PAM type: YTN; PAM sequence: TTC
actgctaacataactagcat

SEQ ID NO: 52414 - DNA, 20 bp, Artificial Sequence
  Description of Artificial Sequence: Synthetic oligonucleotide
  Target: SCN10A; (-) strand; PAM type: YTN; PAM sequence: CTT
cactgctaacataactagca

SEQ ID NO: 52415 - DNA, 20 bp, Artificial Sequence
  Description of Artificial Sequence: Synthetic oligonucleotide
  Target: SCN10A; (-) strand; PAM type: YTN; PAM sequence: CTG
tccatatgacaacttcactg

SEQ ID NO: 52416 - DNA, 20 bp, Artificial Sequence
  Description of Artificial Sequence: Synthetic oligonucleotide
  Target: SCN10A; (-) strand; PAM type: YTN; PAM sequence: CTG
agtctgtccatatgacaact

SEQ ID NO: 52417 - DNA, 20 bp, Artificial Sequence
  Description of Artificial Sequence: Synthetic oligonucleotide
  Target: SCN10A; (-) strand; PAM type: YTN; PAM sequence: CTA
accagacgtcctgagtctgt

SEQ ID NO: 52418 - DNA, 20 bp, Artificial Sequence
  Description of Artificial Sequence: Synthetic oligonucleotide
  Target: SCN10A; (-) strand; PAM type: YTN; PAM sequence: CTG
gctaaccagacgtcctgagt

SEQ ID NO: 52419 - DNA, 20 bp, Artificial Sequence
  Description of Artificial Sequence: Synthetic oligonucleotide
  Target: SCN10A; (-) strand; PAM type: YTN; PAM sequence: CTG
caacatcctggctaaccaga

SEQ ID NO: 52420 - DNA, 20 bp, Artificial Sequence
  Description of Artificial Sequence: Synthetic oligonucleotide
  Target: SCN10A; (-) strand; PAM type: YTN; PAM sequence: CTG
cctgcaacatcctggctaac

SEQ ID NO: 52421 - DNA, 20 bp, Artificial Sequence
  Description of Artificial Sequence: Synthetic oligonucleotide
  Target: SCN10A; (-) strand; PAM type: YTN; PAM sequence: TTG
cactgcctgcaacatcctgg

SEQ ID NO: 52422 - DNA, 20 bp, Artificial Sequence
  Description of Artificial Sequence: Synthetic oligonucleotide
  Target: SCN10A; (-) strand; PAM type: YTN; PAM sequence: TTG
atcccaggaaaaagaaaaca

SEQ ID NO: 52423 - DNA, 20 bp, Artificial Sequence
  Description of Artificial Sequence: Synthetic oligonucleotide
  Target: SCN10A; (-) strand; PAM type: YTN; PAM sequence: TTT
gatcccaggaaaaagaaaac

SEQ ID NO: 52424 - DNA, 20 bp, Artificial Sequence
  Description of Artificial Sequence: Synthetic oligonucleotide
  Target: SCN10A; (-) strand; PAM type: YTN; PAM sequence: CTT
tgatcccaggaaaaagaaaa

SEQ ID NO: 52425 - DNA, 20 bp, Artificial Sequence
  Description of Artificial Sequence: Synthetic oligonucleotide
  Target: SCN10A; (-) strand; PAM type: YTN; PAM sequence: CTC
atgacagaataactttgatc

SEQ ID NO: 52426 - DNA, 20 bp, Artificial Sequence
  Description of Artificial Sequence: Synthetic oligonucleotide
  Target: SCN10A; (-) strand; PAM type: YTN; PAM sequence: TTA
aagcaactcatgacagaata

SEQ ID NO: 52427 - DNA, 20 bp, Artificial Sequence
  Description of Artificial Sequence: Synthetic oligonucleotide
  Target: SCN10A; (-) strand; PAM type: YTN; PAM sequence: CTC
aggccattaaagcaactcat

SEQ ID NO: 52428 - DNA, 20 bp, Artificial Sequence
  Description of Artificial Sequence: Synthetic oligonucleotide
  Target: SCN10A; (-) strand; PAM type: YTN; PAM sequence: CTG
gaggtcaaacagctcaggcc

SEQ ID NO: 52429 - DNA, 20 bp, Artificial Sequence
  Description of Artificial Sequence: Synthetic oligonucleotide
  Target: SCN10A; (-) strand; PAM type: YTN; PAM sequence: CTA
ccggctggaggtcaaacagc

SEQ ID NO: 52430 - DNA, 20 bp, Artificial Sequence
  Description of Artificial Sequence: Synthetic oligonucleotide
  Target: SCN10A; (-) strand; PAM type: YTN; PAM sequence: TTG
aaagcatcacctaccggctg

SEQ ID NO: 52431 - DNA, 20 bp, Artificial Sequence
  Description of Artificial Sequence: Synthetic oligonucleotide
  Target: SCN10A; (-) strand; PAM type: YTN; PAM sequence: CTT
gaaagcatcacctaccggct

SEQ ID NO: 52432 - DNA, 20 bp, Artificial Sequence
  Description of Artificial Sequence: Synthetic oligonucleotide
  Target: SCN10A; (-) strand; PAM type: YTN; PAM sequence: CTC
ttgaaagcatcacctaccgg

SEQ ID NO: 52433 - DNA, 20 bp, Artificial Sequence
  Description of Artificial Sequence: Synthetic oligonucleotide
  Target: SCN10A; (-) strand; PAM type: YTN; PAM sequence: CTC
tcttgaaagcatcacctacc

SEQ ID NO: 52434 - DNA, 20 bp, Artificial Sequence
  Description of Artificial Sequence: Synthetic oligonucleotide
  Target: SCN10A; (-) strand; PAM type: YTN; PAM sequence: CTA
gtgctctcttgaaagcatca

SEQ ID NO: 52435 - DNA, 20 bp, Artificial Sequence
  Description of Artificial Sequence: Synthetic oligonucleotide
  Target: SCN10A; (-) strand; PAM type: YTN; PAM sequence: CTA
atgcactagtgctctcttga

SEQ ID NO: 52436 - DNA, 20 bp, Artificial Sequence
  Description of Artificial Sequence: Synthetic oligonucleotide
  Target: SCN10A; (-) strand; PAM type: YTN; PAM sequence: CTA
ctaatgcactagtgctctct

SEQ ID NO: 52437 - DNA, 20 bp, Artificial Sequence
  Description of Artificial Sequence: Synthetic oligonucleotide
  Target: SCN10A; (-) strand; PAM type: YTN; PAM sequence: TTC
tactaatgcactagtgctct

SEQ ID NO: 52438 - DNA, 20 bp, Artificial Sequence
  Description of Artificial Sequence: Synthetic oligonucleotide
  Target: SCN10A; (-) strand; PAM type: YTN; PAM sequence: CTT
ctactaatgcactagtgctc

SEQ ID NO: 52439 - DNA, 20 bp, Artificial Sequence
  Description of Artificial Sequence: Synthetic oligonucleotide
  Target: SCN10A; (-) strand; PAM type: YTN; PAM sequence: TTA
gatcccccttctactaatgc

SEQ ID NO: 52440 - DNA, 20 bp, Artificial Sequence
  Description of Artificial Sequence: Synthetic oligonucleotide
  Target: SCN10A; (-) strand; PAM type: YTN; PAM sequence: CTT
agatcccccttctactaatg

SEQ ID NO: 52441 - DNA, 20 bp, Artificial Sequence
  Description of Artificial Sequence: Synthetic oligonucleotide
  Target: SCN10A; (-) strand; PAM type: YTN; PAM sequence: TTA
gggtgagcttagatccccct

SEQ ID NO: 52442 - DNA, 20 bp, Artificial Sequence
  Description of Artificial Sequence: Synthetic oligonucleotide
  Target: SCN10A; (-) strand; PAM type: YTN; PAM sequence: CTT
agggtgagcttagatccccc

SEQ ID NO: 52443 - DNA, 20 bp, Artificial Sequence
  Description of Artificial Sequence: Synthetic oligonucleotide
  Target: SCN10A; (-) strand; PAM type: YTN; PAM sequence: CTG
gccaacttagggtgagctta

SEQ ID NO: 52444 - DNA, 20 bp, Artificial Sequence
  Description of Artificial Sequence: Synthetic oligonucleotide
  Target: SCN10A; (-) strand; PAM type: YTN; PAM sequence: TTA
ccctggccaacttagggtga

SEQ ID NO: 52445 - DNA, 20 bp, Artificial Sequence
  Description of Artificial Sequence: Synthetic oligonucleotide
  Target: SCN10A; (-) strand; PAM type: YTN; PAM sequence: TTT
accctggccaacttagggtg

SEQ ID NO: 52446 - DNA, 20 bp, Artificial Sequence
  Description of Artificial Sequence: Synthetic oligonucleotide
  Target: SCN10A; (-) strand; PAM type: YTN; PAM sequence: CTA
aaatatttaccctggccaac

SEQ ID NO: 52447 - DNA, 20 bp, Artificial Sequence
  Description of Artificial Sequence: Synthetic oligonucleotide
  Target: SCN10A; (-) strand; PAM type: YTN; PAM sequence: CTA
agaaactaaaatatttaccc

SEQ ID NO: 52448 - DNA, 20 bp, Artificial Sequence
  Description of Artificial Sequence: Synthetic oligonucleotide
  Target: SCN10A; (-) strand; PAM type: YTN; PAM sequence: CTC
atcacctaagaaactaaaat

SEQ ID NO: 52449 - DNA, 20 bp, Artificial Sequence
  Description of Artificial Sequence: Synthetic oligonucleotide
  Target: SCN10A; (-) strand; PAM type: YTN; PAM sequence: CTG
ctcatcacctaagaaactaa

SEQ ID NO: 52450 - DNA, 20 bp, Artificial Sequence
  Description of Artificial Sequence: Synthetic oligonucleotide
  Target: SCN10A; (-) strand; PAM type: YTN; PAM sequence: TTA
tggccctgctcatcacctaa

SEQ ID NO: 52451 - DNA, 20 bp, Artificial Sequence
  Description of Artificial Sequence: Synthetic oligonucleotide
  Target: SCN10A; (-) strand; PAM type: YTN; PAM sequence: TTT
atggccctgctcatcaccta

SEQ ID NO: 52452 - DNA, 20 bp, Artificial Sequence
  Description of Artificial Sequence: Synthetic oligonucleotide
  Target: SCN10A; (-) strand; PAM type: YTN; PAM sequence: CTT
tatggccctgctcatcacct

SEQ ID NO: 52453 - DNA, 20 bp, Artificial Sequence
  Description of Artificial Sequence: Synthetic oligonucleotide
  Target: SCN10A; (-) strand; PAM type: YTN; PAM sequence: CTC
ggaagctttatggccctgct

SEQ ID NO: 52454 - DNA, 20 bp, Artificial Sequence
  Description of Artificial Sequence: Synthetic oligonucleotide
  Target: SCN10A; (-) strand; PAM type: YTN; PAM sequence: CTC
tcggaagctttatggccctg

SEQ ID NO: 52455 - DNA, 20 bp, Artificial Sequence
  Description of Artificial Sequence: Synthetic oligonucleotide
  Target: SCN10A; (-) strand; PAM type: YTN; PAM sequence: CTG
aacacaaaacccagaaactc

SEQ ID NO: 52456 - DNA, 20 bp, Artificial Sequence
  Description of Artificial Sequence: Synthetic oligonucleotide
  Target: SCN10A; (-) strand; PAM type: YTN; PAM sequence: TTG
gtagctgaacacaaaaccca

SEQ ID NO: 52457 - DNA, 20 bp, Artificial Sequence
  Description of Artificial Sequence: Synthetic oligonucleotide
  Target: SCN10A; (-) strand; PAM type: YTN; PAM sequence: CTT
ggtagctgaacacaaaaccc

SEQ ID NO: 52458 - DNA, 20 bp, Artificial Sequence
  Description of Artificial Sequence: Synthetic oligonucleotide
  Target: SCN10A; (-) strand; PAM type: YTN; PAM sequence: CTG
ccttggtagctgaacacaaa

SEQ ID NO: 52459 - DNA, 20 bp, Artificial Sequence
  Description of Artificial Sequence: Synthetic oligonucleotide
  Target: SCN10A; (-) strand; PAM type: YTN; PAM sequence: CTA
cctgccttggtagctgaaca

SEQ ID NO: 52460 - DNA, 20 bp, Artificial Sequence
  Description of Artificial Sequence: Synthetic oligonucleotide
  Target: SCN10A; (-) strand; PAM type: YTN; PAM sequence: TTC
cctacctgccttggtagctg

SEQ ID NO: 52461 - DNA, 20 bp, Artificial Sequence
  Description of Artificial Sequence: Synthetic oligonucleotide
  Target: SCN10A; (-) strand; PAM type: YTN; PAM sequence: TTT
ccctacctgccttggtagct

SEQ ID NO: 52462 - DNA, 20 bp, Artificial Sequence
  Description of Artificial Sequence: Synthetic oligonucleotide
  Target: SCN10A; (-) strand; PAM type: YTN; PAM sequence: CTG
atggtatttccctacctgcc

SEQ ID NO: 52463 - DNA, 20 bp, Artificial Sequence
  Description of Artificial Sequence: Synthetic oligonucleotide
  Target: SCN10A; (-) strand; PAM type: YTN; PAM sequence: CTG
cccccacctgatggtatttc

SEQ ID NO: 52464 - DNA, 20 bp, Artificial Sequence
  Description of Artificial Sequence: Synthetic oligonucleotide
  Target: SCN10A; (-) strand; PAM type: YTN; PAM sequence: CTA
cccctgcccccacctgatgg

SEQ ID NO: 52465 - DNA, 20 bp, Artificial Sequence
  Description of Artificial Sequence: Synthetic oligonucleotide
  Target: SCN10A; (-) strand; PAM type: YTN; PAM sequence: CTC
acctacccctgcccccacct

SEQ ID NO: 52466 - DNA, 20 bp, Artificial Sequence
  Description of Artificial Sequence: Synthetic oligonucleotide
  Target: SCN10A; (-) strand; PAM type: YTN; PAM sequence: CTA
gactcacctacccctgcccc

SEQ ID NO: 52467 - DNA, 20 bp, Artificial Sequence
  Description of Artificial Sequence: Synthetic oligonucleotide
  Target: SCN10A; (-) strand; PAM type: YTN; PAM sequence: CTG
agtctagactcacctacccc

SEQ ID NO: 52468 - DNA, 20 bp, Artificial Sequence
  Description of Artificial Sequence: Synthetic oligonucleotide
  Target: SCN10A; (-) strand; PAM type: YTN; PAM sequence: CTA
cccaagaagggtctgagtct

SEQ ID NO: 52469 - DNA, 20 bp, Artificial Sequence
  Description of Artificial Sequence: Synthetic oligonucleotide
  Target: SCN10A; (-) strand; PAM type: YTN; PAM sequence: CTG
agaaccaacccccatccacc

SEQ ID NO: 52470 - DNA, 20 bp, Artificial Sequence
  Description of Artificial Sequence: Synthetic oligonucleotide
  Target: SCN10A; (-) strand; PAM type: YTN; PAM sequence: CTG
gcctgagaaccaacccccat

SEQ ID NO: 52471 - DNA, 20 bp, Artificial Sequence
  Description of Artificial Sequence: Synthetic oligonucleotide
  Target: SCN10A; (-) strand; PAM type: YTN; PAM sequence: CTG
gaacacaaccccactggcct

SEQ ID NO: 52472 - DNA, 20 bp, Artificial Sequence
  Description of Artificial Sequence: Synthetic oligonucleotide
  Target: SCN10A; (-) strand; PAM type: YTN; PAM sequence: CTC
tggaacacaaccccactggc

SEQ ID NO: 52473 - DNA, 20 bp, Artificial Sequence
  Description of Artificial Sequence: Synthetic oligonucleotide
  Target: SCN10A; (-) strand; PAM type: YTN; PAM sequence: TTC
cctctggaacacaaccccac

SEQ ID NO: 52474 - DNA, 20 bp, Artificial Sequence
  Description of Artificial Sequence: Synthetic oligonucleotide
  Target: SCN10A; (-) strand; PAM type: YTN; PAM sequence: CTA
tggcacagcagaggcagcca

SEQ ID NO: 52475 - DNA, 20 bp, Artificial Sequence
  Description of Artificial Sequence: Synthetic oligonucleotide
  Target: SCN10A; (-) strand; PAM type: YTN; PAM sequence: CTC
tatggcacagcagaggcagc

SEQ ID NO: 52476 - DNA, 20 bp, Artificial Sequence
  Description of Artificial Sequence: Synthetic oligonucleotide
  Target: SCN10A; (-) strand; PAM type: YTN; PAM sequence: CTG
gagaactctatggcacagca

SEQ ID NO: 52477 - DNA, 20 bp, Artificial Sequence
  Description of Artificial Sequence: Synthetic oligonucleotide
  Target: SCN10A; (-) strand; PAM type: YTN; PAM sequence: TTC
cctggagaactctatggcac

SEQ ID NO: 52478 - DNA, 20 bp, Artificial Sequence
  Description of Artificial Sequence: Synthetic oligonucleotide
  Target: SCN10A; (-) strand; PAM type: YTN; PAM sequence: CTT
ccctggagaactctatggca

SEQ ID NO: 52479 - DNA, 20 bp, Artificial Sequence
  Description of Artificial Sequence: Synthetic oligonucleotide
  Target: SCN10A; (-) strand; PAM type: YTN; PAM sequence: CTA
tcccccacttccctggagaa

SEQ ID NO: 52480 - DNA, 20 bp, Artificial Sequence
  Description of Artificial Sequence: Synthetic oligonucleotide
  Target: SCN10A; (-) strand; PAM type: YTN; PAM sequence: CTA
gcagctatcccccacttccc

SEQ ID NO: 52481 - DNA, 20 bp, Artificial Sequence
  Description of Artificial Sequence: Synthetic oligonucleotide
  Target: SCN10A; (-) strand; PAM type: YTN; PAM sequence: CTC
actagcagctatcccccact

SEQ ID NO: 52482 - DNA, 20 bp, Artificial Sequence
  Description of Artificial Sequence: Synthetic oligonucleotide
  Target: SCN10A; (-) strand; PAM type: YTN; PAM sequence: CTC
tcactagcagctatccccca

SEQ ID NO: 52483 - DNA, 20 bp, Artificial Sequence
  Description of Artificial Sequence: Synthetic oligonucleotide
  Target: SCN10A; (-) strand; PAM type: YTN; PAM sequence: CTA
ggtgaggcctctcactagca

SEQ ID NO: 52484 - DNA, 20 bp, Artificial Sequence
  Description of Artificial Sequence: Synthetic oligonucleotide
  Target: SCN10A; (-) strand; PAM type: YTN; PAM sequence: CTA
catgagagctaggtgaggcc

SEQ ID NO: 52485 - DNA, 20 bp, Artificial Sequence
  Description of Artificial Sequence: Synthetic oligonucleotide
  Target: SCN10A; (-) strand; PAM type: YTN; PAM sequence: CTC
accaactacatgagagctag

SEQ ID NO: 52486 - DNA, 20 bp, Artificial Sequence
  Description of Artificial Sequence: Synthetic oligonucleotide
  Target: SCN10A; (-) strand; PAM type: YTN; PAM sequence: CTG
caggagcaagaccagcctca

SEQ ID NO: 52487 - DNA, 20 bp, Artificial Sequence
  Description of Artificial Sequence: Synthetic oligonucleotide
  Target: SCN10A; (-) strand; PAM type: YTN; PAM sequence: CTG
agtagggcactgcaggagca

SEQ ID NO: 52488 - DNA, 20 bp, Artificial Sequence
  Description of Artificial Sequence: Synthetic oligonucleotide
  Target: SCN10A; (-) strand; PAM type: YTN; PAM sequence: CTG
gggcaaggtctgagtagggc

SEQ ID NO: 52489 - DNA, 20 bp, Artificial Sequence
  Description of Artificial Sequence: Synthetic oligonucleotide
  Target: SCN10A; (-) strand; PAM type: YTN; PAM sequence: CTC
acagcctggggcaaggtctg

SEQ ID NO: 52490 - DNA, 20 bp, Artificial Sequence
  Description of Artificial Sequence: Synthetic oligonucleotide
  Target: SCN10A; (-) strand; PAM type: YTN; PAM sequence: CTC
agtggggaagctcacagcct

SEQ ID NO: 52491 - DNA, 20 bp, Artificial Sequence
  Description of Artificial Sequence: Synthetic oligonucleotide
  Target: SCN10A; (-) strand; PAM type: YTN; PAM sequence: TTC
tcagtggggaagctcacagc

SEQ ID NO: 52492 - DNA, 20 bp, Artificial Sequence
  Description of Artificial Sequence: Synthetic oligonucleotide
  Target: SCN10A; (-) strand; PAM type: YTN; PAM sequence: TTT
ctcagtggggaagctcacag

SEQ ID NO: 52493 - DNA, 20 bp, Artificial Sequence
  Description of Artificial Sequence: Synthetic oligonucleotide
  Target: SCN10A; (-) strand; PAM type: YTN; PAM sequence: CTT
tctcagtggggaagctcaca

SEQ ID NO: 52494 - DNA, 20 bp, Artificial Sequence
  Description of Artificial Sequence: Synthetic oligonucleotide
  Target: SCN10A; (-) strand; PAM type: YTN; PAM sequence: TTC
tttctcagtggggaagctca

SEQ ID NO: 52495 - DNA, 20 bp, Artificial Sequence
  Description of Artificial Sequence: Synthetic oligonucleotide
  Target: SCN10A; (-) strand; PAM type: YTN; PAM sequence: TTT
ctttctcagtggggaagctc

SEQ ID NO: 52496 - DNA, 20 bp, Artificial Sequence
  Description of Artificial Sequence: Synthetic oligonucleotide
  Target: SCN10A; (-) strand; PAM type: YTN; PAM sequence: CTT
tctttctcagtggggaagct

SEQ ID NO: 52497 - DNA, 20 bp, Artificial Sequence
  Description of Artificial Sequence: Synthetic oligonucleotide
  Target: SCN10A; (-) strand; PAM type: YTN; PAM sequence: CTG
caagcagacagtgagggatg

SEQ ID NO: 52498 - DNA, 20 bp, Artificial Sequence
  Description of Artificial Sequence: Synthetic oligonucleotide
  Target: SCN10A; (-) strand; PAM type: YTN; PAM sequence: TTG
agcagaatccagggggcaaa

SEQ ID NO: 52499 - DNA, 20 bp, Artificial Sequence
  Description of Artificial Sequence: Synthetic oligonucleotide
  Target: SCN10A; (-) strand; PAM type: YTN; PAM sequence: CTT
gagcagaatccagggggcaa

SEQ ID NO: 52500 - DNA, 20 bp, Artificial Sequence
  Description of Artificial Sequence: Synthetic oligonucleotide
  Target: SCN10A; (-) strand; PAM type: YTN; PAM sequence: TTC
ttgagcagaatccagggggc

SEQ ID NO: 52501 - DNA, 20 bp, Artificial Sequence
  Description of Artificial Sequence: Synthetic oligonucleotide
  Target: SCN10A; (-) strand; PAM type: YTN; PAM sequence: TTT
cttgagcagaatccaggggg

SEQ ID NO: 52502 - DNA, 20 bp, Artificial Sequence
  Description of Artificial Sequence: Synthetic oligonucleotide
  Target: SCN10A; (-) strand; PAM type: YTN; PAM sequence: TTT
tcttgagcagaatccagggg

SEQ ID NO: 52503 - DNA, 20 bp, Artificial Sequence
  Description of Artificial Sequence: Synthetic oligonucleotide
  Target: SCN10A; (-) strand; PAM type: YTN; PAM sequence: CTG
ggcacaaattttcttgagca

SEQ ID NO: 52504 - DNA, 20 bp, Artificial Sequence
  Description of Artificial Sequence: Synthetic oligonucleotide
  Target: SCN10A; (-) strand; PAM type: YTN; PAM sequence: TTC
aactgggcacaaattttctt

SEQ ID NO: 52505 - DNA, 20 bp, Artificial Sequence
  Description of Artificial Sequence: Synthetic oligonucleotide
  Target: SCN10A; (-) strand; PAM type: YTN; PAM sequence: TTT
caactgggcacaaattttct

SEQ ID NO: 52506 - DNA, 20 bp, Artificial Sequence
  Description of Artificial Sequence: Synthetic oligonucleotide
  Target: SCN10A; (-) strand; PAM type: YTN; PAM sequence: TTA
gtaataatttcaactgggca

SEQ ID NO: 52507 - DNA, 20 bp, Artificial Sequence
  Description of Artificial Sequence: Synthetic oligonucleotide
  Target: SCN10A; (-) strand; PAM type: YTN; PAM sequence: CTA
aaattagtaataatttcaac

SEQ ID NO: 52508 - DNA, 20 bp, Artificial Sequence
  Description of Artificial Sequence: Synthetic oligonucleotide
  Target: SCN10A; (-) strand; PAM type: YTN; PAM sequence: TTC
aactaaaattagtaataatt

SEQ ID NO: 52509 - DNA, 20 bp, Artificial Sequence
  Description of Artificial Sequence: Synthetic oligonucleotide
  Target: SCN10A; (-) strand; PAM type: YTN; PAM sequence: TTT
caactaaaattagtaataat

SEQ ID NO: 52510 - DNA, 20 bp, Artificial Sequence
  Description of Artificial Sequence: Synthetic oligonucleotide
  Target: SCN10A; (-) strand; PAM type: YTN; PAM sequence: TTG
gggaaggcagccagtggaat

SEQ ID NO: 52511 - DNA, 20 bp, Artificial Sequence
  Description of Artificial Sequence: Synthetic oligonucleotide
  Target: SCN10A; (-) strand; PAM type: YTN; PAM sequence: CTT
ggggaaggcagccagtggaa

SEQ ID NO: 52512 - DNA, 20 bp, Artificial Sequence
  Description of Artificial Sequence: Synthetic oligonucleotide
  Target: SCN10A; (-) strand; PAM type: YTN; PAM sequence: CTC
acaggcacccttggggaagg

SEQ ID NO: 52513 - DNA, 20 bp, Artificial Sequence
  Description of Artificial Sequence: Synthetic oligonucleotide
  Target: SCN10A; (-) strand; PAM type: YTN; PAM sequence: CTA
tgtctcacaggcacccttgg

SEQ ID NO: 52514 - DNA, 20 bp, Artificial Sequence
  Description of Artificial Sequence: Synthetic oligonucleotide
  Target: SCN10A; (-) strand; PAM type: YTN; PAM sequence: CTG
actatgtctcacaggcaccc

SEQ ID NO: 52515 - DNA, 20 bp, Artificial Sequence
  Description of Artificial Sequence: Synthetic oligonucleotide
  Target: SCN10A; (-) strand; PAM type: YTN; PAM sequence: TTG
agaccagggaatccatccct

SEQ ID NO: 52516 - DNA, 20 bp, Artificial Sequence
  Description of Artificial Sequence: Synthetic oligonucleotide
  Target: SCN10A; (-) strand; PAM type: YTN; PAM sequence: CTT
gagaccagggaatccatccc

SEQ ID NO: 52517 - DNA, 20 bp, Artificial Sequence
  Description of Artificial Sequence: Synthetic oligonucleotide
  Target: SCN10A; (-) strand; PAM type: YTN; PAM sequence: CTC
cagcttgagaccagggaatc

SEQ ID NO: 52518 - DNA, 20 bp, Artificial Sequence
  Description of Artificial Sequence: Synthetic oligonucleotide
  Target: SCN10A; (-) strand; PAM type: YTN; PAM sequence: CTC
ccagtctccagcttgagacc

SEQ ID NO: 52519 - DNA, 20 bp, Artificial Sequence
  Description of Artificial Sequence: Synthetic oligonucleotide
  Target: SCN10A; (-) strand; PAM type: YTN; PAM sequence: TTG
taggcactcccagtctccag

SEQ ID NO: 52520 - DNA, 20 bp, Artificial Sequence
  Description of Artificial Sequence: Synthetic oligonucleotide
  Target: SCN10A; (-) strand; PAM type: YTN; PAM sequence: CTT
gtaggcactcccagtctcca

SEQ ID NO: 52521 - DNA, 20 bp, Artificial Sequence
  Description of Artificial Sequence: Synthetic oligonucleotide
  Target: SCN10A; (-) strand; PAM type: YTN; PAM sequence: TTA
ggaagccacacaaaatataa

SEQ ID NO: 52522 - DNA, 20 bp, Artificial Sequence
  Description of Artificial Sequence: Synthetic oligonucleotide
  Target: SCN10A; (-) strand; PAM type: YTN; PAM sequence: TTT
aggaagccacacaaaatata

SEQ ID NO: 52523 - DNA, 20 bp, Artificial Sequence
  Description of Artificial Sequence: Synthetic oligonucleotide
  Target: SCN10A; (-) strand; PAM type: YTN; PAM sequence: CTG
gaatgtaaataaatttagga

SEQ ID NO: 52524 - DNA, 20 bp, Artificial Sequence
  Description of Artificial Sequence: Synthetic oligonucleotide
  Target: SCN10A; (-) strand; PAM type: YTN; PAM sequence: TTA
cctggaatgtaaataaattt

SEQ ID NO: 52525 - DNA, 20 bp, Artificial Sequence
  Description of Artificial Sequence: Synthetic oligonucleotide
  Target: SCN10A; (-) strand; PAM type: YTN; PAM sequence: CTT
acctggaatgtaaataaatt

SEQ ID NO: 52526 - DNA, 20 bp, Artificial Sequence
  Description of Artificial Sequence: Synthetic oligonucleotide
  Target: SCN10A; (-) strand; PAM type: YTN; PAM sequence: TTA
cccttacctggaatgtaaat

SEQ ID NO: 52527 - DNA, 20 bp, Artificial Sequence
  Description of Artificial Sequence: Synthetic oligonucleotide
  Target: SCN10A; (-) strand; PAM type: YTN; PAM sequence: TTT
acccttacctggaatgtaaa

SEQ ID NO: 52528 - DNA, 20 bp, Artificial Sequence
  Description of Artificial Sequence: Synthetic oligonucleotide
  Target: SCN10A; (-) strand; PAM type: YTN; PAM sequence: CTG
aaaatccagatcacaggaga

SEQ ID NO: 52529 - DNA, 20 bp, Artificial Sequence
  Description of Artificial Sequence: Synthetic oligonucleotide
  Target: SCN10A; (-) strand; PAM type: YTN; PAM sequence: CTG
ggtaatctgaaaatccagat

SEQ ID NO: 52530 - DNA, 20 bp, Artificial Sequence
  Description of Artificial Sequence: Synthetic oligonucleotide
  Target: SCN10A; (-) strand; PAM type: YTN; PAM sequence: CTC
caaacatacatcccaactgg

SEQ ID NO: 52531 - DNA, 20 bp, Artificial Sequence
  Description of Artificial Sequence: Synthetic oligonucleotide
  Target: SCN10A; (-) strand; PAM type: YTN; PAM sequence: CTG
cctccaaacatacatcccaa

SEQ ID NO: 52532 - DNA, 20 bp, Artificial Sequence
  Description of Artificial Sequence: Synthetic oligonucleotide
  Target: SCN10A; (-) strand; PAM type: YTN; PAM sequence: CTC
ccaaagtgtgagggggggaa

SEQ ID NO: 52533 - DNA, 20 bp, Artificial Sequence
  Description of Artificial Sequence: Synthetic oligonucleotide
  Target: SCN10A; (-) strand; PAM type: YTN; PAM sequence: CTG
tgagctcccaaagtgtgagg

SEQ ID NO: 52534 - DNA, 20 bp, Artificial Sequence
  Description of Artificial Sequence: Synthetic oligonucleotide
  Target: SCN10A; (-) strand; PAM type: YTN; PAM sequence: CTG
caagacaggtgaaaaactgt

SEQ ID NO: 52535 - DNA, 20 bp, Artificial Sequence
  Description of Artificial Sequence: Synthetic oligonucleotide
  Target: SCN10A; (-) strand; PAM type: YTN; PAM sequence: TTC
tgcaagacaggtgaaaaact

SEQ ID NO: 52536 - DNA, 20 bp, Artificial Sequence
  Description of Artificial Sequence: Synthetic oligonucleotide
  Target: SCN10A; (-) strand; PAM type: YTN; PAM sequence: CTG
gaaattctgcaagacaggtg

SEQ ID NO: 52537 - DNA, 20 bp, Artificial Sequence
  Description of Artificial Sequence: Synthetic oligonucleotide
  Target: SCN10A; (-) strand; PAM type: YTN; PAM sequence: CTG
ctggaaattctgcaagacag

SEQ ID NO: 52538 - DNA, 20 bp, Artificial Sequence
  Description of Artificial Sequence: Synthetic oligonucleotide
  Target: SCN10A; (-) strand; PAM type: YTN; PAM sequence: TTA
aataagtggcacactgctgg

SEQ ID NO: 52539 - DNA, 20 bp, Artificial Sequence
  Description of Artificial Sequence: Synthetic oligonucleotide
  Target: SCN10A; (-) strand; PAM type: YTN; PAM sequence: TTT
aaataagtggcacactgctg

SEQ ID NO: 52540 - DNA, 20 bp, Artificial Sequence
  Description of Artificial Sequence: Synthetic oligonucleotide
  Target: SCN10A; (-) strand; PAM type: YTN; PAM sequence: TTT
taaataagtggcacactgct

SEQ ID NO: 52541 - DNA, 20 bp, Artificial Sequence
  Description of Artificial Sequence: Synthetic oligonucleotide
  Target: SCN10A; (-) strand; PAM type: YTN; PAM sequence: CTT
ttaaataagtggcacactgc

SEQ ID NO: 52542 - DNA, 20 bp, Artificial Sequence
  Description of Artificial Sequence: Synthetic oligonucleotide
  Target: SCN10A; (-) strand; PAM type: YTN; PAM sequence: TTC
atagatccttttaaataagt

SEQ ID NO: 52543 - DNA, 20 bp, Artificial Sequence
  Description of Artificial Sequence: Synthetic oligonucleotide
  Target: SCN10A; (-) strand; PAM type: YTN; PAM sequence: CTG
aaagaattcatagatccttt

SEQ ID NO: 52544 - DNA, 20 bp, Artificial Sequence
  Description of Artificial Sequence: Synthetic oligonucleotide
  Target: SCN10A; (-) strand; PAM type: YTN; PAM sequence: CTG
caggaatataccaggagaac

SEQ ID NO: 52545 - DNA, 20 bp, Artificial Sequence
  Description of Artificial Sequence: Synthetic oligonucleotide
  Target: SCN10A; (-) strand; PAM type: YTN; PAM sequence: CTC
caagaaccactgcaggaata

SEQ ID NO: 52546 - DNA, 20 bp, Artificial Sequence
  Description of Artificial Sequence: Synthetic oligonucleotide
  Target: SCN10A; (-) strand; PAM type: YTN; PAM sequence: TTG
ctccaagaaccactgcagga

SEQ ID NO: 52547 - DNA, 20 bp, Artificial Sequence
  Description of Artificial Sequence: Synthetic oligonucleotide
  Target: SCN10A; (-) strand; PAM type: YTN; PAM sequence: TTT
gctccaagaaccactgcagg

SEQ ID NO: 52548 - DNA, 20 bp, Artificial Sequence
  Description of Artificial Sequence: Synthetic oligonucleotide
  Target: SCN10A; (-) strand; PAM type: YTN; PAM sequence: CTC
acaccatgaacgtttgctcc

SEQ ID NO: 52549 - DNA, 20 bp, Artificial Sequence
  Description of Artificial Sequence: Synthetic oligonucleotide
  Target: SCN10A; (-) strand; PAM type: YTN; PAM sequence: TTG
gacagagtgtggagactcac

SEQ ID NO: 52550 - DNA, 20 bp, Artificial Sequence
  Description of Artificial Sequence: Synthetic oligonucleotide
  Target: SCN10A; (-) strand; PAM type: YTN; PAM sequence: CTT
ggacagagtgtggagactca

SEQ ID NO: 52551 - DNA, 20 bp, Artificial Sequence
  Description of Artificial Sequence: Synthetic oligonucleotide
  Target: SCN10A; (-) strand; PAM type: YTN; PAM sequence: CTA
acatgcaggtcccacttgga

SEQ ID NO: 52552 - DNA, 20 bp, Artificial Sequence
  Description of Artificial Sequence: Synthetic oligonucleotide
  Target: SCN10A; (-) strand; PAM type: YTN; PAM sequence: CTG
catgtgtgataggagagggg

SEQ ID NO: 52553 - DNA, 20 bp, Artificial Sequence
  Description of Artificial Sequence: Synthetic oligonucleotide
  Target: SCN10A; (-) strand; PAM type: YTN; PAM sequence: CTA
tgcagatctgcatgtgtgat

SEQ ID NO: 52554 - DNA, 20 bp, Artificial Sequence
  Description of Artificial Sequence: Synthetic oligonucleotide
  Target: SCN10A; (-) strand; PAM type: YTN; PAM sequence: CTC
tatgcagatctgcatgtgtg

SEQ ID NO: 52555 - DNA, 20 bp, Artificial Sequence
  Description of Artificial Sequence: Synthetic oligonucleotide
  Target: SCN10A; (-) strand; PAM type: YTN; PAM sequence: CTG
gcgtgagtatatctctatgc

SEQ ID NO: 52556 - DNA, 20 bp, Artificial Sequence
  Description of Artificial Sequence: Synthetic oligonucleotide
  Target: SCN10A; (-) strand; PAM type: YTN; PAM sequence: TTA
ccctggcgtgagtatatctc

SEQ ID NO: 52557 - DNA, 20 bp, Artificial Sequence
  Description of Artificial Sequence: Synthetic oligonucleotide
  Target: SCN10A; (-) strand; PAM type: YTN; PAM sequence: TTA
gcgtcattaccctggcgtga

SEQ ID NO: 52558 - DNA, 20 bp, Artificial Sequence
  Description of Artificial Sequence: Synthetic oligonucleotide
  Target: SCN10A; (-) strand; PAM type: YTN; PAM sequence: TTT
agcgtcattaccctggcgtg

SEQ ID NO: 52559 - DNA, 20 bp, Artificial Sequence
  Description of Artificial Sequence: Synthetic oligonucleotide
  Target: SCN10A; (-) strand; PAM type: YTN; PAM sequence: TTT
tagcgtcattaccctggcgt

SEQ ID NO: 52560 - DNA, 20 bp, Artificial Sequence
  Description of Artificial Sequence: Synthetic oligonucleotide
  Target: SCN10A; (-) strand; PAM type: YTN; PAM sequence: CTG
gattttagcgtcattaccct

SEQ ID NO: 52561 - DNA, 20 bp, Artificial Sequence
  Description of Artificial Sequence: Synthetic oligonucleotide
  Target: SCN10A; (-) strand; PAM type: YTN; PAM sequence: CTG
gctggattttagcgtcatta

SEQ ID NO: 52562 - DNA, 20 bp, Artificial Sequence
  Description of Artificial Sequence: Synthetic oligonucleotide
  Target: SCN10A; (-) strand; PAM type: YTN; PAM sequence: TTG
gaactggctggattttagcg

SEQ ID NO: 52563 - DNA, 20 bp, Artificial Sequence
  Description of Artificial Sequence: Synthetic oligonucleotide
  Target: SCN10A; (-) strand; PAM type: YTN; PAM sequence: CTT
ggaactggctggattttagc

SEQ ID NO: 52564 - DNA, 20 bp, Artificial Sequence
  Description of Artificial Sequence: Synthetic oligonucleotide
  Target: SCN10A; (-) strand; PAM type: YTN; PAM sequence: CTG
agagatccttggaactggct

SEQ ID NO: 52565 - DNA, 20 bp, Artificial Sequence
  Description of Artificial Sequence: Synthetic oligonucleotide
  Target: SCN10A; (-) strand; PAM type: YTN; PAM sequence: TTC
acgtacctgagagatccttg

SEQ ID NO: 52566 - DNA, 20 bp, Artificial Sequence
  Description of Artificial Sequence: Synthetic oligonucleotide
  Target: SCN10A; (-) strand; PAM type: YTN; PAM sequence: CTA
aatgagttcacgtacctgag

SEQ ID NO: 52567 - DNA, 20 bp, Artificial Sequence
  Description of Artificial Sequence: Synthetic oligonucleotide
  Target: SCN10A; (-) strand; PAM type: YTN; PAM sequence: TTG
tctaaatgagttcacgtacc

SEQ ID NO: 52568 - DNA, 20 bp, Artificial Sequence
  Description of Artificial Sequence: Synthetic oligonucleotide
  Target: SCN10A; (-) strand; PAM type: YTN; PAM sequence: TTT
gtctaaatgagttcacgtac

SEQ ID NO: 52569 - DNA, 20 bp, Artificial Sequence
  Description of Artificial Sequence: Synthetic oligonucleotide
  Target: SCN10A; (-) strand; PAM type: YTN; PAM sequence: TTT
tgtctaaatgagttcacgta

SEQ ID NO: 52570 - DNA, 20 bp, Artificial Sequence
  Description of Artificial Sequence: Synthetic oligonucleotide
  Target: SCN10A; (-) strand; PAM type: YTN; PAM sequence: CTG
gcaagaggattttgtctaaa

SEQ ID NO: 52571 - DNA, 20 bp, Artificial Sequence
  Description of Artificial Sequence: Synthetic oligonucleotide
  Target: SCN10A; (-) strand; PAM type: YTN; PAM sequence: TTG
ataaagatactggcaagagg

SEQ ID NO: 52572 - DNA, 20 bp, Artificial Sequence
  Description of Artificial Sequence: Synthetic oligonucleotide
  Target: SCN10A; (-) strand; PAM type: YTN; PAM sequence: CTT
gataaagatactggcaagag

SEQ ID NO: 52573 - DNA, 20 bp, Artificial Sequence
  Description of Artificial Sequence: Synthetic oligonucleotide
  Target: SCN10A; (-) strand; PAM type: YTN; PAM sequence: TTG
aagccttgataaagatactg

SEQ ID NO: 52574 - DNA, 20 bp, Artificial Sequence
  Description of Artificial Sequence: Synthetic oligonucleotide
  Target: SCN10A; (-) strand; PAM type: YTN; PAM sequence: TTT
gaagccttgataaagatact

SEQ ID NO: 52575 - DNA, 20 bp, Artificial Sequence
  Description of Artificial Sequence: Synthetic oligonucleotide
  Target: SCN10A; (-) strand; PAM type: YTN; PAM sequence: CTT
tgaagccttgataaagatac

SEQ ID NO: 52576 - DNA, 20 bp, Artificial Sequence
  Description of Artificial Sequence: Synthetic oligonucleotide
  Target: SCN10A; (-) strand; PAM type: YTN; PAM sequence: TTA
cacctttgaagccttgataa

SEQ ID NO: 52577 - DNA, 20 bp, Artificial Sequence
  Description of Artificial Sequence: Synthetic oligonucleotide
  Target: SCN10A; (-) strand; PAM type: YTN; PAM sequence: TTT
acacctttgaagccttgata

SEQ ID NO: 52578 - DNA, 20 bp, Artificial Sequence
  Description of Artificial Sequence: Synthetic oligonucleotide
  Target: SCN10A; (-) strand; PAM type: YTN; PAM sequence: CTG
tcatttacacctttgaagcc

SEQ ID NO: 52579 - DNA, 20 bp, Artificial Sequence
  Description of Artificial Sequence: Synthetic oligonucleotide
  Target: SCN10A; (-) strand; PAM type: YTN; PAM sequence: TTC
actgtcatttacacctttga

SEQ ID NO: 52580 - DNA, 20 bp, Artificial Sequence
  Description of Artificial Sequence: Synthetic oligonucleotide
  Target: SCN10A; (-) strand; PAM type: YTN; PAM sequence: CTT
cactgtcatttacacctttg

SEQ ID NO: 52581 - DNA, 20 bp, Artificial Sequence
  Description of Artificial Sequence: Synthetic oligonucleotide
  Target: SCN10A; (-) strand; PAM type: YTN; PAM sequence: TTC
ccagatatgtcttcactgtc

SEQ ID NO: 52582 - DNA, 20 bp, Artificial Sequence
  Description of Artificial Sequence: Synthetic oligonucleotide
  Target: SCN10A; (-) strand; PAM type: YTN; PAM sequence: CTT
cccagatatgtcttcactgt

SEQ ID NO: 52583 - DNA, 20 bp, Artificial Sequence
  Description of Artificial Sequence: Synthetic oligonucleotide
  Target: SCN10A; (-) strand; PAM type: YTN; PAM sequence: CTC
cttcccagatatgtcttcac

SEQ ID NO: 52584 - DNA, 20 bp, Artificial Sequence
  Description of Artificial Sequence: Synthetic oligonucleotide
  Target: SCN10A; (-) strand; PAM type: YTN; PAM sequence: CTA
ccctccttcccagatatgtc

SEQ ID NO: 52585 - DNA, 20 bp, Artificial Sequence
  Description of Artificial Sequence: Synthetic oligonucleotide
  Target: SCN10A; (-) strand; PAM type: YTN; PAM sequence: TTC
taccctccttcccagatatg

SEQ ID NO: 52586 - DNA, 20 bp, Artificial Sequence
  Description of Artificial Sequence: Synthetic oligonucleotide
  Target: SCN10A; (-) strand; PAM type: YTN; PAM sequence: TTT
ctaccctccttcccagatat

SEQ ID NO: 52587 - DNA, 20 bp, Artificial Sequence
  Description of Artificial Sequence: Synthetic oligonucleotide
  Target: SCN10A; (-) strand; PAM type: YTN; PAM sequence: TTT
tctaccctccttcccagata

SEQ ID NO: 52588 - DNA, 20 bp, Artificial Sequence
  Description of Artificial Sequence: Synthetic oligonucleotide
  Target: SCN10A; (-) strand; PAM type: YTN; PAM sequence: CTT
ttctaccctccttcccagat

SEQ ID NO: 52589 - DNA, 20 bp, Artificial Sequence
  Description of Artificial Sequence: Synthetic oligonucleotide
  Target: SCN10A; (-) strand; PAM type: YTN; PAM sequence: CTC
cttttctaccctccttccca

SEQ ID NO: 52590 - DNA, 20 bp, Artificial Sequence
  Description of Artificial Sequence: Synthetic oligonucleotide
  Target: SCN10A; (-) strand; PAM type: YTN; PAM sequence: TTG
acactccttttctaccctcc

SEQ ID NO: 52591 - DNA, 20 bp, Artificial Sequence
  Description of Artificial Sequence: Synthetic oligonucleotide
  Target: SCN10A; (-) strand; PAM type: YTN; PAM sequence: CTC
catggcacagttgacactcc

SEQ ID NO: 52592 - DNA, 20 bp, Artificial Sequence
  Description of Artificial Sequence: Synthetic oligonucleotide
  Target: SCN10A; (-) strand; PAM type: YTN; PAM sequence: CTG
agtacactccatggcacagt

SEQ ID NO: 52593 - DNA, 20 bp, Artificial Sequence
  Description of Artificial Sequence: Synthetic oligonucleotide
  Target: SCN10A; (-) strand; PAM type: YTN; PAM sequence: CTG
gaagaaggaaccccctgagt

SEQ ID NO: 52594 - DNA, 20 bp, Artificial Sequence
  Description of Artificial Sequence: Synthetic oligonucleotide
  Target: SCN10A; (-) strand; PAM type: YTN; PAM sequence: CTC
ctggaagaaggaaccccctg

SEQ ID NO: 52595 - DNA, 20 bp, Artificial Sequence
  Description of Artificial Sequence: Synthetic oligonucleotide
  Target: SCN10A; (-) strand; PAM type: YTN; PAM sequence: CTC
cctcctggaagaaggaaccc

SEQ ID NO: 52596 - DNA, 20 bp, Artificial Sequence
  Description of Artificial Sequence: Synthetic oligonucleotide
  Target: SCN10A; (-) strand; PAM type: YTN; PAM sequence: TTG
gagcagtcagagcaggtcat

SEQ ID NO: 52597 - DNA, 20 bp, Artificial Sequence
  Description of Artificial Sequence: Synthetic oligonucleotide
  Target: SCN10A; (-) strand; PAM type: YTN; PAM sequence: CTT
ggagcagtcagagcaggtca

SEQ ID NO: 52598 - DNA, 20 bp, Artificial Sequence
  Description of Artificial Sequence: Synthetic oligonucleotide
  Target: SCN10A; (-) strand; PAM type: YTN; PAM sequence: TTC
ttggagcagtcagagcaggt

SEQ ID NO: 52599 - DNA, 20 bp, Artificial Sequence
  Description of Artificial Sequence: Synthetic oligonucleotide
  Target: SCN10A; (-) strand; PAM type: YTN; PAM sequence: TTT
cttggagcagtcagagcagg

SEQ ID NO: 52600 - DNA, 20 bp, Artificial Sequence
  Description of Artificial Sequence: Synthetic oligonucleotide
  Target: SCN10A; (-) strand; PAM type: YTN; PAM sequence: TTT
tcttggagcagtcagagcag

SEQ ID NO: 52601 - DNA, 20 bp, Artificial Sequence
  Description of Artificial Sequence: Synthetic oligonucleotide
  Target: SCN10A; (-) strand; PAM type: YTN; PAM sequence: TTT
ttcttggagcagtcagagca

SEQ ID NO: 52602 - DNA, 20 bp, Artificial Sequence
  Description of Artificial Sequence: Synthetic oligonucleotide
  Target: SCN10A; (-) strand; PAM type: YTN; PAM sequence: TTT
tttcttggagcagtcagagc

SEQ ID NO: 52603 - DNA, 20 bp, Artificial Sequence
  Description of Artificial Sequence: Synthetic oligonucleotide
  Target: SCN10A; (-) strand; PAM type: YTN; PAM sequence: TTG
catgttttttcttggagcag

SEQ ID NO: 52604 - DNA, 20 bp, Artificial Sequence
  Description of Artificial Sequence: Synthetic oligonucleotide
  Target: SCN10A; (-) strand; PAM type: YTN; PAM sequence: TTT
gcatgttttttcttggagca

SEQ ID NO: 52605 - DNA, 20 bp, Artificial Sequence
  Description of Artificial Sequence: Synthetic oligonucleotide
  Target: SCN10A; (-) strand; PAM type: YTN; PAM sequence: CTT
tgcatgttttttcttggagc

SEQ ID NO: 52606 - DNA, 20 bp, Artificial Sequence
  Description of Artificial Sequence: Synthetic oligonucleotide
  Target: SCN10A; (-) strand; PAM type: YTN; PAM sequence: TTC
tttgcatgttttttcttgga

SEQ ID NO: 52607 - DNA, 20 bp, Artificial Sequence
  Description of Artificial Sequence: Synthetic oligonucleotide
  Target: SCN10A; (-) strand; PAM type: YTN; PAM sequence: TTG
gtgatattctttgcatgttt

SEQ ID NO: 52608 - DNA, 20 bp, Artificial Sequence
  Description of Artificial Sequence: Synthetic oligonucleotide
  Target: SCN10A; (-) strand; PAM type: YTN; PAM sequence: CTT
ggtgatattctttgcatgtt

SEQ ID NO: 52609 - DNA, 20 bp, Artificial Sequence
  Description of Artificial Sequence: Synthetic oligonucleotide
  Target: SCN10A; (-) strand; PAM type: YTN; PAM sequence: CTC
atcaccttggtgatattctt

SEQ ID NO: 52610 - DNA, 20 bp, Artificial Sequence
  Description of Artificial Sequence: Synthetic oligonucleotide
  Target: SCN10A; (-) strand; PAM type: YTN; PAM sequence: TTC
cccctcatcaccttggtgat

SEQ ID NO: 52611 - DNA, 20 bp, Artificial Sequence
  Description of Artificial Sequence: Synthetic oligonucleotide
  Target: SCN10A; (-) strand; PAM type: YTN; PAM sequence: CTT
ccccctcatcaccttggtga

SEQ ID NO: 52612 - DNA, 20 bp, Artificial Sequence
  Description of Artificial Sequence: Synthetic oligonucleotide
  Target: SCN10A; (-) strand; PAM type: YTN; PAM sequence: TTC
ttccccctcatcaccttggt

SEQ ID NO: 52613 - DNA, 20 bp, Artificial Sequence
  Description of Artificial Sequence: Synthetic oligonucleotide
  Target: SCN10A; (-) strand; PAM type: YTN; PAM sequence: CTT
cttccccctcatcaccttgg

SEQ ID NO: 52614 - DNA, 20 bp, Artificial Sequence
  Description of Artificial Sequence: Synthetic oligonucleotide
  Target: SCN10A; (-) strand; PAM type: YTN; PAM sequence: TTA
ccttcttccccctcatcacc

SEQ ID NO: 52615 - DNA, 20 bp, Artificial Sequence
  Description of Artificial Sequence: Synthetic oligonucleotide
  Target: SCN10A; (-) strand; PAM type: YTN; PAM sequence: CTT
accttcttccccctcatcac

SEQ ID NO: 52616 - DNA, 20 bp, Artificial Sequence
  Description of Artificial Sequence: Synthetic oligonucleotide
  Target: SCN10A; (-) strand; PAM type: YTN; PAM sequence: CTC
cttaccttcttccccctcat

SEQ ID NO: 52617 - DNA, 20 bp, Artificial Sequence
  Description of Artificial Sequence: Synthetic oligonucleotide
  Target: SCN10A; (-) strand; PAM type: YTN; PAM sequence: CTC
tccttaccttcttccccctc

SEQ ID NO: 52618 - DNA, 20 bp, Artificial Sequence
  Description of Artificial Sequence: Synthetic oligonucleotide
  Target: SCN10A; (-) strand; PAM type: YTN; PAM sequence: TTC
ctctccttaccttcttcccc

SEQ ID NO: 52619 - DNA, 20 bp, Artificial Sequence
  Description of Artificial Sequence: Synthetic oligonucleotide
  Target: SCN10A; (-) strand; PAM type: YTN; PAM sequence: TTT
cctctccttaccttcttccc

SEQ ID NO: 52620 - DNA, 20 bp, Artificial Sequence
  Description of Artificial Sequence: Synthetic oligonucleotide
  Target: SCN10A; (-) strand; PAM type: YTN; PAM sequence: TTG
tttcctctccttaccttctt

SEQ ID NO: 52621 - DNA, 20 bp, Artificial Sequence
  Description of Artificial Sequence: Synthetic oligonucleotide
  Target: SCN10A; (-) strand; PAM type: YTN; PAM sequence: CTT
gtttcctctccttaccttct

SEQ ID NO: 52622 - DNA, 20 bp, Artificial Sequence
  Description of Artificial Sequence: Synthetic oligonucleotide
  Target: SCN10A; (-) strand; PAM type: YTN; PAM sequence: CTG
tgtcttgtttcctctcctta

SEQ ID NO: 52623 - DNA, 20 bp, Artificial Sequence
  Description of Artificial Sequence: Synthetic oligonucleotide
  Target: SCN10A; (-) strand; PAM type: YTN; PAM sequence: CTC
agtctgtgtcttgtttcctc

SEQ ID NO: 52624 - DNA, 20 bp, Artificial Sequence
  Description of Artificial Sequence: Synthetic oligonucleotide
  Target: SCN10A; (-) strand; PAM type: YTN; PAM sequence: TTC
cctcagtctgtgtcttgttt

SEQ ID NO: 52625 - DNA, 20 bp, Artificial Sequence
  Description of Artificial Sequence: Synthetic oligonucleotide
  Target: SCN10A; (-) strand; PAM type: YTN; PAM sequence: TTT
ccctcagtctgtgtcttgtt

SEQ ID NO: 52626 - DNA, 20 bp, Artificial Sequence
  Description of Artificial Sequence: Synthetic oligonucleotide
  Target: SCN10A; (-) strand; PAM type: YTN; PAM sequence: TTT
tccctcagtctgtgtcttgt

SEQ ID NO: 52627 - DNA, 20 bp, Artificial Sequence
  Description of Artificial Sequence: Synthetic oligonucleotide
  Target: SCN10A; (-) strand; PAM type: YTN; PAM sequence: TTT
ttccctcagtctgtgtcttg

SEQ ID NO: 52628 - DNA, 20 bp, Artificial Sequence
  Description of Artificial Sequence: Synthetic oligonucleotide
  Target: SCN10A; (-) strand; PAM type: YTN; PAM sequence: CTT
tttccctcagtctgtgtctt

SEQ ID NO: 52629 - DNA, 20 bp, Artificial Sequence
  Description of Artificial Sequence: Synthetic oligonucleotide
  Target: SCN10A; (-) strand; PAM type: YTN; PAM sequence: TTC
tttttccctcagtctgtgtc

SEQ ID NO: 52630 - DNA, 20 bp, Artificial Sequence
  Description of Artificial Sequence: Synthetic oligonucleotide
  Target: SCN10A; (-) strand; PAM type: YTN; PAM sequence: CTT
ctttttccctcagtctgtgt

SEQ ID NO: 52631 - DNA, 20 bp, Artificial Sequence
  Description of Artificial Sequence: Synthetic oligonucleotide
  Target: SCN10A; (-) strand; PAM type: YTN; PAM sequence: TTG
tgtggcccttctttttccct

SEQ ID NO: 52632 - DNA, 20 bp, Artificial Sequence
  Description of Artificial Sequence: Synthetic oligonucleotide
  Target: SCN10A; (-) strand; PAM type: YTN; PAM sequence: TTT
gtgtggcccttctttttccc

SEQ ID NO: 52633 - DNA, 20 bp, Artificial Sequence
  Description of Artificial Sequence: Synthetic oligonucleotide
  Target: SCN10A; (-) strand; PAM type: YTN; PAM sequence: CTA
tttgtgtggcccttcttttt

SEQ ID NO: 52634 - DNA, 20 bp, Artificial Sequence
  Description of Artificial Sequence: Synthetic oligonucleotide
  Target: SCN10A; (-) strand; PAM type: YTN; PAM sequence: CTC
catctatttgtgtggccctt

SEQ ID NO: 52635 - DNA, 20 bp, Artificial Sequence
  Description of Artificial Sequence: Synthetic oligonucleotide
  Target: SCN10A; (-) strand; PAM type: YTN; PAM sequence: CTC
cccactccatctatttgtgt

SEQ ID NO: 52636 - DNA, 20 bp, Artificial Sequence
  Description of Artificial Sequence: Synthetic oligonucleotide
  Target: SCN10A; (-) strand; PAM type: YTN; PAM sequence: CTG
tcccagccacacacatccct

SEQ ID NO: 52637 - DNA, 20 bp, Artificial Sequence
  Description of Artificial Sequence: Synthetic oligonucleotide
  Target: SCN10A; (-) strand; PAM type: YTN; PAM sequence: CTG
gctgtcccagccacacacat

SEQ ID NO: 52638 - DNA, 20 bp, Artificial Sequence
  Description of Artificial Sequence: Synthetic oligonucleotide
  Target: SCN10A; (-) strand; PAM type: YTN; PAM sequence: CTG
ctggctgtcccagccacaca

SEQ ID NO: 52639 - DNA, 20 bp, Artificial Sequence
  Description of Artificial Sequence: Synthetic oligonucleotide
  Target: SCN10A; (-) strand; PAM type: YTN; PAM sequence: CTA
accccagaacagcagaagct

SEQ ID NO: 52640 - DNA, 20 bp, Artificial Sequence
  Description of Artificial Sequence: Synthetic oligonucleotide
  Target: SCN10A; (-) strand; PAM type: YTN; PAM sequence: CTG
cctaaccccagaacagcaga

SEQ ID NO: 52641 - DNA, 20 bp, Artificial Sequence
  Description of Artificial Sequence: Synthetic oligonucleotide
  Target: SCN10A; (-) strand; PAM type: YTN; PAM sequence: CTC
tgcctaaccccagaacagca

SEQ ID NO: 52642 - DNA, 20 bp, Artificial Sequence
  Description of Artificial Sequence: Synthetic oligonucleotide
  Target: SCN10A; (-) strand; PAM type: YTN; PAM sequence: CTG
ccctctgcctaaccccagaa

SEQ ID NO: 52643 - DNA, 20 bp, Artificial Sequence
  Description of Artificial Sequence: Synthetic oligonucleotide
  Target: SCN10A; (-) strand; PAM type: YTN; PAM sequence: CTA
ctgccctctgcctaacccca

SEQ ID NO: 52644 - DNA, 20 bp, Artificial Sequence
  Description of Artificial Sequence: Synthetic oligonucleotide
  Target: SCN10A; (-) strand; PAM type: YTN; PAM sequence: TTC
acccgctactgccctctgcc

SEQ ID NO: 52645 - DNA, 20 bp, Artificial Sequence
  Description of Artificial Sequence: Synthetic oligonucleotide
  Target: SCN10A; (-) strand; PAM type: YTN; PAM sequence: CTT
cacccgctactgccctctgc

SEQ ID NO: 52646 - DNA, 20 bp, Artificial Sequence
  Description of Artificial Sequence: Synthetic oligonucleotide
  Target: SCN10A; (-) strand; PAM type: YTN; PAM sequence: CTC
ttcacccgctactgccctct

SEQ ID NO: 52647 - DNA, 20 bp, Artificial Sequence
  Description of Artificial Sequence: Synthetic oligonucleotide
  Target: SCN10A; (-) strand; PAM type: YTN; PAM sequence: TTG
ctcttcacccgctactgccc

SEQ ID NO: 52648 - DNA, 20 bp, Artificial Sequence
  Description of Artificial Sequence: Synthetic oligonucleotide
  Target: SCN10A; (-) strand; PAM type: YTN; PAM sequence: CTT
gctcttcacccgctactgcc

SEQ ID NO: 52649 - DNA, 20 bp, Artificial Sequence
  Description of Artificial Sequence: Synthetic oligonucleotide
  Target: SCN10A; (-) strand; PAM type: YTN; PAM sequence: CTG
gcagacataaacaggagaat

SEQ ID NO: 52650 - DNA, 20 bp, Artificial Sequence
  Description of Artificial Sequence: Synthetic oligonucleotide
  Target: SCN10A; (-) strand; PAM type: YTN; PAM sequence: TTG
caggatagggaggccctggc

SEQ ID NO: 52651 - DNA, 20 bp, Artificial Sequence
  Description of Artificial Sequence: Synthetic oligonucleotide
  Target: SCN10A; (-) strand; PAM type: YTN; PAM sequence: CTT
gcaggatagggaggccctgg

SEQ ID NO: 52652 - DNA, 20 bp, Artificial Sequence
  Description of Artificial Sequence: Synthetic oligonucleotide
  Target: SCN10A; (-) strand; PAM type: YTN; PAM sequence: TTC
ttgcaggatagggaggccct

SEQ ID NO: 52653 - DNA, 20 bp, Artificial Sequence
  Description of Artificial Sequence: Synthetic oligonucleotide
  Target: SCN10A; (-) strand; PAM type: YTN; PAM sequence: CTT
cttgcaggatagggaggccc

SEQ ID NO: 52654 - DNA, 20 bp, Artificial Sequence
  Description of Artificial Sequence: Synthetic oligonucleotide
  Target: SCN10A; (-) strand; PAM type: YTN; PAM sequence: CTC
cagcttcttgcaggataggg

SEQ ID NO: 52655 - DNA, 20 bp, Artificial Sequence
  Description of Artificial Sequence: Synthetic oligonucleotide
  Target: SCN10A; (-) strand; PAM type: YTN; PAM sequence: TTA
gatgagcctccagcttcttg

SEQ ID NO: 52656 - DNA, 20 bp, Artificial Sequence
  Description of Artificial Sequence: Synthetic oligonucleotide
  Target: SCN10A; (-) strand; PAM type: YTN; PAM sequence: TTT
agatgagcctccagcttctt

SEQ ID NO: 52657 - DNA, 20 bp, Artificial Sequence
  Description of Artificial Sequence: Synthetic oligonucleotide
  Target: SCN10A; (-) strand; PAM type: YTN; PAM sequence: TTT
tagatgagcctccagcttct

SEQ ID NO: 52658 - DNA, 20 bp, Artificial Sequence
  Description of Artificial Sequence: Synthetic oligonucleotide
  Target: SCN10A; (-) strand; PAM type: YTN; PAM sequence: TTT
ttagatgagcctccagcttc

SEQ ID NO: 52659 - DNA, 20 bp, Artificial Sequence
  Description of Artificial Sequence: Synthetic oligonucleotide
  Target: SCN10A; (-) strand; PAM type: YTN; PAM sequence: CTG
ggagtttttagatgagcctc

SEQ ID NO: 52660 - DNA, 20 bp, Artificial Sequence
  Description of Artificial Sequence: Synthetic oligonucleotide
  Target: SCN10A; (-) strand; PAM type: YTN; PAM sequence: CTA
aaaactgggagtttttagat

SEQ ID NO: 52661 - DNA, 20 bp, Artificial Sequence
  Description of Artificial Sequence: Synthetic oligonucleotide
  Target: SCN10A; (-) strand; PAM type: YTN; PAM sequence: TTC
taaaaactgggagtttttag

SEQ ID NO: 52662 - DNA, 20 bp, Artificial Sequence
  Description of Artificial Sequence: Synthetic oligonucleotide
  Target: SCN10A; (-) strand; PAM type: YTN; PAM sequence: TTT
ctaaaaactgggagttttta

SEQ ID NO: 52663 - DNA, 20 bp, Artificial Sequence
  Description of Artificial Sequence: Synthetic oligonucleotide
  Target: SCN10A; (-) strand; PAM type: YTN; PAM sequence: CTC
cagtttctaaaaactgggag

SEQ ID NO: 52664 - DNA, 20 bp, Artificial Sequence
  Description of Artificial Sequence: Synthetic oligonucleotide
  Target: SCN10A; (-) strand; PAM type: YTN; PAM sequence: CTG
cactccagtttctaaaaact

SEQ ID NO: 52665 - DNA, 20 bp, Artificial Sequence
  Description of Artificial Sequence: Synthetic oligonucleotide
  Target: SCN10A; (-) strand; PAM type: YTN; PAM sequence: CTC
atcagtctgcactccagttt

SEQ ID NO: 52666 - DNA, 20 bp, Artificial Sequence
  Description of Artificial Sequence: Synthetic oligonucleotide
  Target: SCN10A; (-) strand; PAM type: YTN; PAM sequence: TTA
ccactcatcagtctgcactc

SEQ ID NO: 52667 - DNA, 20 bp, Artificial Sequence
  Description of Artificial Sequence: Synthetic oligonucleotide
  Target: SCN10A; (-) strand; PAM type: YTN; PAM sequence: CTG
tcagttaccactcatcagtc

SEQ ID NO: 52668 - DNA, 20 bp, Artificial Sequence
  Description of Artificial Sequence: Synthetic oligonucleotide
  Target: SCN10A; (-) strand; PAM type: YTN; PAM sequence: CTC
tgtcagttaccactcatcag

SEQ ID NO: 52669 - DNA, 20 bp, Artificial Sequence
  Description of Artificial Sequence: Synthetic oligonucleotide
  Target: SCN10A; (-) strand; PAM type: YTN; PAM sequence: CTG
ctctgtcagttaccactcat

SEQ ID NO: 52670 - DNA, 20 bp, Artificial Sequence
  Description of Artificial Sequence: Synthetic oligonucleotide
  Target: SCN10A; (-) strand; PAM type: YTN; PAM sequence: TTA
ggtctgctctgtcagttacc

SEQ ID NO: 52671 - DNA, 20 bp, Artificial Sequence
  Description of Artificial Sequence: Synthetic oligonucleotide
  Target: SCN10A; (-) strand; PAM type: YTN; PAM sequence: CTT
aggtctgctctgtcagttac

SEQ ID NO: 52672 - DNA, 20 bp, Artificial Sequence
  Description of Artificial Sequence: Synthetic oligonucleotide
  Target: SCN10A; (-) strand; PAM type: YTN; PAM sequence: TTC
ttaggtctgctctgtcagtt

SEQ ID NO: 52673 - DNA, 20 bp, Artificial Sequence
  Description of Artificial Sequence: Synthetic oligonucleotide
  Target: SCN10A; (-) strand; PAM type: YTN; PAM sequence: TTT
cttaggtctgctctgtcagt

SEQ ID NO: 52674 - DNA, 20 bp, Artificial Sequence
  Description of Artificial Sequence: Synthetic oligonucleotide
  Target: SCN10A; (-) strand; PAM type: YTN; PAM sequence: CTT
tcttaggtctgctctgtcag

SEQ ID NO: 52675 - DNA, 20 bp, Artificial Sequence
  Description of Artificial Sequence: Synthetic oligonucleotide
  Target: SCN10A; (-) strand; PAM type: YTN; PAM sequence: TTC
agctttcttaggtctgctct

SEQ ID NO: 52676 - DNA, 20 bp, Artificial Sequence
  Description of Artificial Sequence: Synthetic oligonucleotide
  Target: SCN10A; (-) strand; PAM type: YTN; PAM sequence: TTT
cagctttcttaggtctgctc

SEQ ID NO: 52677 - DNA, 20 bp, Artificial Sequence
  Description of Artificial Sequence: Synthetic oligonucleotide
  Target: SCN10A; (-) strand; PAM type: YTN; PAM sequence: TTT
tcagctttcttaggtctgct

SEQ ID NO: 52678 - DNA, 20 bp, Artificial Sequence
  Description of Artificial Sequence: Synthetic oligonucleotide
  Target: SCN10A; (-) strand; PAM type: YTN; PAM sequence: TTC
agccagttttcagctttctt

SEQ ID NO: 52679 - DNA, 20 bp, Artificial Sequence
  Description of Artificial Sequence: Synthetic oligonucleotide
  Target: SCN10A; (-) strand; PAM type: YTN; PAM sequence: CTT
cagccagttttcagctttct

SEQ ID NO: 52680 - DNA, 20 bp, Artificial Sequence
  Description of Artificial Sequence: Synthetic oligonucleotide
  Target: SCN10A; (-) strand; PAM type: YTN; PAM sequence: CTG
cttcagccagttttcagctt

SEQ ID NO: 52681 - DNA, 20 bp, Artificial Sequence
  Description of Artificial Sequence: Synthetic oligonucleotide
  Target: SCN10A; (-) strand; PAM type: YTN; PAM sequence: TTC
cctgcttcagccagttttca

SEQ ID NO: 52682 - DNA, 20 bp, Artificial Sequence
  Description of Artificial Sequence: Synthetic oligonucleotide
  Target: SCN10A; (-) strand; PAM type: YTN; PAM sequence: CTG
ggtattccctgcttcagcca

SEQ ID NO: 52683 - DNA, 20 bp, Artificial Sequence
  Description of Artificial Sequence: Synthetic oligonucleotide
  Target: SCN10A; (-) strand; PAM type: YTN; PAM sequence: TTC
tgggtattccctgcttcagc

SEQ ID NO: 52684 - DNA, 20 bp, Artificial Sequence
  Description of Artificial Sequence: Synthetic oligonucleotide
  Target: SCN10A; (-) strand; PAM type: YTN; PAM sequence: CTT
ctgggtattccctgcttcag

SEQ ID NO: 52685 - DNA, 20 bp, Artificial Sequence
  Description of Artificial Sequence: Synthetic oligonucleotide
  Target: SCN10A; (-) strand; PAM type: YTN; PAM sequence: TTG
cttctgggtattccctgctt

SEQ ID NO: 52686 - DNA, 20 bp, Artificial Sequence
  Description of Artificial Sequence: Synthetic oligonucleotide
  Target: SCN10A; (-) strand; PAM type: YTN; PAM sequence: CTT
gcttctgggtattccctgct

SEQ ID NO: 52687 - DNA, 20 bp, Artificial Sequence
  Description of Artificial Sequence: Synthetic oligonucleotide
  Target: SCN10A; (-) strand; PAM type: YTN; PAM sequence: TTG
gcttgcttctgggtattccc

SEQ ID NO: 52688 - DNA, 20 bp, Artificial Sequence
  Description of Artificial Sequence: Synthetic oligonucleotide
  Target: SCN10A; (-) strand; PAM type: YTN; PAM sequence: CTT
ggcttgcttctgggtattcc

SEQ ID NO: 52689 - DNA, 20 bp, Artificial Sequence
  Description of Artificial Sequence: Synthetic oligonucleotide
  Target: SCN10A; (-) strand; PAM type: YTN; PAM sequence: CTG
cagcatagcttggcttgctt

SEQ ID NO: 52690 - DNA, 20 bp, Artificial Sequence
  Description of Artificial Sequence: Synthetic oligonucleotide
  Target: SCN10A; (-) strand; PAM type: YTN; PAM sequence: CTC
tgcagcatagcttggcttgc

SEQ ID NO: 52691 - DNA, 20 bp, Artificial Sequence
  Description of Artificial Sequence: Synthetic oligonucleotide
  Target: SCN10A; (-) strand; PAM type: YTN; PAM sequence: CTG
gggctctgcagcatagcttg

SEQ ID NO: 52692 - DNA, 20 bp, Artificial Sequence
  Description of Artificial Sequence: Synthetic oligonucleotide
  Target: SCN10A; (-) strand; PAM type: YTN; PAM sequence: TTC
tggggctctgcagcatagct

SEQ ID NO: 52693 - DNA, 20 bp, Artificial Sequence
  Description of Artificial Sequence: Synthetic oligonucleotide
  Target: SCN10A; (-) strand; PAM type: YTN; PAM sequence: TTC
caagcagttctggggctctg

SEQ ID NO: 52694 - DNA, 20 bp, Artificial Sequence
  Description of Artificial Sequence: Synthetic oligonucleotide
  Target: SCN10A; (-) strand; PAM type: YTN; PAM sequence: CTA
agttccaagcagttctgggg

SEQ ID NO: 52695 - DNA, 20 bp, Artificial Sequence
  Description of Artificial Sequence: Synthetic oligonucleotide
  Target: SCN10A; (-) strand; PAM type: YTN; PAM sequence: CTC
taagttccaagcagttctgg

SEQ ID NO: 52696 - DNA, 20 bp, Artificial Sequence
  Description of Artificial Sequence: Synthetic oligonucleotide
  Target: SCN10A; (-) strand; PAM type: YTN; PAM sequence: TTA
gcatctctaagttccaagca

SEQ ID NO: 52697 - DNA, 20 bp, Artificial Sequence
  Description of Artificial Sequence: Synthetic oligonucleotide
  Target: SCN10A; (-) strand; PAM type: YTN; PAM sequence: CTT
agcatctctaagttccaagc

SEQ ID NO: 52698 - DNA, 20 bp, Artificial Sequence
  Description of Artificial Sequence: Synthetic oligonucleotide
  Target: SCN10A; (-) strand; PAM type: YTN; PAM sequence: TTC
agagatacttagcatctcta

SEQ ID NO: 52699 - DNA, 20 bp, Artificial Sequence
  Description of Artificial Sequence: Synthetic oligonucleotide
  Target: SCN10A; (-) strand; PAM type: YTN; PAM sequence: TTT
cagagatacttagcatctct

SEQ ID NO: 52700 - DNA, 20 bp, Artificial Sequence
  Description of Artificial Sequence: Synthetic oligonucleotide
  Target: SCN10A; (-) strand; PAM type: YTN; PAM sequence: CTT
tcagagatacttagcatctc

SEQ ID NO: 52701 - DNA, 20 bp, Artificial Sequence
  Description of Artificial Sequence: Synthetic oligonucleotide
  Target: SCN10A; (-) strand; PAM type: YTN; PAM sequence: TTG
ctttcagagatacttagcat

SEQ ID NO: 52702 - DNA, 20 bp, Artificial Sequence
  Description of Artificial Sequence: Synthetic oligonucleotide
  Target: SCN10A; (-) strand; PAM type: YTN; PAM sequence: CTT
gctttcagagatacttagca

SEQ ID NO: 52703 - DNA, 20 bp, Artificial Sequence
  Description of Artificial Sequence: Synthetic oligonucleotide
  Target: SCN10A; (-) strand; PAM type: YTN; PAM sequence: CTC
ccccaaaccttgctttcaga

SEQ ID NO: 52704 - DNA, 20 bp, Artificial Sequence
  Description of Artificial Sequence: Synthetic oligonucleotide
  Target: SCN10A; (-) strand; PAM type: YTN; PAM sequence: TTA
tcaccctcccccaaaccttg

SEQ ID NO: 52705 - DNA, 20 bp, Artificial Sequence
  Description of Artificial Sequence: Synthetic oligonucleotide
  Target: SCN10A; (-) strand; PAM type: YTN; PAM sequence: CTT
atcaccctcccccaaacctt

SEQ ID NO: 52706 - DNA, 20 bp, Artificial Sequence
  Description of Artificial Sequence: Synthetic oligonucleotide
  Target: SCN10A; (-) strand; PAM type: YTN; PAM sequence: CTA
cttatcaccctcccccaaac

SEQ ID NO: 52707 - DNA, 20 bp, Artificial Sequence
  Description of Artificial Sequence: Synthetic oligonucleotide
  Target: SCN10A; (-) strand; PAM type: YTN; PAM sequence: TTC
agccctacttatcaccctcc

SEQ ID NO: 52708 - DNA, 20 bp, Artificial Sequence
  Description of Artificial Sequence: Synthetic oligonucleotide
  Target: SCN10A; (-) strand; PAM type: YTN; PAM sequence: TTT
cagccctacttatcaccctc

SEQ ID NO: 52709 - DNA, 20 bp, Artificial Sequence
  Description of Artificial Sequence: Synthetic oligonucleotide
  Target: SCN10A; (-) strand; PAM type: YTN; PAM sequence: CTT
tcagccctacttatcaccct

SEQ ID NO: 52710 - DNA, 20 bp, Artificial Sequence
  Description of Artificial Sequence: Synthetic oligonucleotide
  Target: SCN10A; (-) strand; PAM type: YTN; PAM sequence: TTC
tttcagccctacttatcacc

SEQ ID NO: 52711 - DNA, 20 bp, Artificial Sequence
  Description of Artificial Sequence: Synthetic oligonucleotide
  Target: SCN10A; (-) strand; PAM type: YTN; PAM sequence: TTC
aagcaattctttcagcccta

SEQ ID NO: 52712 - DNA, 20 bp, Artificial Sequence
  Description of Artificial Sequence: Synthetic oligonucleotide
  Target: SCN10A; (-) strand; PAM type: YTN; PAM sequence: TTT
caagcaattctttcagccct

SEQ ID NO: 52713 - DNA, 20 bp, Artificial Sequence
  Description of Artificial Sequence: Synthetic oligonucleotide
  Target: SCN10A; (-) strand; PAM type: YTN; PAM sequence: CTT
tcaagcaattctttcagccc

SEQ ID NO: 52714 - DNA, 20 bp, Artificial Sequence
  Description of Artificial Sequence: Synthetic oligonucleotide
  Target: SCN10A; (-) strand; PAM type: YTN; PAM sequence: CTG
taaaaaactttcaagcaatt

SEQ ID NO: 52715 - DNA, 20 bp, Artificial Sequence
  Description of Artificial Sequence: Synthetic oligonucleotide
  Target: SCN10A; (-) strand; PAM type: YTN; PAM sequence: TTC
ctgtaaaaaactttcaagca

SEQ ID NO: 52716 - DNA, 20 bp, Artificial Sequence
  Description of Artificial Sequence: Synthetic oligonucleotide
  Target: SCN10A; (-) strand; PAM type: YTN; PAM sequence: CTG
gttcctgtaaaaaactttca

SEQ ID NO: 52717 - DNA, 20 bp, Artificial Sequence
  Description of Artificial Sequence: Synthetic oligonucleotide
  Target: SCN10A; (-) strand; PAM type: YTN; PAM sequence: CTC
aactggttcctgtaaaaaac

SEQ ID NO: 52718 - DNA, 20 bp, Artificial Sequence
  Description of Artificial Sequence: Synthetic oligonucleotide
  Target: SCN10A; (-) strand; PAM type: YTN; PAM sequence: CTA
gaaagctcaactggttcctg

SEQ ID NO: 52719 - DNA, 20 bp, Artificial Sequence
  Description of Artificial Sequence: Synthetic oligonucleotide
  Target: SCN10A; (-) strand; PAM type: YTN; PAM sequence: TTG
aatggatggcataaagcagc

SEQ ID NO: 52720 - DNA, 20 bp, Artificial Sequence
  Description of Artificial Sequence: Synthetic oligonucleotide
  Target: SCN10A; (-) strand; PAM type: YTN; PAM sequence: CTC
attgaatggatggcataaag

SEQ ID NO: 52721 - DNA, 20 bp, Artificial Sequence
  Description of Artificial Sequence: Synthetic oligonucleotide
  Target: SCN10A; (-) strand; PAM type: YTN; PAM sequence: TTC
tcattgaatggatggcataa

SEQ ID NO: 52722 - DNA, 20 bp, Artificial Sequence
  Description of Artificial Sequence: Synthetic oligonucleotide
  Target: SCN10A; (-) strand; PAM type: YTN; PAM sequence: TTT
ctcattgaatggatggcata

SEQ ID NO: 52723 - DNA, 20 bp, Artificial Sequence
  Description of Artificial Sequence: Synthetic oligonucleotide
  Target: SCN10A; (-) strand; PAM type: YTN; PAM sequence: CTG
gagcagaaacagtttctcat

SEQ ID NO: 52724 - DNA, 20 bp, Artificial Sequence
  Description of Artificial Sequence: Synthetic oligonucleotide
  Target: SCN10A; (-) strand; PAM type: YTN; PAM sequence: TTC
tggagcagaaacagtttctc

SEQ ID NO: 52725 - DNA, 20 bp, Artificial Sequence
  Description of Artificial Sequence: Synthetic oligonucleotide
  Target: SCN10A; (-) strand; PAM type: YTN; PAM sequence: TTT
ctggagcagaaacagtttct

SEQ ID NO: 52726 - DNA, 20 bp, Artificial Sequence
  Description of Artificial Sequence: Synthetic oligonucleotide
  Target: SCN10A; (-) strand; PAM type: YTN; PAM sequence: TTA
agaaaatgagcatccaatcc

SEQ ID NO: 52727 - DNA, 20 bp, Artificial Sequence
  Description of Artificial Sequence: Synthetic oligonucleotide
  Target: SCN10A; (-) strand; PAM type: YTN; PAM sequence: CTT
aagaaaatgagcatccaatc

SEQ ID NO: 52728 - DNA, 20 bp, Artificial Sequence
  Description of Artificial Sequence: Synthetic oligonucleotide
  Target: SCN10A; (-) strand; PAM type: YTN; PAM sequence: CTC
ttaagaaaatgagcatccaa

SEQ ID NO: 52729 - DNA, 20 bp, Artificial Sequence
  Description of Artificial Sequence: Synthetic oligonucleotide
  Target: SCN10A; (-) strand; PAM type: YTN; PAM sequence: TTC
aactcttaagaaaatgagca

SEQ ID NO: 52730 - DNA, 20 bp, Artificial Sequence
  Description of Artificial Sequence: Synthetic oligonucleotide
  Target: SCN10A; (-) strand; PAM type: YTN; PAM sequence: CTT
caactcttaagaaaatgagc

SEQ ID NO: 52731 - DNA, 20 bp, Artificial Sequence
  Description of Artificial Sequence: Synthetic oligonucleotide
  Target: SCN10A; (-) strand; PAM type: YTN; PAM sequence: TTC
ttcaactcttaagaaaatga

SEQ ID NO: 52732 - DNA, 20 bp, Artificial Sequence
  Description of Artificial Sequence: Synthetic oligonucleotide
  Target: SCN10A; (-) strand; PAM type: YTN; PAM sequence: CTT
cttcaactcttaagaaaatg

SEQ ID NO: 52733 - DNA, 20 bp, Artificial Sequence
  Description of Artificial Sequence: Synthetic oligonucleotide
  Target: SCN10A; (-) strand; PAM type: YTN; PAM sequence: CTC
ttcttcaactcttaagaaaa

SEQ ID NO: 52734 - DNA, 20 bp, Artificial Sequence
  Description of Artificial Sequence: Synthetic oligonucleotide
  Target: SCN10A; (-) strand; PAM type: YTN; PAM sequence: TTC
cctcttcttcaactcttaag

SEQ ID NO: 52735 - DNA, 20 bp, Artificial Sequence
  Description of Artificial Sequence: Synthetic oligonucleotide
  Target: SCN10A; (-) strand; PAM type: YTN; PAM sequence: TTT
ccctcttcttcaactcttaa

SEQ ID NO: 52736 - DNA, 20 bp, Artificial Sequence
  Description of Artificial Sequence: Synthetic oligonucleotide
  Target: SCN10A; (-) strand; PAM type: YTN; PAM sequence: CTG
tttccctcttcttcaactct

SEQ ID NO: 52737 - DNA, 20 bp, Artificial Sequence
  Description of Artificial Sequence: Synthetic oligonucleotide
  Target: SCN10A; (-) strand; PAM type: YTN; PAM sequence: TTC
agtatgcaactgtttccctc

SEQ ID NO: 52738 - DNA, 20 bp, Artificial Sequence
  Description of Artificial Sequence: Synthetic oligonucleotide
  Target: SCN10A; (-) strand; PAM type: YTN; PAM sequence: TTT
cagtatgcaactgtttccct

SEQ ID NO: 52739 - DNA, 20 bp, Artificial Sequence
  Description of Artificial Sequence: Synthetic oligonucleotide
  Target: SCN10A; (-) strand; PAM type: YTN; PAM sequence: TTT
tcagtatgcaactgtttccc

SEQ ID NO: 52740 - DNA, 20 bp, Artificial Sequence
  Description of Artificial Sequence: Synthetic oligonucleotide
  Target: SCN10A; (-) strand; PAM type: YTN; PAM sequence: TTT
ttcagtatgcaactgtttcc

SEQ ID NO: 52741 - DNA, 20 bp, Artificial Sequence
  Description of Artificial Sequence: Synthetic oligonucleotide
  Target: SCN10A; (-) strand; PAM type: YTN; PAM sequence: TTA
tatgcatttttcagtatgca

SEQ ID NO: 52742 - DNA, 20 bp, Artificial Sequence
  Description of Artificial Sequence: Synthetic oligonucleotide
  Target: SCN10A; (-) strand; PAM type: YTN; PAM sequence: TTT
atatgcatttttcagtatgc

SEQ ID NO: 52743 - DNA, 20 bp, Artificial Sequence
  Description of Artificial Sequence: Synthetic oligonucleotide
  Target: SCN10A; (-) strand; PAM type: YTN; PAM sequence: CTT
tatatgcatttttcagtatg

SEQ ID NO: 52744 - DNA, 20 bp, Artificial Sequence
  Description of Artificial Sequence: Synthetic oligonucleotide
  Target: SCN10A; (-) strand; PAM type: YTN; PAM sequence: TTC
tttatatgcatttttcagta

SEQ ID NO: 52745 - DNA, 20 bp, Artificial Sequence
  Description of Artificial Sequence: Synthetic oligonucleotide
  Target: SCN10A; (-) strand; PAM type: YTN; PAM sequence: TTT
ctttatatgcatttttcagt

SEQ ID NO: 52746 - DNA, 20 bp, Artificial Sequence
  Description of Artificial Sequence: Synthetic oligonucleotide
  Target: SCN10A; (-) strand; PAM type: YTN; PAM sequence: TTT
tctttatatgcatttttcag

SEQ ID NO: 52747 - DNA, 20 bp, Artificial Sequence
  Description of Artificial Sequence: Synthetic oligonucleotide
  Target: SCN10A; (-) strand; PAM type: YTN; PAM sequence: CTT
ttctttatatgcatttttca

SEQ ID NO: 52748 - DNA, 20 bp, Artificial Sequence
  Description of Artificial Sequence: Synthetic oligonucleotide
  Target: SCN10A; (-) strand; PAM type: YTN; PAM sequence: TTC
agtaggtaaacttttcttta

SEQ ID NO: 52749 - DNA, 20 bp, Artificial Sequence
  Description of Artificial Sequence: Synthetic oligonucleotide
  Target: SCN10A; (-) strand; PAM type: YTN; PAM sequence: TTT
cagtaggtaaacttttcttt

SEQ ID NO: 52750 - DNA, 20 bp, Artificial Sequence
  Description of Artificial Sequence: Synthetic oligonucleotide
  Target: SCN10A; (-) strand; PAM type: YTN; PAM sequence: CTT
tcagtaggtaaacttttctt

SEQ ID NO: 52751 - DNA, 20 bp, Artificial Sequence
  Description of Artificial Sequence: Synthetic oligonucleotide
  Target: SCN10A; (-) strand; PAM type: YTN; PAM sequence: TTG
cctttcagtaggtaaacttt

SEQ ID NO: 52752 - DNA, 20 bp, Artificial Sequence
  Description of Artificial Sequence: Synthetic oligonucleotide
  Target: SCN10A; (-) strand; PAM type: YTN; PAM sequence: TTT
gcctttcagtaggtaaactt

SEQ ID NO: 52753 - DNA, 20 bp, Artificial Sequence
  Description of Artificial Sequence: Synthetic oligonucleotide
  Target: SCN10A; (-) strand; PAM type: YTN; PAM sequence: TTG
tttgcctttcagtaggtaaa

SEQ ID NO: 52754 - DNA, 20 bp, Artificial Sequence
  Description of Artificial Sequence: Synthetic oligonucleotide
  Target: SCN10A; (-) strand; PAM type: YTN; PAM sequence: TTA
acgaggagcagaagtgaata

SEQ ID NO: 52755 - DNA, 20 bp, Artificial Sequence
  Description of Artificial Sequence: Synthetic oligonucleotide
  Target: SCN10A; (-) strand; PAM type: YTN; PAM sequence: CTT
aacgaggagcagaagtgaat

SEQ ID NO: 52756 - DNA, 20 bp, Artificial Sequence
  Description of Artificial Sequence: Synthetic oligonucleotide
  Target: SCN10A; (-) strand; PAM type: YTN; PAM sequence: CTG
gaaacttaacgaggagcaga

SEQ ID NO: 52757 - DNA, 20 bp, Artificial Sequence
  Description of Artificial Sequence: Synthetic oligonucleotide
  Target: SCN10A; (-) strand; PAM type: YTN; PAM sequence: TTC
tggaaacttaacgaggagca

SEQ ID NO: 52758 - DNA, 20 bp, Artificial Sequence
  Description of Artificial Sequence: Synthetic oligonucleotide
  Target: SCN10A; (-) strand; PAM type: YTN; PAM sequence: CTT
ctggaaacttaacgaggagc

SEQ ID NO: 52759 - DNA, 20 bp, Artificial Sequence
  Description of Artificial Sequence: Synthetic oligonucleotide
  Target: SCN10A; (-) strand; PAM type: YTN; PAM sequence: TTA
tcttctggaaacttaacgag

SEQ ID NO: 52760 - DNA, 20 bp, Artificial Sequence
  Description of Artificial Sequence: Synthetic oligonucleotide
  Target: SCN10A; (-) strand; PAM type: YTN; PAM sequence: CTA
aaccagattatcttctggaa

SEQ ID NO: 52761 - DNA, 20 bp, Artificial Sequence
  Description of Artificial Sequence: Synthetic oligonucleotide
  Target: SCN10A; (-) strand; PAM type: YTN; PAM sequence: CTC
taaaccagattatcttctgg

SEQ ID NO: 52762 - DNA, 20 bp, Artificial Sequence
  Description of Artificial Sequence: Synthetic oligonucleotide
  Target: SCN10A; (-) strand; PAM type: YTN; PAM sequence: TTC
atgggctctaaaccagatta

SEQ ID NO: 52763 - DNA, 20 bp, Artificial Sequence
  Description of Artificial Sequence: Synthetic oligonucleotide
  Target: SCN10A; (-) strand; PAM type: YTN; PAM sequence: CTT
catgggctctaaaccagatt

SEQ ID NO: 52764 - DNA, 20 bp, Artificial Sequence
  Description of Artificial Sequence: Synthetic oligonucleotide
  Target: SCN10A; (-) strand; PAM type: YTN; PAM sequence: TTA
aaagtgcagcatcttcatgg

SEQ ID NO: 52765 - DNA, 20 bp, Artificial Sequence
  Description of Artificial Sequence: Synthetic oligonucleotide
  Target: SCN10A; (-) strand; PAM type: YTN; PAM sequence: TTC
atgttaaaagtgcagcatct

SEQ ID NO: 52766 - DNA, 20 bp, Artificial Sequence
  Description of Artificial Sequence: Synthetic oligonucleotide
  Target: SCN10A; (-) strand; PAM type: YTN; PAM sequence: CTG
ttcatgttaaaagtgcagca

SEQ ID NO: 52767 - DNA, 20 bp, Artificial Sequence
  Description of Artificial Sequence: Synthetic oligonucleotide
  Target: SCN10A; (-) strand; PAM type: YTN; PAM sequence: CTG
gctgttcatgttaaaagtgc

SEQ ID NO: 52768 - DNA, 20 bp, Artificial Sequence
  Description of Artificial Sequence: Synthetic oligonucleotide
  Target: SCN10A; (-) strand; PAM type: YTN; PAM sequence: TTG
gctggctgttcatgttaaaa

SEQ ID NO: 52769 - DNA, 20 bp, Artificial Sequence
  Description of Artificial Sequence: Synthetic oligonucleotide
  Target: SCN10A; (-) strand; PAM type: YTN; PAM sequence: CTT
ggctggctgttcatgttaaa

SEQ ID NO: 52770 - DNA, 20 bp, Artificial Sequence
  Description of Artificial Sequence: Synthetic oligonucleotide
  Target: SCN10A; (-) strand; PAM type: YTN; PAM sequence: CTC
cttggctggctgttcatgtt

SEQ ID NO: 52771 - DNA, 20 bp, Artificial Sequence
  Description of Artificial Sequence: Synthetic oligonucleotide
  Target: SCN10A; (-) strand; PAM type: YTN; PAM sequence: CTG
atgctccttggctggctgtt

SEQ ID NO: 52772 - DNA, 20 bp, Artificial Sequence
  Description of Artificial Sequence: Synthetic oligonucleotide
  Target: SCN10A; (-) strand; PAM type: YTN; PAM sequence: TTC
ctgatgctccttggctggct

SEQ ID NO: 52773 - DNA, 20 bp, Artificial Sequence
  Description of Artificial Sequence: Synthetic oligonucleotide
  Target: SCN10A; (-) strand; PAM type: YTN; PAM sequence: TTC
aaattcctgatgctccttgg

SEQ ID NO: 52774 - DNA, 20 bp, Artificial Sequence
  Description of Artificial Sequence: Synthetic oligonucleotide
  Target: SCN10A; (-) strand; PAM type: YTN; PAM sequence: CTT
caaattcctgatgctccttg

SEQ ID NO: 52775 - DNA, 20 bp, Artificial Sequence
  Description of Artificial Sequence: Synthetic oligonucleotide
  Target: SCN10A; (-) strand; PAM type: YTN; PAM sequence: TTA
gaagcatccttcaaattcct

SEQ ID NO: 52776 - DNA, 20 bp, Artificial Sequence
  Description of Artificial Sequence: Synthetic oligonucleotide
  Target: SCN10A; (-) strand; PAM type: YTN; PAM sequence: CTG
gtgttagaagcatccttcaa

SEQ ID NO: 52777 - DNA, 20 bp, Artificial Sequence
  Description of Artificial Sequence: Synthetic oligonucleotide
  Target: SCN10A; (-) strand; PAM type: YTN; PAM sequence: TTC
tggtgttagaagcatccttc

SEQ ID NO: 52778 - DNA, 20 bp, Artificial Sequence
  Description of Artificial Sequence: Synthetic oligonucleotide
  Target: SCN10A; (-) strand; PAM type: YTN; PAM sequence: TTT
ctggtgttagaagcatcctt

SEQ ID NO: 52779 - DNA, 20 bp, Artificial Sequence
  Description of Artificial Sequence: Synthetic oligonucleotide
  Target: SCN10A; (-) strand; PAM type: YTN; PAM sequence: TTG
gtttctggtgttagaagcat

SEQ ID NO: 52780 - DNA, 20 bp, Artificial Sequence
  Description of Artificial Sequence: Synthetic oligonucleotide
  Target: SCN10A; (-) strand; PAM type: YTN; PAM sequence: TTT
ggtttctggtgttagaagca

SEQ ID NO: 52781 - DNA, 20 bp, Artificial Sequence
  Description of Artificial Sequence: Synthetic oligonucleotide
  Target: SCN10A; (-) strand; PAM type: YTN; PAM sequence: CTT
tggtttctggtgttagaagc

SEQ ID NO: 52782 - DNA, 20 bp, Artificial Sequence
  Description of Artificial Sequence: Synthetic oligonucleotide
  Target: SCN10A; (-) strand; PAM type: YTN; PAM sequence: TTG
ctttggtttctggtgttaga

SEQ ID NO: 52783 - DNA, 20 bp, Artificial Sequence
  Description of Artificial Sequence: Synthetic oligonucleotide
  Target: SCN10A; (-) strand; PAM type: YTN; PAM sequence: TTG
gttgctttggtttctggtgt

SEQ ID NO: 52784 - DNA, 20 bp, Artificial Sequence
  Description of Artificial Sequence: Synthetic oligonucleotide
  Target: SCN10A; (-) strand; PAM type: YTN; PAM sequence: TTT
ggttgctttggtttctggtg

SEQ ID NO: 52785 - DNA, 20 bp, Artificial Sequence
  Description of Artificial Sequence: Synthetic oligonucleotide
  Target: SCN10A; (-) strand; PAM type: YTN; PAM sequence: TTG
tttggttgctttggtttctg

SEQ ID NO: 52786 - DNA, 20 bp, Artificial Sequence
  Description of Artificial Sequence: Synthetic oligonucleotide
  Target: SCN10A; (-) strand; PAM type: YTN; PAM sequence: TTC
agttgtttggttgctttggt

SEQ ID NO: 52787 - DNA, 20 bp, Artificial Sequence
  Description of Artificial Sequence: Synthetic oligonucleotide
  Target: SCN10A; (-) strand; PAM type: YTN; PAM sequence: TTT
cagttgtttggttgctttgg

SEQ ID NO: 52788 - DNA, 20 bp, Artificial Sequence
  Description of Artificial Sequence: Synthetic oligonucleotide
  Target: SCN10A; (-) strand; PAM type: YTN; PAM sequence: TTT
tcagttgtttggttgctttg

SEQ ID NO: 52789 - DNA, 20 bp, Artificial Sequence
  Description of Artificial Sequence: Synthetic oligonucleotide
  Target: SCN10A; (-) strand; PAM type: YTN; PAM sequence: TTT
ttcagttgtttggttgcttt

SEQ ID NO: 52790 - DNA, 20 bp, Artificial Sequence
  Description of Artificial Sequence: Synthetic oligonucleotide
  Target: SCN10A; (-) strand; PAM type: YTN; PAM sequence: TTT
tttcagttgtttggttgctt

SEQ ID NO: 52791 - DNA, 20 bp, Artificial Sequence
  Description of Artificial Sequence: Synthetic oligonucleotide
  Target: SCN10A; (-) strand; PAM type: YTN; PAM sequence: TTT
ttttcagttgtttggttgct

SEQ ID NO: 52792 - DNA, 20 bp, Artificial Sequence
  Description of Artificial Sequence: Synthetic oligonucleotide
  Target: SCN10A; (-) strand; PAM type: YTN; PAM sequence: TTT
tttttcagttgtttggttgc

SEQ ID NO: 52793 - DNA, 20 bp, Artificial Sequence
  Description of Artificial Sequence: Synthetic oligonucleotide
  Target: SCN10A; (-) strand; PAM type: YTN; PAM sequence: TTT
ttttttcagttgtttggttg

SEQ ID NO: 52794 - DNA, 20 bp, Artificial Sequence
  Description of Artificial Sequence: Synthetic oligonucleotide
  Target: SCN10A; (-) strand; PAM type: YTN; PAM sequence: TTT
tttttttcagttgtttggtt

SEQ ID NO: 52795 - DNA, 20 bp, Artificial Sequence
  Description of Artificial Sequence: Synthetic oligonucleotide
  Target: SCN10A; (-) strand; PAM type: YTN; PAM sequence: TTT
ttttttttcagttgtttggt

SEQ ID NO: 52796 - DNA, 20 bp, Artificial Sequence
  Description of Artificial Sequence: Synthetic oligonucleotide
  Target: SCN10A; (-) strand; PAM type: YTN; PAM sequence: TTT
tttttttttcagttgtttgg

SEQ ID NO: 52797 - DNA, 20 bp, Artificial Sequence
  Description of Artificial Sequence: Synthetic oligonucleotide
  Target: SCN10A; (-) strand; PAM type: YTN; PAM sequence: TTT
ttttttttttcagttgtttg

SEQ ID NO: 52798 - DNA, 20 bp, Artificial Sequence
  Description of Artificial Sequence: Synthetic oligonucleotide
  Target: SCN10A; (-) strand; PAM type: YTN; PAM sequence: TTT
tttttttttttcagttgttt

SEQ ID NO: 52799 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttcagttgtt

SEQ ID NO: 52800 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttcagttgt

SEQ ID NO: 52801 - DNA, 20 bp, Artificial Sequence
  Description of Artificial Sequence: Synthetic oligonucleotide
  Target: SCN10A; (-) strand; PAM type: YTN; PAM sequence: CTT
ttttttttttttttcagttg

SEQ ID NO: 52802 - DNA, 20 bp, Artificial Sequence
  Description of Artificial Sequence: Synthetic oligonucleotide
  Target: SCN10A; (-) strand; PAM type: YTN; PAM sequence: TTC
ttttttttttttttttcagt

SEQ ID NO: 52803 - DNA, 20 bp, Artificial Sequence
  Description of Artificial Sequence: Synthetic oligonucleotide
  Target: SCN10A; (-) strand; PAM type: YTN; PAM sequence: TTT
cttttttttttttttttcag

SEQ ID NO: 52804 - DNA, 20 bp, Artificial Sequence
  Description of Artificial Sequence: Synthetic oligonucleotide
  Target: SCN10A; (-) strand; PAM type: YTN; PAM sequence: TTT
tcttttttttttttttttca

SEQ ID NO: 52805 - DNA, 20 bp, Artificial Sequence
  Description of Artificial Sequence: Synthetic oligonucleotide
  Target: SCN10A; (-) strand; PAM type: YTN; PAM sequence: CTT
ttcttttttttttttttttc

SEQ ID NO: 52806 - DNA, 20 bp, Artificial Sequence
  Description of Artificial Sequence: Synthetic oligonucleotide
  Target: SCN10A; (-) strand; PAM type: YTN; PAM sequence: TTC
ttttcttttttttttttttt

SEQ ID NO: 52807 - DNA, 20 bp, Artificial Sequence
  Description of Artificial Sequence: Synthetic oligonucleotide
  Target: SCN10A; (-) strand; PAM type: YTN; PAM sequence: TTT
cttttctttttttttttttt

SEQ ID NO: 52808 - DNA, 20 bp, Artificial Sequence
  Description of Artificial Sequence: Synthetic oligonucleotide
  Target: SCN10A; (-) strand; PAM type: YTN; PAM sequence: TTT
tcttttcttttttttttttt

SEQ ID NO: 52809 - DNA, 20 bp, Artificial Sequence
  Description of Artificial Sequence: Synthetic oligonucleotide
  Target: SCN10A; (-) strand; PAM type: YTN; PAM sequence: CTT
ttcttttctttttttttttt

SEQ ID NO: 52810 - DNA, 20 bp, Artificial Sequence
  Description of Artificial Sequence: Synthetic oligonucleotide
  Target: SCN10A; (-) strand; PAM type: YTN; PAM sequence: TTC
ttttcttttctttttttttt

SEQ ID NO: 52811 - DNA, 20 bp, Artificial Sequence
  Description of Artificial Sequence: Synthetic oligonucleotide
  Target: SCN10A; (-) strand; PAM type: YTN; PAM sequence: TTT
cttttcttttcttttttttt

SEQ ID NO: 52812 - DNA, 20 bp, Artificial Sequence
  Description of Artificial Sequence: Synthetic oligonucleotide
  Target: SCN10A; (-) strand; PAM type: YTN; PAM sequence: TTT
tcttttcttttctttttttt

SEQ ID NO: 52813 - DNA, 20 bp, Artificial Sequence
  Description of Artificial Sequence: Synthetic oligonucleotide
  Target: SCN10A; (-) strand; PAM type: YTN; PAM sequence: CTT
ttcttttcttttcttttttt

SEQ ID NO: 52814 - DNA, 20 bp, Artificial Sequence
  Description of Artificial Sequence: Synthetic oligonucleotide
  Target: SCN10A; (-) strand; PAM type: YTN; PAM sequence: TTC
ttttcttttcttttcttttt

SEQ ID NO: 52815 - DNA, 20 bp, Artificial Sequence
  Description of Artificial Sequence: Synthetic oligonucleotide
  Target: SCN10A; (-) strand; PAM type: YTN; PAM sequence: TTT
cttttcttttcttttctttt

SEQ ID NO: 52816 - DNA, 20 bp, Artificial Sequence
  Description of Artificial Sequence: Synthetic oligonucleotide
  Target: SCN10A; (-) strand; PAM type: YTN; PAM sequence: TTT
tcttttcttttcttttcttt

SEQ ID NO: 52817 - DNA, 20 bp, Artificial Sequence
  Description of Artificial Sequence: Synthetic oligonucleotide
  Target: SCN10A; (-) strand; PAM type: YTN; PAM sequence: TTT
ttcttttcttttcttttctt

SEQ ID NO: 52818 - DNA, 20 bp, Artificial Sequence
  Description of Artificial Sequence: Synthetic oligonucleotide
  Target: SCN10A; (-) strand; PAM type: YTN; PAM sequence: CTT
tttcttttcttttcttttct

SEQ ID NO: 52819 - DNA, 20 bp, Artificial Sequence
  Description of Artificial Sequence: Synthetic oligonucleotide
  Target: SCN10A; (-) strand; PAM type: YTN; PAM sequence: CTC
tttttcttttcttttctttt

SEQ ID NO: 52820 - DNA, 20 bp, Artificial Sequence
  Description of Artificial Sequence: Synthetic oligonucleotide
  Target: SCN10A; (-) strand; PAM type: YTN; PAM sequence: TTG
tctctttttcttttcttttc

SEQ ID NO: 52821 - DNA, 20 bp, Artificial Sequence
  Description of Artificial Sequence: Synthetic oligonucleotide
  Target: SCN10A; (-) strand; PAM type: YTN; PAM sequence: TTA
ttgtctctttttcttttctt

SEQ ID NO: 52822 - DNA, 20 bp, Artificial Sequence
  Description of Artificial Sequence: Synthetic oligonucleotide
  Target: SCN10A; (-) strand; PAM type: YTN; PAM sequence: TTT
attgtctctttttcttttct

SEQ ID NO: 52823 - DNA, 20 bp, Artificial Sequence
  Description of Artificial Sequence: Synthetic oligonucleotide
  Target: SCN10A; (-) strand; PAM type: YTN; PAM sequence: CTT
tattgtctctttttcttttc

SEQ ID NO: 52824 - DNA, 20 bp, Artificial Sequence
  Description of Artificial Sequence: Synthetic oligonucleotide
  Target: SCN10A; (-) strand; PAM type: YTN; PAM sequence: CTC
tttattgtctctttttcttt

SEQ ID NO: 52825 - DNA, 20 bp, Artificial Sequence
  Description of Artificial Sequence: Synthetic oligonucleotide
  Target: SCN10A; (-) strand; PAM type: YTN; PAM sequence: CTG
ccctctttattgtctctttt

SEQ ID NO: 52826 - DNA, 20 bp, Artificial Sequence
  Description of Artificial Sequence: Synthetic oligonucleotide
  Target: SCN10A; (-) strand; PAM type: YTN; PAM sequence: TTC
tgccctctttattgtctctt

SEQ ID NO: 52827 - DNA, 20 bp, Artificial Sequence
  Description of Artificial Sequence: Synthetic oligonucleotide
  Target: SCN10A; (-) strand; PAM type: YTN; PAM sequence: CTT
ctgccctctttattgtctct

SEQ ID NO: 52828 - DNA, 20 bp, Artificial Sequence
  Description of Artificial Sequence: Synthetic oligonucleotide
  Target: SCN10A; (-) strand; PAM type: YTN; PAM sequence: TTC
ttctgccctctttattgtct

SEQ ID NO: 52829 - DNA, 20 bp, Artificial Sequence
  Description of Artificial Sequence: Synthetic oligonucleotide
  Target: SCN10A; (-) strand; PAM type: YTN; PAM sequence: CTT
cttctgccctctttattgtc

SEQ ID NO: 52830 - DNA, 20 bp, Artificial Sequence
  Description of Artificial Sequence: Synthetic oligonucleotide
  Target: SCN10A; (-) strand; PAM type: YTN; PAM sequence: CTC
ttcttctgccctctttattg

SEQ ID NO: 52831 - DNA, 20 bp, Artificial Sequence
  Description of Artificial Sequence: Synthetic oligonucleotide
  Target: SCN10A; (-) strand; PAM type: YTN; PAM sequence: CTA
actcttcttctgccctcttt

SEQ ID NO: 52832 - DNA, 20 bp, Artificial Sequence
  Description of Artificial Sequence: Synthetic oligonucleotide
  Target: SCN10A; (-) strand; PAM type: YTN; PAM sequence: CTC
taactcttcttctgccctct

SEQ ID NO: 52833 - DNA, 20 bp, Artificial Sequence
  Description of Artificial Sequence: Synthetic oligonucleotide
  Target: SCN10A; (-) strand; PAM type: YTN; PAM sequence: TTC
tctaactcttcttctgccct

SEQ ID NO: 52834 - DNA, 20 bp, Artificial Sequence
  Description of Artificial Sequence: Synthetic oligonucleotide
  Target: SCN10A; (-) strand; PAM type: YTN; PAM sequence: TTT
ctctaactcttcttctgccc

SEQ ID NO: 52835 - DNA, 20 bp, Artificial Sequence
  Description of Artificial Sequence: Synthetic oligonucleotide
  Target: SCN10A; (-) strand; PAM type: YTN; PAM sequence: TTA
tttctctaactcttcttctg

SEQ ID NO: 52836 - DNA, 20 bp, Artificial Sequence
  Description of Artificial Sequence: Synthetic oligonucleotide
  Target: SCN10A; (-) strand; PAM type: YTN; PAM sequence: TTT
atttctctaactcttcttct

SEQ ID NO: 52837 - DNA, 20 bp, Artificial Sequence
  Description of Artificial Sequence: Synthetic oligonucleotide
  Target: SCN10A; (-) strand; PAM type: YTN; PAM sequence: TTT
tatttctctaactcttcttc

SEQ ID NO: 52838 - DNA, 20 bp, Artificial Sequence
  Description of Artificial Sequence: Synthetic oligonucleotide
  Target: SCN10A; (-) strand; PAM type: YTN; PAM sequence: CTG
gccaatacagttttatttct

SEQ ID NO: 52839 - DNA, 20 bp, Artificial Sequence
  Description of Artificial Sequence: Synthetic oligonucleotide
  Target: SCN10A; (-) strand; PAM type: YTN; PAM sequence: TTA
caggcgtgagccacagcgcc

SEQ ID NO: 52840 - DNA, 20 bp, Artificial Sequence
  Description of Artificial Sequence: Synthetic oligonucleotide
  Target: SCN10A; (-) strand; PAM type: YTN; PAM sequence: CTG
cgattacaggcgtgagccac

SEQ ID NO: 52841 - DNA, 20 bp, Artificial Sequence
  Description of Artificial Sequence: Synthetic oligonucleotide
  Target: SCN10A; (-) strand; PAM type: YTN; PAM sequence: CTC
ccaaagtgctgcgattacag

SEQ ID NO: 52842 - DNA, 20 bp, Artificial Sequence
  Description of Artificial Sequence: Synthetic oligonucleotide
  Target: SCN10A; (-) strand; PAM type: YTN; PAM sequence: CTC
ggcctcccaaagtgctgcga

SEQ ID NO: 52843 - DNA, 20 bp, Artificial Sequence
  Description of Artificial Sequence: Synthetic oligonucleotide
  Target: SCN10A; (-) strand; PAM type: YTN; PAM sequence: CTG
cccgcctcggcctcccaaag

SEQ ID NO: 52844 - DNA, 20 bp, Artificial Sequence
  Description of Artificial Sequence: Synthetic oligonucleotide
  Target: SCN10A; (-) strand; PAM type: YTN; PAM sequence: CTC
gtaatctgcccgcctcggcc

SEQ ID NO: 52845 - DNA, 20 bp, Artificial Sequence
  Description of Artificial Sequence: Synthetic oligonucleotide
  Target: SCN10A; (-) strand; PAM type: YTN; PAM sequence: CTG
acctcgtaatctgcccgcct

SEQ ID NO: 52846 - DNA, 20 bp, Artificial Sequence
  Description of Artificial Sequence: Synthetic oligonucleotide
  Target: SCN10A; (-) strand; PAM type: YTN; PAM sequence: CTC
ctgacctcgtaatctgcccg

SEQ ID NO: 52847 - DNA, 20 bp, Artificial Sequence
  Description of Artificial Sequence: Synthetic oligonucleotide
  Target: SCN10A; (-) strand; PAM type: YTN; PAM sequence: CTC
gatctcctgacctcgtaatc

SEQ ID NO: 52848 - DNA, 20 bp, Artificial Sequence
  Description of Artificial Sequence: Synthetic oligonucleotide
  Target: SCN10A; (-) strand; PAM type: YTN; PAM sequence: TTA
gccaggatggtctcgatctc

SEQ ID NO: 52849 - DNA, 20 bp, Artificial Sequence
  Description of Artificial Sequence: Synthetic oligonucleotide
  Target: SCN10A; (-) strand; PAM type: YTN; PAM sequence: TTC
accgcgttagccaggatggt

SEQ ID NO: 52850 - DNA, 20 bp, Artificial Sequence
  Description of Artificial Sequence: Synthetic oligonucleotide
  Target: SCN10A; (-) strand; PAM type: YTN; PAM sequence: TTT
caccgcgttagccaggatgg

SEQ ID NO: 52851 - DNA, 20 bp, Artificial Sequence
  Description of Artificial Sequence: Synthetic oligonucleotide
  Target: SCN10A; (-) strand; PAM type: YTN; PAM sequence: TTA
gtagagacggggtttcaccg

SEQ ID NO: 52852 - DNA, 20 bp, Artificial Sequence
  Description of Artificial Sequence: Synthetic oligonucleotide
  Target: SCN10A; (-) strand; PAM type: YTN; PAM sequence: TTT
agtagagacggggtttcacc

SEQ ID NO: 52853 - DNA, 20 bp, Artificial Sequence
  Description of Artificial Sequence: Synthetic oligonucleotide
  Target: SCN10A; (-) strand; PAM type: YTN; PAM sequence: TTT
tagtagagacggggtttcac

SEQ ID NO: 52854 - DNA, 20 bp, Artificial Sequence
  Description of Artificial Sequence: Synthetic oligonucleotide
  Target: SCN10A; (-) strand; PAM type: YTN; PAM sequence: TTT
ttagtagagacggggtttca

SEQ ID NO: 52855 - DNA, 20 bp, Artificial Sequence
  Description of Artificial Sequence: Synthetic oligonucleotide
  Target: SCN10A; (-) strand; PAM type: YTN; PAM sequence: TTG
tatttttagtagagacgggg

SEQ ID NO: 52856 - DNA, 20 bp, Artificial Sequence
  Description of Artificial Sequence: Synthetic oligonucleotide
  Target: SCN10A; (-) strand; PAM type: YTN; PAM sequence: TTT
gtatttttagtagagacggg

SEQ ID NO: 52857 - DNA, 20 bp, Artificial Sequence
  Description of Artificial Sequence: Synthetic oligonucleotide
  Target: SCN10A; (-) strand; PAM type: YTN; PAM sequence: TTT
tgtatttttagtagagacgg

SEQ ID NO: 52858 - DNA, 20 bp, Artificial Sequence
  Description of Artificial Sequence: Synthetic oligonucleotide
  Target: SCN10A; (-) strand; PAM type: YTN; PAM sequence: TTT
ttgtatttttagtagagacg

SEQ ID NO: 52859 - DNA, 20 bp, Artificial Sequence
  Description of Artificial Sequence: Synthetic oligonucleotide
  Target: SCN10A; (-) strand; PAM type: YTN; PAM sequence: TTT
tttgtatttttagtagagac

SEQ ID NO: 52860 - DNA, 20 bp, Artificial Sequence
  Description of Artificial Sequence: Synthetic oligonucleotide
  Target: SCN10A; (-) strand; PAM type: YTN; PAM sequence: CTA
attttttgtatttttagtag

SEQ ID NO: 52861 - DNA, 20 bp, Artificial Sequence
  Description of Artificial Sequence: Synthetic oligonucleotide
  Target: SCN10A; (-) strand; PAM type: YTN; PAM sequence: CTA
caggtgcccgccaaggcgcc

SEQ ID NO: 52862 - DNA, 20 bp, Artificial Sequence
  Description of Artificial Sequence: Synthetic oligonucleotide
  Target: SCN10A; (-) strand; PAM type: YTN; PAM sequence: CTG
gaactacaggtgcccgccaa

SEQ ID NO: 52863 - DNA, 20 bp, Artificial Sequence
  Description of Artificial Sequence: Synthetic oligonucleotide
  Target: SCN10A; (-) strand; PAM type: YTN; PAM sequence: CTC
cggagtagctggaactacag

SEQ ID NO: 52864 - DNA, 20 bp, Artificial Sequence
  Description of Artificial Sequence: Synthetic oligonucleotide
  Target: SCN10A; (-) strand; PAM type: YTN; PAM sequence: CTC
agcctccggagtagctggaa

SEQ ID NO: 52865 - DNA, 20 bp, Artificial Sequence
  Description of Artificial Sequence: Synthetic oligonucleotide
  Target: SCN10A; (-) strand; PAM type: YTN; PAM sequence: CTC
ccgcctcagcctccggagta

SEQ ID NO: 52866 - DNA, 20 bp, Artificial Sequence
  Description of Artificial Sequence: Synthetic oligonucleotide
  Target: SCN10A; (-) strand; PAM type: YTN; PAM sequence: TTC
tcccgcctcagcctccggag

SEQ ID NO: 52867 - DNA, 20 bp, Artificial Sequence
  Description of Artificial Sequence: Synthetic oligonucleotide
  Target: SCN10A; (-) strand; PAM type: YTN; PAM sequence: TTC
acgccattctcccgcctcag

SEQ ID NO: 52868 - DNA, 20 bp, Artificial Sequence
  Description of Artificial Sequence: Synthetic oligonucleotide
  Target: SCN10A; (-) strand; PAM type: YTN; PAM sequence: CTC
ccgggttcacgccattctcc

SEQ ID NO: 52869 - DNA, 20 bp, Artificial Sequence
  Description of Artificial Sequence: Synthetic oligonucleotide
  Target: SCN10A; (-) strand; PAM type: YTN; PAM sequence: CTC
cgcctcccgggttcacgcca

SEQ ID NO: 52870 - DNA, 20 bp, Artificial Sequence
  Description of Artificial Sequence: Synthetic oligonucleotide
  Target: SCN10A; (-) strand; PAM type: YTN; PAM sequence: CTG
caagctccgcctcccgggtt

SEQ ID NO: 52871 - DNA, 20 bp, Artificial Sequence
  Description of Artificial Sequence: Synthetic oligonucleotide
  Target: SCN10A; (-) strand; PAM type: YTN; PAM sequence: CTC
actgcaagctccgcctcccg

SEQ ID NO: 52872 - DNA, 20 bp, Artificial Sequence
  Description of Artificial Sequence: Synthetic oligonucleotide
  Target: SCN10A; (-) strand; PAM type: YTN; PAM sequence: CTA
ggctcactgcaagctccgcc

SEQ ID NO: 52873 - DNA, 20 bp, Artificial Sequence
  Description of Artificial Sequence: Synthetic oligonucleotide
  Target: SCN10A; (-) strand; PAM type: YTN; PAM sequence: CTG
gagtgcagtgacgcgatcta

SEQ ID NO: 52874 - DNA, 20 bp, Artificial Sequence
  Description of Artificial Sequence: Synthetic oligonucleotide
  Target: SCN10A; (-) strand; PAM type: YTN; PAM sequence: CTG
tcacccagactggagtgcag

SEQ ID NO: 52875 - DNA, 20 bp, Artificial Sequence
  Description of Artificial Sequence: Synthetic oligonucleotide
  Target: SCN10A; (-) strand; PAM type: YTN; PAM sequence: CTC
tgtcacccagactggagtgc

SEQ ID NO: 52876 - DNA, 20 bp, Artificial Sequence
  Description of Artificial Sequence: Synthetic oligonucleotide
  Target: SCN10A; (-) strand; PAM type: YTN; PAM sequence: TTG
ctctgtcacccagactggag

SEQ ID NO: 52877 - DNA, 20 bp, Artificial Sequence
  Description of Artificial Sequence: Synthetic oligonucleotide
  Target: SCN10A; (-) strand; PAM type: YTN; PAM sequence: CTT
gctctgtcacccagactgga

SEQ ID NO: 52878 - DNA, 20 bp, Artificial Sequence
  Description of Artificial Sequence: Synthetic oligonucleotide
  Target: SCN10A; (-) strand; PAM type: YTN; PAM sequence: TTG
gagacgaagtcttgctctgt

SEQ ID NO: 52879 - DNA, 20 bp, Artificial Sequence
  Description of Artificial Sequence: Synthetic oligonucleotide
  Target: SCN10A; (-) strand; PAM type: YTN; PAM sequence: TTT
ggagacgaagtcttgctctg

SEQ ID NO: 52880 - DNA, 20 bp, Artificial Sequence
  Description of Artificial Sequence: Synthetic oligonucleotide
  Target: SCN10A; (-) strand; PAM type: YTN; PAM sequence: TTT
tggagacgaagtcttgctct

SEQ ID NO: 52881 - DNA, 20 bp, Artificial Sequence
  Description of Artificial Sequence: Synthetic oligonucleotide
  Target: SCN10A; (-) strand; PAM type: YTN; PAM sequence: TTG
ttttggagacgaagtcttgc

SEQ ID NO: 52882 - DNA, 20 bp, Artificial Sequence
  Description of Artificial Sequence: Synthetic oligonucleotide
  Target: SCN10A; (-) strand; PAM type: YTN; PAM sequence: TTG
ttgttttggagacgaagtct

SEQ ID NO: 52883 - DNA, 20 bp, Artificial Sequence
  Description of Artificial Sequence: Synthetic oligonucleotide
  Target: SCN10A; (-) strand; PAM type: YTN; PAM sequence: TTG
ttgttgttttggagacgaag

SEQ ID NO: 52884 - DNA, 20 bp, Artificial Sequence
  Description of Artificial Sequence: Synthetic oligonucleotide
  Target: SCN10A; (-) strand; PAM type: YTN; PAM sequence: TTG
ttgttgttgttttggagacg

SEQ ID NO: 52885 - DNA, 20 bp, Artificial Sequence
  Description of Artificial Sequence: Synthetic oligonucleotide
  Target: SCN10A; (-) strand; PAM type: YTN; PAM sequence: CTG
ttgttgttgttgttttggag

SEQ ID NO: 52886 - DNA, 20 bp, Artificial Sequence
  Description of Artificial Sequence: Synthetic oligonucleotide
  Target: SCN10A; (-) strand; PAM type: YTN; PAM sequence: TTG
ctgttgttgttgttgttttg

SEQ ID NO: 52887 - DNA, 20 bp, Artificial Sequence
  Description of Artificial Sequence: Synthetic oligonucleotide
  Target: SCN10A; (-) strand; PAM type: YTN; PAM sequence: TTG
ttgctgttgttgttgttgtt

SEQ ID NO: 52888 - DNA, 20 bp, Artificial Sequence
  Description of Artificial Sequence: Synthetic oligonucleotide
  Target: SCN10A; (-) strand; PAM type: YTN; PAM sequence: TTG
ttgttgctgttgttgttgtt

SEQ ID NO: 52889 - DNA, 20 bp, Artificial Sequence
  Description of Artificial Sequence: Synthetic oligonucleotide
  Target: SCN10A; (-) strand; PAM type: YTN; PAM sequence: TTG
ttgttgttgctgttgttgtt

SEQ ID NO: 52890 - DNA, 20 bp, Artificial Sequence
  Description of Artificial Sequence: Synthetic oligonucleotide
  Target: SCN10A; (-) strand; PAM type: YTN; PAM sequence: TTG
ttgttgttgttgctgttgtt

SEQ ID NO: 52891 - DNA, 20 bp, Artificial Sequence
  Description of Artificial Sequence: Synthetic oligonucleotide
  Target: SCN10A; (-) strand; PAM type: YTN; PAM sequence: TTG
ttgttgttgttgttgctgtt

SEQ ID NO: 52892 - DNA, 20 bp, Artificial Sequence
  Description of Artificial Sequence: Synthetic oligonucleotide
  Target: SCN10A; (-) strand; PAM type: YTN; PAM sequence: TTT
gttgttgttgttgttgctgt

SEQ ID NO: 52893 - DNA, 20 bp, Artificial Sequence
  Description of Artificial Sequence: Synthetic oligonucleotide
  Target: SCN10A; (-) strand; PAM type: YTN; PAM sequence: TTT
tgttgttgttgttgttgctg

SEQ ID NO: 52894 - DNA, 20 bp, Artificial Sequence
  Description of Artificial Sequence: Synthetic oligonucleotide
  Target: SCN10A; (-) strand; PAM type: YTN; PAM sequence: TTT
ttgttgttgttgttgttgct

SEQ ID NO: 52895 - DNA, 20 bp, Artificial Sequence
  Description of Artificial Sequence: Synthetic oligonucleotide
  Target: SCN10A; (-) strand; PAM type: YTN; PAM sequence: TTG
tttttgttgttgttgttgtt

SEQ ID NO: 52896 - DNA, 20 bp, Artificial Sequence
  Description of Artificial Sequence: Synthetic oligonucleotide
  Target: SCN10A; (-) strand; PAM type: YTN; PAM sequence: TTT
gtttttgttgttgttgttgt

SEQ ID NO: 52897 - DNA, 20 bp, Artificial Sequence
  Description of Artificial Sequence: Synthetic oligonucleotide
  Target: SCN10A; (-) strand; PAM type: YTN; PAM sequence: TTT
tgtttttgttgttgttgttg

SEQ ID NO: 52898 - DNA, 20 bp, Artificial Sequence
  Description of Artificial Sequence: Synthetic oligonucleotide
  Target: SCN10A; (-) strand; PAM type: YTN; PAM sequence: TTT
ttgtttttgttgttgttgtt

SEQ ID NO: 52899 - DNA, 20 bp, Artificial Sequence
  Description of Artificial Sequence: Synthetic oligonucleotide
  Target: SCN10A; (-) strand; PAM type: YTN; PAM sequence: TTG
tttttgtttttgttgttgtt

SEQ ID NO: 52900 - DNA, 20 bp, Artificial Sequence
  Description of Artificial Sequence: Synthetic oligonucleotide
  Target: SCN10A; (-) strand; PAM type: YTN; PAM sequence: TTT
gtttttgtttttgttgttgt

SEQ ID NO: 52901 - DNA, 20 bp, Artificial Sequence
  Description of Artificial Sequence: Synthetic oligonucleotide
  Target: SCN10A; (-) strand; PAM type: YTN; PAM sequence: TTT
tgtttttgtttttgttgttg

SEQ ID NO: 52902 - DNA, 20 bp, Artificial Sequence
  Description of Artificial Sequence: Synthetic oligonucleotide
  Target: SCN10A; (-) strand; PAM type: YTN; PAM sequence: TTT
ttgtttttgtttttgttgtt

SEQ ID NO: 52903 - DNA, 20 bp, Artificial Sequence
  Description of Artificial Sequence: Synthetic oligonucleotide
  Target: SCN10A; (-) strand; PAM type: YTN; PAM sequence: TTT
tttgtttttgtttttgttgt

SEQ ID NO: 52904 - DNA, 20 bp, Artificial Sequence
  Description of Artificial Sequence: Synthetic oligonucleotide
  Target: SCN10A; (-) strand; PAM type: YTN; PAM sequence: TTT
ttttgtttttgtttttgttg

SEQ ID NO: 52905 - DNA, 20 bp, Artificial Sequence
  Description of Artificial Sequence: Synthetic oligonucleotide
  Target: SCN10A; (-) strand; PAM type: YTN; PAM sequence: TTT
tttttgtttttgtttttgtt

SEQ ID NO: 52906 - DNA, 20 bp, Artificial Sequence
  Description of Artificial Sequence: Synthetic oligonucleotide
  Target: SCN10A; (-) strand; PAM type: YTN; PAM sequence: TTT
ttttttgtttttgtttttgt

SEQ ID NO: 52907 - DNA, 20 bp, Artificial Sequence
  Description of Artificial Sequence: Synthetic oligonucleotide
  Target: SCN10A; (-) strand; PAM type: YTN; PAM sequence: TTT
tttttttgtttttgtttttg

SEQ ID NO: 52908 - DNA, 20 bp, Artificial Sequence
  Description of Artificial Sequence: Synthetic oligonucleotide
  Target: SCN10A; (-) strand; PAM type: YTN; PAM sequence: TTT
ttttttttgtttttgttttt

SEQ ID NO: 52909 - DNA, 20 bp, Artificial Sequence
  Description of Artificial Sequence: Synthetic oligonucleotide
  Target: SCN10A; (-) strand; PAM type: YTN; PAM sequence: TTT
tttttttttgtttttgtttt

SEQ ID NO: 52910 - DNA, 20 bp, Artificial Sequence
  Description of Artificial Sequence: Synthetic oligonucleotide
  Target: SCN10A; (-) strand; PAM type: YTN; PAM sequence: TTT
ttttttttttgtttttgttt

SEQ ID NO: 52911 - DNA, 20 bp, Artificial Sequence
  Description of Artificial Sequence: Synthetic oligonucleotide
  Target: SCN10A; (-) strand; PAM type: YTN; PAM sequence: TTA
gtacaggttttttttttttt

SEQ ID NO: 52912 - DNA, 20 bp, Artificial Sequence
  Description of Artificial Sequence: Synthetic oligonucleotide
  Target: SCN10A; (-) strand; PAM type: YTN; PAM sequence: CTA
aaaatattagtacaggtttt

SEQ ID NO: 52913 - DNA, 20 bp, Artificial Sequence
  Description of Artificial Sequence: Synthetic oligonucleotide
  Target: SCN10A; (-) strand; PAM type: YTN; PAM sequence: CTC
taaaaatattagtacaggtt

SEQ ID NO: 52914 - DNA, 20 bp, Artificial Sequence
  Description of Artificial Sequence: Synthetic oligonucleotide
  Target: SCN10A; (-) strand; PAM type: YTN; PAM sequence: CTC
tctaaaaatattagtacagg

SEQ ID NO: 52915 - DNA, 20 bp, Artificial Sequence
  Description of Artificial Sequence: Synthetic oligonucleotide
  Target: SCN10A; (-) strand; PAM type: YTN; PAM sequence: TTA
actctctaaaaatattagta

SEQ ID NO: 52916 - DNA, 20 bp, Artificial Sequence
  Description of Artificial Sequence: Synthetic oligonucleotide
  Target: SCN10A; (-) strand; PAM type: YTN; PAM sequence: CTT
aactctctaaaaatattagt

SEQ ID NO: 52917 - DNA, 20 bp, Artificial Sequence
  Description of Artificial Sequence: Synthetic oligonucleotide
  Target: SCN10A; (-) strand; PAM type: YTN; PAM sequence: CTC
ttaactctctaaaaatatta

SEQ ID NO: 52918 - DNA, 20 bp, Artificial Sequence
  Description of Artificial Sequence: Synthetic oligonucleotide
  Target: SCN10A; (-) strand; PAM type: YTN; PAM sequence: CTC
acctcttaactctctaaaaa

SEQ ID NO: 52919 - DNA, 20 bp, Artificial Sequence
  Description of Artificial Sequence: Synthetic oligonucleotide
  Target: SCN10A; (-) strand; PAM type: YTN; PAM sequence: TTC
tcacctcttaactctctaaa

SEQ ID NO: 52920 - DNA, 20 bp, Artificial Sequence
  Description of Artificial Sequence: Synthetic oligonucleotide
  Target: SCN10A; (-) strand; PAM type: YTN; PAM sequence: CTT
ctcacctcttaactctctaa

SEQ ID NO: 52921 - DNA, 20 bp, Artificial Sequence
  Description of Artificial Sequence: Synthetic oligonucleotide
  Target: SCN10A; (-) strand; PAM type: YTN; PAM sequence: CTC
ttctcacctcttaactctct

SEQ ID NO: 52922 - DNA, 20 bp, Artificial Sequence
  Description of Artificial Sequence: Synthetic oligonucleotide
  Target: SCN10A; (-) strand; PAM type: YTN; PAM sequence: CTA
tacgtggagcctcttctcac

SEQ ID NO: 52923 - DNA, 20 bp, Artificial Sequence
  Description of Artificial Sequence: Synthetic oligonucleotide
  Target: SCN10A; (-) strand; PAM type: YTN; PAM sequence: TTC
tatacgtggagcctcttctc

SEQ ID NO: 52924 - DNA, 20 bp, Artificial Sequence
  Description of Artificial Sequence: Synthetic oligonucleotide
  Target: SCN10A; (-) strand; PAM type: YTN; PAM sequence: TTG
ttctatacgtggagcctctt

SEQ ID NO: 52925 - DNA, 20 bp, Artificial Sequence
  Description of Artificial Sequence: Synthetic oligonucleotide
  Target: SCN10A; (-) strand; PAM type: YTN; PAM sequence: CTT
gttctatacgtggagcctct

SEQ ID NO: 52926 - DNA, 20 bp, Artificial Sequence
  Description of Artificial Sequence: Synthetic oligonucleotide
  Target: SCN10A; (-) strand; PAM type: YTN; PAM sequence: CTC
ttgttctatacgtggagcct

SEQ ID NO: 52927 - DNA, 20 bp, Artificial Sequence
  Description of Artificial Sequence: Synthetic oligonucleotide
  Target: SCN10A; (-) strand; PAM type: YTN; PAM sequence: CTG
ctcttgttctatacgtggag

SEQ ID NO: 52928 - DNA, 20 bp, Artificial Sequence
  Description of Artificial Sequence: Synthetic oligonucleotide
  Target: SCN10A; (-) strand; PAM type: YTN; PAM sequence: TTC
tgctcttgttctatacgtgg

SEQ ID NO: 52929 - DNA, 20 bp, Artificial Sequence
  Description of Artificial Sequence: Synthetic oligonucleotide
  Target: SCN10A; (-) strand; PAM type: YTN; PAM sequence: CTT
ctgctcttgttctatacgtg

SEQ ID NO: 52930 - DNA, 20 bp, Artificial Sequence
  Description of Artificial Sequence: Synthetic oligonucleotide
  Target: SCN10A; (-) strand; PAM type: YTN; PAM sequence: TTA
catccttctgctcttgttct

SEQ ID NO: 52931 - DNA, 20 bp, Artificial Sequence
  Description of Artificial Sequence: Synthetic oligonucleotide
  Target: SCN10A; (-) strand; PAM type: YTN; PAM sequence: TTT
acatccttctgctcttgttc

SEQ ID NO: 52932 - DNA, 20 bp, Artificial Sequence
  Description of Artificial Sequence: Synthetic oligonucleotide
  Target: SCN10A; (-) strand; PAM type: YTN; PAM sequence: TTT
tacatccttctgctcttgtt

SEQ ID NO: 52933 - DNA, 20 bp, Artificial Sequence
  Description of Artificial Sequence: Synthetic oligonucleotide
  Target: SCN10A; (-) strand; PAM type: YTN; PAM sequence: TTT
ttacatccttctgctcttgt

SEQ ID NO: 52934 - DNA, 20 bp, Artificial Sequence
  Description of Artificial Sequence: Synthetic oligonucleotide
  Target: SCN10A; (-) strand; PAM type: YTN; PAM sequence: CTT
tttacatccttctgctcttg

SEQ ID NO: 52935 - DNA, 20 bp, Artificial Sequence
  Description of Artificial Sequence: Synthetic oligonucleotide
  Target: SCN10A; (-) strand; PAM type: YTN; PAM sequence: TTG
aaggtactttttacatcctt

SEQ ID NO: 52936 - DNA, 20 bp, Artificial Sequence
  Description of Artificial Sequence: Synthetic oligonucleotide
  Target: SCN10A; (-) strand; PAM type: YTN; PAM sequence: TTT
gaaggtactttttacatcct

SEQ ID NO: 52937 - DNA, 20 bp, Artificial Sequence
  Description of Artificial Sequence: Synthetic oligonucleotide
  Target: SCN10A; (-) strand; PAM type: YTN; PAM sequence: CTT
tgaaggtactttttacatcc

SEQ ID NO: 52938 - DNA, 20 bp, Artificial Sequence
  Description of Artificial Sequence: Synthetic oligonucleotide
  Target: SCN10A; (-) strand; PAM type: YTN; PAM sequence: TTG
tctttgaaggtactttttac

SEQ ID NO: 52939 - DNA, 20 bp, Artificial Sequence
  Description of Artificial Sequence: Synthetic oligonucleotide
  Target: SCN10A; (-) strand; PAM type: YTN; PAM sequence: TTT
gtctttgaaggtacttttta

SEQ ID NO: 52940 - DNA, 20 bp, Artificial Sequence
  Description of Artificial Sequence: Synthetic oligonucleotide
  Target: SCN10A; (-) strand; PAM type: YTN; PAM sequence: TTT
tgtctttgaaggtacttttt

SEQ ID NO: 52941 - DNA, 20 bp, Artificial Sequence
  Description of Artificial Sequence: Synthetic oligonucleotide
  Target: SCN10A; (-) strand; PAM type: YTN; PAM sequence: TTC
cattttgtctttgaaggtac

SEQ ID NO: 52942 - DNA, 20 bp, Artificial Sequence
  Description of Artificial Sequence: Synthetic oligonucleotide
  Target: SCN10A; (-) strand; PAM type: YTN; PAM sequence: TTC
aaaattccattttgtctttg

SEQ ID NO: 52943 - DNA, 20 bp, Artificial Sequence
  Description of Artificial Sequence: Synthetic oligonucleotide
  Target: SCN10A; (-) strand; PAM type: YTN; PAM sequence: TTT
caaaattccattttgtcttt

SEQ ID NO: 52944 - DNA, 20 bp, Artificial Sequence
  Description of Artificial Sequence: Synthetic oligonucleotide
  Target: SCN10A; (-) strand; PAM type: YTN; PAM sequence: TTT
tcaaaattccattttgtctt

SEQ ID NO: 52945 - DNA, 20 bp, Artificial Sequence
  Description of Artificial Sequence: Synthetic oligonucleotide
  Target: SCN10A; (-) strand; PAM type: YTN; PAM sequence: TTG
ttttcaaaattccattttgt

SEQ ID NO: 52946 - DNA, 20 bp, Artificial Sequence
  Description of Artificial Sequence: Synthetic oligonucleotide
  Target: SCN10A; (-) strand; PAM type: YTN; PAM sequence: TTT
gttttcaaaattccattttg

SEQ ID NO: 52947 - DNA, 20 bp, Artificial Sequence
  Description of Artificial Sequence: Synthetic oligonucleotide
  Target: SCN10A; (-) strand; PAM type: YTN; PAM sequence: TTT
tgttttcaaaattccatttt

SEQ ID NO: 52948 - DNA, 20 bp, Artificial Sequence
  Description of Artificial Sequence: Synthetic oligonucleotide
  Target: SCN10A; (-) strand; PAM type: YTN; PAM sequence: TTT
ttgttttcaaaattccattt

SEQ ID NO: 52949 - DNA, 20 bp, Artificial Sequence
  Description of Artificial Sequence: Synthetic oligonucleotide
  Target: SCN10A; (-) strand; PAM type: YTN; PAM sequence: CTA
tcatatttttgttttcaaaa

SEQ ID NO: 52950 - DNA, 20 bp, Artificial Sequence
  Description of Artificial Sequence: Synthetic oligonucleotide
  Target: SCN10A; (-) strand; PAM type: YTN; PAM sequence: TTG
ctatcatatttttgttttca

SEQ ID NO: 52951 - DNA, 20 bp, Artificial Sequence
  Description of Artificial Sequence: Synthetic oligonucleotide
  Target: SCN10A; (-) strand; PAM type: YTN; PAM sequence: TTT
gctatcatatttttgttttc

SEQ ID NO: 52952 - DNA, 20 bp, Artificial Sequence
  Description of Artificial Sequence: Synthetic oligonucleotide
  Target: SCN10A; (-) strand; PAM type: YTN; PAM sequence: TTT
tgctatcatatttttgtttt

SEQ ID NO: 52953 - DNA, 20 bp, Artificial Sequence
  Description of Artificial Sequence: Synthetic oligonucleotide
  Target: SCN10A; (-) strand; PAM type: YTN; PAM sequence: CTT
ttgctatcatatttttgttt

SEQ ID NO: 52954 - DNA, 20 bp, Artificial Sequence
  Description of Artificial Sequence: Synthetic oligonucleotide
  Target: SCN10A; (-) strand; PAM type: YTN; PAM sequence: TTA
cttttgctatcatatttttg

SEQ ID NO: 52955 - DNA, 20 bp, Artificial Sequence
  Description of Artificial Sequence: Synthetic oligonucleotide
  Target: SCN10A; (-) strand; PAM type: YTN; PAM sequence: TTT
acttttgctatcatattttt

SEQ ID NO: 52956 - DNA, 20 bp, Artificial Sequence
  Description of Artificial Sequence: Synthetic oligonucleotide
  Target: SCN10A; (-) strand; PAM type: YTN; PAM sequence: TTT
tacttttgctatcatatttt

SEQ ID NO: 52957 - DNA, 20 bp, Artificial Sequence
  Description of Artificial Sequence: Synthetic oligonucleotide
  Target: SCN10A; (-) strand; PAM type: YTN; PAM sequence: TTA
gtgttttacttttgctatca

SEQ ID NO: 52958 - DNA, 20 bp, Artificial Sequence
  Description of Artificial Sequence: Synthetic oligonucleotide
  Target: SCN10A; (-) strand; PAM type: YTN; PAM sequence: CTA
ttagtgttttacttttgcta

SEQ ID NO: 52959 - DNA, 20 bp, Artificial Sequence
  Description of Artificial Sequence: Synthetic oligonucleotide
  Target: SCN10A; (-) strand; PAM type: YTN; PAM sequence: TTA
caagtccgcctattagtgtt

SEQ ID NO: 52960 - DNA, 20 bp, Artificial Sequence
  Description of Artificial Sequence: Synthetic oligonucleotide
  Target: SCN10A; (-) strand; PAM type: YTN; PAM sequence: TTT
acaagtccgcctattagtgt

SEQ ID NO: 52961 - DNA, 20 bp, Artificial Sequence
  Description of Artificial Sequence: Synthetic oligonucleotide
  Target: SCN10A; (-) strand; PAM type: YTN; PAM sequence: TTA
tttacaagtccgcctattag

SEQ ID NO: 52962 - DNA, 20 bp, Artificial Sequence
  Description of Artificial Sequence: Synthetic oligonucleotide
  Target: SCN10A; (-) strand; PAM type: YTN; PAM sequence: TTT
atttacaagtccgcctatta

SEQ ID NO: 52963 - DNA, 20 bp, Artificial Sequence
  Description of Artificial Sequence: Synthetic oligonucleotide
  Target: SCN10A; (-) strand; PAM type: YTN; PAM sequence: CTT
tatttacaagtccgcctatt

SEQ ID NO: 52964 - DNA, 20 bp, Artificial Sequence
  Description of Artificial Sequence: Synthetic oligonucleotide
  Target: SCN10A; (-) strand; PAM type: YTN; PAM sequence: TTC
caaaactttatttacaagtc

SEQ ID NO: 52965 - DNA, 20 bp, Artificial Sequence
  Description of Artificial Sequence: Synthetic oligonucleotide
  Target: SCN10A; (-) strand; PAM type: YTN; PAM sequence: TTT
ccaaaactttatttacaagt

SEQ ID NO: 52966 - DNA, 20 bp, Artificial Sequence
  Description of Artificial Sequence: Synthetic oligonucleotide
  Target: SCN10A; (-) strand; PAM type: YTN; PAM sequence: CTG
tgagatttccaaaactttat

SEQ ID NO: 52967 - DNA, 20 bp, Artificial Sequence
  Description of Artificial Sequence: Synthetic oligonucleotide
  Target: SCN10A; (-) strand; PAM type: YTN; PAM sequence: TTC
ctgtgagatttccaaaactt

SEQ ID NO: 52968 - DNA, 20 bp, Artificial Sequence
  Description of Artificial Sequence: Synthetic oligonucleotide
  Target: SCN10A; (-) strand; PAM type: YTN; PAM sequence: CTT
cctgtgagatttccaaaact

SEQ ID NO: 52969 - DNA, 20 bp, Artificial Sequence
  Description of Artificial Sequence: Synthetic oligonucleotide
  Target: SCN10A; (-) strand; PAM type: YTN; PAM sequence: TTC
cacttcctgtgagatttcca

SEQ ID NO: 52970 - DNA, 20 bp, Artificial Sequence
  Description of Artificial Sequence: Synthetic oligonucleotide
  Target: SCN10A; (-) strand; PAM type: YTN; PAM sequence: TTG
ttccacttcctgtgagattt

SEQ ID NO: 52971 - DNA, 20 bp, Artificial Sequence
  Description of Artificial Sequence: Synthetic oligonucleotide
  Target: SCN10A; (-) strand; PAM type: YTN; PAM sequence: TTT
gttccacttcctgtgagatt

SEQ ID NO: 52972 - DNA, 20 bp, Artificial Sequence
  Description of Artificial Sequence: Synthetic oligonucleotide
  Target: SCN10A; (-) strand; PAM type: YTN; PAM sequence: TTT
tgttccacttcctgtgagat

SEQ ID NO: 52973 - DNA, 20 bp, Artificial Sequence
  Description of Artificial Sequence: Synthetic oligonucleotide
  Target: SCN10A; (-) strand; PAM type: YTN; PAM sequence: TTT
ttgttccacttcctgtgaga

SEQ ID NO: 52974 - DNA, 20 bp, Artificial Sequence
  Description of Artificial Sequence: Synthetic oligonucleotide
  Target: SCN10A; (-) strand; PAM type: YTN; PAM sequence: TTT
tttgttccacttcctgtgag

SEQ ID NO: 52975 - DNA, 20 bp, Artificial Sequence
  Description of Artificial Sequence: Synthetic oligonucleotide
  Target: SCN10A; (-) strand; PAM type: YTN; PAM sequence: CTT
ttttgttccacttcctgtga

SEQ ID NO: 52976 - DNA, 20 bp, Artificial Sequence
  Description of Artificial Sequence: Synthetic oligonucleotide
  Target: SCN10A; (-) strand; PAM type: YTN; PAM sequence: CTG
cttttttgttccacttcctg

SEQ ID NO: 52977 - DNA, 20 bp, Artificial Sequence
  Description of Artificial Sequence: Synthetic oligonucleotide
  Target: SCN10A; (-) strand; PAM type: YTN; PAM sequence: TTC
tgcttttttgttccacttcc

SEQ ID NO: 52978 - DNA, 20 bp, Artificial Sequence
  Description of Artificial Sequence: Synthetic oligonucleotide
  Target: SCN10A; (-) strand; PAM type: YTN; PAM sequence: TTT
ctgcttttttgttccacttc

SEQ ID NO: 52979 - DNA, 20 bp, Artificial Sequence
  Description of Artificial Sequence: Synthetic oligonucleotide
  Target: SCN10A; (-) strand; PAM type: YTN; PAM sequence: CTA
tccatttctgcttttttgtt

SEQ ID NO: 52980 - DNA, 20 bp, Artificial Sequence
  Description of Artificial Sequence: Synthetic oligonucleotide
  Target: SCN10A; (-) strand; PAM type: YTN; PAM sequence: TTC
ctatccatttctgctttttt

SEQ ID NO: 52981 - DNA, 20 bp, Artificial Sequence
  Description of Artificial Sequence: Synthetic oligonucleotide
  Target: SCN10A; (-) strand; PAM type: YTN; PAM sequence: CTT
cctatccatttctgcttttt

SEQ ID NO: 52982 - DNA, 20 bp, Artificial Sequence
  Description of Artificial Sequence: Synthetic oligonucleotide
  Target: SCN10A; (-) strand; PAM type: YTN; PAM sequence: TTA
tcacttcctatccatttctg

SEQ ID NO: 52983 - DNA, 20 bp, Artificial Sequence
  Description of Artificial Sequence: Synthetic oligonucleotide
  Target: SCN10A; (-) strand; PAM type: YTN; PAM sequence: TTT
atcacttcctatccatttct

SEQ ID NO: 52984 - DNA, 20 bp, Artificial Sequence
  Description of Artificial Sequence: Synthetic oligonucleotide
  Target: SCN10A; (-) strand; PAM type: YTN; PAM sequence: TTT
tatcacttcctatccatttc

SEQ ID NO: 52985 - DNA, 20 bp, Artificial Sequence
  Description of Artificial Sequence: Synthetic oligonucleotide
  Target: SCN10A; (-) strand; PAM type: YTN; PAM sequence: TTT
ttatcacttcctatccattt

SEQ ID NO: 52986 - DNA, 20 bp, Artificial Sequence
  Description of Artificial Sequence: Synthetic oligonucleotide
  Target: SCN10A; (-) strand; PAM type: YTN; PAM sequence: CTT
tttatcacttcctatccatt

SEQ ID NO: 52987 - DNA, 20 bp, Artificial Sequence
  Description of Artificial Sequence: Synthetic oligonucleotide
  Target: SCN10A; (-) strand; PAM type: YTN; PAM sequence: TTC
aaactttttatcacttccta

SEQ ID NO: 52988 - DNA, 20 bp, Artificial Sequence
  Description of Artificial Sequence: Synthetic oligonucleotide
  Target: SCN10A; (-) strand; PAM type: YTN; PAM sequence: TTT
caaactttttatcacttcct

SEQ ID NO: 52989 - DNA, 20 bp, Artificial Sequence
  Description of Artificial Sequence: Synthetic oligonucleotide
  Target: SCN10A; (-) strand; PAM type: YTN; PAM sequence: TTT
tcaaactttttatcacttcc

SEQ ID NO: 52990 - DNA, 20 bp, Artificial Sequence
  Description of Artificial Sequence: Synthetic oligonucleotide
  Target: SCN10A; (-) strand; PAM type: YTN; PAM sequence: CTA
attttcaaactttttatcac

SEQ ID NO: 52991 - DNA, 20 bp, Artificial Sequence
  Description of Artificial Sequence: Synthetic oligonucleotide
  Target: SCN10A; (-) strand; PAM type: YTN; PAM sequence: CTC
taattttcaaactttttatc

SEQ ID NO: 52992 - DNA, 20 bp, Artificial Sequence
  Description of Artificial Sequence: Synthetic oligonucleotide
  Target: SCN10A; (-) strand; PAM type: YTN; PAM sequence: TTC
tctaattttcaaacttttta

SEQ ID NO: 52993 - DNA, 20 bp, Artificial Sequence
  Description of Artificial Sequence: Synthetic oligonucleotide
  Target: SCN10A; (-) strand; PAM type: YTN; PAM sequence: CTG
attctctaattttcaaactt

SEQ ID NO: 52994 - DNA, 20 bp, Artificial Sequence
  Description of Artificial Sequence: Synthetic oligonucleotide
  Target: SCN10A; (-) strand; PAM type: YTN; PAM sequence: CTA
gtctgattctctaattttca

SEQ ID NO: 52995 - DNA, 20 bp, Artificial Sequence
  Description of Artificial Sequence: Synthetic oligonucleotide
  Target: SCN10A; (-) strand; PAM type: YTN; PAM sequence: CTC
ctagtctgattctctaattt

SEQ ID NO: 52996 - DNA, 20 bp, Artificial Sequence
  Description of Artificial Sequence: Synthetic oligonucleotide
  Target: SCN10A; (-) strand; PAM type: YTN; PAM sequence: TTA
gtcaaacaatatacctccta

SEQ ID NO: 52997 - DNA, 20 bp, Artificial Sequence
  Description of Artificial Sequence: Synthetic oligonucleotide
  Target: SCN10A; (-) strand; PAM type: YTN; PAM sequence: CTA
ttagtcaaacaatatacctc

SEQ ID NO: 52998 - DNA, 20 bp, Artificial Sequence
  Description of Artificial Sequence: Synthetic oligonucleotide
  Target: SCN10A; (-) strand; PAM type: YTN; PAM sequence: CTC
ctattagtcaaacaatatac

SEQ ID NO: 52999 - DNA, 20 bp, Artificial Sequence
  Description of Artificial Sequence: Synthetic oligonucleotide
  Target: SCN10A; (-) strand; PAM type: YTN; PAM sequence: CTA
gacctcctattagtcaaaca

SEQ ID NO: 53000 - DNA, 20 bp, Artificial Sequence
  Description of Artificial Sequence: Synthetic oligonucleotide
  Target: SCN10A; (-) strand; PAM type: YTN; PAM sequence: TTC
tagacctcctattagtcaaa

SEQ ID NO: 53001 - DNA, 20 bp, Artificial Sequence
  Description of Artificial Sequence: Synthetic oligonucleotide
  Target: SCN10A; (-) strand; PAM type: YTN; PAM sequence: TTT
ctagacctcctattagtcaa

SEQ ID NO: 53002 - DNA, 20 bp, Artificial Sequence
  Description of Artificial Sequence: Synthetic oligonucleotide
  Target: SCN10A; (-) strand; PAM type: YTN; PAM sequence: CTT
tctagacctcctattagtca

SEQ ID NO: 53003 - DNA, 20 bp, Artificial Sequence
  Description of Artificial Sequence: Synthetic oligonucleotide
  Target: SCN10A; (-) strand; PAM type: YTN; PAM sequence: TTC
tttctagacctcctattagt

SEQ ID NO: 53004 - DNA, 20 bp, Artificial Sequence
  Description of Artificial Sequence: Synthetic oligonucleotide
  Target: SCN10A; (-) strand; PAM type: YTN; PAM sequence: TTT
ctttctagacctcctattag

SEQ ID NO: 53005 - DNA, 20 bp, Artificial Sequence
  Description of Artificial Sequence: Synthetic oligonucleotide
  Target: SCN10A; (-) strand; PAM type: YTN; PAM sequence: CTA
atttctttctagacctccta

SEQ ID NO: 53006 - DNA, 20 bp, Artificial Sequence
  Description of Artificial Sequence: Synthetic oligonucleotide
  Target: SCN10A; (-) strand; PAM type: YTN; PAM sequence: TTC
taatttctttctagacctcc

SEQ ID NO: 53007 - DNA, 20 bp, Artificial Sequence
  Description of Artificial Sequence: Synthetic oligonucleotide
  Target: SCN10A; (-) strand; PAM type: YTN; PAM sequence: CTT
ctaatttctttctagacctc

SEQ ID NO: 53008 - DNA, 20 bp, Artificial Sequence
  Description of Artificial Sequence: Synthetic oligonucleotide
  Target: SCN10A; (-) strand; PAM type: YTN; PAM sequence: TTG
tcttctaatttctttctaga

SEQ ID NO: 53009 - DNA, 20 bp, Artificial Sequence
  Description of Artificial Sequence: Synthetic oligonucleotide
  Target: SCN10A; (-) strand; PAM type: YTN; PAM sequence: CTC
attgtcttctaatttctttc

SEQ ID NO: 53010 - DNA, 20 bp, Artificial Sequence
  Description of Artificial Sequence: Synthetic oligonucleotide
  Target: SCN10A; (-) strand; PAM type: YTN; PAM sequence: TTG
ctcattgtcttctaatttct

SEQ ID NO: 53011 - DNA, 20 bp, Artificial Sequence
  Description of Artificial Sequence: Synthetic oligonucleotide
  Target: SCN10A; (-) strand; PAM type: YTN; PAM sequence: CTT
gctcattgtcttctaatttc

SEQ ID NO: 53012 - DNA, 20 bp, Artificial Sequence
  Description of Artificial Sequence: Synthetic oligonucleotide
  Target: SCN10A; (-) strand; PAM type: YTN; PAM sequence: TTG
aaggccttgctcattgtctt

SEQ ID NO: 53013 - DNA, 20 bp, Artificial Sequence
  Description of Artificial Sequence: Synthetic oligonucleotide
  Target: SCN10A; (-) strand; PAM type: YTN; PAM sequence: TTT
gaaggccttgctcattgtct

SEQ ID NO: 53014 - DNA, 20 bp, Artificial Sequence
  Description of Artificial Sequence: Synthetic oligonucleotide
  Target: SCN10A; (-) strand; PAM type: YTN; PAM sequence: TTT
tgaaggccttgctcattgtc

SEQ ID NO: 53015 - DNA, 20 bp, Artificial Sequence
  Description of Artificial Sequence: Synthetic oligonucleotide
  Target: SCN10A; (-) strand; PAM type: YTN; PAM sequence: TTA
attttgaaggccttgctcat

SEQ ID NO: 53016 - DNA, 20 bp, Artificial Sequence
  Description of Artificial Sequence: Synthetic oligonucleotide
  Target: SCN10A; (-) strand; PAM type: YTN; PAM sequence: CTT
aattttgaaggccttgctca

SEQ ID NO: 53017 - DNA, 20 bp, Artificial Sequence
  Description of Artificial Sequence: Synthetic oligonucleotide
  Target: SCN10A; (-) strand; PAM type: YTN; PAM sequence: CTC
ttaattttgaaggccttgct

SEQ ID NO: 53018 - DNA, 20 bp, Artificial Sequence
  Description of Artificial Sequence: Synthetic oligonucleotide
  Target: SCN10A; (-) strand; PAM type: YTN; PAM sequence: TTC
cctcttaattttgaaggcct

SEQ ID NO: 53019 - DNA, 20 bp, Artificial Sequence
  Description of Artificial Sequence: Synthetic oligonucleotide
  Target: SCN10A; (-) strand; PAM type: YTN; PAM sequence: TTT
ccctcttaattttgaaggcc

SEQ ID NO: 53020 - DNA, 20 bp, Artificial Sequence
  Description of Artificial Sequence: Synthetic oligonucleotide
  Target: SCN10A; (-) strand; PAM type: YTN; PAM sequence: TTA
tttccctcttaattttgaag

SEQ ID NO: 53021 - DNA, 20 bp, Artificial Sequence
  Description of Artificial Sequence: Synthetic oligonucleotide
  Target: SCN10A; (-) strand; PAM type: YTN; PAM sequence: TTA
gaaattatttccctcttaat

SEQ ID NO: 53022 - DNA, 20 bp, Artificial Sequence
  Description of Artificial Sequence: Synthetic oligonucleotide
  Target: SCN10A; (-) strand; PAM type: YTN; PAM sequence: CTG
tattagaaattatttccctc

SEQ ID NO: 53023 - DNA, 20 bp, Artificial Sequence
  Description of Artificial Sequence: Synthetic oligonucleotide
  Target: SCN10A; (-) strand; PAM type: YTN; PAM sequence: TTC
tgtattagaaattatttccc

SEQ ID NO: 53024 - DNA, 20 bp, Artificial Sequence
  Description of Artificial Sequence: Synthetic oligonucleotide
  Target: SCN10A; (-) strand; PAM type: YTN; PAM sequence: CTT
ctgtattagaaattatttcc

SEQ ID NO: 53025 - DNA, 20 bp, Artificial Sequence
  Description of Artificial Sequence: Synthetic oligonucleotide
  Target: SCN10A; (-) strand; PAM type: YTN; PAM sequence: CTA
gggaaagacttctgtattag

SEQ ID NO: 53026 - DNA, 20 bp, Artificial Sequence
  Description of Artificial Sequence: Synthetic oligonucleotide
  Target: SCN10A; (-) strand; PAM type: YTN; PAM sequence: TTG
gctagggaaagacttctgta

SEQ ID NO: 53027 - DNA, 20 bp, Artificial Sequence
  Description of Artificial Sequence: Synthetic oligonucleotide
  Target: SCN10A; (-) strand; PAM type: YTN; PAM sequence: TTT
ggctagggaaagacttctgt

SEQ ID NO: 53028 - DNA, 20 bp, Artificial Sequence
  Description of Artificial Sequence: Synthetic oligonucleotide
  Target: SCN10A; (-) strand; PAM type: YTN; PAM sequence: TTG
acagtttggctagggaaaga

SEQ ID NO: 53029 - DNA, 20 bp, Artificial Sequence
  Description of Artificial Sequence: Synthetic oligonucleotide
  Target: SCN10A; (-) strand; PAM type: YTN; PAM sequence: TTT
gacagtttggctagggaaag

SEQ ID NO: 53030 - DNA, 20 bp, Artificial Sequence
  Description of Artificial Sequence: Synthetic oligonucleotide
  Target: SCN10A; (-) strand; PAM type: YTN; PAM sequence: CTT
tgacagtttggctagggaaa

SEQ ID NO: 53031 - DNA, 20 bp, Artificial Sequence
  Description of Artificial Sequence: Synthetic oligonucleotide
  Target: SCN10A; (-) strand; PAM type: YTN; PAM sequence: TTC
tttgacagtttggctaggga

SEQ ID NO: 53032 - DNA, 20 bp, Artificial Sequence
  Description of Artificial Sequence: Synthetic oligonucleotide
  Target: SCN10A; (-) strand; PAM type: YTN; PAM sequence: CTT
ctttgacagtttggctaggg

SEQ ID NO: 53033 - DNA, 20 bp, Artificial Sequence
  Description of Artificial Sequence: Synthetic oligonucleotide
  Target: SCN10A; (-) strand; PAM type: YTN; PAM sequence: CTA
ccttctttgacagtttggct

SEQ ID NO: 53034 - DNA, 20 bp, Artificial Sequence
  Description of Artificial Sequence: Synthetic oligonucleotide
  Target: SCN10A; (-) strand; PAM type: YTN; PAM sequence: TTC
taccttctttgacagtttgg

SEQ ID NO: 53035 - DNA, 20 bp, Artificial Sequence
  Description of Artificial Sequence: Synthetic oligonucleotide
  Target: SCN10A; (-) strand; PAM type: YTN; PAM sequence: TTC
atatattctaccttctttga

SEQ ID NO: 53036 - DNA, 20 bp, Artificial Sequence
  Description of Artificial Sequence: Synthetic oligonucleotide
  Target: SCN10A; (-) strand; PAM type: YTN; PAM sequence: CTT
catatattctaccttctttg

SEQ ID NO: 53037 - DNA, 20 bp, Artificial Sequence
  Description of Artificial Sequence: Synthetic oligonucleotide
  Target: SCN10A; (-) strand; PAM type: YTN; PAM sequence: TTC
ccaagacttcatatattcta

SEQ ID NO: 53038 - DNA, 20 bp, Artificial Sequence
  Description of Artificial Sequence: Synthetic oligonucleotide
  Target: SCN10A; (-) strand; PAM type: YTN; PAM sequence: TTT
cccaagacttcatatattct

SEQ ID NO: 53039 - DNA, 20 bp, Artificial Sequence
  Description of Artificial Sequence: Synthetic oligonucleotide
  Target: SCN10A; (-) strand; PAM type: YTN; PAM sequence: CTA
agaagtacatttcccaagac

SEQ ID NO: 53040 - DNA, 20 bp, Artificial Sequence
  Description of Artificial Sequence: Synthetic oligonucleotide
  Target: SCN10A; (-) strand; PAM type: YTN; PAM sequence: TTA
gaagggtaactaagaagtac

SEQ ID NO: 53041 - DNA, 20 bp, Artificial Sequence
  Description of Artificial Sequence: Synthetic oligonucleotide
  Target: SCN10A; (-) strand; PAM type: YTN; PAM sequence: TTA
ttagaagggtaactaagaag

SEQ ID NO: 53042 - DNA, 20 bp, Artificial Sequence
  Description of Artificial Sequence: Synthetic oligonucleotide
  Target: SCN10A; (-) strand; PAM type: YTN; PAM sequence: TTT
attagaagggtaactaagaa

SEQ ID NO: 53043 - DNA, 20 bp, Artificial Sequence
  Description of Artificial Sequence: Synthetic oligonucleotide
  Target: SCN10A; (-) strand; PAM type: YTN; PAM sequence: CTT
tattagaagggtaactaaga

SEQ ID NO: 53044 - DNA, 20 bp, Artificial Sequence
  Description of Artificial Sequence: Synthetic oligonucleotide
  Target: SCN10A; (-) strand; PAM type: YTN; PAM sequence: CTA
gtaactttattagaagggta

SEQ ID NO: 53045 - DNA, 20 bp, Artificial Sequence
  Description of Artificial Sequence: Synthetic oligonucleotide
  Target: SCN10A; (-) strand; PAM type: YTN; PAM sequence: TTC
tagtaactttattagaaggg

SEQ ID NO: 53046 - DNA, 20 bp, Artificial Sequence
  Description of Artificial Sequence: Synthetic oligonucleotide
  Target: SCN10A; (-) strand; PAM type: YTN; PAM sequence: CTT
ctagtaactttattagaagg

SEQ ID NO: 53047 - DNA, 20 bp, Artificial Sequence
  Description of Artificial Sequence: Synthetic oligonucleotide
  Target: SCN10A; (-) strand; PAM type: YTN; PAM sequence: CTA
caggtacataccaccatgcc

SEQ ID NO: 53048 - DNA, 20 bp, Artificial Sequence
  Description of Artificial Sequence: Synthetic oligonucleotide
  Target: SCN10A; (-) strand; PAM type: YTN; PAM sequence: TTA
ggactacaggtacataccac

SEQ ID NO: 53049 - DNA, 20 bp, Artificial Sequence
  Description of Artificial Sequence: Synthetic oligonucleotide
  Target: SCN10A; (-) strand; PAM type: YTN; PAM sequence: CTC
ccaagtagttaggactacag

SEQ ID NO: 53050 - DNA, 20 bp, Artificial Sequence
  Description of Artificial Sequence: Synthetic oligonucleotide
  Target: SCN10A; (-) strand; PAM type: YTN; PAM sequence: CTC
aacctcccaagtagttagga

SEQ ID NO: 53051 - DNA, 20 bp, Artificial Sequence
  Description of Artificial Sequence: Synthetic oligonucleotide
  Target: SCN10A; (-) strand; PAM type: YTN; PAM sequence: CTG
cctcaacctcccaagtagtt

SEQ ID NO: 53052 - DNA, 20 bp, Artificial Sequence
  Description of Artificial Sequence: Synthetic oligonucleotide
  Target: SCN10A; (-) strand; PAM type: YTN; PAM sequence: CTC
ctgcctcaacctcccaagta

SEQ ID NO: 53053 - DNA, 20 bp, Artificial Sequence
  Description of Artificial Sequence: Synthetic oligonucleotide
  Target: SCN10A; (-) strand; PAM type: YTN; PAM sequence: TTC
aagtgatcctcctgcctcaa

SEQ ID NO: 53054 - DNA, 20 bp, Artificial Sequence
  Description of Artificial Sequence: Synthetic oligonucleotide
  Target: SCN10A; (-) strand; PAM type: YTN; PAM sequence: CTG
ggttcaagtgatcctcctgc

SEQ ID NO: 53055 - DNA, 20 bp, Artificial Sequence
  Description of Artificial Sequence: Synthetic oligonucleotide
  Target: SCN10A; (-) strand; PAM type: YTN; PAM sequence: CTC
ctgggttcaagtgatcctcc

SEQ ID NO: 53056 - DNA, 20 bp, Artificial Sequence
  Description of Artificial Sequence: Synthetic oligonucleotide
  Target: SCN10A; (-) strand; PAM type: YTN; PAM sequence: CTC
aaactcctgggttcaagtga

SEQ ID NO: 53057 - DNA, 20 bp, Artificial Sequence
  Description of Artificial Sequence: Synthetic oligonucleotide
  Target: SCN10A; (-) strand; PAM type: YTN; PAM sequence: TTG
gcctcaaactcctgggttca

SEQ ID NO: 53058 - DNA, 20 bp, Artificial Sequence
  Description of Artificial Sequence: Synthetic oligonucleotide
  Target: SCN10A; (-) strand; PAM type: YTN; PAM sequence: CTG
ttggcctcaaactcctgggt

SEQ ID NO: 53059 - DNA, 20 bp, Artificial Sequence
  Description of Artificial Sequence: Synthetic oligonucleotide
  Target: SCN10A; (-) strand; PAM type: YTN; PAM sequence: CTG
cccaggctgttggcctcaaa

SEQ ID NO: 53060 - DNA, 20 bp, Artificial Sequence
  Description of Artificial Sequence: Synthetic oligonucleotide
  Target: SCN10A; (-) strand; PAM type: YTN; PAM sequence: CTA
tgctgcccaggctgttggcc

SEQ ID NO: 53061 - DNA, 20 bp, Artificial Sequence
  Description of Artificial Sequence: Synthetic oligonucleotide
  Target: SCN10A; (-) strand; PAM type: YTN; PAM sequence: CTC
tatgctgcccaggctgttgg

SEQ ID NO: 53062 - DNA, 20 bp, Artificial Sequence
  Description of Artificial Sequence: Synthetic oligonucleotide
  Target: SCN10A; (-) strand; PAM type: YTN; PAM sequence: CTC
tctatgctgcccaggctgtt

SEQ ID NO: 53063 - DNA, 20 bp, Artificial Sequence
  Description of Artificial Sequence: Synthetic oligonucleotide
  Target: SCN10A; (-) strand; PAM type: YTN; PAM sequence: TTA
agacaaagtctctctatgct

SEQ ID NO: 53064 - DNA, 20 bp, Artificial Sequence
  Description of Artificial Sequence: Synthetic oligonucleotide
  Target: SCN10A; (-) strand; PAM type: YTN; PAM sequence: TTT
aagacaaagtctctctatgc

SEQ ID NO: 53065 - DNA, 20 bp, Artificial Sequence
  Description of Artificial Sequence: Synthetic oligonucleotide
  Target: SCN10A; (-) strand; PAM type: YTN; PAM sequence: TTT
taagacaaagtctctctatg

SEQ ID NO: 53066 - DNA, 20 bp, Artificial Sequence
  Description of Artificial Sequence: Synthetic oligonucleotide
  Target: SCN10A; (-) strand; PAM type: YTN; PAM sequence: TTT
ttaagacaaagtctctctat

SEQ ID NO: 53067 - DNA, 20 bp, Artificial Sequence
  Description of Artificial Sequence: Synthetic oligonucleotide
  Target: SCN10A; (-) strand; PAM type: YTN; PAM sequence: TTT
tttaagacaaagtctctcta

SEQ ID NO: 53068 - DNA, 20 bp, Artificial Sequence
  Description of Artificial Sequence: Synthetic oligonucleotide
  Target: SCN10A; (-) strand; PAM type: YTN; PAM sequence: TTT
ttttaagacaaagtctctct

SEQ ID NO: 53069 - DNA, 20 bp, Artificial Sequence
  Description of Artificial Sequence: Synthetic oligonucleotide
  Target: SCN10A; (-) strand; PAM type: YTN; PAM sequence: TTT
tttttaagacaaagtctctc

SEQ ID NO: 53070 - DNA, 20 bp, Artificial Sequence
  Description of Artificial Sequence: Synthetic oligonucleotide
  Target: SCN10A; (-) strand; PAM type: YTN; PAM sequence: TTT
ttttttaagacaaagtctct

SEQ ID NO: 53071 - DNA, 20 bp, Artificial Sequence
  Description of Artificial Sequence: Synthetic oligonucleotide
  Target: SCN10A; (-) strand; PAM type: YTN; PAM sequence: CTA
gtaacatttttttttaagac

SEQ ID NO: 53072 - DNA, 20 bp, Artificial Sequence
  Description of Artificial Sequence: Synthetic oligonucleotide
  Target: SCN10A; (-) strand; PAM type: YTN; PAM sequence: CTC
tagtaacatttttttttaag

SEQ ID NO: 53073 - DNA, 20 bp, Artificial Sequence
  Description of Artificial Sequence: Synthetic oligonucleotide
  Target: SCN10A; (-) strand; PAM type: YTN; PAM sequence: TTG
aatggagcatatcctctagt

SEQ ID NO: 53074 - DNA, 20 bp, Artificial Sequence
  Description of Artificial Sequence: Synthetic oligonucleotide
  Target: SCN10A; (-) strand; PAM type: YTN; PAM sequence: TTT
gaatggagcatatcctctag

SEQ ID NO: 53075 - DNA, 20 bp, Artificial Sequence
  Description of Artificial Sequence: Synthetic oligonucleotide
  Target: SCN10A; (-) strand; PAM type: YTN; PAM sequence: TTG
tttgaatggagcatatcctc

SEQ ID NO: 53076 - DNA, 20 bp, Artificial Sequence
  Description of Artificial Sequence: Synthetic oligonucleotide
  Target: SCN10A; (-) strand; PAM type: YTN; PAM sequence: CTT
gtttgaatggagcatatcct

SEQ ID NO: 53077 - DNA, 20 bp, Artificial Sequence
  Description of Artificial Sequence: Synthetic oligonucleotide
  Target: SCN10A; (-) strand; PAM type: YTN; PAM sequence: TTC
ttgtttgaatggagcatatc

SEQ ID NO: 53078 - DNA, 20 bp, Artificial Sequence
  Description of Artificial Sequence: Synthetic oligonucleotide
  Target: SCN10A; (-) strand; PAM type: YTN; PAM sequence: TTT
cttgtttgaatggagcatat

SEQ ID NO: 53079 - DNA, 20 bp, Artificial Sequence
  Description of Artificial Sequence: Synthetic oligonucleotide
  Target: SCN10A; (-) strand; PAM type: YTN; PAM sequence: CTG
gatcgcatatatgtttcttg

SEQ ID NO: 53080 - DNA, 20 bp, Artificial Sequence
  Description of Artificial Sequence: Synthetic oligonucleotide
  Target: SCN10A; (-) strand; PAM type: YTN; PAM sequence: TTC
cctggatcgcatatatgttt

SEQ ID NO: 53081 - DNA, 20 bp, Artificial Sequence
  Description of Artificial Sequence: Synthetic oligonucleotide
  Target: SCN10A; (-) strand; PAM type: YTN; PAM sequence: CTT
ccctggatcgcatatatgtt

SEQ ID NO: 53082 - DNA, 20 bp, Artificial Sequence
  Description of Artificial Sequence: Synthetic oligonucleotide
  Target: SCN10A; (-) strand; PAM type: YTN; PAM sequence: CTC
ttccctggatcgcatatatg

SEQ ID NO: 53083 - DNA, 20 bp, Artificial Sequence
  Description of Artificial Sequence: Synthetic oligonucleotide
  Target: SCN10A; (-) strand; PAM type: YTN; PAM sequence: TTG
cctcttccctggatcgcata

SEQ ID NO: 53084 - DNA, 20 bp, Artificial Sequence
  Description of Artificial Sequence: Synthetic oligonucleotide
  Target: SCN10A; (-) strand; PAM type: YTN; PAM sequence: TTT
gcctcttccctggatcgcat

SEQ ID NO: 53085 - DNA, 20 bp, Artificial Sequence
  Description of Artificial Sequence: Synthetic oligonucleotide
  Target: SCN10A; (-) strand; PAM type: YTN; PAM sequence: TTT
tgcctcttccctggatcgca

SEQ ID NO: 53086 - DNA, 20 bp, Artificial Sequence
  Description of Artificial Sequence: Synthetic oligonucleotide
  Target: SCN10A; (-) strand; PAM type: YTN; PAM sequence: CTT
ttgcctcttccctggatcgc

SEQ ID NO: 53087 - DNA, 20 bp, Artificial Sequence
  Description of Artificial Sequence: Synthetic oligonucleotide
  Target: SCN10A; (-) strand; PAM type: YTN; PAM sequence: TTC
cttttgcctcttccctggat

SEQ ID NO: 53088 - DNA, 20 bp, Artificial Sequence
  Description of Artificial Sequence: Synthetic oligonucleotide
  Target: SCN10A; (-) strand; PAM type: YTN; PAM sequence: TTG
gattccttttgcctcttccc

SEQ ID NO: 53089 - DNA, 20 bp, Artificial Sequence
  Description of Artificial Sequence: Synthetic oligonucleotide
  Target: SCN10A; (-) strand; PAM type: YTN; PAM sequence: TTT
ggattccttttgcctcttcc

SEQ ID NO: 53090 - DNA, 20 bp, Artificial Sequence
  Description of Artificial Sequence: Synthetic oligonucleotide
  Target: SCN10A; (-) strand; PAM type: YTN; PAM sequence: TTT
tggattccttttgcctcttc

SEQ ID NO: 53091 - DNA, 20 bp, Artificial Sequence
  Description of Artificial Sequence: Synthetic oligonucleotide
  Target: SCN10A; (-) strand; PAM type: YTN; PAM sequence: TTT
ttggattccttttgcctctt

SEQ ID NO: 53092 - DNA, 20 bp, Artificial Sequence
  Description of Artificial Sequence: Synthetic oligonucleotide
  Target: SCN10A; (-) strand; PAM type: YTN; PAM sequence: TTT
tttggattccttttgcctct

SEQ ID NO: 53093 - DNA, 20 bp, Artificial Sequence
  Description of Artificial Sequence: Synthetic oligonucleotide
  Target: SCN10A; (-) strand; PAM type: YTN; PAM sequence: TTT
ttttggattccttttgcctc

SEQ ID NO: 53094 - DNA, 20 bp, Artificial Sequence
  Description of Artificial Sequence: Synthetic oligonucleotide
  Target: SCN10A; (-) strand; PAM type: YTN; PAM sequence: CTT
tttttggattccttttgcct

SEQ ID NO: 53095 - DNA, 20 bp, Artificial Sequence
  Description of Artificial Sequence: Synthetic oligonucleotide
  Target: SCN10A; (-) strand; PAM type: YTN; PAM sequence: TTC
tttttttggattccttttgc

SEQ ID NO: 53096 - DNA, 20 bp, Artificial Sequence
  Description of Artificial Sequence: Synthetic oligonucleotide
  Target: SCN10A; (-) strand; PAM type: YTN; PAM sequence: TTC
attctttttttggattcctt

SEQ ID NO: 53097 - DNA, 20 bp, Artificial Sequence
  Description of Artificial Sequence: Synthetic oligonucleotide
  Target: SCN10A; (-) strand; PAM type: YTN; PAM sequence: CTT
cattctttttttggattcct

SEQ ID NO: 53098 - DNA, 20 bp, Artificial Sequence
  Description of Artificial Sequence: Synthetic oligonucleotide
  Target: SCN10A; (-) strand; PAM type: YTN; PAM sequence: TTC
ttcattctttttttggattc

SEQ ID NO: 53099 - DNA, 20 bp, Artificial Sequence
  Description of Artificial Sequence: Synthetic oligonucleotide
  Target: SCN10A; (-) strand; PAM type: YTN; PAM sequence: CTT
cttcattctttttttggatt

SEQ ID NO: 53100 - DNA, 20 bp, Artificial Sequence
  Description of Artificial Sequence: Synthetic oligonucleotide
  Target: SCN10A; (-) strand; PAM type: YTN; PAM sequence: TTC
ttcttcattctttttttgga

SEQ ID NO: 53101 - DNA, 20 bp, Artificial Sequence
  Description of Artificial Sequence: Synthetic oligonucleotide
  Target: SCN10A; (-) strand; PAM type: YTN; PAM sequence: TTT
cttcttcattctttttttgg

SEQ ID NO: 53102 - DNA, 20 bp, Artificial Sequence
  Description of Artificial Sequence: Synthetic oligonucleotide
  Target: SCN10A; (-) strand; PAM type: YTN; PAM sequence: TTT
tcttcttcattctttttttg

SEQ ID NO: 53103 - DNA, 20 bp, Artificial Sequence
  Description of Artificial Sequence: Synthetic oligonucleotide
  Target: SCN10A; (-) strand; PAM type: YTN; PAM sequence: TTT
ttcttcttcattcttttttt

SEQ ID NO: 53104 - DNA, 20 bp, Artificial Sequence
  Description of Artificial Sequence: Synthetic oligonucleotide
  Target: SCN10A; (-) strand; PAM type: YTN; PAM sequence: TTT
tttcttcttcattctttttt

SEQ ID NO: 53105 - DNA, 20 bp, Artificial Sequence
  Description of Artificial Sequence: Synthetic oligonucleotide
  Target: SCN10A; (-) strand; PAM type: YTN; PAM sequence: CTA
gagattttttcttcttcatt

SEQ ID NO: 53106 - DNA, 20 bp, Artificial Sequence
  Description of Artificial Sequence: Synthetic oligonucleotide
  Target: SCN10A; (-) strand; PAM type: YTN; PAM sequence: TTC
tagagattttttcttcttca

SEQ ID NO: 53107 - DNA, 20 bp, Artificial Sequence
  Description of Artificial Sequence: Synthetic oligonucleotide
  Target: SCN10A; (-) strand; PAM type: YTN; PAM sequence: TTT
ctagagattttttcttcttc

SEQ ID NO: 53108 - DNA, 20 bp, Artificial Sequence
  Description of Artificial Sequence: Synthetic oligonucleotide
  Target: SCN10A; (-) strand; PAM type: YTN; PAM sequence: TTT
tctagagattttttcttctt

SEQ ID NO: 53109 - DNA, 20 bp, Artificial Sequence
  Description of Artificial Sequence: Synthetic oligonucleotide
  Target: SCN10A; (-) strand; PAM type: YTN; PAM sequence: CTG
ttttctagagattttttctt

SEQ ID NO: 53110 - DNA, 20 bp, Artificial Sequence
  Description of Artificial Sequence: Synthetic oligonucleotide
  Target: SCN10A; (-) strand; PAM type: YTN; PAM sequence: CTG
atgcacagctgttttctaga

SEQ ID NO: 53111 - DNA, 20 bp, Artificial Sequence
  Description of Artificial Sequence: Synthetic oligonucleotide
  Target: SCN10A; (-) strand; PAM type: YTN; PAM sequence: CTA
ggcctgatgcacagctgttt

SEQ ID NO: 53112 - DNA, 20 bp, Artificial Sequence
  Description of Artificial Sequence: Synthetic oligonucleotide
  Target: SCN10A; (-) strand; PAM type: YTN; PAM sequence: TTC
taggcctgatgcacagctgt

SEQ ID NO: 53113 - DNA, 20 bp, Artificial Sequence
  Description of Artificial Sequence: Synthetic oligonucleotide
  Target: SCN10A; (-) strand; PAM type: YTN; PAM sequence: TTT
ctaggcctgatgcacagctg

SEQ ID NO: 53114 - DNA, 20 bp, Artificial Sequence
  Description of Artificial Sequence: Synthetic oligonucleotide
  Target: SCN10A; (-) strand; PAM type: YTN; PAM sequence: TTT
tctaggcctgatgcacagct

SEQ ID NO: 53115 - DNA, 20 bp, Artificial Sequence
  Description of Artificial Sequence: Synthetic oligonucleotide
  Target: SCN10A; (-) strand; PAM type: YTN; PAM sequence: CTA
gatgttttctaggcctgatg

SEQ ID NO: 53116 - DNA, 20 bp, Artificial Sequence
  Description of Artificial Sequence: Synthetic oligonucleotide
  Target: SCN10A; (-) strand; PAM type: YTN; PAM sequence: CTG
acctagatgttttctaggcc

SEQ ID NO: 53117 - DNA, 20 bp, Artificial Sequence
  Description of Artificial Sequence: Synthetic oligonucleotide
  Target: SCN10A; (-) strand; PAM type: YTN; PAM sequence: TTC
tgacctagatgttttctagg

SEQ ID NO: 53118 - DNA, 20 bp, Artificial Sequence
  Description of Artificial Sequence: Synthetic oligonucleotide
  Target: SCN10A; (-) strand; PAM type: YTN; PAM sequence: CTC
attctgacctagatgttttc

SEQ ID NO: 53119 - DNA, 20 bp, Artificial Sequence
  Description of Artificial Sequence: Synthetic oligonucleotide
  Target: SCN10A; (-) strand; PAM type: YTN; PAM sequence: CTG
cctcattctgacctagatgt

SEQ ID NO: 53120 - DNA, 20 bp, Artificial Sequence
  Description of Artificial Sequence: Synthetic oligonucleotide
  Target: SCN10A; (-) strand; PAM type: YTN; PAM sequence: TTC
tgcctcattctgacctagat

SEQ ID NO: 53121 - DNA, 20 bp, Artificial Sequence
  Description of Artificial Sequence: Synthetic oligonucleotide
  Target: SCN10A; (-) strand; PAM type: YTN; PAM sequence: CTT
ctgcctcattctgacctaga

SEQ ID NO: 53122 - DNA, 20 bp, Artificial Sequence
  Description of Artificial Sequence: Synthetic oligonucleotide
  Target: SCN10A; (-) strand; PAM type: YTN; PAM sequence: TTC
atcttctgcctcattctgac

SEQ ID NO: 53123 - DNA, 20 bp, Artificial Sequence
  Description of Artificial Sequence: Synthetic oligonucleotide
  Target: SCN10A; (-) strand; PAM type: YTN; PAM sequence: CTT
catcttctgcctcattctga

SEQ ID NO: 53124 - DNA, 20 bp, Artificial Sequence
  Description of Artificial Sequence: Synthetic oligonucleotide
  Target: SCN10A; (-) strand; PAM type: YTN; PAM sequence: CTA
gagtacttcatcttctgcct

SEQ ID NO: 53125 - DNA, 20 bp, Artificial Sequence
  Description of Artificial Sequence: Synthetic oligonucleotide
  Target: SCN10A; (-) strand; PAM type: YTN; PAM sequence: CTA
tgggaatcacagctagagta

SEQ ID NO: 53126 - DNA, 20 bp, Artificial Sequence
  Description of Artificial Sequence: Synthetic oligonucleotide
  Target: SCN10A; (-) strand; PAM type: YTN; PAM sequence: TTC
ctatgggaatcacagctaga

SEQ ID NO: 53127 - DNA, 20 bp, Artificial Sequence
  Description of Artificial Sequence: Synthetic oligonucleotide
  Target: SCN10A; (-) strand; PAM type: YTN; PAM sequence: TTT
cctatgggaatcacagctag

SEQ ID NO: 53128 - DNA, 20 bp, Artificial Sequence
  Description of Artificial Sequence: Synthetic oligonucleotide
  Target: SCN10A; (-) strand; PAM type: YTN; PAM sequence: TTT
tcctatgggaatcacagcta

SEQ ID NO: 53129 - DNA, 20 bp, Artificial Sequence
  Description of Artificial Sequence: Synthetic oligonucleotide
  Target: SCN10A; (-) strand; PAM type: YTN; PAM sequence: TTT
ttcctatgggaatcacagct

SEQ ID NO: 53130 - DNA, 20 bp, Artificial Sequence
  Description of Artificial Sequence: Synthetic oligonucleotide
  Target: SCN10A; (-) strand; PAM type: YTN; PAM sequence: TTT
tttcctatgggaatcacagc

SEQ ID NO: 53131 - DNA, 20 bp, Artificial Sequence
  Description of Artificial Sequence: Synthetic oligonucleotide
  Target: SCN10A; (-) strand; PAM type: YTN; PAM sequence: TTT
ttttcctatgggaatcacag

SEQ ID NO: 53132 - DNA, 20 bp, Artificial Sequence
  Description of Artificial Sequence: Synthetic oligonucleotide
  Target: SCN10A; (-) strand; PAM type: YTN; PAM sequence: TTG
cacacatcaggtgcatgtgt

SEQ ID NO: 53133 - DNA, 20 bp, Artificial Sequence
  Description of Artificial Sequence: Synthetic oligonucleotide
  Target: SCN10A; (-) strand; PAM type: YTN; PAM sequence: TTT
gcacacatcaggtgcatgtg

SEQ ID NO: 53134 - DNA, 20 bp, Artificial Sequence
  Description of Artificial Sequence: Synthetic oligonucleotide
  Target: SCN10A; (-) strand; PAM type: YTN; PAM sequence: TTA
tttgcacacatcaggtgcat

SEQ ID NO: 53135 - DNA, 20 bp, Artificial Sequence
  Description of Artificial Sequence: Synthetic oligonucleotide
  Target: SCN10A; (-) strand; PAM type: YTN; PAM sequence: TTT
atttgcacacatcaggtgca

SEQ ID NO: 53136 - DNA, 20 bp, Artificial Sequence
  Description of Artificial Sequence: Synthetic oligonucleotide
  Target: SCN10A; (-) strand; PAM type: YTN; PAM sequence: TTC
aatttatttgcacacatcag

SEQ ID NO: 53137 - DNA, 20 bp, Artificial Sequence
  Description of Artificial Sequence: Synthetic oligonucleotide
  Target: SCN10A; (-) strand; PAM type: YTN; PAM sequence: CTT
caatttatttgcacacatca

SEQ ID NO: 53138 - DNA, 20 bp, Artificial Sequence
  Description of Artificial Sequence: Synthetic oligonucleotide
  Target: SCN10A; (-) strand; PAM type: YTN; PAM sequence: TTG
cttcaatttatttgcacaca

SEQ ID NO: 53139 - DNA, 20 bp, Artificial Sequence
  Description of Artificial Sequence: Synthetic oligonucleotide
  Target: SCN10A; (-) strand; PAM type: YTN; PAM sequence: TTG
ttgcttcaatttatttgcac

SEQ ID NO: 53140 - DNA, 20 bp, Artificial Sequence
  Description of Artificial Sequence: Synthetic oligonucleotide
  Target: SCN10A; (-) strand; PAM type: YTN; PAM sequence: TTA
attgttgcttcaatttattt

SEQ ID NO: 53141 - DNA, 20 bp, Artificial Sequence
  Description of Artificial Sequence: Synthetic oligonucleotide
  Target: SCN10A; (-) strand; PAM type: YTN; PAM sequence: TTT
aattgttgcttcaatttatt

SEQ ID NO: 53142 - DNA, 20 bp, Artificial Sequence
  Description of Artificial Sequence: Synthetic oligonucleotide
  Target: SCN10A; (-) strand; PAM type: YTN; PAM sequence: CTC
cagatgtttaattgttgctt

SEQ ID NO: 53143 - DNA, 20 bp, Artificial Sequence
  Description of Artificial Sequence: Synthetic oligonucleotide
  Target: SCN10A; (-) strand; PAM type: YTN; PAM sequence: TTC
tccagatgtttaattgttgc

SEQ ID NO: 53144 - DNA, 20 bp, Artificial Sequence
  Description of Artificial Sequence: Synthetic oligonucleotide
  Target: SCN10A; (-) strand; PAM type: YTN; PAM sequence: CTT
ctccagatgtttaattgttg

SEQ ID NO: 53145 - DNA, 20 bp, Artificial Sequence
  Description of Artificial Sequence: Synthetic oligonucleotide
  Target: SCN10A; (-) strand; PAM type: YTN; PAM sequence: CTC
ttctccagatgtttaattgt

SEQ ID NO: 53146 - DNA, 20 bp, Artificial Sequence
  Description of Artificial Sequence: Synthetic oligonucleotide
  Target: SCN10A; (-) strand; PAM type: YTN; PAM sequence: TTC
ccaaactcttctccagatgt

SEQ ID NO: 53147 - DNA, 20 bp, Artificial Sequence
  Description of Artificial Sequence: Synthetic oligonucleotide
  Target: SCN10A; (-) strand; PAM type: YTN; PAM sequence: TTG
ttcccaaactcttctccaga

SEQ ID NO: 53148 - DNA, 20 bp, Artificial Sequence
  Description of Artificial Sequence: Synthetic oligonucleotide
  Target: SCN10A; (-) strand; PAM type: YTN; PAM sequence: TTT
gttcccaaactcttctccag

SEQ ID NO: 53149 - DNA, 20 bp, Artificial Sequence
  Description of Artificial Sequence: Synthetic oligonucleotide
  Target: SCN10A; (-) strand; PAM type: YTN; PAM sequence: CTA
atttgttcccaaactcttct

SEQ ID NO: 53150 - DNA, 20 bp, Artificial Sequence
  Description of Artificial Sequence: Synthetic oligonucleotide
  Target: SCN10A; (-) strand; PAM type: YTN; PAM sequence: TTA
tccctaatttgttcccaaac

SEQ ID NO: 53151 - DNA, 20 bp, Artificial Sequence
  Description of Artificial Sequence: Synthetic oligonucleotide
  Target: SCN10A; (-) strand; PAM type: YTN; PAM sequence: TTT
atccctaatttgttcccaaa

SEQ ID NO: 53152 - DNA, 20 bp, Artificial Sequence
  Description of Artificial Sequence: Synthetic oligonucleotide
  Target: SCN10A; (-) strand; PAM type: YTN; PAM sequence: CTA
tttatccctaatttgttccc

SEQ ID NO: 53153 - DNA, 20 bp, Artificial Sequence
  Description of Artificial Sequence: Synthetic oligonucleotide
  Target: SCN10A; (-) strand; PAM type: YTN; PAM sequence: TTC
tatttatccctaatttgttc

SEQ ID NO: 53154 - DNA, 20 bp, Artificial Sequence
  Description of Artificial Sequence: Synthetic oligonucleotide
  Target: SCN10A; (-) strand; PAM type: YTN; PAM sequence: TTT
ctatttatccctaatttgtt

SEQ ID NO: 53155 - DNA, 20 bp, Artificial Sequence
  Description of Artificial Sequence: Synthetic oligonucleotide
  Target: SCN10A; (-) strand; PAM type: YTN; PAM sequence: TTT
tctatttatccctaatttgt

SEQ ID NO: 53156 - DNA, 20 bp, Artificial Sequence
  Description of Artificial Sequence: Synthetic oligonucleotide
  Target: SCN10A; (-) strand; PAM type: YTN; PAM sequence: CTC
agttttctatttatccctaa

SEQ ID NO: 53157 - DNA, 20 bp, Artificial Sequence
  Description of Artificial Sequence: Synthetic oligonucleotide
  Target: SCN10A; (-) strand; PAM type: YTN; PAM sequence: TTG
ctcagttttctatttatccc

SEQ ID NO: 53158 - DNA, 20 bp, Artificial Sequence
  Description of Artificial Sequence: Synthetic oligonucleotide
  Target: SCN10A; (-) strand; PAM type: YTN; PAM sequence: TTT
gctcagttttctatttatcc

SEQ ID NO: 53159 - DNA, 20 bp, Artificial Sequence
  Description of Artificial Sequence: Synthetic oligonucleotide
  Target: SCN10A; (-) strand; PAM type: YTN; PAM sequence: TTG
tttgctcagttttctattta

SEQ ID NO: 53160 - DNA, 20 bp, Artificial Sequence
  Description of Artificial Sequence: Synthetic oligonucleotide
  Target: SCN10A; (-) strand; PAM type: YTN; PAM sequence: TTT
gtttgctcagttttctattt

SEQ ID NO: 53161 - DNA, 20 bp, Artificial Sequence
  Description of Artificial Sequence: Synthetic oligonucleotide
  Target: SCN10A; (-) strand; PAM type: YTN; PAM sequence: TTT
tgtttgctcagttttctatt

SEQ ID NO: 53162 - DNA, 20 bp, Artificial Sequence
  Description of Artificial Sequence: Synthetic oligonucleotide
  Target: SCN10A; (-) strand; PAM type: YTN; PAM sequence: TTT
ttgtttgctcagttttctat

SEQ ID NO: 53163 - DNA, 20 bp, Artificial Sequence
  Description of Artificial Sequence: Synthetic oligonucleotide
  Target: SCN10A; (-) strand; PAM type: YTN; PAM sequence: TTT
tttgtttgctcagttttcta

SEQ ID NO: 53164 - DNA, 20 bp, Artificial Sequence
  Description of Artificial Sequence: Synthetic oligonucleotide
  Target: SCN10A; (-) strand; PAM type: YTN; PAM sequence: TTT
ttttgtttgctcagttttct

SEQ ID NO: 53165 - DNA, 20 bp, Artificial Sequence
  Description of Artificial Sequence: Synthetic oligonucleotide
  Target: SCN10A; (-) strand; PAM type: YTN; PAM sequence: TTA
tttttttgtttgctcagttt

SEQ ID NO: 53166 - DNA, 20 bp, Artificial Sequence
  Description of Artificial Sequence: Synthetic oligonucleotide
  Target: SCN10A; (-) strand; PAM type: YTN; PAM sequence: TTT
atttttttgtttgctcagtt

SEQ ID NO: 53167 - DNA, 20 bp, Artificial Sequence
  Description of Artificial Sequence: Synthetic oligonucleotide
  Target: SCN10A; (-) strand; PAM type: YTN; PAM sequence: TTT
tatttttttgtttgctcagt

SEQ ID NO: 53168 - DNA, 20 bp, Artificial Sequence
  Description of Artificial Sequence: Synthetic oligonucleotide
  Target: SCN10A; (-) strand; PAM type: YTN; PAM sequence: TTA
ataaggattttatttttttg

SEQ ID NO: 53169 - DNA, 20 bp, Artificial Sequence
  Description of Artificial Sequence: Synthetic oligonucleotide
  Target: SCN10A; (-) strand; PAM type: YTN; PAM sequence: TTG
gagttaataaggattttatt

SEQ ID NO: 53170 - DNA, 20 bp, Artificial Sequence
  Description of Artificial Sequence: Synthetic oligonucleotide
  Target: SCN10A; (-) strand; PAM type: YTN; PAM sequence: CTT
ggagttaataaggattttat

SEQ ID NO: 53171 - DNA, 20 bp, Artificial Sequence
  Description of Artificial Sequence: Synthetic oligonucleotide
  Target: SCN10A; (-) strand; PAM type: YTN; PAM sequence: TTC
cttggagttaataaggattt

SEQ ID NO: 53172 - DNA, 20 bp, Artificial Sequence
  Description of Artificial Sequence: Synthetic oligonucleotide
  Target: SCN10A; (-) strand; PAM type: YTN; PAM sequence: TTT
ccttggagttaataaggatt

SEQ ID NO: 53173 - DNA, 20 bp, Artificial Sequence
  Description of Artificial Sequence: Synthetic oligonucleotide
  Target: SCN10A; (-) strand; PAM type: YTN; PAM sequence: CTT
tccttggagttaataaggat

SEQ ID NO: 53174 - DNA, 20 bp, Artificial Sequence
  Description of Artificial Sequence: Synthetic oligonucleotide
  Target: SCN10A; (-) strand; PAM type: YTN; PAM sequence: TTG
ctttccttggagttaataag

SEQ ID NO: 53175 - DNA, 20 bp, Artificial Sequence
  Description of Artificial Sequence: Synthetic oligonucleotide
  Target: SCN10A; (-) strand; PAM type: YTN; PAM sequence: TTT
gctttccttggagttaataa

SEQ ID NO: 53176 - DNA, 20 bp, Artificial Sequence
  Description of Artificial Sequence: Synthetic oligonucleotide
  Target: SCN10A; (-) strand; PAM type: YTN; PAM sequence: TTT
tgctttccttggagttaata

SEQ ID NO: 53177 - DNA, 20 bp, Artificial Sequence
  Description of Artificial Sequence: Synthetic oligonucleotide
  Target: SCN10A; (-) strand; PAM type: YTN; PAM sequence: TTT
ttgctttccttggagttaat

SEQ ID NO: 53178 - DNA, 20 bp, Artificial Sequence
  Description of Artificial Sequence: Synthetic oligonucleotide
  Target: SCN10A; (-) strand; PAM type: YTN; PAM sequence: TTG
cacaatgtttttgctttcct

SEQ ID NO: 53179 - DNA, 20 bp, Artificial Sequence
  Description of Artificial Sequence: Synthetic oligonucleotide
  Target: SCN10A; (-) strand; PAM type: YTN; PAM sequence: TTT
gcacaatgtttttgctttcc

SEQ ID NO: 53180 - DNA, 20 bp, Artificial Sequence
  Description of Artificial Sequence: Synthetic oligonucleotide
  Target: SCN10A; (-) strand; PAM type: YTN; PAM sequence: TTT
tgcacaatgtttttgctttc

SEQ ID NO: 53181 - DNA, 20 bp, Artificial Sequence
  Description of Artificial Sequence: Synthetic oligonucleotide
  Target: SCN10A; (-) strand; PAM type: YTN; PAM sequence: TTT
ttgcacaatgtttttgcttt

SEQ ID NO: 53182 - DNA, 20 bp, Artificial Sequence
  Description of Artificial Sequence: Synthetic oligonucleotide
  Target: SCN10A; (-) strand; PAM type: YTN; PAM sequence: CTT
tttgcacaatgtttttgctt

SEQ ID NO: 53183 - DNA, 20 bp, Artificial Sequence
  Description of Artificial Sequence: Synthetic oligonucleotide
  Target: SCN10A; (-) strand; PAM type: YTN; PAM sequence: TTC
ctttttgcacaatgtttttg

SEQ ID NO: 53184 - DNA, 20 bp, Artificial Sequence
  Description of Artificial Sequence: Synthetic oligonucleotide
  Target: SCN10A; (-) strand; PAM type: YTN; PAM sequence: TTT
cctttttgcacaatgttttt

SEQ ID NO: 53185 - DNA, 20 bp, Artificial Sequence
  Description of Artificial Sequence: Synthetic oligonucleotide
  Target: SCN10A; (-) strand; PAM type: YTN; PAM sequence: CTA
tatttcctttttgcacaatg

SEQ ID NO: 53186 - DNA, 20 bp, Artificial Sequence
  Description of Artificial Sequence: Synthetic oligonucleotide
  Target: SCN10A; (-) strand; PAM type: YTN; PAM sequence: TTG
actatatttcctttttgcac

SEQ ID NO: 53187 - DNA, 20 bp, Artificial Sequence
  Description of Artificial Sequence: Synthetic oligonucleotide
  Target: SCN10A; (-) strand; PAM type: YTN; PAM sequence: TTT
gactatatttcctttttgca

SEQ ID NO: 53188 - DNA, 20 bp, Artificial Sequence
  Description of Artificial Sequence: Synthetic oligonucleotide
  Target: SCN10A; (-) strand; PAM type: YTN; PAM sequence: CTT
tgactatatttcctttttgc

SEQ ID NO: 53189 - DNA, 20 bp, Artificial Sequence
  Description of Artificial Sequence: Synthetic oligonucleotide
  Target: SCN10A; (-) strand; PAM type: YTN; PAM sequence: CTG
tgtcatgcagtgtactttga

SEQ ID NO: 53190 - DNA, 20 bp, Artificial Sequence
  Description of Artificial Sequence: Synthetic oligonucleotide
  Target: SCN10A; (-) strand; PAM type: YTN; PAM sequence: TTA
cagctgtgtcatgcagtgta

SEQ ID NO: 53191 - DNA, 20 bp, Artificial Sequence
  Description of Artificial Sequence: Synthetic oligonucleotide
  Target: SCN10A; (-) strand; PAM type: YTN; PAM sequence: TTT
acagctgtgtcatgcagtgt

SEQ ID NO: 53192 - DNA, 20 bp, Artificial Sequence
  Description of Artificial Sequence: Synthetic oligonucleotide
  Target: SCN10A; (-) strand; PAM type: YTN; PAM sequence: CTG
tttacagctgtgtcatgcag

SEQ ID NO: 53193 - DNA, 20 bp, Artificial Sequence
  Description of Artificial Sequence: Synthetic oligonucleotide
  Target: SCN10A; (-) strand; PAM type: YTN; PAM sequence: CTA
agtaaacactgtttacagct

SEQ ID NO: 53194 - DNA, 20 bp, Artificial Sequence
  Description of Artificial Sequence: Synthetic oligonucleotide
  Target: SCN10A; (-) strand; PAM type: YTN; PAM sequence: TTG
ctaagtaaacactgtttaca

SEQ ID NO: 53195 - DNA, 20 bp, Artificial Sequence
  Description of Artificial Sequence: Synthetic oligonucleotide
  Target: SCN10A; (-) strand; PAM type: YTN; PAM sequence: TTA
cattgctaagtaaacactgt

SEQ ID NO: 53196 - DNA, 20 bp, Artificial Sequence
  Description of Artificial Sequence: Synthetic oligonucleotide
  Target: SCN10A; (-) strand; PAM type: YTN; PAM sequence: TTA
cattacattgctaagtaaac

SEQ ID NO: 53197 - DNA, 20 bp, Artificial Sequence
  Description of Artificial Sequence: Synthetic oligonucleotide
  Target: SCN10A; (-) strand; PAM type: YTN; PAM sequence: CTA
catatataattacattacat

SEQ ID NO: 53198 - DNA, 20 bp, Artificial Sequence
  Description of Artificial Sequence: Synthetic oligonucleotide
  Target: SCN10A; (-) strand; PAM type: YTN; PAM sequence: TTG
tatgactacatatataatta

SEQ ID NO: 53199 - DNA, 20 bp, Artificial Sequence
  Description of Artificial Sequence: Synthetic oligonucleotide
  Target: SCN10A; (-) strand; PAM type: YTN; PAM sequence: TTA
gatcatcagataatatatcc

SEQ ID NO: 53200 - DNA, 20 bp, Artificial Sequence
  Description of Artificial Sequence: Synthetic oligonucleotide
  Target: SCN10A; (-) strand; PAM type: YTN; PAM sequence: TTC
agttagatcatcagataata

SEQ ID NO: 53201 - DNA, 20 bp, Artificial Sequence
  Description of Artificial Sequence: Synthetic oligonucleotide
  Target: SCN10A; (-) strand; PAM type: YTN; PAM sequence: CTT
cagttagatcatcagataat

SEQ ID NO: 53202 - DNA, 20 bp, Artificial Sequence
  Description of Artificial Sequence: Synthetic oligonucleotide
  Target: SCN10A; (-) strand; PAM type: YTN; PAM sequence: TTG
taatcttcagttagatcatc

SEQ ID NO: 53203 - DNA, 20 bp, Artificial Sequence
  Description of Artificial Sequence: Synthetic oligonucleotide
  Target: SCN10A; (-) strand; PAM type: YTN; PAM sequence: TTA
tattgtaatcttcagttaga

SEQ ID NO: 53204 - DNA, 20 bp, Artificial Sequence
  Description of Artificial Sequence: Synthetic oligonucleotide
  Target: SCN10A; (-) strand; PAM type: YTN; PAM sequence: TTA
cagttatattgtaatcttca

SEQ ID NO: 53205 - DNA, 20 bp, Artificial Sequence
  Description of Artificial Sequence: Synthetic oligonucleotide
  Target: SCN10A; (-) strand; PAM type: YTN; PAM sequence: CTG
ttacagttatattgtaatct

SEQ ID NO: 53206 - DNA, 20 bp, Artificial Sequence
  Description of Artificial Sequence: Synthetic oligonucleotide
  Target: SCN10A; (-) strand; PAM type: YTN; PAM sequence: TTC
ctgttacagttatattgtaa

SEQ ID NO: 53207 - DNA, 20 bp, Artificial Sequence
  Description of Artificial Sequence: Synthetic oligonucleotide
  Target: SCN10A; (-) strand; PAM type: YTN; PAM sequence: CTT
cctgttacagttatattgta

SEQ ID NO: 53208 - DNA, 20 bp, Artificial Sequence
  Description of Artificial Sequence: Synthetic oligonucleotide
  Target: SCN10A; (-) strand; PAM type: YTN; PAM sequence: CTC
atcttcctgttacagttata

SEQ ID NO: 53209 - DNA, 20 bp, Artificial Sequence
  Description of Artificial Sequence: Synthetic oligonucleotide
  Target: SCN10A; (-) strand; PAM type: YTN; PAM sequence: CTC
accctcatcttcctgttaca

SEQ ID NO: 53210 - DNA, 20 bp, Artificial Sequence
  Description of Artificial Sequence: Synthetic oligonucleotide
  Target: SCN10A; (-) strand; PAM type: YTN; PAM sequence: CTC
tcaccctcatcttcctgtta

SEQ ID NO: 53211 - DNA, 20 bp, Artificial Sequence
  Description of Artificial Sequence: Synthetic oligonucleotide
  Target: SCN10A; (-) strand; PAM type: YTN; PAM sequence: TTC
ctctcaccctcatcttcctg

SEQ ID NO: 53212 - DNA, 20 bp, Artificial Sequence
  Description of Artificial Sequence: Synthetic oligonucleotide
  Target: SCN10A; (-) strand; PAM type: YTN; PAM sequence: TTT
cctctcaccctcatcttcct

SEQ ID NO: 53213 - DNA, 20 bp, Artificial Sequence
  Description of Artificial Sequence: Synthetic oligonucleotide
  Target: SCN10A; (-) strand; PAM type: YTN; PAM sequence: CTC
atttcctctcaccctcatct

SEQ ID NO: 53214 - DNA, 20 bp, Artificial Sequence
  Description of Artificial Sequence: Synthetic oligonucleotide
  Target: SCN10A; (-) strand; PAM type: YTN; PAM sequence: TTA
aggccacatccacaaactca

SEQ ID NO: 53215 - DNA, 20 bp, Artificial Sequence
  Description of Artificial Sequence: Synthetic oligonucleotide
  Target: SCN10A; (-) strand; PAM type: YTN; PAM sequence: CTT
aaggccacatccacaaactc

SEQ ID NO: 53216 - DNA, 20 bp, Artificial Sequence
  Description of Artificial Sequence: Synthetic oligonucleotide
  Target: SCN10A; (-) strand; PAM type: YTN; PAM sequence: TTA
tgagaaaaaacttaaggcca

SEQ ID NO: 53217 - DNA, 20 bp, Artificial Sequence
  Description of Artificial Sequence: Synthetic oligonucleotide
  Target: SCN10A; (-) strand; PAM type: YTN; PAM sequence: CTA
ttatgagaaaaaacttaagg

SEQ ID NO: 53218 - DNA, 20 bp, Artificial Sequence
  Description of Artificial Sequence: Synthetic oligonucleotide
  Target: SCN10A; (-) strand; PAM type: YTN; PAM sequence: TTC
ctattatgagaaaaaactta

SEQ ID NO: 53219 - DNA, 20 bp, Artificial Sequence
  Description of Artificial Sequence: Synthetic oligonucleotide
  Target: SCN10A; (-) strand; PAM type: YTN; PAM sequence: CTT
cctattatgagaaaaaactt

SEQ ID NO: 53220 - DNA, 20 bp, Artificial Sequence
  Description of Artificial Sequence: Synthetic oligonucleotide
  Target: SCN10A; (-) strand; PAM type: YTN; PAM sequence: TTG
gcttcctattatgagaaaaa

SEQ ID NO: 53221 - DNA, 20 bp, Artificial Sequence
  Description of Artificial Sequence: Synthetic oligonucleotide
  Target: SCN10A; (-) strand; PAM type: YTN; PAM sequence: TTA
ttggcttcctattatgagaa

SEQ ID NO: 53222 - DNA, 20 bp, Artificial Sequence
  Description of Artificial Sequence: Synthetic oligonucleotide
  Target: SCN10A; (-) strand; PAM type: YTN; PAM sequence: TTT
attggcttcctattatgaga

SEQ ID NO: 53223 - DNA, 20 bp, Artificial Sequence
  Description of Artificial Sequence: Synthetic oligonucleotide
  Target: SCN10A; (-) strand; PAM type: YTN; PAM sequence: TTA
tttattggcttcctattatg

SEQ ID NO: 53224 - DNA, 20 bp, Artificial Sequence
  Description of Artificial Sequence: Synthetic oligonucleotide
  Target: SCN10A; (-) strand; PAM type: YTN; PAM sequence: CTG
atgttatttattggcttcct

SEQ ID NO: 53225 - DNA, 20 bp, Artificial Sequence
  Description of Artificial Sequence: Synthetic oligonucleotide
  Target: SCN10A; (-) strand; PAM type: YTN; PAM sequence: TTC
tgatgttatttattggcttc

SEQ ID NO: 53226 - DNA, 20 bp, Artificial Sequence
  Description of Artificial Sequence: Synthetic oligonucleotide
  Target: SCN10A; (-) strand; PAM type: YTN; PAM sequence: TTT
ctgatgttatttattggctt

SEQ ID NO: 53227 - DNA, 20 bp, Artificial Sequence
  Description of Artificial Sequence: Synthetic oligonucleotide
  Target: SCN10A; (-) strand; PAM type: YTN; PAM sequence: TTC
aatttctgatgttatttatt

SEQ ID NO: 53228 - DNA, 20 bp, Artificial Sequence
  Description of Artificial Sequence: Synthetic oligonucleotide
  Target: SCN10A; (-) strand; PAM type: YTN; PAM sequence: TTT
caatttctgatgttatttat

SEQ ID NO: 53229 - DNA, 20 bp, Artificial Sequence
  Description of Artificial Sequence: Synthetic oligonucleotide
  Target: SCN10A; (-) strand; PAM type: YTN; PAM sequence: TTT
tcaatttctgatgttattta

SEQ ID NO: 53230 - DNA, 20 bp, Artificial Sequence
  Description of Artificial Sequence: Synthetic oligonucleotide
  Target: SCN10A; (-) strand; PAM type: YTN; PAM sequence: TTT
ttcaatttctgatgttattt

SEQ ID NO: 53231 - DNA, 20 bp, Artificial Sequence
  Description of Artificial Sequence: Synthetic oligonucleotide
  Target: SCN10A; (-) strand; PAM type: YTN; PAM sequence: TTA
atttttcaatttctgatgtt

SEQ ID NO: 53232 - DNA, 20 bp, Artificial Sequence
  Description of Artificial Sequence: Synthetic oligonucleotide
  Target: SCN10A; (-) strand; PAM type: YTN; PAM sequence: TTT
aatttttcaatttctgatgt

SEQ ID NO: 53233 - DNA, 20 bp, Artificial Sequence
  Description of Artificial Sequence: Synthetic oligonucleotide
  Target: SCN10A; (-) strand; PAM type: YTN; PAM sequence: TTT
taatttttcaatttctgatg

SEQ ID NO: 53234 - DNA, 20 bp, Artificial Sequence
  Description of Artificial Sequence: Synthetic oligonucleotide
  Target: SCN10A; (-) strand; PAM type: YTN; PAM sequence: TTT
ttaatttttcaatttctgat

SEQ ID NO: 53235 - DNA, 20 bp, Artificial Sequence
  Description of Artificial Sequence: Synthetic oligonucleotide
  Target: SCN10A; (-) strand; PAM type: YTN; PAM sequence: CTA
atttttaatttttcaatttc

SEQ ID NO: 53236 - DNA, 20 bp, Artificial Sequence
  Description of Artificial Sequence: Synthetic oligonucleotide
  Target: SCN10A; (-) strand; PAM type: YTN; PAM sequence: CTC
ataatactaatttttaattt

SEQ ID NO: 53237 - DNA, 20 bp, Artificial Sequence
  Description of Artificial Sequence: Synthetic oligonucleotide
  Target: SCN10A; (-) strand; PAM type: YTN; PAM sequence: CTC
caataatatactcataatac

SEQ ID NO: 53238 - DNA, 20 bp, Artificial Sequence
  Description of Artificial Sequence: Synthetic oligonucleotide
  Target: SCN10A; (-) strand; PAM type: YTN; PAM sequence: CTA
tctccaataatatactcata

SEQ ID NO: 53239 - DNA, 20 bp, Artificial Sequence
  Description of Artificial Sequence: Synthetic oligonucleotide
  Target: SCN10A; (-) strand; PAM type: YTN; PAM sequence: CTC
cctatctccaataatatact

SEQ ID NO: 53240 - DNA, 20 bp, Artificial Sequence
  Description of Artificial Sequence: Synthetic oligonucleotide
  Target: SCN10A; (-) strand; PAM type: YTN; PAM sequence: CTG
atacctccctatctccaata

SEQ ID NO: 53241 - DNA, 20 bp, Artificial Sequence
  Description of Artificial Sequence: Synthetic oligonucleotide
  Target: SCN10A; (-) strand; PAM type: YTN; PAM sequence: TTC
tgatacctccctatctccaa

SEQ ID NO: 53242 - DNA, 20 bp, Artificial Sequence
  Description of Artificial Sequence: Synthetic oligonucleotide
  Target: SCN10A; (-) strand; PAM type: YTN; PAM sequence: CTT
ctgatacctccctatctcca

SEQ ID NO: 53243 - DNA, 20 bp, Artificial Sequence
  Description of Artificial Sequence: Synthetic oligonucleotide
  Target: SCN10A; (-) strand; PAM type: YTN; PAM sequence: CTG
tgtcttctgatacctcccta

SEQ ID NO: 53244 - DNA, 20 bp, Artificial Sequence
  Description of Artificial Sequence: Synthetic oligonucleotide
  Target: SCN10A; (-) strand; PAM type: YTN; PAM sequence: TTA
cctgtgtcttctgatacctc

SEQ ID NO: 53245 - DNA, 20 bp, Artificial Sequence
  Description of Artificial Sequence: Synthetic oligonucleotide
  Target: SCN10A; (-) strand; PAM type: YTN; PAM sequence: TTT
acctgtgtcttctgatacct

SEQ ID NO: 53246 - DNA, 20 bp, Artificial Sequence
  Description of Artificial Sequence: Synthetic oligonucleotide
  Target: SCN10A; (-) strand; PAM type: YTN; PAM sequence: TTT
tacctgtgtcttctgatacc

SEQ ID NO: 53247 - DNA, 20 bp, Artificial Sequence
  Description of Artificial Sequence: Synthetic oligonucleotide
  Target: SCN10A; (-) strand; PAM type: YTN; PAM sequence: TTT
ttacctgtgtcttctgatac

SEQ ID NO: 53248 - DNA, 20 bp, Artificial Sequence
  Description of Artificial Sequence: Synthetic oligonucleotide
  Target: SCN10A; (-) strand; PAM type: YTN; PAM sequence: TTT
tttacctgtgtcttctgata

SEQ ID NO: 53249 - DNA, 20 bp, Artificial Sequence
  Description of Artificial Sequence: Synthetic oligonucleotide
  Target: SCN10A; (-) strand; PAM type: YTN; PAM sequence: TTT
ttttacctgtgtcttctgat

SEQ ID NO: 53250 - DNA, 20 bp, Artificial Sequence
  Description of Artificial Sequence: Synthetic oligonucleotide
  Target: SCN10A; (-) strand; PAM type: YTN; PAM sequence: CTT
tttttacctgtgtcttctga

SEQ ID NO: 53251 - DNA, 20 bp, Artificial Sequence
  Description of Artificial Sequence: Synthetic oligonucleotide
  Target: SCN10A; (-) strand; PAM type: YTN; PAM sequence: TTA
gctttttttacctgtgtctt

SEQ ID NO: 53252 - DNA, 20 bp, Artificial Sequence
  Description of Artificial Sequence: Synthetic oligonucleotide
  Target: SCN10A; (-) strand; PAM type: YTN; PAM sequence: TTT
agctttttttacctgtgtct

SEQ ID NO: 53253 - DNA, 20 bp, Artificial Sequence
  Description of Artificial Sequence: Synthetic oligonucleotide
  Target: SCN10A; (-) strand; PAM type: YTN; PAM sequence: TTT
tagctttttttacctgtgtc

SEQ ID NO: 53254 - DNA, 20 bp, Artificial Sequence
  Description of Artificial Sequence: Synthetic oligonucleotide
  Target: SCN10A; (-) strand; PAM type: YTN; PAM sequence: CTT
ttagctttttttacctgtgt

SEQ ID NO: 53255 - DNA, 20 bp, Artificial Sequence
  Description of Artificial Sequence: Synthetic oligonucleotide
  Target: SCN10A; (-) strand; PAM type: YTN; PAM sequence: TTC
cagaggccaccacttttagc

SEQ ID NO: 53256 - DNA, 20 bp, Artificial Sequence
  Description of Artificial Sequence: Synthetic oligonucleotide
  Target: SCN10A; (-) strand; PAM type: YTN; PAM sequence: TTT
ccagaggccaccacttttag

SEQ ID NO: 53257 - DNA, 20 bp, Artificial Sequence
  Description of Artificial Sequence: Synthetic oligonucleotide
  Target: SCN10A; (-) strand; PAM type: YTN; PAM sequence: CTT
tccagaggccaccactttta

SEQ ID NO: 53258 - DNA, 20 bp, Artificial Sequence
  Description of Artificial Sequence: Synthetic oligonucleotide
  Target: SCN10A; (-) strand; PAM type: YTN; PAM sequence: TTC
tttccagaggccaccacttt

SEQ ID NO: 53259 - DNA, 20 bp, Artificial Sequence
  Description of Artificial Sequence: Synthetic oligonucleotide
  Target: SCN10A; (-) strand; PAM type: YTN; PAM sequence: CTT
ctttccagaggccaccactt

SEQ ID NO: 53260 - DNA, 20 bp, Artificial Sequence
  Description of Artificial Sequence: Synthetic oligonucleotide
  Target: SCN10A; (-) strand; PAM type: YTN; PAM sequence: CTC
ttctttccagaggccaccac

SEQ ID NO: 53261 - DNA, 20 bp, Artificial Sequence
  Description of Artificial Sequence: Synthetic oligonucleotide
  Target: SCN10A; (-) strand; PAM type: YTN; PAM sequence: CTC
atctcttctttccagaggcc

SEQ ID NO: 53262 - DNA, 20 bp, Artificial Sequence
  Description of Artificial Sequence: Synthetic oligonucleotide
  Target: SCN10A; (-) strand; PAM type: YTN; PAM sequence: TTC
tcatctcttctttccagagg

SEQ ID NO: 53263 - DNA, 20 bp, Artificial Sequence
  Description of Artificial Sequence: Synthetic oligonucleotide
  Target: SCN10A; (-) strand; PAM type: YTN; PAM sequence: TTT
ctcatctcttctttccagag

SEQ ID NO: 53264 - DNA, 20 bp, Artificial Sequence
  Description of Artificial Sequence: Synthetic oligonucleotide
  Target: SCN10A; (-) strand; PAM type: YTN; PAM sequence: TTT
tctcatctcttctttccaga

SEQ ID NO: 53265 - DNA, 20 bp, Artificial Sequence
  Description of Artificial Sequence: Synthetic oligonucleotide
  Target: SCN10A; (-) strand; PAM type: YTN; PAM sequence: TTT
ttctcatctcttctttccag

SEQ ID NO: 53266 - DNA, 20 bp, Artificial Sequence
  Description of Artificial Sequence: Synthetic oligonucleotide
  Target: SCN10A; (-) strand; PAM type: YTN; PAM sequence: TTC
atttttctcatctcttcttt

SEQ ID NO: 53267 - DNA, 20 bp, Artificial Sequence
  Description of Artificial Sequence: Synthetic oligonucleotide
  Target: SCN10A; (-) strand; PAM type: YTN; PAM sequence: TTT
catttttctcatctcttctt

SEQ ID NO: 53268 - DNA, 20 bp, Artificial Sequence
  Description of Artificial Sequence: Synthetic oligonucleotide
  Target: SCN10A; (-) strand; PAM type: YTN; PAM sequence: CTG
acaaaaaaaacagcaatttc

SEQ ID NO: 53269 - DNA, 20 bp, Artificial Sequence
  Description of Artificial Sequence: Synthetic oligonucleotide
  Target: SCN10A; (-) strand; PAM type: YTN; PAM sequence: TTC
tgacaaaaaaaacagcaatt

SEQ ID NO: 53270 - DNA, 20 bp, Artificial Sequence
  Description of Artificial Sequence: Synthetic oligonucleotide
  Target: SCN10A; (-) strand; PAM type: YTN; PAM sequence: TTA
taaagattctgacaaaaaaa

SEQ ID NO: 53271 - DNA, 20 bp, Artificial Sequence
  Description of Artificial Sequence: Synthetic oligonucleotide
  Target: SCN10A; (-) strand; PAM type: YTN; PAM sequence: TTT
ataaagattctgacaaaaaa

SEQ ID NO: 53272 - DNA, 20 bp, Artificial Sequence
  Description of Artificial Sequence: Synthetic oligonucleotide
  Target: SCN10A; (-) strand; PAM type: YTN; PAM sequence: TTT
tataaagattctgacaaaaa

SEQ ID NO: 53273 - DNA, 20 bp, Artificial Sequence
  Description of Artificial Sequence: Synthetic oligonucleotide
  Target: SCN10A; (-) strand; PAM type: YTN; PAM sequence: TTA
aaaggtcacagagttttata

SEQ ID NO: 53274 - DNA, 20 bp, Artificial Sequence
  Description of Artificial Sequence: Synthetic oligonucleotide
  Target: SCN10A; (-) strand; PAM type: YTN; PAM sequence: TTT
aaaaggtcacagagttttat

SEQ ID NO: 53275 - DNA, 20 bp, Artificial Sequence
  Description of Artificial Sequence: Synthetic oligonucleotide
  Target: SCN10A; (-) strand; PAM type: YTN; PAM sequence: TTC
ataatttaaaaggtcacaga

SEQ ID NO: 53276 - DNA, 20 bp, Artificial Sequence
  Description of Artificial Sequence: Synthetic oligonucleotide
  Target: SCN10A; (-) strand; PAM type: YTN; PAM sequence: TTA
agacatatatgttcataatt

SEQ ID NO: 53277 - DNA, 20 bp, Artificial Sequence
  Description of Artificial Sequence: Synthetic oligonucleotide
  Target: SCN10A; (-) strand; PAM type: YTN; PAM sequence: TTT
aagacatatatgttcataat

SEQ ID NO: 53278 - DNA, 20 bp, Artificial Sequence
  Description of Artificial Sequence: Synthetic oligonucleotide
  Target: SCN10A; (-) strand; PAM type: YTN; PAM sequence: TTA
tttaagacatatatgttcat

SEQ ID NO: 53279 - DNA, 20 bp, Artificial Sequence
  Description of Artificial Sequence: Synthetic oligonucleotide
  Target: SCN10A; (-) strand; PAM type: YTN; PAM sequence: TTT
atttaagacatatatgttca

SEQ ID NO: 53280 - DNA, 20 bp, Artificial Sequence
  Description of Artificial Sequence: Synthetic oligonucleotide
  Target: SCN10A; (-) strand; PAM type: YTN; PAM sequence: TTT
tatttaagacatatatgttc

SEQ ID NO: 53281 - DNA, 20 bp, Artificial Sequence
  Description of Artificial Sequence: Synthetic oligonucleotide
  Target: SCN10A; (-) strand; PAM type: YTN; PAM sequence: CTT
ttatttaagacatatatgtt

SEQ ID NO: 53282 - DNA, 20 bp, Artificial Sequence
  Description of Artificial Sequence: Synthetic oligonucleotide
  Target: SCN10A; (-) strand; PAM type: YTN; PAM sequence: TTA
cttttatttaagacatatat

SEQ ID NO: 53283 - DNA, 20 bp, Artificial Sequence
  Description of Artificial Sequence: Synthetic oligonucleotide
  Target: SCN10A; (-) strand; PAM type: YTN; PAM sequence: TTT
acttttatttaagacatata

SEQ ID NO: 53284 - DNA, 20 bp, Artificial Sequence
  Description of Artificial Sequence: Synthetic oligonucleotide
  Target: SCN10A; (-) strand; PAM type: YTN; PAM sequence: TTT
tacttttatttaagacatat

SEQ ID NO: 53285 - DNA, 20 bp, Artificial Sequence
  Description of Artificial Sequence: Synthetic oligonucleotide
  Target: SCN10A; (-) strand; PAM type: YTN; PAM sequence: CTT
ttacttttatttaagacata

SEQ ID NO: 53286 - DNA, 20 bp, Artificial Sequence
  Description of Artificial Sequence: Synthetic oligonucleotide
  Target: SCN10A; (-) strand; PAM type: YTN; PAM sequence: TTG
acttttacttttatttaaga

SEQ ID NO: 53287 - DNA, 20 bp, Artificial Sequence
  Description of Artificial Sequence: Synthetic oligonucleotide
  Target: SCN10A; (-) strand; PAM type: YTN; PAM sequence: CTT
gacttttacttttatttaag

SEQ ID NO: 53288 - DNA, 20 bp, Artificial Sequence
  Description of Artificial Sequence: Synthetic oligonucleotide
  Target: SCN10A; (-) strand; PAM type: YTN; PAM sequence: TTA
acttgacttttacttttatt

SEQ ID NO: 53289 - DNA, 20 bp, Artificial Sequence
  Description of Artificial Sequence: Synthetic oligonucleotide
  Target: SCN10A; (-) strand; PAM type: YTN; PAM sequence: TTT
aacttgacttttacttttat

SEQ ID NO: 53290 - DNA, 20 bp, Artificial Sequence
  Description of Artificial Sequence: Synthetic oligonucleotide
  Target: SCN10A; (-) strand; PAM type: YTN; PAM sequence: TTT
taacttgacttttactttta

SEQ ID NO: 53291 - DNA, 20 bp, Artificial Sequence
  Description of Artificial Sequence: Synthetic oligonucleotide
  Target: SCN10A; (-) strand; PAM type: YTN; PAM sequence: TTT
ttaacttgacttttactttt

SEQ ID NO: 53292 - DNA, 20 bp, Artificial Sequence
  Description of Artificial Sequence: Synthetic oligonucleotide
  Target: SCN10A; (-) strand; PAM type: YTN; PAM sequence: CTT
tttaacttgacttttacttt

SEQ ID NO: 53293 - DNA, 20 bp, Artificial Sequence
  Description of Artificial Sequence: Synthetic oligonucleotide
  Target: SCN10A; (-) strand; PAM type: YTN; PAM sequence: TTC
actttttaacttgactttta

SEQ ID NO: 53294 - DNA, 20 bp, Artificial Sequence
  Description of Artificial Sequence: Synthetic oligonucleotide
  Target: SCN10A; (-) strand; PAM type: YTN; PAM sequence: TTA
ttcactttttaacttgactt

SEQ ID NO: 53295 - DNA, 20 bp, Artificial Sequence
  Description of Artificial Sequence: Synthetic oligonucleotide
  Target: SCN10A; (-) strand; PAM type: YTN; PAM sequence: CTC
acagatgtgaaaaaaaatta

SEQ ID NO: 53296 - DNA, 20 bp, Artificial Sequence
  Description of Artificial Sequence: Synthetic oligonucleotide
  Target: SCN10A; (-) strand; PAM type: YTN; PAM sequence: CTC
tcacagatgtgaaaaaaaat

SEQ ID NO: 53297 - DNA, 20 bp, Artificial Sequence
  Description of Artificial Sequence: Synthetic oligonucleotide
  Target: SCN10A; (-) strand; PAM type: YTN; PAM sequence: CTC
ctctcacagatgtgaaaaaa

SEQ ID NO: 53298 - DNA, 20 bp, Artificial Sequence
  Description of Artificial Sequence: Synthetic oligonucleotide
  Target: SCN10A; (-) strand; PAM type: YTN; PAM sequence: TTC
tcctctcacagatgtgaaaa

SEQ ID NO: 53299 - DNA, 20 bp, Artificial Sequence
  Description of Artificial Sequence: Synthetic oligonucleotide
  Target: SCN10A; (-) strand; PAM type: YTN; PAM sequence: TTT
ctcctctcacagatgtgaaa

SEQ ID NO: 53300 - DNA, 20 bp, Artificial Sequence
  Description of Artificial Sequence: Synthetic oligonucleotide
  Target: SCN10A; (-) strand; PAM type: YTN; PAM sequence: TTC
aaacacgatttctcctctca

SEQ ID NO: 53301 - DNA, 20 bp, Artificial Sequence
  Description of Artificial Sequence: Synthetic oligonucleotide
  Target: SCN10A; (-) strand; PAM type: YTN; PAM sequence: TTT
caaacacgatttctcctctc

SEQ ID NO: 53302 - DNA, 20 bp, Artificial Sequence
  Description of Artificial Sequence: Synthetic oligonucleotide
  Target: SCN10A; (-) strand; PAM type: YTN; PAM sequence: CTA
aatgatttcaaacacgattt

SEQ ID NO: 53303 - DNA, 20 bp, Artificial Sequence
  Description of Artificial Sequence: Synthetic oligonucleotide
  Target: SCN10A; (-) strand; PAM type: YTN; PAM sequence: TTC
ctaaatgatttcaaacacga

SEQ ID NO: 53304 - DNA, 20 bp, Artificial Sequence
  Description of Artificial Sequence: Synthetic oligonucleotide
  Target: SCN10A; (-) strand; PAM type: YTN; PAM sequence: CTA
tgcaaccagatatagattcc

SEQ ID NO: 53305 - DNA, 20 bp, Artificial Sequence
  Description of Artificial Sequence: Synthetic oligonucleotide
  Target: SCN10A; (-) strand; PAM type: YTN; PAM sequence: CTC
aagcagctatgcaaccagat

SEQ ID NO: 53306 - DNA, 20 bp, Artificial Sequence
  Description of Artificial Sequence: Synthetic oligonucleotide
  Target: SCN10A; (-) strand; PAM type: YTN; PAM sequence: CTG
acagctcaagcagctatgca

SEQ ID NO: 53307 - DNA, 20 bp, Artificial Sequence
  Description of Artificial Sequence: Synthetic oligonucleotide
  Target: SCN10A; (-) strand; PAM type: YTN; PAM sequence: TTA
gaaaacataaagagtgtggg

SEQ ID NO: 53308 - DNA, 20 bp, Artificial Sequence
  Description of Artificial Sequence: Synthetic oligonucleotide
  Target: SCN10A; (-) strand; PAM type: YTN; PAM sequence: TTT
agaaaacataaagagtgtgg

SEQ ID NO: 53309 - DNA, 20 bp, Artificial Sequence
  Description of Artificial Sequence: Synthetic oligonucleotide
  Target: SCN10A; (-) strand; PAM type: YTN; PAM sequence: CTA
atttagaaaacataaagagt

SEQ ID NO: 53310 - DNA, 20 bp, Artificial Sequence
  Description of Artificial Sequence: Synthetic oligonucleotide
  Target: SCN10A; (-) strand; PAM type: YTN; PAM sequence: TTC
taatttagaaaacataaaga

SEQ ID NO: 53311 - DNA, 20 bp, Artificial Sequence
  Description of Artificial Sequence: Synthetic oligonucleotide
  Target: SCN10A; (-) strand; PAM type: YTN; PAM sequence: TTT
ctaatttagaaaacataaag

SEQ ID NO: 53312 - DNA, 20 bp, Artificial Sequence
  Description of Artificial Sequence: Synthetic oligonucleotide
  Target: SCN10A; (-) strand; PAM type: YTN; PAM sequence: TTT
tctaatttagaaaacataaa

SEQ ID NO: 53313 - DNA, 20 bp, Artificial Sequence
  Description of Artificial Sequence: Synthetic oligonucleotide
  Target: SCN10A; (-) strand; PAM type: YTN; PAM sequence: TTA
agattttctaatttagaaaa

SEQ ID NO: 53314 - DNA, 20 bp, Artificial Sequence
  Description of Artificial Sequence: Synthetic oligonucleotide
  Target: SCN10A; (-) strand; PAM type: YTN; PAM sequence: CTG
agttaagattttctaattta

SEQ ID NO: 53315 - DNA, 20 bp, Artificial Sequence
  Description of Artificial Sequence: Synthetic oligonucleotide
  Target: SCN10A; (-) strand; PAM type: YTN; PAM sequence: TTC
tgagttaagattttctaatt

SEQ ID NO: 53316 - DNA, 20 bp, Artificial Sequence
  Description of Artificial Sequence: Synthetic oligonucleotide
  Target: SCN10A; (-) strand; PAM type: YTN; PAM sequence: CTA
taattctgagttaagatttt

SEQ ID NO: 53317 - DNA, 20 bp, Artificial Sequence
  Description of Artificial Sequence: Synthetic oligonucleotide
  Target: SCN10A; (-) strand; PAM type: YTN; PAM sequence: TTC
ccaacaacctataattctga

SEQ ID NO: 53318 - DNA, 20 bp, Artificial Sequence
  Description of Artificial Sequence: Synthetic oligonucleotide
  Target: SCN10A; (-) strand; PAM type: YTN; PAM sequence: CTT
cccaacaacctataattctg

SEQ ID NO: 53319 - DNA, 20 bp, Artificial Sequence
  Description of Artificial Sequence: Synthetic oligonucleotide
  Target: SCN10A; (-) strand; PAM type: YTN; PAM sequence: TTG
acaaaccagaaatatccatc

SEQ ID NO: 53320 - DNA, 20 bp, Artificial Sequence
  Description of Artificial Sequence: Synthetic oligonucleotide
  Target: SCN10A; (-) strand; PAM type: YTN; PAM sequence: TTT
gacaaaccagaaatatccat

SEQ ID NO: 53321 - DNA, 20 bp, Artificial Sequence
  Description of Artificial Sequence: Synthetic oligonucleotide
  Target: SCN10A; (-) strand; PAM type: YTN; PAM sequence: TTG
atttgacaaaccagaaatat

SEQ ID NO: 53322 - DNA, 20 bp, Artificial Sequence
  Description of Artificial Sequence: Synthetic oligonucleotide
  Target: SCN10A; (-) strand; PAM type: YTN; PAM sequence: TTT
gatttgacaaaccagaaata

SEQ ID NO: 53323 - DNA, 20 bp, Artificial Sequence
  Description of Artificial Sequence: Synthetic oligonucleotide
  Target: SCN10A; (-) strand; PAM type: YTN; PAM sequence: CTG
tgtttgatttgacaaaccag

SEQ ID NO: 53324 - DNA, 20 bp, Artificial Sequence
  Description of Artificial Sequence: Synthetic oligonucleotide
  Target: SCN10A; (-) strand; PAM type: YTN; PAM sequence: CTG
ggtctgtgtttgatttgaca

SEQ ID NO: 53325 - DNA, 20 bp, Artificial Sequence
  Description of Artificial Sequence: Synthetic oligonucleotide
  Target: SCN10A; (-) strand; PAM type: YTN; PAM sequence: TTC
tgggtctgtgtttgatttga

SEQ ID NO: 53326 - DNA, 20 bp, Artificial Sequence
  Description of Artificial Sequence: Synthetic oligonucleotide
  Target: SCN10A; (-) strand; PAM type: YTN; PAM sequence: TTT
ctgggtctgtgtttgatttg

SEQ ID NO: 53327 - DNA, 20 bp, Artificial Sequence
  Description of Artificial Sequence: Synthetic oligonucleotide
  Target: SCN10A; (-) strand; PAM type: YTN; PAM sequence: CTC
cataatttctgggtctgtgt

SEQ ID NO: 53328 - DNA, 20 bp, Artificial Sequence
  Description of Artificial Sequence: Synthetic oligonucleotide
  Target: SCN10A; (-) strand; PAM type: YTN; PAM sequence: CTC
tccataatttctgggtctgt

SEQ ID NO: 53329 - DNA, 20 bp, Artificial Sequence
  Description of Artificial Sequence: Synthetic oligonucleotide
  Target: SCN10A; (-) strand; PAM type: YTN; PAM sequence: CTC
tctccataatttctgggtct

SEQ ID NO: 53330 - DNA, 20 bp, Artificial Sequence
  Description of Artificial Sequence: Synthetic oligonucleotide
  Target: SCN10A; (-) strand; PAM type: YTN; PAM sequence: TTA
gagagcactctctccataat

SEQ ID NO: 53331 - DNA, 20 bp, Artificial Sequence
  Description of Artificial Sequence: Synthetic oligonucleotide
  Target: SCN10A; (-) strand; PAM type: YTN; PAM sequence: TTT
agagagcactctctccataa

SEQ ID NO: 53332 - DNA, 20 bp, Artificial Sequence
  Description of Artificial Sequence: Synthetic oligonucleotide
  Target: SCN10A; (-) strand; PAM type: YTN; PAM sequence: CTT
tagagagcactctctccata

SEQ ID NO: 53333 - DNA, 20 bp, Artificial Sequence
  Description of Artificial Sequence: Synthetic oligonucleotide
  Target: SCN10A; (-) strand; PAM type: YTN; PAM sequence: CTG
aaaatagtctttagagagca

SEQ ID NO: 53334 - DNA, 20 bp, Artificial Sequence
  Description of Artificial Sequence: Synthetic oligonucleotide
  Target: SCN10A; (-) strand; PAM type: YTN; PAM sequence: CTG
gtgaagcactgaaaatagtc

SEQ ID NO: 53335 - DNA, 20 bp, Artificial Sequence
  Description of Artificial Sequence: Synthetic oligonucleotide
  Target: SCN10A; (-) strand; PAM type: YTN; PAM sequence: TTC
tggtgaagcactgaaaatag

SEQ ID NO: 53336 - DNA, 20 bp, Artificial Sequence
  Description of Artificial Sequence: Synthetic oligonucleotide
  Target: SCN10A; (-) strand; PAM type: YTN; PAM sequence: CTT
ctggtgaagcactgaaaata

SEQ ID NO: 53337 - DNA, 20 bp, Artificial Sequence
  Description of Artificial Sequence: Synthetic oligonucleotide
  Target: SCN10A; (-) strand; PAM type: YTN; PAM sequence: TTG
ccttctggtgaagcactgaa

SEQ ID NO: 53338 - DNA, 20 bp, Artificial Sequence
  Description of Artificial Sequence: Synthetic oligonucleotide
  Target: SCN10A; (-) strand; PAM type: YTN; PAM sequence: CTT
gccttctggtgaagcactga

SEQ ID NO: 53339 - DNA, 20 bp, Artificial Sequence
  Description of Artificial Sequence: Synthetic oligonucleotide
  Target: SCN10A; (-) strand; PAM type: YTN; PAM sequence: CTG
gggcacttgccttctggtga

SEQ ID NO: 53340 - DNA, 20 bp, Artificial Sequence
  Description of Artificial Sequence: Synthetic oligonucleotide
  Target: SCN10A; (-) strand; PAM type: YTN; PAM sequence: TTG
agctggggcacttgccttct

SEQ ID NO: 53341 - DNA, 20 bp, Artificial Sequence
  Description of Artificial Sequence: Synthetic oligonucleotide
  Target: SCN10A; (-) strand; PAM type: YTN; PAM sequence: CTG
ttgagctggggcacttgcct

SEQ ID NO: 53342 - DNA, 20 bp, Artificial Sequence
  Description of Artificial Sequence: Synthetic oligonucleotide
  Target: SCN10A; (-) strand; PAM type: YTN; PAM sequence: CTG
ctgttgagctggggcacttg

SEQ ID NO: 53343 - DNA, 20 bp, Artificial Sequence
  Description of Artificial Sequence: Synthetic oligonucleotide
  Target: SCN10A; (-) strand; PAM type: YTN; PAM sequence: TTA
gctgctgttgagctggggca

SEQ ID NO: 53344 - DNA, 20 bp, Artificial Sequence
  Description of Artificial Sequence: Synthetic oligonucleotide
  Target: SCN10A; (-) strand; PAM type: YTN; PAM sequence: CTC
cattagctgctgttgagctg

SEQ ID NO: 53345 - DNA, 20 bp, Artificial Sequence
  Description of Artificial Sequence: Synthetic oligonucleotide
  Target: SCN10A; (-) strand; PAM type: YTN; PAM sequence: TTG
cagagccaaataccaccaaa

SEQ ID NO: 53346 - DNA, 20 bp, Artificial Sequence
  Description of Artificial Sequence: Synthetic oligonucleotide
  Target: SCN10A; (-) strand; PAM type: YTN; PAM sequence: CTT
gcagagccaaataccaccaa

SEQ ID NO: 53347 - DNA, 20 bp, Artificial Sequence
  Description of Artificial Sequence: Synthetic oligonucleotide
  Target: SCN10A; (-) strand; PAM type: YTN; PAM sequence: CTG
caacccaacatcaagaaata

SEQ ID NO: 53348 - DNA, 20 bp, Artificial Sequence
  Description of Artificial Sequence: Synthetic oligonucleotide
  Target: SCN10A; (-) strand; PAM type: YTN; PAM sequence: CTG
aatgctgcaacccaacatca

SEQ ID NO: 53349 - DNA, 20 bp, Artificial Sequence
  Description of Artificial Sequence: Synthetic oligonucleotide
  Target: SCN10A; (-) strand; PAM type: YTN; PAM sequence: TTA
catctgaatgctgcaaccca

SEQ ID NO: 53350 - DNA, 20 bp, Artificial Sequence
  Description of Artificial Sequence: Synthetic oligonucleotide
  Target: SCN10A; (-) strand; PAM type: YTN; PAM sequence: TTA
aaaattacatctgaatgctg

SEQ ID NO: 53351 - DNA, 20 bp, Artificial Sequence
  Description of Artificial Sequence: Synthetic oligonucleotide
  Target: SCN10A; (-) strand; PAM type: YTN; PAM sequence: TTA
ttaaaaattacatctgaatg

SEQ ID NO: 53352 - DNA, 20 bp, Artificial Sequence
  Description of Artificial Sequence: Synthetic oligonucleotide
  Target: SCN10A; (-) strand; PAM type: YTN; PAM sequence: CTT
attaaaaattacatctgaat

SEQ ID NO: 53353 - DNA, 20 bp, Artificial Sequence
  Description of Artificial Sequence: Synthetic oligonucleotide
  Target: SCN10A; (-) strand; PAM type: YTN; PAM sequence: TTG
ggcttattaaaaattacatc

SEQ ID NO: 53354 - DNA, 20 bp, Artificial Sequence
  Description of Artificial Sequence: Synthetic oligonucleotide
  Target: SCN10A; (-) strand; PAM type: YTN; PAM sequence: TTA
ggaaataacacattgggctt

SEQ ID NO: 53355 - DNA, 20 bp, Artificial Sequence
  Description of Artificial Sequence: Synthetic oligonucleotide
  Target: SCN10A; (-) strand; PAM type: YTN; PAM sequence: CTT
aggaaataacacattgggct

SEQ ID NO: 53356 - DNA, 20 bp, Artificial Sequence
  Description of Artificial Sequence: Synthetic oligonucleotide
  Target: SCN10A; (-) strand; PAM type: YTN; PAM sequence: TTC
accagaaaaagcacttagga

SEQ ID NO: 53357 - DNA, 20 bp, Artificial Sequence
  Description of Artificial Sequence: Synthetic oligonucleotide
  Target: SCN10A; (-) strand; PAM type: YTN; PAM sequence: TTC
attcaccagaaaaagcactt

SEQ ID NO: 53358 - DNA, 20 bp, Artificial Sequence
  Description of Artificial Sequence: Synthetic oligonucleotide
  Target: SCN10A; (-) strand; PAM type: YTN; PAM sequence: CTT
cattcaccagaaaaagcact

SEQ ID NO: 53359 - DNA, 20 bp, Artificial Sequence
  Description of Artificial Sequence: Synthetic oligonucleotide
  Target: SCN10A; (-) strand; PAM type: YTN; PAM sequence: TTC
ttcattcaccagaaaaagca

SEQ ID NO: 53360 - DNA, 20 bp, Artificial Sequence
  Description of Artificial Sequence: Synthetic oligonucleotide
  Target: SCN10A; (-) strand; PAM type: YTN; PAM sequence: TTT
cttcattcaccagaaaaagc

SEQ ID NO: 53361 - DNA, 20 bp, Artificial Sequence
  Description of Artificial Sequence: Synthetic oligonucleotide
  Target: SCN10A; (-) strand; PAM type: YTN; PAM sequence: TTT
tcttcattcaccagaaaaag

SEQ ID NO: 53362 - DNA, 20 bp, Artificial Sequence
  Description of Artificial Sequence: Synthetic oligonucleotide
  Target: SCN10A; (-) strand; PAM type: YTN; PAM sequence: TTC
ccaatacccaatgattttct

SEQ ID NO: 53363 - DNA, 20 bp, Artificial Sequence
  Description of Artificial Sequence: Synthetic oligonucleotide
  Target: SCN10A; (-) strand; PAM type: YTN; PAM sequence: TTT
cccaatacccaatgattttc

SEQ ID NO: 53364 - DNA, 20 bp, Artificial Sequence
  Description of Artificial Sequence: Synthetic oligonucleotide
  Target: SCN10A; (-) strand; PAM type: YTN; PAM sequence: TTT
tcccaatacccaatgatttt

SEQ ID NO: 53365 - DNA, 20 bp, Artificial Sequence
  Description of Artificial Sequence: Synthetic oligonucleotide
  Target: SCN10A; (-) strand; PAM type: YTN; PAM sequence: TTT
ttcccaatacccaatgattt

SEQ ID NO: 53366 - DNA, 20 bp, Artificial Sequence
  Description of Artificial Sequence: Synthetic oligonucleotide
  Target: SCN10A; (-) strand; PAM type: YTN; PAM sequence: CTT
tttcccaatacccaatgatt

SEQ ID NO: 53367 - DNA, 20 bp, Artificial Sequence
  Description of Artificial Sequence: Synthetic oligonucleotide
  Target: SCN10A; (-) strand; PAM type: YTN; PAM sequence: TTG
actttttcccaatacccaat

SEQ ID NO: 53368 - DNA, 20 bp, Artificial Sequence
  Description of Artificial Sequence: Synthetic oligonucleotide
  Target: SCN10A; (-) strand; PAM type: YTN; PAM sequence: CTT
gactttttcccaatacccaa

SEQ ID NO: 53369 - DNA, 20 bp, Artificial Sequence
  Description of Artificial Sequence: Synthetic oligonucleotide
  Target: SCN10A; (-) strand; PAM type: YTN; PAM sequence: CTG
agaacttgactttttcccaa

SEQ ID NO: 53370 - DNA, 20 bp, Artificial Sequence
  Description of Artificial Sequence: Synthetic oligonucleotide
  Target: SCN10A; (-) strand; PAM type: YTN; PAM sequence: CTC
aacggctgagaacttgactt

SEQ ID NO: 53371 - DNA, 20 bp, Artificial Sequence
  Description of Artificial Sequence: Synthetic oligonucleotide
  Target: SCN10A; (-) strand; PAM type: YTN; PAM sequence: TTG
taacaatcagacatcagtgg

SEQ ID NO: 53372 - DNA, 20 bp, Artificial Sequence
  Description of Artificial Sequence: Synthetic oligonucleotide
  Target: SCN10A; (-) strand; PAM type: YTN; PAM sequence: TTT
gtaacaatcagacatcagtg

SEQ ID NO: 53373 - DNA, 20 bp, Artificial Sequence
  Description of Artificial Sequence: Synthetic oligonucleotide
  Target: SCN10A; (-) strand; PAM type: YTN; PAM sequence: CTG
aatatcgggatttgtaacaa

SEQ ID NO: 53374 - DNA, 20 bp, Artificial Sequence
  Description of Artificial Sequence: Synthetic oligonucleotide
  Target: SCN10A; (-) strand; PAM type: YTN; PAM sequence: TTC
agagcctgaatatcgggatt

SEQ ID NO: 53375 - DNA, 20 bp, Artificial Sequence
  Description of Artificial Sequence: Synthetic oligonucleotide
  Target: SCN10A; (-) strand; PAM type: YTN; PAM sequence: TTT
cagagcctgaatatcgggat

SEQ ID NO: 53376 - DNA, 20 bp, Artificial Sequence
  Description of Artificial Sequence: Synthetic oligonucleotide
  Target: SCN10A; (-) strand; PAM type: YTN; PAM sequence: TTT
tcagagcctgaatatcggga

SEQ ID NO: 53377 - DNA, 20 bp, Artificial Sequence
  Description of Artificial Sequence: Synthetic oligonucleotide
  Target: SCN10A; (-) strand; PAM type: YTN; PAM sequence: TTG
ttttcagagcctgaatatcg

SEQ ID NO: 53378 - DNA, 20 bp, Artificial Sequence
  Description of Artificial Sequence: Synthetic oligonucleotide
  Target: SCN10A; (-) strand; PAM type: YTN; PAM sequence: TTT
gttttcagagcctgaatatc

SEQ ID NO: 53379 - DNA, 20 bp, Artificial Sequence
  Description of Artificial Sequence: Synthetic oligonucleotide
  Target: SCN10A; (-) strand; PAM type: YTN; PAM sequence: CTT
tgttttcagagcctgaatat

SEQ ID NO: 53380 - DNA, 20 bp, Artificial Sequence
  Description of Artificial Sequence: Synthetic oligonucleotide
  Target: SCN10A; (-) strand; PAM type: YTN; PAM sequence: TTA
tgaatctttgttttcagagc

SEQ ID NO: 53381 - DNA, 20 bp, Artificial Sequence
  Description of Artificial Sequence: Synthetic oligonucleotide
  Target: SCN10A; (-) strand; PAM type: YTN; PAM sequence: TTG
aatattatgaatctttgttt

SEQ ID NO: 53382 - DNA, 20 bp, Artificial Sequence
  Description of Artificial Sequence: Synthetic oligonucleotide
  Target: SCN10A; (-) strand; PAM type: YTN; PAM sequence: TTT
gaatattatgaatctttgtt

SEQ ID NO: 53383 - DNA, 20 bp, Artificial Sequence
  Description of Artificial Sequence: Synthetic oligonucleotide
  Target: SCN10A; (-) strand; PAM type: YTN; PAM sequence: TTC
agaatttgaatattatgaat

SEQ ID NO: 53384 - DNA, 20 bp, Artificial Sequence
  Description of Artificial Sequence: Synthetic oligonucleotide
  Target: SCN10A; (-) strand; PAM type: YTN; PAM sequence: CTC
agtgatccattcagaatttg

SEQ ID NO: 53385 - DNA, 20 bp, Artificial Sequence
  Description of Artificial Sequence: Synthetic oligonucleotide
  Target: SCN10A; (-) strand; PAM type: YTN; PAM sequence: TTG
ggtatctcagtgatccattc

SEQ ID NO: 53386 - DNA, 20 bp, Artificial Sequence
  Description of Artificial Sequence: Synthetic oligonucleotide
  Target: SCN10A; (-) strand; PAM type: YTN; PAM sequence: TTA
tgaatacaagttgggtatct

SEQ ID NO: 53387 - DNA, 20 bp, Artificial Sequence
  Description of Artificial Sequence: Synthetic oligonucleotide
  Target: SCN10A; (-) strand; PAM type: YTN; PAM sequence: TTT
atgaatacaagttgggtatc

SEQ ID NO: 53388 - DNA, 20 bp, Artificial Sequence
  Description of Artificial Sequence: Synthetic oligonucleotide
  Target: SCN10A; (-) strand; PAM type: YTN; PAM sequence: TTT
tatgaatacaagttgggtat

SEQ ID NO: 53389 - DNA, 20 bp, Artificial Sequence
  Description of Artificial Sequence: Synthetic oligonucleotide
  Target: SCN10A; (-) strand; PAM type: YTN; PAM sequence: TTT
ttatgaatacaagttgggta

SEQ ID NO: 53390 - DNA, 20 bp, Artificial Sequence
  Description of Artificial Sequence: Synthetic oligonucleotide
  Target: SCN10A; (-) strand; PAM type: YTN; PAM sequence: TTA
ccatttttatgaatacaagt

SEQ ID NO: 53391 - DNA, 20 bp, Artificial Sequence
  Description of Artificial Sequence: Synthetic oligonucleotide
  Target: SCN10A; (-) strand; PAM type: YTN; PAM sequence: TTA
aattaccatttttatgaata

SEQ ID NO: 53392 - DNA, 20 bp, Artificial Sequence
  Description of Artificial Sequence: Synthetic oligonucleotide
  Target: SCN10A; (-) strand; PAM type: YTN; PAM sequence: TTT
aaattaccatttttatgaat

SEQ ID NO: 53393 - DNA, 20 bp, Artificial Sequence
  Description of Artificial Sequence: Synthetic oligonucleotide
  Target: SCN10A; (-) strand; PAM type: YTN; PAM sequence: TTT
taaattaccatttttatgaa

SEQ ID NO: 53394 - DNA, 20 bp, Artificial Sequence
  Description of Artificial Sequence: Synthetic oligonucleotide
  Target: SCN10A; (-) strand; PAM type: YTN; PAM sequence: TTA
aaaataaggaatgaaatgtt

SEQ ID NO: 53395 - DNA, 20 bp, Artificial Sequence
  Description of Artificial Sequence: Synthetic oligonucleotide
  Target: SCN10A; (-) strand; PAM type: YTN; PAM sequence: TTT
aaaaataaggaatgaaatgt

SEQ ID NO: 53396 - DNA, 20 bp, Artificial Sequence
  Description of Artificial Sequence: Synthetic oligonucleotide
  Target: SCN10A; (-) strand; PAM type: YTN; PAM sequence: TTT
taaaaataaggaatgaaatg

SEQ ID NO: 53397 - DNA, 20 bp, Artificial Sequence
  Description of Artificial Sequence: Synthetic oligonucleotide
  Target: SCN10A; (-) strand; PAM type: YTN; PAM sequence: TTA
cacagagttttaaaaataag

SEQ ID NO: 53398 - DNA, 20 bp, Artificial Sequence
  Description of Artificial Sequence: Synthetic oligonucleotide
  Target: SCN10A; (-) strand; PAM type: YTN; PAM sequence: CTT
acacagagttttaaaaataa

SEQ ID NO: 53399 - DNA, 20 bp, Artificial Sequence
  Description of Artificial Sequence: Synthetic oligonucleotide
  Target: SCN10A; (-) strand; PAM type: YTN; PAM sequence: CTG
gcaaatgggaagggcttaca

SEQ ID NO: 53400 - DNA, 20 bp, Artificial Sequence
  Description of Artificial Sequence: Synthetic oligonucleotide
  Target: SCN10A; (-) strand; PAM type: YTN; PAM sequence: TTG
gctggcaaatgggaagggct

SEQ ID NO: 53401 - DNA, 20 bp, Artificial Sequence
  Description of Artificial Sequence: Synthetic oligonucleotide
  Target: SCN10A; (-) strand; PAM type: YTN; PAM sequence: TTT
ggctggcaaatgggaagggc

SEQ ID NO: 53402 - DNA, 20 bp, Artificial Sequence
  Description of Artificial Sequence: Synthetic oligonucleotide
  Target: SCN10A; (-) strand; PAM type: YTN; PAM sequence: CTT
tggctggcaaatgggaaggg

SEQ ID NO: 53403 - DNA, 20 bp, Artificial Sequence
  Description of Artificial Sequence: Synthetic oligonucleotide
  Target: SCN10A; (-) strand; PAM type: YTN; PAM sequence: TTG
ctttggctggcaaatgggaa

SEQ ID NO: 53404 - DNA, 20 bp, Artificial Sequence
  Description of Artificial Sequence: Synthetic oligonucleotide
  Target: SCN10A; (-) strand; PAM type: YTN; PAM sequence: CTG
aattgctttggctggcaaat

SEQ ID NO: 53405 - DNA, 20 bp, Artificial Sequence
  Description of Artificial Sequence: Synthetic oligonucleotide
  Target: SCN10A; (-) strand; PAM type: YTN; PAM sequence: CTC
ccacactgaattgctttggc

SEQ ID NO: 53406 - DNA, 20 bp, Artificial Sequence
  Description of Artificial Sequence: Synthetic oligonucleotide
  Target: SCN10A; (-) strand; PAM type: YTN; PAM sequence: CTC
tcccacactgaattgctttg

SEQ ID NO: 53407 - DNA, 20 bp, Artificial Sequence
  Description of Artificial Sequence: Synthetic oligonucleotide
  Target: SCN10A; (-) strand; PAM type: YTN; PAM sequence: CTG
ctctcccacactgaattgct

SEQ ID NO: 53408 - DNA, 20 bp, Artificial Sequence
  Description of Artificial Sequence: Synthetic oligonucleotide
  Target: SCN10A; (-) strand; PAM type: YTN; PAM sequence: CTG
aaatgaaaagtgagtaagag

SEQ ID NO: 53409 - DNA, 20 bp, Artificial Sequence
  Description of Artificial Sequence: Synthetic oligonucleotide
  Target: SCN10A; (-) strand; PAM type: YTN; PAM sequence: CTG
ggctgaaatgaaaagtgagt

SEQ ID NO: 53410 - DNA, 20 bp, Artificial Sequence
  Description of Artificial Sequence: Synthetic oligonucleotide
  Target: SCN10A; (-) strand; PAM type: YTN; PAM sequence: CTA
ctgggctgaaatgaaaagtg

SEQ ID NO: 53411 - DNA, 20 bp, Artificial Sequence
  Description of Artificial Sequence: Synthetic oligonucleotide
  Target: SCN10A; (-) strand; PAM type: YTN; PAM sequence: TTG
gcctactgggctgaaatgaa

SEQ ID NO: 53412 - DNA, 20 bp, Artificial Sequence
  Description of Artificial Sequence: Synthetic oligonucleotide
  Target: SCN10A; (-) strand; PAM type: YTN; PAM sequence: TTT
ggcctactgggctgaaatga

SEQ ID NO: 53413 - DNA, 20 bp, Artificial Sequence
  Description of Artificial Sequence: Synthetic oligonucleotide
  Target: SCN10A; (-) strand; PAM type: YTN; PAM sequence: CTT
tggcctactgggctgaaatg

SEQ ID NO: 53414 - DNA, 20 bp, Artificial Sequence
  Description of Artificial Sequence: Synthetic oligonucleotide
  Target: SCN10A; (-) strand; PAM type: YTN; PAM sequence: CTC
tttggcctactgggctgaaa

SEQ ID NO: 53415 - DNA, 20 bp, Artificial Sequence
  Description of Artificial Sequence: Synthetic oligonucleotide
  Target: SCN10A; (-) strand; PAM type: YTN; PAM sequence: TTA
gtgtacatctctttggccta

SEQ ID NO: 53416 - DNA, 20 bp, Artificial Sequence
  Description of Artificial Sequence: Synthetic oligonucleotide
  Target: SCN10A; (-) strand; PAM type: YTN; PAM sequence: CTT
agtgtacatctctttggcct

SEQ ID NO: 53417 - DNA, 20 bp, Artificial Sequence
  Description of Artificial Sequence: Synthetic oligonucleotide
  Target: SCN10A; (-) strand; PAM type: YTN; PAM sequence: TTG
tggtcacttagtgtacatct

SEQ ID NO: 53418 - DNA, 20 bp, Artificial Sequence
  Description of Artificial Sequence: Synthetic oligonucleotide
  Target: SCN10A; (-) strand; PAM type: YTN; PAM sequence: CTG
attgtggtcacttagtgtac

SEQ ID NO: 53419 - DNA, 20 bp, Artificial Sequence
  Description of Artificial Sequence: Synthetic oligonucleotide
  Target: SCN10A; (-) strand; PAM type: YTN; PAM sequence: TTG
tgaatacaaactgattgtgg

SEQ ID NO: 53420 - DNA, 20 bp, Artificial Sequence
  Description of Artificial Sequence: Synthetic oligonucleotide
  Target: SCN10A; (-) strand; PAM type: YTN; PAM sequence: TTG
aggtacacagtggaaattgt

SEQ ID NO: 53421 - DNA, 20 bp, Artificial Sequence
  Description of Artificial Sequence: Synthetic oligonucleotide
  Target: SCN10A; (-) strand; PAM type: YTN; PAM sequence: CTG
ttgaggtacacagtggaaat

SEQ ID NO: 53422 - DNA, 20 bp, Artificial Sequence
  Description of Artificial Sequence: Synthetic oligonucleotide
  Target: SCN10A; (-) strand; PAM type: YTN; PAM sequence: TTG
ctgttgaggtacacagtgga

SEQ ID NO: 53423 - DNA, 20 bp, Artificial Sequence
  Description of Artificial Sequence: Synthetic oligonucleotide
  Target: SCN10A; (-) strand; PAM type: YTN; PAM sequence: TTT
gctgttgaggtacacagtgg

SEQ ID NO: 53424 - DNA, 20 bp, Artificial Sequence
  Description of Artificial Sequence: Synthetic oligonucleotide
  Target: SCN10A; (-) strand; PAM type: YTN; PAM sequence: CTG
atttgctgttgaggtacaca

SEQ ID NO: 53425 - DNA, 20 bp, Artificial Sequence
  Description of Artificial Sequence: Synthetic oligonucleotide
  Target: SCN10A; (-) strand; PAM type: YTN; PAM sequence: TTC
tgatttgctgttgaggtaca

SEQ ID NO: 53426 - DNA, 20 bp, Artificial Sequence
  Description of Artificial Sequence: Synthetic oligonucleotide
  Target: SCN10A; (-) strand; PAM type: YTN; PAM sequence: CTC
cagattctgatttgctgttg

SEQ ID NO: 53427 - DNA, 20 bp, Artificial Sequence
  Description of Artificial Sequence: Synthetic oligonucleotide
  Target: SCN10A; (-) strand; PAM type: YTN; PAM sequence: CTG
taatatgcctccagattctg

SEQ ID NO: 53428 - DNA, 20 bp, Artificial Sequence
  Description of Artificial Sequence: Synthetic oligonucleotide
  Target: SCN10A; (-) strand; PAM type: YTN; PAM sequence: CTG
ggggtctgtaatatgcctcc

SEQ ID NO: 53429 - DNA, 20 bp, Artificial Sequence
  Description of Artificial Sequence: Synthetic oligonucleotide
  Target: SCN10A; (-) strand; PAM type: YTN; PAM sequence: TTC
acggaacgcagctgggggtc

SEQ ID NO: 53430 - DNA, 20 bp, Artificial Sequence
  Description of Artificial Sequence: Synthetic oligonucleotide
  Target: SCN10A; (-) strand; PAM type: YTN; PAM sequence: TTA
ttcacggaacgcagctgggg

SEQ ID NO: 53431 - DNA, 20 bp, Artificial Sequence
  Description of Artificial Sequence: Synthetic oligonucleotide
  Target: SCN10A; (-) strand; PAM type: YTN; PAM sequence: CTT
attcacggaacgcagctggg

SEQ ID NO: 53432 - DNA, 20 bp, Artificial Sequence
  Description of Artificial Sequence: Synthetic oligonucleotide
  Target: SCN10A; (-) strand; PAM type: YTN; PAM sequence: CTA
gtgcataccttattcacgga

SEQ ID NO: 53433 - DNA, 20 bp, Artificial Sequence
  Description of Artificial Sequence: Synthetic oligonucleotide
  Target: SCN10A; (-) strand; PAM type: YTN; PAM sequence: CTC
ccagatcccaatgctagtgc

SEQ ID NO: 53434 - DNA, 20 bp, Artificial Sequence
  Description of Artificial Sequence: Synthetic oligonucleotide
  Target: SCN10A; (-) strand; PAM type: YTN; PAM sequence: CTG
ctcccagatcccaatgctag

SEQ ID NO: 53435 - DNA, 20 bp, Artificial Sequence
  Description of Artificial Sequence: Synthetic oligonucleotide
  Target: SCN10A; (-) strand; PAM type: YTN; PAM sequence: CTA
tccagatagaagatgctgct

SEQ ID NO: 53436 - DNA, 20 bp, Artificial Sequence
  Description of Artificial Sequence: Synthetic oligonucleotide
  Target: SCN10A; (-) strand; PAM type: YTN; PAM sequence: CTC
cagccacatggtcagcaagg

SEQ ID NO: 53437 - DNA, 20 bp, Artificial Sequence
  Description of Artificial Sequence: Synthetic oligonucleotide
  Target: SCN10A; (-) strand; PAM type: YTN; PAM sequence: TTG
aagaaactccagccacatgg

SEQ ID NO: 53438 - DNA, 20 bp, Artificial Sequence
  Description of Artificial Sequence: Synthetic oligonucleotide
  Target: SCN10A; (-) strand; PAM type: YTN; PAM sequence: TTG
ccattgaagaaactccagcc

SEQ ID NO: 53439 - DNA, 20 bp, Artificial Sequence
  Description of Artificial Sequence: Synthetic oligonucleotide
  Target: SCN10A; (-) strand; PAM type: YTN; PAM sequence: TTA
aattgccattgaagaaactc

SEQ ID NO: 53440 - DNA, 20 bp, Artificial Sequence
  Description of Artificial Sequence: Synthetic oligonucleotide
  Target: SCN10A; (-) strand; PAM type: YTN; PAM sequence: TTA
aaagaggaaaggtgttaaat

SEQ ID NO: 53441 - DNA, 20 bp, Artificial Sequence
  Description of Artificial Sequence: Synthetic oligonucleotide
  Target: SCN10A; (-) strand; PAM type: YTN; PAM sequence: TTT
aaaagaggaaaggtgttaaa

SEQ ID NO: 53442 - DNA, 20 bp, Artificial Sequence
  Description of Artificial Sequence: Synthetic oligonucleotide
  Target: SCN10A; (-) strand; PAM type: YTN; PAM sequence: TTT
taaaagaggaaaggtgttaa

SEQ ID NO: 53443 - DNA, 20 bp, Artificial Sequence
  Description of Artificial Sequence: Synthetic oligonucleotide
  Target: SCN10A; (-) strand; PAM type: YTN; PAM sequence: TTT
ttaaaagaggaaaggtgtta

SEQ ID NO: 53444 - DNA, 20 bp, Artificial Sequence
  Description of Artificial Sequence: Synthetic oligonucleotide
  Target: SCN10A; (-) strand; PAM type: YTN; PAM sequence: TTT
tttaaaagaggaaaggtgtt

SEQ ID NO: 53445 - DNA, 20 bp, Artificial Sequence
  Description of Artificial Sequence: Synthetic oligonucleotide
  Target: SCN10A; (-) strand; PAM type: YTN; PAM sequence: TTT
ttttaaaagaggaaaggtgt

SEQ ID NO: 53446 - DNA, 20 bp, Artificial Sequence
  Description of Artificial Sequence: Synthetic oligonucleotide
  Target: SCN10A; (-) strand; PAM type: YTN; PAM sequence: TTT
tttttaaaagaggaaaggtg

SEQ ID NO: 53447 - DNA, 20 bp, Artificial Sequence
  Description of Artificial Sequence: Synthetic oligonucleotide
  Target: SCN10A; (-) strand; PAM type: YTN; PAM sequence: CTT
ttttttaaaagaggaaaggt

SEQ ID NO: 53448 - DNA, 20 bp, Artificial Sequence
  Description of Artificial Sequence: Synthetic oligonucleotide
  Target: SCN10A; (-) strand; PAM type: YTN; PAM sequence: TTA
ccaaaacttttttttaaaag

SEQ ID NO: 53449 - DNA, 20 bp, Artificial Sequence
  Description of Artificial Sequence: Synthetic oligonucleotide
  Target: SCN10A; (-) strand; PAM type: YTN; PAM sequence: TTT
accaaaacttttttttaaaa

SEQ ID NO: 53450 - DNA, 20 bp, Artificial Sequence
  Description of Artificial Sequence: Synthetic oligonucleotide
  Target: SCN10A; (-) strand; PAM type: YTN; PAM sequence: TTT
taccaaaacttttttttaaa

SEQ ID NO: 53451 - DNA, 20 bp, Artificial Sequence
  Description of Artificial Sequence: Synthetic oligonucleotide
  Target: SCN10A; (-) strand; PAM type: YTN; PAM sequence: TTA
tgcatattttaccaaaactt

SEQ ID NO: 53452 - DNA, 20 bp, Artificial Sequence
  Description of Artificial Sequence: Synthetic oligonucleotide
  Target: SCN10A; (-) strand; PAM type: YTN; PAM sequence: TTA
tgtatattatgcatatttta

SEQ ID NO: 53453 - DNA, 20 bp, Artificial Sequence
  Description of Artificial Sequence: Synthetic oligonucleotide
  Target: SCN10A; (-) strand; PAM type: YTN; PAM sequence: TTA
tgttatgtatattatgcata

SEQ ID NO: 53454 - DNA, 20 bp, Artificial Sequence
  Description of Artificial Sequence: Synthetic oligonucleotide
  Target: SCN10A; (-) strand; PAM type: YTN; PAM sequence: TTT
atgttatgtatattatgcat

SEQ ID NO: 53455 - DNA, 20 bp, Artificial Sequence
  Description of Artificial Sequence: Synthetic oligonucleotide
  Target: SCN10A; (-) strand; PAM type: YTN; PAM sequence: TTT
tatgttatgtatattatgca

SEQ ID NO: 53456 - DNA, 20 bp, Artificial Sequence
  Description of Artificial Sequence: Synthetic oligonucleotide
  Target: SCN10A; (-) strand; PAM type: YTN; PAM sequence: TTA
aaaatggtgaaagtggtaaa

SEQ ID NO: 53457 - DNA, 20 bp, Artificial Sequence
  Description of Artificial Sequence: Synthetic oligonucleotide
  Target: SCN10A; (-) strand; PAM type: YTN; PAM sequence: CTT
aaaaatggtgaaagtggtaa

SEQ ID NO: 53458 - DNA, 20 bp, Artificial Sequence
  Description of Artificial Sequence: Synthetic oligonucleotide
  Target: SCN10A; (-) strand; PAM type: YTN; PAM sequence: TTG
tgtacttaaaaatggtgaaa

SEQ ID NO: 53459 - DNA, 20 bp, Artificial Sequence
  Description of Artificial Sequence: Synthetic oligonucleotide
  Target: SCN10A; (-) strand; PAM type: YTN; PAM sequence: CTA
aattgtgtacttaaaaatgg

SEQ ID NO: 53460 - DNA, 20 bp, Artificial Sequence
  Description of Artificial Sequence: Synthetic oligonucleotide
  Target: SCN10A; (-) strand; PAM type: YTN; PAM sequence: TTA
atgccactaaattgtgtact

SEQ ID NO: 53461 - DNA, 20 bp, Artificial Sequence
  Description of Artificial Sequence: Synthetic oligonucleotide
  Target: SCN10A; (-) strand; PAM type: YTN; PAM sequence: CTT
aatgccactaaattgtgtac

SEQ ID NO: 53462 - DNA, 20 bp, Artificial Sequence
  Description of Artificial Sequence: Synthetic oligonucleotide
  Target: SCN10A; (-) strand; PAM type: YTN; PAM sequence: CTG
aatgtacttaatgccactaa

SEQ ID NO: 53463 - DNA, 20 bp, Artificial Sequence
  Description of Artificial Sequence: Synthetic oligonucleotide
  Target: SCN10A; (-) strand; PAM type: YTN; PAM sequence: TTC
cacaatactgaatgtactta

SEQ ID NO: 53464 - DNA, 20 bp, Artificial Sequence
  Description of Artificial Sequence: Synthetic oligonucleotide
  Target: SCN10A; (-) strand; PAM type: YTN; PAM sequence: TTG
gaaacagatagtggtgatag

SEQ ID NO: 53465 - DNA, 20 bp, Artificial Sequence
  Description of Artificial Sequence: Synthetic oligonucleotide
  Target: SCN10A; (-) strand; PAM type: YTN; PAM sequence: TTT
ggaaacagatagtggtgata

SEQ ID NO: 53466 - DNA, 20 bp, Artificial Sequence
  Description of Artificial Sequence: Synthetic oligonucleotide
  Target: SCN10A; (-) strand; PAM type: YTN; PAM sequence: TTA
taaaaaagtttggaaacaga

SEQ ID NO: 53467 - DNA, 20 bp, Artificial Sequence
  Description of Artificial Sequence: Synthetic oligonucleotide
  Target: SCN10A; (-) strand; PAM type: YTN; PAM sequence: TTC
gggattataaaaaagtttgg

SEQ ID NO: 53468 - DNA, 20 bp, Artificial Sequence
  Description of Artificial Sequence: Synthetic oligonucleotide
  Target: SCN10A; (-) strand; PAM type: YTN; PAM sequence: CTG
ttcgggattataaaaaagtt

SEQ ID NO: 53469 - DNA, 20 bp, Artificial Sequence
  Description of Artificial Sequence: Synthetic oligonucleotide
  Target: SCN10A; (-) strand; PAM type: YTN; PAM sequence: TTC
tgttcgggattataaaaaag

SEQ ID NO: 53470 - DNA, 20 bp, Artificial Sequence
  Description of Artificial Sequence: Synthetic oligonucleotide
  Target: SCN10A; (-) strand; PAM type: YTN; PAM sequence: TTT
ctgttcgggattataaaaaa

SEQ ID NO: 53471 - DNA, 20 bp, Artificial Sequence
  Description of Artificial Sequence: Synthetic oligonucleotide
  Target: SCN10A; (-) strand; PAM type: YTN; PAM sequence: TTA
atgggtacatttctgttcgg

SEQ ID NO: 53472 - DNA, 20 bp, Artificial Sequence
  Description of Artificial Sequence: Synthetic oligonucleotide
  Target: SCN10A; (-) strand; PAM type: YTN; PAM sequence: TTT
aatgggtacatttctgttcg

SEQ ID NO: 53473 - DNA, 20 bp, Artificial Sequence
  Description of Artificial Sequence: Synthetic oligonucleotide
  Target: SCN10A; (-) strand; PAM type: YTN; PAM sequence: TTA
tttaatgggtacatttctgt

SEQ ID NO: 53474 - DNA, 20 bp, Artificial Sequence
  Description of Artificial Sequence: Synthetic oligonucleotide
  Target: SCN10A; (-) strand; PAM type: YTN; PAM sequence: TTA
ttatttaatgggtacatttc

SEQ ID NO: 53475 - DNA, 20 bp, Artificial Sequence
  Description of Artificial Sequence: Synthetic oligonucleotide
  Target: SCN10A; (-) strand; PAM type: YTN; PAM sequence: TTG
ccagagagggggaatgggga

SEQ ID NO: 53476 - DNA, 20 bp, Artificial Sequence
  Description of Artificial Sequence: Synthetic oligonucleotide
  Target: SCN10A; (-) strand; PAM type: YTN; PAM sequence: TTC
atggagacagaaagtagaat

SEQ ID NO: 53477 - DNA, 20 bp, Artificial Sequence
  Description of Artificial Sequence: Synthetic oligonucleotide
  Target: SCN10A; (-) strand; PAM type: YTN; PAM sequence: CTA
gaacaggcaaattcatggag

SEQ ID NO: 53478 - DNA, 20 bp, Artificial Sequence
  Description of Artificial Sequence: Synthetic oligonucleotide
  Target: SCN10A; (-) strand; PAM type: YTN; PAM sequence: TTA
gtaggtacctagaacaggca

SEQ ID NO: 53479 - DNA, 20 bp, Artificial Sequence
  Description of Artificial Sequence: Synthetic oligonucleotide
  Target: SCN10A; (-) strand; PAM type: YTN; PAM sequence: TTT
agtaggtacctagaacaggc

SEQ ID NO: 53480 - DNA, 20 bp, Artificial Sequence
  Description of Artificial Sequence: Synthetic oligonucleotide
  Target: SCN10A; (-) strand; PAM type: YTN; PAM sequence: CTT
tagtaggtacctagaacagg

SEQ ID NO: 53481 - DNA, 20 bp, Artificial Sequence
  Description of Artificial Sequence: Synthetic oligonucleotide
  Target: SCN10A; (-) strand; PAM type: YTN; PAM sequence: TTC
cacctttagtaggtacctag

SEQ ID NO: 53482 - DNA, 20 bp, Artificial Sequence
  Description of Artificial Sequence: Synthetic oligonucleotide
  Target: SCN10A; (-) strand; PAM type: YTN; PAM sequence: TTG
catgattccacctttagtag

SEQ ID NO: 53483 - DNA, 20 bp, Artificial Sequence
  Description of Artificial Sequence: Synthetic oligonucleotide
  Target: SCN10A; (-) strand; PAM type: YTN; PAM sequence: CTC
aaacgcaaaagaacaaatgt

SEQ ID NO: 53484 - DNA, 20 bp, Artificial Sequence
  Description of Artificial Sequence: Synthetic oligonucleotide
  Target: SCN10A; (-) strand; PAM type: YTN; PAM sequence: CTA
agtaaaataactcaaacgca

SEQ ID NO: 53485 - DNA, 20 bp, Artificial Sequence
  Description of Artificial Sequence: Synthetic oligonucleotide
  Target: SCN10A; (-) strand; PAM type: YTN; PAM sequence: TTG
tgctaagtaaaataactcaa

SEQ ID NO: 53486 - DNA, 20 bp, Artificial Sequence
  Description of Artificial Sequence: Synthetic oligonucleotide
  Target: SCN10A; (-) strand; PAM type: YTN; PAM sequence: TTG
acaaagcattgtgctaagta

SEQ ID NO: 53487 - DNA, 20 bp, Artificial Sequence
  Description of Artificial Sequence: Synthetic oligonucleotide
  Target: SCN10A; (-) strand; PAM type: YTN; PAM sequence: CTG
atacatgccacaacattgac

SEQ ID NO: 53488 - DNA, 20 bp, Artificial Sequence
  Description of Artificial Sequence: Synthetic oligonucleotide
  Target: SCN10A; (-) strand; PAM type: YTN; PAM sequence: TTC
tgatacatgccacaacattg

SEQ ID NO: 53489 - DNA, 20 bp, Artificial Sequence
  Description of Artificial Sequence: Synthetic oligonucleotide
  Target: SCN10A; (-) strand; PAM type: YTN; PAM sequence: TTA
aaaatgaatgagattctgat

SEQ ID NO: 53490 - DNA, 20 bp, Artificial Sequence
  Description of Artificial Sequence: Synthetic oligonucleotide
  Target: SCN10A; (-) strand; PAM type: YTN; PAM sequence: TTT
aaaaatgaatgagattctga

SEQ ID NO: 53491 - DNA, 20 bp, Artificial Sequence
  Description of Artificial Sequence: Synthetic oligonucleotide
  Target: SCN10A; (-) strand; PAM type: YTN; PAM sequence: TTT
taaaaatgaatgagattctg

SEQ ID NO: 53492 - DNA, 20 bp, Artificial Sequence
  Description of Artificial Sequence: Synthetic oligonucleotide
  Target: SCN10A; (-) strand; PAM type: YTN; PAM sequence: TTC
agttttaaaaatgaatgaga

SEQ ID NO: 53493 - DNA, 20 bp, Artificial Sequence
  Description of Artificial Sequence: Synthetic oligonucleotide
  Target: SCN10A; (-) strand; PAM type: YTN; PAM sequence: TTG
aatatcattcagttttaaaa

SEQ ID NO: 53494 - DNA, 20 bp, Artificial Sequence
  Description of Artificial Sequence: Synthetic oligonucleotide
  Target: SCN10A; (-) strand; PAM type: YTN; PAM sequence: TTC
acaatagccaaatatgtcca

SEQ ID NO: 53495 - DNA, 20 bp, Artificial Sequence
  Description of Artificial Sequence: Synthetic oligonucleotide
  Target: SCN10A; (-) strand; PAM type: YTN; PAM sequence: TTA
ttcacaatagccaaatatgt

SEQ ID NO: 53496 - DNA, 20 bp, Artificial Sequence
  Description of Artificial Sequence: Synthetic oligonucleotide
  Target: SCN10A; (-) strand; PAM type: YTN; PAM sequence: TTG
tagcagcgttattcacaata

SEQ ID NO: 53497 - DNA, 20 bp, Artificial Sequence
  Description of Artificial Sequence: Synthetic oligonucleotide
  Target: SCN10A; (-) strand; PAM type: YTN; PAM sequence: TTT
gtagcagcgttattcacaat

SEQ ID NO: 53498 - DNA, 20 bp, Artificial Sequence
  Description of Artificial Sequence: Synthetic oligonucleotide
  Target: SCN10A; (-) strand; PAM type: YTN; PAM sequence: CTA
atgtttgtagcagcgttatt

SEQ ID NO: 53499 - DNA, 20 bp, Artificial Sequence
  Description of Artificial Sequence: Synthetic oligonucleotide
  Target: SCN10A; (-) strand; PAM type: YTN; PAM sequence: TTA
tgcactaatgtttgtagcag

SEQ ID NO: 53500 - DNA, 20 bp, Artificial Sequence
  Description of Artificial Sequence: Synthetic oligonucleotide
  Target: SCN10A; (-) strand; PAM type: YTN; PAM sequence: CTT
atgcactaatgtttgtagca

SEQ ID NO: 53501 - DNA, 20 bp, Artificial Sequence
  Description of Artificial Sequence: Synthetic oligonucleotide
  Target: SCN10A; (-) strand; PAM type: YTN; PAM sequence: TTG
gcttatgcactaatgtttgt

SEQ ID NO: 53502 - DNA, 20 bp, Artificial Sequence
  Description of Artificial Sequence: Synthetic oligonucleotide
  Target: SCN10A; (-) strand; PAM type: YTN; PAM sequence: TTA
aaaggtatgttggcttatgc

SEQ ID NO: 53503 - DNA, 20 bp, Artificial Sequence
  Description of Artificial Sequence: Synthetic oligonucleotide
  Target: SCN10A; (-) strand; PAM type: YTN; PAM sequence: TTT
aaaaggtatgttggcttatg

SEQ ID NO: 53504 - DNA, 20 bp, Artificial Sequence
  Description of Artificial Sequence: Synthetic oligonucleotide
  Target: SCN10A; (-) strand; PAM type: YTN; PAM sequence: CTT
taaaaggtatgttggcttat

SEQ ID NO: 53505 - DNA, 20 bp, Artificial Sequence
  Description of Artificial Sequence: Synthetic oligonucleotide
  Target: SCN10A; (-) strand; PAM type: YTN; PAM sequence: CTA
tgaaacagactttaaaaggt

SEQ ID NO: 53506 - DNA, 20 bp, Artificial Sequence
  Description of Artificial Sequence: Synthetic oligonucleotide
  Target: SCN10A; (-) strand; PAM type: YTN; PAM sequence: TTG
aacctatgaaacagacttta

SEQ ID NO: 53507 - DNA, 20 bp, Artificial Sequence
  Description of Artificial Sequence: Synthetic oligonucleotide
  Target: SCN10A; (-) strand; PAM type: YTN; PAM sequence: TTT
gaacctatgaaacagacttt

SEQ ID NO: 53508 - DNA, 20 bp, Artificial Sequence
  Description of Artificial Sequence: Synthetic oligonucleotide
  Target: SCN10A; (-) strand; PAM type: YTN; PAM sequence: TTA
gtttgaacctatgaaacaga

SEQ ID NO: 53509 - DNA, 20 bp, Artificial Sequence
  Description of Artificial Sequence: Synthetic oligonucleotide
  Target: SCN10A; (-) strand; PAM type: YTN; PAM sequence: TTA
aaaattagtttgaacctatg

SEQ ID NO: 53510 - DNA, 20 bp, Artificial Sequence
  Description of Artificial Sequence: Synthetic oligonucleotide
  Target: SCN10A; (-) strand; PAM type: YTN; PAM sequence: TTA
attaaaaattagtttgaacc

SEQ ID NO: 53511 - DNA, 20 bp, Artificial Sequence
  Description of Artificial Sequence: Synthetic oligonucleotide
  Target: SCN10A; (-) strand; PAM type: YTN; PAM sequence: TTT
aattaaaaattagtttgaac

SEQ ID NO: 53512 - DNA, 20 bp, Artificial Sequence
  Description of Artificial Sequence: Synthetic oligonucleotide
  Target: SCN10A; (-) strand; PAM type: YTN; PAM sequence: CTG
gtttaattaaaaattagttt

SEQ ID NO: 53513 - DNA, 20 bp, Artificial Sequence
  Description of Artificial Sequence: Synthetic oligonucleotide
  Target: SCN10A; (-) strand; PAM type: YTN; PAM sequence: CTC
tggtttaattaaaaattagt

SEQ ID NO: 53514 - DNA, 20 bp, Artificial Sequence
  Description of Artificial Sequence: Synthetic oligonucleotide
  Target: SCN10A; (-) strand; PAM type: YTN; PAM sequence: CTC
tctggtttaattaaaaatta

SEQ ID NO: 53515 - DNA, 20 bp, Artificial Sequence
  Description of Artificial Sequence: Synthetic oligonucleotide
  Target: SCN10A; (-) strand; PAM type: YTN; PAM sequence: TTA
aaagaagagctctctggttt

SEQ ID NO: 53516 - DNA, 20 bp, Artificial Sequence
  Description of Artificial Sequence: Synthetic oligonucleotide
  Target: SCN10A; (-) strand; PAM type: YTN; PAM sequence: TTT
aaaagaagagctctctggtt

SEQ ID NO: 53517 - DNA, 20 bp, Artificial Sequence
  Description of Artificial Sequence: Synthetic oligonucleotide
  Target: SCN10A; (-) strand; PAM type: YTN; PAM sequence: TTT
taaaagaagagctctctggt

SEQ ID NO: 53518 - DNA, 20 bp, Artificial Sequence
  Description of Artificial Sequence: Synthetic oligonucleotide
  Target: SCN10A; (-) strand; PAM type: YTN; PAM sequence: CTA
attttaaaagaagagctctc

SEQ ID NO: 53519 - DNA, 20 bp, Artificial Sequence
  Description of Artificial Sequence: Synthetic oligonucleotide
  Target: SCN10A; (-) strand; PAM type: YTN; PAM sequence: TTA
tcatgaagctaattttaaaa

SEQ ID NO: 53520 - DNA, 20 bp, Artificial Sequence
  Description of Artificial Sequence: Synthetic oligonucleotide
  Target: SCN10A; (-) strand; PAM type: YTN; PAM sequence: TTT
atcatgaagctaattttaaa

SEQ ID NO: 53521 - DNA, 20 bp, Artificial Sequence
  Description of Artificial Sequence: Synthetic oligonucleotide
  Target: SCN10A; (-) strand; PAM type: YTN; PAM sequence: CTA
tttatcatgaagctaatttt

SEQ ID NO: 53522 - DNA, 20 bp, Artificial Sequence
  Description of Artificial Sequence: Synthetic oligonucleotide
  Target: SCN10A; (-) strand; PAM type: YTN; PAM sequence: TTC
tatttatcatgaagctaatt

SEQ ID NO: 53523 - DNA, 20 bp, Artificial Sequence
  Description of Artificial Sequence: Synthetic oligonucleotide
  Target: SCN10A; (-) strand; PAM type: YTN; PAM sequence: TTG
ttctatttatcatgaagcta

SEQ ID NO: 53524 - DNA, 20 bp, Artificial Sequence
  Description of Artificial Sequence: Synthetic oligonucleotide
  Target: SCN10A; (-) strand; PAM type: YTN; PAM sequence: TTT
gttctatttatcatgaagct

SEQ ID NO: 53525 - DNA, 20 bp, Artificial Sequence
  Description of Artificial Sequence: Synthetic oligonucleotide
  Target: SCN10A; (-) strand; PAM type: YTN; PAM sequence: TTT
tgttctatttatcatgaagc

SEQ ID NO: 53526 - DNA, 20 bp, Artificial Sequence
  Description of Artificial Sequence: Synthetic oligonucleotide
  Target: SCN10A; (-) strand; PAM type: YTN; PAM sequence: TTT
ttgttctatttatcatgaag

SEQ ID NO: 53527 - DNA, 20 bp, Artificial Sequence
  Description of Artificial Sequence: Synthetic oligonucleotide
  Target: SCN10A; (-) strand; PAM type: YTN; PAM sequence: CTT
tttgttctatttatcatgaa

SEQ ID NO: 53528 - DNA, 20 bp, Artificial Sequence
  Description of Artificial Sequence: Synthetic oligonucleotide
  Target: SCN10A; (-) strand; PAM type: YTN; PAM sequence: CTC
agtgactttttgttctattt

SEQ ID NO: 53529 - DNA, 20 bp, Artificial Sequence
  Description of Artificial Sequence: Synthetic oligonucleotide
  Target: SCN10A; (-) strand; PAM type: YTN; PAM sequence: CTA
tatatatgggaaagactcag

SEQ ID NO: 53530 - DNA, 20 bp, Artificial Sequence
  Description of Artificial Sequence: Synthetic oligonucleotide
  Target: SCN10A; (-) strand; PAM type: YTN; PAM sequence: TTC
actatatatatgggaaagac

SEQ ID NO: 53531 - DNA, 20 bp, Artificial Sequence
  Description of Artificial Sequence: Synthetic oligonucleotide
  Target: SCN10A; (-) strand; PAM type: YTN; PAM sequence: CTT
cactatatatatgggaaaga

SEQ ID NO: 53532 - DNA, 20 bp, Artificial Sequence
  Description of Artificial Sequence: Synthetic oligonucleotide
  Target: SCN10A; (-) strand; PAM type: YTN; PAM sequence: TTG
tcagcatatcttcactatat

SEQ ID NO: 53533 - DNA, 20 bp, Artificial Sequence
  Description of Artificial Sequence: Synthetic oligonucleotide
  Target: SCN10A; (-) strand; PAM type: YTN; PAM sequence: CTA
tgaataagtaagttgtcagc

SEQ ID NO: 53534 - DNA, 20 bp, Artificial Sequence
  Description of Artificial Sequence: Synthetic oligonucleotide
  Target: SCN10A; (-) strand; PAM type: YTN; PAM sequence: TTG
aacaaaactatgaataagta

SEQ ID NO: 53535 - DNA, 20 bp, Artificial Sequence
  Description of Artificial Sequence: Synthetic oligonucleotide
  Target: SCN10A; (-) strand; PAM type: YTN; PAM sequence: TTA
tagttgaacaaaactatgaa

SEQ ID NO: 53536 - DNA, 20 bp, Artificial Sequence
  Description of Artificial Sequence: Synthetic oligonucleotide
  Target: SCN10A; (-) strand; PAM type: YTN; PAM sequence: TTT
atagttgaacaaaactatga

SEQ ID NO: 53537 - DNA, 20 bp, Artificial Sequence
  Description of Artificial Sequence: Synthetic oligonucleotide
  Target: SCN10A; (-) strand; PAM type: YTN; PAM sequence: TTT
tatagttgaacaaaactatg

SEQ ID NO: 53538 - DNA, 20 bp, Artificial Sequence
  Description of Artificial Sequence: Synthetic oligonucleotide
  Target: SCN10A; (-) strand; PAM type: YTN; PAM sequence: TTA
ttttatagttgaacaaaact

SEQ ID NO: 53539 - DNA, 20 bp, Artificial Sequence
  Description of Artificial Sequence: Synthetic oligonucleotide
  Target: SCN10A; (-) strand; PAM type: YTN; PAM sequence: TTT
attttatagttgaacaaaac

SEQ ID NO: 53540 - DNA, 20 bp, Artificial Sequence
  Description of Artificial Sequence: Synthetic oligonucleotide
  Target: SCN10A; (-) strand; PAM type: YTN; PAM sequence: TTT
tattttatagttgaacaaaa

SEQ ID NO: 53541 - DNA, 20 bp, Artificial Sequence
  Description of Artificial Sequence: Synthetic oligonucleotide
  Target: SCN10A; (-) strand; PAM type: YTN; PAM sequence: TTA
ggtatacgagcagacatttt

SEQ ID NO: 53542 - DNA, 20 bp, Artificial Sequence
  Description of Artificial Sequence: Synthetic oligonucleotide
  Target: SCN10A; (-) strand; PAM type: YTN; PAM sequence: CTG
ttaggtatacgagcagacat

SEQ ID NO: 53543 - DNA, 20 bp, Artificial Sequence
  Description of Artificial Sequence: Synthetic oligonucleotide
  Target: SCN10A; (-) strand; PAM type: YTN; PAM sequence: TTA
aagtcaatgactgttaggta

SEQ ID NO: 53544 - DNA, 20 bp, Artificial Sequence
  Description of Artificial Sequence: Synthetic oligonucleotide
  Target: SCN10A; (-) strand; PAM type: YTN; PAM sequence: TTT
aaagtcaatgactgttaggt

SEQ ID NO: 53545 - DNA, 20 bp, Artificial Sequence
  Description of Artificial Sequence: Synthetic oligonucleotide
  Target: SCN10A; (-) strand; PAM type: YTN; PAM sequence: CTG
gcatttaaagtcaatgactg

SEQ ID NO: 53546 - DNA, 20 bp, Artificial Sequence
  Description of Artificial Sequence: Synthetic oligonucleotide
  Target: SCN10A; (-) strand; PAM type: YTN; PAM sequence: TTA
taatgtgactggcatttaaa

SEQ ID NO: 53547 - DNA, 20 bp, Artificial Sequence
  Description of Artificial Sequence: Synthetic oligonucleotide
  Target: SCN10A; (-) strand; PAM type: YTN; PAM sequence: CTT
ataatgtgactggcatttaa

SEQ ID NO: 53548 - DNA, 20 bp, Artificial Sequence
  Description of Artificial Sequence: Synthetic oligonucleotide
  Target: SCN10A; (-) strand; PAM type: YTN; PAM sequence: TTC
cttataatgtgactggcatt

SEQ ID NO: 53549 - DNA, 20 bp, Artificial Sequence
  Description of Artificial Sequence: Synthetic oligonucleotide
  Target: SCN10A; (-) strand; PAM type: YTN; PAM sequence: TTG
cattccttataatgtgactg

SEQ ID NO: 53550 - DNA, 20 bp, Artificial Sequence
  Description of Artificial Sequence: Synthetic oligonucleotide
  Target: SCN10A; (-) strand; PAM type: YTN; PAM sequence: TTA
gaagtattgcattccttata

SEQ ID NO: 53551 - DNA, 20 bp, Artificial Sequence
  Description of Artificial Sequence: Synthetic oligonucleotide
  Target: SCN10A; (-) strand; PAM type: YTN; PAM sequence: TTA
attagaagtattgcattcct

SEQ ID NO: 53552 - DNA, 20 bp, Artificial Sequence
  Description of Artificial Sequence: Synthetic oligonucleotide
  Target: SCN10A; (-) strand; PAM type: YTN; PAM sequence: CTT
aattagaagtattgcattcc

SEQ ID NO: 53553 - DNA, 20 bp, Artificial Sequence
  Description of Artificial Sequence: Synthetic oligonucleotide
  Target: SCN10A; (-) strand; PAM type: YTN; PAM sequence: TTC
cttaattagaagtattgcat

SEQ ID NO: 53554 - DNA, 20 bp, Artificial Sequence
  Description of Artificial Sequence: Synthetic oligonucleotide
  Target: SCN10A; (-) strand; PAM type: YTN; PAM sequence: TTG
gtataattccttaattagaa

SEQ ID NO: 53555 - DNA, 20 bp, Artificial Sequence
  Description of Artificial Sequence: Synthetic oligonucleotide
  Target: SCN10A; (-) strand; PAM type: YTN; PAM sequence: TTG
gagaagaaacaagaaaaaca

SEQ ID NO: 53556 - DNA, 20 bp, Artificial Sequence
  Description of Artificial Sequence: Synthetic oligonucleotide
  Target: SCN10A; (-) strand; PAM type: YTN; PAM sequence: TTG
tggttggagaagaaacaaga

SEQ ID NO: 53557 - DNA, 20 bp, Artificial Sequence
  Description of Artificial Sequence: Synthetic oligonucleotide
  Target: SCN10A; (-) strand; PAM type: YTN; PAM sequence: TTA
caaatattgtggttggagaa

SEQ ID NO: 53558 - DNA, 20 bp, Artificial Sequence
  Description of Artificial Sequence: Synthetic oligonucleotide
  Target: SCN10A; (-) strand; PAM type: YTN; PAM sequence: TTC
caaatcaattacaaatattg

SEQ ID NO: 53559 - DNA, 20 bp, Artificial Sequence
  Description of Artificial Sequence: Synthetic oligonucleotide
  Target: SCN10A; (-) strand; PAM type: YTN; PAM sequence: TTT
ccaaatcaattacaaatatt

SEQ ID NO: 53560 - DNA, 20 bp, Artificial Sequence
  Description of Artificial Sequence: Synthetic oligonucleotide
  Target: SCN10A; (-) strand; PAM type: YTN; PAM sequence: CTG
gtaagatacaaaaccagttt

SEQ ID NO: 53561 - DNA, 20 bp, Artificial Sequence
  Description of Artificial Sequence: Synthetic oligonucleotide
  Target: SCN10A; (-) strand; PAM type: YTN; PAM sequence: CTG
ctggtaagatacaaaaccag

SEQ ID NO: 53562 - DNA, 20 bp, Artificial Sequence
  Description of Artificial Sequence: Synthetic oligonucleotide
  Target: SCN10A; (-) strand; PAM type: YTN; PAM sequence: CTC
ctgctggtaagatacaaaac

SEQ ID NO: 53563 - DNA, 20 bp, Artificial Sequence
  Description of Artificial Sequence: Synthetic oligonucleotide
  Target: SCN10A; (-) strand; PAM type: YTN; PAM sequence: TTG
cactcctgctggtaagatac

SEQ ID NO: 53564 - DNA, 20 bp, Artificial Sequence
  Description of Artificial Sequence: Synthetic oligonucleotide
  Target: SCN10A; (-) strand; PAM type: YTN; PAM sequence: CTC
atatcaaaaataagcacaat

SEQ ID NO: 53565 - DNA, 20 bp, Artificial Sequence
  Description of Artificial Sequence: Synthetic oligonucleotide
  Target: SCN10A; (-) strand; PAM type: YTN; PAM sequence: TTC
atcctcatatcaaaaataag

SEQ ID NO: 53566 - DNA, 20 bp, Artificial Sequence
  Description of Artificial Sequence: Synthetic oligonucleotide
  Target: SCN10A; (-) strand; PAM type: YTN; PAM sequence: CTA
tagagtcatcattcatcctc

SEQ ID NO: 53567 - DNA, 20 bp, Artificial Sequence
  Description of Artificial Sequence: Synthetic oligonucleotide
  Target: SCN10A; (-) strand; PAM type: YTN; PAM sequence: TTG
agaagacaacaaaactatag

SEQ ID NO: 53568 - DNA, 20 bp, Artificial Sequence
  Description of Artificial Sequence: Synthetic oligonucleotide
  Target: SCN10A; (-) strand; PAM type: YTN; PAM sequence: TTA
aaggttgagaagacaacaaa

SEQ ID NO: 53569 - DNA, 20 bp, Artificial Sequence
  Description of Artificial Sequence: Synthetic oligonucleotide
  Target: SCN10A; (-) strand; PAM type: YTN; PAM sequence: TTA
tgttaaaggttgagaagaca

SEQ ID NO: 53570 - DNA, 20 bp, Artificial Sequence
  Description of Artificial Sequence: Synthetic oligonucleotide
  Target: SCN10A; (-) strand; PAM type: YTN; PAM sequence: TTT
atgttaaaggttgagaagac

SEQ ID NO: 53571 - DNA, 20 bp, Artificial Sequence
  Description of Artificial Sequence: Synthetic oligonucleotide
  Target: SCN10A; (-) strand; PAM type: YTN; PAM sequence: TTT
tatgttaaaggttgagaaga

SEQ ID NO: 53572 - DNA, 20 bp, Artificial Sequence
  Description of Artificial Sequence: Synthetic oligonucleotide
  Target: SCN10A; (-) strand; PAM type: YTN; PAM sequence: TTG
tgaaaattttatgttaaagg

SEQ ID NO: 53573 - DNA, 20 bp, Artificial Sequence
  Description of Artificial Sequence: Synthetic oligonucleotide
  Target: SCN10A; (-) strand; PAM type: YTN; PAM sequence: TTC
ccagtataaaattgtgaaaa

SEQ ID NO: 53574 - DNA, 20 bp, Artificial Sequence
  Description of Artificial Sequence: Synthetic oligonucleotide
  Target: SCN10A; (-) strand; PAM type: YTN; PAM sequence: TTT
cccagtataaaattgtgaaa

SEQ ID NO: 53575 - DNA, 20 bp, Artificial Sequence
  Description of Artificial Sequence: Synthetic oligonucleotide
  Target: SCN10A; (-) strand; PAM type: YTN; PAM sequence: CTT
tcccagtataaaattgtgaa

SEQ ID NO: 53576 - DNA, 20 bp, Artificial Sequence
  Description of Artificial Sequence: Synthetic oligonucleotide
  Target: SCN10A; (-) strand; PAM type: YTN; PAM sequence: CTA
caagcacaaaataaggcttt

SEQ ID NO: 53577 - DNA, 20 bp, Artificial Sequence
  Description of Artificial Sequence: Synthetic oligonucleotide
  Target: SCN10A; (-) strand; PAM type: YTN; PAM sequence: CTA
ctacaagcacaaaataaggc

SEQ ID NO: 53578 - DNA, 20 bp, Artificial Sequence
  Description of Artificial Sequence: Synthetic oligonucleotide
  Target: SCN10A; (-) strand; PAM type: YTN; PAM sequence: CTC
tactacaagcacaaaataag

SEQ ID NO: 53579 - DNA, 20 bp, Artificial Sequence
  Description of Artificial Sequence: Synthetic oligonucleotide
  Target: SCN10A; (-) strand; PAM type: YTN; PAM sequence: TTG
aatatctctactacaagcac

SEQ ID NO: 53580 - DNA, 20 bp, Artificial Sequence
  Description of Artificial Sequence: Synthetic oligonucleotide
  Target: SCN10A; (-) strand; PAM type: YTN; PAM sequence: TTA
aaccaattgaatatctctac

SEQ ID NO: 53581 - DNA, 20 bp, Artificial Sequence
  Description of Artificial Sequence: Synthetic oligonucleotide
  Target: SCN10A; (-) strand; PAM type: YTN; PAM sequence: TTT
aaaccaattgaatatctcta

SEQ ID NO: 53582 - DNA, 20 bp, Artificial Sequence
  Description of Artificial Sequence: Synthetic oligonucleotide
  Target: SCN10A; (-) strand; PAM type: YTN; PAM sequence: TTT
taaaccaattgaatatctct

SEQ ID NO: 53583 - DNA, 20 bp, Artificial Sequence
  Description of Artificial Sequence: Synthetic oligonucleotide
  Target: SCN10A; (-) strand; PAM type: YTN; PAM sequence: CTT
ttaaaccaattgaatatctc

SEQ ID NO: 53584 - DNA, 20 bp, Artificial Sequence
  Description of Artificial Sequence: Synthetic oligonucleotide
  Target: SCN10A; (-) strand; PAM type: YTN; PAM sequence: TTA
tcaaccccacttttaaacca

SEQ ID NO: 53585 - DNA, 20 bp, Artificial Sequence
  Description of Artificial Sequence: Synthetic oligonucleotide
  Target: SCN10A; (-) strand; PAM type: YTN; PAM sequence: TTT
atcaaccccacttttaaacc

SEQ ID NO: 53586 - DNA, 20 bp, Artificial Sequence
  Description of Artificial Sequence: Synthetic oligonucleotide
  Target: SCN10A; (-) strand; PAM type: YTN; PAM sequence: TTC
caataaagtttatcaacccc

SEQ ID NO: 53587 - DNA, 20 bp, Artificial Sequence
  Description of Artificial Sequence: Synthetic oligonucleotide
  Target: SCN10A; (-) strand; PAM type: YTN; PAM sequence: TTT
ccaataaagtttatcaaccc

SEQ ID NO: 53588 - DNA, 20 bp, Artificial Sequence
  Description of Artificial Sequence: Synthetic oligonucleotide
  Target: SCN10A; (-) strand; PAM type: YTN; PAM sequence: TTT
tccaataaagtttatcaacc

SEQ ID NO: 53589 - DNA, 20 bp, Artificial Sequence
  Description of Artificial Sequence: Synthetic oligonucleotide
  Target: SCN10A; (-) strand; PAM type: YTN; PAM sequence: TTA
ttttccaataaagtttatca

SEQ ID NO: 53590 - DNA, 20 bp, Artificial Sequence
  Description of Artificial Sequence: Synthetic oligonucleotide
  Target: SCN10A; (-) strand; PAM type: YTN; PAM sequence: TTC
catattattttccaataaag

SEQ ID NO: 53591 - DNA, 20 bp, Artificial Sequence
  Description of Artificial Sequence: Synthetic oligonucleotide
  Target: SCN10A; (-) strand; PAM type: YTN; PAM sequence: CTT
ccatattattttccaataaa

SEQ ID NO: 53592 - DNA, 20 bp, Artificial Sequence
  Description of Artificial Sequence: Synthetic oligonucleotide
  Target: SCN10A; (-) strand; PAM type: YTN; PAM sequence: CTA
tcaaaacttccatattattt

SEQ ID NO: 53593 - DNA, 20 bp, Artificial Sequence
  Description of Artificial Sequence: Synthetic oligonucleotide
  Target: SCN10A; (-) strand; PAM type: YTN; PAM sequence: TTG
tcaagtaatgatataaagct

SEQ ID NO: 53594 - DNA, 20 bp, Artificial Sequence
  Description of Artificial Sequence: Synthetic oligonucleotide
  Target: SCN10A; (-) strand; PAM type: YTN; PAM sequence: TTT
gtcaagtaatgatataaagc

SEQ ID NO: 53595 - DNA, 20 bp, Artificial Sequence
  Description of Artificial Sequence: Synthetic oligonucleotide
  Target: SCN10A; (-) strand; PAM type: YTN; PAM sequence: TTT
tgtcaagtaatgatataaag

SEQ ID NO: 53596 - DNA, 20 bp, Artificial Sequence
  Description of Artificial Sequence: Synthetic oligonucleotide
  Target: SCN10A; (-) strand; PAM type: YTN; PAM sequence: TTT
ttgtcaagtaatgatataaa

SEQ ID NO: 53597 - DNA, 20 bp, Artificial Sequence
  Description of Artificial Sequence: Synthetic oligonucleotide
  Target: SCN10A; (-) strand; PAM type: YTN; PAM sequence: CTA
acgtttttgtcaagtaatga

SEQ ID NO: 53598 - DNA, 20 bp, Artificial Sequence
  Description of Artificial Sequence: Synthetic oligonucleotide
  Target: SCN10A; (-) strand; PAM type: YTN; PAM sequence: CTG
ctaacgtttttgtcaagtaa

SEQ ID NO: 53599 - DNA, 20 bp, Artificial Sequence
  Description of Artificial Sequence: Synthetic oligonucleotide
  Target: SCN10A; (-) strand; PAM type: YTN; PAM sequence: TTA
tctgctaacgtttttgtcaa

SEQ ID NO: 53600 - DNA, 20 bp, Artificial Sequence
  Description of Artificial Sequence: Synthetic oligonucleotide
  Target: SCN10A; (-) strand; PAM type: YTN; PAM sequence: TTA
ttatctgctaacgtttttgt

SEQ ID NO: 53601 - DNA, 20 bp, Artificial Sequence
  Description of Artificial Sequence: Synthetic oligonucleotide
  Target: SCN10A; (-) strand; PAM type: YTN; PAM sequence: TTT
attatctgctaacgtttttg

SEQ ID NO: 53602 - DNA, 20 bp, Artificial Sequence
  Description of Artificial Sequence: Synthetic oligonucleotide
  Target: SCN10A; (-) strand; PAM type: YTN; PAM sequence: CTA
gtacccaatttattatctgc

SEQ ID NO: 53603 - DNA, 20 bp, Artificial Sequence
  Description of Artificial Sequence: Synthetic oligonucleotide
  Target: SCN10A; (-) strand; PAM type: YTN; PAM sequence: TTG
tcctagtacccaatttatta

SEQ ID NO: 53604 - DNA, 20 bp, Artificial Sequence
  Description of Artificial Sequence: Synthetic oligonucleotide
  Target: SCN10A; (-) strand; PAM type: YTN; PAM sequence: TTT
gtcctagtacccaatttatt

SEQ ID NO: 53605 - DNA, 20 bp, Artificial Sequence
  Description of Artificial Sequence: Synthetic oligonucleotide
  Target: SCN10A; (-) strand; PAM type: YTN; PAM sequence: TTT
tgtcctagtacccaatttat

SEQ ID NO: 53606 - DNA, 20 bp, Artificial Sequence
  Description of Artificial Sequence: Synthetic oligonucleotide
  Target: SCN10A; (-) strand; PAM type: YTN; PAM sequence: CTT
ttgtcctagtacccaattta

SEQ ID NO: 53607 - DNA, 20 bp, Artificial Sequence
  Description of Artificial Sequence: Synthetic oligonucleotide
  Target: SCN10A; (-) strand; PAM type: YTN; PAM sequence: TTG
gaccaatgatccttttgtcc

SEQ ID NO: 53608 - DNA, 20 bp, Artificial Sequence
  Description of Artificial Sequence: Synthetic oligonucleotide
  Target: SCN10A; (-) strand; PAM type: YTN; PAM sequence: TTA
ttggaccaatgatccttttg

SEQ ID NO: 53609 - DNA, 20 bp, Artificial Sequence
  Description of Artificial Sequence: Synthetic oligonucleotide
  Target: SCN10A; (-) strand; PAM type: YTN; PAM sequence: TTT
attggaccaatgatcctttt

SEQ ID NO: 53610 - DNA, 20 bp, Artificial Sequence
  Description of Artificial Sequence: Synthetic oligonucleotide
  Target: SCN10A; (-) strand; PAM type: YTN; PAM sequence: TTT
tattggaccaatgatccttt

SEQ ID NO: 53611 - DNA, 20 bp, Artificial Sequence
  Description of Artificial Sequence: Synthetic oligonucleotide
  Target: SCN10A; (-) strand; PAM type: YTN; PAM sequence: TTG
aattttattggaccaatgat

SEQ ID NO: 53612 - DNA, 20 bp, Artificial Sequence
  Description of Artificial Sequence: Synthetic oligonucleotide
  Target: SCN10A; (-) strand; PAM type: YTN; PAM sequence: CTC
ccaaaaccagacaaaaatat

SEQ ID NO: 53613 - DNA, 20 bp, Artificial Sequence
  Description of Artificial Sequence: Synthetic oligonucleotide
  Target: SCN10A; (-) strand; PAM type: YTN; PAM sequence: TTG
tcatgagacaagtggataat

SEQ ID NO: 53614 - DNA, 20 bp, Artificial Sequence
  Description of Artificial Sequence: Synthetic oligonucleotide
  Target: SCN10A; (-) strand; PAM type: YTN; PAM sequence: TTT
gtcatgagacaagtggataa

SEQ ID NO: 53615 - DNA, 20 bp, Artificial Sequence
  Description of Artificial Sequence: Synthetic oligonucleotide
  Target: SCN10A; (-) strand; PAM type: YTN; PAM sequence: CTG
tttgtcatgagacaagtgga

SEQ ID NO: 53616 - DNA, 20 bp, Artificial Sequence
  Description of Artificial Sequence: Synthetic oligonucleotide
  Target: SCN10A; (-) strand; PAM type: YTN; PAM sequence: TTG
taaaaatacaaagcatgaat

SEQ ID NO: 53617 - DNA, 20 bp, Artificial Sequence
  Description of Artificial Sequence: Synthetic oligonucleotide
  Target: SCN10A; (-) strand; PAM type: YTN; PAM sequence: CTC
cattgtaaaaatacaaagca

SEQ ID NO: 53618 - DNA, 20 bp, Artificial Sequence
  Description of Artificial Sequence: Synthetic oligonucleotide
  Target: SCN10A; (-) strand; PAM type: YTN; PAM sequence: CTA
caatgtgaaataaggtcaca

SEQ ID NO: 53619 - DNA, 20 bp, Artificial Sequence
  Description of Artificial Sequence: Synthetic oligonucleotide
  Target: SCN10A; (-) strand; PAM type: YTN; PAM sequence: CTG
aagcataacaataatgataa

SEQ ID NO: 53620 - DNA, 20 bp, Artificial Sequence
  Description of Artificial Sequence: Synthetic oligonucleotide
  Target: SCN10A; (-) strand; PAM type: YTN; PAM sequence: TTC
tgaagcataacaataatgat

SEQ ID NO: 53621 - DNA, 20 bp, Artificial Sequence
  Description of Artificial Sequence: Synthetic oligonucleotide
  Target: SCN10A; (-) strand; PAM type: YTN; PAM sequence: TTT
ctgaagcataacaataatga

SEQ ID NO: 53622 - DNA, 20 bp, Artificial Sequence
  Description of Artificial Sequence: Synthetic oligonucleotide
  Target: SCN10A; (-) strand; PAM type: YTN; PAM sequence: TTT
tctgaagcataacaataatg

SEQ ID NO: 53623 - DNA, 20 bp, Artificial Sequence
  Description of Artificial Sequence: Synthetic oligonucleotide
  Target: SCN10A; (-) strand; PAM type: YTN; PAM sequence: TTC
gaaagtggttttctgaagca

SEQ ID NO: 53624 - DNA, 20 bp, Artificial Sequence
  Description of Artificial Sequence: Synthetic oligonucleotide
  Target: SCN10A; (-) strand; PAM type: YTN; PAM sequence: CTT
cgaaagtggttttctgaagc

SEQ ID NO: 53625 - DNA, 20 bp, Artificial Sequence
  Description of Artificial Sequence: Synthetic oligonucleotide
  Target: SCN10A; (-) strand; PAM type: YTN; PAM sequence: TTC
aaaaaaaagagtcatcactt

SEQ ID NO: 53626 - DNA, 20 bp, Artificial Sequence
  Description of Artificial Sequence: Synthetic oligonucleotide
  Target: SCN10A; (-) strand; PAM type: YTN; PAM sequence: TTG
cataatatcacaattcaaaa

SEQ ID NO: 53627 - DNA, 20 bp, Artificial Sequence
  Description of Artificial Sequence: Synthetic oligonucleotide
  Target: SCN10A; (-) strand; PAM type: YTN; PAM sequence: TTT
gcataatatcacaattcaaa

SEQ ID NO: 53628 - DNA, 20 bp, Artificial Sequence
  Description of Artificial Sequence: Synthetic oligonucleotide
  Target: SCN10A; (-) strand; PAM type: YTN; PAM sequence: CTT
tgcataatatcacaattcaa

SEQ ID NO: 53629 - DNA, 20 bp, Artificial Sequence
  Description of Artificial Sequence: Synthetic oligonucleotide
  Target: SCN10A; (-) strand; PAM type: YTN; PAM sequence: CTG
tcgctttgcataatatcaca

SEQ ID NO: 53630 - DNA, 20 bp, Artificial Sequence
  Description of Artificial Sequence: Synthetic oligonucleotide
  Target: SCN10A; (-) strand; PAM type: YTN; PAM sequence: TTA
ctgtcgctttgcataatatc

SEQ ID NO: 53631 - DNA, 20 bp, Artificial Sequence
  Description of Artificial Sequence: Synthetic oligonucleotide
  Target: SCN10A; (-) strand; PAM type: YTN; PAM sequence: TTA
ttactgtcgctttgcataat

SEQ ID NO: 53632 - DNA, 20 bp, Artificial Sequence
  Description of Artificial Sequence: Synthetic oligonucleotide
  Target: SCN10A; (-) strand; PAM type: YTN; PAM sequence: TTG
ccattattactgtcgctttg

SEQ ID NO: 53633 - DNA, 20 bp, Artificial Sequence
  Description of Artificial Sequence: Synthetic oligonucleotide
  Target: SCN10A; (-) strand; PAM type: YTN; PAM sequence: TTT
gccattattactgtcgcttt

SEQ ID NO: 53634 - DNA, 20 bp, Artificial Sequence
  Description of Artificial Sequence: Synthetic oligonucleotide
  Target: SCN10A; (-) strand; PAM type: YTN; PAM sequence: TTG
catttgccattattactgtc

SEQ ID NO: 53635 - DNA, 20 bp, Artificial Sequence
  Description of Artificial Sequence: Synthetic oligonucleotide
  Target: SCN10A; (-) strand; PAM type: YTN; PAM sequence: CTT
gcatttgccattattactgt

SEQ ID NO: 53636 - DNA, 20 bp, Artificial Sequence
  Description of Artificial Sequence: Synthetic oligonucleotide
  Target: SCN10A; (-) strand; PAM type: YTN; PAM sequence: TTG
tcagacttgcatttgccatt

SEQ ID NO: 53637 - DNA, 20 bp, Artificial Sequence
  Description of Artificial Sequence: Synthetic oligonucleotide
  Target: SCN10A; (-) strand; PAM type: YTN; PAM sequence: CTT
gtcagacttgcatttgccat

SEQ ID NO: 53638 - DNA, 20 bp, Artificial Sequence
  Description of Artificial Sequence: Synthetic oligonucleotide
  Target: SCN10A; (-) strand; PAM type: YTN; PAM sequence: TTA
cacttgtcagacttgcattt

SEQ ID NO: 53639 - DNA, 20 bp, Artificial Sequence
  Description of Artificial Sequence: Synthetic oligonucleotide
  Target: SCN10A; (-) strand; PAM type: YTN; PAM sequence: TTT
acacttgtcagacttgcatt

SEQ ID NO: 53640 - DNA, 20 bp, Artificial Sequence
  Description of Artificial Sequence: Synthetic oligonucleotide
  Target: SCN10A; (-) strand; PAM type: YTN; PAM sequence: TTA
tttacacttgtcagacttgc

SEQ ID NO: 53641 - DNA, 20 bp, Artificial Sequence
  Description of Artificial Sequence: Synthetic oligonucleotide
  Target: SCN10A; (-) strand; PAM type: YTN; PAM sequence: CTG
acagttatttacacttgtca

SEQ ID NO: 53642 - DNA, 20 bp, Artificial Sequence
  Description of Artificial Sequence: Synthetic oligonucleotide
  Target: SCN10A; (-) strand; PAM type: YTN; PAM sequence: TTG
tcacctgacagttatttaca

SEQ ID NO: 53643 - DNA, 20 bp, Artificial Sequence
  Description of Artificial Sequence: Synthetic oligonucleotide
  Target: SCN10A; (-) strand; PAM type: YTN; PAM sequence: TTA
ttgtcacctgacagttattt

SEQ ID NO: 53644 - DNA, 20 bp, Artificial Sequence
  Description of Artificial Sequence: Synthetic oligonucleotide
  Target: SCN10A; (-) strand; PAM type: YTN; PAM sequence: TTT
attgtcacctgacagttatt

SEQ ID NO: 53645 - DNA, 20 bp, Artificial Sequence
  Description of Artificial Sequence: Synthetic oligonucleotide
  Target: SCN10A; (-) strand; PAM type: YTN; PAM sequence: TTT
tattgtcacctgacagttat

SEQ ID NO: 53646 - DNA, 20 bp, Artificial Sequence
  Description of Artificial Sequence: Synthetic oligonucleotide
  Target: SCN10A; (-) strand; PAM type: YTN; PAM sequence: CTA
atgtattttattgtcacctg

SEQ ID NO: 53647 - DNA, 20 bp, Artificial Sequence
  Description of Artificial Sequence: Synthetic oligonucleotide
  Target: SCN10A; (-) strand; PAM type: YTN; PAM sequence: TTG
actaatgtattttattgtca

SEQ ID NO: 53648 - DNA, 20 bp, Artificial Sequence
  Description of Artificial Sequence: Synthetic oligonucleotide
  Target: SCN10A; (-) strand; PAM type: YTN; PAM sequence: CTT
gactaatgtattttattgtc

SEQ ID NO: 53649 - DNA, 20 bp, Artificial Sequence
  Description of Artificial Sequence: Synthetic oligonucleotide
  Target: SCN10A; (-) strand; PAM type: YTN; PAM sequence: TTA
tcttgactaatgtattttat

SEQ ID NO: 53650 - DNA, 20 bp, Artificial Sequence
  Description of Artificial Sequence: Synthetic oligonucleotide
  Target: SCN10A; (-) strand; PAM type: YTN; PAM sequence: TTT
atcttgactaatgtatttta

SEQ ID NO: 53651 - DNA, 20 bp, Artificial Sequence
  Description of Artificial Sequence: Synthetic oligonucleotide
  Target: SCN10A; (-) strand; PAM type: YTN; PAM sequence: TTA
atcataggcagtttatcttg

SEQ ID NO: 53652 - DNA, 20 bp, Artificial Sequence
  Description of Artificial Sequence: Synthetic oligonucleotide
  Target: SCN10A; (-) strand; PAM type: YTN; PAM sequence: TTA
acatggagttaatcataggc

SEQ ID NO: 53653 - DNA, 20 bp, Artificial Sequence
  Description of Artificial Sequence: Synthetic oligonucleotide
  Target: SCN10A; (-) strand; PAM type: YTN; PAM sequence: TTC
ataatggttaacatggagtt

SEQ ID NO: 53654 - DNA, 20 bp, Artificial Sequence
  Description of Artificial Sequence: Synthetic oligonucleotide
  Target: SCN10A; (-) strand; PAM type: YTN; PAM sequence: TTC
attcataatggttaacatgg

SEQ ID NO: 53655 - DNA, 20 bp, Artificial Sequence
  Description of Artificial Sequence: Synthetic oligonucleotide
  Target: SCN10A; (-) strand; PAM type: YTN; PAM sequence: TTT
cattcataatggttaacatg

SEQ ID NO: 53656 - DNA, 20 bp, Artificial Sequence
  Description of Artificial Sequence: Synthetic oligonucleotide
  Target: SCN10A; (-) strand; PAM type: YTN; PAM sequence: CTG
atttcattcataatggttaa

SEQ ID NO: 53657 - DNA, 20 bp, Artificial Sequence
  Description of Artificial Sequence: Synthetic oligonucleotide
  Target: SCN10A; (-) strand; PAM type: YTN; PAM sequence: TTC
aaaaactgatttcattcata

SEQ ID NO: 53658 - DNA, 20 bp, Artificial Sequence
  Description of Artificial Sequence: Synthetic oligonucleotide
  Target: SCN10A; (-) strand; PAM type: YTN; PAM sequence: CTT
caaaaactgatttcattcat

SEQ ID NO: 53659 - DNA, 20 bp, Artificial Sequence
  Description of Artificial Sequence: Synthetic oligonucleotide
  Target: SCN10A; (-) strand; PAM type: YTN; PAM sequence: TTC
aaaaacagtgtatgtgcttc

SEQ ID NO: 53660 - DNA, 20 bp, Artificial Sequence
  Description of Artificial Sequence: Synthetic oligonucleotide
  Target: SCN10A; (-) strand; PAM type: YTN; PAM sequence: TTT
caaaaacagtgtatgtgctt

SEQ ID NO: 53661 - DNA, 20 bp, Artificial Sequence
  Description of Artificial Sequence: Synthetic oligonucleotide
  Target: SCN10A; (-) strand; PAM type: YTN; PAM sequence: TTT
tcaaaaacagtgtatgtgct

SEQ ID NO: 53662 - DNA, 20 bp, Artificial Sequence
  Description of Artificial Sequence: Synthetic oligonucleotide
  Target: SCN10A; (-) strand; PAM type: YTN; PAM sequence: TTA
tgttttcaaaaacagtgtat

SEQ ID NO: 53663 - DNA, 20 bp, Artificial Sequence
  Description of Artificial Sequence: Synthetic oligonucleotide
  Target: SCN10A; (-) strand; PAM type: YTN; PAM sequence: TTT
atgttttcaaaaacagtgta

SEQ ID NO: 53664 - DNA, 20 bp, Artificial Sequence
  Description of Artificial Sequence: Synthetic oligonucleotide
  Target: SCN10A; (-) strand; PAM type: YTN; PAM sequence: TTT
tatgttttcaaaaacagtgt

SEQ ID NO: 53665 - DNA, 20 bp, Artificial Sequence
  Description of Artificial Sequence: Synthetic oligonucleotide
  Target: SCN10A; (-) strand; PAM type: YTN; PAM sequence: TTT
ttatgttttcaaaaacagtg

SEQ ID NO: 53666 - DNA, 20 bp, Artificial Sequence
  Description of Artificial Sequence: Synthetic oligonucleotide
  Target: SCN10A; (-) strand; PAM type: YTN; PAM sequence: CTT
tttatgttttcaaaaacagt

SEQ ID NO: 53667 - DNA, 20 bp, Artificial Sequence
  Description of Artificial Sequence: Synthetic oligonucleotide
  Target: SCN10A; (-) strand; PAM type: YTN; PAM sequence: CTA
actttttatgttttcaaaaa

SEQ ID NO: 53668 - DNA, 20 bp, Artificial Sequence
  Description of Artificial Sequence: Synthetic oligonucleotide
  Target: SCN10A; (-) strand; PAM type: YTN; PAM sequence: TTC
taactttttatgttttcaaa

SEQ ID NO: 53669 - DNA, 20 bp, Artificial Sequence
  Description of Artificial Sequence: Synthetic oligonucleotide
  Target: SCN10A; (-) strand; PAM type: YTN; PAM sequence: TTT
ctaactttttatgttttcaa

SEQ ID NO: 53670 - DNA, 20 bp, Artificial Sequence
  Description of Artificial Sequence: Synthetic oligonucleotide
  Target: SCN10A; (-) strand; PAM type: YTN; PAM sequence: TTC
atagaatttctaacttttta

SEQ ID NO: 53671 - DNA, 20 bp, Artificial Sequence
  Description of Artificial Sequence: Synthetic oligonucleotide
  Target: SCN10A; (-) strand; PAM type: YTN; PAM sequence: TTA
tattcatagaatttctaact

SEQ ID NO: 53672 - DNA, 20 bp, Artificial Sequence
  Description of Artificial Sequence: Synthetic oligonucleotide
  Target: SCN10A; (-) strand; PAM type: YTN; PAM sequence: TTA
ttatattcatagaatttcta

SEQ ID NO: 53673 - DNA, 20 bp, Artificial Sequence
  Description of Artificial Sequence: Synthetic oligonucleotide
  Target: SCN10A; (-) strand; PAM type: YTN; PAM sequence: TTA
attattatattcatagaatt

SEQ ID NO: 53674 - DNA, 20 bp, Artificial Sequence
  Description of Artificial Sequence: Synthetic oligonucleotide
  Target: SCN10A; (-) strand; PAM type: YTN; PAM sequence: CTA
acatgtaagattaattatta

SEQ ID NO: 53675 - DNA, 20 bp, Artificial Sequence
  Description of Artificial Sequence: Synthetic oligonucleotide
  Target: SCN10A; (-) strand; PAM type: YTN; PAM sequence: TTA
aaatctaacatgtaagatta

SEQ ID NO: 53676 - DNA, 20 bp, Artificial Sequence
  Description of Artificial Sequence: Synthetic oligonucleotide
  Target: SCN10A; (-) strand; PAM type: YTN; PAM sequence: TTT
aaaatctaacatgtaagatt

SEQ ID NO: 53677 - DNA, 20 bp, Artificial Sequence
  Description of Artificial Sequence: Synthetic oligonucleotide
  Target: SCN10A; (-) strand; PAM type: YTN; PAM sequence: TTT
taaaatctaacatgtaagat

SEQ ID NO: 53678 - DNA, 20 bp, Artificial Sequence
  Description of Artificial Sequence: Synthetic oligonucleotide
  Target: SCN10A; (-) strand; PAM type: YTN; PAM sequence: CTA
tgcacatataattttaaaat

SEQ ID NO: 53679 - DNA, 20 bp, Artificial Sequence
  Description of Artificial Sequence: Synthetic oligonucleotide
  Target: SCN10A; (-) strand; PAM type: YTN; PAM sequence: CTC
tatgcacatataattttaaa

SEQ ID NO: 53680 - DNA, 20 bp, Artificial Sequence
  Description of Artificial Sequence: Synthetic oligonucleotide
  Target: SCN10A; (-) strand; PAM type: YTN; PAM sequence: CTA
aggatctctatgcacatata

SEQ ID NO: 53681 - DNA, 20 bp, Artificial Sequence
  Description of Artificial Sequence: Synthetic oligonucleotide
  Target: SCN10A; (-) strand; PAM type: YTN; PAM sequence: CTC
aacaagtgatctaaggatct

SEQ ID NO: 53682 - DNA, 20 bp, Artificial Sequence
  Description of Artificial Sequence: Synthetic oligonucleotide
  Target: SCN10A; (-) strand; PAM type: YTN; PAM sequence: TTC
tcaacaagtgatctaaggat

SEQ ID NO: 53683 - DNA, 20 bp, Artificial Sequence
  Description of Artificial Sequence: Synthetic oligonucleotide
  Target: SCN10A; (-) strand; PAM type: YTN; PAM sequence: TTT
ctcaacaagtgatctaagga

SEQ ID NO: 53684 - DNA, 20 bp, Artificial Sequence
  Description of Artificial Sequence: Synthetic oligonucleotide
  Target: SCN10A; (-) strand; PAM type: YTN; PAM sequence: CTA
caatgtttctcaacaagtga

SEQ ID NO: 53685 - DNA, 20 bp, Artificial Sequence
  Description of Artificial Sequence: Synthetic oligonucleotide
  Target: SCN10A; (-) strand; PAM type: YTN; PAM sequence: CTC
ctacaatgtttctcaacaag

SEQ ID NO: 53686 - DNA, 20 bp, Artificial Sequence
  Description of Artificial Sequence: Synthetic oligonucleotide
  Target: SCN10A; (-) strand; PAM type: YTN; PAM sequence: CTC
catctcctacaatgtttctc

SEQ ID NO: 53687 - DNA, 20 bp, Artificial Sequence
  Description of Artificial Sequence: Synthetic oligonucleotide
  Target: SCN10A; (-) strand; PAM type: YTN; PAM sequence: CTC
tccatctcctacaatgtttc

SEQ ID NO: 53688 - DNA, 20 bp, Artificial Sequence
  Description of Artificial Sequence: Synthetic oligonucleotide
  Target: SCN10A; (-) strand; PAM type: YTN; PAM sequence: CTC
tctccatctcctacaatgtt

SEQ ID NO: 53689 - DNA, 20 bp, Artificial Sequence
  Description of Artificial Sequence: Synthetic oligonucleotide
  Target: SCN10A; (-) strand; PAM type: YTN; PAM sequence: TTC
atctctctccatctcctaca

SEQ ID NO: 53690 - DNA, 20 bp, Artificial Sequence
  Description of Artificial Sequence: Synthetic oligonucleotide
  Target: SCN10A; (-) strand; PAM type: YTN; PAM sequence: TTA
gcagagcaattcatctctct

SEQ ID NO: 53691 - DNA, 20 bp, Artificial Sequence
  Description of Artificial Sequence: Synthetic oligonucleotide
  Target: SCN10A; (-) strand; PAM type: YTN; PAM sequence: TTT
agcagagcaattcatctctc

SEQ ID NO: 53692 - DNA, 20 bp, Artificial Sequence
  Description of Artificial Sequence: Synthetic oligonucleotide
  Target: SCN10A; (-) strand; PAM type: YTN; PAM sequence: TTG
tttagcagagcaattcatct

SEQ ID NO: 53693 - DNA, 20 bp, Artificial Sequence
  Description of Artificial Sequence: Synthetic oligonucleotide
  Target: SCN10A; (-) strand; PAM type: YTN; PAM sequence: TTT
gtttagcagagcaattcatc

SEQ ID NO: 53694 - DNA, 20 bp, Artificial Sequence
  Description of Artificial Sequence: Synthetic oligonucleotide
  Target: SCN10A; (-) strand; PAM type: YTN; PAM sequence: CTT
tgtttagcagagcaattcat

SEQ ID NO: 53695 - DNA, 20 bp, Artificial Sequence
  Description of Artificial Sequence: Synthetic oligonucleotide
  Target: SCN10A; (-) strand; PAM type: YTN; PAM sequence: TTA
ctttgtttagcagagcaatt

SEQ ID NO: 53696 - DNA, 20 bp, Artificial Sequence
  Description of Artificial Sequence: Synthetic oligonucleotide
  Target: SCN10A; (-) strand; PAM type: YTN; PAM sequence: CTT
actttgtttagcagagcaat

SEQ ID NO: 53697 - DNA, 20 bp, Artificial Sequence
  Description of Artificial Sequence: Synthetic oligonucleotide
  Target: SCN10A; (-) strand; PAM type: YTN; PAM sequence: TTC
ttactttgtttagcagagca

SEQ ID NO: 53698 - DNA, 20 bp, Artificial Sequence
  Description of Artificial Sequence: Synthetic oligonucleotide
  Target: SCN10A; (-) strand; PAM type: YTN; PAM sequence: TTA
ttcttactttgtttagcaga

SEQ ID NO: 53699 - DNA, 20 bp, Artificial Sequence
  Description of Artificial Sequence: Synthetic oligonucleotide
  Target: SCN10A; (-) strand; PAM type: YTN; PAM sequence: CTT
attcttactttgtttagcag

SEQ ID NO: 53700 - DNA, 20 bp, Artificial Sequence
  Description of Artificial Sequence: Synthetic oligonucleotide
  Target: SCN10A; (-) strand; PAM type: YTN; PAM sequence: CTC
caacttattcttactttgtt

SEQ ID NO: 53701 - DNA, 20 bp, Artificial Sequence
  Description of Artificial Sequence: Synthetic oligonucleotide
  Target: SCN10A; (-) strand; PAM type: YTN; PAM sequence: CTG
ggaactccaacttattctta

SEQ ID NO: 53702 - DNA, 20 bp, Artificial Sequence
  Description of Artificial Sequence: Synthetic oligonucleotide
  Target: SCN10A; (-) strand; PAM type: YTN; PAM sequence: TTG
tccctgggaactccaactta

SEQ ID NO: 53703 - DNA, 20 bp, Artificial Sequence
  Description of Artificial Sequence: Synthetic oligonucleotide
  Target: SCN10A; (-) strand; PAM type: YTN; PAM sequence: CTC
aattgtccctgggaactcca

SEQ ID NO: 53704 - DNA, 20 bp, Artificial Sequence
  Description of Artificial Sequence: Synthetic oligonucleotide
  Target: SCN10A; (-) strand; PAM type: YTN; PAM sequence: CTC
ctcaattgtccctgggaact

SEQ ID NO: 53705 - DNA, 20 bp, Artificial Sequence
  Description of Artificial Sequence: Synthetic oligonucleotide
  Target: SCN10A; (-) strand; PAM type: YTN; PAM sequence: CTC
tcctcaattgtccctgggaa

SEQ ID NO: 53706 - DNA, 20 bp, Artificial Sequence
  Description of Artificial Sequence: Synthetic oligonucleotide
  Target: SCN10A; (-) strand; PAM type: YTN; PAM sequence: CTC
tctcctcaattgtccctggg

SEQ ID NO: 53707 - DNA, 20 bp, Artificial Sequence
  Description of Artificial Sequence: Synthetic oligonucleotide
  Target: SCN10A; (-) strand; PAM type: YTN; PAM sequence: TTC
caactctctcctcaattgtc

SEQ ID NO: 53708 - DNA, 20 bp, Artificial Sequence
  Description of Artificial Sequence: Synthetic oligonucleotide
  Target: SCN10A; (-) strand; PAM type: YTN; PAM sequence: TTG
ggatgttccaactctctcct

SEQ ID NO: 53709 - DNA, 20 bp, Artificial Sequence
  Description of Artificial Sequence: Synthetic oligonucleotide
  Target: SCN10A; (-) strand; PAM type: YTN; PAM sequence: TTT
gggatgttccaactctctcc

SEQ ID NO: 53710 - DNA, 20 bp, Artificial Sequence
  Description of Artificial Sequence: Synthetic oligonucleotide
  Target: SCN10A; (-) strand; PAM type: YTN; PAM sequence: CTT
tgggatgttccaactctctc

SEQ ID NO: 53711 - DNA, 20 bp, Artificial Sequence
  Description of Artificial Sequence: Synthetic oligonucleotide
  Target: SCN10A; (-) strand; PAM type: YTN; PAM sequence: CTG
tccctttgggatgttccaac

SEQ ID NO: 53712 - DNA, 20 bp, Artificial Sequence
  Description of Artificial Sequence: Synthetic oligonucleotide
  Target: SCN10A; (-) strand; PAM type: YTN; PAM sequence: TTC
ataaactgtccctttgggat

SEQ ID NO: 53713 - DNA, 20 bp, Artificial Sequence
  Description of Artificial Sequence: Synthetic oligonucleotide
  Target: SCN10A; (-) strand; PAM type: YTN; PAM sequence: TTT
cataaactgtccctttggga

SEQ ID NO: 53714 - DNA, 20 bp, Artificial Sequence
  Description of Artificial Sequence: Synthetic oligonucleotide
  Target: SCN10A; (-) strand; PAM type: YTN; PAM sequence: CTT
tcataaactgtccctttggg

SEQ ID NO: 53715 - DNA, 20 bp, Artificial Sequence
  Description of Artificial Sequence: Synthetic oligonucleotide
  Target: SCN10A; (-) strand; PAM type: YTN; PAM sequence: TTC
tttcataaactgtccctttg

SEQ ID NO: 53716 - DNA, 20 bp, Artificial Sequence
  Description of Artificial Sequence: Synthetic oligonucleotide
  Target: SCN10A; (-) strand; PAM type: YTN; PAM sequence: CTT
ctttcataaactgtcccttt

SEQ ID NO: 53717 - DNA, 20 bp, Artificial Sequence
  Description of Artificial Sequence: Synthetic oligonucleotide
  Target: SCN10A; (-) strand; PAM type: YTN; PAM sequence: CTG
taatcttctttcataaactg

SEQ ID NO: 53718 - DNA, 20 bp, Artificial Sequence
  Description of Artificial Sequence: Synthetic oligonucleotide
  Target: SCN10A; (-) strand; PAM type: YTN; PAM sequence: CTG
gcctgtaatcttctttcata

SEQ ID NO: 53719 - DNA, 20 bp, Artificial Sequence
  Description of Artificial Sequence: Synthetic oligonucleotide
  Target: SCN10A; (-) strand; PAM type: YTN; PAM sequence: CTA
aatgaggctggcctgtaatc

SEQ ID NO: 53720 - DNA, 20 bp, Artificial Sequence
  Description of Artificial Sequence: Synthetic oligonucleotide
  Target: SCN10A; (-) strand; PAM type: YTN; PAM sequence: TTG
ctaaatgaggctggcctgta

SEQ ID NO: 53721 - DNA, 20 bp, Artificial Sequence
  Description of Artificial Sequence: Synthetic oligonucleotide
  Target: SCN10A; (-) strand; PAM type: YTN; PAM sequence: TTT
gctaaatgaggctggcctgt

SEQ ID NO: 53722 - DNA, 20 bp, Artificial Sequence
  Description of Artificial Sequence: Synthetic oligonucleotide
  Target: SCN10A; (-) strand; PAM type: YTN; PAM sequence: TTT
tgctaaatgaggctggcctg

SEQ ID NO: 53723 - DNA, 20 bp, Artificial Sequence
  Description of Artificial Sequence: Synthetic oligonucleotide
  Target: SCN10A; (-) strand; PAM type: YTN; PAM sequence: CTA
ttttgctaaatgaggctggc

SEQ ID NO: 53724 - DNA, 20 bp, Artificial Sequence
  Description of Artificial Sequence: Synthetic oligonucleotide
  Target: SCN10A; (-) strand; PAM type: YTN; PAM sequence: TTA
tctattttgctaaatgaggc

SEQ ID NO: 53725 - DNA, 20 bp, Artificial Sequence
  Description of Artificial Sequence: Synthetic oligonucleotide
  Target: SCN10A; (-) strand; PAM type: YTN; PAM sequence: TTT
atctattttgctaaatgagg

SEQ ID NO: 53726 - DNA, 20 bp, Artificial Sequence
  Description of Artificial Sequence: Synthetic oligonucleotide
  Target: SCN10A; (-) strand; PAM type: YTN; PAM sequence: TTT
tatctattttgctaaatgag

SEQ ID NO: 53727 - DNA, 20 bp, Artificial Sequence
  Description of Artificial Sequence: Synthetic oligonucleotide
  Target: SCN10A; (-) strand; PAM type: YTN; PAM sequence: TTC
attttatctattttgctaaa

SEQ ID NO: 53728 - DNA, 20 bp, Artificial Sequence
  Description of Artificial Sequence: Synthetic oligonucleotide
  Target: SCN10A; (-) strand; PAM type: YTN; PAM sequence: TTT
cattttatctattttgctaa

SEQ ID NO: 53729 - DNA, 20 bp, Artificial Sequence
  Description of Artificial Sequence: Synthetic oligonucleotide
  Target: SCN10A; (-) strand; PAM type: YTN; PAM sequence: TTA
ggtgtatttcattttatcta

SEQ ID NO: 53730 - DNA, 20 bp, Artificial Sequence
  Description of Artificial Sequence: Synthetic oligonucleotide
  Target: SCN10A; (-) strand; PAM type: YTN; PAM sequence: TTC
aattaggtgtatttcatttt

SEQ ID NO: 53731 - DNA, 20 bp, Artificial Sequence
  Description of Artificial Sequence: Synthetic oligonucleotide
  Target: SCN10A; (-) strand; PAM type: YTN; PAM sequence: CTG
gattcaattaggtgtatttc

SEQ ID NO: 53732 - DNA, 20 bp, Artificial Sequence
  Description of Artificial Sequence: Synthetic oligonucleotide
  Target: SCN10A; (-) strand; PAM type: YTN; PAM sequence: TTG
ctggattcaattaggtgtat

SEQ ID NO: 53733 - DNA, 20 bp, Artificial Sequence
  Description of Artificial Sequence: Synthetic oligonucleotide
  Target: SCN10A; (-) strand; PAM type: YTN; PAM sequence: TTT
gctggattcaattaggtgta

SEQ ID NO: 53734 - DNA, 20 bp, Artificial Sequence
  Description of Artificial Sequence: Synthetic oligonucleotide
  Target: SCN10A; (-) strand; PAM type: YTN; PAM sequence: TTT
tgctggattcaattaggtgt

SEQ ID NO: 53735 - DNA, 20 bp, Artificial Sequence
  Description of Artificial Sequence: Synthetic oligonucleotide
  Target: SCN10A; (-) strand; PAM type: YTN; PAM sequence: CTG
atcattttgctggattcaat

SEQ ID NO: 53736 - DNA, 20 bp, Artificial Sequence
  Description of Artificial Sequence: Synthetic oligonucleotide
  Target: SCN10A; (-) strand; PAM type: YTN; PAM sequence: TTC
cagctgatcattttgctgga

SEQ ID NO: 53737 - DNA, 20 bp, Artificial Sequence
  Description of Artificial Sequence: Synthetic oligonucleotide
  Target: SCN10A; (-) strand; PAM type: YTN; PAM sequence: TTA
atggttccagctgatcattt

SEQ ID NO: 53738 - DNA, 20 bp, Artificial Sequence
  Description of Artificial Sequence: Synthetic oligonucleotide
  Target: SCN10A; (-) strand; PAM type: YTN; PAM sequence: TTT
aatggttccagctgatcatt

SEQ ID NO: 53739 - DNA, 20 bp, Artificial Sequence
  Description of Artificial Sequence: Synthetic oligonucleotide
  Target: SCN10A; (-) strand; PAM type: YTN; PAM sequence: TTT
taatggttccagctgatcat

SEQ ID NO: 53740 - DNA, 20 bp, Artificial Sequence
  Description of Artificial Sequence: Synthetic oligonucleotide
  Target: SCN10A; (-) strand; PAM type: YTN; PAM sequence: TTT
ttaatggttccagctgatca

SEQ ID NO: 53741 - DNA, 20 bp, Artificial Sequence
  Description of Artificial Sequence: Synthetic oligonucleotide
  Target: SCN10A; (-) strand; PAM type: YTN; PAM sequence: CTA
tttttaatggttccagctga

SEQ ID NO: 53742 - DNA, 20 bp, Artificial Sequence
  Description of Artificial Sequence: Synthetic oligonucleotide
  Target: SCN10A; (-) strand; PAM type: YTN; PAM sequence: TTA
gtctatttttaatggttcca

SEQ ID NO: 53743 - DNA, 20 bp, Artificial Sequence
  Description of Artificial Sequence: Synthetic oligonucleotide
  Target: SCN10A; (-) strand; PAM type: YTN; PAM sequence: TTG
ttagtctatttttaatggtt

SEQ ID NO: 53744 - DNA, 20 bp, Artificial Sequence
  Description of Artificial Sequence: Synthetic oligonucleotide
  Target: SCN10A; (-) strand; PAM type: YTN; PAM sequence: TTT
gttagtctatttttaatggt

SEQ ID NO: 53745 - DNA, 20 bp, Artificial Sequence
  Description of Artificial Sequence: Synthetic oligonucleotide
  Target: SCN10A; (-) strand; PAM type: YTN; PAM sequence: CTA
acaggtttgttagtctattt

SEQ ID NO: 53746 - DNA, 20 bp, Artificial Sequence
  Description of Artificial Sequence: Synthetic oligonucleotide
  Target: SCN10A; (-) strand; PAM type: YTN; PAM sequence: CTG
taaactaacaggtttgttag

SEQ ID NO: 53747 - DNA, 20 bp, Artificial Sequence
  Description of Artificial Sequence: Synthetic oligonucleotide
  Target: SCN10A; (-) strand; PAM type: YTN; PAM sequence: TTA
gtatagtaaatctgtaaact

SEQ ID NO: 53748 - DNA, 20 bp, Artificial Sequence
  Description of Artificial Sequence: Synthetic oligonucleotide
  Target: SCN10A; (-) strand; PAM type: YTN; PAM sequence: CTG
ttagtatagtaaatctgtaa

SEQ ID NO: 53749 - DNA, 20 bp, Artificial Sequence
  Description of Artificial Sequence: Synthetic oligonucleotide
  Target: SCN10A; (-) strand; PAM type: YTN; PAM sequence: TTC
atctgttagtatagtaaatc

SEQ ID NO: 53750 - DNA, 20 bp, Artificial Sequence
  Description of Artificial Sequence: Synthetic oligonucleotide
  Target: SCN10A; (-) strand; PAM type: YTN; PAM sequence: TTT
catctgttagtatagtaaat

SEQ ID NO: 53751 - DNA, 20 bp, Artificial Sequence
  Description of Artificial Sequence: Synthetic oligonucleotide
  Target: SCN10A; (-) strand; PAM type: YTN; PAM sequence: CTT
tcatctgttagtatagtaaa

SEQ ID NO: 53752 - DNA, 20 bp, Artificial Sequence
  Description of Artificial Sequence: Synthetic oligonucleotide
  Target: SCN10A; (-) strand; PAM type: YTN; PAM sequence: TTA
tcatatagtctttcatctgt

SEQ ID NO: 53753 - DNA, 20 bp, Artificial Sequence
  Description of Artificial Sequence: Synthetic oligonucleotide
  Target: SCN10A; (-) strand; PAM type: YTN; PAM sequence: TTG
aggttatcatatagtctttc

SEQ ID NO: 53754 - DNA, 20 bp, Artificial Sequence
  Description of Artificial Sequence: Synthetic oligonucleotide
  Target: SCN10A; (-) strand; PAM type: YTN; PAM sequence: TTA
ttgaggttatcatatagtct

SEQ ID NO: 53755 - DNA, 20 bp, Artificial Sequence
  Description of Artificial Sequence: Synthetic oligonucleotide
  Target: SCN10A; (-) strand; PAM type: YTN; PAM sequence: TTT
attgaggttatcatatagtc

SEQ ID NO: 53756 - DNA, 20 bp, Artificial Sequence
  Description of Artificial Sequence: Synthetic oligonucleotide
  Target: SCN10A; (-) strand; PAM type: YTN; PAM sequence: TTA
tatttattgaggttatcata

SEQ ID NO: 53757 - DNA, 20 bp, Artificial Sequence
  Description of Artificial Sequence: Synthetic oligonucleotide
  Target: SCN10A; (-) strand; PAM type: YTN; PAM sequence: TTT
atatttattgaggttatcat

SEQ ID NO: 53758 - DNA, 20 bp, Artificial Sequence
  Description of Artificial Sequence: Synthetic oligonucleotide
  Target: SCN10A; (-) strand; PAM type: YTN; PAM sequence: TTT
tatatttattgaggttatca

SEQ ID NO: 53759 - DNA, 20 bp, Artificial Sequence
  Description of Artificial Sequence: Synthetic oligonucleotide
  Target: SCN10A; (-) strand; PAM type: YTN; PAM sequence: TTT
ttatatttattgaggttatc

SEQ ID NO: 53760 - DNA, 20 bp, Artificial Sequence
  Description of Artificial Sequence: Synthetic oligonucleotide
  Target: SCN10A; (-) strand; PAM type: YTN; PAM sequence: CTA
tcagtatttttatatttatt

SEQ ID NO: 53761 - DNA, 20 bp, Artificial Sequence
  Description of Artificial Sequence: Synthetic oligonucleotide
  Target: SCN10A; (-) strand; PAM type: YTN; PAM sequence: TTC
tatcagtatttttatattta

SEQ ID NO: 53762 - DNA, 20 bp, Artificial Sequence
  Description of Artificial Sequence: Synthetic oligonucleotide
  Target: SCN10A; (-) strand; PAM type: YTN; PAM sequence: CTT
ctatcagtatttttatattt

SEQ ID NO: 53763 - DNA, 20 bp, Artificial Sequence
  Description of Artificial Sequence: Synthetic oligonucleotide
  Target: SCN10A; (-) strand; PAM type: YTN; PAM sequence: TTG
gcttctatcagtatttttat

SEQ ID NO: 53764 - DNA, 20 bp, Artificial Sequence
  Description of Artificial Sequence: Synthetic oligonucleotide
  Target: SCN10A; (-) strand; PAM type: YTN; PAM sequence: TTC
atcatgaatgggtgttggct

SEQ ID NO: 53765 - DNA, 20 bp, Artificial Sequence
  Description of Artificial Sequence: Synthetic oligonucleotide
  Target: SCN10A; (-) strand; PAM type: YTN; PAM sequence: TTT
catcatgaatgggtgttggc

SEQ ID NO: 53766 - DNA, 20 bp, Artificial Sequence
  Description of Artificial Sequence: Synthetic oligonucleotide
  Target: SCN10A; (-) strand; PAM type: YTN; PAM sequence: CTT
tcatcatgaatgggtgttgg

SEQ ID NO: 53767 - DNA, 20 bp, Artificial Sequence
  Description of Artificial Sequence: Synthetic oligonucleotide
  Target: SCN10A; (-) strand; PAM type: YTN; PAM sequence: TTG
agactttcatcatgaatggg

SEQ ID NO: 53768 - DNA, 20 bp, Artificial Sequence
  Description of Artificial Sequence: Synthetic oligonucleotide
  Target: SCN10A; (-) strand; PAM type: YTN; PAM sequence: TTG
ttgagactttcatcatgaat

SEQ ID NO: 53769 - DNA, 20 bp, Artificial Sequence
  Description of Artificial Sequence: Synthetic oligonucleotide
  Target: SCN10A; (-) strand; PAM type: YTN; PAM sequence: TTT
gttgagactttcatcatgaa

SEQ ID NO: 53770 - DNA, 20 bp, Artificial Sequence
  Description of Artificial Sequence: Synthetic oligonucleotide
  Target: SCN10A; (-) strand; PAM type: YTN; PAM sequence: TTG
tttgttgagactttcatcat

SEQ ID NO: 53771 - DNA, 20 bp, Artificial Sequence
  Description of Artificial Sequence: Synthetic oligonucleotide
  Target: SCN10A; (-) strand; PAM type: YTN; PAM sequence: CTT
gtttgttgagactttcatca

SEQ ID NO: 53772 - DNA, 20 bp, Artificial Sequence
  Description of Artificial Sequence: Synthetic oligonucleotide
  Target: SCN10A; (-) strand; PAM type: YTN; PAM sequence: TTC
ttgtttgttgagactttcat

SEQ ID NO: 53773 - DNA, 20 bp, Artificial Sequence
  Description of Artificial Sequence: Synthetic oligonucleotide
  Target: SCN10A; (-) strand; PAM type: YTN; PAM sequence: TTT
cttgtttgttgagactttca

SEQ ID NO: 53774 - DNA, 20 bp, Artificial Sequence
  Description of Artificial Sequence: Synthetic oligonucleotide
  Target: SCN10A; (-) strand; PAM type: YTN; PAM sequence: TTC
catttcttgtttgttgagac

SEQ ID NO: 53775 - DNA, 20 bp, Artificial Sequence
  Description of Artificial Sequence: Synthetic oligonucleotide
  Target: SCN10A; (-) strand; PAM type: YTN; PAM sequence: TTT
ccatttcttgtttgttgaga

SEQ ID NO: 53776 - DNA, 20 bp, Artificial Sequence
  Description of Artificial Sequence: Synthetic oligonucleotide
  Target: SCN10A; (-) strand; PAM type: YTN; PAM sequence: TTT
tccatttcttgtttgttgag

SEQ ID NO: 53777 - DNA, 20 bp, Artificial Sequence
  Description of Artificial Sequence: Synthetic oligonucleotide
  Target: SCN10A; (-) strand; PAM type: YTN; PAM sequence: TTT
ttccatttcttgtttgttga

SEQ ID NO: 53778 - DNA, 20 bp, Artificial Sequence
  Description of Artificial Sequence: Synthetic oligonucleotide
  Target: SCN10A; (-) strand; PAM type: YTN; PAM sequence: TTT
tttccatttcttgtttgttg

SEQ ID NO: 53779 - DNA, 20 bp, Artificial Sequence
  Description of Artificial Sequence: Synthetic oligonucleotide
  Target: SCN10A; (-) strand; PAM type: YTN; PAM sequence: TTA
tatcaattttttccatttct

SEQ ID NO: 53780 - DNA, 20 bp, Artificial Sequence
  Description of Artificial Sequence: Synthetic oligonucleotide
  Target: SCN10A; (-) strand; PAM type: YTN; PAM sequence: TTT
atatcaattttttccatttc

SEQ ID NO: 53781 - DNA, 20 bp, Artificial Sequence
  Description of Artificial Sequence: Synthetic oligonucleotide
  Target: SCN10A; (-) strand; PAM type: YTN; PAM sequence: TTT
tatatcaattttttccattt

SEQ ID NO: 53782 - DNA, 20 bp, Artificial Sequence
  Description of Artificial Sequence: Synthetic oligonucleotide
  Target: SCN10A; (-) strand; PAM type: YTN; PAM sequence: TTT
ttatatcaattttttccatt

SEQ ID NO: 53783 - DNA, 20 bp, Artificial Sequence
  Description of Artificial Sequence: Synthetic oligonucleotide
  Target: SCN10A; (-) strand; PAM type: YTN; PAM sequence: CTT
tttatatcaattttttccat

SEQ ID NO: 53784 - DNA, 20 bp, Artificial Sequence
  Description of Artificial Sequence: Synthetic oligonucleotide
  Target: SCN10A; (-) strand; PAM type: YTN; PAM sequence: TTA
ctttttatatcaattttttc

SEQ ID NO: 53785 - DNA, 20 bp, Artificial Sequence
  Description of Artificial Sequence: Synthetic oligonucleotide
  Target: SCN10A; (-) strand; PAM type: YTN; PAM sequence: CTC
ataattactttttatatcaa

SEQ ID NO: 53786 - DNA, 20 bp, Artificial Sequence
  Description of Artificial Sequence: Synthetic oligonucleotide
  Target: SCN10A; (-) strand; PAM type: YTN; PAM sequence: TTA
tgagagtctcataattactt

SEQ ID NO: 53787 - DNA, 20 bp, Artificial Sequence
  Description of Artificial Sequence: Synthetic oligonucleotide
  Target: SCN10A; (-) strand; PAM type: YTN; PAM sequence: TTT
atgagagtctcataattact

SEQ ID NO: 53788 - DNA, 20 bp, Artificial Sequence
  Description of Artificial Sequence: Synthetic oligonucleotide
  Target: SCN10A; (-) strand; PAM type: YTN; PAM sequence: TTA
tgatgtttatgagagtctca

SEQ ID NO: 53789 - DNA, 20 bp, Artificial Sequence
  Description of Artificial Sequence: Synthetic oligonucleotide
  Target: SCN10A; (-) strand; PAM type: YTN; PAM sequence: CTA
ttatgatgtttatgagagtc

SEQ ID NO: 53790 - DNA, 20 bp, Artificial Sequence
  Description of Artificial Sequence: Synthetic oligonucleotide
  Target: SCN10A; (-) strand; PAM type: YTN; PAM sequence: TTC
actattatgatgtttatgag

SEQ ID NO: 53791 - DNA, 20 bp, Artificial Sequence
  Description of Artificial Sequence: Synthetic oligonucleotide
  Target: SCN10A; (-) strand; PAM type: YTN; PAM sequence: TTT
cactattatgatgtttatga

SEQ ID NO: 53792 - DNA, 20 bp, Artificial Sequence
  Description of Artificial Sequence: Synthetic oligonucleotide
  Target: SCN10A; (-) strand; PAM type: YTN; PAM sequence: CTA
atgtttcactattatgatgt

SEQ ID NO: 53793 - DNA, 20 bp, Artificial Sequence
  Description of Artificial Sequence: Synthetic oligonucleotide
  Target: SCN10A; (-) strand; PAM type: YTN; PAM sequence: TTC
taatgtttcactattatgat

SEQ ID NO: 53794 - DNA, 20 bp, Artificial Sequence
  Description of Artificial Sequence: Synthetic oligonucleotide
  Target: SCN10A; (-) strand; PAM type: YTN; PAM sequence: CTT
ctaatgtttcactattatga

SEQ ID NO: 53795 - DNA, 20 bp, Artificial Sequence
  Description of Artificial Sequence: Synthetic oligonucleotide
  Target: SCN10A; (-) strand; PAM type: YTN; PAM sequence: TTA
aagtgtgtgcttctaatgtt

SEQ ID NO: 53796 - DNA, 20 bp, Artificial Sequence
  Description of Artificial Sequence: Synthetic oligonucleotide
  Target: SCN10A; (-) strand; PAM type: YTN; PAM sequence: TTT
aaagtgtgtgcttctaatgt

SEQ ID NO: 53797 - DNA, 20 bp, Artificial Sequence
  Description of Artificial Sequence: Synthetic oligonucleotide
  Target: SCN10A; (-) strand; PAM type: YTN; PAM sequence: TTT
taaagtgtgtgcttctaatg

SEQ ID NO: 53798 - DNA, 20 bp, Artificial Sequence
  Description of Artificial Sequence: Synthetic oligonucleotide
  Target: SCN10A; (-) strand; PAM type: YTN; PAM sequence: TTG
attttaaagtgtgtgcttct

SEQ ID NO: 53799 - DNA, 20 bp, Artificial Sequence
  Description of Artificial Sequence: Synthetic oligonucleotide
  Target: SCN10A; (-) strand; PAM type: YTN; PAM sequence: CTT
gattttaaagtgtgtgcttc

SEQ ID NO: 53800 - DNA, 20 bp, Artificial Sequence
  Description of Artificial Sequence: Synthetic oligonucleotide
  Target: SCN10A; (-) strand; PAM type: YTN; PAM sequence: CTC
ttgattttaaagtgtgtgct

SEQ ID NO: 53801 - DNA, 20 bp, Artificial Sequence
  Description of Artificial Sequence: Synthetic oligonucleotide
  Target: SCN10A; (-) strand; PAM type: YTN; PAM sequence: TTG
ctcttgattttaaagtgtgt

SEQ ID NO: 53802 - DNA, 20 bp, Artificial Sequence
  Description of Artificial Sequence: Synthetic oligonucleotide
  Target: SCN10A; (-) strand; PAM type: YTN; PAM sequence: TTT
gctcttgattttaaagtgtg

SEQ ID NO: 53803 - DNA, 20 bp, Artificial Sequence
  Description of Artificial Sequence: Synthetic oligonucleotide
  Target: SCN10A; (-) strand; PAM type: YTN; PAM sequence: TTT
tgctcttgattttaaagtgt

SEQ ID NO: 53804 - DNA, 20 bp, Artificial Sequence
  Description of Artificial Sequence: Synthetic oligonucleotide
  Target: SCN10A; (-) strand; PAM type: YTN; PAM sequence: TTA
ttttgctcttgattttaaag

SEQ ID NO: 53805 - DNA, 20 bp, Artificial Sequence
  Description of Artificial Sequence: Synthetic oligonucleotide
  Target: SCN10A; (-) strand; PAM type: YTN; PAM sequence: TTT
attttgctcttgattttaaa

SEQ ID NO: 53806 - DNA, 20 bp, Artificial Sequence
  Description of Artificial Sequence: Synthetic oligonucleotide
  Target: SCN10A; (-) strand; PAM type: YTN; PAM sequence: CTA
tgacagtgagcatatttatt

SEQ ID NO: 53807 - DNA, 20 bp, Artificial Sequence
  Description of Artificial Sequence: Synthetic oligonucleotide
  Target: SCN10A; (-) strand; PAM type: YTN; PAM sequence: TTC
aaagctatgacagtgagcat

SEQ ID NO: 53808 - DNA, 20 bp, Artificial Sequence
  Description of Artificial Sequence: Synthetic oligonucleotide
  Target: SCN10A; (-) strand; PAM type: YTN; PAM sequence: TTC
aacaagatggtaattcaaag

SEQ ID NO: 53809 - DNA, 20 bp, Artificial Sequence
  Description of Artificial Sequence: Synthetic oligonucleotide
  Target: SCN10A; (-) strand; PAM type: YTN; PAM sequence: CTT
caacaagatggtaattcaaa

SEQ ID NO: 53810 - DNA, 20 bp, Artificial Sequence
  Description of Artificial Sequence: Synthetic oligonucleotide
  Target: SCN10A; (-) strand; PAM type: YTN; PAM sequence: TTG
gccgggaccttcaacaagat

SEQ ID NO: 53811 - DNA, 20 bp, Artificial Sequence
  Description of Artificial Sequence: Synthetic oligonucleotide
  Target: SCN10A; (-) strand; PAM type: YTN; PAM sequence: TTG
aattggccgggaccttcaac

SEQ ID NO: 53812 - DNA, 20 bp, Artificial Sequence
  Description of Artificial Sequence: Synthetic oligonucleotide
  Target: SCN10A; (-) strand; PAM type: YTN; PAM sequence: TTA
ttgaattggccgggaccttc

SEQ ID NO: 53813 - DNA, 20 bp, Artificial Sequence
  Description of Artificial Sequence: Synthetic oligonucleotide
  Target: SCN10A; (-) strand; PAM type: YTN; PAM sequence: CTT
attgaattggccgggacctt

SEQ ID NO: 53814 - DNA, 20 bp, Artificial Sequence
  Description of Artificial Sequence: Synthetic oligonucleotide
  Target: SCN10A; (-) strand; PAM type: YTN; PAM sequence: CTG
tcttattgaattggccggga

SEQ ID NO: 53815 - DNA, 20 bp, Artificial Sequence
  Description of Artificial Sequence: Synthetic oligonucleotide
  Target: SCN10A; (-) strand; PAM type: YTN; PAM sequence: TTC
ctgtcttattgaattggccg

SEQ ID NO: 53816 - DNA, 20 bp, Artificial Sequence
  Description of Artificial Sequence: Synthetic oligonucleotide
  Target: SCN10A; (-) strand; PAM type: YTN; PAM sequence: TTT
cctgtcttattgaattggcc

SEQ ID NO: 53817 - DNA, 20 bp, Artificial Sequence
  Description of Artificial Sequence: Synthetic oligonucleotide
  Target: SCN10A; (-) strand; PAM type: YTN; PAM sequence: TTT
tcctgtcttattgaattggc

SEQ ID NO: 53818 - DNA, 20 bp, Artificial Sequence
  Description of Artificial Sequence: Synthetic oligonucleotide
  Target: SCN10A; (-) strand; PAM type: YTN; PAM sequence: TTT
ttcctgtcttattgaattgg

SEQ ID NO: 53819 - DNA, 20 bp, Artificial Sequence
  Description of Artificial Sequence: Synthetic oligonucleotide
  Target: SCN10A; (-) strand; PAM type: YTN; PAM sequence: TTA
tttttcctgtcttattgaat

SEQ ID NO: 53820 - DNA, 20 bp, Artificial Sequence
  Description of Artificial Sequence: Synthetic oligonucleotide
  Target: SCN10A; (-) strand; PAM type: YTN; PAM sequence: TTT
atttttcctgtcttattgaa

SEQ ID NO: 53821 - DNA, 20 bp, Artificial Sequence
  Description of Artificial Sequence: Synthetic oligonucleotide
  Target: SCN10A; (-) strand; PAM type: YTN; PAM sequence: TTT
tatttttcctgtcttattga

SEQ ID NO: 53822 - DNA, 20 bp, Artificial Sequence
  Description of Artificial Sequence: Synthetic oligonucleotide
  Target: SCN10A; (-) strand; PAM type: YTN; PAM sequence: TTT
ttatttttcctgtcttattg

SEQ ID NO: 53823 - DNA, 20 bp, Artificial Sequence
  Description of Artificial Sequence: Synthetic oligonucleotide
  Target: SCN10A; (-) strand; PAM type: YTN; PAM sequence: TTT
tttatttttcctgtcttatt

SEQ ID NO: 53824 - DNA, 20 bp, Artificial Sequence
  Description of Artificial Sequence: Synthetic oligonucleotide
  Target: SCN10A; (-) strand; PAM type: YTN; PAM sequence: CTT
ttttatttttcctgtcttat

SEQ ID NO: 53825 - DNA, 20 bp, Artificial Sequence
  Description of Artificial Sequence: Synthetic oligonucleotide
  Target: SCN10A; (-) strand; PAM type: YTN; PAM sequence: TTA
taccacttttttatttttcc

SEQ ID NO: 53826 - DNA, 20 bp, Artificial Sequence
  Description of Artificial Sequence: Synthetic oligonucleotide
  Target: SCN10A; (-) strand; PAM type: YTN; PAM sequence: CTT
ataccacttttttatttttc

SEQ ID NO: 53827 - DNA, 20 bp, Artificial Sequence
  Description of Artificial Sequence: Synthetic oligonucleotide
  Target: SCN10A; (-) strand; PAM type: YTN; PAM sequence: TTC
ttataccacttttttatttt

SEQ ID NO: 53828 - DNA, 20 bp, Artificial Sequence
  Description of Artificial Sequence: Synthetic oligonucleotide
  Target: SCN10A; (-) strand; PAM type: YTN; PAM sequence: TTA
tgattcttataccacttttt

SEQ ID NO: 53829 - DNA, 20 bp, Artificial Sequence
  Description of Artificial Sequence: Synthetic oligonucleotide
  Target: SCN10A; (-) strand; PAM type: YTN; PAM sequence: TTT
atgattcttataccactttt

SEQ ID NO: 53830 - DNA, 20 bp, Artificial Sequence
  Description of Artificial Sequence: Synthetic oligonucleotide
  Target: SCN10A; (-) strand; PAM type: YTN; PAM sequence: CTT
tatgattcttataccacttt

SEQ ID NO: 53831 - DNA, 20 bp, Artificial Sequence
  Description of Artificial Sequence: Synthetic oligonucleotide
  Target: SCN10A; (-) strand; PAM type: YTN; PAM sequence: TTC
ctttatgattcttataccac

SEQ ID NO: 53832 - DNA, 20 bp, Artificial Sequence
  Description of Artificial Sequence: Synthetic oligonucleotide
  Target: SCN10A; (-) strand; PAM type: YTN; PAM sequence: CTT
cctttatgattcttatacca

SEQ ID NO: 53833 - DNA, 20 bp, Artificial Sequence
  Description of Artificial Sequence: Synthetic oligonucleotide
  Target: SCN10A; (-) strand; PAM type: YTN; PAM sequence: TTC
ttcctttatgattcttatac

SEQ ID NO: 53834 - DNA, 20 bp, Artificial Sequence
  Description of Artificial Sequence: Synthetic oligonucleotide
  Target: SCN10A; (-) strand; PAM type: YTN; PAM sequence: TTT
cttcctttatgattcttata

SEQ ID NO: 53835 - DNA, 20 bp, Artificial Sequence
  Description of Artificial Sequence: Synthetic oligonucleotide
  Target: SCN10A; (-) strand; PAM type: YTN; PAM sequence: TTG
tttcttcctttatgattctt

SEQ ID NO: 53836 - DNA, 20 bp, Artificial Sequence
  Description of Artificial Sequence: Synthetic oligonucleotide
  Target: SCN10A; (-) strand; PAM type: YTN; PAM sequence: CTT
gtttcttcctttatgattct

SEQ ID NO: 53837 - DNA, 20 bp, Artificial Sequence
  Description of Artificial Sequence: Synthetic oligonucleotide
  Target: SCN10A; (-) strand; PAM type: YTN; PAM sequence: CTG
caaataatgacaaacttgtt

SEQ ID NO: 53838 - DNA, 20 bp, Artificial Sequence
  Description of Artificial Sequence: Synthetic oligonucleotide
  Target: SCN10A; (-) strand; PAM type: YTN; PAM sequence: TTA
tctgcaaataatgacaaact

SEQ ID NO: 53839 - DNA, 20 bp, Artificial Sequence
  Description of Artificial Sequence: Synthetic oligonucleotide
  Target: SCN10A; (-) strand; PAM type: YTN; PAM sequence: TTA
tattatctgcaaataatgac

SEQ ID NO: 53840 - DNA, 20 bp, Artificial Sequence
  Description of Artificial Sequence: Synthetic oligonucleotide
  Target: SCN10A; (-) strand; PAM type: YTN; PAM sequence: TTA
gacagttatattatctgcaa

SEQ ID NO: 53841 - DNA, 20 bp, Artificial Sequence
  Description of Artificial Sequence: Synthetic oligonucleotide
  Target: SCN10A; (-) strand; PAM type: YTN; PAM sequence: TTT
agacagttatattatctgca

SEQ ID NO: 53842 - DNA, 20 bp, Artificial Sequence
  Description of Artificial Sequence: Synthetic oligonucleotide
  Target: SCN10A; (-) strand; PAM type: YTN; PAM sequence: CTA
tttagacagttatattatct

SEQ ID NO: 53843 - DNA, 20 bp, Artificial Sequence
  Description of Artificial Sequence: Synthetic oligonucleotide
  Target: SCN10A; (-) strand; PAM type: YTN; PAM sequence: TTC
ctatttagacagttatatta

SEQ ID NO: 53844 - DNA, 20 bp, Artificial Sequence
  Description of Artificial Sequence: Synthetic oligonucleotide
  Target: SCN10A; (-) strand; PAM type: YTN; PAM sequence: CTT
cctatttagacagttatatt

SEQ ID NO: 53845 - DNA, 20 bp, Artificial Sequence
  Description of Artificial Sequence: Synthetic oligonucleotide
  Target: SCN10A; (-) strand; PAM type: YTN; PAM sequence: TTG
gacttcctatttagacagtt

SEQ ID NO: 53846 - DNA, 20 bp, Artificial Sequence
  Description of Artificial Sequence: Synthetic oligonucleotide
  Target: SCN10A; (-) strand; PAM type: YTN; PAM sequence: CTT
ggacttcctatttagacagt

SEQ ID NO: 53847 - DNA, 20 bp, Artificial Sequence
  Description of Artificial Sequence: Synthetic oligonucleotide
  Target: SCN10A; (-) strand; PAM type: YTN; PAM sequence: TTC
ccttggacttcctatttaga

SEQ ID NO: 53848 - DNA, 20 bp, Artificial Sequence
  Description of Artificial Sequence: Synthetic oligonucleotide
  Target: SCN10A; (-) strand; PAM type: YTN; PAM sequence: CTG
tagattcccttggacttcct

SEQ ID NO: 53849 - DNA, 20 bp, Artificial Sequence
  Description of Artificial Sequence: Synthetic oligonucleotide
  Target: SCN10A; (-) strand; PAM type: YTN; PAM sequence: TTC
tgtagattcccttggacttc

SEQ ID NO: 53850 - DNA, 20 bp, Artificial Sequence
  Description of Artificial Sequence: Synthetic oligonucleotide
  Target: SCN10A; (-) strand; PAM type: YTN; PAM sequence: TTT
ctgtagattcccttggactt

SEQ ID NO: 53851 - DNA, 20 bp, Artificial Sequence
  Description of Artificial Sequence: Synthetic oligonucleotide
  Target: SCN10A; (-) strand; PAM type: YTN; PAM sequence: TTT
tctgtagattcccttggact

SEQ ID NO: 53852 - DNA, 20 bp, Artificial Sequence
  Description of Artificial Sequence: Synthetic oligonucleotide
  Target: SCN10A; (-) strand; PAM type: YTN; PAM sequence: TTT
ttctgtagattcccttggac

SEQ ID NO: 53853 - DNA, 20 bp, Artificial Sequence
  Description of Artificial Sequence: Synthetic oligonucleotide
  Target: SCN10A; (-) strand; PAM type: YTN; PAM sequence: TTA
aatttttctgtagattccct

SEQ ID NO: 53854 - DNA, 20 bp, Artificial Sequence
  Description of Artificial Sequence: Synthetic oligonucleotide
  Target: SCN10A; (-) strand; PAM type: YTN; PAM sequence: TTA
aagttaaatttttctgtaga

SEQ ID NO: 53855 - DNA, 20 bp, Artificial Sequence
  Description of Artificial Sequence: Synthetic oligonucleotide
  Target: SCN10A; (-) strand; PAM type: YTN; PAM sequence: CTT
aaagttaaatttttctgtag

SEQ ID NO: 53856 - DNA, 20 bp, Artificial Sequence
  Description of Artificial Sequence: Synthetic oligonucleotide
  Target: SCN10A; (-) strand; PAM type: YTN; PAM sequence: CTC
cttaaagttaaatttttctg

SEQ ID NO: 53857 - DNA, 20 bp, Artificial Sequence
  Description of Artificial Sequence: Synthetic oligonucleotide
  Target: SCN10A; (-) strand; PAM type: YTN; PAM sequence: CTG
agctccttaaagttaaattt

SEQ ID NO: 53858 - DNA, 20 bp, Artificial Sequence
  Description of Artificial Sequence: Synthetic oligonucleotide
  Target: SCN10A; (-) strand; PAM type: YTN; PAM sequence: CTG
ctgagctccttaaagttaaa

SEQ ID NO: 53859 - DNA, 20 bp, Artificial Sequence
  Description of Artificial Sequence: Synthetic oligonucleotide
  Target: SCN10A; (-) strand; PAM type: YTN; PAM sequence: TTG
catccagcaaccctgctgag

SEQ ID NO: 53860 - DNA, 20 bp, Artificial Sequence
  Description of Artificial Sequence: Synthetic oligonucleotide
  Target: SCN10A; (-) strand; PAM type: YTN; PAM sequence: TTT
gcatccagcaaccctgctga

SEQ ID NO: 53861 - DNA, 20 bp, Artificial Sequence
  Description of Artificial Sequence: Synthetic oligonucleotide
  Target: SCN10A; (-) strand; PAM type: YTN; PAM sequence: TTT
tgcatccagcaaccctgctg

SEQ ID NO: 53862 - DNA, 20 bp, Artificial Sequence
  Description of Artificial Sequence: Synthetic oligonucleotide
  Target: SCN10A; (-) strand; PAM type: YTN; PAM sequence: CTA
tatagtgattttgcatccag

SEQ ID NO: 53863 - DNA, 20 bp, Artificial Sequence
  Description of Artificial Sequence: Synthetic oligonucleotide
  Target: SCN10A; (-) strand; PAM type: YTN; PAM sequence: TTC
tatatagtgattttgcatcc

SEQ ID NO: 53864 - DNA, 20 bp, Artificial Sequence
  Description of Artificial Sequence: Synthetic oligonucleotide
  Target: SCN10A; (-) strand; PAM type: YTN; PAM sequence: TTT
ctatatagtgattttgcatc

SEQ ID NO: 53865 - DNA, 20 bp, Artificial Sequence
  Description of Artificial Sequence: Synthetic oligonucleotide
  Target: SCN10A; (-) strand; PAM type: YTN; PAM sequence: TTA
atttctatatagtgattttg

SEQ ID NO: 53866 - DNA, 20 bp, Artificial Sequence
  Description of Artificial Sequence: Synthetic oligonucleotide
  Target: SCN10A; (-) strand; PAM type: YTN; PAM sequence: TTA
ttaatttctatatagtgatt

SEQ ID NO: 53867 - DNA, 20 bp, Artificial Sequence
  Description of Artificial Sequence: Synthetic oligonucleotide
  Target: SCN10A; (-) strand; PAM type: YTN; PAM sequence: TTA
atattattaatttctatata

SEQ ID NO: 53868 - DNA, 20 bp, Artificial Sequence
  Description of Artificial Sequence: Synthetic oligonucleotide
  Target: SCN10A; (-) strand; PAM type: YTN; PAM sequence: CTT
aatattattaatttctatat

SEQ ID NO: 53869 - DNA, 20 bp, Artificial Sequence
  Description of Artificial Sequence: Synthetic oligonucleotide
  Target: SCN10A; (-) strand; PAM type: YTN; PAM sequence: CTG
tcttaatattattaatttct

SEQ ID NO: 53870 - DNA, 20 bp, Artificial Sequence
  Description of Artificial Sequence: Synthetic oligonucleotide
  Target: SCN10A; (-) strand; PAM type: YTN; PAM sequence: CTA
aactgtcttaatattattaa

SEQ ID NO: 53871 - DNA, 20 bp, Artificial Sequence
  Description of Artificial Sequence: Synthetic oligonucleotide
  Target: SCN10A; (-) strand; PAM type: YTN; PAM sequence: TTG
ctaaactgtcttaatattat

SEQ ID NO: 53872 - DNA, 20 bp, Artificial Sequence
  Description of Artificial Sequence: Synthetic oligonucleotide
  Target: SCN10A; (-) strand; PAM type: YTN; PAM sequence: TTA
ttgctaaactgtcttaatat

SEQ ID NO: 53873 - DNA, 20 bp, Artificial Sequence
  Description of Artificial Sequence: Synthetic oligonucleotide
  Target: SCN10A; (-) strand; PAM type: YTN; PAM sequence: TTA
ttattgctaaactgtcttaa

SEQ ID NO: 53874 - DNA, 20 bp, Artificial Sequence
  Description of Artificial Sequence: Synthetic oligonucleotide
  Target: SCN10A; (-) strand; PAM type: YTN; PAM sequence: CTT
attattgctaaactgtctta

SEQ ID NO: 53875 - DNA, 20 bp, Artificial Sequence
  Description of Artificial Sequence: Synthetic oligonucleotide
  Target: SCN10A; (-) strand; PAM type: YTN; PAM sequence: TTG
aatacttattattgctaaac

SEQ ID NO: 53876 - DNA, 20 bp, Artificial Sequence
  Description of Artificial Sequence: Synthetic oligonucleotide
  Target: SCN10A; (-) strand; PAM type: YTN; PAM sequence: CTA
ttgaatacttattattgcta

SEQ ID NO: 53877 - DNA, 20 bp, Artificial Sequence
  Description of Artificial Sequence: Synthetic oligonucleotide
  Target: SCN10A; (-) strand; PAM type: YTN; PAM sequence: TTG
ccctattgaatacttattat

SEQ ID NO: 53878 - DNA, 20 bp, Artificial Sequence
  Description of Artificial Sequence: Synthetic oligonucleotide
  Target: SCN10A; (-) strand; PAM type: YTN; PAM sequence: TTG
gttgccctattgaatactta

SEQ ID NO: 53879 - DNA, 20 bp, Artificial Sequence
  Description of Artificial Sequence: Synthetic oligonucleotide
  Target: SCN10A; (-) strand; PAM type: YTN; PAM sequence: TTT
ggttgccctattgaatactt

SEQ ID NO: 53880 - DNA, 20 bp, Artificial Sequence
  Description of Artificial Sequence: Synthetic oligonucleotide
  Target: SCN10A; (-) strand; PAM type: YTN; PAM sequence: TTT
tggttgccctattgaatact

SEQ ID NO: 53881 - DNA, 20 bp, Artificial Sequence
  Description of Artificial Sequence: Synthetic oligonucleotide
  Target: SCN10A; (-) strand; PAM type: YTN; PAM sequence: TTG
caattttggttgccctattg

SEQ ID NO: 53882 - DNA, 20 bp, Artificial Sequence
  Description of Artificial Sequence: Synthetic oligonucleotide
  Target: SCN10A; (-) strand; PAM type: YTN; PAM sequence: CTA
ggtacattgcaattttggtt

SEQ ID NO: 53883 - DNA, 20 bp, Artificial Sequence
  Description of Artificial Sequence: Synthetic oligonucleotide
  Target: SCN10A; (-) strand; PAM type: YTN; PAM sequence: TTC
ctaggtacattgcaattttg

SEQ ID NO: 53884 - DNA, 20 bp, Artificial Sequence
  Description of Artificial Sequence: Synthetic oligonucleotide
  Target: SCN10A; (-) strand; PAM type: YTN; PAM sequence: TTT
cctaggtacattgcaatttt

SEQ ID NO: 53885 - DNA, 20 bp, Artificial Sequence
  Description of Artificial Sequence: Synthetic oligonucleotide
  Target: SCN10A; (-) strand; PAM type: YTN; PAM sequence: TTT
tcctaggtacattgcaattt

SEQ ID NO: 53886 - DNA, 20 bp, Artificial Sequence
  Description of Artificial Sequence: Synthetic oligonucleotide
  Target: SCN10A; (-) strand; PAM type: YTN; PAM sequence: TTT
ttcctaggtacattgcaatt

SEQ ID NO: 53887 - DNA, 20 bp, Artificial Sequence
  Description of Artificial Sequence: Synthetic oligonucleotide
  Target: SCN10A; (-) strand; PAM type: YTN; PAM sequence: CTT
tttcctaggtacattgcaat

SEQ ID NO: 53888 - DNA, 20 bp, Artificial Sequence
  Description of Artificial Sequence: Synthetic oligonucleotide
  Target: SCN10A; (-) strand; PAM type: YTN; PAM sequence: TTA
taatgtctttttcctaggta

SEQ ID NO: 53889 - DNA, 20 bp, Artificial Sequence
  Description of Artificial Sequence: Synthetic oligonucleotide
  Target: SCN10A; (-) strand; PAM type: YTN; PAM sequence: TTT
ataatgtctttttcctaggt

SEQ ID NO: 53890 - DNA, 20 bp, Artificial Sequence
  Description of Artificial Sequence: Synthetic oligonucleotide
  Target: SCN10A; (-) strand; PAM type: YTN; PAM sequence: TTT
tataatgtctttttcctagg

SEQ ID NO: 53891 - DNA, 20 bp, Artificial Sequence
  Description of Artificial Sequence: Synthetic oligonucleotide
  Target: SCN10A; (-) strand; PAM type: YTN; PAM sequence: CTA
cattttataatgtctttttc

SEQ ID NO: 53892 - DNA, 20 bp, Artificial Sequence
  Description of Artificial Sequence: Synthetic oligonucleotide
  Target: SCN10A; (-) strand; PAM type: YTN; PAM sequence: TTC
tacattttataatgtctttt

SEQ ID NO: 53893 - DNA, 20 bp, Artificial Sequence
  Description of Artificial Sequence: Synthetic oligonucleotide
  Target: SCN10A; (-) strand; PAM type: YTN; PAM sequence: TTT
ctacattttataatgtcttt

SEQ ID NO: 53894 - DNA, 20 bp, Artificial Sequence
  Description of Artificial Sequence: Synthetic oligonucleotide
  Target: SCN10A; (-) strand; PAM type: YTN; PAM sequence: TTT
tctacattttataatgtctt

SEQ ID NO: 53895 - DNA, 20 bp, Artificial Sequence
  Description of Artificial Sequence: Synthetic oligonucleotide
  Target: SCN10A; (-) strand; PAM type: YTN; PAM sequence: TTT
ttctacattttataatgtct

SEQ ID NO: 53896 - DNA, 20 bp, Artificial Sequence
  Description of Artificial Sequence: Synthetic oligonucleotide
  Target: SCN10A; (-) strand; PAM type: YTN; PAM sequence: TTA
atatttttctacattttata

SEQ ID NO: 53897 - DNA, 20 bp, Artificial Sequence
  Description of Artificial Sequence: Synthetic oligonucleotide
  Target: SCN10A; (-) strand; PAM type: YTN; PAM sequence: TTT
aatatttttctacattttat

SEQ ID NO: 53898 - DNA, 20 bp, Artificial Sequence
  Description of Artificial Sequence: Synthetic oligonucleotide
  Target: SCN10A; (-) strand; PAM type: YTN; PAM sequence: CTT
taatatttttctacatttta

SEQ ID NO: 53899 - DNA, 20 bp, Artificial Sequence
  Description of Artificial Sequence: Synthetic oligonucleotide
  Target: SCN10A; (-) strand; PAM type: YTN; PAM sequence: TTC
tttaatatttttctacattt

SEQ ID NO: 53900 - DNA, 20 bp, Artificial Sequence
  Description of Artificial Sequence: Synthetic oligonucleotide
  Target: SCN10A; (-) strand; PAM type: YTN; PAM sequence: CTT
ctttaatatttttctacatt

SEQ ID NO: 53901 - DNA, 20 bp, Artificial Sequence
  Description of Artificial Sequence: Synthetic oligonucleotide
  Target: SCN10A; (-) strand; PAM type: YTN; PAM sequence: TTA
tacaggtcttctttaatatt

SEQ ID NO: 53902 - DNA, 20 bp, Artificial Sequence
  Description of Artificial Sequence: Synthetic oligonucleotide
  Target: SCN10A; (-) strand; PAM type: YTN; PAM sequence: TTT
atacaggtcttctttaatat

SEQ ID NO: 53903 - DNA, 20 bp, Artificial Sequence
  Description of Artificial Sequence: Synthetic oligonucleotide
  Target: SCN10A; (-) strand; PAM type: YTN; PAM sequence: TTA
atttatacaggtcttcttta

SEQ ID NO: 53904 - DNA, 20 bp, Artificial Sequence
  Description of Artificial Sequence: Synthetic oligonucleotide
  Target: SCN10A; (-) strand; PAM type: YTN; PAM sequence: CTT
aatttatacaggtcttcttt

SEQ ID NO: 53905 - DNA, 20 bp, Artificial Sequence
  Description of Artificial Sequence: Synthetic oligonucleotide
  Target: SCN10A; (-) strand; PAM type: YTN; PAM sequence: CTC
ttaatttatacaggtcttct

SEQ ID NO: 53906 - DNA, 20 bp, Artificial Sequence
  Description of Artificial Sequence: Synthetic oligonucleotide
  Target: SCN10A; (-) strand; PAM type: YTN; PAM sequence: TTC
ccacacatcagtatggcaga

SEQ ID NO: 53907 - DNA, 20 bp, Artificial Sequence
  Description of Artificial Sequence: Synthetic oligonucleotide
  Target: SCN10A; (-) strand; PAM type: YTN; PAM sequence: CTT
cccacacatcagtatggcag

SEQ ID NO: 53908 - DNA, 20 bp, Artificial Sequence
  Description of Artificial Sequence: Synthetic oligonucleotide
  Target: SCN10A; (-) strand; PAM type: YTN; PAM sequence: TTA
caatacgaagccttcccaca

SEQ ID NO: 53909 - DNA, 20 bp, Artificial Sequence
  Description of Artificial Sequence: Synthetic oligonucleotide
  Target: SCN10A; (-) strand; PAM type: YTN; PAM sequence: TTT
acaatacgaagccttcccac

SEQ ID NO: 53910 - DNA, 20 bp, Artificial Sequence
  Description of Artificial Sequence: Synthetic oligonucleotide
  Target: SCN10A; (-) strand; PAM type: YTN; PAM sequence: TTA
tcaccacaggaagaatcgcc

SEQ ID NO: 53911 - DNA, 20 bp, Artificial Sequence
  Description of Artificial Sequence: Synthetic oligonucleotide
  Target: SCN10A; (-) strand; PAM type: YTN; PAM sequence: TTT
atcaccacaggaagaatcgc

SEQ ID NO: 53912 - DNA, 20 bp, Artificial Sequence
  Description of Artificial Sequence: Synthetic oligonucleotide
  Target: SCN10A; (-) strand; PAM type: YTN; PAM sequence: TTG
atttatcaccacaggaagaa

SEQ ID NO: 53913 - DNA, 20 bp, Artificial Sequence
  Description of Artificial Sequence: Synthetic oligonucleotide
  Target: SCN10A; (-) strand; PAM type: YTN; PAM sequence: CTG
aattgatttatcaccacagg

SEQ ID NO: 53914 - DNA, 20 bp, Artificial Sequence
  Description of Artificial Sequence: Synthetic oligonucleotide
  Target: SCN10A; (-) strand; PAM type: YTN; PAM sequence: TTG
gtaatgcactgaattgattt

SEQ ID NO: 53915 - DNA, 20 bp, Artificial Sequence
  Description of Artificial Sequence: Synthetic oligonucleotide
  Target: SCN10A; (-) strand; PAM type: YTN; PAM sequence: TTT
ggtaatgcactgaattgatt

SEQ ID NO: 53916 - DNA, 20 bp, Artificial Sequence
  Description of Artificial Sequence: Synthetic oligonucleotide
  Target: SCN10A; (-) strand; PAM type: YTN; PAM sequence: TTG
tttggtaatgcactgaattg

SEQ ID NO: 53917 - DNA, 20 bp, Artificial Sequence
  Description of Artificial Sequence: Synthetic oligonucleotide
  Target: SCN10A; (-) strand; PAM type: YTN; PAM sequence: TTT
gtttggtaatgcactgaatt

SEQ ID NO: 53918 - DNA, 20 bp, Artificial Sequence
  Description of Artificial Sequence: Synthetic oligonucleotide
  Target: SCN10A; (-) strand; PAM type: YTN; PAM sequence: CTT
tgtttggtaatgcactgaat

SEQ ID NO: 53919 - DNA, 20 bp, Artificial Sequence
  Description of Artificial Sequence: Synthetic oligonucleotide
  Target: SCN10A; (-) strand; PAM type: YTN; PAM sequence: CTG
tggaaactttgtttggtaat

SEQ ID NO: 53920 - DNA, 20 bp, Artificial Sequence
  Description of Artificial Sequence: Synthetic oligonucleotide
  Target: SCN10A; (-) strand; PAM type: YTN; PAM sequence: CTC
tgtggaaactttgtttggta

SEQ ID NO: 53921 - DNA, 20 bp, Artificial Sequence
  Description of Artificial Sequence: Synthetic oligonucleotide
  Target: SCN10A; (-) strand; PAM type: YTN; PAM sequence: TTA
caactctgtggaaactttgt

SEQ ID NO: 53922 - DNA, 20 bp, Artificial Sequence
  Description of Artificial Sequence: Synthetic oligonucleotide
  Target: SCN10A; (-) strand; PAM type: YTN; PAM sequence: CTT
acaactctgtggaaactttg

SEQ ID NO: 53923 - DNA, 20 bp, Artificial Sequence
  Description of Artificial Sequence: Synthetic oligonucleotide
  Target: SCN10A; (-) strand; PAM type: YTN; PAM sequence: TTC
ttacaactctgtggaaactt

SEQ ID NO: 53924 - DNA, 20 bp, Artificial Sequence
  Description of Artificial Sequence: Synthetic oligonucleotide
  Target: SCN10A; (-) strand; PAM type: YTN; PAM sequence: TTT
cttacaactctgtggaaact

SEQ ID NO: 53925 - DNA, 20 bp, Artificial Sequence
  Description of Artificial Sequence: Synthetic oligonucleotide
  Target: SCN10A; (-) strand; PAM type: YTN; PAM sequence: TTT
tcttacaactctgtggaaac

SEQ ID NO: 53926 - DNA, 20 bp, Artificial Sequence
  Description of Artificial Sequence: Synthetic oligonucleotide
  Target: SCN10A; (-) strand; PAM type: YTN; PAM sequence: CTT
ttcttacaactctgtggaaa

SEQ ID NO: 53927 - DNA, 20 bp, Artificial Sequence
  Description of Artificial Sequence: Synthetic oligonucleotide
  Target: SCN10A; (-) strand; PAM type: YTN; PAM sequence: CTC
ttttcttacaactctgtgga

SEQ ID NO: 53928 - DNA, 20 bp, Artificial Sequence
  Description of Artificial Sequence: Synthetic oligonucleotide
  Target: SCN10A; (-) strand; PAM type: YTN; PAM sequence: TTC
cagctcttttcttacaactc

SEQ ID NO: 53929 - DNA, 20 bp, Artificial Sequence
  Description of Artificial Sequence: Synthetic oligonucleotide
  Target: SCN10A; (-) strand; PAM type: YTN; PAM sequence: TTT
ccagctcttttcttacaact

SEQ ID NO: 53930 - DNA, 20 bp, Artificial Sequence
  Description of Artificial Sequence: Synthetic oligonucleotide
  Target: SCN10A; (-) strand; PAM type: YTN; PAM sequence: TTT
tccagctcttttcttacaac

SEQ ID NO: 53931 - DNA, 20 bp, Artificial Sequence
  Description of Artificial Sequence: Synthetic oligonucleotide
  Target: SCN10A; (-) strand; PAM type: YTN; PAM sequence: TTA
agggtcacattttccagctc

SEQ ID NO: 53932 - DNA, 20 bp, Artificial Sequence
  Description of Artificial Sequence: Synthetic oligonucleotide
  Target: SCN10A; (-) strand; PAM type: YTN; PAM sequence: TTT
aagggtcacattttccagct

SEQ ID NO: 53933 - DNA, 20 bp, Artificial Sequence
  Description of Artificial Sequence: Synthetic oligonucleotide
  Target: SCN10A; (-) strand; PAM type: YTN; PAM sequence: TTC
catatcagtttaagggtcac

SEQ ID NO: 53934 - DNA, 20 bp, Artificial Sequence
  Description of Artificial Sequence: Synthetic oligonucleotide
  Target: SCN10A; (-) strand; PAM type: YTN; PAM sequence: TTT
ccatatcagtttaagggtca

SEQ ID NO: 53935 - DNA, 20 bp, Artificial Sequence
  Description of Artificial Sequence: Synthetic oligonucleotide
  Target: SCN10A; (-) strand; PAM type: YTN; PAM sequence: TTT
tccatatcagtttaagggtc

SEQ ID NO: 53936 - DNA, 20 bp, Artificial Sequence
  Description of Artificial Sequence: Synthetic oligonucleotide
  Target: SCN10A; (-) strand; PAM type: YTN; PAM sequence: CTT
ttccatatcagtttaagggt

SEQ ID NO: 53937 - DNA, 20 bp, Artificial Sequence
  Description of Artificial Sequence: Synthetic oligonucleotide
  Target: SCN10A; (-) strand; PAM type: YTN; PAM sequence: TTA
cttttccatatcagtttaag

SEQ ID NO: 53938 - DNA, 20 bp, Artificial Sequence
  Description of Artificial Sequence: Synthetic oligonucleotide
  Target: SCN10A; (-) strand; PAM type: YTN; PAM sequence: TTT
acttttccatatcagtttaa

SEQ ID NO: 53939 - DNA, 20 bp, Artificial Sequence
  Description of Artificial Sequence: Synthetic oligonucleotide
  Target: SCN10A; (-) strand; PAM type: YTN; PAM sequence: CTT
tacttttccatatcagttta

SEQ ID NO: 53940 - DNA, 20 bp, Artificial Sequence
  Description of Artificial Sequence: Synthetic oligonucleotide
  Target: SCN10A; (-) strand; PAM type: YTN; PAM sequence: TTC
tttacttttccatatcagtt

SEQ ID NO: 53941 - DNA, 20 bp, Artificial Sequence
  Description of Artificial Sequence: Synthetic oligonucleotide
  Target: SCN10A; (-) strand; PAM type: YTN; PAM sequence: TTT
ctttacttttccatatcagt

SEQ ID NO: 53942 - DNA, 20 bp, Artificial Sequence
  Description of Artificial Sequence: Synthetic oligonucleotide
  Target: SCN10A; (-) strand; PAM type: YTN; PAM sequence: TTG
tttctttacttttccatatc

SEQ ID NO: 53943 - DNA, 20 bp, Artificial Sequence
  Description of Artificial Sequence: Synthetic oligonucleotide
  Target: SCN10A; (-) strand; PAM type: YTN; PAM sequence: CTT
gtttctttacttttccatat

SEQ ID NO: 53944 - DNA, 20 bp, Artificial Sequence
  Description of Artificial Sequence: Synthetic oligonucleotide
  Target: SCN10A; (-) strand; PAM type: YTN; PAM sequence: TTC
ttgtttctttacttttccat

SEQ ID NO: 53945 - DNA, 20 bp, Artificial Sequence
  Description of Artificial Sequence: Synthetic oligonucleotide
  Target: SCN10A; (-) strand; PAM type: YTN; PAM sequence: TTG
gttcttgtttctttactttt

SEQ ID NO: 53946 - DNA, 20 bp, Artificial Sequence
  Description of Artificial Sequence: Synthetic oligonucleotide
  Target: SCN10A; (-) strand; PAM type: YTN; PAM sequence: TTT
ggttcttgtttctttacttt

SEQ ID NO: 53947 - DNA, 20 bp, Artificial Sequence
  Description of Artificial Sequence: Synthetic oligonucleotide
  Target: SCN10A; (-) strand; PAM type: YTN; PAM sequence: TTT
tggttcttgtttctttactt

SEQ ID NO: 53948 - DNA, 20 bp, Artificial Sequence
  Description of Artificial Sequence: Synthetic oligonucleotide
  Target: SCN10A; (-) strand; PAM type: YTN; PAM sequence: TTA
ttttggttcttgtttcttta

SEQ ID NO: 53949 - DNA, 20 bp, Artificial Sequence
  Description of Artificial Sequence: Synthetic oligonucleotide
  Target: SCN10A; (-) strand; PAM type: YTN; PAM sequence: TTG
aaaattattttggttcttgt

SEQ ID NO: 53950 - DNA, 20 bp, Artificial Sequence
  Description of Artificial Sequence: Synthetic oligonucleotide
  Target: SCN10A; (-) strand; PAM type: YTN; PAM sequence: CTT
gaaaattattttggttcttg

SEQ ID NO: 53951 - DNA, 20 bp, Artificial Sequence
  Description of Artificial Sequence: Synthetic oligonucleotide
  Target: SCN10A; (-) strand; PAM type: YTN; PAM sequence: TTC
ttgaaaattattttggttct

SEQ ID NO: 53952 - DNA, 20 bp, Artificial Sequence
  Description of Artificial Sequence: Synthetic oligonucleotide
  Target: SCN10A; (-) strand; PAM type: YTN; PAM sequence: CTT
cttgaaaattattttggttc

SEQ ID NO: 53953 - DNA, 20 bp, Artificial Sequence
  Description of Artificial Sequence: Synthetic oligonucleotide
  Target: SCN10A; (-) strand; PAM type: YTN; PAM sequence: TTG
tcttcttgaaaattattttg

SEQ ID NO: 53954 - DNA, 20 bp, Artificial Sequence
  Description of Artificial Sequence: Synthetic oligonucleotide
  Target: SCN10A; (-) strand; PAM type: YTN; PAM sequence: TTT
gtcttcttgaaaattatttt

SEQ ID NO: 53955 - DNA, 20 bp, Artificial Sequence
  Description of Artificial Sequence: Synthetic oligonucleotide
  Target: SCN10A; (-) strand; PAM type: YTN; PAM sequence: TTA
tttgtcttcttgaaaattat

SEQ ID NO: 53956 - DNA, 20 bp, Artificial Sequence
  Description of Artificial Sequence: Synthetic oligonucleotide
  Target: SCN10A; (-) strand; PAM type: YTN; PAM sequence: CTT
atttgtcttcttgaaaatta

SEQ ID NO: 53957 - DNA, 20 bp, Artificial Sequence
  Description of Artificial Sequence: Synthetic oligonucleotide
  Target: SCN10A; (-) strand; PAM type: YTN; PAM sequence: CTC
cttatttgtcttcttgaaaa

SEQ ID NO: 53958 - DNA, 20 bp, Artificial Sequence
  Description of Artificial Sequence: Synthetic oligonucleotide
  Target: SCN10A; (-) strand; PAM type: YTN; PAM sequence: TTC
acatgcccctccttatttgt

SEQ ID NO: 53959 - DNA, 20 bp, Artificial Sequence
  Description of Artificial Sequence: Synthetic oligonucleotide
  Target: SCN10A; (-) strand; PAM type: YTN; PAM sequence: CTG
gtcgattcacatgcccctcc

SEQ ID NO: 53960 - DNA, 20 bp, Artificial Sequence
  Description of Artificial Sequence: Synthetic oligonucleotide
  Target: SCN10A; (-) strand; PAM type: YTN; PAM sequence: TTG
acctggtcgattcacatgcc

SEQ ID NO: 53961 - DNA, 20 bp, Artificial Sequence
  Description of Artificial Sequence: Synthetic oligonucleotide
  Target: SCN10A; (-) strand; PAM type: YTN; PAM sequence: TTT
gacctggtcgattcacatgc

SEQ ID NO: 53962 - DNA, 20 bp, Artificial Sequence
  Description of Artificial Sequence: Synthetic oligonucleotide
  Target: SCN10A; (-) strand; PAM type: YTN; PAM sequence: CTA
tagtaagatttgacctggtc

SEQ ID NO: 53963 - DNA, 20 bp, Artificial Sequence
  Description of Artificial Sequence: Synthetic oligonucleotide
  Target: SCN10A; (-) strand; PAM type: YTN; PAM sequence: CTC
tatagtaagatttgacctgg

SEQ ID NO: 53964 - DNA, 20 bp, Artificial Sequence
  Description of Artificial Sequence: Synthetic oligonucleotide
  Target: SCN10A; (-) strand; PAM type: YTN; PAM sequence: TTA
aatgctctatagtaagattt

SEQ ID NO: 53965 - DNA, 20 bp, Artificial Sequence
  Description of Artificial Sequence: Synthetic oligonucleotide
  Target: SCN10A; (-) strand; PAM type: YTN; PAM sequence: TTT
aaatgctctatagtaagatt

SEQ ID NO: 53966 - DNA, 20 bp, Artificial Sequence
  Description of Artificial Sequence: Synthetic oligonucleotide
  Target: SCN10A; (-) strand; PAM type: YTN; PAM sequence: CTG
agtcaacaccacgtggattt

SEQ ID NO: 53967 - DNA, 20 bp, Artificial Sequence
  Description of Artificial Sequence: Synthetic oligonucleotide
  Target: SCN10A; (-) strand; PAM type: YTN; PAM sequence: TTG
tcacatcctgagtcaacacc

SEQ ID NO: 53968 - DNA, 20 bp, Artificial Sequence
  Description of Artificial Sequence: Synthetic oligonucleotide
  Target: SCN10A; (-) strand; PAM type: YTN; PAM sequence: CTC
attgtcacatcctgagtcaa

SEQ ID NO: 53969 - DNA, 20 bp, Artificial Sequence
  Description of Artificial Sequence: Synthetic oligonucleotide
  Target: SCN10A; (-) strand; PAM type: YTN; PAM sequence: CTC
ccagtaatctcattgtcaca

SEQ ID NO: 53970 - DNA, 20 bp, Artificial Sequence
  Description of Artificial Sequence: Synthetic oligonucleotide
  Target: SCN10A; (-) strand; PAM type: YTN; PAM sequence: TTC
tcccagtaatctcattgtca

SEQ ID NO: 53971 - DNA, 20 bp, Artificial Sequence
  Description of Artificial Sequence: Synthetic oligonucleotide
  Target: SCN10A; (-) strand; PAM type: YTN; PAM sequence: TTT
ctcccagtaatctcattgtc

SEQ ID NO: 53972 - DNA, 20 bp, Artificial Sequence
  Description of Artificial Sequence: Synthetic oligonucleotide
  Target: SCN10A; (-) strand; PAM type: YTN; PAM sequence: CTG
tttctcccagtaatctcatt

SEQ ID NO: 53973 - DNA, 20 bp, Artificial Sequence
  Description of Artificial Sequence: Synthetic oligonucleotide
  Target: SCN10A; (-) strand; PAM type: YTN; PAM sequence: CTG
aatctgtttctcccagtaat

SEQ ID NO: 53974 - DNA, 20 bp, Artificial Sequence
  Description of Artificial Sequence: Synthetic oligonucleotide
  Target: SCN10A; (-) strand; PAM type: YTN; PAM sequence: CTA
ctgaatctgtttctcccagt

SEQ ID NO: 53975 - DNA, 20 bp, Artificial Sequence
  Description of Artificial Sequence: Synthetic oligonucleotide
  Target: SCN10A; (-) strand; PAM type: YTN; PAM sequence: TTC
ccatgtctactgaatctgtt

SEQ ID NO: 53976 - DNA, 20 bp, Artificial Sequence
  Description of Artificial Sequence: Synthetic oligonucleotide
  Target: SCN10A; (-) strand; PAM type: YTN; PAM sequence: CTG
ccatgcaccagattcccatg

SEQ ID NO: 53977 - DNA, 20 bp, Artificial Sequence
  Description of Artificial Sequence: Synthetic oligonucleotide
  Target: SCN10A; (-) strand; PAM type: YTN; PAM sequence: TTC
tgccatgcaccagattccca

SEQ ID NO: 53978 - DNA, 20 bp, Artificial Sequence
  Description of Artificial Sequence: Synthetic oligonucleotide
  Target: SCN10A; (-) strand; PAM type: YTN; PAM sequence: CTT
ctgccatgcaccagattccc

SEQ ID NO: 53979 - DNA, 20 bp, Artificial Sequence
  Description of Artificial Sequence: Synthetic oligonucleotide
  Target: SCN10A; (-) strand; PAM type: YTN; PAM sequence: CTG
cttctgccatgcaccagatt

SEQ ID NO: 53980 - DNA, 20 bp, Artificial Sequence
  Description of Artificial Sequence: Synthetic oligonucleotide
  Target: SCN10A; (-) strand; PAM type: YTN; PAM sequence: CTA
ccactgcttctgccatgcac

SEQ ID NO: 53981 - DNA, 20 bp, Artificial Sequence
  Description of Artificial Sequence: Synthetic oligonucleotide
  Target: SCN10A; (-) strand; PAM type: YTN; PAM sequence: TTC
ctaccactgcttctgccatg

SEQ ID NO: 53982 - DNA, 20 bp, Artificial Sequence
  Description of Artificial Sequence: Synthetic oligonucleotide
  Target: SCN10A; (-) strand; PAM type: YTN; PAM sequence: TTC
ccaagtggttcctaccactg

SEQ ID NO: 53983 - DNA, 20 bp, Artificial Sequence
  Description of Artificial Sequence: Synthetic oligonucleotide
  Target: SCN10A; (-) strand; PAM type: YTN; PAM sequence: TTT
cccaagtggttcctaccact

SEQ ID NO: 53984 - DNA, 20 bp, Artificial Sequence
  Description of Artificial Sequence: Synthetic oligonucleotide
  Target: SCN10A; (-) strand; PAM type: YTN; PAM sequence: TTC
aatacatcatttcccaagtg

SEQ ID NO: 53985 - DNA, 20 bp, Artificial Sequence
  Description of Artificial Sequence: Synthetic oligonucleotide
  Target: SCN10A; (-) strand; PAM type: YTN; PAM sequence: TTT
caatacatcatttcccaagt

SEQ ID NO: 53986 - DNA, 20 bp, Artificial Sequence
  Description of Artificial Sequence: Synthetic oligonucleotide
  Target: SCN10A; (-) strand; PAM type: YTN; PAM sequence: TTT
tcaatacatcatttcccaag

SEQ ID NO: 53987 - DNA, 20 bp, Artificial Sequence
  Description of Artificial Sequence: Synthetic oligonucleotide
  Target: SCN10A; (-) strand; PAM type: YTN; PAM sequence: TTT
ttcaatacatcatttcccaa

SEQ ID NO: 53988 - DNA, 20 bp, Artificial Sequence
  Description of Artificial Sequence: Synthetic oligonucleotide
  Target: SCN10A; (-) strand; PAM type: YTN; PAM sequence: TTT
tttcaatacatcatttccca

SEQ ID NO: 53989 - DNA, 20 bp, Artificial Sequence
  Description of Artificial Sequence: Synthetic oligonucleotide
  Target: SCN10A; (-) strand; PAM type: YTN; PAM sequence: TTT
ttttcaatacatcatttccc

SEQ ID NO: 53990 - DNA, 20 bp, Artificial Sequence
  Description of Artificial Sequence: Synthetic oligonucleotide
  Target: SCN10A; (-) strand; PAM type: YTN; PAM sequence: TTC
caacatttttttcaatacat

SEQ ID NO: 53991 - DNA, 20 bp, Artificial Sequence
  Description of Artificial Sequence: Synthetic oligonucleotide
  Target: SCN10A; (-) strand; PAM type: YTN; PAM sequence: TTA
ttccaacatttttttcaata

SEQ ID NO: 53992 - DNA, 20 bp, Artificial Sequence
  Description of Artificial Sequence: Synthetic oligonucleotide
  Target: SCN10A; (-) strand; PAM type: YTN; PAM sequence: TTC
catatggattattccaacat

SEQ ID NO: 53993 - DNA, 20 bp, Artificial Sequence
  Description of Artificial Sequence: Synthetic oligonucleotide
  Target: SCN10A; (-) strand; PAM type: YTN; PAM sequence: TTT
ccatatggattattccaaca

SEQ ID NO: 53994 - DNA, 20 bp, Artificial Sequence
  Description of Artificial Sequence: Synthetic oligonucleotide
  Target: SCN10A; (-) strand; PAM type: YTN; PAM sequence: TTT
tccatatggattattccaac

SEQ ID NO: 53995 - DNA, 20 bp, Artificial Sequence
  Description of Artificial Sequence: Synthetic oligonucleotide
  Target: SCN10A; (-) strand; PAM type: YTN; PAM sequence: TTT
ttccatatggattattccaa

SEQ ID NO: 53996 - DNA, 20 bp, Artificial Sequence
  Description of Artificial Sequence: Synthetic oligonucleotide
  Target: SCN10A; (-) strand; PAM type: YTN; PAM sequence: TTC
caatatttttccatatggat

SEQ ID NO: 53997 - DNA, 20 bp, Artificial Sequence
  Description of Artificial Sequence: Synthetic oligonucleotide
  Target: SCN10A; (-) strand; PAM type: YTN; PAM sequence: CTT
ccaatatttttccatatgga

SEQ ID NO: 53998 - DNA, 20 bp, Artificial Sequence
  Description of Artificial Sequence: Synthetic oligonucleotide
  Target: SCN10A; (-) strand; PAM type: YTN; PAM sequence: TTG
tatgtgtgtggtatgagata

SEQ ID NO: 53999 - DNA, 20 bp, Artificial Sequence
  Description of Artificial Sequence: Synthetic oligonucleotide
  Target: SCN10A; (-) strand; PAM type: YTN; PAM sequence: TTT
gtatgtgtgtggtatgagat

SEQ ID NO: 54000 - DNA, 20 bp, Artificial Sequence
  Description of Artificial Sequence: Synthetic oligonucleotide
  Target: SCN10A; (-) strand; PAM type: YTN; PAM sequence: TTT
tgtatgtgtgtggtatgaga

SEQ ID NO: 54001 - DNA, 20 bp, Artificial Sequence
  Description of Artificial Sequence: Synthetic oligonucleotide
  Target: SCN10A; (-) strand; PAM type: YTN; PAM sequence: TTT
ttgtatgtgtgtggtatgag

SEQ ID NO: 54002 - DNA, 20 bp, Artificial Sequence
  Description of Artificial Sequence: Synthetic oligonucleotide
  Target: SCN10A; (-) strand; PAM type: YTN; PAM sequence: TTA
tttttgtatgtgtgtggtat

SEQ ID NO: 54003 - DNA, 20 bp, Artificial Sequence
  Description of Artificial Sequence: Synthetic oligonucleotide
  Target: SCN10A; (-) strand; PAM type: YTN; PAM sequence: TTT
atttttgtatgtgtgtggta

SEQ ID NO: 54004 - DNA, 20 bp, Artificial Sequence
  Description of Artificial Sequence: Synthetic oligonucleotide
  Target: SCN10A; (-) strand; PAM type: YTN; PAM sequence: CTA
gaatttatttttgtatgtgt

SEQ ID NO: 54005 - DNA, 20 bp, Artificial Sequence
  Description of Artificial Sequence: Synthetic oligonucleotide
  Target: SCN10A; (-) strand; PAM type: YTN; PAM sequence: CTC
ctagaatttatttttgtatg

SEQ ID NO: 54006 - DNA, 20 bp, Artificial Sequence
  Description of Artificial Sequence: Synthetic oligonucleotide
  Target: SCN10A; (-) strand; PAM type: YTN; PAM sequence: TTC
aatctcctagaatttatttt

SEQ ID NO: 54007 - DNA, 20 bp, Artificial Sequence
  Description of Artificial Sequence: Synthetic oligonucleotide
  Target: SCN10A; (-) strand; PAM type: YTN; PAM sequence: TTT
caatctcctagaatttattt

SEQ ID NO: 54008 - DNA, 20 bp, Artificial Sequence
  Description of Artificial Sequence: Synthetic oligonucleotide
  Target: SCN10A; (-) strand; PAM type: YTN; PAM sequence: TTA
ggtatttcaatctcctagaa

SEQ ID NO: 54009 - DNA, 20 bp, Artificial Sequence
  Description of Artificial Sequence: Synthetic oligonucleotide
  Target: SCN10A; (-) strand; PAM type: YTN; PAM sequence: TTT
aggtatttcaatctcctaga

SEQ ID NO: 54010 - DNA, 20 bp, Artificial Sequence
  Description of Artificial Sequence: Synthetic oligonucleotide
  Target: SCN10A; (-) strand; PAM type: YTN; PAM sequence: CTA
catttaggtatttcaatctc

SEQ ID NO: 54011 - DNA, 20 bp, Artificial Sequence
  Description of Artificial Sequence: Synthetic oligonucleotide
  Target: SCN10A; (-) strand; PAM type: YTN; PAM sequence: TTC
tacatttaggtatttcaatc

SEQ ID NO: 54012 - DNA, 20 bp, Artificial Sequence
  Description of Artificial Sequence: Synthetic oligonucleotide
  Target: SCN10A; (-) strand; PAM type: YTN; PAM sequence: TTT
ctacatttaggtatttcaat

SEQ ID NO: 54013 - DNA, 20 bp, Artificial Sequence
  Description of Artificial Sequence: Synthetic oligonucleotide
  Target: SCN10A; (-) strand; PAM type: YTN; PAM sequence: CTT
tctacatttaggtatttcaa

SEQ ID NO: 54014 - DNA, 20 bp, Artificial Sequence
  Description of Artificial Sequence: Synthetic oligonucleotide
  Target: SCN10A; (-) strand; PAM type: YTN; PAM sequence: TTC
ctttctacatttaggtattt

SEQ ID NO: 54015 - DNA, 20 bp, Artificial Sequence
  Description of Artificial Sequence: Synthetic oligonucleotide
  Target: SCN10A; (-) strand; PAM type: YTN; PAM sequence: TTT
cctttctacatttaggtatt

SEQ ID NO: 54016 - DNA, 20 bp, Artificial Sequence
  Description of Artificial Sequence: Synthetic oligonucleotide
  Target: SCN10A; (-) strand; PAM type: YTN; PAM sequence: TTT
tcctttctacatttaggtat

SEQ ID NO: 54017 - DNA, 20 bp, Artificial Sequence
  Description of Artificial Sequence: Synthetic oligonucleotide
  Target: SCN10A; (-) strand; PAM type: YTN; PAM sequence: TTA
cagttttcctttctacattt

SEQ ID NO: 54018 - DNA, 20 bp, Artificial Sequence
  Description of Artificial Sequence: Synthetic oligonucleotide
  Target: SCN10A; (-) strand; PAM type: YTN; PAM sequence: CTC
aaagttacagttttcctttc

SEQ ID NO: 54019 - DNA, 20 bp, Artificial Sequence
  Description of Artificial Sequence: Synthetic oligonucleotide
  Target: SCN10A; (-) strand; PAM type: YTN; PAM sequence: CTC
ctcaaagttacagttttcct

SEQ ID NO: 54020 - DNA, 20 bp, Artificial Sequence
  Description of Artificial Sequence: Synthetic oligonucleotide
  Target: SCN10A; (-) strand; PAM type: YTN; PAM sequence: TTC
tcctcaaagttacagttttc

SEQ ID NO: 54021 - DNA, 20 bp, Artificial Sequence
  Description of Artificial Sequence: Synthetic oligonucleotide
  Target: SCN10A; (-) strand; PAM type: YTN; PAM sequence: TTT
ctcctcaaagttacagtttt

SEQ ID NO: 54022 - DNA, 20 bp, Artificial Sequence
  Description of Artificial Sequence: Synthetic oligonucleotide
  Target: SCN10A; (-) strand; PAM type: YTN; PAM sequence: TTT
tctcctcaaagttacagttt

SEQ ID NO: 54023 - DNA, 20 bp, Artificial Sequence
  Description of Artificial Sequence: Synthetic oligonucleotide
  Target: SCN10A; (-) strand; PAM type: YTN; PAM sequence: CTG
tgttttctcctcaaagttac

SEQ ID NO: 54024 - DNA, 20 bp, Artificial Sequence
  Description of Artificial Sequence: Synthetic oligonucleotide
  Target: SCN10A; (-) strand; PAM type: YTN; PAM sequence: TTA
tcctgtgttttctcctcaaa

SEQ ID NO: 54025 - DNA, 20 bp, Artificial Sequence
  Description of Artificial Sequence: Synthetic oligonucleotide
  Target: SCN10A; (-) strand; PAM type: YTN; PAM sequence: TTC
cataaagatattatcctgtg

SEQ ID NO: 54026 - DNA, 20 bp, Artificial Sequence
  Description of Artificial Sequence: Synthetic oligonucleotide
  Target: SCN10A; (-) strand; PAM type: YTN; PAM sequence: TTG
ccatatagtattccataaag

SEQ ID NO: 54027 - DNA, 20 bp, Artificial Sequence
  Description of Artificial Sequence: Synthetic oligonucleotide
  Target: SCN10A; (-) strand; PAM type: YTN; PAM sequence: TTA
ttgccatatagtattccata

SEQ ID NO: 54028 - DNA, 20 bp, Artificial Sequence
  Description of Artificial Sequence: Synthetic oligonucleotide
  Target: SCN10A; (-) strand; PAM type: YTN; PAM sequence: TTT
attgccatatagtattccat

SEQ ID NO: 54029 - DNA, 20 bp, Artificial Sequence
  Description of Artificial Sequence: Synthetic oligonucleotide
  Target: SCN10A; (-) strand; PAM type: YTN; PAM sequence: TTT
tattgccatatagtattcca

SEQ ID NO: 54030 - DNA, 20 bp, Artificial Sequence
  Description of Artificial Sequence: Synthetic oligonucleotide
  Target: SCN10A; (-) strand; PAM type: YTN; PAM sequence: TTT
ttattgccatatagtattcc

SEQ ID NO: 54031 - DNA, 20 bp, Artificial Sequence
  Description of Artificial Sequence: Synthetic oligonucleotide
  Target: SCN10A; (-) strand; PAM type: YTN; PAM sequence: TTT
tttattgccatatagtattc

SEQ ID NO: 54032 - DNA, 20 bp, Artificial Sequence
  Description of Artificial Sequence: Synthetic oligonucleotide
  Target: SCN10A; (-) strand; PAM type: YTN; PAM sequence: TTC
attttttattgccatatagt

SEQ ID NO: 54033 - DNA, 20 bp, Artificial Sequence
  Description of Artificial Sequence: Synthetic oligonucleotide
  Target: SCN10A; (-) strand; PAM type: YTN; PAM sequence: TTC
attcattttttattgccata

SEQ ID NO: 54034 - DNA, 20 bp, Artificial Sequence
  Description of Artificial Sequence: Synthetic oligonucleotide
  Target: SCN10A; (-) strand; PAM type: YTN; PAM sequence: CTA
attcattcattttttattgc

SEQ ID NO: 54035 - DNA, 20 bp, Artificial Sequence
  Description of Artificial Sequence: Synthetic oligonucleotide
  Target: SCN10A; (-) strand; PAM type: YTN; PAM sequence: TTG
cccaaatggatacatgtaga

SEQ ID NO: 54036 - DNA, 20 bp, Artificial Sequence
  Description of Artificial Sequence: Synthetic oligonucleotide
  Target: SCN10A; (-) strand; PAM type: YTN; PAM sequence: TTT
gcccaaatggatacatgtag

SEQ ID NO: 54037 - DNA, 20 bp, Artificial Sequence
  Description of Artificial Sequence: Synthetic oligonucleotide
  Target: SCN10A; (-) strand; PAM type: YTN; PAM sequence: TTG
ggatttgcccaaatggatac

SEQ ID NO: 54038 - DNA, 20 bp, Artificial Sequence
  Description of Artificial Sequence: Synthetic oligonucleotide
  Target: SCN10A; (-) strand; PAM type: YTN; PAM sequence: TTT
gggatttgcccaaatggata

SEQ ID NO: 54039 - DNA, 20 bp, Artificial Sequence
  Description of Artificial Sequence: Synthetic oligonucleotide
  Target: SCN10A; (-) strand; PAM type: YTN; PAM sequence: TTT
tgggatttgcccaaatggat

SEQ ID NO: 54040 - DNA, 20 bp, Artificial Sequence
  Description of Artificial Sequence: Synthetic oligonucleotide
  Target: SCN10A; (-) strand; PAM type: YTN; PAM sequence: TTT
ttgggatttgcccaaatgga

SEQ ID NO: 54041 - DNA, 20 bp, Artificial Sequence
  Description of Artificial Sequence: Synthetic oligonucleotide
  Target: SCN10A; (-) strand; PAM type: YTN; PAM sequence: TTA
tgtttttgggatttgcccaa

SEQ ID NO: 54042 - DNA, 20 bp, Artificial Sequence
  Description of Artificial Sequence: Synthetic oligonucleotide
  Target: SCN10A; (-) strand; PAM type: YTN; PAM sequence: TTA
aaattatgtttttgggattt

SEQ ID NO: 54043 - DNA, 20 bp, Artificial Sequence
  Description of Artificial Sequence: Synthetic oligonucleotide
  Target: SCN10A; (-) strand; PAM type: YTN; PAM sequence: TTT
aaaattatgtttttgggatt

SEQ ID NO: 54044 - DNA, 20 bp, Artificial Sequence
  Description of Artificial Sequence: Synthetic oligonucleotide
  Target: SCN10A; (-) strand; PAM type: YTN; PAM sequence: TTT
taaaattatgtttttgggat

SEQ ID NO: 54045 - DNA, 20 bp, Artificial Sequence
  Description of Artificial Sequence: Synthetic oligonucleotide
  Target: SCN10A; (-) strand; PAM type: YTN; PAM sequence: CTG
atgttttaaaattatgtttt

SEQ ID NO: 54046 - DNA, 20 bp, Artificial Sequence
  Description of Artificial Sequence: Synthetic oligonucleotide
  Target: SCN10A; (-) strand; PAM type: YTN; PAM sequence: TTA
tctgatgttttaaaattatg

SEQ ID NO: 54047 - DNA, 20 bp, Artificial Sequence
  Description of Artificial Sequence: Synthetic oligonucleotide
  Target: SCN10A; (-) strand; PAM type: YTN; PAM sequence: TTT
atctgatgttttaaaattat

SEQ ID NO: 54048 - DNA, 20 bp, Artificial Sequence
  Description of Artificial Sequence: Synthetic oligonucleotide
  Target: SCN10A; (-) strand; PAM type: YTN; PAM sequence: CTT
tatctgatgttttaaaatta

SEQ ID NO: 54049 - DNA, 20 bp, Artificial Sequence
  Description of Artificial Sequence: Synthetic oligonucleotide
  Target: SCN10A; (-) strand; PAM type: YTN; PAM sequence: TTA
tatgtgtgctttatctgatg

SEQ ID NO: 54050 - DNA, 20 bp, Artificial Sequence
  Description of Artificial Sequence: Synthetic oligonucleotide
  Target: SCN10A; (-) strand; PAM type: YTN; PAM sequence: TTT
atatgtgtgctttatctgat

SEQ ID NO: 54051 - DNA, 20 bp, Artificial Sequence
  Description of Artificial Sequence: Synthetic oligonucleotide
  Target: SCN10A; (-) strand; PAM type: YTN; PAM sequence: TTT
tatatgtgtgctttatctga

SEQ ID NO: 54052 - DNA, 20 bp, Artificial Sequence
  Description of Artificial Sequence: Synthetic oligonucleotide
  Target: SCN10A; (-) strand; PAM type: YTN; PAM sequence: TTA
tcattttatatgtgtgcttt

SEQ ID NO: 54053 - DNA, 20 bp, Artificial Sequence
  Description of Artificial Sequence: Synthetic oligonucleotide
  Target: SCN10A; (-) strand; PAM type: YTN; PAM sequence: CTG
ttatcattttatatgtgtgc

SEQ ID NO: 54054 - DNA, 20 bp, Artificial Sequence
  Description of Artificial Sequence: Synthetic oligonucleotide
  Target: SCN10A; (-) strand; PAM type: YTN; PAM sequence: TTA
tggaactgttatcattttat

SEQ ID NO: 54055 - DNA, 20 bp, Artificial Sequence
  Description of Artificial Sequence: Synthetic oligonucleotide
  Target: SCN10A; (-) strand; PAM type: YTN; PAM sequence: TTT
atggaactgttatcatttta

SEQ ID NO: 54056 - DNA, 20 bp, Artificial Sequence
  Description of Artificial Sequence: Synthetic oligonucleotide
  Target: SCN10A; (-) strand; PAM type: YTN; PAM sequence: TTC
aaatttatggaactgttatc

SEQ ID NO: 54057 - DNA, 20 bp, Artificial Sequence
  Description of Artificial Sequence: Synthetic oligonucleotide
  Target: SCN10A; (-) strand; PAM type: YTN; PAM sequence: TTT
caaatttatggaactgttat

SEQ ID NO: 54058 - DNA, 20 bp, Artificial Sequence
  Description of Artificial Sequence: Synthetic oligonucleotide
  Target: SCN10A; (-) strand; PAM type: YTN; PAM sequence: TTT
tcaaatttatggaactgtta

SEQ ID NO: 54059 - DNA, 20 bp, Artificial Sequence
  Description of Artificial Sequence: Synthetic oligonucleotide
  Target: SCN10A; (-) strand; PAM type: YTN; PAM sequence: CTT
ttcaaatttatggaactgtt

SEQ ID NO: 54060 - DNA, 20 bp, Artificial Sequence
  Description of Artificial Sequence: Synthetic oligonucleotide
  Target: SCN10A; (-) strand; PAM type: YTN; PAM sequence: TTG
tatcttttcaaatttatgga

SEQ ID NO: 54061 - DNA, 20 bp, Artificial Sequence
  Description of Artificial Sequence: Synthetic oligonucleotide
  Target: SCN10A; (-) strand; PAM type: YTN; PAM sequence: TTT
gtatcttttcaaatttatgg

SEQ ID NO: 54062 - DNA, 20 bp, Artificial Sequence
  Description of Artificial Sequence: Synthetic oligonucleotide
  Target: SCN10A; (-) strand; PAM type: YTN; PAM sequence: TTG
atttgtatcttttcaaattt

SEQ ID NO: 54063 - DNA, 20 bp, Artificial Sequence
  Description of Artificial Sequence: Synthetic oligonucleotide
  Target: SCN10A; (-) strand; PAM type: YTN; PAM sequence: CTG
catgcataaagtattgattt

SEQ ID NO: 54064 - DNA, 20 bp, Artificial Sequence
  Description of Artificial Sequence: Synthetic oligonucleotide
  Target: SCN10A; (-) strand; PAM type: YTN; PAM sequence: TTA
acactgcatgcataaagtat

SEQ ID NO: 54065 - DNA, 20 bp, Artificial Sequence
  Description of Artificial Sequence: Synthetic oligonucleotide
  Target: SCN10A; (-) strand; PAM type: YTN; PAM sequence: TTT
aacactgcatgcataaagta

SEQ ID NO: 54066 - DNA, 20 bp, Artificial Sequence
  Description of Artificial Sequence: Synthetic oligonucleotide
  Target: SCN10A; (-) strand; PAM type: YTN; PAM sequence: CTG
caaacggggaagtgggtgtt

SEQ ID NO: 54067 - DNA, 20 bp, Artificial Sequence
  Description of Artificial Sequence: Synthetic oligonucleotide
  Target: SCN10A; (-) strand; PAM type: YTN; PAM sequence: CTA
ctgcaaacggggaagtgggt

SEQ ID NO: 54068 - DNA, 20 bp, Artificial Sequence
  Description of Artificial Sequence: Synthetic oligonucleotide
  Target: SCN10A; (-) strand; PAM type: YTN; PAM sequence: CTG
aatctactgcaaacggggaa

SEQ ID NO: 54069 - DNA, 20 bp, Artificial Sequence
  Description of Artificial Sequence: Synthetic oligonucleotide
  Target: SCN10A; (-) strand; PAM type: YTN; PAM sequence: CTG
gcaaagaacatgtgaaatga

SEQ ID NO: 54070 - DNA, 20 bp, Artificial Sequence
  Description of Artificial Sequence: Synthetic oligonucleotide
  Target: SCN10A; (-) strand; PAM type: YTN; PAM sequence: CTC
acctggcaaagaacatgtga

SEQ ID NO: 54071 - DNA, 20 bp, Artificial Sequence
  Description of Artificial Sequence: Synthetic oligonucleotide
  Target: SCN10A; (-) strand; PAM type: YTN; PAM sequence: TTC
tcacctggcaaagaacatgt

SEQ ID NO: 54072 - DNA, 20 bp, Artificial Sequence
  Description of Artificial Sequence: Synthetic oligonucleotide
  Target: SCN10A; (-) strand; PAM type: YTN; PAM sequence: TTT
ctcacctggcaaagaacatg

SEQ ID NO: 54073 - DNA, 20 bp, Artificial Sequence
  Description of Artificial Sequence: Synthetic oligonucleotide
  Target: SCN10A; (-) strand; PAM type: YTN; PAM sequence: TTT
tctcacctggcaaagaacat

SEQ ID NO: 54074 - DNA, 20 bp, Artificial Sequence
  Description of Artificial Sequence: Synthetic oligonucleotide
  Target: SCN10A; (-) strand; PAM type: YTN; PAM sequence: TTG
tagagaagataaatgttttc

SEQ ID NO: 54075 - DNA, 20 bp, Artificial Sequence
  Description of Artificial Sequence: Synthetic oligonucleotide
  Target: SCN10A; (-) strand; PAM type: YTN; PAM sequence: TTG
gttgtagagaagataaatgt

SEQ ID NO: 54076 - DNA, 20 bp, Artificial Sequence
  Description of Artificial Sequence: Synthetic oligonucleotide
  Target: SCN10A; (-) strand; PAM type: YTN; PAM sequence: TTT
ggttgtagagaagataaatg

SEQ ID NO: 54077 - DNA, 20 bp, Artificial Sequence
  Description of Artificial Sequence: Synthetic oligonucleotide
  Target: SCN10A; (-) strand; PAM type: YTN; PAM sequence: TTA
tagcaatttggttgtagaga

SEQ ID NO: 54078 - DNA, 20 bp, Artificial Sequence
  Description of Artificial Sequence: Synthetic oligonucleotide
  Target: SCN10A; (-) strand; PAM type: YTN; PAM sequence: TTG
acaaattatagcaatttggt

SEQ ID NO: 54079 - DNA, 20 bp, Artificial Sequence
  Description of Artificial Sequence: Synthetic oligonucleotide
  Target: SCN10A; (-) strand; PAM type: YTN; PAM sequence: TTT
gacaaattatagcaatttgg

SEQ ID NO: 54080 - DNA, 20 bp, Artificial Sequence
  Description of Artificial Sequence: Synthetic oligonucleotide
  Target: SCN10A; (-) strand; PAM type: YTN; PAM sequence: CTT
tgacaaattatagcaatttg

SEQ ID NO: 54081 - DNA, 20 bp, Artificial Sequence
  Description of Artificial Sequence: Synthetic oligonucleotide
  Target: SCN10A; (-) strand; PAM type: YTN; PAM sequence: CTG
gaaaacctttgacaaattat

SEQ ID NO: 54082 - DNA, 20 bp, Artificial Sequence
  Description of Artificial Sequence: Synthetic oligonucleotide
  Target: SCN10A; (-) strand; PAM type: YTN; PAM sequence: TTC
tggaaaacctttgacaaatt

SEQ ID NO: 54083 - DNA, 20 bp, Artificial Sequence
  Description of Artificial Sequence: Synthetic oligonucleotide
  Target: SCN10A; (-) strand; PAM type: YTN; PAM sequence: CTA
agcataacaatattctggaa

SEQ ID NO: 54084 - DNA, 20 bp, Artificial Sequence
  Description of Artificial Sequence: Synthetic oligonucleotide
  Target: SCN10A; (-) strand; PAM type: YTN; PAM sequence: CTC
taagcataacaatattctgg

SEQ ID NO: 54085 - DNA, 20 bp, Artificial Sequence
  Description of Artificial Sequence: Synthetic oligonucleotide
  Target: SCN10A; (-) strand; PAM type: YTN; PAM sequence: CTC
acctctaagcataacaatat

SEQ ID NO: 54086 - DNA, 20 bp, Artificial Sequence
  Description of Artificial Sequence: Synthetic oligonucleotide
  Target: SCN10A; (-) strand; PAM type: YTN; PAM sequence: CTA
ggacactcacctctaagcat

SEQ ID NO: 54087 - DNA, 20 bp, Artificial Sequence
  Description of Artificial Sequence: Synthetic oligonucleotide
  Target: SCN10A; (-) strand; PAM type: YTN; PAM sequence: TTG
atgaccctaggacactcacc

SEQ ID NO: 54088 - DNA, 20 bp, Artificial Sequence
  Description of Artificial Sequence: Synthetic oligonucleotide
  Target: SCN10A; (-) strand; PAM type: YTN; PAM sequence: TTT
gatgaccctaggacactcac

SEQ ID NO: 54089 - DNA, 20 bp, Artificial Sequence
  Description of Artificial Sequence: Synthetic oligonucleotide
  Target: SCN10A; (-) strand; PAM type: YTN; PAM sequence: CTT
tgatgaccctaggacactca

SEQ ID NO: 54090 - DNA, 20 bp, Artificial Sequence
  Description of Artificial Sequence: Synthetic oligonucleotide
  Target: SCN10A; (-) strand; PAM type: YTN; PAM sequence: CTC
tttgatgaccctaggacact

SEQ ID NO: 54091 - DNA, 20 bp, Artificial Sequence
  Description of Artificial Sequence: Synthetic oligonucleotide
  Target: SCN10A; (-) strand; PAM type: YTN; PAM sequence: TTG
aaggggctctttgatgaccc

SEQ ID NO: 54092 - DNA, 20 bp, Artificial Sequence
  Description of Artificial Sequence: Synthetic oligonucleotide
  Target: SCN10A; (-) strand; PAM type: YTN; PAM sequence: TTC
agagaatcattgaaggggct

SEQ ID NO: 54093 - DNA, 20 bp, Artificial Sequence
  Description of Artificial Sequence: Synthetic oligonucleotide
  Target: SCN10A; (-) strand; PAM type: YTN; PAM sequence: TTT
cagagaatcattgaaggggc

SEQ ID NO: 54094 - DNA, 20 bp, Artificial Sequence
  Description of Artificial Sequence: Synthetic oligonucleotide
  Target: SCN10A; (-) strand; PAM type: YTN; PAM sequence: CTG
gtttcagagaatcattgaag

SEQ ID NO: 54095 - DNA, 20 bp, Artificial Sequence
  Description of Artificial Sequence: Synthetic oligonucleotide
  Target: SCN10A; (-) strand; PAM type: YTN; PAM sequence: CTC
cccatgccctggtttcagag

SEQ ID NO: 54096 - DNA, 20 bp, Artificial Sequence
  Description of Artificial Sequence: Synthetic oligonucleotide
  Target: SCN10A; (-) strand; PAM type: YTN; PAM sequence: CTC
tccccatgccctggtttcag

SEQ ID NO: 54097 - DNA, 20 bp, Artificial Sequence
  Description of Artificial Sequence: Synthetic oligonucleotide
  Target: SCN10A; (-) strand; PAM type: YTN; PAM sequence: CTA
ctctccccatgccctggttt

SEQ ID NO: 54098 - DNA, 20 bp, Artificial Sequence
  Description of Artificial Sequence: Synthetic oligonucleotide
  Target: SCN10A; (-) strand; PAM type: YTN; PAM sequence: TTC
ctactctccccatgccctgg

SEQ ID NO: 54099 - DNA, 20 bp, Artificial Sequence
  Description of Artificial Sequence: Synthetic oligonucleotide
  Target: SCN10A; (-) strand; PAM type: YTN; PAM sequence: TTT
cctactctccccatgccctg

SEQ ID NO: 54100 - DNA, 20 bp, Artificial Sequence
  Description of Artificial Sequence: Synthetic oligonucleotide
  Target: SCN10A; (-) strand; PAM type: YTN; PAM sequence: CTT
tcctactctccccatgccct

SEQ ID NO: 54101 - DNA, 20 bp, Artificial Sequence
  Description of Artificial Sequence: Synthetic oligonucleotide
  Target: SCN10A; (-) strand; PAM type: YTN; PAM sequence: CTA
gaactttcctactctcccca

SEQ ID NO: 54102 - DNA, 20 bp, Artificial Sequence
  Description of Artificial Sequence: Synthetic oligonucleotide
  Target: SCN10A; (-) strand; PAM type: YTN; PAM sequence: TTA
agaagggcaagactagaact

SEQ ID NO: 54103 - DNA, 20 bp, Artificial Sequence
  Description of Artificial Sequence: Synthetic oligonucleotide
  Target: SCN10A; (-) strand; PAM type: YTN; PAM sequence: TTG
ttaagaagggcaagactaga

SEQ ID NO: 54104 - DNA, 20 bp, Artificial Sequence
  Description of Artificial Sequence: Synthetic oligonucleotide
  Target: SCN10A; (-) strand; PAM type: YTN; PAM sequence: TTG
ggcaccagaaggtaaagaga

SEQ ID NO: 54105 - DNA, 20 bp, Artificial Sequence
  Description of Artificial Sequence: Synthetic oligonucleotide
  Target: SCN10A; (-) strand; PAM type: YTN; PAM sequence: CTC
agattgggcaccagaaggta

SEQ ID NO: 54106 - DNA, 20 bp, Artificial Sequence
  Description of Artificial Sequence: Synthetic oligonucleotide
  Target: SCN10A; (-) strand; PAM type: YTN; PAM sequence: TTC
ctcagattgggcaccagaag

SEQ ID NO: 54107 - DNA, 20 bp, Artificial Sequence
  Description of Artificial Sequence: Synthetic oligonucleotide
  Target: SCN10A; (-) strand; PAM type: YTN; PAM sequence: CTT
cctcagattgggcaccagaa

SEQ ID NO: 54108 - DNA, 20 bp, Artificial Sequence
  Description of Artificial Sequence: Synthetic oligonucleotide
  Target: SCN10A; (-) strand; PAM type: YTN; PAM sequence: TTC
ttcctcagattgggcaccag

SEQ ID NO: 54109 - DNA, 20 bp, Artificial Sequence
  Description of Artificial Sequence: Synthetic oligonucleotide
  Target: SCN10A; (-) strand; PAM type: YTN; PAM sequence: CTA
gaggttcttcctcagattgg

SEQ ID NO: 54110 - DNA, 20 bp, Artificial Sequence
  Description of Artificial Sequence: Synthetic oligonucleotide
  Target: SCN10A; (-) strand; PAM type: YTN; PAM sequence: TTG
ggaagaaactagaggttctt

SEQ ID NO: 54111 - DNA, 20 bp, Artificial Sequence
  Description of Artificial Sequence: Synthetic oligonucleotide
  Target: SCN10A; (-) strand; PAM type: YTN; PAM sequence: CTT
gggaagaaactagaggttct

SEQ ID NO: 54112 - DNA, 20 bp, Artificial Sequence
  Description of Artificial Sequence: Synthetic oligonucleotide
  Target: SCN10A; (-) strand; PAM type: YTN; PAM sequence: TTG
cttgggaagaaactagaggt

SEQ ID NO: 54113 - DNA, 20 bp, Artificial Sequence
  Description of Artificial Sequence: Synthetic oligonucleotide
  Target: SCN10A; (-) strand; PAM type: YTN; PAM sequence: TTT
gcttgggaagaaactagagg

SEQ ID NO: 54114 - DNA, 20 bp, Artificial Sequence
  Description of Artificial Sequence: Synthetic oligonucleotide
  Target: SCN10A; (-) strand; PAM type: YTN; PAM sequence: TTT
tgcttgggaagaaactagag

SEQ ID NO: 54115 - DNA, 20 bp, Artificial Sequence
  Description of Artificial Sequence: Synthetic oligonucleotide
  Target: SCN10A; (-) strand; PAM type: YTN; PAM sequence: CTT
ttgcttgggaagaaactaga

SEQ ID NO: 54116 - DNA, 20 bp, Artificial Sequence
  Description of Artificial Sequence: Synthetic oligonucleotide
  Target: SCN10A; (-) strand; PAM type: YTN; PAM sequence: CTC
ttttgcttgggaagaaacta

SEQ ID NO: 54117 - DNA, 20 bp, Artificial Sequence
  Description of Artificial Sequence: Synthetic oligonucleotide
  Target: SCN10A; (-) strand; PAM type: YTN; PAM sequence: CTA
atcccctcttttgcttggga

SEQ ID NO: 54118 - DNA, 20 bp, Artificial Sequence
  Description of Artificial Sequence: Synthetic oligonucleotide
  Target: SCN10A; (-) strand; PAM type: YTN; PAM sequence: TTC
taatcccctcttttgcttgg

SEQ ID NO: 54119 - DNA, 20 bp, Artificial Sequence
  Description of Artificial Sequence: Synthetic oligonucleotide
  Target: SCN10A; (-) strand; PAM type: YTN; PAM sequence: TTT
ctaatcccctcttttgcttg

SEQ ID NO: 54120 - DNA, 20 bp, Artificial Sequence
  Description of Artificial Sequence: Synthetic oligonucleotide
  Target: SCN10A; (-) strand; PAM type: YTN; PAM sequence: TTT
tctaatcccctcttttgctt

SEQ ID NO: 54121 - DNA, 20 bp, Artificial Sequence
  Description of Artificial Sequence: Synthetic oligonucleotide
  Target: SCN10A; (-) strand; PAM type: YTN; PAM sequence: TTC
cattttctaatcccctcttt

SEQ ID NO: 54122 - DNA, 20 bp, Artificial Sequence
  Description of Artificial Sequence: Synthetic oligonucleotide
  Target: SCN10A; (-) strand; PAM type: YTN; PAM sequence: TTG
tggaaagataaagatagata

SEQ ID NO: 54123 - DNA, 20 bp, Artificial Sequence
  Description of Artificial Sequence: Synthetic oligonucleotide
  Target: SCN10A; (-) strand; PAM type: YTN; PAM sequence: CTT
gtggaaagataaagatagat

SEQ ID NO: 54124 - DNA, 20 bp, Artificial Sequence
  Description of Artificial Sequence: Synthetic oligonucleotide
  Target: SCN10A; (-) strand; PAM type: YTN; PAM sequence: CTG
cttgtggaaagataaagata

SEQ ID NO: 54125 - DNA, 20 bp, Artificial Sequence
  Description of Artificial Sequence: Synthetic oligonucleotide
  Target: SCN10A; (-) strand; PAM type: YTN; PAM sequence: CTG
tctgcttgtggaaagataaa

SEQ ID NO: 54126 - DNA, 20 bp, Artificial Sequence
  Description of Artificial Sequence: Synthetic oligonucleotide
  Target: SCN10A; (-) strand; PAM type: YTN; PAM sequence: CTA
tctgtctgcttgtggaaaga

SEQ ID NO: 54127 - DNA, 20 bp, Artificial Sequence
  Description of Artificial Sequence: Synthetic oligonucleotide
  Target: SCN10A; (-) strand; PAM type: YTN; PAM sequence: CTG
cctatctgtctgcttgtgga

SEQ ID NO: 54128 - DNA, 20 bp, Artificial Sequence
  Description of Artificial Sequence: Synthetic oligonucleotide
  Target: SCN10A; (-) strand; PAM type: YTN; PAM sequence: CTG
cgtgcctgcctatctgtctg

SEQ ID NO: 54129 - DNA, 20 bp, Artificial Sequence
  Description of Artificial Sequence: Synthetic oligonucleotide
  Target: SCN10A; (-) strand; PAM type: YTN; PAM sequence: TTC
tgcgtgcctgcctatctgtc

SEQ ID NO: 54130 - DNA, 20 bp, Artificial Sequence
  Description of Artificial Sequence: Synthetic oligonucleotide
  Target: SCN10A; (-) strand; PAM type: YTN; PAM sequence: TTT
ctgcgtgcctgcctatctgt

SEQ ID NO: 54131 - DNA, 20 bp, Artificial Sequence
  Description of Artificial Sequence: Synthetic oligonucleotide
  Target: SCN10A; (-) strand; PAM type: YTN; PAM sequence: CTT
tctgcgtgcctgcctatctg

SEQ ID NO: 54132 - DNA, 20 bp, Artificial Sequence
  Description of Artificial Sequence: Synthetic oligonucleotide
  Target: SCN10A; (-) strand; PAM type: YTN; PAM sequence: CTA
tgtctttctgcgtgcctgcc

SEQ ID NO: 54133 - DNA, 20 bp, Artificial Sequence
  Description of Artificial Sequence: Synthetic oligonucleotide
  Target: SCN10A; (-) strand; PAM type: YTN; PAM sequence: CTC
tatgtctttctgcgtgcctg

SEQ ID NO: 54134 - DNA, 20 bp, Artificial Sequence
  Description of Artificial Sequence: Synthetic oligonucleotide
  Target: SCN10A; (-) strand; PAM type: YTN; PAM sequence: CTG
ataatggtagctctatgtct

SEQ ID NO: 54135 - DNA, 20 bp, Artificial Sequence
  Description of Artificial Sequence: Synthetic oligonucleotide
  Target: SCN10A; (-) strand; PAM type: YTN; PAM sequence: CTG
ctgataatggtagctctatg

SEQ ID NO: 54136 - DNA, 20 bp, Artificial Sequence
  Description of Artificial Sequence: Synthetic oligonucleotide
  Target: SCN10A; (-) strand; PAM type: YTN; PAM sequence: TTA
cctgctgataatggtagctc

SEQ ID NO: 54137 - DNA, 20 bp, Artificial Sequence
  Description of Artificial Sequence: Synthetic oligonucleotide
  Target: SCN10A; (-) strand; PAM type: YTN; PAM sequence: TTG
cacaattacctgctgataat

SEQ ID NO: 54138 - DNA, 20 bp, Artificial Sequence
  Description of Artificial Sequence: Synthetic oligonucleotide
  Target: SCN10A; (-) strand; PAM type: YTN; PAM sequence: TTT
gcacaattacctgctgataa

SEQ ID NO: 54139 - DNA, 20 bp, Artificial Sequence
  Description of Artificial Sequence: Synthetic oligonucleotide
  Target: SCN10A; (-) strand; PAM type: YTN; PAM sequence: CTT
tgcacaattacctgctgata

SEQ ID NO: 54140 - DNA, 20 bp, Artificial Sequence
  Description of Artificial Sequence: Synthetic oligonucleotide
  Target: SCN10A; (-) strand; PAM type: YTN; PAM sequence: TTA
gctttgcacaattacctgct

SEQ ID NO: 54141 - DNA, 20 bp, Artificial Sequence
  Description of Artificial Sequence: Synthetic oligonucleotide
  Target: SCN10A; (-) strand; PAM type: YTN; PAM sequence: CTG
aaacattagctttgcacaat

SEQ ID NO: 54142 - DNA, 20 bp, Artificial Sequence
  Description of Artificial Sequence: Synthetic oligonucleotide
  Target: SCN10A; (-) strand; PAM type: YTN; PAM sequence: TTG
ctgaaacattagctttgcac

SEQ ID NO: 54143 - DNA, 20 bp, Artificial Sequence
  Description of Artificial Sequence: Synthetic oligonucleotide
  Target: SCN10A; (-) strand; PAM type: YTN; PAM sequence: CTT
gctgaaacattagctttgca

SEQ ID NO: 54144 - DNA, 20 bp, Artificial Sequence
  Description of Artificial Sequence: Synthetic oligonucleotide
  Target: SCN10A; (-) strand; PAM type: YTN; PAM sequence: TTC
cttgctgaaacattagcttt

SEQ ID NO: 54145 - DNA, 20 bp, Artificial Sequence
  Description of Artificial Sequence: Synthetic oligonucleotide
  Target: SCN10A; (-) strand; PAM type: YTN; PAM sequence: TTA
ttccttgctgaaacattagc

SEQ ID NO: 54146 - DNA, 20 bp, Artificial Sequence
  Description of Artificial Sequence: Synthetic oligonucleotide
  Target: SCN10A; (-) strand; PAM type: YTN; PAM sequence: TTC
cattattccttgctgaaaca

SEQ ID NO: 54147 - DNA, 20 bp, Artificial Sequence
  Description of Artificial Sequence: Synthetic oligonucleotide
  Target: SCN10A; (-) strand; PAM type: YTN; PAM sequence: CTT
ccattattccttgctgaaac

SEQ ID NO: 54148 - DNA, 20 bp, Artificial Sequence
  Description of Artificial Sequence: Synthetic oligonucleotide
  Target: SCN10A; (-) strand; PAM type: YTN; PAM sequence: CTC
ccttccattattccttgctg

SEQ ID NO: 54149 - DNA, 20 bp, Artificial Sequence
  Description of Artificial Sequence: Synthetic oligonucleotide
  Target: SCN10A; (-) strand; PAM type: YTN; PAM sequence: TTC
cctcccttccattattcctt

SEQ ID NO: 54150 - DNA, 20 bp, Artificial Sequence
  Description of Artificial Sequence: Synthetic oligonucleotide
  Target: SCN10A; (-) strand; PAM type: YTN; PAM sequence: CTT
ccctcccttccattattcct

SEQ ID NO: 54151 - DNA, 20 bp, Artificial Sequence
  Description of Artificial Sequence: Synthetic oligonucleotide
  Target: SCN10A; (-) strand; PAM type: YTN; PAM sequence: TTA
tcttccctcccttccattat

SEQ ID NO: 54152 - DNA, 20 bp, Artificial Sequence
  Description of Artificial Sequence: Synthetic oligonucleotide
  Target: SCN10A; (-) strand; PAM type: YTN; PAM sequence: CTT
atcttccctcccttccatta

SEQ ID NO: 54153 - DNA, 20 bp, Artificial Sequence
  Description of Artificial Sequence: Synthetic oligonucleotide
  Target: SCN10A; (-) strand; PAM type: YTN; PAM sequence: TTC
cttatcttccctcccttcca

SEQ ID NO: 54154 - DNA, 20 bp, Artificial Sequence
  Description of Artificial Sequence: Synthetic oligonucleotide
  Target: SCN10A; (-) strand; PAM type: YTN; PAM sequence: TTT
ccttatcttccctcccttcc

SEQ ID NO: 54155 - DNA, 20 bp, Artificial Sequence
  Description of Artificial Sequence: Synthetic oligonucleotide
  Target: SCN10A; (-) strand; PAM type: YTN; PAM sequence: TTT
tccttatcttccctcccttc

SEQ ID NO: 54156 - DNA, 20 bp, Artificial Sequence
  Description of Artificial Sequence: Synthetic oligonucleotide
  Target: SCN10A; (-) strand; PAM type: YTN; PAM sequence: TTT
ttccttatcttccctccctt

SEQ ID NO: 54157 - DNA, 20 bp, Artificial Sequence
  Description of Artificial Sequence: Synthetic oligonucleotide
  Target: SCN10A; (-) strand; PAM type: YTN; PAM sequence: CTT
tttccttatcttccctccct

SEQ ID NO: 54158 - DNA, 20 bp, Artificial Sequence
  Description of Artificial Sequence: Synthetic oligonucleotide
  Target: SCN10A; (-) strand; PAM type: YTN; PAM sequence: TTA
acacaatctttttccttatc

SEQ ID NO: 54159 - DNA, 20 bp, Artificial Sequence
  Description of Artificial Sequence: Synthetic oligonucleotide
  Target: SCN10A; (-) strand; PAM type: YTN; PAM sequence: CTT
aacacaatctttttccttat

SEQ ID NO: 54160 - DNA, 20 bp, Artificial Sequence
  Description of Artificial Sequence: Synthetic oligonucleotide
  Target: SCN10A; (-) strand; PAM type: YTN; PAM sequence: TTC
ttaacacaatctttttcctt

SEQ ID NO: 54161 - DNA, 20 bp, Artificial Sequence
  Description of Artificial Sequence: Synthetic oligonucleotide
  Target: SCN10A; (-) strand; PAM type: YTN; PAM sequence: TTG
ccatgttcttaacacaatct

SEQ ID NO: 54162 - DNA, 20 bp, Artificial Sequence
  Description of Artificial Sequence: Synthetic oligonucleotide
  Target: SCN10A; (-) strand; PAM type: YTN; PAM sequence: TTA
ttgccatgttcttaacacaa

SEQ ID NO: 54163 - DNA, 20 bp, Artificial Sequence
  Description of Artificial Sequence: Synthetic oligonucleotide
  Target: SCN10A; (-) strand; PAM type: YTN; PAM sequence: CTT
attgccatgttcttaacaca

SEQ ID NO: 54164 - DNA, 20 bp, Artificial Sequence
  Description of Artificial Sequence: Synthetic oligonucleotide
  Target: SCN10A; (-) strand; PAM type: YTN; PAM sequence: TTG
tagccagtgaggaatcagaa

SEQ ID NO: 54165 - DNA, 20 bp, Artificial Sequence
  Description of Artificial Sequence: Synthetic oligonucleotide
  Target: SCN10A; (-) strand; PAM type: YTN; PAM sequence: TTA
aattgtagccagtgaggaat

SEQ ID NO: 54166 - DNA, 20 bp, Artificial Sequence
  Description of Artificial Sequence: Synthetic oligonucleotide
  Target: SCN10A; (-) strand; PAM type: YTN; PAM sequence: TTG
aaaaagcattaaattgtagc

SEQ ID NO: 54167 - DNA, 20 bp, Artificial Sequence
  Description of Artificial Sequence: Synthetic oligonucleotide
  Target: SCN10A; (-) strand; PAM type: YTN; PAM sequence: TTT
gaaaaagcattaaattgtag

SEQ ID NO: 54168 - DNA, 20 bp, Artificial Sequence
  Description of Artificial Sequence: Synthetic oligonucleotide
  Target: SCN10A; (-) strand; PAM type: YTN; PAM sequence: TTT
tgaaaaagcattaaattgta

SEQ ID NO: 54169 - DNA, 20 bp, Artificial Sequence
  Description of Artificial Sequence: Synthetic oligonucleotide
  Target: SCN10A; (-) strand; PAM type: YTN; PAM sequence: CTT
ttgaaaaagcattaaattgt

SEQ ID NO: 54170 - DNA, 20 bp, Artificial Sequence
  Description of Artificial Sequence: Synthetic oligonucleotide
  Target: SCN10A; (-) strand; PAM type: YTN; PAM sequence: CTG
tatacttttgaaaaagcatt

SEQ ID NO: 54171 - DNA, 20 bp, Artificial Sequence
  Description of Artificial Sequence: Synthetic oligonucleotide
  Target: SCN10A; (-) strand; PAM type: YTN; PAM sequence: CTC
caaagatcatgctgtatact

SEQ ID NO: 54172 - DNA, 20 bp, Artificial Sequence
  Description of Artificial Sequence: Synthetic oligonucleotide
  Target: SCN10A; (-) strand; PAM type: YTN; PAM sequence: CTG
gggctccaaagatcatgctg

SEQ ID NO: 54173 - DNA, 20 bp, Artificial Sequence
  Description of Artificial Sequence: Synthetic oligonucleotide
  Target: SCN10A; (-) strand; PAM type: YTN; PAM sequence: TTG
ggatagactggggctccaaa

SEQ ID NO: 54174 - DNA, 20 bp, Artificial Sequence
  Description of Artificial Sequence: Synthetic oligonucleotide
  Target: SCN10A; (-) strand; PAM type: YTN; PAM sequence: CTT
gggatagactggggctccaa

SEQ ID NO: 54175 - DNA, 20 bp, Artificial Sequence
  Description of Artificial Sequence: Synthetic oligonucleotide
  Target: SCN10A; (-) strand; PAM type: YTN; PAM sequence: CTG
agaacccagaggaagataat

SEQ ID NO: 54176 - DNA, 20 bp, Artificial Sequence
  Description of Artificial Sequence: Synthetic oligonucleotide
  Target: SCN10A; (-) strand; PAM type: YTN; PAM sequence: TTG
ctgagaacccagaggaagat

SEQ ID NO: 54177 - DNA, 20 bp, Artificial Sequence
  Description of Artificial Sequence: Synthetic oligonucleotide
  Target: SCN10A; (-) strand; PAM type: YTN; PAM sequence: CTA
tgttgctgagaacccagagg

SEQ ID NO: 54178 - DNA, 20 bp, Artificial Sequence
  Description of Artificial Sequence: Synthetic oligonucleotide
  Target: SCN10A; (-) strand; PAM type: YTN; PAM sequence: TTC
ctatgttgctgagaacccag

SEQ ID NO: 54179 - DNA, 20 bp, Artificial Sequence
  Description of Artificial Sequence: Synthetic oligonucleotide
  Target: SCN10A; (-) strand; PAM type: YTN; PAM sequence: TTT
cctatgttgctgagaaccca

SEQ ID NO: 54180 - DNA, 20 bp, Artificial Sequence
  Description of Artificial Sequence: Synthetic oligonucleotide
  Target: SCN10A; (-) strand; PAM type: YTN; PAM sequence: TTG
tttcctatgttgctgagaac

SEQ ID NO: 54181 - DNA, 20 bp, Artificial Sequence
  Description of Artificial Sequence: Synthetic oligonucleotide
  Target: SCN10A; (-) strand; PAM type: YTN; PAM sequence: TTA
gttgtttcctatgttgctga

SEQ ID NO: 54182 - DNA, 20 bp, Artificial Sequence
  Description of Artificial Sequence: Synthetic oligonucleotide
  Target: SCN10A; (-) strand; PAM type: YTN; PAM sequence: TTG
ataatagccattagttgttt

SEQ ID NO: 54183 - DNA, 20 bp, Artificial Sequence
  Description of Artificial Sequence: Synthetic oligonucleotide
  Target: SCN10A; (-) strand; PAM type: YTN; PAM sequence: TTG
aaatgcaaattgataatagc

SEQ ID NO: 54184 - DNA, 20 bp, Artificial Sequence
  Description of Artificial Sequence: Synthetic oligonucleotide
  Target: SCN10A; (-) strand; PAM type: YTN; PAM sequence: TTT
gaaatgcaaattgataatag

SEQ ID NO: 54185 - DNA, 20 bp, Artificial Sequence
  Description of Artificial Sequence: Synthetic oligonucleotide
  Target: SCN10A; (-) strand; PAM type: YTN; PAM sequence: TTT
tgaaatgcaaattgataata

SEQ ID NO: 54186 - DNA, 20 bp, Artificial Sequence
  Description of Artificial Sequence: Synthetic oligonucleotide
  Target: SCN10A; (-) strand; PAM type: YTN; PAM sequence: TTT
ttgaaatgcaaattgataat

SEQ ID NO: 54187 - DNA, 20 bp, Artificial Sequence
  Description of Artificial Sequence: Synthetic oligonucleotide
  Target: SCN10A; (-) strand; PAM type: YTN; PAM sequence: CTT
tttgaaatgcaaattgataa

SEQ ID NO: 54188 - DNA, 20 bp, Artificial Sequence
  Description of Artificial Sequence: Synthetic oligonucleotide
  Target: SCN10A; (-) strand; PAM type: YTN; PAM sequence: TTC
tttttgaaatgcaaattgat

SEQ ID NO: 54189 - DNA, 20 bp, Artificial Sequence
  Description of Artificial Sequence: Synthetic oligonucleotide
  Target: SCN10A; (-) strand; PAM type: YTN; PAM sequence: TTT
ctttttgaaatgcaaattga

SEQ ID NO: 54190 - DNA, 20 bp, Artificial Sequence
  Description of Artificial Sequence: Synthetic oligonucleotide
  Target: SCN10A; (-) strand; PAM type: YTN; PAM sequence: TTT
tctttttgaaatgcaaattg

SEQ ID NO: 54191 - DNA, 20 bp, Artificial Sequence
  Description of Artificial Sequence: Synthetic oligonucleotide
  Target: SCN10A; (-) strand; PAM type: YTN; PAM sequence: CTA
gattttctttttgaaatgca

SEQ ID NO: 54192 - DNA, 20 bp, Artificial Sequence
  Description of Artificial Sequence: Synthetic oligonucleotide
  Target: SCN10A; (-) strand; PAM type: YTN; PAM sequence: CTC
gtggaaataatcagactaga

SEQ ID NO: 54193 - DNA, 20 bp, Artificial Sequence
  Description of Artificial Sequence: Synthetic oligonucleotide
  Target: SCN10A; (-) strand; PAM type: YTN; PAM sequence: TTG
gcctcgtggaaataatcaga

SEQ ID NO: 54194 - DNA, 20 bp, Artificial Sequence
  Description of Artificial Sequence: Synthetic oligonucleotide
  Target: SCN10A; (-) strand; PAM type: YTN; PAM sequence: CTT
ggcctcgtggaaataatcag

SEQ ID NO: 54195 - DNA, 20 bp, Artificial Sequence
  Description of Artificial Sequence: Synthetic oligonucleotide
  Target: SCN10A; (-) strand; PAM type: YTN; PAM sequence: TTC
agcatccttggcctcgtgga

SEQ ID NO: 54196 - DNA, 20 bp, Artificial Sequence
  Description of Artificial Sequence: Synthetic oligonucleotide
  Target: SCN10A; (-) strand; PAM type: YTN; PAM sequence: TTG
gatgatgttcagcatccttg

SEQ ID NO: 54197 - DNA, 20 bp, Artificial Sequence
  Description of Artificial Sequence: Synthetic oligonucleotide
  Target: SCN10A; (-) strand; PAM type: YTN; PAM sequence: TTA
tgtgacaggtattggatgat

SEQ ID NO: 54198 - DNA, 20 bp, Artificial Sequence
  Description of Artificial Sequence: Synthetic oligonucleotide
  Target: SCN10A; (-) strand; PAM type: YTN; PAM sequence: TTT
atgtgacaggtattggatga

SEQ ID NO: 54199 - DNA, 20 bp, Artificial Sequence
  Description of Artificial Sequence: Synthetic oligonucleotide
  Target: SCN10A; (-) strand; PAM type: YTN; PAM sequence: CTG
ggaatttatgtgacaggtat

SEQ ID NO: 54200 - DNA, 20 bp, Artificial Sequence
  Description of Artificial Sequence: Synthetic oligonucleotide
  Target: SCN10A; (-) strand; PAM type: YTN; PAM sequence: CTA
tatggtcacaatcctgggaa

SEQ ID NO: 54201 - DNA, 20 bp, Artificial Sequence
  Description of Artificial Sequence: Synthetic oligonucleotide
  Target: SCN10A; (-) strand; PAM type: YTN; PAM sequence: CTA
cctatatggtcacaatcctg

SEQ ID NO: 54202 - DNA, 20 bp, Artificial Sequence
  Description of Artificial Sequence: Synthetic oligonucleotide
  Target: SCN10A; (-) strand; PAM type: YTN; PAM sequence: CTA
tgaaaagtataacatataca

SEQ ID NO: 54203 - DNA, 20 bp, Artificial Sequence
  Description of Artificial Sequence: Synthetic oligonucleotide
  Target: SCN10A; (-) strand; PAM type: YTN; PAM sequence: TTA
tatgcacactatgaaaagta

SEQ ID NO: 54204 - DNA, 20 bp, Artificial Sequence
  Description of Artificial Sequence: Synthetic oligonucleotide
  Target: SCN10A; (-) strand; PAM type: YTN; PAM sequence: TTT
atatgcacactatgaaaagt

SEQ ID NO: 54205 - DNA, 20 bp, Artificial Sequence
  Description of Artificial Sequence: Synthetic oligonucleotide
  Target: SCN10A; (-) strand; PAM type: YTN; PAM sequence: CTT
tatatgcacactatgaaaag

SEQ ID NO: 54206 - DNA, 20 bp, Artificial Sequence
  Description of Artificial Sequence: Synthetic oligonucleotide
  Target: SCN10A; (-) strand; PAM type: YTN; PAM sequence: TTC
cctttatatgcacactatga

SEQ ID NO: 54207 - DNA, 20 bp, Artificial Sequence
  Description of Artificial Sequence: Synthetic oligonucleotide
  Target: SCN10A; (-) strand; PAM type: YTN; PAM sequence: TTG
acataattccctttatatgc

SEQ ID NO: 54208 - DNA, 20 bp, Artificial Sequence
  Description of Artificial Sequence: Synthetic oligonucleotide
  Target: SCN10A; (-) strand; PAM type: YTN; PAM sequence: CTG
ttgacataattccctttata

SEQ ID NO: 54209 - DNA, 20 bp, Artificial Sequence
  Description of Artificial Sequence: Synthetic oligonucleotide
  Target: SCN10A; (-) strand; PAM type: YTN; PAM sequence: CTG
aactgttgacataattccct

SEQ ID NO: 54210 - DNA, 20 bp, Artificial Sequence
  Description of Artificial Sequence: Synthetic oligonucleotide
  Target: SCN10A; (-) strand; PAM type: YTN; PAM sequence: TTA
actgaactgttgacataatt

SEQ ID NO: 54211 - DNA, 20 bp, Artificial Sequence
  Description of Artificial Sequence: Synthetic oligonucleotide
  Target: SCN10A; (-) strand; PAM type: YTN; PAM sequence: TTG
tattaactgaactgttgaca

SEQ ID NO: 54212 - DNA, 20 bp, Artificial Sequence
  Description of Artificial Sequence: Synthetic oligonucleotide
  Target: SCN10A; (-) strand; PAM type: YTN; PAM sequence: TTT
gtattaactgaactgttgac

SEQ ID NO: 54213 - DNA, 20 bp, Artificial Sequence
  Description of Artificial Sequence: Synthetic oligonucleotide
  Target: SCN10A; (-) strand; PAM type: YTN; PAM sequence: TTT
tgtattaactgaactgttga

SEQ ID NO: 54214 - DNA, 20 bp, Artificial Sequence
  Description of Artificial Sequence: Synthetic oligonucleotide
  Target: SCN10A; (-) strand; PAM type: YTN; PAM sequence: TTA
ggagattttgtattaactga

SEQ ID NO: 54215 - DNA, 20 bp, Artificial Sequence
  Description of Artificial Sequence: Synthetic oligonucleotide
  Target: SCN10A; (-) strand; PAM type: YTN; PAM sequence: TTT
aggagattttgtattaactg

SEQ ID NO: 54216 - DNA, 20 bp, Artificial Sequence
  Description of Artificial Sequence: Synthetic oligonucleotide
  Target: SCN10A; (-) strand; PAM type: YTN; PAM sequence: CTT
taggagattttgtattaact

SEQ ID NO: 54217 - DNA, 20 bp, Artificial Sequence
  Description of Artificial Sequence: Synthetic oligonucleotide
  Target: SCN10A; (-) strand; PAM type: YTN; PAM sequence: TTC
tttaggagattttgtattaa

SEQ ID NO: 54218 - DNA, 20 bp, Artificial Sequence
  Description of Artificial Sequence: Synthetic oligonucleotide
  Target: SCN10A; (-) strand; PAM type: YTN; PAM sequence: TTA
tcaaatccattctttaggag

SEQ ID NO: 54219 - DNA, 20 bp, Artificial Sequence
  Description of Artificial Sequence: Synthetic oligonucleotide
  Target: SCN10A; (-) strand; PAM type: YTN; PAM sequence: TTC
ccagtaattatcaaatccat

SEQ ID NO: 54220 - DNA, 20 bp, Artificial Sequence
  Description of Artificial Sequence: Synthetic oligonucleotide
  Target: SCN10A; (-) strand; PAM type: YTN; PAM sequence: TTC
cattcccagtaattatcaaa

SEQ ID NO: 54221 - DNA, 20 bp, Artificial Sequence
  Description of Artificial Sequence: Synthetic oligonucleotide
  Target: SCN10A; (-) strand; PAM type: YTN; PAM sequence: TTT
ccattcccagtaattatcaa

SEQ ID NO: 54222 - DNA, 20 bp, Artificial Sequence
  Description of Artificial Sequence: Synthetic oligonucleotide
  Target: SCN10A; (-) strand; PAM type: YTN; PAM sequence: CTT
tccattcccagtaattatca

SEQ ID NO: 54223 - DNA, 20 bp, Artificial Sequence
  Description of Artificial Sequence: Synthetic oligonucleotide
  Target: SCN10A; (-) strand; PAM type: YTN; PAM sequence: TTG
gatcctttccattcccagta

SEQ ID NO: 54224 - DNA, 20 bp, Artificial Sequence
  Description of Artificial Sequence: Synthetic oligonucleotide
  Target: SCN10A; (-) strand; PAM type: YTN; PAM sequence: TTC
caaagttggatcctttccat

SEQ ID NO: 54225 - DNA, 20 bp, Artificial Sequence
  Description of Artificial Sequence: Synthetic oligonucleotide
  Target: SCN10A; (-) strand; PAM type: YTN; PAM sequence: CTT
ccaaagttggatcctttcca

SEQ ID NO: 54226 - DNA, 20 bp, Artificial Sequence
  Description of Artificial Sequence: Synthetic oligonucleotide
  Target: SCN10A; (-) strand; PAM type: YTN; PAM sequence: TTG
ccaaatcgtcttccaaagtt

SEQ ID NO: 54227 - DNA, 20 bp, Artificial Sequence
  Description of Artificial Sequence: Synthetic oligonucleotide
  Target: SCN10A; (-) strand; PAM type: YTN; PAM sequence: TTG
agatattgccaaatcgtctt

SEQ ID NO: 54228 - DNA, 20 bp, Artificial Sequence
  Description of Artificial Sequence: Synthetic oligonucleotide
  Target: SCN10A; (-) strand; PAM type: YTN; PAM sequence: TTT
gagatattgccaaatcgtct

SEQ ID NO: 54229 - DNA, 20 bp, Artificial Sequence
  Description of Artificial Sequence: Synthetic oligonucleotide
  Target: SCN10A; (-) strand; PAM type: YTN; PAM sequence: TTT
tgagatattgccaaatcgtc

SEQ ID NO: 54230 - DNA, 20 bp, Artificial Sequence
  Description of Artificial Sequence: Synthetic oligonucleotide
  Target: SCN10A; (-) strand; PAM type: YTN; PAM sequence: TTT
ttgagatattgccaaatcgt

SEQ ID NO: 54231 - DNA, 20 bp, Artificial Sequence
  Description of Artificial Sequence: Synthetic oligonucleotide
  Target: SCN10A; (-) strand; PAM type: YTN; PAM sequence: TTA
atttttgagatattgccaaa

SEQ ID NO: 54232 - DNA, 20 bp, Artificial Sequence
  Description of Artificial Sequence: Synthetic oligonucleotide
  Target: SCN10A; (-) strand; PAM type: YTN; PAM sequence: TTT
aatttttgagatattgccaa

SEQ ID NO: 54233 - DNA, 20 bp, Artificial Sequence
  Description of Artificial Sequence: Synthetic oligonucleotide
  Target: SCN10A; (-) strand; PAM type: YTN; PAM sequence: TTT
taatttttgagatattgcca

SEQ ID NO: 54234 - DNA, 20 bp, Artificial Sequence
  Description of Artificial Sequence: Synthetic oligonucleotide
  Target: SCN10A; (-) strand; PAM type: YTN; PAM sequence: TTG
ccaggtcaaaggggtgtaca

SEQ ID NO: 54235 - DNA, 20 bp, Artificial Sequence
  Description of Artificial Sequence: Synthetic oligonucleotide
  Target: SCN10A; (-) strand; PAM type: YTN; PAM sequence: CTA
gaagtagaattgccaggtca

SEQ ID NO: 54236 - DNA, 20 bp, Artificial Sequence
  Description of Artificial Sequence: Synthetic oligonucleotide
  Target: SCN10A; (-) strand; PAM type: YTN; PAM sequence: TTC
tagaagtagaattgccaggt

SEQ ID NO: 54237 - DNA, 20 bp, Artificial Sequence
  Description of Artificial Sequence: Synthetic oligonucleotide
  Target: SCN10A; (-) strand; PAM type: YTN; PAM sequence: TTT
ctagaagtagaattgccagg

SEQ ID NO: 54238 - DNA, 20 bp, Artificial Sequence
  Description of Artificial Sequence: Synthetic oligonucleotide
  Target: SCN10A; (-) strand; PAM type: YTN; PAM sequence: TTA
aggatgaatttctagaagta

SEQ ID NO: 54239 - DNA, 20 bp, Artificial Sequence
  Description of Artificial Sequence: Synthetic oligonucleotide
  Target: SCN10A; (-) strand; PAM type: YTN; PAM sequence: TTG
tacacataatatgagtaaaa

SEQ ID NO: 54240 - DNA, 20 bp, Artificial Sequence
  Description of Artificial Sequence: Synthetic oligonucleotide
  Target: SCN10A; (-) strand; PAM type: YTN; PAM sequence: TTT
gtacacataatatgagtaaa

SEQ ID NO: 54241 - DNA, 20 bp, Artificial Sequence
  Description of Artificial Sequence: Synthetic oligonucleotide
  Target: SCN10A; (-) strand; PAM type: YTN; PAM sequence: CTT
tgtacacataatatgagtaa

SEQ ID NO: 54242 - DNA, 20 bp, Artificial Sequence
  Description of Artificial Sequence: Synthetic oligonucleotide
  Target: SCN10A; (-) strand; PAM type: YTN; PAM sequence: TTA
cacatgtatctttgtacaca

SEQ ID NO: 54243 - DNA, 20 bp, Artificial Sequence
  Description of Artificial Sequence: Synthetic oligonucleotide
  Target: SCN10A; (-) strand; PAM type: YTN; PAM sequence: CTT
acacatgtatctttgtacac

SEQ ID NO: 54244 - DNA, 20 bp, Artificial Sequence
  Description of Artificial Sequence: Synthetic oligonucleotide
  Target: SCN10A; (-) strand; PAM type: YTN; PAM sequence: TTG
gtgagtatccttacacatgt

SEQ ID NO: 54245 - DNA, 20 bp, Artificial Sequence
  Description of Artificial Sequence: Synthetic oligonucleotide
  Target: SCN10A; (-) strand; PAM type: YTN; PAM sequence: TTT
ggtgagtatccttacacatg

SEQ ID NO: 54246 - DNA, 20 bp, Artificial Sequence
  Description of Artificial Sequence: Synthetic oligonucleotide
  Target: SCN10A; (-) strand; PAM type: YTN; PAM sequence: TTT
tggtgagtatccttacacat

SEQ ID NO: 54247 - DNA, 20 bp, Artificial Sequence
  Description of Artificial Sequence: Synthetic oligonucleotide
  Target: SCN10A; (-) strand; PAM type: YTN; PAM sequence: TTT
ttggtgagtatccttacaca

SEQ ID NO: 54248 - DNA, 20 bp, Artificial Sequence
  Description of Artificial Sequence: Synthetic oligonucleotide
  Target: SCN10A; (-) strand; PAM type: YTN; PAM sequence: TTT
tttggtgagtatccttacac

SEQ ID NO: 54249 - DNA, 20 bp, Artificial Sequence
  Description of Artificial Sequence: Synthetic oligonucleotide
  Target: SCN10A; (-) strand; PAM type: YTN; PAM sequence: TTA
attttttggtgagtatcctt

SEQ ID NO: 54250 - DNA, 20 bp, Artificial Sequence
  Description of Artificial Sequence: Synthetic oligonucleotide
  Target: SCN10A; (-) strand; PAM type: YTN; PAM sequence: TTG
ccaccacatattaatttttt

SEQ ID NO: 54251 - DNA, 20 bp, Artificial Sequence
  Description of Artificial Sequence: Synthetic oligonucleotide
  Target: SCN10A; (-) strand; PAM type: YTN; PAM sequence: TTT
gccaccacatattaattttt

SEQ ID NO: 54252 - DNA, 20 bp, Artificial Sequence
  Description of Artificial Sequence: Synthetic oligonucleotide
  Target: SCN10A; (-) strand; PAM type: YTN; PAM sequence: TTT
tgccaccacatattaatttt

SEQ ID NO: 54253 - DNA, 20 bp, Artificial Sequence
  Description of Artificial Sequence: Synthetic oligonucleotide
  Target: SCN10A; (-) strand; PAM type: YTN; PAM sequence: CTC
atattttgccaccacatatt

SEQ ID NO: 54254 - DNA, 20 bp, Artificial Sequence
  Description of Artificial Sequence: Synthetic oligonucleotide
  Target: SCN10A; (-) strand; PAM type: YTN; PAM sequence: TTA
acataatcctcatattttgc

SEQ ID NO: 54255 - DNA, 20 bp, Artificial Sequence
  Description of Artificial Sequence: Synthetic oligonucleotide
  Target: SCN10A; (-) strand; PAM type: YTN; PAM sequence: TTA
tcataattaacataatcctc

SEQ ID NO: 54256 - DNA, 20 bp, Artificial Sequence
  Description of Artificial Sequence: Synthetic oligonucleotide
  Target: SCN10A; (-) strand; PAM type: YTN; PAM sequence: TTT
atcataattaacataatcct

SEQ ID NO: 54257 - DNA, 20 bp, Artificial Sequence
  Description of Artificial Sequence: Synthetic oligonucleotide
  Target: SCN10A; (-) strand; PAM type: YTN; PAM sequence: TTC
acatttatcataattaacat

SEQ ID NO: 54258 - DNA, 20 bp, Artificial Sequence
  Description of Artificial Sequence: Synthetic oligonucleotide
  Target: SCN10A; (-) strand; PAM type: YTN; PAM sequence: TTG
atagacattcacatttatca

SEQ ID NO: 54259 - DNA, 20 bp, Artificial Sequence
  Description of Artificial Sequence: Synthetic oligonucleotide
  Target: SCN10A; (-) strand; PAM type: YTN; PAM sequence: CTA
ttgatagacattcacattta

SEQ ID NO: 54260 - DNA, 20 bp, Artificial Sequence
  Description of Artificial Sequence: Synthetic oligonucleotide
  Target: SCN10A; (-) strand; PAM type: YTN; PAM sequence: TTC
ctattgatagacattcacat

SEQ ID NO: 54261 - DNA, 20 bp, Artificial Sequence
  Description of Artificial Sequence: Synthetic oligonucleotide
  Target: SCN10A; (-) strand; PAM type: YTN; PAM sequence: TTT
cctattgatagacattcaca

SEQ ID NO: 54262 - DNA, 20 bp, Artificial Sequence
  Description of Artificial Sequence: Synthetic oligonucleotide
  Target: SCN10A; (-) strand; PAM type: YTN; PAM sequence: TTT
tcctattgatagacattcac

SEQ ID NO: 54263 - DNA, 20 bp, Artificial Sequence
  Description of Artificial Sequence: Synthetic oligonucleotide
  Target: SCN10A; (-) strand; PAM type: YTN; PAM sequence: CTA
ttttcctattgatagacatt

SEQ ID NO: 54264 - DNA, 20 bp, Artificial Sequence
  Description of Artificial Sequence: Synthetic oligonucleotide
  Target: SCN10A; (-) strand; PAM type: YTN; PAM sequence: TTA
actattttcctattgataga

SEQ ID NO: 54265 - DNA, 20 bp, Artificial Sequence
  Description of Artificial Sequence: Synthetic oligonucleotide
  Target: SCN10A; (-) strand; PAM type: YTN; PAM sequence: TTT
aactattttcctattgatag

SEQ ID NO: 54266 - DNA, 20 bp, Artificial Sequence
  Description of Artificial Sequence: Synthetic oligonucleotide
  Target: SCN10A; (-) strand; PAM type: YTN; PAM sequence: TTA
tttaactattttcctattga

SEQ ID NO: 54267 - DNA, 20 bp, Artificial Sequence
  Description of Artificial Sequence: Synthetic oligonucleotide
  Target: SCN10A; (-) strand; PAM type: YTN; PAM sequence: TTT
atttaactattttcctattg

SEQ ID NO: 54268 - DNA, 20 bp, Artificial Sequence
  Description of Artificial Sequence: Synthetic oligonucleotide
  Target: SCN10A; (-) strand; PAM type: YTN; PAM sequence: TTG
catggatgaagtgaagttta

SEQ ID NO: 54269 - DNA, 20 bp, Artificial Sequence
  Description of Artificial Sequence: Synthetic oligonucleotide
  Target: SCN10A; (-) strand; PAM type: YTN; PAM sequence: TTT
gcatggatgaagtgaagttt

SEQ ID NO: 54270 - DNA, 20 bp, Artificial Sequence
  Description of Artificial Sequence: Synthetic oligonucleotide
  Target: SCN10A; (-) strand; PAM type: YTN; PAM sequence: TTC
atttgcatggatgaagtgaa

SEQ ID NO: 54271 - DNA, 20 bp, Artificial Sequence
  Description of Artificial Sequence: Synthetic oligonucleotide
  Target: SCN10A; (-) strand; PAM type: YTN; PAM sequence: TTT
catttgcatggatgaagtga

SEQ ID NO: 54272 - DNA, 20 bp, Artificial Sequence
  Description of Artificial Sequence: Synthetic oligonucleotide
  Target: SCN10A; (-) strand; PAM type: YTN; PAM sequence: CTG
aacagatttcatttgcatgg

SEQ ID NO: 54273 - DNA, 20 bp, Artificial Sequence
  Description of Artificial Sequence: Synthetic oligonucleotide
  Target: SCN10A; (-) strand; PAM type: YTN; PAM sequence: TTA
gctgaacagatttcatttgc

SEQ ID NO: 54274 - DNA, 20 bp, Artificial Sequence
  Description of Artificial Sequence: Synthetic oligonucleotide
  Target: SCN10A; (-) strand; PAM type: YTN; PAM sequence: TTA
tagaaattagctgaacagat

SEQ ID NO: 54275 - DNA, 20 bp, Artificial Sequence
  Description of Artificial Sequence: Synthetic oligonucleotide
  Target: SCN10A; (-) strand; PAM type: YTN; PAM sequence: TTT
atagaaattagctgaacaga

SEQ ID NO: 54276 - DNA, 20 bp, Artificial Sequence
  Description of Artificial Sequence: Synthetic oligonucleotide
  Target: SCN10A; (-) strand; PAM type: YTN; PAM sequence: TTT
tatagaaattagctgaacag

SEQ ID NO: 54277 - DNA, 20 bp, Artificial Sequence
  Description of Artificial Sequence: Synthetic oligonucleotide
  Target: SCN10A; (-) strand; PAM type: YTN; PAM sequence: CTG
ttttatagaaattagctgaa

SEQ ID NO: 54278 - DNA, 20 bp, Artificial Sequence
  Description of Artificial Sequence: Synthetic oligonucleotide
  Target: SCN10A; (-) strand; PAM type: YTN; PAM sequence: TTC
aatgacatccccaaaaaaat

SEQ ID NO: 54279 - DNA, 20 bp, Artificial Sequence
  Description of Artificial Sequence: Synthetic oligonucleotide
  Target: SCN10A; (-) strand; PAM type: YTN; PAM sequence: CTA
taaattcaatgacatcccca

SEQ ID NO: 54280 - DNA, 20 bp, Artificial Sequence
  Description of Artificial Sequence: Synthetic oligonucleotide
  Target: SCN10A; (-) strand; PAM type: YTN; PAM sequence: TTA
gtctataaattcaatgacat

SEQ ID NO: 54281 - DNA, 20 bp, Artificial Sequence
  Description of Artificial Sequence: Synthetic oligonucleotide
  Target: SCN10A; (-) strand; PAM type: YTN; PAM sequence: CTG
cccaaattagtctataaatt

SEQ ID NO: 54282 - DNA, 20 bp, Artificial Sequence
  Description of Artificial Sequence: Synthetic oligonucleotide
  Target: SCN10A; (-) strand; PAM type: YTN; PAM sequence: TTA
gaatgtcagtgctgcccaaa

SEQ ID NO: 54283 - DNA, 20 bp, Artificial Sequence
  Description of Artificial Sequence: Synthetic oligonucleotide
  Target: SCN10A; (-) strand; PAM type: YTN; PAM sequence: TTG
ttagaatgtcagtgctgccc

SEQ ID NO: 54284 - DNA, 20 bp, Artificial Sequence
  Description of Artificial Sequence: Synthetic oligonucleotide
  Target: SCN10A; (-) strand; PAM type: YTN; PAM sequence: TTC
ataattgttagaatgtcagt

SEQ ID NO: 54285 - DNA, 20 bp, Artificial Sequence
  Description of Artificial Sequence: Synthetic oligonucleotide
  Target: SCN10A; (-) strand; PAM type: YTN; PAM sequence: TTA
gaagattcataattgttaga

SEQ ID NO: 54286 - DNA, 20 bp, Artificial Sequence
  Description of Artificial Sequence: Synthetic oligonucleotide
  Target: SCN10A; (-) strand; PAM type: YTN; PAM sequence: CTG
gattagaagattcataattg

SEQ ID NO: 54287 - DNA, 20 bp, Artificial Sequence
  Description of Artificial Sequence: Synthetic oligonucleotide
  Target: SCN10A; (-) strand; PAM type: YTN; PAM sequence: CTC
atgtgactggattagaagat

SEQ ID NO: 54288 - DNA, 20 bp, Artificial Sequence
  Description of Artificial Sequence: Synthetic oligonucleotide
  Target: SCN10A; (-) strand; PAM type: YTN; PAM sequence: TTA
aaggatgtctcatgtgactg

SEQ ID NO: 54289 - DNA, 20 bp, Artificial Sequence
  Description of Artificial Sequence: Synthetic oligonucleotide
  Target: SCN10A; (-) strand; PAM type: YTN; PAM sequence: CTA
aatgaattaaaggatgtctc

SEQ ID NO: 54290 - DNA, 20 bp, Artificial Sequence
  Description of Artificial Sequence: Synthetic oligonucleotide
  Target: SCN10A; (-) strand; PAM type: YTN; PAM sequence: TTA
aagtacctaaatgaattaaa

SEQ ID NO: 54291 - DNA, 20 bp, Artificial Sequence
  Description of Artificial Sequence: Synthetic oligonucleotide
  Target: SCN10A; (-) strand; PAM type: YTN; PAM sequence: TTT
aaagtacctaaatgaattaa

SEQ ID NO: 54292 - DNA, 20 bp, Artificial Sequence
  Description of Artificial Sequence: Synthetic oligonucleotide
  Target: SCN10A; (-) strand; PAM type: YTN; PAM sequence: TTT
taaagtacctaaatgaatta

SEQ ID NO: 54293 - DNA, 20 bp, Artificial Sequence
  Description of Artificial Sequence: Synthetic oligonucleotide
  Target: SCN10A; (-) strand; PAM type: YTN; PAM sequence: TTG
agagaaattttaaagtacct

SEQ ID NO: 54294 - DNA, 20 bp, Artificial Sequence
  Description of Artificial Sequence: Synthetic oligonucleotide
  Target: SCN10A; (-) strand; PAM type: YTN; PAM sequence: TTA
ttgagagaaattttaaagta

SEQ ID NO: 54295 - DNA, 20 bp, Artificial Sequence
  Description of Artificial Sequence: Synthetic oligonucleotide
  Target: SCN10A; (-) strand; PAM type: YTN; PAM sequence: CTA
aaaaataatacagcattatt

SEQ ID NO: 54296 - DNA, 20 bp, Artificial Sequence
  Description of Artificial Sequence: Synthetic oligonucleotide
  Target: SCN10A; (-) strand; PAM type: YTN; PAM sequence: TTA
tactaaaaaataatacagca

SEQ ID NO: 54297 - DNA, 20 bp, Artificial Sequence
  Description of Artificial Sequence: Synthetic oligonucleotide
  Target: SCN10A; (-) strand; PAM type: YTN; PAM sequence: TTT
atactaaaaaataatacagc

SEQ ID NO: 54298 - DNA, 20 bp, Artificial Sequence
  Description of Artificial Sequence: Synthetic oligonucleotide
  Target: SCN10A; (-) strand; PAM type: YTN; PAM sequence: CTT
tatactaaaaaataatacag

SEQ ID NO: 54299 - DNA, 20 bp, Artificial Sequence
  Description of Artificial Sequence: Synthetic oligonucleotide
  Target: SCN10A; (-) strand; PAM type: YTN; PAM sequence: TTG
taaaaatatgcacaagacct

SEQ ID NO: 54300 - DNA, 20 bp, Artificial Sequence
  Description of Artificial Sequence: Synthetic oligonucleotide
  Target: SCN10A; (-) strand; PAM type: YTN; PAM sequence: CTG
ttgtaaaaatatgcacaaga

SEQ ID NO: 54301 - DNA, 20 bp, Artificial Sequence
  Description of Artificial Sequence: Synthetic oligonucleotide
  Target: SCN10A; (-) strand; PAM type: YTN; PAM sequence: CTA
ataaatccaaatgctgttgt

SEQ ID NO: 54302 - DNA, 20 bp, Artificial Sequence
  Description of Artificial Sequence: Synthetic oligonucleotide
  Target: SCN10A; (-) strand; PAM type: YTN; PAM sequence: TTA
caaaatagaaaaacagtaga

SEQ ID NO: 54303 - DNA, 20 bp, Artificial Sequence
  Description of Artificial Sequence: Synthetic oligonucleotide
  Target: SCN10A; (-) strand; PAM type: YTN; PAM sequence: TTA
taaaaagcaataaattacaa

SEQ ID NO: 54304 - DNA, 20 bp, Artificial Sequence
  Description of Artificial Sequence: Synthetic oligonucleotide
  Target: SCN10A; (-) strand; PAM type: YTN; PAM sequence: TTA
ataattataaaaagcaataa

SEQ ID NO: 54305 - DNA, 20 bp, Artificial Sequence
  Description of Artificial Sequence: Synthetic oligonucleotide
  Target: SCN10A; (-) strand; PAM type: YTN; PAM sequence: CTA
gaaaaaggataacaaatgaa

SEQ ID NO: 54306 - DNA, 20 bp, Artificial Sequence
  Description of Artificial Sequence: Synthetic oligonucleotide
  Target: SCN10A; (-) strand; PAM type: YTN; PAM sequence: CTA
acaaaactagaaaaaggata

SEQ ID NO: 54307 - DNA, 20 bp, Artificial Sequence
  Description of Artificial Sequence: Synthetic oligonucleotide
  Target: SCN10A; (-) strand; PAM type: YTN; PAM sequence: TTA
aagacctaacaaaactagaa

SEQ ID NO: 54308 - DNA, 20 bp, Artificial Sequence
  Description of Artificial Sequence: Synthetic oligonucleotide
  Target: SCN10A; (-) strand; PAM type: YTN; PAM sequence: TTT
aaagacctaacaaaactaga

SEQ ID NO: 54309 - DNA, 20 bp, Artificial Sequence
  Description of Artificial Sequence: Synthetic oligonucleotide
  Target: SCN10A; (-) strand; PAM type: YTN; PAM sequence: TTA
tttaaagacctaacaaaact

SEQ ID NO: 54310 - DNA, 20 bp, Artificial Sequence
  Description of Artificial Sequence: Synthetic oligonucleotide
  Target: SCN10A; (-) strand; PAM type: YTN; PAM sequence: CTG
aaaagaaattatttaaagac

SEQ ID NO: 54311 - DNA, 20 bp, Artificial Sequence
  Description of Artificial Sequence: Synthetic oligonucleotide
  Target: SCN10A; (-) strand; PAM type: YTN; PAM sequence: TTA
tatcagtaaaagctgaaaag

SEQ ID NO: 54312 - DNA, 20 bp, Artificial Sequence
  Description of Artificial Sequence: Synthetic oligonucleotide
  Target: SCN10A; (-) strand; PAM type: YTN; PAM sequence: TTT
atatcagtaaaagctgaaaa

SEQ ID NO: 54313 - DNA, 20 bp, Artificial Sequence
  Description of Artificial Sequence: Synthetic oligonucleotide
  Target: SCN10A; (-) strand; PAM type: YTN; PAM sequence: TTC
agggaataagtcacagcatg

SEQ ID NO: 54314 - DNA, 20 bp, Artificial Sequence
  Description of Artificial Sequence: Synthetic oligonucleotide
  Target: SCN10A; (-) strand; PAM type: YTN; PAM sequence: TTA
aagacatacatattcaggga

SEQ ID NO: 54315 - DNA, 20 bp, Artificial Sequence
  Description of Artificial Sequence: Synthetic oligonucleotide
  Target: SCN10A; (-) strand; PAM type: YTN; PAM sequence: CTA
gagagtgcagttaaagacat

SEQ ID NO: 54316 - DNA, 20 bp, Artificial Sequence
  Description of Artificial Sequence: Synthetic oligonucleotide
  Target: SCN10A; (-) strand; PAM type: YTN; PAM sequence: TTA
atcagaacctagagagtgca

SEQ ID NO: 54317 - DNA, 20 bp, Artificial Sequence
  Description of Artificial Sequence: Synthetic oligonucleotide
  Target: SCN10A; (-) strand; PAM type: YTN; PAM sequence: TTT
aatcagaacctagagagtgc

SEQ ID NO: 54318 - DNA, 20 bp, Artificial Sequence
  Description of Artificial Sequence: Synthetic oligonucleotide
  Target: SCN10A; (-) strand; PAM type: YTN; PAM sequence: TTC
gagggaaggaaagataaaaa

SEQ ID NO: 54319 - DNA, 20 bp, Artificial Sequence
  Description of Artificial Sequence: Synthetic oligonucleotide
  Target: SCN10A; (-) strand; PAM type: YTN; PAM sequence: TTT
cgagggaaggaaagataaaa

SEQ ID NO: 54320 - DNA, 20 bp, Artificial Sequence
  Description of Artificial Sequence: Synthetic oligonucleotide
  Target: SCN10A; (-) strand; PAM type: YTN; PAM sequence: TTA
tataatttcgagggaaggaa

SEQ ID NO: 54321 - DNA, 20 bp, Artificial Sequence
  Description of Artificial Sequence: Synthetic oligonucleotide
  Target: SCN10A; (-) strand; PAM type: YTN; PAM sequence: CTA
aaattatataatttcgaggg

SEQ ID NO: 54322 - DNA, 20 bp, Artificial Sequence
  Description of Artificial Sequence: Synthetic oligonucleotide
  Target: SCN10A; (-) strand; PAM type: YTN; PAM sequence: CTA
taaactaaaattatataatt

SEQ ID NO: 54323 - DNA, 20 bp, Artificial Sequence
  Description of Artificial Sequence: Synthetic oligonucleotide
  Target: SCN10A; (-) strand; PAM type: YTN; PAM sequence: TTG
gacaaaagacaaactataaa

SEQ ID NO: 54324 - DNA, 20 bp, Artificial Sequence
  Description of Artificial Sequence: Synthetic oligonucleotide
  Target: SCN10A; (-) strand; PAM type: YTN; PAM sequence: CTT
ggacaaaagacaaactataa

SEQ ID NO: 54325 - DNA, 20 bp, Artificial Sequence
  Description of Artificial Sequence: Synthetic oligonucleotide
  Target: SCN10A; (-) strand; PAM type: YTN; PAM sequence: TTC
ttggacaaaagacaaactat

SEQ ID NO: 54326 - DNA, 20 bp, Artificial Sequence
  Description of Artificial Sequence: Synthetic oligonucleotide
  Target: SCN10A; (-) strand; PAM type: YTN; PAM sequence: TTA
aagaattcttggacaaaaga

SEQ ID NO: 54327 - DNA, 20 bp, Artificial Sequence
  Description of Artificial Sequence: Synthetic oligonucleotide
  Target: SCN10A; (-) strand; PAM type: YTN; PAM sequence: CTT
aaagaattcttggacaaaag

SEQ ID NO: 54328 - DNA, 20 bp, Artificial Sequence
  Description of Artificial Sequence: Synthetic oligonucleotide
  Target: SCN10A; (-) strand; PAM type: YTN; PAM sequence: CTC
ttaaagaattcttggacaaa

SEQ ID NO: 54329 - DNA, 20 bp, Artificial Sequence
  Description of Artificial Sequence: Synthetic oligonucleotide
  Target: SCN10A; (-) strand; PAM type: YTN; PAM sequence: CTC
tcttaaagaattcttggaca

SEQ ID NO: 54330 - DNA, 20 bp, Artificial Sequence
  Description of Artificial Sequence: Synthetic oligonucleotide
  Target: SCN10A; (-) strand; PAM type: YTN; PAM sequence: TTA
aaaatctctcttaaagaatt

SEQ ID NO: 54331 - DNA, 20 bp, Artificial Sequence
  Description of Artificial Sequence: Synthetic oligonucleotide
  Target: SCN10A; (-) strand; PAM type: YTN; PAM sequence: TTT
aaaaatctctcttaaagaat

SEQ ID NO: 54332 - DNA, 20 bp, Artificial Sequence
  Description of Artificial Sequence: Synthetic oligonucleotide
  Target: SCN10A; (-) strand; PAM type: YTN; PAM sequence: TTT
taaaaatctctcttaaagaa

SEQ ID NO: 54333 - DNA, 20 bp, Artificial Sequence
  Description of Artificial Sequence: Synthetic oligonucleotide
  Target: SCN10A; (-) strand; PAM type: YTN; PAM sequence: TTT
ttaaaaatctctcttaaaga

SEQ ID NO: 54334 - DNA, 20 bp, Artificial Sequence
  Description of Artificial Sequence: Synthetic oligonucleotide
  Target: SCN10A; (-) strand; PAM type: YTN; PAM sequence: TTG
ataatttttaaaaatctctc

SEQ ID NO: 54335 - DNA, 20 bp, Artificial Sequence
  Description of Artificial Sequence: Synthetic oligonucleotide
  Target: SCN10A; (-) strand; PAM type: YTN; PAM sequence: CTT
gataatttttaaaaatctct

SEQ ID NO: 54336 - DNA, 20 bp, Artificial Sequence
  Description of Artificial Sequence: Synthetic oligonucleotide
  Target: SCN10A; (-) strand; PAM type: YTN; PAM sequence: TTC
cacttgataatttttaaaaa

SEQ ID NO: 54337 - DNA, 20 bp, Artificial Sequence
  Description of Artificial Sequence: Synthetic oligonucleotide
  Target: SCN10A; (-) strand; PAM type: YTN; PAM sequence: TTT
ccacttgataatttttaaaa

SEQ ID NO: 54338 - DNA, 20 bp, Artificial Sequence
  Description of Artificial Sequence: Synthetic oligonucleotide
  Target: SCN10A; (-) strand; PAM type: YTN; PAM sequence: CTT
tccacttgataatttttaaa

SEQ ID NO: 54339 - DNA, 20 bp, Artificial Sequence
  Description of Artificial Sequence: Synthetic oligonucleotide
  Target: SCN10A; (-) strand; PAM type: YTN; PAM sequence: TTA
atgaaatgagaggactttcc

SEQ ID NO: 54340 - DNA, 20 bp, Artificial Sequence
  Description of Artificial Sequence: Synthetic oligonucleotide
  Target: SCN10A; (-) strand; PAM type: YTN; PAM sequence: TTT
aatgaaatgagaggactttc

SEQ ID NO: 54341 - DNA, 20 bp, Artificial Sequence
  Description of Artificial Sequence: Synthetic oligonucleotide
  Target: SCN10A; (-) strand; PAM type: YTN; PAM sequence: TTA
aaaaaaataaccaaatttaa

SEQ ID NO: 54342 - DNA, 20 bp, Artificial Sequence
  Description of Artificial Sequence: Synthetic oligonucleotide
  Target: SCN10A; (-) strand; PAM type: YTN; PAM sequence: CTG
atcataatgaaatagagtta

SEQ ID NO: 54343 - DNA, 20 bp, Artificial Sequence
  Description of Artificial Sequence: Synthetic oligonucleotide
  Target: SCN10A; (-) strand; PAM type: YTN; PAM sequence: CTC
tgatcataatgaaatagagt

SEQ ID NO: 54344 - DNA, 20 bp, Artificial Sequence
  Description of Artificial Sequence: Synthetic oligonucleotide
  Target: SCN10A; (-) strand; PAM type: YTN; PAM sequence: TTC
tctgatcataatgaaataga

SEQ ID NO: 54345 - DNA, 20 bp, Artificial Sequence
  Description of Artificial Sequence: Synthetic oligonucleotide
  Target: SCN10A; (-) strand; PAM type: YTN; PAM sequence: CTC
cagaaagtggaaataatata

SEQ ID NO: 54346 - DNA, 20 bp, Artificial Sequence
  Description of Artificial Sequence: Synthetic oligonucleotide
  Target: SCN10A; (-) strand; PAM type: YTN; PAM sequence: CTC
aataagctccagaaagtgga

SEQ ID NO: 54347 - DNA, 20 bp, Artificial Sequence
  Description of Artificial Sequence: Synthetic oligonucleotide
  Target: SCN10A; (-) strand; PAM type: YTN; PAM sequence: TTA
agccatgacaaaaacctcaa

SEQ ID NO: 54348 - DNA, 20 bp, Artificial Sequence
  Description of Artificial Sequence: Synthetic oligonucleotide
  Target: SCN10A; (-) strand; PAM type: YTN; PAM sequence: TTC
aaaaaaccaaacatatcaaa

SEQ ID NO: 54349 - DNA, 20 bp, Artificial Sequence
  Description of Artificial Sequence: Synthetic oligonucleotide
  Target: SCN10A; (-) strand; PAM type: YTN; PAM sequence: TTT
caaaaaaccaaacatatcaa

SEQ ID NO: 54350 - DNA, 20 bp, Artificial Sequence
  Description of Artificial Sequence: Synthetic oligonucleotide
  Target: SCN10A; (-) strand; PAM type: YTN; PAM sequence: TTT
tcaaaaaaccaaacatatca

SEQ ID NO: 54351 - DNA, 20 bp, Artificial Sequence
  Description of Artificial Sequence: Synthetic oligonucleotide
  Target: SCN10A; (-) strand; PAM type: YTN; PAM sequence: CTT
ttcaaaaaaccaaacatatc

SEQ ID NO: 54352 - DNA, 20 bp, Artificial Sequence
  Description of Artificial Sequence: Synthetic oligonucleotide
  Target: SCN10A; (-) strand; PAM type: YTN; PAM sequence: CTC
cttttcaaaaaaccaaacat

SEQ ID NO: 54353 - DNA, 20 bp, Artificial Sequence
  Description of Artificial Sequence: Synthetic oligonucleotide
  Target: SCN10A; (-) strand; PAM type: YTN; PAM sequence: CTA
acaatagaaaatgcacctcc

SEQ ID NO: 54354 - DNA, 20 bp, Artificial Sequence
  Description of Artificial Sequence: Synthetic oligonucleotide
  Target: SCN10A; (-) strand; PAM type: YTN; PAM sequence: TTC
cctaacaatagaaaatgcac

SEQ ID NO: 54355 - DNA, 20 bp, Artificial Sequence
  Description of Artificial Sequence: Synthetic oligonucleotide
  Target: SCN10A; (-) strand; PAM type: YTN; PAM sequence: CTT
ccctaacaatagaaaatgca

SEQ ID NO: 54356 - DNA, 20 bp, Artificial Sequence
  Description of Artificial Sequence: Synthetic oligonucleotide
  Target: SCN10A; (-) strand; PAM type: YTN; PAM sequence: CTA
ccttccctaacaatagaaaa

SEQ ID NO: 54357 - DNA, 20 bp, Artificial Sequence
  Description of Artificial Sequence: Synthetic oligonucleotide
  Target: SCN10A; (-) strand; PAM type: YTN; PAM sequence: TTA
atatatagcaaactaccttc

SEQ ID NO: 54358 - DNA, 20 bp, Artificial Sequence
  Description of Artificial Sequence: Synthetic oligonucleotide
  Target: SCN10A; (-) strand; PAM type: YTN; PAM sequence: CTG
attaatatatagcaaactac

SEQ ID NO: 54359 - DNA, 20 bp, Artificial Sequence
  Description of Artificial Sequence: Synthetic oligonucleotide
  Target: SCN10A; (-) strand; PAM type: YTN; PAM sequence: TTA
atataatgtatctgattaat

SEQ ID NO: 54360 - DNA, 20 bp, Artificial Sequence
  Description of Artificial Sequence: Synthetic oligonucleotide
  Target: SCN10A; (-) strand; PAM type: YTN; PAM sequence: CTA
gtaatataattaatataatg

SEQ ID NO: 54361 - DNA, 20 bp, Artificial Sequence
  Description of Artificial Sequence: Synthetic oligonucleotide
  Target: SCN10A; (-) strand; PAM type: YTN; PAM sequence: TTA
tagatgacctagtaatataa

SEQ ID NO: 54362 - DNA, 20 bp, Artificial Sequence
  Description of Artificial Sequence: Synthetic oligonucleotide
  Target: SCN10A; (-) strand; PAM type: YTN; PAM sequence: TTA
aaaagtatgtaaaattatag

SEQ ID NO: 54363 - DNA, 20 bp, Artificial Sequence
  Description of Artificial Sequence: Synthetic oligonucleotide
  Target: SCN10A; (-) strand; PAM type: YTN; PAM sequence: TTA
gccaataacagatcaaatgt

SEQ ID NO: 54364 - DNA, 20 bp, Artificial Sequence
  Description of Artificial Sequence: Synthetic oligonucleotide
  Target: SCN10A; (-) strand; PAM type: YTN; PAM sequence: TTT
agccaataacagatcaaatg

SEQ ID NO: 54365 - DNA, 20 bp, Artificial Sequence
  Description of Artificial Sequence: Synthetic oligonucleotide
  Target: SCN10A; (-) strand; PAM type: YTN; PAM sequence: TTT
tagccaataacagatcaaat

SEQ ID NO: 54366 - DNA, 20 bp, Artificial Sequence
  Description of Artificial Sequence: Synthetic oligonucleotide
  Target: SCN10A; (-) strand; PAM type: YTN; PAM sequence: TTA
attttagccaataacagatc

SEQ ID NO: 54367 - DNA, 20 bp, Artificial Sequence
  Description of Artificial Sequence: Synthetic oligonucleotide
  Target: SCN10A; (-) strand; PAM type: YTN; PAM sequence: TTC
aattaattttagccaataac

SEQ ID NO: 54368 - DNA, 20 bp, Artificial Sequence
  Description of Artificial Sequence: Synthetic oligonucleotide
  Target: SCN10A; (-) strand; PAM type: YTN; PAM sequence: TTT
caattaattttagccaataa

SEQ ID NO: 54369 - DNA, 20 bp, Artificial Sequence
  Description of Artificial Sequence: Synthetic oligonucleotide
  Target: SCN10A; (-) strand; PAM type: YTN; PAM sequence: TTT
tcaattaattttagccaata

SEQ ID NO: 54370 - DNA, 20 bp, Artificial Sequence
  Description of Artificial Sequence: Synthetic oligonucleotide
  Target: SCN10A; (-) strand; PAM type: YTN; PAM sequence: TTG
taggaatagaaattttcaat

SEQ ID NO: 54371 - DNA, 20 bp, Artificial Sequence
  Description of Artificial Sequence: Synthetic oligonucleotide
  Target: SCN10A; (-) strand; PAM type: YTN; PAM sequence: TTA
gagtaggaggataaataaaa

SEQ ID NO: 54372 - DNA, 20 bp, Artificial Sequence
  Description of Artificial Sequence: Synthetic oligonucleotide
  Target: SCN10A; (-) strand; PAM type: YTN; PAM sequence: TTA
ttagagtaggaggataaata

SEQ ID NO: 54373 - DNA, 20 bp, Artificial Sequence
  Description of Artificial Sequence: Synthetic oligonucleotide
  Target: SCN10A; (-) strand; PAM type: YTN; PAM sequence: TTA
taaatcagaaattattagag

SEQ ID NO: 54374 - DNA, 20 bp, Artificial Sequence
  Description of Artificial Sequence: Synthetic oligonucleotide
  Target: SCN10A; (-) strand; PAM type: YTN; PAM sequence: TTT
ataaatcagaaattattaga

SEQ ID NO: 54375 - DNA, 20 bp, Artificial Sequence
  Description of Artificial Sequence: Synthetic oligonucleotide
  Target: SCN10A; (-) strand; PAM type: YTN; PAM sequence: TTG
caacaaataagatggcaaca

SEQ ID NO: 54376 - DNA, 20 bp, Artificial Sequence
  Description of Artificial Sequence: Synthetic oligonucleotide
  Target: SCN10A; (-) strand; PAM type: YTN; PAM sequence: TTT
gcaacaaataagatggcaac

SEQ ID NO: 54377 - DNA, 20 bp, Artificial Sequence
  Description of Artificial Sequence: Synthetic oligonucleotide
  Target: SCN10A; (-) strand; PAM type: YTN; PAM sequence: CTT
tgcaacaaataagatggcaa

SEQ ID NO: 54378 - DNA, 20 bp, Artificial Sequence
  Description of Artificial Sequence: Synthetic oligonucleotide
  Target: SCN10A; (-) strand; PAM type: YTN; PAM sequence: CTA
tatctttgcaacaaataaga

SEQ ID NO: 54379 - DNA, 20 bp, Artificial Sequence
  Description of Artificial Sequence: Synthetic oligonucleotide
  Target: SCN10A; (-) strand; PAM type: YTN; PAM sequence: TTA
aagacgatagtaatctatat

SEQ ID NO: 54380 - DNA, 20 bp, Artificial Sequence
  Description of Artificial Sequence: Synthetic oligonucleotide
  Target: SCN10A; (-) strand; PAM type: YTN; PAM sequence: TTA
atattaaagacgatagtaat

SEQ ID NO: 54381 - DNA, 20 bp, Artificial Sequence
  Description of Artificial Sequence: Synthetic oligonucleotide
  Target: SCN10A; (-) strand; PAM type: YTN; PAM sequence: TTG
cacagacatattaatattaa

SEQ ID NO: 54382 - DNA, 20 bp, Artificial Sequence
  Description of Artificial Sequence: Synthetic oligonucleotide
  Target: SCN10A; (-) strand; PAM type: YTN; PAM sequence: CTC
ggtcaaaaagcatgaaatag

SEQ ID NO: 54383 - DNA, 20 bp, Artificial Sequence
  Description of Artificial Sequence: Synthetic oligonucleotide
  Target: SCN10A; (-) strand; PAM type: YTN; PAM sequence: TTA
atatcagagaaagtggaatc

SEQ ID NO: 54384 - DNA, 20 bp, Artificial Sequence
  Description of Artificial Sequence: Synthetic oligonucleotide
  Target: SCN10A; (-) strand; PAM type: YTN; PAM sequence: TTT
aatatcagagaaagtggaat

SEQ ID NO: 54385 - DNA, 20 bp, Artificial Sequence
  Description of Artificial Sequence: Synthetic oligonucleotide
  Target: SCN10A; (-) strand; PAM type: YTN; PAM sequence: TTT
taatatcagagaaagtggaa

SEQ ID NO: 54386 - DNA, 20 bp, Artificial Sequence
  Description of Artificial Sequence: Synthetic oligonucleotide
  Target: SCN10A; (-) strand; PAM type: YTN; PAM sequence: TTC
aaaagacataagcaaaggca

SEQ ID NO: 54387 - DNA, 20 bp, Artificial Sequence
  Description of Artificial Sequence: Synthetic oligonucleotide
  Target: SCN10A; (-) strand; PAM type: YTN; PAM sequence: TTA
tagaattcaaaagacataag

SEQ ID NO: 54388 - DNA, 20 bp, Artificial Sequence
  Description of Artificial Sequence: Synthetic oligonucleotide
  Target: SCN10A; (-) strand; PAM type: YTN; PAM sequence: CTA
aaattatagaattcaaaaga

SEQ ID NO: 54389 - DNA, 20 bp, Artificial Sequence
  Description of Artificial Sequence: Synthetic oligonucleotide
  Target: SCN10A; (-) strand; PAM type: YTN; PAM sequence: CTC
acggtgatacagaaaggcta

SEQ ID NO: 54390 - DNA, 20 bp, Artificial Sequence
  Description of Artificial Sequence: Synthetic oligonucleotide
  Target: SCN10A; (-) strand; PAM type: YTN; PAM sequence: CTC
ctcacggtgatacagaaagg

SEQ ID NO: 54391 - DNA, 20 bp, Artificial Sequence
  Description of Artificial Sequence: Synthetic oligonucleotide
  Target: SCN10A; (-) strand; PAM type: YTN; PAM sequence: TTG
aataaaaaaaatactcctca

SEQ ID NO: 54392 - DNA, 20 bp, Artificial Sequence
  Description of Artificial Sequence: Synthetic oligonucleotide
  Target: SCN10A; (-) strand; PAM type: YTN; PAM sequence: CTA
tgttgaataaaaaaaatact

SEQ ID NO: 54393 - DNA, 20 bp, Artificial Sequence
  Description of Artificial Sequence: Synthetic oligonucleotide
  Target: SCN10A; (-) strand; PAM type: YTN; PAM sequence: CTC
tatgttgaataaaaaaaata

SEQ ID NO: 54394 - DNA, 20 bp, Artificial Sequence
  Description of Artificial Sequence: Synthetic oligonucleotide
  Target: SCN10A; (-) strand; PAM type: YTN; PAM sequence: TTA
caaagcaatacccaactcta

SEQ ID NO: 54395 - DNA, 20 bp, Artificial Sequence
  Description of Artificial Sequence: Synthetic oligonucleotide
  Target: SCN10A; (-) strand; PAM type: YTN; PAM sequence: TTA
cattacaaagcaatacccaa

SEQ ID NO: 54396 - DNA, 20 bp, Artificial Sequence
  Description of Artificial Sequence: Synthetic oligonucleotide
  Target: SCN10A; (-) strand; PAM type: YTN; PAM sequence: CTA
ttacattacaaagcaatacc

SEQ ID NO: 54397 - DNA, 20 bp, Artificial Sequence
  Description of Artificial Sequence: Synthetic oligonucleotide
  Target: SCN10A; (-) strand; PAM type: YTN; PAM sequence: TTA
aaaatgcctattacattaca

SEQ ID NO: 54398 - DNA, 20 bp, Artificial Sequence
  Description of Artificial Sequence: Synthetic oligonucleotide
  Target: SCN10A; (-) strand; PAM type: YTN; PAM sequence: TTT
aaaaatgcctattacattac

SEQ ID NO: 54399 - DNA, 20 bp, Artificial Sequence
  Description of Artificial Sequence: Synthetic oligonucleotide
  Target: SCN10A; (-) strand; PAM type: YTN; PAM sequence: TTT
taaaaatgcctattacatta

SEQ ID NO: 54400 - DNA, 20 bp, Artificial Sequence
  Description of Artificial Sequence: Synthetic oligonucleotide
  Target: SCN10A; (-) strand; PAM type: YTN; PAM sequence: TTT
ttaaaaatgcctattacatt

SEQ ID NO: 54401 - DNA, 20 bp, Artificial Sequence
  Description of Artificial Sequence: Synthetic oligonucleotide
  Target: SCN10A; (-) strand; PAM type: YTN; PAM sequence: CTA
tttttaaaaatgcctattac

SEQ ID NO: 54402 - DNA, 20 bp, Artificial Sequence
  Description of Artificial Sequence: Synthetic oligonucleotide
  Target: SCN10A; (-) strand; PAM type: YTN; PAM sequence: CTC
acctatttttaaaaatgcct

SEQ ID NO: 54403 - DNA, 20 bp, Artificial Sequence
  Description of Artificial Sequence: Synthetic oligonucleotide
  Target: SCN10A; (-) strand; PAM type: YTN; PAM sequence: TTA
ctcacctatttttaaaaatg

SEQ ID NO: 54404 - DNA, 20 bp, Artificial Sequence
  Description of Artificial Sequence: Synthetic oligonucleotide
  Target: SCN10A; (-) strand; PAM type: YTN; PAM sequence: TTT
actcacctatttttaaaaat

SEQ ID NO: 54405 - DNA, 20 bp, Artificial Sequence
  Description of Artificial Sequence: Synthetic oligonucleotide
  Target: SCN10A; (-) strand; PAM type: YTN; PAM sequence: TTT
tactcacctatttttaaaaa

SEQ ID NO: 54406 - DNA, 20 bp, Artificial Sequence
  Description of Artificial Sequence: Synthetic oligonucleotide
  Target: SCN10A; (-) strand; PAM type: YTN; PAM sequence: CTA
aatataaatggattttactc

SEQ ID NO: 54407 - DNA, 20 bp, Artificial Sequence
  Description of Artificial Sequence: Synthetic oligonucleotide
  Target: SCN10A; (-) strand; PAM type: YTN; PAM sequence: CTG
tcatgtcactaaatataaat

SEQ ID NO: 54408 - DNA, 20 bp, Artificial Sequence
  Description of Artificial Sequence: Synthetic oligonucleotide
  Target: SCN10A; (-) strand; PAM type: YTN; PAM sequence: CTA
agcaaatctgtcatgtcact

SEQ ID NO: 54409 - DNA, 20 bp, Artificial Sequence
  Description of Artificial Sequence: Synthetic oligonucleotide
  Target: SCN10A; (-) strand; PAM type: YTN; PAM sequence: CTA
agactaagcaaatctgtcat

SEQ ID NO: 54410 - DNA, 20 bp, Artificial Sequence
  Description of Artificial Sequence: Synthetic oligonucleotide
  Target: SCN10A; (-) strand; PAM type: YTN; PAM sequence: CTA
aatacgtcatatgaaataat

SEQ ID NO: 54411 - DNA, 20 bp, Artificial Sequence
  Description of Artificial Sequence: Synthetic oligonucleotide
  Target: SCN10A; (-) strand; PAM type: YTN; PAM sequence: TTA
aaaactaaatacgtcatatg

SEQ ID NO: 54412 - DNA, 20 bp, Artificial Sequence
  Description of Artificial Sequence: Synthetic oligonucleotide
  Target: SCN10A; (-) strand; PAM type: YTN; PAM sequence: TTT
aaaaactaaatacgtcatat

SEQ ID NO: 54413 - DNA, 20 bp, Artificial Sequence
  Description of Artificial Sequence: Synthetic oligonucleotide
  Target: SCN10A; (-) strand; PAM type: YTN; PAM sequence: TTT
taaaaactaaatacgtcata

SEQ ID NO: 54414 - DNA, 20 bp, Artificial Sequence
  Description of Artificial Sequence: Synthetic oligonucleotide
  Target: SCN10A; (-) strand; PAM type: YTN; PAM sequence: CTA
atattttaaaaactaaatac

SEQ ID NO: 54415 - DNA, 20 bp, Artificial Sequence
  Description of Artificial Sequence: Synthetic oligonucleotide
  Target: SCN10A; (-) strand; PAM type: YTN; PAM sequence: TTG
taccaacctaatattttaaa

SEQ ID NO: 54416 - DNA, 20 bp, Artificial Sequence
  Description of Artificial Sequence: Synthetic oligonucleotide
  Target: SCN10A; (-) strand; PAM type: YTN; PAM sequence: TTT
gtaccaacctaatattttaa

SEQ ID NO: 54417 - DNA, 20 bp, Artificial Sequence
  Description of Artificial Sequence: Synthetic oligonucleotide
  Target: SCN10A; (-) strand; PAM type: YTN; PAM sequence: TTT
tgtaccaacctaatatttta

SEQ ID NO: 54418 - DNA, 20 bp, Artificial Sequence
  Description of Artificial Sequence: Synthetic oligonucleotide
  Target: SCN10A; (-) strand; PAM type: YTN; PAM sequence: CTT
ttgtaccaacctaatatttt

SEQ ID NO: 54419 - DNA, 20 bp, Artificial Sequence
  Description of Artificial Sequence: Synthetic oligonucleotide
  Target: SCN10A; (-) strand; PAM type: YTN; PAM sequence: TTA
cttttgtaccaacctaatat

SEQ ID NO: 54420 - DNA, 20 bp, Artificial Sequence
  Description of Artificial Sequence: Synthetic oligonucleotide
  Target: SCN10A; (-) strand; PAM type: YTN; PAM sequence: TTC
aacaatgcaaaaaccacaat

SEQ ID NO: 54421 - DNA, 20 bp, Artificial Sequence
  Description of Artificial Sequence: Synthetic oligonucleotide
  Target: SCN10A; (-) strand; PAM type: YTN; PAM sequence: TTT
caacaatgcaaaaaccacaa

SEQ ID NO: 54422 - DNA, 20 bp, Artificial Sequence
  Description of Artificial Sequence: Synthetic oligonucleotide
  Target: SCN10A; (-) strand; PAM type: YTN; PAM sequence: TTC
caatatcaaacggcaaattt

SEQ ID NO: 54423 - DNA, 20 bp, Artificial Sequence
  Description of Artificial Sequence: Synthetic oligonucleotide
  Target: SCN10A; (-) strand; PAM type: YTN; PAM sequence: TTA
agaatgtattccaatatcaa

SEQ ID NO: 54424 - DNA, 20 bp, Artificial Sequence
  Description of Artificial Sequence: Synthetic oligonucleotide
  Target: SCN10A; (-) strand; PAM type: YTN; PAM sequence: TTT
aagaatgtattccaatatca

SEQ ID NO: 54425 - DNA, 20 bp, Artificial Sequence
  Description of Artificial Sequence: Synthetic oligonucleotide
  Target: SCN10A; (-) strand; PAM type: YTN; PAM sequence: TTA
tttaagaatgtattccaata

SEQ ID NO: 54426 - DNA, 20 bp, Artificial Sequence
  Description of Artificial Sequence: Synthetic oligonucleotide
  Target: SCN10A; (-) strand; PAM type: YTN; PAM sequence: TTT
atttaagaatgtattccaat

SEQ ID NO: 54427 - DNA, 20 bp, Artificial Sequence
  Description of Artificial Sequence: Synthetic oligonucleotide
  Target: SCN10A; (-) strand; PAM type: YTN; PAM sequence: TTA
aaatgatgtataacatggtc

SEQ ID NO: 54428 - DNA, 20 bp, Artificial Sequence
  Description of Artificial Sequence: Synthetic oligonucleotide
  Target: SCN10A; (-) strand; PAM type: YTN; PAM sequence: TTA
gcaaaaaaaaaagtgagaaa

SEQ ID NO: 54429 - DNA, 20 bp, Artificial Sequence
  Description of Artificial Sequence: Synthetic oligonucleotide
  Target: SCN10A; (-) strand; PAM type: YTN; PAM sequence: CTA
aaataaatataaaataaaca

SEQ ID NO: 54430 - DNA, 20 bp, Artificial Sequence
  Description of Artificial Sequence: Synthetic oligonucleotide
  Target: SCN10A; (-) strand; PAM type: YTN; PAM sequence: TTC
catagtctaaaataaatata

SEQ ID NO: 54431 - DNA, 20 bp, Artificial Sequence
  Description of Artificial Sequence: Synthetic oligonucleotide
  Target: SCN10A; (-) strand; PAM type: YTN; PAM sequence: TTT
ccatagtctaaaataaatat

SEQ ID NO: 54432 - DNA, 20 bp, Artificial Sequence
  Description of Artificial Sequence: Synthetic oligonucleotide
  Target: SCN10A; (-) strand; PAM type: YTN; PAM sequence: TTG
tataacataatttccatagt

SEQ ID NO: 54433 - DNA, 20 bp, Artificial Sequence
  Description of Artificial Sequence: Synthetic oligonucleotide
  Target: SCN10A; (-) strand; PAM type: YTN; PAM sequence: TTT
gtataacataatttccatag

SEQ ID NO: 54434 - DNA, 20 bp, Artificial Sequence
  Description of Artificial Sequence: Synthetic oligonucleotide
  Target: SCN10A; (-) strand; PAM type: YTN; PAM sequence: TTT
tgtataacataatttccata

SEQ ID NO: 54435 - DNA, 20 bp, Artificial Sequence
  Description of Artificial Sequence: Synthetic oligonucleotide
  Target: SCN10A; (-) strand; PAM type: YTN; PAM sequence: TTT
ttgtataacataatttccat

SEQ ID NO: 54436 - DNA, 20 bp, Artificial Sequence
  Description of Artificial Sequence: Synthetic oligonucleotide
  Target: SCN10A; (-) strand; PAM type: YTN; PAM sequence: CTT
tttgtataacataatttcca

SEQ ID NO: 54437 - DNA, 20 bp, Artificial Sequence
  Description of Artificial Sequence: Synthetic oligonucleotide
  Target: SCN10A; (-) strand; PAM type: YTN; PAM sequence: TTG
ctttttgtataacataattt

SEQ ID NO: 54438 - DNA, 20 bp, Artificial Sequence
  Description of Artificial Sequence: Synthetic oligonucleotide
  Target: SCN10A; (-) strand; PAM type: YTN; PAM sequence: TTT
gctttttgtataacataatt

SEQ ID NO: 54439 - DNA, 20 bp, Artificial Sequence
  Description of Artificial Sequence: Synthetic oligonucleotide
  Target: SCN10A; (-) strand; PAM type: YTN; PAM sequence: CTC
gaatttgctttttgtataac

SEQ ID NO: 54440 - DNA, 20 bp, Artificial Sequence
  Description of Artificial Sequence: Synthetic oligonucleotide
  Target: SCN10A; (-) strand; PAM type: YTN; PAM sequence: CTC
aaataagaaaatcgctcgaa

SEQ ID NO: 54441 - DNA, 20 bp, Artificial Sequence
  Description of Artificial Sequence: Synthetic oligonucleotide
  Target: SCN10A; (-) strand; PAM type: YTN; PAM sequence: TTG
aactcaaataagaaaatcgc

SEQ ID NO: 54442 - DNA, 20 bp, Artificial Sequence
  Description of Artificial Sequence: Synthetic oligonucleotide
  Target: SCN10A; (-) strand; PAM type: YTN; PAM sequence: TTT
gaactcaaataagaaaatcg

SEQ ID NO: 54443 - DNA, 20 bp, Artificial Sequence
  Description of Artificial Sequence: Synthetic oligonucleotide
  Target: SCN10A; (-) strand; PAM type: YTN; PAM sequence: TTT
tgaactcaaataagaaaatc

SEQ ID NO: 54444 - DNA, 20 bp, Artificial Sequence
  Description of Artificial Sequence: Synthetic oligonucleotide
  Target: SCN10A; (-) strand; PAM type: YTN; PAM sequence: TTA
caacccattttgaactcaaa

SEQ ID NO: 54445 - DNA, 20 bp, Artificial Sequence
  Description of Artificial Sequence: Synthetic oligonucleotide
  Target: SCN10A; (-) strand; PAM type: YTN; PAM sequence: TTT
acaacccattttgaactcaa

SEQ ID NO: 54446 - DNA, 20 bp, Artificial Sequence
  Description of Artificial Sequence: Synthetic oligonucleotide
  Target: SCN10A; (-) strand; PAM type: YTN; PAM sequence: CTT
tacaacccattttgaactca

SEQ ID NO: 54447 - DNA, 20 bp, Artificial Sequence
  Description of Artificial Sequence: Synthetic oligonucleotide
  Target: SCN10A; (-) strand; PAM type: YTN; PAM sequence: CTG
ctttacaacccattttgaac

SEQ ID NO: 54448 - DNA, 20 bp, Artificial Sequence
  Description of Artificial Sequence: Synthetic oligonucleotide
  Target: SCN10A; (-) strand; PAM type: YTN; PAM sequence: CTG
ctgctttacaacccattttg

SEQ ID NO: 54449 - DNA, 20 bp, Artificial Sequence
  Description of Artificial Sequence: Synthetic oligonucleotide
  Target: SCN10A; (-) strand; PAM type: YTN; PAM sequence: CTC
tgctgctttacaacccattt

SEQ ID NO: 54450 - DNA, 20 bp, Artificial Sequence
  Description of Artificial Sequence: Synthetic oligonucleotide
  Target: SCN10A; (-) strand; PAM type: YTN; PAM sequence: TTG
tctctgctgctttacaaccc

SEQ ID NO: 54451 - DNA, 20 bp, Artificial Sequence
  Description of Artificial Sequence: Synthetic oligonucleotide
  Target: SCN10A; (-) strand; PAM type: YTN; PAM sequence: TTG
agttgtctctgctgctttac

SEQ ID NO: 54452 - DNA, 20 bp, Artificial Sequence
  Description of Artificial Sequence: Synthetic oligonucleotide
  Target: SCN10A; (-) strand; PAM type: YTN; PAM sequence: TTG
atgttgagttgtctctgctg

SEQ ID NO: 54453 - DNA, 20 bp, Artificial Sequence
  Description of Artificial Sequence: Synthetic oligonucleotide
  Target: SCN10A; (-) strand; PAM type: YTN; PAM sequence: TTG
ttgatgttgagttgtctctg

SEQ ID NO: 54454 - DNA, 20 bp, Artificial Sequence
  Description of Artificial Sequence: Synthetic oligonucleotide
  Target: SCN10A; (-) strand; PAM type: YTN; PAM sequence: CTG
ggccaaatgcgttgttgatg

SEQ ID NO: 54455 - DNA, 20 bp, Artificial Sequence
  Description of Artificial Sequence: Synthetic oligonucleotide
  Target: SCN10A; (-) strand; PAM type: YTN; PAM sequence: TTA
gcaatccctgggccaaatgc

SEQ ID NO: 54456 - DNA, 20 bp, Artificial Sequence
  Description of Artificial Sequence: Synthetic oligonucleotide
  Target: SCN10A; (-) strand; PAM type: YTN; PAM sequence: TTG
ttagcaatccctgggccaaa

SEQ ID NO: 54457 - DNA, 20 bp, Artificial Sequence
  Description of Artificial Sequence: Synthetic oligonucleotide
  Target: SCN10A; (-) strand; PAM type: YTN; PAM sequence: TTT
gttagcaatccctgggccaa

SEQ ID NO: 54458 - DNA, 20 bp, Artificial Sequence
  Description of Artificial Sequence: Synthetic oligonucleotide
  Target: SCN10A; (-) strand; PAM type: YTN; PAM sequence: CTT
tgttagcaatccctgggcca

SEQ ID NO: 54459 - DNA, 20 bp, Artificial Sequence
  Description of Artificial Sequence: Synthetic oligonucleotide
  Target: SCN10A; (-) strand; PAM type: YTN; PAM sequence: CTG
tacctttgttagcaatccct

SEQ ID NO: 54460 - DNA, 20 bp, Artificial Sequence
  Description of Artificial Sequence: Synthetic oligonucleotide
  Target: SCN10A; (-) strand; PAM type: YTN; PAM sequence: CTG
cactgtacctttgttagcaa

SEQ ID NO: 54461 - DNA, 20 bp, Artificial Sequence
  Description of Artificial Sequence: Synthetic oligonucleotide
  Target: SCN10A; (-) strand; PAM type: YTN; PAM sequence: TTG
aaccaccactgcactgtacc

SEQ ID NO: 54462 - DNA, 20 bp, Artificial Sequence
  Description of Artificial Sequence: Synthetic oligonucleotide
  Target: SCN10A; (-) strand; PAM type: YTN; PAM sequence: CTT
gaaccaccactgcactgtac

SEQ ID NO: 54463 - DNA, 20 bp, Artificial Sequence
  Description of Artificial Sequence: Synthetic oligonucleotide
  Target: SCN10A; (-) strand; PAM type: YTN; PAM sequence: TTC
ttgaaccaccactgcactgt

SEQ ID NO: 54464 - DNA, 20 bp, Artificial Sequence
  Description of Artificial Sequence: Synthetic oligonucleotide
  Target: SCN10A; (-) strand; PAM type: YTN; PAM sequence: CTT
cttgaaccaccactgcactg

SEQ ID NO: 54465 - DNA, 20 bp, Artificial Sequence
  Description of Artificial Sequence: Synthetic oligonucleotide
  Target: SCN10A; (-) strand; PAM type: YTN; PAM sequence: TTG
caaaacttcttgaaccacca

SEQ ID NO: 54466 - DNA, 20 bp, Artificial Sequence
  Description of Artificial Sequence: Synthetic oligonucleotide
  Target: SCN10A; (-) strand; PAM type: YTN; PAM sequence: TTT
gcaaaacttcttgaaccacc

SEQ ID NO: 54467 - DNA, 20 bp, Artificial Sequence
  Description of Artificial Sequence: Synthetic oligonucleotide
  Target: SCN10A; (-) strand; PAM type: YTN; PAM sequence: CTT
tgcaaaacttcttgaaccac

SEQ ID NO: 54468 - DNA, 20 bp, Artificial Sequence
  Description of Artificial Sequence: Synthetic oligonucleotide
  Target: SCN10A; (-) strand; PAM type: YTN; PAM sequence: CTC
ctttgcaaaacttcttgaac

SEQ ID NO: 54469 - DNA, 20 bp, Artificial Sequence
  Description of Artificial Sequence: Synthetic oligonucleotide
  Target: SCN10A; (-) strand; PAM type: YTN; PAM sequence: CTC
atctcctttgcaaaacttct

SEQ ID NO: 54470 - DNA, 20 bp, Artificial Sequence
  Description of Artificial Sequence: Synthetic oligonucleotide
  Target: SCN10A; (-) strand; PAM type: YTN; PAM sequence: TTC
tcatctcctttgcaaaactt

SEQ ID NO: 54471 - DNA, 20 bp, Artificial Sequence
  Description of Artificial Sequence: Synthetic oligonucleotide
  Target: SCN10A; (-) strand; PAM type: YTN; PAM sequence: TTC
aaggttctcatctcctttgc

SEQ ID NO: 54472 - DNA, 20 bp, Artificial Sequence
  Description of Artificial Sequence: Synthetic oligonucleotide
  Target: SCN10A; (-) strand; PAM type: YTN; PAM sequence: CTT
caaggttctcatctcctttg

SEQ ID NO: 54473 - DNA, 20 bp, Artificial Sequence
  Description of Artificial Sequence: Synthetic oligonucleotide
  Target: SCN10A; (-) strand; PAM type: YTN; PAM sequence: CTC
atcttcaaggttctcatctc

SEQ ID NO: 54474 - DNA, 20 bp, Artificial Sequence
  Description of Artificial Sequence: Synthetic oligonucleotide
  Target: SCN10A; (-) strand; PAM type: YTN; PAM sequence: CTC
ctcatcttcaaggttctcat

SEQ ID NO: 54475 - DNA, 20 bp, Artificial Sequence
  Description of Artificial Sequence: Synthetic oligonucleotide
  Target: SCN10A; (-) strand; PAM type: YTN; PAM sequence: CTC
tcctcatcttcaaggttctc

SEQ ID NO: 54476 - DNA, 20 bp, Artificial Sequence
  Description of Artificial Sequence: Synthetic oligonucleotide
  Target: SCN10A; (-) strand; PAM type: YTN; PAM sequence: CTA
ctctcctcatcttcaaggtt

SEQ ID NO: 54477 - DNA, 20 bp, Artificial Sequence
  Description of Artificial Sequence: Synthetic oligonucleotide
  Target: SCN10A; (-) strand; PAM type: YTN; PAM sequence: TTC
caatggccagccactactct

SEQ ID NO: 54478 - DNA, 20 bp, Artificial Sequence
  Description of Artificial Sequence: Synthetic oligonucleotide
  Target: SCN10A; (-) strand; PAM type: YTN; PAM sequence: CTT
ccaatggccagccactactc

SEQ ID NO: 54479 - DNA, 20 bp, Artificial Sequence
  Description of Artificial Sequence: Synthetic oligonucleotide
  Target: SCN10A; (-) strand; PAM type: YTN; PAM sequence: TTG
tcaacttccaatggccagcc

SEQ ID NO: 54480 - DNA, 20 bp, Artificial Sequence
  Description of Artificial Sequence: Synthetic oligonucleotide
  Target: SCN10A; (-) strand; PAM type: YTN; PAM sequence: TTG
gtcattgtcaacttccaatg

SEQ ID NO: 54481 - DNA, 20 bp, Artificial Sequence
  Description of Artificial Sequence: Synthetic oligonucleotide
  Target: SCN10A; (-) strand; PAM type: YTN; PAM sequence: CTC
aattggtcattgtcaacttc

SEQ ID NO: 54482 - DNA, 20 bp, Artificial Sequence
  Description of Artificial Sequence: Synthetic oligonucleotide
  Target: SCN10A; (-) strand; PAM type: YTN; PAM sequence: CTC
tcaattggtcattgtcaact

SEQ ID NO: 54483 - DNA, 20 bp, Artificial Sequence
  Description of Artificial Sequence: Synthetic oligonucleotide
  Target: SCN10A; (-) strand; PAM type: YTN; PAM sequence: TTG
ctctcaattggtcattgtca

SEQ ID NO: 54484 - DNA, 20 bp, Artificial Sequence
  Description of Artificial Sequence: Synthetic oligonucleotide
  Target: SCN10A; (-) strand; PAM type: YTN; PAM sequence: TTC
gatgattgctctcaattggt

SEQ ID NO: 54485 - DNA, 20 bp, Artificial Sequence
  Description of Artificial Sequence: Synthetic oligonucleotide
  Target: SCN10A; (-) strand; PAM type: YTN; PAM sequence: CTT
cgatgattgctctcaattgg

SEQ ID NO: 54486 - DNA, 20 bp, Artificial Sequence
  Description of Artificial Sequence: Synthetic oligonucleotide
  Target: SCN10A; (-) strand; PAM type: YTN; PAM sequence: TTG
taagaggatcaacttcgatg

SEQ ID NO: 54487 - DNA, 20 bp, Artificial Sequence
  Description of Artificial Sequence: Synthetic oligonucleotide
  Target: SCN10A; (-) strand; PAM type: YTN; PAM sequence: TTG
tgcagttgtaagaggatcaa

SEQ ID NO: 54488 - DNA, 20 bp, Artificial Sequence
  Description of Artificial Sequence: Synthetic oligonucleotide
  Target: SCN10A; (-) strand; PAM type: YTN; PAM sequence: CTT
gtgcagttgtaagaggatca

SEQ ID NO: 54489 - DNA, 20 bp, Artificial Sequence
  Description of Artificial Sequence: Synthetic oligonucleotide
  Target: SCN10A; (-) strand; PAM type: YTN; PAM sequence: TTC
ttgtgcagttgtaagaggat

SEQ ID NO: 54490 - DNA, 20 bp, Artificial Sequence
  Description of Artificial Sequence: Synthetic oligonucleotide
  Target: SCN10A; (-) strand; PAM type: YTN; PAM sequence: CTT
cttgtgcagttgtaagagga

SEQ ID NO: 54491 - DNA, 20 bp, Artificial Sequence
  Description of Artificial Sequence: Synthetic oligonucleotide
  Target: SCN10A; (-) strand; PAM type: YTN; PAM sequence: CTC
agcttcttgtgcagttgtaa

SEQ ID NO: 54492 - DNA, 20 bp, Artificial Sequence
  Description of Artificial Sequence: Synthetic oligonucleotide
  Target: SCN10A; (-) strand; PAM type: YTN; PAM sequence: TTC
ctcagcttcttgtgcagttg

SEQ ID NO: 54493 - DNA, 20 bp, Artificial Sequence
  Description of Artificial Sequence: Synthetic oligonucleotide
  Target: SCN10A; (-) strand; PAM type: YTN; PAM sequence: CTT
cctcagcttcttgtgcagtt

SEQ ID NO: 54494 - DNA, 20 bp, Artificial Sequence
  Description of Artificial Sequence: Synthetic oligonucleotide
  Target: SCN10A; (-) strand; PAM type: YTN; PAM sequence: TTC
ttcctcagcttcttgtgcag

SEQ ID NO: 54495 - DNA, 20 bp, Artificial Sequence
  Description of Artificial Sequence: Synthetic oligonucleotide
  Target: SCN10A; (-) strand; PAM type: YTN; PAM sequence: CTG
ccgaatgaccgtagaatggt

SEQ ID NO: 54496 - DNA, 20 bp, Artificial Sequence
  Description of Artificial Sequence: Synthetic oligonucleotide
  Target: SCN10A; (-) strand; PAM type: YTN; PAM sequence: TTC
aactgccgaatgaccgtaga

SEQ ID NO: 54497 - DNA, 20 bp, Artificial Sequence
  Description of Artificial Sequence: Synthetic oligonucleotide
  Target: SCN10A; (-) strand; PAM type: YTN; PAM sequence: CTT
caactgccgaatgaccgtag

SEQ ID NO: 54498 - DNA, 20 bp, Artificial Sequence
  Description of Artificial Sequence: Synthetic oligonucleotide
  Target: SCN10A; (-) strand; PAM type: YTN; PAM sequence: TTG
cttcaactgccgaatgaccg

SEQ ID NO: 54499 - DNA, 20 bp, Artificial Sequence
  Description of Artificial Sequence: Synthetic oligonucleotide
  Target: SCN10A; (-) strand; PAM type: YTN; PAM sequence: TTT
gcttcaactgccgaatgacc

SEQ ID NO: 54500 - DNA, 20 bp, Artificial Sequence
  Description of Artificial Sequence: Synthetic oligonucleotide
  Target: SCN10A; (-) strand; PAM type: YTN; PAM sequence: TTC
caatttgcttcaactgccga

SEQ ID NO: 54501 - DNA, 20 bp, Artificial Sequence
  Description of Artificial Sequence: Synthetic oligonucleotide
  Target: SCN10A; (-) strand; PAM type: YTN; PAM sequence: TTT
ccaatttgcttcaactgccg

SEQ ID NO: 54502 - DNA, 20 bp, Artificial Sequence
  Description of Artificial Sequence: Synthetic oligonucleotide
  Target: SCN10A; (-) strand; PAM type: YTN; PAM sequence: CTT
tccaatttgcttcaactgcc

SEQ ID NO: 54503 - DNA, 20 bp, Artificial Sequence
  Description of Artificial Sequence: Synthetic oligonucleotide
  Target: SCN10A; (-) strand; PAM type: YTN; PAM sequence: TTC
acctttccaatttgcttcaa

SEQ ID NO: 54504 - DNA, 20 bp, Artificial Sequence
  Description of Artificial Sequence: Synthetic oligonucleotide
  Target: SCN10A; (-) strand; PAM type: YTN; PAM sequence: TTT
cacctttccaatttgcttca

SEQ ID NO: 54505 - DNA, 20 bp, Artificial Sequence
  Description of Artificial Sequence: Synthetic oligonucleotide
  Target: SCN10A; (-) strand; PAM type: YTN; PAM sequence: CTG
tttcacctttccaatttgct

SEQ ID NO: 54506 - DNA, 20 bp, Artificial Sequence
  Description of Artificial Sequence: Synthetic oligonucleotide
  Target: SCN10A; (-) strand; PAM type: YTN; PAM sequence: TTA
tggagctgtttcacctttcc

SEQ ID NO: 54507 - DNA, 20 bp, Artificial Sequence
  Description of Artificial Sequence: Synthetic oligonucleotide
  Target: SCN10A; (-) strand; PAM type: YTN; PAM sequence: TTT
atggagctgtttcacctttc

SEQ ID NO: 54508 - DNA, 20 bp, Artificial Sequence
  Description of Artificial Sequence: Synthetic oligonucleotide
  Target: SCN10A; (-) strand; PAM type: YTN; PAM sequence: TTA
tgaggcacccatttatggag

SEQ ID NO: 54509 - DNA, 20 bp, Artificial Sequence
  Description of Artificial Sequence: Synthetic oligonucleotide
  Target: SCN10A; (-) strand; PAM type: YTN; PAM sequence: CTT
atgaggcacccatttatgga

SEQ ID NO: 54510 - DNA, 20 bp, Artificial Sequence
  Description of Artificial Sequence: Synthetic oligonucleotide
  Target: SCN10A; (-) strand; PAM type: YTN; PAM sequence: TTA
gcttatgaggcacccattta

SEQ ID NO: 54511 - DNA, 20 bp, Artificial Sequence
  Description of Artificial Sequence: Synthetic oligonucleotide
  Target: SCN10A; (-) strand; PAM type: YTN; PAM sequence: CTT
agcttatgaggcacccattt

SEQ ID NO: 54512 - DNA, 20 bp, Artificial Sequence
  Description of Artificial Sequence: Synthetic oligonucleotide
  Target: SCN10A; (-) strand; PAM type: YTN; PAM sequence: TTC
cttagcttatgaggcaccca

SEQ ID NO: 54513 - DNA, 20 bp, Artificial Sequence
  Description of Artificial Sequence: Synthetic oligonucleotide
  Target: SCN10A; (-) strand; PAM type: YTN; PAM sequence: TTT
ccttagcttatgaggcaccc

SEQ ID NO: 54514 - DNA, 20 bp, Artificial Sequence
  Description of Artificial Sequence: Synthetic oligonucleotide
  Target: SCN10A; (-) strand; PAM type: YTN; PAM sequence: TTT
tccttagcttatgaggcacc

SEQ ID NO: 54515 - DNA, 20 bp, Artificial Sequence
  Description of Artificial Sequence: Synthetic oligonucleotide
  Target: SCN10A; (-) strand; PAM type: YTN; PAM sequence: TTT
ttccttagcttatgaggcac

SEQ ID NO: 54516 - DNA, 20 bp, Artificial Sequence
  Description of Artificial Sequence: Synthetic oligonucleotide
  Target: SCN10A; (-) strand; PAM type: YTN; PAM sequence: TTA
aacatttttccttagcttat

SEQ ID NO: 54517 - DNA, 20 bp, Artificial Sequence
  Description of Artificial Sequence: Synthetic oligonucleotide
  Target: SCN10A; (-) strand; PAM type: YTN; PAM sequence: TTT
aaacatttttccttagctta

SEQ ID NO: 54518 - DNA, 20 bp, Artificial Sequence
  Description of Artificial Sequence: Synthetic oligonucleotide
  Target: SCN10A; (-) strand; PAM type: YTN; PAM sequence: TTT
taaacatttttccttagctt

SEQ ID NO: 54519 - DNA, 20 bp, Artificial Sequence
  Description of Artificial Sequence: Synthetic oligonucleotide
  Target: SCN10A; (-) strand; PAM type: YTN; PAM sequence: TTT
ttaaacatttttccttagct

SEQ ID NO: 54520 - DNA, 20 bp, Artificial Sequence
  Description of Artificial Sequence: Synthetic oligonucleotide
  Target: SCN10A; (-) strand; PAM type: YTN; PAM sequence: TTT
tttaaacatttttccttagc

SEQ ID NO: 54521 - DNA, 20 bp, Artificial Sequence
  Description of Artificial Sequence: Synthetic oligonucleotide
  Target: SCN10A; (-) strand; PAM type: YTN; PAM sequence: TTC
aaaatgacgattttttaaac

SEQ ID NO: 54522 - DNA, 20 bp, Artificial Sequence
  Description of Artificial Sequence: Synthetic oligonucleotide
  Target: SCN10A; (-) strand; PAM type: YTN; PAM sequence: CTT
caaaatgacgattttttaaa

SEQ ID NO: 54523 - DNA, 20 bp, Artificial Sequence
  Description of Artificial Sequence: Synthetic oligonucleotide
  Target: SCN10A; (-) strand; PAM type: YTN; PAM sequence: TTG
catagaataagagacgacaa

SEQ ID NO: 54524 - DNA, 20 bp, Artificial Sequence
  Description of Artificial Sequence: Synthetic oligonucleotide
  Target: SCN10A; (-) strand; PAM type: YTN; PAM sequence: TTG
ttgcatagaataagagacga

SEQ ID NO: 54525 - DNA, 20 bp, Artificial Sequence
  Description of Artificial Sequence: Synthetic oligonucleotide
  Target: SCN10A; (-) strand; PAM type: YTN; PAM sequence: TTT
gttgcatagaataagagacg

SEQ ID NO: 54526 - DNA, 20 bp, Artificial Sequence
  Description of Artificial Sequence: Synthetic oligonucleotide
  Target: SCN10A; (-) strand; PAM type: YTN; PAM sequence: TTT
tgttgcatagaataagagac

SEQ ID NO: 54527 - DNA, 20 bp, Artificial Sequence
  Description of Artificial Sequence: Synthetic oligonucleotide
  Target: SCN10A; (-) strand; PAM type: YTN; PAM sequence: TTT
ttgttgcatagaataagaga

SEQ ID NO: 54528 - DNA, 20 bp, Artificial Sequence
  Description of Artificial Sequence: Synthetic oligonucleotide
  Target: SCN10A; (-) strand; PAM type: YTN; PAM sequence: TTC
atttttgttgcatagaataa

SEQ ID NO: 54529 - DNA, 20 bp, Artificial Sequence
  Description of Artificial Sequence: Synthetic oligonucleotide
  Target: SCN10A; (-) strand; PAM type: YTN; PAM sequence: TTA
agaaatagttcatttttgtt

SEQ ID NO: 54530 - DNA, 20 bp, Artificial Sequence
  Description of Artificial Sequence: Synthetic oligonucleotide
  Target: SCN10A; (-) strand; PAM type: YTN; PAM sequence: CTG
attaagaaatagttcatttt

SEQ ID NO: 54531 - DNA, 20 bp, Artificial Sequence
  Description of Artificial Sequence: Synthetic oligonucleotide
  Target: SCN10A; (-) strand; PAM type: YTN; PAM sequence: TTA
tcgcacatcacaatctgatt

SEQ ID NO: 54532 - DNA, 20 bp, Artificial Sequence
  Description of Artificial Sequence: Synthetic oligonucleotide
  Target: SCN10A; (-) strand; PAM type: YTN; PAM sequence: TTT
atcgcacatcacaatctgat

SEQ ID NO: 54533 - DNA, 20 bp, Artificial Sequence
  Description of Artificial Sequence: Synthetic oligonucleotide
  Target: SCN10A; (-) strand; PAM type: YTN; PAM sequence: TTT
tatcgcacatcacaatctga

SEQ ID NO: 54534 - DNA, 20 bp, Artificial Sequence
  Description of Artificial Sequence: Synthetic oligonucleotide
  Target: SCN10A; (-) strand; PAM type: YTN; PAM sequence: TTT
ttatcgcacatcacaatctg

SEQ ID NO: 54535 - DNA, 20 bp, Artificial Sequence
  Description of Artificial Sequence: Synthetic oligonucleotide
  Target: SCN10A; (-) strand; PAM type: YTN; PAM sequence: CTT
tttatcgcacatcacaatct

SEQ ID NO: 54536 - DNA, 20 bp, Artificial Sequence
  Description of Artificial Sequence: Synthetic oligonucleotide
  Target: SCN10A; (-) strand; PAM type: YTN; PAM sequence: TTC
actttttatcgcacatcaca

SEQ ID NO: 54537 - DNA, 20 bp, Artificial Sequence
  Description of Artificial Sequence: Synthetic oligonucleotide
  Target: SCN10A; (-) strand; PAM type: YTN; PAM sequence: TTG
tcaagtaaaattcacttttt

SEQ ID NO: 54538 - DNA, 20 bp, Artificial Sequence
  Description of Artificial Sequence: Synthetic oligonucleotide
  Target: SCN10A; (-) strand; PAM type: YTN; PAM sequence: TTG
ccagttgtcaagtaaaattc

SEQ ID NO: 54539 - DNA, 20 bp, Artificial Sequence
  Description of Artificial Sequence: Synthetic oligonucleotide
  Target: SCN10A; (-) strand; PAM type: YTN; PAM sequence: CTG
gtcattgccagttgtcaagt

SEQ ID NO: 54540 - DNA, 20 bp, Artificial Sequence
  Description of Artificial Sequence: Synthetic oligonucleotide
  Target: SCN10A; (-) strand; PAM type: YTN; PAM sequence: CTC
agtccagccaccaagctggt

SEQ ID NO: 54541 - DNA, 20 bp, Artificial Sequence
  Description of Artificial Sequence: Synthetic oligonucleotide
  Target: SCN10A; (-) strand; PAM type: YTN; PAM sequence: TTC
tcagtccagccaccaagctg

SEQ ID NO: 54542 - DNA, 20 bp, Artificial Sequence
  Description of Artificial Sequence: Synthetic oligonucleotide
  Target: SCN10A; (-) strand; PAM type: YTN; PAM sequence: CTT
ctcagtccagccaccaagct

SEQ ID NO: 54543 - DNA, 20 bp, Artificial Sequence
  Description of Artificial Sequence: Synthetic oligonucleotide
  Target: SCN10A; (-) strand; PAM type: YTN; PAM sequence: TTC
ttctcagtccagccaccaag

SEQ ID NO: 54544 - DNA, 20 bp, Artificial Sequence
  Description of Artificial Sequence: Synthetic oligonucleotide
  Target: SCN10A; (-) strand; PAM type: YTN; PAM sequence: CTT
cttctcagtccagccaccaa

SEQ ID NO: 54545 - DNA, 20 bp, Artificial Sequence
  Description of Artificial Sequence: Synthetic oligonucleotide
  Target: SCN10A; (-) strand; PAM type: YTN; PAM sequence: TTG
gagcttcttctcagtccagc

SEQ ID NO: 54546 - DNA, 20 bp, Artificial Sequence
  Description of Artificial Sequence: Synthetic oligonucleotide
  Target: SCN10A; (-) strand; PAM type: YTN; PAM sequence: TTT
ggagcttcttctcagtccag

SEQ ID NO: 54547 - DNA, 20 bp, Artificial Sequence
  Description of Artificial Sequence: Synthetic oligonucleotide
  Target: SCN10A; (-) strand; PAM type: YTN; PAM sequence: CTT
tggagcttcttctcagtcca

SEQ ID NO: 54548 - DNA, 20 bp, Artificial Sequence
  Description of Artificial Sequence: Synthetic oligonucleotide
  Target: SCN10A; (-) strand; PAM type: YTN; PAM sequence: TTG
ggaagtgctttggagcttct

SEQ ID NO: 54549 - DNA, 20 bp, Artificial Sequence
  Description of Artificial Sequence: Synthetic oligonucleotide
  Target: SCN10A; (-) strand; PAM type: YTN; PAM sequence: TTT
gggaagtgctttggagcttc

SEQ ID NO: 54550 - DNA, 20 bp, Artificial Sequence
  Description of Artificial Sequence: Synthetic oligonucleotide
  Target: SCN10A; (-) strand; PAM type: YTN; PAM sequence: TTT
tgggaagtgctttggagctt

SEQ ID NO: 54551 - DNA, 20 bp, Artificial Sequence
  Description of Artificial Sequence: Synthetic oligonucleotide
  Target: SCN10A; (-) strand; PAM type: YTN; PAM sequence: TTG
ggttttgggaagtgctttgg

SEQ ID NO: 54552 - DNA, 20 bp, Artificial Sequence
  Description of Artificial Sequence: Synthetic oligonucleotide
  Target: SCN10A; (-) strand; PAM type: YTN; PAM sequence: TTG
gtgcaagttgggttttggga

SEQ ID NO: 54553 - DNA, 20 bp, Artificial Sequence
  Description of Artificial Sequence: Synthetic oligonucleotide
  Target: SCN10A; (-) strand; PAM type: YTN; PAM sequence: TTT
ggtgcaagttgggttttggg

SEQ ID NO: 54554 - DNA, 20 bp, Artificial Sequence
  Description of Artificial Sequence: Synthetic oligonucleotide
  Target: SCN10A; (-) strand; PAM type: YTN; PAM sequence: TTT
tggtgcaagttgggttttgg

SEQ ID NO: 54555 - DNA, 20 bp, Artificial Sequence
  Description of Artificial Sequence: Synthetic oligonucleotide
  Target: SCN10A; (-) strand; PAM type: YTN; PAM sequence: TTT
ttggtgcaagttgggttttg

SEQ ID NO: 54556 - DNA, 20 bp, Artificial Sequence
  Description of Artificial Sequence: Synthetic oligonucleotide
  Target: SCN10A; (-) strand; PAM type: YTN; PAM sequence: TTT
tttggtgcaagttgggtttt

SEQ ID NO: 54557 - DNA, 20 bp, Artificial Sequence
  Description of Artificial Sequence: Synthetic oligonucleotide
  Target: SCN10A; (-) strand; PAM type: YTN; PAM sequence: TTT
ttttggtgcaagttgggttt

SEQ ID NO: 54558 - DNA, 20 bp, Artificial Sequence
  Description of Artificial Sequence: Synthetic oligonucleotide
  Target: SCN10A; (-) strand; PAM type: YTN; PAM sequence: CTT
tttttggtgcaagttgggtt

SEQ ID NO: 54559 - DNA, 20 bp, Artificial Sequence
  Description of Artificial Sequence: Synthetic oligonucleotide
  Target: SCN10A; (-) strand; PAM type: YTN; PAM sequence: CTG
tagtagatcagaccggcagc

SEQ ID NO: 54560 - DNA, 20 bp, Artificial Sequence
  Description of Artificial Sequence: Synthetic oligonucleotide
  Target: SCN10A; (-) strand; PAM type: YTN; PAM sequence: TTC
agaaagctgtagtagatcag

SEQ ID NO: 54561 - DNA, 20 bp, Artificial Sequence
  Description of Artificial Sequence: Synthetic oligonucleotide
  Target: SCN10A; (-) strand; PAM type: YTN; PAM sequence: CTG
ggattcagaaagctgtagta

SEQ ID NO: 54562 - DNA, 20 bp, Artificial Sequence
  Description of Artificial Sequence: Synthetic oligonucleotide
  Target: SCN10A; (-) strand; PAM type: YTN; PAM sequence: TTG
ctgggattcagaaagctgta

SEQ ID NO: 54563 - DNA, 20 bp, Artificial Sequence
  Description of Artificial Sequence: Synthetic oligonucleotide
  Target: SCN10A; (-) strand; PAM type: YTN; PAM sequence: TTT
gctgggattcagaaagctgt

SEQ ID NO: 54564 - DNA, 20 bp, Artificial Sequence
  Description of Artificial Sequence: Synthetic oligonucleotide
  Target: SCN10A; (-) strand; PAM type: YTN; PAM sequence: CTT
tgctgggattcagaaagctg

SEQ ID NO: 54565 - DNA, 20 bp, Artificial Sequence
  Description of Artificial Sequence: Synthetic oligonucleotide
  Target: SCN10A; (-) strand; PAM type: YTN; PAM sequence: CTC
agatgtaatggctttgctgg

SEQ ID NO: 54566 - DNA, 20 bp, Artificial Sequence
  Description of Artificial Sequence: Synthetic oligonucleotide
  Target: SCN10A; (-) strand; PAM type: YTN; PAM sequence: TTC
tcagatgtaatggctttgct

SEQ ID NO: 54567 - DNA, 20 bp, Artificial Sequence
  Description of Artificial Sequence: Synthetic oligonucleotide
  Target: SCN10A; (-) strand; PAM type: YTN; PAM sequence: TTT
ctcagatgtaatggctttgc

SEQ ID NO: 54568 - DNA, 20 bp, Artificial Sequence
  Description of Artificial Sequence: Synthetic oligonucleotide
  Target: SCN10A; (-) strand; PAM type: YTN; PAM sequence: CTG
aacatatttctcagatgtaa

SEQ ID NO: 54569 - DNA, 20 bp, Artificial Sequence
  Description of Artificial Sequence: Synthetic oligonucleotide
  Target: SCN10A; (-) strand; PAM type: YTN; PAM sequence: TTG
ctgaacatatttctcagatg

SEQ ID NO: 54570 - DNA, 20 bp, Artificial Sequence
  Description of Artificial Sequence: Synthetic oligonucleotide
  Target: SCN10A; (-) strand; PAM type: YTN; PAM sequence: TTT
gctgaacatatttctcagat

SEQ ID NO: 54571 - DNA, 20 bp, Artificial Sequence
  Description of Artificial Sequence: Synthetic oligonucleotide
  Target: SCN10A; (-) strand; PAM type: YTN; PAM sequence: CTC
atcgatttgctgaacatatt

SEQ ID NO: 54572 - DNA, 20 bp, Artificial Sequence
  Description of Artificial Sequence: Synthetic oligonucleotide
  Target: SCN10A; (-) strand; PAM type: YTN; PAM sequence: CTG
tgcatctcatcgatttgctg

SEQ ID NO: 54573 - DNA, 20 bp, Artificial Sequence
  Description of Artificial Sequence: Synthetic oligonucleotide
  Target: SCN10A; (-) strand; PAM type: YTN; PAM sequence: TTC
tgtgcatctcatcgatttgc

SEQ ID NO: 54574 - DNA, 20 bp, Artificial Sequence
  Description of Artificial Sequence: Synthetic oligonucleotide
  Target: SCN10A; (-) strand; PAM type: YTN; PAM sequence: TTT
ctgtgcatctcatcgatttg

SEQ ID NO: 54575 - DNA, 20 bp, Artificial Sequence
  Description of Artificial Sequence: Synthetic oligonucleotide
  Target: SCN10A; (-) strand; PAM type: YTN; PAM sequence: TTT
tctgtgcatctcatcgattt

SEQ ID NO: 54576 - DNA, 20 bp, Artificial Sequence
  Description of Artificial Sequence: Synthetic oligonucleotide
  Target: SCN10A; (-) strand; PAM type: YTN; PAM sequence: TTG
cagttttctgtgcatctcat

SEQ ID NO: 54577 - DNA, 20 bp, Artificial Sequence
  Description of Artificial Sequence: Synthetic oligonucleotide
  Target: SCN10A; (-) strand; PAM type: YTN; PAM sequence: CTT
gcagttttctgtgcatctca

SEQ ID NO: 54578 - DNA, 20 bp, Artificial Sequence
  Description of Artificial Sequence: Synthetic oligonucleotide
  Target: SCN10A; (-) strand; PAM type: YTN; PAM sequence: CTG
caggccttgcagttttctgt

SEQ ID NO: 54579 - DNA, 20 bp, Artificial Sequence
  Description of Artificial Sequence: Synthetic oligonucleotide
  Target: SCN10A; (-) strand; PAM type: YTN; PAM sequence: TTG
accaatgccagctgcaggcc

SEQ ID NO: 54580 - DNA, 20 bp, Artificial Sequence
  Description of Artificial Sequence: Synthetic oligonucleotide
  Target: SCN10A; (-) strand; PAM type: YTN; PAM sequence: CTG
ttgaccaatgccagctgcag

SEQ ID NO: 54581 - DNA, 20 bp, Artificial Sequence
  Description of Artificial Sequence: Synthetic oligonucleotide
  Target: SCN10A; (-) strand; PAM type: YTN; PAM sequence: TTC
tgttgaccaatgccagctgc

SEQ ID NO: 54582 - DNA, 20 bp, Artificial Sequence
  Description of Artificial Sequence: Synthetic oligonucleotide
  Target: SCN10A; (-) strand; PAM type: YTN; PAM sequence: TTT
ctgttgaccaatgccagctg

SEQ ID NO: 54583 - DNA, 20 bp, Artificial Sequence
  Description of Artificial Sequence: Synthetic oligonucleotide
  Target: SCN10A; (-) strand; PAM type: YTN; PAM sequence: CTT
tctgttgaccaatgccagct

SEQ ID NO: 54584 - DNA, 20 bp, Artificial Sequence
  Description of Artificial Sequence: Synthetic oligonucleotide
  Target: SCN10A; (-) strand; PAM type: YTN; PAM sequence: TTG
ggccctttctgttgaccaat

SEQ ID NO: 54585 - DNA, 20 bp, Artificial Sequence
  Description of Artificial Sequence: Synthetic oligonucleotide
  Target: SCN10A; (-) strand; PAM type: YTN; PAM sequence: TTG
tggagaagaattgggccctt

SEQ ID NO: 54586 - DNA, 20 bp, Artificial Sequence
  Description of Artificial Sequence: Synthetic oligonucleotide
  Target: SCN10A; (-) strand; PAM type: YTN; PAM sequence: TTG
ttgtggagaagaattgggcc

SEQ ID NO: 54587 - DNA, 20 bp, Artificial Sequence
  Description of Artificial Sequence: Synthetic oligonucleotide
  Target: SCN10A; (-) strand; PAM type: YTN; PAM sequence: TTG
tgtgacatgcagtcggttgt

SEQ ID NO: 54588 - DNA, 20 bp, Artificial Sequence
  Description of Artificial Sequence: Synthetic oligonucleotide
  Target: SCN10A; (-) strand; PAM type: YTN; PAM sequence: TTG
gttgtgtgacatgcagtcgg

SEQ ID NO: 54589 - DNA, 20 bp, Artificial Sequence
  Description of Artificial Sequence: Synthetic oligonucleotide
  Target: SCN10A; (-) strand; PAM type: YTN; PAM sequence: CTG
ttggttgtgtgacatgcagt

SEQ ID NO: 54590 - DNA, 20 bp, Artificial Sequence
  Description of Artificial Sequence: Synthetic oligonucleotide
  Target: SCN10A; (-) strand; PAM type: YTN; PAM sequence: TTG
aagtaactgttggttgtgtg

SEQ ID NO: 54591 - DNA, 20 bp, Artificial Sequence
  Description of Artificial Sequence: Synthetic oligonucleotide
  Target: SCN10A; (-) strand; PAM type: YTN; PAM sequence: TTT
gaagtaactgttggttgtgt

SEQ ID NO: 54592 - DNA, 20 bp, Artificial Sequence
  Description of Artificial Sequence: Synthetic oligonucleotide
  Target: SCN10A; (-) strand; PAM type: YTN; PAM sequence: TTT
tgaagtaactgttggttgtg

SEQ ID NO: 54593 - DNA, 20 bp, Artificial Sequence
  Description of Artificial Sequence: Synthetic oligonucleotide
  Target: SCN10A; (-) strand; PAM type: YTN; PAM sequence: CTT
ttgaagtaactgttggttgt

SEQ ID NO: 54594 - DNA, 20 bp, Artificial Sequence
  Description of Artificial Sequence: Synthetic oligonucleotide
  Target: SCN10A; (-) strand; PAM type: YTN; PAM sequence: TTC
aacttttgaagtaactgttg

SEQ ID NO: 54595 - DNA, 20 bp, Artificial Sequence
  Description of Artificial Sequence: Synthetic oligonucleotide
  Target: SCN10A; (-) strand; PAM type: YTN; PAM sequence: TTC
attcaacttttgaagtaact

SEQ ID NO: 54596 - DNA, 20 bp, Artificial Sequence
  Description of Artificial Sequence: Synthetic oligonucleotide
  Target: SCN10A; (-) strand; PAM type: YTN; PAM sequence: TTC
atagcccaattcattcaact

SEQ ID NO: 54597 - DNA, 20 bp, Artificial Sequence
  Description of Artificial Sequence: Synthetic oligonucleotide
  Target: SCN10A; (-) strand; PAM type: YTN; PAM sequence: CTT
catagcccaattcattcaac

SEQ ID NO: 54598 - DNA, 20 bp, Artificial Sequence
  Description of Artificial Sequence: Synthetic oligonucleotide
  Target: SCN10A; (-) strand; PAM type: YTN; PAM sequence: TTG
gtgagaggtcaggtgaatat

SEQ ID NO: 54599 - DNA, 20 bp, Artificial Sequence
  Description of Artificial Sequence: Synthetic oligonucleotide
  Target: SCN10A; (-) strand; PAM type: YTN; PAM sequence: TTG
gttggtgagaggtcaggtga

SEQ ID NO: 54600 - DNA, 20 bp, Artificial Sequence
  Description of Artificial Sequence: Synthetic oligonucleotide
  Target: SCN10A; (-) strand; PAM type: YTN; PAM sequence: TTG
aagaagtggtagttggttgg

SEQ ID NO: 54601 - DNA, 20 bp, Artificial Sequence
  Description of Artificial Sequence: Synthetic oligonucleotide
  Target: SCN10A; (-) strand; PAM type: YTN; PAM sequence: CTT
gaagaagtggtagttggttg

SEQ ID NO: 54602 - DNA, 20 bp, Artificial Sequence
  Description of Artificial Sequence: Synthetic oligonucleotide
  Target: SCN10A; (-) strand; PAM type: YTN; PAM sequence: TTC
agatgcttgaagaagtggta

SEQ ID NO: 54603 - DNA, 20 bp, Artificial Sequence
  Description of Artificial Sequence: Synthetic oligonucleotide
  Target: SCN10A; (-) strand; PAM type: YTN; PAM sequence: TTG
ttcagatgcttgaagaagtg

SEQ ID NO: 54604 - DNA, 20 bp, Artificial Sequence
  Description of Artificial Sequence: Synthetic oligonucleotide
  Target: SCN10A; (-) strand; PAM type: YTN; PAM sequence: CTG
caaaaagttgttcagatgct

SEQ ID NO: 54605 - DNA, 20 bp, Artificial Sequence
  Description of Artificial Sequence: Synthetic oligonucleotide
  Target: SCN10A; (-) strand; PAM type: YTN; PAM sequence: TTC
acctgcaaaaagttgttcag

SEQ ID NO: 54606 - DNA, 20 bp, Artificial Sequence
  Description of Artificial Sequence: Synthetic oligonucleotide
  Target: SCN10A; (-) strand; PAM type: YTN; PAM sequence: TTT
cacctgcaaaaagttgttca

SEQ ID NO: 54607 - DNA, 20 bp, Artificial Sequence
  Description of Artificial Sequence: Synthetic oligonucleotide
  Target: SCN10A; (-) strand; PAM type: YTN; PAM sequence: TTA
tggaagtgtttcacctgcaa

SEQ ID NO: 54608 - DNA, 20 bp, Artificial Sequence
  Description of Artificial Sequence: Synthetic oligonucleotide
  Target: SCN10A; (-) strand; PAM type: YTN; PAM sequence: CTG
gttatggaagtgtttcacct

SEQ ID NO: 54609 - DNA, 20 bp, Artificial Sequence
  Description of Artificial Sequence: Synthetic oligonucleotide
  Target: SCN10A; (-) strand; PAM type: YTN; PAM sequence: CTG
catcccgctggttatggaag

SEQ ID NO: 54610 - DNA, 20 bp, Artificial Sequence
  Description of Artificial Sequence: Synthetic oligonucleotide
  Target: SCN10A; (-) strand; PAM type: YTN; PAM sequence: TTC
tgcatcccgctggttatgga

SEQ ID NO: 54611 - DNA, 20 bp, Artificial Sequence
  Description of Artificial Sequence: Synthetic oligonucleotide
  Target: SCN10A; (-) strand; PAM type: YTN; PAM sequence: TTT
ctgcatcccgctggttatgg

SEQ ID NO: 54612 - DNA, 20 bp, Artificial Sequence
  Description of Artificial Sequence: Synthetic oligonucleotide
  Target: SCN10A; (-) strand; PAM type: YTN; PAM sequence: TTT
tctgcatcccgctggttatg

SEQ ID NO: 54613 - DNA, 20 bp, Artificial Sequence
  Description of Artificial Sequence: Synthetic oligonucleotide
  Target: SCN10A; (-) strand; PAM type: YTN; PAM sequence: TTG
gaaggcattttctgcatccc

SEQ ID NO: 54614 - DNA, 20 bp, Artificial Sequence
  Description of Artificial Sequence: Synthetic oligonucleotide
  Target: SCN10A; (-) strand; PAM type: YTN; PAM sequence: CTT
ggaaggcattttctgcatcc

SEQ ID NO: 54615 - DNA, 20 bp, Artificial Sequence
  Description of Artificial Sequence: Synthetic oligonucleotide
  Target: SCN10A; (-) strand; PAM type: YTN; PAM sequence: CTC
ttggaaggcattttctgcat

SEQ ID NO: 54616 - DNA, 20 bp, Artificial Sequence
  Description of Artificial Sequence: Synthetic oligonucleotide
  Target: SCN10A; (-) strand; PAM type: YTN; PAM sequence: TTC
aatgaactcttggaaggcat

SEQ ID NO: 54617 - DNA, 20 bp, Artificial Sequence
  Description of Artificial Sequence: Synthetic oligonucleotide
  Target: SCN10A; (-) strand; PAM type: YTN; PAM sequence: TTG
ggattcaatgaactcttgga

SEQ ID NO: 54618 - DNA, 20 bp, Artificial Sequence
  Description of Artificial Sequence: Synthetic oligonucleotide
  Target: SCN10A; (-) strand; PAM type: YTN; PAM sequence: TTT
gggattcaatgaactcttgg

SEQ ID NO: 54619 - DNA, 20 bp, Artificial Sequence
  Description of Artificial Sequence: Synthetic oligonucleotide
  Target: SCN10A; (-) strand; PAM type: YTN; PAM sequence: CTT
tgggattcaatgaactcttg

SEQ ID NO: 54620 - DNA, 20 bp, Artificial Sequence
  Description of Artificial Sequence: Synthetic oligonucleotide
  Target: SCN10A; (-) strand; PAM type: YTN; PAM sequence: CTG
tagcataaaaatccatgctt

SEQ ID NO: 54621 - DNA, 20 bp, Artificial Sequence
  Description of Artificial Sequence: Synthetic oligonucleotide
  Target: SCN10A; (-) strand; PAM type: YTN; PAM sequence: TTC
ctgtagcataaaaatccatg

SEQ ID NO: 54622 - DNA, 20 bp, Artificial Sequence
  Description of Artificial Sequence: Synthetic oligonucleotide
  Target: SCN10A; (-) strand; PAM type: YTN; PAM sequence: TTA
ttcctgtagcataaaaatcc

SEQ ID NO: 54623 - DNA, 20 bp, Artificial Sequence
  Description of Artificial Sequence: Synthetic oligonucleotide
  Target: SCN10A; (-) strand; PAM type: YTN; PAM sequence: TTT
attcctgtagcataaaaatc

SEQ ID NO: 54624 - DNA, 20 bp, Artificial Sequence
  Description of Artificial Sequence: Synthetic oligonucleotide
  Target: SCN10A; (-) strand; PAM type: YTN; PAM sequence: TTG
tttattcctgtagcataaaa

SEQ ID NO: 54625 - DNA, 20 bp, Artificial Sequence
  Description of Artificial Sequence: Synthetic oligonucleotide
  Target: SCN10A; (-) strand; PAM type: YTN; PAM sequence: TTT
gtttattcctgtagcataaa

SEQ ID NO: 54626 - DNA, 20 bp, Artificial Sequence
  Description of Artificial Sequence: Synthetic oligonucleotide
  Target: SCN10A; (-) strand; PAM type: YTN; PAM sequence: TTG
ccaatgagaaatgagtttgt

SEQ ID NO: 54627 - DNA, 20 bp, Artificial Sequence
  Description of Artificial Sequence: Synthetic oligonucleotide
  Target: SCN10A; (-) strand; PAM type: YTN; PAM sequence: TTT
gccaatgagaaatgagtttg

SEQ ID NO: 54628 - DNA, 20 bp, Artificial Sequence
  Description of Artificial Sequence: Synthetic oligonucleotide
  Target: SCN10A; (-) strand; PAM type: YTN; PAM sequence: TTT
tgccaatgagaaatgagttt

SEQ ID NO: 54629 - DNA, 20 bp, Artificial Sequence
  Description of Artificial Sequence: Synthetic oligonucleotide
  Target: SCN10A; (-) strand; PAM type: YTN; PAM sequence: TTT
ttgccaatgagaaatgagtt

SEQ ID NO: 54630 - DNA, 20 bp, Artificial Sequence
  Description of Artificial Sequence: Synthetic oligonucleotide
  Target: SCN10A; (-) strand; PAM type: YTN; PAM sequence: TTA
caatcaacacatttttgcca

SEQ ID NO: 54631 - DNA, 20 bp, Artificial Sequence
  Description of Artificial Sequence: Synthetic oligonucleotide
  Target: SCN10A; (-) strand; PAM type: YTN; PAM sequence: TTA
atcaaagtaggaaccattac

SEQ ID NO: 54632 - DNA, 20 bp, Artificial Sequence
  Description of Artificial Sequence: Synthetic oligonucleotide
  Target: SCN10A; (-) strand; PAM type: YTN; PAM sequence: TTA
ttaatcaaagtaggaaccat

SEQ ID NO: 54633 - DNA, 20 bp, Artificial Sequence
  Description of Artificial Sequence: Synthetic oligonucleotide
  Target: SCN10A; (-) strand; PAM type: YTN; PAM sequence: TTT
attaatcaaagtaggaacca

SEQ ID NO: 54634 - DNA, 20 bp, Artificial Sequence
  Description of Artificial Sequence: Synthetic oligonucleotide
  Target: SCN10A; (-) strand; PAM type: YTN; PAM sequence: CTT
tattaatcaaagtaggaacc

SEQ ID NO: 54635 - DNA, 20 bp, Artificial Sequence
  Description of Artificial Sequence: Synthetic oligonucleotide
  Target: SCN10A; (-) strand; PAM type: YTN; PAM sequence: CTC
aaacacatctttattaatca

SEQ ID NO: 54636 - DNA, 20 bp, Artificial Sequence
  Description of Artificial Sequence: Synthetic oligonucleotide
  Target: SCN10A; (-) strand; PAM type: YTN; PAM sequence: CTA
ggctcaaacacatctttatt

SEQ ID NO: 54637 - DNA, 20 bp, Artificial Sequence
  Description of Artificial Sequence: Synthetic oligonucleotide
  Target: SCN10A; (-) strand; PAM type: YTN; PAM sequence: TTA
taactaggctcaaacacatc

SEQ ID NO: 54638 - DNA, 20 bp, Artificial Sequence
  Description of Artificial Sequence: Synthetic oligonucleotide
  Target: SCN10A; (-) strand; PAM type: YTN; PAM sequence: TTA
aatcattataactaggctca

SEQ ID NO: 54639 - DNA, 20 bp, Artificial Sequence
  Description of Artificial Sequence: Synthetic oligonucleotide
  Target: SCN10A; (-) strand; PAM type: YTN; PAM sequence: TTC
agaccataaatattaaatca

SEQ ID NO: 54640 - DNA, 20 bp, Artificial Sequence
  Description of Artificial Sequence: Synthetic oligonucleotide
  Target: SCN10A; (-) strand; PAM type: YTN; PAM sequence: TTT
cagaccataaatattaaatc

SEQ ID NO: 54641 - DNA, 20 bp, Artificial Sequence
  Description of Artificial Sequence: Synthetic oligonucleotide
  Target: SCN10A; (-) strand; PAM type: YTN; PAM sequence: TTG
gggtttcagaccataaatat

SEQ ID NO: 54642 - DNA, 20 bp, Artificial Sequence
  Description of Artificial Sequence: Synthetic oligonucleotide
  Target: SCN10A; (-) strand; PAM type: YTN; PAM sequence: TTG
tacatcaaaaaataaaaagc

SEQ ID NO: 54643 - DNA, 20 bp, Artificial Sequence
  Description of Artificial Sequence: Synthetic oligonucleotide
  Target: SCN10A; (-) strand; PAM type: YTN; PAM sequence: CTG
gaagaattgtacatcaaaaa

SEQ ID NO: 54644 - DNA, 20 bp, Artificial Sequence
  Description of Artificial Sequence: Synthetic oligonucleotide
  Target: SCN10A; (-) strand; PAM type: YTN; PAM sequence: CTA
aatactggaagaattgtaca

SEQ ID NO: 54645 - DNA, 20 bp, Artificial Sequence
  Description of Artificial Sequence: Synthetic oligonucleotide
  Target: SCN10A; (-) strand; PAM type: YTN; PAM sequence: CTC
taaatactggaagaattgta

SEQ ID NO: 54646 - DNA, 20 bp, Artificial Sequence
  Description of Artificial Sequence: Synthetic oligonucleotide
  Target: SCN10A; (-) strand; PAM type: YTN; PAM sequence: TTG
taacaaataatatgacaaac

SEQ ID NO: 54647 - DNA, 20 bp, Artificial Sequence
  Description of Artificial Sequence: Synthetic oligonucleotide
  Target: SCN10A; (-) strand; PAM type: YTN; PAM sequence: TTT
gtaacaaataatatgacaaa

SEQ ID NO: 54648 - DNA, 20 bp, Artificial Sequence
  Description of Artificial Sequence: Synthetic oligonucleotide
  Target: SCN10A; (-) strand; PAM type: YTN; PAM sequence: CTA
tatatttgtaacaaataata

SEQ ID NO: 54649 - DNA, 20 bp, Artificial Sequence
  Description of Artificial Sequence: Synthetic oligonucleotide
  Target: SCN10A; (-) strand; PAM type: YTN; PAM sequence: TTA
gtaatctatatatttgtaac

SEQ ID NO: 54650 - DNA, 20 bp, Artificial Sequence
  Description of Artificial Sequence: Synthetic oligonucleotide
  Target: SCN10A; (-) strand; PAM type: YTN; PAM sequence: TTT
agtaatctatatatttgtaa

SEQ ID NO: 54651 - DNA, 20 bp, Artificial Sequence
  Description of Artificial Sequence: Synthetic oligonucleotide
  Target: SCN10A; (-) strand; PAM type: YTN; PAM sequence: CTT
tagtaatctatatatttgta

SEQ ID NO: 54652 - DNA, 20 bp, Artificial Sequence
  Description of Artificial Sequence: Synthetic oligonucleotide
  Target: SCN10A; (-) strand; PAM type: YTN; PAM sequence: CTC
tttagtaatctatatatttg

SEQ ID NO: 54653 - DNA, 20 bp, Artificial Sequence
  Description of Artificial Sequence: Synthetic oligonucleotide
  Target: SCN10A; (-) strand; PAM type: YTN; PAM sequence: CTA
ggataaagatacaaactctt

SEQ ID NO: 54654 - DNA, 20 bp, Artificial Sequence
  Description of Artificial Sequence: Synthetic oligonucleotide
  Target: SCN10A; (-) strand; PAM type: YTN; PAM sequence: TTA
taaagacaaccactaggata

SEQ ID NO: 54655 - DNA, 20 bp, Artificial Sequence
  Description of Artificial Sequence: Synthetic oligonucleotide
  Target: SCN10A; (-) strand; PAM type: YTN; PAM sequence: CTT
ataaagacaaccactaggat

SEQ ID NO: 54656 - DNA, 20 bp, Artificial Sequence
  Description of Artificial Sequence: Synthetic oligonucleotide
  Target: SCN10A; (-) strand; PAM type: YTN; PAM sequence: TTA
cttataaagacaaccactag

SEQ ID NO: 54657 - DNA, 20 bp, Artificial Sequence
  Description of Artificial Sequence: Synthetic oligonucleotide
  Target: SCN10A; (-) strand; PAM type: YTN; PAM sequence: TTT
acttataaagacaaccacta

SEQ ID NO: 54658 - DNA, 20 bp, Artificial Sequence
  Description of Artificial Sequence: Synthetic oligonucleotide
  Target: SCN10A; (-) strand; PAM type: YTN; PAM sequence: TTT
tacttataaagacaaccact

SEQ ID NO: 54659 - DNA, 20 bp, Artificial Sequence
  Description of Artificial Sequence: Synthetic oligonucleotide
  Target: SCN10A; (-) strand; PAM type: YTN; PAM sequence: TTT
ttacttataaagacaaccac

SEQ ID NO: 54660 - DNA, 20 bp, Artificial Sequence
  Description of Artificial Sequence: Synthetic oligonucleotide
  Target: SCN10A; (-) strand; PAM type: YTN; PAM sequence: TTA
taataagtttttacttataa

SEQ ID NO: 54661 - DNA, 20 bp, Artificial Sequence
  Description of Artificial Sequence: Synthetic oligonucleotide
  Target: SCN10A; (-) strand; PAM type: YTN; PAM sequence: TTT
ataataagtttttacttata

SEQ ID NO: 54662 - DNA, 20 bp, Artificial Sequence
  Description of Artificial Sequence: Synthetic oligonucleotide
  Target: SCN10A; (-) strand; PAM type: YTN; PAM sequence: TTA
taaatttataataagttttt

SEQ ID NO: 54663 - DNA, 20 bp, Artificial Sequence
  Description of Artificial Sequence: Synthetic oligonucleotide
  Target: SCN10A; (-) strand; PAM type: YTN; PAM sequence: TTA
taattataaatttataataa

SEQ ID NO: 54664 - DNA, 20 bp, Artificial Sequence
  Description of Artificial Sequence: Synthetic oligonucleotide
  Target: SCN10A; (-) strand; PAM type: YTN; PAM sequence: TTA
attataattataaatttata

SEQ ID NO: 54665 - DNA, 20 bp, Artificial Sequence
  Description of Artificial Sequence: Synthetic oligonucleotide
  Target: SCN10A; (-) strand; PAM type: YTN; PAM sequence: TTT
aattataattataaatttat

SEQ ID NO: 54666 - DNA, 20 bp, Artificial Sequence
  Description of Artificial Sequence: Synthetic oligonucleotide
  Target: SCN10A; (-) strand; PAM type: YTN; PAM sequence: TTT
taattataattataaattta

SEQ ID NO: 54667 - DNA, 20 bp, Artificial Sequence
  Description of Artificial Sequence: Synthetic oligonucleotide
  Target: SCN10A; (-) strand; PAM type: YTN; PAM sequence: TTA
cacggttttaattataatta

SEQ ID NO: 54668 - DNA, 20 bp, Artificial Sequence
  Description of Artificial Sequence: Synthetic oligonucleotide
  Target: SCN10A; (-) strand; PAM type: YTN; PAM sequence: CTA
aggacaatgtattacacggt

SEQ ID NO: 54669 - DNA, 20 bp, Artificial Sequence
  Description of Artificial Sequence: Synthetic oligonucleotide
  Target: SCN10A; (-) strand; PAM type: YTN; PAM sequence: TTA
aagaaatagtacactaagga

SEQ ID NO: 54670 - DNA, 20 bp, Artificial Sequence
  Description of Artificial Sequence: Synthetic oligonucleotide
  Target: SCN10A; (-) strand; PAM type: YTN; PAM sequence: TTG
attaaagaaatagtacacta

SEQ ID NO: 54671 - DNA, 20 bp, Artificial Sequence
  Description of Artificial Sequence: Synthetic oligonucleotide
  Target: SCN10A; (-) strand; PAM type: YTN; PAM sequence: TTT
gattaaagaaatagtacact

SEQ ID NO: 54672 - DNA, 20 bp, Artificial Sequence
  Description of Artificial Sequence: Synthetic oligonucleotide
  Target: SCN10A; (-) strand; PAM type: YTN; PAM sequence: TTT
tgattaaagaaatagtacac

SEQ ID NO: 54673 - DNA, 20 bp, Artificial Sequence
  Description of Artificial Sequence: Synthetic oligonucleotide
  Target: SCN10A; (-) strand; PAM type: YTN; PAM sequence: TTA
aatacagtcagataatggat

SEQ ID NO: 54674 - DNA, 20 bp, Artificial Sequence
  Description of Artificial Sequence: Synthetic oligonucleotide
  Target: SCN10A; (-) strand; PAM type: YTN; PAM sequence: TTA
ttaaatacagtcagataatg

SEQ ID NO: 54675 - DNA, 20 bp, Artificial Sequence
  Description of Artificial Sequence: Synthetic oligonucleotide
  Target: SCN10A; (-) strand; PAM type: YTN; PAM sequence: TTG
acagtacaaaggtaagcaca

SEQ ID NO: 54676 - DNA, 20 bp, Artificial Sequence
  Description of Artificial Sequence: Synthetic oligonucleotide
  Target: SCN10A; (-) strand; PAM type: YTN; PAM sequence: CTT
gacagtacaaaggtaagcac

SEQ ID NO: 54677 - DNA, 20 bp, Artificial Sequence
  Description of Artificial Sequence: Synthetic oligonucleotide
  Target: SCN10A; (-) strand; PAM type: YTN; PAM sequence: TTA
cacttgacagtacaaaggta

SEQ ID NO: 54678 - DNA, 20 bp, Artificial Sequence
  Description of Artificial Sequence: Synthetic oligonucleotide
  Target: SCN10A; (-) strand; PAM type: YTN; PAM sequence: TTG
acaaataaagaaatggacaa

SEQ ID NO: 54679 - DNA, 20 bp, Artificial Sequence
  Description of Artificial Sequence: Synthetic oligonucleotide
  Target: SCN10A; (-) strand; PAM type: YTN; PAM sequence: TTA
aagttgacaaataaagaaat

SEQ ID NO: 54680 - DNA, 20 bp, Artificial Sequence
  Description of Artificial Sequence: Synthetic oligonucleotide
  Target: SCN10A; (-) strand; PAM type: YTN; PAM sequence: TTT
aaagttgacaaataaagaaa

SEQ ID NO: 54681 - DNA, 20 bp, Artificial Sequence
  Description of Artificial Sequence: Synthetic oligonucleotide
  Target: SCN10A; (-) strand; PAM type: YTN; PAM sequence: TTA
tttaaagttgacaaataaag

SEQ ID NO: 54682 - DNA, 20 bp, Artificial Sequence
  Description of Artificial Sequence: Synthetic oligonucleotide
  Target: SCN10A; (-) strand; PAM type: YTN; PAM sequence: TTA
aagagtattatttaaagttg

SEQ ID NO: 54683 - DNA, 20 bp, Artificial Sequence
  Description of Artificial Sequence: Synthetic oligonucleotide
  Target: SCN10A; (-) strand; PAM type: YTN; PAM sequence: CTA
taataacaagaagttaaaga

SEQ ID NO: 54684 - DNA, 20 bp, Artificial Sequence
  Description of Artificial Sequence: Synthetic oligonucleotide
  Target: SCN10A; (-) strand; PAM type: YTN; PAM sequence: TTC
tataataacaagaagttaaa

SEQ ID NO: 54685 - DNA, 20 bp, Artificial Sequence
  Description of Artificial Sequence: Synthetic oligonucleotide
  Target: SCN10A; (-) strand; PAM type: YTN; PAM sequence: CTT
ctataataacaagaagttaa

SEQ ID NO: 54686 - DNA, 20 bp, Artificial Sequence
  Description of Artificial Sequence: Synthetic oligonucleotide
  Target: SCN10A; (-) strand; PAM type: YTN; PAM sequence: CTG
cttctataataacaagaagt

SEQ ID NO: 54687 - DNA, 20 bp, Artificial Sequence
  Description of Artificial Sequence: Synthetic oligonucleotide
  Target: SCN10A; (-) strand; PAM type: YTN; PAM sequence: CTG
ctgcttctataataacaaga

SEQ ID NO: 54688 - DNA, 20 bp, Artificial Sequence
  Description of Artificial Sequence: Synthetic oligonucleotide
  Target: SCN10A; (-) strand; PAM type: YTN; PAM sequence: TTA
ctgctgcttctataataaca

SEQ ID NO: 54689 - DNA, 20 bp, Artificial Sequence
  Description of Artificial Sequence: Synthetic oligonucleotide
  Target: SCN10A; (-) strand; PAM type: YTN; PAM sequence: CTT
actgctgcttctataataac

SEQ ID NO: 54690 - DNA, 20 bp, Artificial Sequence
  Description of Artificial Sequence: Synthetic oligonucleotide
  Target: SCN10A; (-) strand; PAM type: YTN; PAM sequence: TTC
acttactgctgcttctataa

SEQ ID NO: 54691 - DNA, 20 bp, Artificial Sequence
  Description of Artificial Sequence: Synthetic oligonucleotide
  Target: SCN10A; (-) strand; PAM type: YTN; PAM sequence: TTG
acatgatacaaatagcaaga

SEQ ID NO: 54692 - DNA, 20 bp, Artificial Sequence
  Description of Artificial Sequence: Synthetic oligonucleotide
  Target: SCN10A; (-) strand; PAM type: YTN; PAM sequence: CTG
caagtgttgacatgatacaa

SEQ ID NO: 54693 - DNA, 20 bp, Artificial Sequence
  Description of Artificial Sequence: Synthetic oligonucleotide
  Target: SCN10A; (-) strand; PAM type: YTN; PAM sequence: CTG
cccaacaagccccagaggcc

SEQ ID NO: 54694 - DNA, 20 bp, Artificial Sequence
  Description of Artificial Sequence: Synthetic oligonucleotide
  Target: SCN10A; (-) strand; PAM type: YTN; PAM sequence: TTA
ccgcccccgctgcccaacaa

SEQ ID NO: 54695 - DNA, 20 bp, Artificial Sequence
  Description of Artificial Sequence: Synthetic oligonucleotide
  Target: SCN10A; (-) strand; PAM type: YTN; PAM sequence: TTT
accgcccccgctgcccaaca

SEQ ID NO: 54696 - DNA, 20 bp, Artificial Sequence
  Description of Artificial Sequence: Synthetic oligonucleotide
  Target: SCN10A; (-) strand; PAM type: YTN; PAM sequence: TTT
taccgcccccgctgcccaac

SEQ ID NO: 54697 - DNA, 20 bp, Artificial Sequence
  Description of Artificial Sequence: Synthetic oligonucleotide
  Target: SCN10A; (-) strand; PAM type: YTN; PAM sequence: CTC
cagagggggataaaaatgag

SEQ ID NO: 54698 - DNA, 20 bp, Artificial Sequence
  Description of Artificial Sequence: Synthetic oligonucleotide
  Target: SCN10A; (-) strand; PAM type: YTN; PAM sequence: TTA
aaccacggtgcctccagagg

SEQ ID NO: 54699 - DNA, 20 bp, Artificial Sequence
  Description of Artificial Sequence: Synthetic oligonucleotide
  Target: SCN10A; (-) strand; PAM type: YTN; PAM sequence: TTG
ttaaaccacggtgcctccag

SEQ ID NO: 54700 - DNA, 20 bp, Artificial Sequence
  Description of Artificial Sequence: Synthetic oligonucleotide
  Target: SCN10A; (-) strand; PAM type: YTN; PAM sequence: TTT
gttaaaccacggtgcctcca

SEQ ID NO: 54701 - DNA, 20 bp, Artificial Sequence
  Description of Artificial Sequence: Synthetic oligonucleotide
  Target: SCN10A; (-) strand; PAM type: YTN; PAM sequence: TTA
gcagatcagggtttgttaaa

SEQ ID NO: 54702 - DNA, 20 bp, Artificial Sequence
  Description of Artificial Sequence: Synthetic oligonucleotide
  Target: SCN10A; (-) strand; PAM type: YTN; PAM sequence: CTT
agcagatcagggtttgttaa

SEQ ID NO: 54703 - DNA, 20 bp, Artificial Sequence
  Description of Artificial Sequence: Synthetic oligonucleotide
  Target: SCN10A; (-) strand; PAM type: YTN; PAM sequence: TTG
gaagaccaaaagtgggtgga

SEQ ID NO: 54704 - DNA, 20 bp, Artificial Sequence
  Description of Artificial Sequence: Synthetic oligonucleotide
  Target: SCN10A; (-) strand; PAM type: YTN; PAM sequence: CTT
ggaagaccaaaagtgggtgg

SEQ ID NO: 54705 - DNA, 20 bp, Artificial Sequence
  Description of Artificial Sequence: Synthetic oligonucleotide
  Target: SCN10A; (-) strand; PAM type: YTN; PAM sequence: CTC
aaaatgccaatagaatgaca

SEQ ID NO: 54706 - DNA, 20 bp, Artificial Sequence
  Description of Artificial Sequence: Synthetic oligonucleotide
  Target: SCN10A; (-) strand; PAM type: YTN; PAM sequence: CTC
tcaaaatgccaatagaatga

SEQ ID NO: 54707 - DNA, 20 bp, Artificial Sequence
  Description of Artificial Sequence: Synthetic oligonucleotide
  Target: SCN10A; (-) strand; PAM type: YTN; PAM sequence: TTA
ccccaccctctcaaaatgcc

SEQ ID NO: 54708 - DNA, 20 bp, Artificial Sequence
  Description of Artificial Sequence: Synthetic oligonucleotide
  Target: SCN10A; (-) strand; PAM type: YTN; PAM sequence: TTT
accccaccctctcaaaatgc

SEQ ID NO: 54709 - DNA, 20 bp, Artificial Sequence
  Description of Artificial Sequence: Synthetic oligonucleotide
  Target: SCN10A; (-) strand; PAM type: YTN; PAM sequence: TTT
taccccaccctctcaaaatg

SEQ ID NO: 54710 - DNA, 20 bp, Artificial Sequence
  Description of Artificial Sequence: Synthetic oligonucleotide
  Target: SCN10A; (-) strand; PAM type: YTN; PAM sequence: TTA
aatatggaagatagaatgca

SEQ ID NO: 54711 - DNA, 20 bp, Artificial Sequence
  Description of Artificial Sequence: Synthetic oligonucleotide
  Target: SCN10A; (-) strand; PAM type: YTN; PAM sequence: TTG
tggttaaatatggaagatag

SEQ ID NO: 54712 - DNA, 20 bp, Artificial Sequence
  Description of Artificial Sequence: Synthetic oligonucleotide
  Target: SCN10A; (-) strand; PAM type: YTN; PAM sequence: TTG
gagattgtggttaaatatgg

SEQ ID NO: 54713 - DNA, 20 bp, Artificial Sequence
  Description of Artificial Sequence: Synthetic oligonucleotide
  Target: SCN10A; (-) strand; PAM type: YTN; PAM sequence: TTT
ggagattgtggttaaatatg

SEQ ID NO: 54714 - DNA, 20 bp, Artificial Sequence
  Description of Artificial Sequence: Synthetic oligonucleotide
  Target: SCN10A; (-) strand; PAM type: YTN; PAM sequence: TTA
tttggagattgtggttaaat

SEQ ID NO: 54715 - DNA, 20 bp, Artificial Sequence
  Description of Artificial Sequence: Synthetic oligonucleotide
  Target: SCN10A; (-) strand; PAM type: YTN; PAM sequence: TTG
ggagttatttggagattgtg

SEQ ID NO: 54716 - DNA, 20 bp, Artificial Sequence
  Description of Artificial Sequence: Synthetic oligonucleotide
  Target: SCN10A; (-) strand; PAM type: YTN; PAM sequence: TTT
gggagttatttggagattgt

SEQ ID NO: 54717 - DNA, 20 bp, Artificial Sequence
  Description of Artificial Sequence: Synthetic oligonucleotide
  Target: SCN10A; (-) strand; PAM type: YTN; PAM sequence: TTA
tttgggagttatttggagat

SEQ ID NO: 54718 - DNA, 20 bp, Artificial Sequence
  Description of Artificial Sequence: Synthetic oligonucleotide
  Target: SCN10A; (-) strand; PAM type: YTN; PAM sequence: TTG
caaaatgagttatttgggag

SEQ ID NO: 54719 - DNA, 20 bp, Artificial Sequence
  Description of Artificial Sequence: Synthetic oligonucleotide
  Target: SCN10A; (-) strand; PAM type: YTN; PAM sequence: TTT
gcaaaatgagttatttggga

SEQ ID NO: 54720 - DNA, 20 bp, Artificial Sequence
  Description of Artificial Sequence: Synthetic oligonucleotide
  Target: SCN10A; (-) strand; PAM type: YTN; PAM sequence: TTT
tgcaaaatgagttatttggg

SEQ ID NO: 54721 - DNA, 20 bp, Artificial Sequence
  Description of Artificial Sequence: Synthetic oligonucleotide
  Target: SCN10A; (-) strand; PAM type: YTN; PAM sequence: TTT
ttgcaaaatgagttatttgg

SEQ ID NO: 54722 - DNA, 20 bp, Artificial Sequence
  Description of Artificial Sequence: Synthetic oligonucleotide
  Target: SCN10A; (-) strand; PAM type: YTN; PAM sequence: TTT
tttgcaaaatgagttatttg

SEQ ID NO: 54723 - DNA, 20 bp, Artificial Sequence
  Description of Artificial Sequence: Synthetic oligonucleotide
  Target: SCN10A; (-) strand; PAM type: YTN; PAM sequence: TTT
ttttgcaaaatgagttattt

SEQ ID NO: 54724 - DNA, 20 bp, Artificial Sequence
  Description of Artificial Sequence: Synthetic oligonucleotide
  Target: SCN10A; (-) strand; PAM type: YTN; PAM sequence: TTA
atgtaaaacatttttttgca

SEQ ID NO: 54725 - DNA, 20 bp, Artificial Sequence
  Description of Artificial Sequence: Synthetic oligonucleotide
  Target: SCN10A; (-) strand; PAM type: YTN; PAM sequence: TTT
aatgtaaaacatttttttgc

SEQ ID NO: 54726 - DNA, 20 bp, Artificial Sequence
  Description of Artificial Sequence: Synthetic oligonucleotide
  Target: SCN10A; (-) strand; PAM type: YTN; PAM sequence: TTT
taatgtaaaacatttttttg

SEQ ID NO: 54727 - DNA, 20 bp, Artificial Sequence
  Description of Artificial Sequence: Synthetic oligonucleotide
  Target: SCN10A; (-) strand; PAM type: YTN; PAM sequence: TTG
gagttttaatgtaaaacatt

SEQ ID NO: 54728 - DNA, 20 bp, Artificial Sequence
  Description of Artificial Sequence: Synthetic oligonucleotide
  Target: SCN10A; (-) strand; PAM type: YTN; PAM sequence: TTT
ggagttttaatgtaaaacat

SEQ ID NO: 54729 - DNA, 20 bp, Artificial Sequence
  Description of Artificial Sequence: Synthetic oligonucleotide
  Target: SCN10A; (-) strand; PAM type: YTN; PAM sequence: TTT
tggagttttaatgtaaaaca

SEQ ID NO: 54730 - DNA, 20 bp, Artificial Sequence
  Description of Artificial Sequence: Synthetic oligonucleotide
  Target: SCN10A; (-) strand; PAM type: YTN; PAM sequence: CTT
ttggagttttaatgtaaaac

SEQ ID NO: 54731 - DNA, 20 bp, Artificial Sequence
  Description of Artificial Sequence: Synthetic oligonucleotide
  Target: SCN10A; (-) strand; PAM type: YTN; PAM sequence: TTC
ttttggagttttaatgtaaa

SEQ ID NO: 54732 - DNA, 20 bp, Artificial Sequence
  Description of Artificial Sequence: Synthetic oligonucleotide
  Target: SCN10A; (-) strand; PAM type: YTN; PAM sequence: CTT
cttttggagttttaatgtaa

SEQ ID NO: 54733 - DNA, 20 bp, Artificial Sequence
  Description of Artificial Sequence: Synthetic oligonucleotide
  Target: SCN10A; (-) strand; PAM type: YTN; PAM sequence: CTA
tgcttcttttggagttttaa

SEQ ID NO: 54734 - DNA, 20 bp, Artificial Sequence
  Description of Artificial Sequence: Synthetic oligonucleotide
  Target: SCN10A; (-) strand; PAM type: YTN; PAM sequence: TTG
agatcatatagcatgtaaaa

SEQ ID NO: 54735 - DNA, 20 bp, Artificial Sequence
  Description of Artificial Sequence: Synthetic oligonucleotide
  Target: SCN10A; (-) strand; PAM type: YTN; PAM sequence: TTG
ttgagatcatatagcatgta

SEQ ID NO: 54736 - DNA, 20 bp, Artificial Sequence
  Description of Artificial Sequence: Synthetic oligonucleotide
  Target: SCN10A; (-) strand; PAM type: YTN; PAM sequence: TTA
atattgttgagatcatatag

SEQ ID NO: 54737 - DNA, 20 bp, Artificial Sequence
  Description of Artificial Sequence: Synthetic oligonucleotide
  Target: SCN10A; (-) strand; PAM type: YTN; PAM sequence: TTT
aatattgttgagatcatata

SEQ ID NO: 54738 - DNA, 20 bp, Artificial Sequence
  Description of Artificial Sequence: Synthetic oligonucleotide
  Target: SCN10A; (-) strand; PAM type: YTN; PAM sequence: TTA
tatttaatattgttgagatc

SEQ ID NO: 54739 - DNA, 20 bp, Artificial Sequence
  Description of Artificial Sequence: Synthetic oligonucleotide
  Target: SCN10A; (-) strand; PAM type: YTN; PAM sequence: CTA
agtagagaaatcacaaaatc

SEQ ID NO: 54740 - DNA, 20 bp, Artificial Sequence
  Description of Artificial Sequence: Synthetic oligonucleotide
  Target: SCN10A; (-) strand; PAM type: YTN; PAM sequence: TTA
ctaagtagagaaatcacaaa

SEQ ID NO: 54741 - DNA, 20 bp, Artificial Sequence
  Description of Artificial Sequence: Synthetic oligonucleotide
  Target: SCN10A; (-) strand; PAM type: YTN; PAM sequence: CTG
aaaatataaatcagaagatg

SEQ ID NO: 54742 - DNA, 20 bp, Artificial Sequence
  Description of Artificial Sequence: Synthetic oligonucleotide
  Target: SCN10A; (-) strand; PAM type: YTN; PAM sequence: TTG
caaaaaatgcagaacactga

SEQ ID NO: 54743 - DNA, 20 bp, Artificial Sequence
  Description of Artificial Sequence: Synthetic oligonucleotide
  Target: SCN10A; (-) strand; PAM type: YTN; PAM sequence: TTA
aaataaatgaccattgcaaa

SEQ ID NO: 54744 - DNA, 20 bp, Artificial Sequence
  Description of Artificial Sequence: Synthetic oligonucleotide
  Target: SCN10A; (-) strand; PAM type: YTN; PAM sequence: TTT
aaaataaatgaccattgcaa

SEQ ID NO: 54745 - DNA, 20 bp, Artificial Sequence
  Description of Artificial Sequence: Synthetic oligonucleotide
  Target: SCN10A; (-) strand; PAM type: YTN; PAM sequence: TTT
taaaataaatgaccattgca

SEQ ID NO: 54746 - DNA, 20 bp, Artificial Sequence
  Description of Artificial Sequence: Synthetic oligonucleotide
  Target: SCN10A; (-) strand; PAM type: YTN; PAM sequence: TTT
ttaaaataaatgaccattgc

SEQ ID NO: 54747 - DNA, 20 bp, Artificial Sequence
  Description of Artificial Sequence: Synthetic oligonucleotide
  Target: SCN10A; (-) strand; PAM type: YTN; PAM sequence: TTT
tttaaaataaatgaccattg

SEQ ID NO: 54748 - DNA, 20 bp, Artificial Sequence
  Description of Artificial Sequence: Synthetic oligonucleotide
  Target: SCN10A; (-) strand; PAM type: YTN; PAM sequence: TTA
catatcataataaaaaccca

SEQ ID NO: 54749 - DNA, 20 bp, Artificial Sequence
  Description of Artificial Sequence: Synthetic oligonucleotide
  Target: SCN10A; (-) strand; PAM type: YTN; PAM sequence: TTA
tgcatgttacatatcataat

SEQ ID NO: 54750 - DNA, 20 bp, Artificial Sequence
  Description of Artificial Sequence: Synthetic oligonucleotide
  Target: SCN10A; (-) strand; PAM type: YTN; PAM sequence: TTA
ttatgcatgttacatatcat

SEQ ID NO: 54751 - DNA, 20 bp, Artificial Sequence
  Description of Artificial Sequence: Synthetic oligonucleotide
  Target: SCN10A; (-) strand; PAM type: YTN; PAM sequence: TTT
attatgcatgttacatatca

SEQ ID NO: 54752 - DNA, 20 bp, Artificial Sequence
  Description of Artificial Sequence: Synthetic oligonucleotide
  Target: SCN10A; (-) strand; PAM type: YTN; PAM sequence: TTT
tattatgcatgttacatatc

SEQ ID NO: 54753 - DNA, 20 bp, Artificial Sequence
  Description of Artificial Sequence: Synthetic oligonucleotide
  Target: SCN10A; (-) strand; PAM type: YTN; PAM sequence: TTT
ttattatgcatgttacatat

SEQ ID NO: 54754 - DNA, 20 bp, Artificial Sequence
  Description of Artificial Sequence: Synthetic oligonucleotide
  Target: SCN10A; (-) strand; PAM type: YTN; PAM sequence: TTA
tgtacatttttattatgcat

SEQ ID NO: 54755 - DNA, 20 bp, Artificial Sequence
  Description of Artificial Sequence: Synthetic oligonucleotide
  Target: SCN10A; (-) strand; PAM type: YTN; PAM sequence: TTT
atgtacatttttattatgca

SEQ ID NO: 54756 - DNA, 20 bp, Artificial Sequence
  Description of Artificial Sequence: Synthetic oligonucleotide
  Target: SCN10A; (-) strand; PAM type: YTN; PAM sequence: TTT
tatgtacatttttattatgc

SEQ ID NO: 54757 - DNA, 20 bp, Artificial Sequence
  Description of Artificial Sequence: Synthetic oligonucleotide
  Target: SCN10A; (-) strand; PAM type: YTN; PAM sequence: TTA
tgttttatgtacatttttat

SEQ ID NO: 54758 - DNA, 20 bp, Artificial Sequence
  Description of Artificial Sequence: Synthetic oligonucleotide
  Target: SCN10A; (-) strand; PAM type: YTN; PAM sequence: TTT
atgttttatgtacattttta

SEQ ID NO: 54759 - DNA, 20 bp, Artificial Sequence
  Description of Artificial Sequence: Synthetic oligonucleotide
  Target: SCN10A; (-) strand; PAM type: YTN; PAM sequence: TTA
atttatgttttatgtacatt

SEQ ID NO: 54760 - DNA, 20 bp, Artificial Sequence
  Description of Artificial Sequence: Synthetic oligonucleotide
  Target: SCN10A; (-) strand; PAM type: YTN; PAM sequence: TTA
aaataattaatttatgtttt

SEQ ID NO: 54761 - DNA, 20 bp, Artificial Sequence
  Description of Artificial Sequence: Synthetic oligonucleotide
  Target: SCN10A; (-) strand; PAM type: YTN; PAM sequence: TTT
aaaataattaatttatgttt

SEQ ID NO: 54762 - DNA, 20 bp, Artificial Sequence
  Description of Artificial Sequence: Synthetic oligonucleotide
  Target: SCN10A; (-) strand; PAM type: YTN; PAM sequence: TTT
taaaataattaatttatgtt

SEQ ID NO: 54763 - DNA, 20 bp, Artificial Sequence
  Description of Artificial Sequence: Synthetic oligonucleotide
  Target: SCN10A; (-) strand; PAM type: YTN; PAM sequence: TTG
ttttaaaataattaatttat

SEQ ID NO: 54764 - DNA, 20 bp, Artificial Sequence
  Description of Artificial Sequence: Synthetic oligonucleotide
  Target: SCN10A; (-) strand; PAM type: YTN; PAM sequence: TTT
gttttaaaataattaattta

SEQ ID NO: 54765 - DNA, 20 bp, Artificial Sequence
  Description of Artificial Sequence: Synthetic oligonucleotide
  Target: SCN10A; (-) strand; PAM type: YTN; PAM sequence: CTA
atacacaaacatttgtttta

SEQ ID NO: 54766 - DNA, 20 bp, Artificial Sequence
  Description of Artificial Sequence: Synthetic oligonucleotide
  Target: SCN10A; (-) strand; PAM type: YTN; PAM sequence: CTG
actaatacacaaacatttgt

SEQ ID NO: 54767 - DNA, 20 bp, Artificial Sequence
  Description of Artificial Sequence: Synthetic oligonucleotide
  Target: SCN10A; (-) strand; PAM type: YTN; PAM sequence: TTA
aggcaacaaaggctgactaa

SEQ ID NO: 54768 - DNA, 20 bp, Artificial Sequence
  Description of Artificial Sequence: Synthetic oligonucleotide
  Target: SCN10A; (-) strand; PAM type: YTN; PAM sequence: TTG
ttaaggcaacaaaggctgac

SEQ ID NO: 54769 - DNA, 20 bp, Artificial Sequence
  Description of Artificial Sequence: Synthetic oligonucleotide
  Target: SCN10A; (-) strand; PAM type: YTN; PAM sequence: TTT
gttaaggcaacaaaggctga

SEQ ID NO: 54770 - DNA, 20 bp, Artificial Sequence
  Description of Artificial Sequence: Synthetic oligonucleotide
  Target: SCN10A; (-) strand; PAM type: YTN; PAM sequence: TTT
tgttaaggcaacaaaggctg

SEQ ID NO: 54771 - DNA, 20 bp, Artificial Sequence
  Description of Artificial Sequence: Synthetic oligonucleotide
  Target: SCN10A; (-) strand; PAM type: YTN; PAM sequence: CTA
tggtattttgttaaggcaac

SEQ ID NO: 54772 - DNA, 20 bp, Artificial Sequence
  Description of Artificial Sequence: Synthetic oligonucleotide
  Target: SCN10A; (-) strand; PAM type: YTN; PAM sequence: TTG
cataagccacccagtctatg

SEQ ID NO: 54773 - DNA, 20 bp, Artificial Sequence
  Description of Artificial Sequence: Synthetic oligonucleotide
  Target: SCN10A; (-) strand; PAM type: YTN; PAM sequence: CTG
ttgcataagccacccagtct

SEQ ID NO: 54774 - DNA, 20 bp, Artificial Sequence
  Description of Artificial Sequence: Synthetic oligonucleotide
  Target: SCN10A; (-) strand; PAM type: YTN; PAM sequence: TTC
tgttgcataagccacccagt

SEQ ID NO: 54775 - DNA, 20 bp, Artificial Sequence
  Description of Artificial Sequence: Synthetic oligonucleotide
  Target: SCN10A; (-) strand; PAM type: YTN; PAM sequence: TTT
ctgttgcataagccacccag

SEQ ID NO: 54776 - DNA, 20 bp, Artificial Sequence
  Description of Artificial Sequence: Synthetic oligonucleotide
  Target: SCN10A; (-) strand; PAM type: YTN; PAM sequence: TTG
tgagaaaataaatttctgtt

SEQ ID NO: 54777 - DNA, 20 bp, Artificial Sequence
  Description of Artificial Sequence: Synthetic oligonucleotide
  Target: SCN10A; (-) strand; PAM type: YTN; PAM sequence: TTT
gtgagaaaataaatttctgt

SEQ ID NO: 54778 - DNA, 20 bp, Artificial Sequence
  Description of Artificial Sequence: Synthetic oligonucleotide
  Target: SCN10A; (-) strand; PAM type: YTN; PAM sequence: CTC
cagatttgtgagaaaataaa

SEQ ID NO: 54779 - DNA, 20 bp, Artificial Sequence
  Description of Artificial Sequence: Synthetic oligonucleotide
  Target: SCN10A; (-) strand; PAM type: YTN; PAM sequence: TTC
aacctccagatttgtgagaa

SEQ ID NO: 54780 - DNA, 20 bp, Artificial Sequence
  Description of Artificial Sequence: Synthetic oligonucleotide
  Target: SCN10A; (-) strand; PAM type: YTN; PAM sequence: CTT
caacctccagatttgtgaga

SEQ ID NO: 54781 - DNA, 20 bp, Artificial Sequence
  Description of Artificial Sequence: Synthetic oligonucleotide
  Target: SCN10A; (-) strand; PAM type: YTN; PAM sequence: CTC
aggcttcaacctccagattt

SEQ ID NO: 54782 - DNA, 20 bp, Artificial Sequence
  Description of Artificial Sequence: Synthetic oligonucleotide
  Target: SCN10A; (-) strand; PAM type: YTN; PAM sequence: CTG
acatcccaatctcaggcttc

SEQ ID NO: 54783 - DNA, 20 bp, Artificial Sequence
  Description of Artificial Sequence: Synthetic oligonucleotide
  Target: SCN10A; (-) strand; PAM type: YTN; PAM sequence: CTA
tgctgacatcccaatctcag

SEQ ID NO: 54784 - DNA, 20 bp, Artificial Sequence
  Description of Artificial Sequence: Synthetic oligonucleotide
  Target: SCN10A; (-) strand; PAM type: YTN; PAM sequence: TTC
ccagacccaactatgctgac

SEQ ID NO: 54785 - DNA, 20 bp, Artificial Sequence
  Description of Artificial Sequence: Synthetic oligonucleotide
  Target: SCN10A; (-) strand; PAM type: YTN; PAM sequence: TTT
cccagacccaactatgctga

SEQ ID NO: 54786 - DNA, 20 bp, Artificial Sequence
  Description of Artificial Sequence: Synthetic oligonucleotide
  Target: SCN10A; (-) strand; PAM type: YTN; PAM sequence: CTT
tcccagacccaactatgctg

SEQ ID NO: 54787 - DNA, 20 bp, Artificial Sequence
  Description of Artificial Sequence: Synthetic oligonucleotide
  Target: SCN10A; (-) strand; PAM type: YTN; PAM sequence: CTA
gaaagagagtctttcccaga

SEQ ID NO: 54788 - DNA, 20 bp, Artificial Sequence
  Description of Artificial Sequence: Synthetic oligonucleotide
  Target: SCN10A; (-) strand; PAM type: YTN; PAM sequence: CTA
taagctagaaagagagtctt

SEQ ID NO: 54789 - DNA, 20 bp, Artificial Sequence
  Description of Artificial Sequence: Synthetic oligonucleotide
  Target: SCN10A; (-) strand; PAM type: YTN; PAM sequence: TTG
tgtgagaacacaaggacaag

SEQ ID NO: 54790 - DNA, 20 bp, Artificial Sequence
  Description of Artificial Sequence: Synthetic oligonucleotide
  Target: SCN10A; (-) strand; PAM type: YTN; PAM sequence: TTT
gtgtgagaacacaaggacaa

SEQ ID NO: 54791 - DNA, 20 bp, Artificial Sequence
  Description of Artificial Sequence: Synthetic oligonucleotide
  Target: SCN10A; (-) strand; PAM type: YTN; PAM sequence: CTT
tgtgtgagaacacaaggaca

SEQ ID NO: 54792 - DNA, 20 bp, Artificial Sequence
  Description of Artificial Sequence: Synthetic oligonucleotide
  Target: SCN10A; (-) strand; PAM type: YTN; PAM sequence: CTC
ccctttgtgtgagaacacaa

SEQ ID NO: 54793 - DNA, 20 bp, Artificial Sequence
  Description of Artificial Sequence: Synthetic oligonucleotide
  Target: SCN10A; (-) strand; PAM type: YTN; PAM sequence: TTC
tcccctttgtgtgagaacac

SEQ ID NO: 54794 - DNA, 20 bp, Artificial Sequence
  Description of Artificial Sequence: Synthetic oligonucleotide
  Target: SCN10A; (-) strand; PAM type: YTN; PAM sequence: TTT
ctcccctttgtgtgagaaca

SEQ ID NO: 54795 - DNA, 20 bp, Artificial Sequence
  Description of Artificial Sequence: Synthetic oligonucleotide
  Target: SCN10A; (-) strand; PAM type: YTN; PAM sequence: CTT
tctcccctttgtgtgagaac

SEQ ID NO: 54796 - DNA, 20 bp, Artificial Sequence
  Description of Artificial Sequence: Synthetic oligonucleotide
  Target: SCN10A; (-) strand; PAM type: YTN; PAM sequence: TTA
taagagaaagagacagcttt

SEQ ID NO: 54797 - DNA, 20 bp, Artificial Sequence
  Description of Artificial Sequence: Synthetic oligonucleotide
  Target: SCN10A; (-) strand; PAM type: YTN; PAM sequence: CTT
ataagagaaagagacagctt

SEQ ID NO: 54798 - DNA, 20 bp, Artificial Sequence
  Description of Artificial Sequence: Synthetic oligonucleotide
  Target: SCN10A; (-) strand; PAM type: YTN; PAM sequence: CTG
gtgtccttataagagaaaga

SEQ ID NO: 54799 - DNA, 20 bp, Artificial Sequence
  Description of Artificial Sequence: Synthetic oligonucleotide
  Target: SCN10A; (-) strand; PAM type: YTN; PAM sequence: TTA
agtggtagaactggtgtcct

SEQ ID NO: 54800 - DNA, 20 bp, Artificial Sequence
  Description of Artificial Sequence: Synthetic oligonucleotide
  Target: SCN10A; (-) strand; PAM type: YTN; PAM sequence: CTT
aagtggtagaactggtgtcc

SEQ ID NO: 54801 - DNA, 20 bp, Artificial Sequence
  Description of Artificial Sequence: Synthetic oligonucleotide
  Target: SCN10A; (-) strand; PAM type: YTN; PAM sequence: TTA
aatgaagtcacaagagtaga

SEQ ID NO: 54802 - DNA, 20 bp, Artificial Sequence
  Description of Artificial Sequence: Synthetic oligonucleotide
  Target: SCN10A; (-) strand; PAM type: YTN; PAM sequence: TTG
ggttaaatgaagtcacaaga

SEQ ID NO: 54803 - DNA, 20 bp, Artificial Sequence
  Description of Artificial Sequence: Synthetic oligonucleotide
  Target: SCN10A; (-) strand; PAM type: YTN; PAM sequence: CTA
aggaggtgattgggttaaat

SEQ ID NO: 54804 - DNA, 20 bp, Artificial Sequence
  Description of Artificial Sequence: Synthetic oligonucleotide
  Target: SCN10A; (-) strand; PAM type: YTN; PAM sequence: CTC
taaggaggtgattgggttaa

SEQ ID NO: 54805 - DNA, 20 bp, Artificial Sequence
  Description of Artificial Sequence: Synthetic oligonucleotide
  Target: SCN10A; (-) strand; PAM type: YTN; PAM sequence: TTG
ggcctctaaggaggtgattg

SEQ ID NO: 54806 - DNA, 20 bp, Artificial Sequence
  Description of Artificial Sequence: Synthetic oligonucleotide
  Target: SCN10A; (-) strand; PAM type: YTN; PAM sequence: TTG
gagattgggcctctaaggag

SEQ ID NO: 54807 - DNA, 20 bp, Artificial Sequence
  Description of Artificial Sequence: Synthetic oligonucleotide
  Target: SCN10A; (-) strand; PAM type: YTN; PAM sequence: CTA
tgttggagattgggcctcta

SEQ ID NO: 54808 - DNA, 20 bp, Artificial Sequence
  Description of Artificial Sequence: Synthetic oligonucleotide
  Target: SCN10A; (-) strand; PAM type: YTN; PAM sequence: TTG
ctatgttggagattgggcct

SEQ ID NO: 54809 - DNA, 20 bp, Artificial Sequence
  Description of Artificial Sequence: Synthetic oligonucleotide
  Target: SCN10A; (-) strand; PAM type: YTN; PAM sequence: TTG
aaacaaaccccccatgttgc

SEQ ID NO: 54810 - DNA, 20 bp, Artificial Sequence
  Description of Artificial Sequence: Synthetic oligonucleotide
  Target: SCN10A; (-) strand; PAM type: YTN; PAM sequence: TTC
aaatgttgaaacaaaccccc

SEQ ID NO: 54811 - DNA, 20 bp, Artificial Sequence
  Description of Artificial Sequence: Synthetic oligonucleotide
  Target: SCN10A; (-) strand; PAM type: YTN; PAM sequence: CTC
aaaattcaaatgttgaaaca

SEQ ID NO: 54812 - DNA, 20 bp, Artificial Sequence
  Description of Artificial Sequence: Synthetic oligonucleotide
  Target: SCN10A; (-) strand; PAM type: YTN; PAM sequence: TTG
tcccctcaaaattcaaatgt

SEQ ID NO: 54813 - DNA, 20 bp, Artificial Sequence
  Description of Artificial Sequence: Synthetic oligonucleotide
  Target: SCN10A; (-) strand; PAM type: YTN; PAM sequence: TTT
gtcccctcaaaattcaaatg

SEQ ID NO: 54814 - DNA, 20 bp, Artificial Sequence
  Description of Artificial Sequence: Synthetic oligonucleotide
  Target: SCN10A; (-) strand; PAM type: YTN; PAM sequence: TTT
tgtcccctcaaaattcaaat

SEQ ID NO: 54815 - DNA, 20 bp, Artificial Sequence
  Description of Artificial Sequence: Synthetic oligonucleotide
  Target: SCN10A; (-) strand; PAM type: YTN; PAM sequence: CTA
tggagtgaattttgtcccct

SEQ ID NO: 54816 - DNA, 20 bp, Artificial Sequence
  Description of Artificial Sequence: Synthetic oligonucleotide
  Target: SCN10A; (-) strand; PAM type: YTN; PAM sequence: CTG
ctatggagtgaattttgtcc

SEQ ID NO: 54817 - DNA, 20 bp, Artificial Sequence
  Description of Artificial Sequence: Synthetic oligonucleotide
  Target: SCN10A; (-) strand; PAM type: YTN; PAM sequence: TTG
tcacacaagctgctatggag

SEQ ID NO: 54818 - DNA, 20 bp, Artificial Sequence
  Description of Artificial Sequence: Synthetic oligonucleotide
  Target: SCN10A; (-) strand; PAM type: YTN; PAM sequence: TTA
tggcatgggtagttgtcaca

SEQ ID NO: 54819 - DNA, 20 bp, Artificial Sequence
  Description of Artificial Sequence: Synthetic oligonucleotide
  Target: SCN10A; (-) strand; PAM type: YTN; PAM sequence: TTT
atggcatgggtagttgtcac

SEQ ID NO: 54820 - DNA, 20 bp, Artificial Sequence
  Description of Artificial Sequence: Synthetic oligonucleotide
  Target: SCN10A; (-) strand; PAM type: YTN; PAM sequence: TTT
tatggcatgggtagttgtca

SEQ ID NO: 54821 - DNA, 20 bp, Artificial Sequence
  Description of Artificial Sequence: Synthetic oligonucleotide
  Target: SCN10A; (-) strand; PAM type: YTN; PAM sequence: TTC
cattttatggcatgggtagt

SEQ ID NO: 54822 - DNA, 20 bp, Artificial Sequence
  Description of Artificial Sequence: Synthetic oligonucleotide
  Target: SCN10A; (-) strand; PAM type: YTN; PAM sequence: CTG
gtcacgttccattttatggc

SEQ ID NO: 54823 - DNA, 20 bp, Artificial Sequence
  Description of Artificial Sequence: Synthetic oligonucleotide
  Target: SCN10A; (-) strand; PAM type: YTN; PAM sequence: CTG
gtgaagtgctggtcacgttc

SEQ ID NO: 54824 - DNA, 20 bp, Artificial Sequence
  Description of Artificial Sequence: Synthetic oligonucleotide
  Target: SCN10A; (-) strand; PAM type: YTN; PAM sequence: TTG
ggaaggagctggtgaagtgc

SEQ ID NO: 54825 - DNA, 20 bp, Artificial Sequence
  Description of Artificial Sequence: Synthetic oligonucleotide
  Target: SCN10A; (-) strand; PAM type: YTN; PAM sequence: CTC
cagggcagaagagggaggat

SEQ ID NO: 54826 - DNA, 20 bp, Artificial Sequence
  Description of Artificial Sequence: Synthetic oligonucleotide
  Target: SCN10A; (-) strand; PAM type: YTN; PAM sequence: TTA
ggagaatagtggcctccagg

SEQ ID NO: 54827 - DNA, 20 bp, Artificial Sequence
  Description of Artificial Sequence: Synthetic oligonucleotide
  Target: SCN10A; (-) strand; PAM type: YTN; PAM sequence: TTA
tgaagtaaaaagcatcaata

SEQ ID NO: 54828 - DNA, 20 bp, Artificial Sequence
  Description of Artificial Sequence: Synthetic oligonucleotide
  Target: SCN10A; (-) strand; PAM type: YTN; PAM sequence: CTT
atgaagtaaaaagcatcaat

SEQ ID NO: 54829 - DNA, 20 bp, Artificial Sequence
  Description of Artificial Sequence: Synthetic oligonucleotide
  Target: SCN10A; (-) strand; PAM type: YTN; PAM sequence: TTA
ggaatgcatacttatgaagt

SEQ ID NO: 54830 - DNA, 20 bp, Artificial Sequence
  Description of Artificial Sequence: Synthetic oligonucleotide
  Target: SCN10A; (-) strand; PAM type: YTN; PAM sequence: TTT
aggaatgcatacttatgaag

SEQ ID NO: 54831 - DNA, 20 bp, Artificial Sequence
  Description of Artificial Sequence: Synthetic oligonucleotide
  Target: SCN10A; (-) strand; PAM type: YTN; PAM sequence: TTG
tttaggaatgcatacttatg

SEQ ID NO: 54832 - DNA, 20 bp, Artificial Sequence
  Description of Artificial Sequence: Synthetic oligonucleotide
  Target: SCN10A; (-) strand; PAM type: YTN; PAM sequence: TTT
gtttaggaatgcatacttat

SEQ ID NO: 54833 - DNA, 20 bp, Artificial Sequence
  Description of Artificial Sequence: Synthetic oligonucleotide
  Target: SCN10A; (-) strand; PAM type: YTN; PAM sequence: TTT
tgtttaggaatgcatactta

SEQ ID NO: 54834 - DNA, 20 bp, Artificial Sequence
  Description of Artificial Sequence: Synthetic oligonucleotide
  Target: SCN10A; (-) strand; PAM type: YTN; PAM sequence: CTA
ttttgtttaggaatgcatac

SEQ ID NO: 54835 - DNA, 20 bp, Artificial Sequence
  Description of Artificial Sequence: Synthetic oligonucleotide
  Target: SCN10A; (-) strand; PAM type: YTN; PAM sequence: CTA
aactattttgtttaggaatg

SEQ ID NO: 54836 - DNA, 20 bp, Artificial Sequence
  Description of Artificial Sequence: Synthetic oligonucleotide
  Target: SCN10A; (-) strand; PAM type: YTN; PAM sequence: TTG
aaatcaagcaaaactaaact

SEQ ID NO: 54837 - DNA, 20 bp, Artificial Sequence
  Description of Artificial Sequence: Synthetic oligonucleotide
  Target: SCN10A; (-) strand; PAM type: YTN; PAM sequence: TTT
gaaatcaagcaaaactaaac

SEQ ID NO: 54838 - DNA, 20 bp, Artificial Sequence
  Description of Artificial Sequence: Synthetic oligonucleotide
  Target: SCN10A; (-) strand; PAM type: YTN; PAM sequence: TTA
tataaagtttgaaatcaagc

SEQ ID NO: 54839 - DNA, 20 bp, Artificial Sequence
  Description of Artificial Sequence: Synthetic oligonucleotide
  Target: SCN10A; (-) strand; PAM type: YTN; PAM sequence: TTT
atataaagtttgaaatcaag

SEQ ID NO: 54840 - DNA, 20 bp, Artificial Sequence
  Description of Artificial Sequence: Synthetic oligonucleotide
  Target: SCN10A; (-) strand; PAM type: YTN; PAM sequence: TTC
atttatataaagtttgaaat

SEQ ID NO: 54841 - DNA, 20 bp, Artificial Sequence
  Description of Artificial Sequence: Synthetic oligonucleotide
  Target: SCN10A; (-) strand; PAM type: YTN; PAM sequence: TTA
cataaacaaggttcatttat

SEQ ID NO: 54842 - DNA, 20 bp, Artificial Sequence
  Description of Artificial Sequence: Synthetic oligonucleotide
  Target: SCN10A; (-) strand; PAM type: YTN; PAM sequence: TTG
aacaaaaaaagccaaatgca

SEQ ID NO: 54843 - DNA, 20 bp, Artificial Sequence
  Description of Artificial Sequence: Synthetic oligonucleotide
  Target: SCN10A; (-) strand; PAM type: YTN; PAM sequence: TTA
agaaagtaatattgaacaaa

SEQ ID NO: 54844 - DNA, 20 bp, Artificial Sequence
  Description of Artificial Sequence: Synthetic oligonucleotide
  Target: SCN10A; (-) strand; PAM type: YTN; PAM sequence: CTT
aagaaagtaatattgaacaa

SEQ ID NO: 54845 - DNA, 20 bp, Artificial Sequence
  Description of Artificial Sequence: Synthetic oligonucleotide
  Target: SCN10A; (-) strand; PAM type: YTN; PAM sequence: CTG
cacaacaataaggatgagtc

SEQ ID NO: 54846 - DNA, 20 bp, Artificial Sequence
  Description of Artificial Sequence: Synthetic oligonucleotide
  Target: SCN10A; (-) strand; PAM type: YTN; PAM sequence: TTA
gtgctgcacaacaataagga

SEQ ID NO: 54847 - DNA, 20 bp, Artificial Sequence
  Description of Artificial Sequence: Synthetic oligonucleotide
  Target: SCN10A; (-) strand; PAM type: YTN; PAM sequence: TTT
agtgctgcacaacaataagg

SEQ ID NO: 54848 - DNA, 20 bp, Artificial Sequence
  Description of Artificial Sequence: Synthetic oligonucleotide
  Target: SCN10A; (-) strand; PAM type: YTN; PAM sequence: CTT
tagtgctgcacaacaataag

SEQ ID NO: 54849 - DNA, 20 bp, Artificial Sequence
  Description of Artificial Sequence: Synthetic oligonucleotide
  Target: SCN10A; (-) strand; PAM type: YTN; PAM sequence: TTA
ataaactttagtgctgcaca

SEQ ID NO: 54850 - DNA, 20 bp, Artificial Sequence
  Description of Artificial Sequence: Synthetic oligonucleotide
  Target: SCN10A; (-) strand; PAM type: YTN; PAM sequence: TTA
cagcaataaaaattaataaa

SEQ ID NO: 54851 - DNA, 20 bp, Artificial Sequence
  Description of Artificial Sequence: Synthetic oligonucleotide
  Target: SCN10A; (-) strand; PAM type: YTN; PAM sequence: CTT
acagcaataaaaattaataa

SEQ ID NO: 54852 - DNA, 20 bp, Artificial Sequence
  Description of Artificial Sequence: Synthetic oligonucleotide
  Target: SCN10A; (-) strand; PAM type: YTN; PAM sequence: CTA
aaatgagaaaacttacagca

SEQ ID NO: 54853 - DNA, 20 bp, Artificial Sequence
  Description of Artificial Sequence: Synthetic oligonucleotide
  Target: SCN10A; (-) strand; PAM type: YTN; PAM sequence: TTC
taaaatgagaaaacttacag

SEQ ID NO: 54854 - DNA, 20 bp, Artificial Sequence
  Description of Artificial Sequence: Synthetic oligonucleotide
  Target: SCN10A; (-) strand; PAM type: YTN; PAM sequence: TTA
tattctaaaatgagaaaact

SEQ ID NO: 54855 - DNA, 20 bp, Artificial Sequence
  Description of Artificial Sequence: Synthetic oligonucleotide
  Target: SCN10A; (-) strand; PAM type: YTN; PAM sequence: CTG
ttatattctaaaatgagaaa

SEQ ID NO: 54856 - DNA, 20 bp, Artificial Sequence
  Description of Artificial Sequence: Synthetic oligonucleotide
  Target: SCN10A; (-) strand; PAM type: YTN; PAM sequence: TTC
tgttatattctaaaatgaga

SEQ ID NO: 54857 - DNA, 20 bp, Artificial Sequence
  Description of Artificial Sequence: Synthetic oligonucleotide
  Target: SCN10A; (-) strand; PAM type: YTN; PAM sequence: TTT
ctgttatattctaaaatgag

SEQ ID NO: 54858 - DNA, 20 bp, Artificial Sequence
  Description of Artificial Sequence: Synthetic oligonucleotide
  Target: SCN10A; (-) strand; PAM type: YTN; PAM sequence: CTA
tttctgttatattctaaaat

SEQ ID NO: 54859 - DNA, 20 bp, Artificial Sequence
  Description of Artificial Sequence: Synthetic oligonucleotide
  Target: SCN10A; (-) strand; PAM type: YTN; PAM sequence: TTA
actatttctgttatattcta

SEQ ID NO: 54860 - DNA, 20 bp, Artificial Sequence
  Description of Artificial Sequence: Synthetic oligonucleotide
  Target: SCN10A; (-) strand; PAM type: YTN; PAM sequence: TTG
agtacattaactatttctgt

SEQ ID NO: 54861 - DNA, 20 bp, Artificial Sequence
  Description of Artificial Sequence: Synthetic oligonucleotide
  Target: SCN10A; (-) strand; PAM type: YTN; PAM sequence: TTT
gagtacattaactatttctg

SEQ ID NO: 54862 - DNA, 20 bp, Artificial Sequence
  Description of Artificial Sequence: Synthetic oligonucleotide
  Target: SCN10A; (-) strand; PAM type: YTN; PAM sequence: CTT
tgagtacattaactatttct

SEQ ID NO: 54863 - DNA, 20 bp, Artificial Sequence
  Description of Artificial Sequence: Synthetic oligonucleotide
  Target: SCN10A; (-) strand; PAM type: YTN; PAM sequence: CTC
aaatgtccataaactttgag

SEQ ID NO: 54864 - DNA, 20 bp, Artificial Sequence
  Description of Artificial Sequence: Synthetic oligonucleotide
  Target: SCN10A; (-) strand; PAM type: YTN; PAM sequence: TTG
cccataaaaaccccaaaccg

SEQ ID NO: 54865 - DNA, 20 bp, Artificial Sequence
  Description of Artificial Sequence: Synthetic oligonucleotide
  Target: SCN10A; (-) strand; PAM type: YTN; PAM sequence: TTT
gcccataaaaaccccaaacc

SEQ ID NO: 54866 - DNA, 20 bp, Artificial Sequence
  Description of Artificial Sequence: Synthetic oligonucleotide
  Target: SCN10A; (-) strand; PAM type: YTN; PAM sequence: TTA
tgaacatttgcccataaaaa

SEQ ID NO: 54867 - DNA, 20 bp, Artificial Sequence
  Description of Artificial Sequence: Synthetic oligonucleotide
  Target: SCN10A; (-) strand; PAM type: YTN; PAM sequence: TTT
atgaacatttgcccataaaa

SEQ ID NO: 54868 - DNA, 20 bp, Artificial Sequence
  Description of Artificial Sequence: Synthetic oligonucleotide
  Target: SCN10A; (-) strand; PAM type: YTN; PAM sequence: CTA
caagaaagtttatgaacatt

SEQ ID NO: 54869 - DNA, 20 bp, Artificial Sequence
  Description of Artificial Sequence: Synthetic oligonucleotide
  Target: SCN10A; (-) strand; PAM type: YTN; PAM sequence: TTA
cagctacaagaaagtttatg

SEQ ID NO: 54870 - DNA, 20 bp, Artificial Sequence
  Description of Artificial Sequence: Synthetic oligonucleotide
  Target: SCN10A; (-) strand; PAM type: YTN; PAM sequence: TTG
tggacaccagattacagcta

SEQ ID NO: 54871 - DNA, 20 bp, Artificial Sequence
  Description of Artificial Sequence: Synthetic oligonucleotide
  Target: SCN10A; (-) strand; PAM type: YTN; PAM sequence: CTT
gtggacaccagattacagct

SEQ ID NO: 54872 - DNA, 20 bp, Artificial Sequence
  Description of Artificial Sequence: Synthetic oligonucleotide
  Target: SCN10A; (-) strand; PAM type: YTN; PAM sequence: TTA
acagaaatatgtacttgtgg

SEQ ID NO: 54873 - DNA, 20 bp, Artificial Sequence
  Description of Artificial Sequence: Synthetic oligonucleotide
  Target: SCN10A; (-) strand; PAM type: YTN; PAM sequence: TTT
aacagaaatatgtacttgtg

SEQ ID NO: 54874 - DNA, 20 bp, Artificial Sequence
  Description of Artificial Sequence: Synthetic oligonucleotide
  Target: SCN10A; (-) strand; PAM type: YTN; PAM sequence: CTA
tgtttaacagaaatatgtac

SEQ ID NO: 54875 - DNA, 20 bp, Artificial Sequence
  Description of Artificial Sequence: Synthetic oligonucleotide
  Target: SCN10A; (-) strand; PAM type: YTN; PAM sequence: TTA
ggtacctatgtttaacagaa

SEQ ID NO: 54876 - DNA, 20 bp, Artificial Sequence
  Description of Artificial Sequence: Synthetic oligonucleotide
  Target: SCN10A; (-) strand; PAM type: YTN; PAM sequence: CTT
aggtacctatgtttaacaga

SEQ ID NO: 54877 - DNA, 20 bp, Artificial Sequence
  Description of Artificial Sequence: Synthetic oligonucleotide
  Target: SCN10A; (-) strand; PAM type: YTN; PAM sequence: TTA
cacccttaggtacctatgtt

SEQ ID NO: 54878 - DNA, 20 bp, Artificial Sequence
  Description of Artificial Sequence: Synthetic oligonucleotide
  Target: SCN10A; (-) strand; PAM type: YTN; PAM sequence: CTA
ttacacccttaggtacctat

SEQ ID NO: 54879 - DNA, 20 bp, Artificial Sequence
  Description of Artificial Sequence: Synthetic oligonucleotide
  Target: SCN10A; (-) strand; PAM type: YTN; PAM sequence: TTC
tattacacccttaggtacct

SEQ ID NO: 54880 - DNA, 20 bp, Artificial Sequence
  Description of Artificial Sequence: Synthetic oligonucleotide
  Target: SCN10A; (-) strand; PAM type: YTN; PAM sequence: CTT
ctattacacccttaggtacc

SEQ ID NO: 54881 - DNA, 20 bp, Artificial Sequence
  Description of Artificial Sequence: Synthetic oligonucleotide
  Target: SCN10A; (-) strand; PAM type: YTN; PAM sequence: TTC
ttctattacacccttaggta

SEQ ID NO: 54882 - DNA, 20 bp, Artificial Sequence
  Description of Artificial Sequence: Synthetic oligonucleotide
  Target: SCN10A; (-) strand; PAM type: YTN; PAM sequence: CTG
tattcttctattacaccctt

SEQ ID NO: 54883 - DNA, 20 bp, Artificial Sequence
  Description of Artificial Sequence: Synthetic oligonucleotide
  Target: SCN10A; (-) strand; PAM type: YTN; PAM sequence: CTA
gtaaaggtgtaagcatacat

SEQ ID NO: 54884 - DNA, 20 bp, Artificial Sequence
  Description of Artificial Sequence: Synthetic oligonucleotide
  Target: SCN10A; (-) strand; PAM type: YTN; PAM sequence: TTA
tctagtaaaggtgtaagcat

SEQ ID NO: 54885 - DNA, 20 bp, Artificial Sequence
  Description of Artificial Sequence: Synthetic oligonucleotide
  Target: SCN10A; (-) strand; PAM type: YTN; PAM sequence: TTG
gaaagcaaggggtattatct

SEQ ID NO: 54886 - DNA, 20 bp, Artificial Sequence
  Description of Artificial Sequence: Synthetic oligonucleotide
  Target: SCN10A; (-) strand; PAM type: YTN; PAM sequence: TTT
ggaaagcaaggggtattatc

SEQ ID NO: 54887 - DNA, 20 bp, Artificial Sequence
  Description of Artificial Sequence: Synthetic oligonucleotide
  Target: SCN10A; (-) strand; PAM type: YTN; PAM sequence: CTT
tggaaagcaaggggtattat

SEQ ID NO: 54888 - DNA, 20 bp, Artificial Sequence
  Description of Artificial Sequence: Synthetic oligonucleotide
  Target: SCN10A; (-) strand; PAM type: YTN; PAM sequence: CTC
tttggaaagcaaggggtatt

SEQ ID NO: 54889 - DNA, 20 bp, Artificial Sequence
  Description of Artificial Sequence: Synthetic oligonucleotide
  Target: SCN10A; (-) strand; PAM type: YTN; PAM sequence: TTG
gacaacctctttggaaagca

SEQ ID NO: 54890 - DNA, 20 bp, Artificial Sequence
  Description of Artificial Sequence: Synthetic oligonucleotide
  Target: SCN10A; (-) strand; PAM type: YTN; PAM sequence: TTT
ggacaacctctttggaaagc

SEQ ID NO: 54891 - DNA, 20 bp, Artificial Sequence
  Description of Artificial Sequence: Synthetic oligonucleotide
  Target: SCN10A; (-) strand; PAM type: YTN; PAM sequence: CTG
gtgggagtgtaaatttggac

SEQ ID NO: 54892 - DNA, 20 bp, Artificial Sequence
  Description of Artificial Sequence: Synthetic oligonucleotide
  Target: SCN10A; (-) strand; PAM type: YTN; PAM sequence: CTG
ctggtgggagtgtaaatttg

SEQ ID NO: 54893 - DNA, 20 bp, Artificial Sequence
  Description of Artificial Sequence: Synthetic oligonucleotide
  Target: SCN10A; (-) strand; PAM type: YTN; PAM sequence: CTC
acacactgctggtgggagtg

SEQ ID NO: 54894 - DNA, 20 bp, Artificial Sequence
  Description of Artificial Sequence: Synthetic oligonucleotide
  Target: SCN10A; (-) strand; PAM type: YTN; PAM sequence: TTG
ggaatgacatggagcaacag

SEQ ID NO: 54895 - DNA, 20 bp, Artificial Sequence
  Description of Artificial Sequence: Synthetic oligonucleotide
  Target: SCN10A; (-) strand; PAM type: YTN; PAM sequence: TTA
aagtgtcacaataccaagta

SEQ ID NO: 54896 - DNA, 20 bp, Artificial Sequence
  Description of Artificial Sequence: Synthetic oligonucleotide
  Target: SCN10A; (-) strand; PAM type: YTN; PAM sequence: TTT
aaagtgtcacaataccaagt

SEQ ID NO: 54897 - DNA, 20 bp, Artificial Sequence
  Description of Artificial Sequence: Synthetic oligonucleotide
  Target: SCN10A; (-) strand; PAM type: YTN; PAM sequence: TTT
taaagtgtcacaataccaag

SEQ ID NO: 54898 - DNA, 20 bp, Artificial Sequence
  Description of Artificial Sequence: Synthetic oligonucleotide
  Target: SCN10A; (-) strand; PAM type: YTN; PAM sequence: TTT
ttaaagtgtcacaataccaa

SEQ ID NO: 54899 - DNA, 20 bp, Artificial Sequence
  Description of Artificial Sequence: Synthetic oligonucleotide
  Target: SCN10A; (-) strand; PAM type: YTN; PAM sequence: TTT
tttaaagtgtcacaatacca

SEQ ID NO: 54900 - DNA, 20 bp, Artificial Sequence
  Description of Artificial Sequence: Synthetic oligonucleotide
  Target: SCN10A; (-) strand; PAM type: YTN; PAM sequence: TTC
atcatagaagggaaattttt

SEQ ID NO: 54901 - DNA, 20 bp, Artificial Sequence
  Description of Artificial Sequence: Synthetic oligonucleotide
  Target: SCN10A; (-) strand; PAM type: YTN; PAM sequence: TTA
catgttcatcatagaaggga

SEQ ID NO: 54902 - DNA, 20 bp, Artificial Sequence
  Description of Artificial Sequence: Synthetic oligonucleotide
  Target: SCN10A; (-) strand; PAM type: YTN; PAM sequence: TTA
ttacatgttcatcatagaag

SEQ ID NO: 54903 - DNA, 20 bp, Artificial Sequence
  Description of Artificial Sequence: Synthetic oligonucleotide
  Target: SCN10A; (-) strand; PAM type: YTN; PAM sequence: TTT
attacatgttcatcatagaa

SEQ ID NO: 54904 - DNA, 20 bp, Artificial Sequence
  Description of Artificial Sequence: Synthetic oligonucleotide
  Target: SCN10A; (-) strand; PAM type: YTN; PAM sequence: TTT
tattacatgttcatcataga

SEQ ID NO: 54905 - DNA, 20 bp, Artificial Sequence
  Description of Artificial Sequence: Synthetic oligonucleotide
  Target: SCN10A; (-) strand; PAM type: YTN; PAM sequence: CTG
agattttattacatgttcat

SEQ ID NO: 54906 - DNA, 20 bp, Artificial Sequence
  Description of Artificial Sequence: Synthetic oligonucleotide
  Target: SCN10A; (-) strand; PAM type: YTN; PAM sequence: TTA
aaatcacactgagattttat

SEQ ID NO: 54907 - DNA, 20 bp, Artificial Sequence
  Description of Artificial Sequence: Synthetic oligonucleotide
  Target: SCN10A; (-) strand; PAM type: YTN; PAM sequence: TTG
caaattaaaatcacactgag

SEQ ID NO: 54908 - DNA, 20 bp, Artificial Sequence
  Description of Artificial Sequence: Synthetic oligonucleotide
  Target: SCN10A; (-) strand; PAM type: YTN; PAM sequence: TTA
aatcaaagagttgcaaatta

SEQ ID NO: 54909 - DNA, 20 bp, Artificial Sequence
  Description of Artificial Sequence: Synthetic oligonucleotide
  Target: SCN10A; (-) strand; PAM type: YTN; PAM sequence: TTT
aaatcaaagagttgcaaatt

SEQ ID NO: 54910 - DNA, 20 bp, Artificial Sequence
  Description of Artificial Sequence: Synthetic oligonucleotide
  Target: SCN10A; (-) strand; PAM type: YTN; PAM sequence: TTT
taaatcaaagagttgcaaat

SEQ ID NO: 54911 - DNA, 20 bp, Artificial Sequence
  Description of Artificial Sequence: Synthetic oligonucleotide
  Target: SCN10A; (-) strand; PAM type: YTN; PAM sequence: TTT
ttaaatcaaagagttgcaaa

SEQ ID NO: 54912 - DNA, 20 bp, Artificial Sequence
  Description of Artificial Sequence: Synthetic oligonucleotide
  Target: SCN10A; (-) strand; PAM type: YTN; PAM sequence: TTT
tttaaatcaaagagttgcaa

SEQ ID NO: 54913 - DNA, 20 bp, Artificial Sequence
  Description of Artificial Sequence: Synthetic oligonucleotide
  Target: SCN10A; (-) strand; PAM type: YTN; PAM sequence: TTT
ttttaaatcaaagagttgca

SEQ ID NO: 54914 - DNA, 20 bp, Artificial Sequence
  Description of Artificial Sequence: Synthetic oligonucleotide
  Target: SCN10A; (-) strand; PAM type: YTN; PAM sequence: CTT
tttttaaatcaaagagttgc

SEQ ID NO: 54915 - DNA, 20 bp, Artificial Sequence
  Description of Artificial Sequence: Synthetic oligonucleotide
  Target: SCN10A; (-) strand; PAM type: YTN; PAM sequence: TTA
acctttttttaaatcaaaga

SEQ ID NO: 54916 - DNA, 20 bp, Artificial Sequence
  Description of Artificial Sequence: Synthetic oligonucleotide
  Target: SCN10A; (-) strand; PAM type: YTN; PAM sequence: CTT
aacctttttttaaatcaaag

SEQ ID NO: 54917 - DNA, 20 bp, Artificial Sequence
  Description of Artificial Sequence: Synthetic oligonucleotide
  Target: SCN10A; (-) strand; PAM type: YTN; PAM sequence: TTC
ttaacctttttttaaatcaa

SEQ ID NO: 54918 - DNA, 20 bp, Artificial Sequence
  Description of Artificial Sequence: Synthetic oligonucleotide
  Target: SCN10A; (-) strand; PAM type: YTN; PAM sequence: TTA
caaaagtggaaatccaaatg

SEQ ID NO: 54919 - DNA, 20 bp, Artificial Sequence
  Description of Artificial Sequence: Synthetic oligonucleotide
  Target: SCN10A; (-) strand; PAM type: YTN; PAM sequence: TTT
acaaaagtggaaatccaaat

SEQ ID NO: 54920 - DNA, 20 bp, Artificial Sequence
  Description of Artificial Sequence: Synthetic oligonucleotide
  Target: SCN10A; (-) strand; PAM type: YTN; PAM sequence: CTT
tacaaaagtggaaatccaaa

SEQ ID NO: 54921 - DNA, 20 bp, Artificial Sequence
  Description of Artificial Sequence: Synthetic oligonucleotide
  Target: SCN10A; (-) strand; PAM type: YTN; PAM sequence: TTG
aataggcactttacaaaagt

SEQ ID NO: 54922 - DNA, 20 bp, Artificial Sequence
  Description of Artificial Sequence: Synthetic oligonucleotide
  Target: SCN10A; (-) strand; PAM type: YTN; PAM sequence: TTT
gaataggcactttacaaaag

SEQ ID NO: 54923 - DNA, 20 bp, Artificial Sequence
  Description of Artificial Sequence: Synthetic oligonucleotide
  Target: SCN10A; (-) strand; PAM type: YTN; PAM sequence: TTG
taaaatagcacaaaatttga

SEQ ID NO: 54924 - DNA, 20 bp, Artificial Sequence
  Description of Artificial Sequence: Synthetic oligonucleotide
  Target: SCN10A; (-) strand; PAM type: YTN; PAM sequence: CTT
gtaaaatagcacaaaatttg

SEQ ID NO: 54925 - DNA, 20 bp, Artificial Sequence
  Description of Artificial Sequence: Synthetic oligonucleotide
  Target: SCN10A; (-) strand; PAM type: YTN; PAM sequence: TTA
gaaaaatgtcagaacaacca

SEQ ID NO: 54926 - DNA, 20 bp, Artificial Sequence
  Description of Artificial Sequence: Synthetic oligonucleotide
  Target: SCN10A; (-) strand; PAM type: YTN; PAM sequence: CTA
caaatcaattagaaaaatgt

SEQ ID NO: 54927 - DNA, 20 bp, Artificial Sequence
  Description of Artificial Sequence: Synthetic oligonucleotide
  Target: SCN10A; (-) strand; PAM type: YTN; PAM sequence: CTC
tacaaatcaattagaaaaat

SEQ ID NO: 54928 - DNA, 20 bp, Artificial Sequence
  Description of Artificial Sequence: Synthetic oligonucleotide
  Target: SCN10A; (-) strand; PAM type: YTN; PAM sequence: TTC
agagtaatgaactctacaaa

SEQ ID NO: 54929 - DNA, 20 bp, Artificial Sequence
  Description of Artificial Sequence: Synthetic oligonucleotide
  Target: SCN10A; (-) strand; PAM type: YTN; PAM sequence: TTA
tattcagagtaatgaactct

SEQ ID NO: 54930 - DNA, 20 bp, Artificial Sequence
  Description of Artificial Sequence: Synthetic oligonucleotide
  Target: SCN10A; (-) strand; PAM type: YTN; PAM sequence: CTT
atattcagagtaatgaactc

SEQ ID NO: 54931 - DNA, 20 bp, Artificial Sequence
  Description of Artificial Sequence: Synthetic oligonucleotide
  Target: SCN10A; (-) strand; PAM type: YTN; PAM sequence: TTA
agagcatgaaaaagcaagtg

SEQ ID NO: 54932 - DNA, 20 bp, Artificial Sequence
  Description of Artificial Sequence: Synthetic oligonucleotide
  Target: SCN10A; (-) strand; PAM type: YTN; PAM sequence: TTT
aagagcatgaaaaagcaagt

SEQ ID NO: 54933 - DNA, 20 bp, Artificial Sequence
  Description of Artificial Sequence: Synthetic oligonucleotide
  Target: SCN10A; (-) strand; PAM type: YTN; PAM sequence: CTT
taagagcatgaaaaagcaag

SEQ ID NO: 54934 - DNA, 20 bp, Artificial Sequence
  Description of Artificial Sequence: Synthetic oligonucleotide
  Target: SCN10A; (-) strand; PAM type: YTN; PAM sequence: TTC
atcagaagacaactttaaga

SEQ ID NO: 54935 - DNA, 20 bp, Artificial Sequence
  Description of Artificial Sequence: Synthetic oligonucleotide
  Target: SCN10A; (-) strand; PAM type: YTN; PAM sequence: TTA
agaatgttcatcagaagaca

SEQ ID NO: 54936 - DNA, 20 bp, Artificial Sequence
  Description of Artificial Sequence: Synthetic oligonucleotide
  Target: SCN10A; (-) strand; PAM type: YTN; PAM sequence: CTA
taattaagaatgttcatcag

SEQ ID NO: 54937 - DNA, 20 bp, Artificial Sequence
  Description of Artificial Sequence: Synthetic oligonucleotide
  Target: SCN10A; (-) strand; PAM type: YTN; PAM sequence: TTA
gtatactataattaagaatg

SEQ ID NO: 54938 - DNA, 20 bp, Artificial Sequence
  Description of Artificial Sequence: Synthetic oligonucleotide
  Target: SCN10A; (-) strand; PAM type: YTN; PAM sequence: TTT
agtatactataattaagaat

SEQ ID NO: 54939 - DNA, 20 bp, Artificial Sequence
  Description of Artificial Sequence: Synthetic oligonucleotide
  Target: SCN10A; (-) strand; PAM type: YTN; PAM sequence: TTT
tagtatactataattaagaa

SEQ ID NO: 54940 - DNA, 20 bp, Artificial Sequence
  Description of Artificial Sequence: Synthetic oligonucleotide
  Target: SCN10A; (-) strand; PAM type: YTN; PAM sequence: CTG
atacattttagtatactata

SEQ ID NO: 54941 - DNA, 20 bp, Artificial Sequence
  Description of Artificial Sequence: Synthetic oligonucleotide
  Target: SCN10A; (-) strand; PAM type: YTN; PAM sequence: CTA
tacaggaaaaaactgataca

SEQ ID NO: 54942 - DNA, 20 bp, Artificial Sequence
  Description of Artificial Sequence: Synthetic oligonucleotide
  Target: SCN10A; (-) strand; PAM type: YTN; PAM sequence: CTA
actatacaggaaaaaactga

SEQ ID NO: 54943 - DNA, 20 bp, Artificial Sequence
  Description of Artificial Sequence: Synthetic oligonucleotide
  Target: SCN10A; (-) strand; PAM type: YTN; PAM sequence: TTA
catatgacacaagaagcact

SEQ ID NO: 54944 - DNA, 20 bp, Artificial Sequence
  Description of Artificial Sequence: Synthetic oligonucleotide
  Target: SCN10A; (-) strand; PAM type: YTN; PAM sequence: TTA
ttacatatgacacaagaagc

SEQ ID NO: 54945 - DNA, 20 bp, Artificial Sequence
  Description of Artificial Sequence: Synthetic oligonucleotide
  Target: SCN10A; (-) strand; PAM type: YTN; PAM sequence: TTT
attacatatgacacaagaag

SEQ ID NO: 54946 - DNA, 20 bp, Artificial Sequence
  Description of Artificial Sequence: Synthetic oligonucleotide
  Target: SCN10A; (-) strand; PAM type: YTN; PAM sequence: CTT
tattacatatgacacaagaa

SEQ ID NO: 54947 - DNA, 20 bp, Artificial Sequence
  Description of Artificial Sequence: Synthetic oligonucleotide
  Target: SCN10A; (-) strand; PAM type: YTN; PAM sequence: CTA
agaaaaactttattacatat

SEQ ID NO: 54948 - DNA, 20 bp, Artificial Sequence
  Description of Artificial Sequence: Synthetic oligonucleotide
  Target: SCN10A; (-) strand; PAM type: YTN; PAM sequence: CTC
agactaagaaaaactttatt

SEQ ID NO: 54949 - DNA, 20 bp, Artificial Sequence
  Description of Artificial Sequence: Synthetic oligonucleotide
  Target: SCN10A; (-) strand; PAM type: YTN; PAM sequence: TTA
tgacctcagactaagaaaaa

SEQ ID NO: 54950 - DNA, 20 bp, Artificial Sequence
  Description of Artificial Sequence: Synthetic oligonucleotide
  Target: SCN10A; (-) strand; PAM type: YTN; PAM sequence: TTT
atgacctcagactaagaaaa

SEQ ID NO: 54951 - DNA, 20 bp, Artificial Sequence
  Description of Artificial Sequence: Synthetic oligonucleotide
  Target: SCN10A; (-) strand; PAM type: YTN; PAM sequence: CTT
tatgacctcagactaagaaa

SEQ ID NO: 54952 - DNA, 20 bp, Artificial Sequence
  Description of Artificial Sequence: Synthetic oligonucleotide
  Target: SCN10A; (-) strand; PAM type: YTN; PAM sequence: TTG
aaaggaaaaaacaaagagga

SEQ ID NO: 54953 - DNA, 20 bp, Artificial Sequence
  Description of Artificial Sequence: Synthetic oligonucleotide
  Target: SCN10A; (-) strand; PAM type: YTN; PAM sequence: TTT
gaaaggaaaaaacaaagagg

SEQ ID NO: 54954 - DNA, 20 bp, Artificial Sequence
  Description of Artificial Sequence: Synthetic oligonucleotide
  Target: SCN10A; (-) strand; PAM type: YTN; PAM sequence: TTT
tgaaaggaaaaaacaaagag

SEQ ID NO: 54955 - DNA, 20 bp, Artificial Sequence
  Description of Artificial Sequence: Synthetic oligonucleotide
  Target: SCN10A; (-) strand; PAM type: YTN; PAM sequence: TTT
ttgaaaggaaaaaacaaaga

SEQ ID NO: 54956 - DNA, 20 bp, Artificial Sequence
  Description of Artificial Sequence: Synthetic oligonucleotide
  Target: SCN10A; (-) strand; PAM type: YTN; PAM sequence: CTT
tttgaaaggaaaaaacaaag

SEQ ID NO: 54957 - DNA, 20 bp, Artificial Sequence
  Description of Artificial Sequence: Synthetic oligonucleotide
  Target: SCN10A; (-) strand; PAM type: YTN; PAM sequence: TTG
atcgtggtggataagctttt

SEQ ID NO: 54958 - DNA, 20 bp, Artificial Sequence
  Description of Artificial Sequence: Synthetic oligonucleotide
  Target: SCN10A; (-) strand; PAM type: YTN; PAM sequence: CTT
gatcgtggtggataagcttt

SEQ ID NO: 54959 - DNA, 20 bp, Artificial Sequence
  Description of Artificial Sequence: Synthetic oligonucleotide
  Target: SCN10A; (-) strand; PAM type: YTN; PAM sequence: TTG
atcccaggtatgaagccgac

SEQ ID NO: 54960 - DNA, 20 bp, Artificial Sequence
  Description of Artificial Sequence: Synthetic oligonucleotide
  Target: SCN10A; (-) strand; PAM type: YTN; PAM sequence: TTT
gatcccaggtatgaagccga

SEQ ID NO: 54961 - DNA, 20 bp, Artificial Sequence
  Description of Artificial Sequence: Synthetic oligonucleotide
  Target: SCN10A; (-) strand; PAM type: YTN; PAM sequence: CTT
tgatcccaggtatgaagccg

SEQ ID NO: 54962 - DNA, 20 bp, Artificial Sequence
  Description of Artificial Sequence: Synthetic oligonucleotide
  Target: SCN10A; (-) strand; PAM type: YTN; PAM sequence: TTG
aaccagctttgatcccaggt

SEQ ID NO: 54963 - DNA, 20 bp, Artificial Sequence
  Description of Artificial Sequence: Synthetic oligonucleotide
  Target: SCN10A; (-) strand; PAM type: YTN; PAM sequence: TTG
cgtatgttgaaccagctttg

SEQ ID NO: 54964 - DNA, 20 bp, Artificial Sequence
  Description of Artificial Sequence: Synthetic oligonucleotide
  Target: SCN10A; (-) strand; PAM type: YTN; PAM sequence: CTT
gcgtatgttgaaccagcttt

SEQ ID NO: 54965 - DNA, 20 bp, Artificial Sequence
  Description of Artificial Sequence: Synthetic oligonucleotide
  Target: SCN10A; (-) strand; PAM type: YTN; PAM sequence: TTG
acttgcgtatgttgaaccag

SEQ ID NO: 54966 - DNA, 20 bp, Artificial Sequence
  Description of Artificial Sequence: Synthetic oligonucleotide
  Target: SCN10A; (-) strand; PAM type: YTN; PAM sequence: TTA
ttgacttgcgtatgttgaac

SEQ ID NO: 54967 - DNA, 20 bp, Artificial Sequence
  Description of Artificial Sequence: Synthetic oligonucleotide
  Target: SCN10A; (-) strand; PAM type: YTN; PAM sequence: TTT
attgacttgcgtatgttgaa

SEQ ID NO: 54968 - DNA, 20 bp, Artificial Sequence
  Description of Artificial Sequence: Synthetic oligonucleotide
  Target: SCN10A; (-) strand; PAM type: YTN; PAM sequence: TTA
cgtttattgacttgcgtatg

SEQ ID NO: 54969 - DNA, 20 bp, Artificial Sequence
  Description of Artificial Sequence: Synthetic oligonucleotide
  Target: SCN10A; (-) strand; PAM type: YTN; PAM sequence: TTG
tgtgatggattacgtttatt

SEQ ID NO: 54970 - DNA, 20 bp, Artificial Sequence
  Description of Artificial Sequence: Synthetic oligonucleotide
  Target: SCN10A; (-) strand; PAM type: YTN; PAM sequence: TTT
gtgtgatggattacgtttat

SEQ ID NO: 54971 - DNA, 20 bp, Artificial Sequence
  Description of Artificial Sequence: Synthetic oligonucleotide
  Target: SCN10A; (-) strand; PAM type: YTN; PAM sequence: CTG
tttgtgtgatggattacgtt

SEQ ID NO: 54972 - DNA, 20 bp, Artificial Sequence
  Description of Artificial Sequence: Synthetic oligonucleotide
  Target: SCN10A; (-) strand; PAM type: YTN; PAM sequence: TTC
tgtttgtgtgatggattacg

SEQ ID NO: 54973 - DNA, 20 bp, Artificial Sequence
  Description of Artificial Sequence: Synthetic oligonucleotide
  Target: SCN10A; (-) strand; PAM type: YTN; PAM sequence: TTG
gttctgtttgtgtgatggat

SEQ ID NO: 54974 - DNA, 20 bp, Artificial Sequence
  Description of Artificial Sequence: Synthetic oligonucleotide
  Target: SCN10A; (-) strand; PAM type: YTN; PAM sequence: TTG
tcattggttctgtttgtgtg

SEQ ID NO: 54975 - DNA, 20 bp, Artificial Sequence
  Description of Artificial Sequence: Synthetic oligonucleotide
  Target: SCN10A; (-) strand; PAM type: YTN; PAM sequence: TTT
gtcattggttctgtttgtgt

SEQ ID NO: 54976 - DNA, 20 bp, Artificial Sequence
  Description of Artificial Sequence: Synthetic oligonucleotide
  Target: SCN10A; (-) strand; PAM type: YTN; PAM sequence: TTT
tgtcattggttctgtttgtg

SEQ ID NO: 54977 - DNA, 20 bp, Artificial Sequence
  Description of Artificial Sequence: Synthetic oligonucleotide
  Target: SCN10A; (-) strand; PAM type: YTN; PAM sequence: TTT
ttgtcattggttctgtttgt

SEQ ID NO: 54978 - DNA, 20 bp, Artificial Sequence
  Description of Artificial Sequence: Synthetic oligonucleotide
  Target: SCN10A; (-) strand; PAM type: YTN; PAM sequence: TTG
agataatcacgtggtttttg

SEQ ID NO: 54979 - DNA, 20 bp, Artificial Sequence
  Description of Artificial Sequence: Synthetic oligonucleotide
  Target: SCN10A; (-) strand; PAM type: YTN; PAM sequence: CTA
ttgagataatcacgtggttt

SEQ ID NO: 54980 - DNA, 20 bp, Artificial Sequence
  Description of Artificial Sequence: Synthetic oligonucleotide
  Target: SCN10A; (-) strand; PAM type: YTN; PAM sequence: CTG
catctattgagataatcacg

SEQ ID NO: 54981 - DNA, 20 bp, Artificial Sequence
  Description of Artificial Sequence: Synthetic oligonucleotide
  Target: SCN10A; (-) strand; PAM type: YTN; PAM sequence: TTC
tgcatctattgagataatca

SEQ ID NO: 54982 - DNA, 20 bp, Artificial Sequence
  Description of Artificial Sequence: Synthetic oligonucleotide
  Target: SCN10A; (-) strand; PAM type: YTN; PAM sequence: TTT
ctgcatctattgagataatc

SEQ ID NO: 54983 - DNA, 20 bp, Artificial Sequence
  Description of Artificial Sequence: Synthetic oligonucleotide
  Target: SCN10A; (-) strand; PAM type: YTN; PAM sequence: TTT
tctgcatctattgagataat

SEQ ID NO: 54984 - DNA, 20 bp, Artificial Sequence
  Description of Artificial Sequence: Synthetic oligonucleotide
  Target: SCN10A; (-) strand; PAM type: YTN; PAM sequence: CTT
ttctgcatctattgagataa

SEQ ID NO: 54985 - DNA, 20 bp, Artificial Sequence
  Description of Artificial Sequence: Synthetic oligonucleotide
  Target: SCN10A; (-) strand; PAM type: YTN; PAM sequence: TTG
tcgaagaccttttctgcatc

SEQ ID NO: 54986 - DNA, 20 bp, Artificial Sequence
  Description of Artificial Sequence: Synthetic oligonucleotide
  Target: SCN10A; (-) strand; PAM type: YTN; PAM sequence: TTT
gtcgaagaccttttctgcat

SEQ ID NO: 54987 - DNA, 20 bp, Artificial Sequence
  Description of Artificial Sequence: Synthetic oligonucleotide
  Target: SCN10A; (-) strand; PAM type: YTN; PAM sequence: TTT
tgtcgaagaccttttctgca

SEQ ID NO: 54988 - DNA, 20 bp, Artificial Sequence
  Description of Artificial Sequence: Synthetic oligonucleotide
  Target: SCN10A; (-) strand; PAM type: YTN; PAM sequence: TTG
aattttgtcgaagacctttt

SEQ ID NO: 54989 - DNA, 20 bp, Artificial Sequence
  Description of Artificial Sequence: Synthetic oligonucleotide
  Target: SCN10A; (-) strand; PAM type: YTN; PAM sequence: TTA
gcatgaatgggtgttgaatt

SEQ ID NO: 54990 - DNA, 20 bp, Artificial Sequence
  Description of Artificial Sequence: Synthetic oligonucleotide
  Target: SCN10A; (-) strand; PAM type: YTN; PAM sequence: TTT
agcatgaatgggtgttgaat

SEQ ID NO: 54991 - DNA, 20 bp, Artificial Sequence
  Description of Artificial Sequence: Synthetic oligonucleotide
  Target: SCN10A; (-) strand; PAM type: YTN; PAM sequence: TTT
tagcatgaatgggtgttgaa

SEQ ID NO: 54992 - DNA, 20 bp, Artificial Sequence
  Description of Artificial Sequence: Synthetic oligonucleotide
  Target: SCN10A; (-) strand; PAM type: YTN; PAM sequence: CTT
ttagcatgaatgggtgttga

SEQ ID NO: 54993 - DNA, 20 bp, Artificial Sequence
  Description of Artificial Sequence: Synthetic oligonucleotide
  Target: SCN10A; (-) strand; PAM type: YTN; PAM sequence: TTG
agagcttttagcatgaatgg

SEQ ID NO: 54994 - DNA, 20 bp, Artificial Sequence
  Description of Artificial Sequence: Synthetic oligonucleotide
  Target: SCN10A; (-) strand; PAM type: YTN; PAM sequence: TTA
ttgagagcttttagcatgaa

SEQ ID NO: 54995 - DNA, 20 bp, Artificial Sequence
  Description of Artificial Sequence: Synthetic oligonucleotide
  Target: SCN10A; (-) strand; PAM type: YTN; PAM sequence: TTT
attgagagcttttagcatga

SEQ ID NO: 54996 - DNA, 20 bp, Artificial Sequence
  Description of Artificial Sequence: Synthetic oligonucleotide
  Target: SCN10A; (-) strand; PAM type: YTN; PAM sequence: CTA
gtttattgagagcttttagc

SEQ ID NO: 54997 - DNA, 20 bp, Artificial Sequence
  Description of Artificial Sequence: Synthetic oligonucleotide
  Target: SCN10A; (-) strand; PAM type: YTN; PAM sequence: TTC
catcaatacctagtttattg

SEQ ID NO: 54998 - DNA, 20 bp, Artificial Sequence
  Description of Artificial Sequence: Synthetic oligonucleotide
  Target: SCN10A; (-) strand; PAM type: YTN; PAM sequence: TTG
agatacattccatcaatacc

SEQ ID NO: 54999 - DNA, 20 bp, Artificial Sequence
  Description of Artificial Sequence: Synthetic oligonucleotide
  Target: SCN10A; (-) strand; PAM type: YTN; PAM sequence: TTT
gagatacattccatcaatac

SEQ ID NO: 55000 - DNA, 20 bp, Artificial Sequence
  Description of Artificial Sequence: Synthetic oligonucleotide
  Target: SCN10A; (-) strand; PAM type: YTN; PAM sequence: TTT
tgagatacattccatcaata

SEQ ID NO: 55001 - DNA, 20 bp, Artificial Sequence
  Description of Artificial Sequence: Synthetic oligonucleotide
  Target: SCN10A; (-) strand; PAM type: YTN; PAM sequence: TTA
ttttgagatacattccatca

SEQ ID NO: 55002 - DNA, 20 bp, Artificial Sequence
  Description of Artificial Sequence: Synthetic oligonucleotide
  Target: SCN10A; (-) strand; PAM type: YTN; PAM sequence: TTA
ttattttgagatacattcca

SEQ ID NO: 55003 - DNA, 20 bp, Artificial Sequence
  Description of Artificial Sequence: Synthetic oligonucleotide
  Target: SCN10A; (-) strand; PAM type: YTN; PAM sequence: CTT
attattttgagatacattcc

SEQ ID NO: 55004 - DNA, 20 bp, Artificial Sequence
  Description of Artificial Sequence: Synthetic oligonucleotide
  Target: SCN10A; (-) strand; PAM type: YTN; PAM sequence: TTC
ttattattttgagatacatt

SEQ ID NO: 55005 - DNA, 20 bp, Artificial Sequence
  Description of Artificial Sequence: Synthetic oligonucleotide
  Target: SCN10A; (-) strand; PAM type: YTN; PAM sequence: TTG
tcataaatagttcttattat

SEQ ID NO: 55006 - DNA, 20 bp, Artificial Sequence
  Description of Artificial Sequence: Synthetic oligonucleotide
  Target: SCN10A; (-) strand; PAM type: YTN; PAM sequence: CTT
gtcataaatagttcttatta

SEQ ID NO: 55007 - DNA, 20 bp, Artificial Sequence
  Description of Artificial Sequence: Synthetic oligonucleotide
  Target: SCN10A; (-) strand; PAM type: YTN; PAM sequence: CTG
ggggcttgtcataaatagtt

SEQ ID NO: 55008 - DNA, 20 bp, Artificial Sequence
  Description of Artificial Sequence: Synthetic oligonucleotide
  Target: SCN10A; (-) strand; PAM type: YTN; PAM sequence: TTG
gctgggggcttgtcataaat

SEQ ID NO: 55009 - DNA, 20 bp, Artificial Sequence
  Description of Artificial Sequence: Synthetic oligonucleotide
  Target: SCN10A; (-) strand; PAM type: YTN; PAM sequence: TTC
agtatgatattggctggggg

SEQ ID NO: 55010 - DNA, 20 bp, Artificial Sequence
  Description of Artificial Sequence: Synthetic oligonucleotide
  Target: SCN10A; (-) strand; PAM type: YTN; PAM sequence: TTG
cccattcagtatgatattgg

SEQ ID NO: 55011 - DNA, 20 bp, Artificial Sequence
  Description of Artificial Sequence: Synthetic oligonucleotide
  Target: SCN10A; (-) strand; PAM type: YTN; PAM sequence: TTT
gcccattcagtatgatattg

SEQ ID NO: 55012 - DNA, 20 bp, Artificial Sequence
  Description of Artificial Sequence: Synthetic oligonucleotide
  Target: SCN10A; (-) strand; PAM type: YTN; PAM sequence: TTT
tgcccattcagtatgatatt

SEQ ID NO: 55013 - DNA, 20 bp, Artificial Sequence
  Description of Artificial Sequence: Synthetic oligonucleotide
  Target: SCN10A; (-) strand; PAM type: YTN; PAM sequence: TTT
ttgcccattcagtatgatat

SEQ ID NO: 55014 - DNA, 20 bp, Artificial Sequence
  Description of Artificial Sequence: Synthetic oligonucleotide
  Target: SCN10A; (-) strand; PAM type: YTN; PAM sequence: TTC
cagtttttgcccattcagta

SEQ ID NO: 55015 - DNA, 20 bp, Artificial Sequence
  Description of Artificial Sequence: Synthetic oligonucleotide
  Target: SCN10A; (-) strand; PAM type: YTN; PAM sequence: CTT
ccagtttttgcccattcagt

SEQ ID NO: 55016 - DNA, 20 bp, Artificial Sequence
  Description of Artificial Sequence: Synthetic oligonucleotide
  Target: SCN10A; (-) strand; PAM type: YTN; PAM sequence: TTC
aaaggaaatgcttccagttt

SEQ ID NO: 55017 - DNA, 20 bp, Artificial Sequence
  Description of Artificial Sequence: Synthetic oligonucleotide
  Target: SCN10A; (-) strand; PAM type: YTN; PAM sequence: TTT
caaaggaaatgcttccagtt

SEQ ID NO: 55018 - DNA, 20 bp, Artificial Sequence
  Description of Artificial Sequence: Synthetic oligonucleotide
  Target: SCN10A; (-) strand; PAM type: YTN; PAM sequence: TTT
tcaaaggaaatgcttccagt

SEQ ID NO: 55019 - DNA, 20 bp, Artificial Sequence
  Description of Artificial Sequence: Synthetic oligonucleotide
  Target: SCN10A; (-) strand; PAM type: YTN; PAM sequence: CTG
gttttcaaaggaaatgcttc

SEQ ID NO: 55020 - DNA, 20 bp, Artificial Sequence
  Description of Artificial Sequence: Synthetic oligonucleotide
  Target: SCN10A; (-) strand; PAM type: YTN; PAM sequence: TTG
tgctggttttcaaaggaaat

SEQ ID NO: 55021 - DNA, 20 bp, Artificial Sequence
  Description of Artificial Sequence: Synthetic oligonucleotide
  Target: SCN10A; (-) strand; PAM type: YTN; PAM sequence: CTT
gtgctggttttcaaaggaaa

SEQ ID NO: 55022 - DNA, 20 bp, Artificial Sequence
  Description of Artificial Sequence: Synthetic oligonucleotide
  Target: SCN10A; (-) strand; PAM type: YTN; PAM sequence: TTG
tcttgtgctggttttcaaag

SEQ ID NO: 55023 - DNA, 20 bp, Artificial Sequence
  Description of Artificial Sequence: Synthetic oligonucleotide
  Target: SCN10A; (-) strand; PAM type: YTN; PAM sequence: CTT
gtcttgtgctggttttcaaa

SEQ ID NO: 55024 - DNA, 20 bp, Artificial Sequence
  Description of Artificial Sequence: Synthetic oligonucleotide
  Target: SCN10A; (-) strand; PAM type: YTN; PAM sequence: TTC
ttgtcttgtgctggttttca

SEQ ID NO: 55025 - DNA, 20 bp, Artificial Sequence
  Description of Artificial Sequence: Synthetic oligonucleotide
  Target: SCN10A; (-) strand; PAM type: YTN; PAM sequence: TTG
aataagagtggtgagatagg

SEQ ID NO: 55026 - DNA, 20 bp, Artificial Sequence
  Description of Artificial Sequence: Synthetic oligonucleotide
  Target: SCN10A; (-) strand; PAM type: YTN; PAM sequence: CTA
tgttgaataagagtggtgag

SEQ ID NO: 55027 - DNA, 20 bp, Artificial Sequence
  Description of Artificial Sequence: Synthetic oligonucleotide
  Target: SCN10A; (-) strand; PAM type: YTN; PAM sequence: TTC
caatactatgttgaataaga

SEQ ID NO: 55028 - DNA, 20 bp, Artificial Sequence
  Description of Artificial Sequence: Synthetic oligonucleotide
  Target: SCN10A; (-) strand; PAM type: YTN; PAM sequence: CTT
ccaatactatgttgaataag

SEQ ID NO: 55029 - DNA, 20 bp, Artificial Sequence
  Description of Artificial Sequence: Synthetic oligonucleotide
  Target: SCN10A; (-) strand; PAM type: YTN; PAM sequence: CTG
gccagaacttccaatactat

SEQ ID NO: 55030 - DNA, 20 bp, Artificial Sequence
  Description of Artificial Sequence: Synthetic oligonucleotide
  Target: SCN10A; (-) strand; PAM type: YTN; PAM sequence: CTG
atcgccctggccagaacttc

SEQ ID NO: 55031 - DNA, 20 bp, Artificial Sequence
  Description of Artificial Sequence: Synthetic oligonucleotide
  Target: SCN10A; (-) strand; PAM type: YTN; PAM sequence: TTG
cctgatcgccctggccagaa

SEQ ID NO: 55032 - DNA, 20 bp, Artificial Sequence
  Description of Artificial Sequence: Synthetic oligonucleotide
  Target: SCN10A; (-) strand; PAM type: YTN; PAM sequence: CTT
gcctgatcgccctggccaga

SEQ ID NO: 55033 - DNA, 20 bp, Artificial Sequence
  Description of Artificial Sequence: Synthetic oligonucleotide
  Target: SCN10A; (-) strand; PAM type: YTN; PAM sequence: CTC
ttgcctgatcgccctggcca

SEQ ID NO: 55034 - DNA, 20 bp, Artificial Sequence
  Description of Artificial Sequence: Synthetic oligonucleotide
  Target: SCN10A; (-) strand; PAM type: YTN; PAM sequence: TTC
tcttgcctgatcgccctggc

SEQ ID NO: 55035 - DNA, 20 bp, Artificial Sequence
  Description of Artificial Sequence: Synthetic oligonucleotide
  Target: SCN10A; (-) strand; PAM type: YTN; PAM sequence: TTT
ctcttgcctgatcgccctgg

SEQ ID NO: 55036 - DNA, 20 bp, Artificial Sequence
  Description of Artificial Sequence: Synthetic oligonucleotide
  Target: SCN10A; (-) strand; PAM type: YTN; PAM sequence: CTT
tctcttgcctgatcgccctg

SEQ ID NO: 55037 - DNA, 20 bp, Artificial Sequence
  Description of Artificial Sequence: Synthetic oligonucleotide
  Target: SCN10A; (-) strand; PAM type: YTN; PAM sequence: TTC
tttctcttgcctgatcgccc

SEQ ID NO: 55038 - DNA, 20 bp, Artificial Sequence
  Description of Artificial Sequence: Synthetic oligonucleotide
  Target: SCN10A; (-) strand; PAM type: YTN; PAM sequence: TTT
ctttctcttgcctgatcgcc

SEQ ID NO: 55039 - DNA, 20 bp, Artificial Sequence
  Description of Artificial Sequence: Synthetic oligonucleotide
  Target: SCN10A; (-) strand; PAM type: YTN; PAM sequence: TTA
tttctttctcttgcctgatc

SEQ ID NO: 55040 - DNA, 20 bp, Artificial Sequence
  Description of Artificial Sequence: Synthetic oligonucleotide
  Target: SCN10A; (-) strand; PAM type: YTN; PAM sequence: CTT
atttctttctcttgcctgat

SEQ ID NO: 55041 - DNA, 20 bp, Artificial Sequence
  Description of Artificial Sequence: Synthetic oligonucleotide
  Target: SCN10A; (-) strand; PAM type: YTN; PAM sequence: TTG
aataccccttatttctttct

SEQ ID NO: 55042 - DNA, 20 bp, Artificial Sequence
  Description of Artificial Sequence: Synthetic oligonucleotide
  Target: SCN10A; (-) strand; PAM type: YTN; PAM sequence: TTT
gaataccccttatttctttc

SEQ ID NO: 55043 - DNA, 20 bp, Artificial Sequence
  Description of Artificial Sequence: Synthetic oligonucleotide
  Target: SCN10A; (-) strand; PAM type: YTN; PAM sequence: CTA
tttgaataccccttatttct

SEQ ID NO: 55044 - DNA, 20 bp, Artificial Sequence
  Description of Artificial Sequence: Synthetic oligonucleotide
  Target: SCN10A; (-) strand; PAM type: YTN; PAM sequence: TTC
ctatttgaataccccttatt

SEQ ID NO: 55045 - DNA, 20 bp, Artificial Sequence
  Description of Artificial Sequence: Synthetic oligonucleotide
  Target: SCN10A; (-) strand; PAM type: YTN; PAM sequence: TTT
cctatttgaataccccttat

SEQ ID NO: 55046 - DNA, 20 bp, Artificial Sequence
  Description of Artificial Sequence: Synthetic oligonucleotide
  Target: SCN10A; (-) strand; PAM type: YTN; PAM sequence: TTT
tcctatttgaatacccctta

SEQ ID NO: 55047 - DNA, 20 bp, Artificial Sequence
  Description of Artificial Sequence: Synthetic oligonucleotide
  Target: SCN10A; (-) strand; PAM type: YTN; PAM sequence: CTT
ttcctatttgaatacccctt

SEQ ID NO: 55048 - DNA, 20 bp, Artificial Sequence
  Description of Artificial Sequence: Synthetic oligonucleotide
  Target: SCN10A; (-) strand; PAM type: YTN; PAM sequence: CTC
ttttcctatttgaatacccc

SEQ ID NO: 55049 - DNA, 20 bp, Artificial Sequence
  Description of Artificial Sequence: Synthetic oligonucleotide
  Target: SCN10A; (-) strand; PAM type: YTN; PAM sequence: TTC
ctcttttcctatttgaatac

SEQ ID NO: 55050 - DNA, 20 bp, Artificial Sequence
  Description of Artificial Sequence: Synthetic oligonucleotide
  Target: SCN10A; (-) strand; PAM type: YTN; PAM sequence: CTT
cctcttttcctatttgaata

SEQ ID NO: 55051 - DNA, 20 bp, Artificial Sequence
  Description of Artificial Sequence: Synthetic oligonucleotide
  Target: SCN10A; (-) strand; PAM type: YTN; PAM sequence: TTG
acttcctcttttcctatttg

SEQ ID NO: 55052 - DNA, 20 bp, Artificial Sequence
  Description of Artificial Sequence: Synthetic oligonucleotide
  Target: SCN10A; (-) strand; PAM type: YTN; PAM sequence: TTT
gacttcctcttttcctattt

SEQ ID NO: 55053 - DNA, 20 bp, Artificial Sequence
  Description of Artificial Sequence: Synthetic oligonucleotide
  Target: SCN10A; (-) strand; PAM type: YTN; PAM sequence: CTG
caaacagagacaatttgact

SEQ ID NO: 55054 - DNA, 20 bp, Artificial Sequence
  Description of Artificial Sequence: Synthetic oligonucleotide
  Target: SCN10A; (-) strand; PAM type: YTN; PAM sequence: CTA
aatatacagtcatgtcatct

SEQ ID NO: 55055 - DNA, 20 bp, Artificial Sequence
  Description of Artificial Sequence: Synthetic oligonucleotide
  Target: SCN10A; (-) strand; PAM type: YTN; PAM sequence: TTC
taaatatacagtcatgtcat

SEQ ID NO: 55056 - DNA, 20 bp, Artificial Sequence
  Description of Artificial Sequence: Synthetic oligonucleotide
  Target: SCN10A; (-) strand; PAM type: YTN; PAM sequence: TTT
ctaaatatacagtcatgtca

SEQ ID NO: 55057 - DNA, 20 bp, Artificial Sequence
  Description of Artificial Sequence: Synthetic oligonucleotide
  Target: SCN10A; (-) strand; PAM type: YTN; PAM sequence: TTT
tctaaatatacagtcatgtc

SEQ ID NO: 55058 - DNA, 20 bp, Artificial Sequence
  Description of Artificial Sequence: Synthetic oligonucleotide
  Target: SCN10A; (-) strand; PAM type: YTN; PAM sequence: CTG
agatgatggggttttctaaa

SEQ ID NO: 55059 - DNA, 20 bp, Artificial Sequence
  Description of Artificial Sequence: Synthetic oligonucleotide
  Target: SCN10A; (-) strand; PAM type: YTN; PAM sequence: TTG
ggctgagatgatggggtttt

SEQ ID NO: 55060 - DNA, 20 bp, Artificial Sequence
  Description of Artificial Sequence: Synthetic oligonucleotide
  Target: SCN10A; (-) strand; PAM type: YTN; PAM sequence: TTT
gggctgagatgatggggttt

SEQ ID NO: 55061 - DNA, 20 bp, Artificial Sequence
  Description of Artificial Sequence: Synthetic oligonucleotide
  Target: SCN10A; (-) strand; PAM type: YTN; PAM sequence: TTT
tgggctgagatgatggggtt

SEQ ID NO: 55062 - DNA, 20 bp, Artificial Sequence
  Description of Artificial Sequence: Synthetic oligonucleotide
  Target: SCN10A; (-) strand; PAM type: YTN; PAM sequence: TTA
aggagattttgggctgagat

SEQ ID NO: 55063 - DNA, 20 bp, Artificial Sequence
  Description of Artificial Sequence: Synthetic oligonucleotide
  Target: SCN10A; (-) strand; PAM type: YTN; PAM sequence: CTT
aaggagattttgggctgaga

SEQ ID NO: 55064 - DNA, 20 bp, Artificial Sequence
  Description of Artificial Sequence: Synthetic oligonucleotide
  Target: SCN10A; (-) strand; PAM type: YTN; PAM sequence: TTA
tcagcttaaggagattttgg

SEQ ID NO: 55065 - DNA, 20 bp, Artificial Sequence
  Description of Artificial Sequence: Synthetic oligonucleotide
  Target: SCN10A; (-) strand; PAM type: YTN; PAM sequence: CTT
atcagcttaaggagattttg

SEQ ID NO: 55066 - DNA, 20 bp, Artificial Sequence
  Description of Artificial Sequence: Synthetic oligonucleotide
  Target: SCN10A; (-) strand; PAM type: YTN; PAM sequence: TTG
cttatcagcttaaggagatt

SEQ ID NO: 55067 - DNA, 20 bp, Artificial Sequence
  Description of Artificial Sequence: Synthetic oligonucleotide
  Target: SCN10A; (-) strand; PAM type: YTN; PAM sequence: CTG
aagttgcttatcagcttaag

SEQ ID NO: 55068 - DNA, 20 bp, Artificial Sequence
  Description of Artificial Sequence: Synthetic oligonucleotide
  Target: SCN10A; (-) strand; PAM type: YTN; PAM sequence: TTG
ctgaagttgcttatcagctt

SEQ ID NO: 55069 - DNA, 20 bp, Artificial Sequence
  Description of Artificial Sequence: Synthetic oligonucleotide
  Target: SCN10A; (-) strand; PAM type: YTN; PAM sequence: TTT
gctgaagttgcttatcagct

SEQ ID NO: 55070 - DNA, 20 bp, Artificial Sequence
  Description of Artificial Sequence: Synthetic oligonucleotide
  Target: SCN10A; (-) strand; PAM type: YTN; PAM sequence: CTT
tgctgaagttgcttatcagc

SEQ ID NO: 55071 - DNA, 20 bp, Artificial Sequence
  Description of Artificial Sequence: Synthetic oligonucleotide
  Target: SCN10A; (-) strand; PAM type: YTN; PAM sequence: CTG
agactttgctgaagttgctt

SEQ ID NO: 55072 - DNA, 20 bp, Artificial Sequence
  Description of Artificial Sequence: Synthetic oligonucleotide
  Target: SCN10A; (-) strand; PAM type: YTN; PAM sequence: TTG
tatcctgagactttgctgaa

SEQ ID NO: 55073 - DNA, 20 bp, Artificial Sequence
  Description of Artificial Sequence: Synthetic oligonucleotide
  Target: SCN10A; (-) strand; PAM type: YTN; PAM sequence: TTT
gtatcctgagactttgctga

SEQ ID NO: 55074 - DNA, 20 bp, Artificial Sequence
  Description of Artificial Sequence: Synthetic oligonucleotide
  Target: SCN10A; (-) strand; PAM type: YTN; PAM sequence: TTT
tgtatcctgagactttgctg

SEQ ID NO: 55075 - DNA, 20 bp, Artificial Sequence
  Description of Artificial Sequence: Synthetic oligonucleotide
  Target: SCN10A; (-) strand; PAM type: YTN; PAM sequence: TTG
attttgtatcctgagacttt

SEQ ID NO: 55076 - DNA, 20 bp, Artificial Sequence
  Description of Artificial Sequence: Synthetic oligonucleotide
  Target: SCN10A; (-) strand; PAM type: YTN; PAM sequence: TTG
cacattgattttgtatcctg

SEQ ID NO: 55077 - DNA, 20 bp, Artificial Sequence
  Description of Artificial Sequence: Synthetic oligonucleotide
  Target: SCN10A; (-) strand; PAM type: YTN; PAM sequence: TTT
gcacattgattttgtatcct

SEQ ID NO: 55078 - DNA, 20 bp, Artificial Sequence
  Description of Artificial Sequence: Synthetic oligonucleotide
  Target: SCN10A; (-) strand; PAM type: YTN; PAM sequence: TTT
tgcacattgattttgtatcc

SEQ ID NO: 55079 - DNA, 20 bp, Artificial Sequence
  Description of Artificial Sequence: Synthetic oligonucleotide
  Target: SCN10A; (-) strand; PAM type: YTN; PAM sequence: TTT
ttgcacattgattttgtatc

SEQ ID NO: 55080 - DNA, 20 bp, Artificial Sequence
  Description of Artificial Sequence: Synthetic oligonucleotide
  Target: SCN10A; (-) strand; PAM type: YTN; PAM sequence: TTG
tgatttttgcacattgattt

SEQ ID NO: 55081 - DNA, 20 bp, Artificial Sequence
  Description of Artificial Sequence: Synthetic oligonucleotide
  Target: SCN10A; (-) strand; PAM type: YTN; PAM sequence: CTT
gtgatttttgcacattgatt

SEQ ID NO: 55082 - DNA, 20 bp, Artificial Sequence
  Description of Artificial Sequence: Synthetic oligonucleotide
  Target: SCN10A; (-) strand; PAM type: YTN; PAM sequence: TTG
gtgtatgggaatgcttgtga

SEQ ID NO: 55083 - DNA, 20 bp, Artificial Sequence
  Description of Artificial Sequence: Synthetic oligonucleotide
  Target: SCN10A; (-) strand; PAM type: YTN; PAM sequence: TTA
ttggtgtatgggaatgcttg

SEQ ID NO: 55084 - DNA, 20 bp, Artificial Sequence
  Description of Artificial Sequence: Synthetic oligonucleotide
  Target: SCN10A; (-) strand; PAM type: YTN; PAM sequence: CTG
ttattggtgtatgggaatgc

SEQ ID NO: 55085 - DNA, 20 bp, Artificial Sequence
  Description of Artificial Sequence: Synthetic oligonucleotide
  Target: SCN10A; (-) strand; PAM type: YTN; PAM sequence: TTG
tctgttattggtgtatggga

SEQ ID NO: 55086 - DNA, 20 bp, Artificial Sequence
  Description of Artificial Sequence: Synthetic oligonucleotide
  Target: SCN10A; (-) strand; PAM type: YTN; PAM sequence: TTT
gtctgttattggtgtatggg

SEQ ID NO: 55087 - DNA, 20 bp, Artificial Sequence
  Description of Artificial Sequence: Synthetic oligonucleotide
  Target: SCN10A; (-) strand; PAM type: YTN; PAM sequence: CTC
ggtttgtctgttattggtgt

SEQ ID NO: 55088 - DNA, 20 bp, Artificial Sequence
  Description of Artificial Sequence: Synthetic oligonucleotide
  Target: SCN10A; (-) strand; PAM type: YTN; PAM sequence: CTC
tcggtttgtctgttattggt

SEQ ID NO: 55089 - DNA, 20 bp, Artificial Sequence
  Description of Artificial Sequence: Synthetic oligonucleotide
  Target: SCN10A; (-) strand; PAM type: YTN; PAM sequence: TTG
gctctcggtttgtctgttat

SEQ ID NO: 55090 - DNA, 20 bp, Artificial Sequence
  Description of Artificial Sequence: Synthetic oligonucleotide
  Target: SCN10A; (-) strand; PAM type: YTN; PAM sequence: TTT
ggctctcggtttgtctgtta

SEQ ID NO: 55091 - DNA, 20 bp, Artificial Sequence
  Description of Artificial Sequence: Synthetic oligonucleotide
  Target: SCN10A; (-) strand; PAM type: YTN; PAM sequence: CTC
atgatttggctctcggtttg

SEQ ID NO: 55092 - DNA, 20 bp, Artificial Sequence
  Description of Artificial Sequence: Synthetic oligonucleotide
  Target: SCN10A; (-) strand; PAM type: YTN; PAM sequence: TTC
actcatgatttggctctcgg

SEQ ID NO: 55093 - DNA, 20 bp, Artificial Sequence
  Description of Artificial Sequence: Synthetic oligonucleotide
  Target: SCN10A; (-) strand; PAM type: YTN; PAM sequence: TTG
tgaatgggagttcactcatg

SEQ ID NO: 55094 - DNA, 20 bp, Artificial Sequence
  Description of Artificial Sequence: Synthetic oligonucleotide
  Target: SCN10A; (-) strand; PAM type: YTN; PAM sequence: TTG
caattgtgaatgggagttca

SEQ ID NO: 55095 - DNA, 20 bp, Artificial Sequence
  Description of Artificial Sequence: Synthetic oligonucleotide
  Target: SCN10A; (-) strand; PAM type: YTN; PAM sequence: TTG
ttgcaattgtgaatgggagt

SEQ ID NO: 55096 - DNA, 20 bp, Artificial Sequence
  Description of Artificial Sequence: Synthetic oligonucleotide
  Target: SCN10A; (-) strand; PAM type: YTN; PAM sequence: TTT
gttgcaattgtgaatgggag

SEQ ID NO: 55097 - DNA, 20 bp, Artificial Sequence
  Description of Artificial Sequence: Synthetic oligonucleotide
  Target: SCN10A; (-) strand; PAM type: YTN; PAM sequence: CTT
tgttgcaattgtgaatggga

SEQ ID NO: 55098 - DNA, 20 bp, Artificial Sequence
  Description of Artificial Sequence: Synthetic oligonucleotide
  Target: SCN10A; (-) strand; PAM type: YTN; PAM sequence: CTC
tttgttgcaattgtgaatgg

SEQ ID NO: 55099 - DNA, 20 bp, Artificial Sequence
  Description of Artificial Sequence: Synthetic oligonucleotide
  Target: SCN10A; (-) strand; PAM type: YTN; PAM sequence: TTC
tctttgttgcaattgtgaat

SEQ ID NO: 55100 - DNA, 20 bp, Artificial Sequence
  Description of Artificial Sequence: Synthetic oligonucleotide
  Target: SCN10A; (-) strand; PAM type: YTN; PAM sequence: TTA
ttctctttgttgcaattgtg

SEQ ID NO: 55101 - DNA, 20 bp, Artificial Sequence
  Description of Artificial Sequence: Synthetic oligonucleotide
  Target: SCN10A; (-) strand; PAM type: YTN; PAM sequence: TTT
attctctttgttgcaattgt

SEQ ID NO: 55102 - DNA, 20 bp, Artificial Sequence
  Description of Artificial Sequence: Synthetic oligonucleotide
  Target: SCN10A; (-) strand; PAM type: YTN; PAM sequence: TTT
tattctctttgttgcaattg

SEQ ID NO: 55103 - DNA, 20 bp, Artificial Sequence
  Description of Artificial Sequence: Synthetic oligonucleotide
  Target: SCN10A; (-) strand; PAM type: YTN; PAM sequence: CTA
gatattttattctctttgtt

SEQ ID NO: 55104 - DNA, 20 bp, Artificial Sequence
  Description of Artificial Sequence: Synthetic oligonucleotide
  Target: SCN10A; (-) strand; PAM type: YTN; PAM sequence: TTC
tagatattttattctctttg

SEQ ID NO: 55105 - DNA, 20 bp, Artificial Sequence
  Description of Artificial Sequence: Synthetic oligonucleotide
  Target: SCN10A; (-) strand; PAM type: YTN; PAM sequence: TTT
ctagatattttattctcttt

SEQ ID NO: 55106 - DNA, 20 bp, Artificial Sequence
  Description of Artificial Sequence: Synthetic oligonucleotide
  Target: SCN10A; (-) strand; PAM type: YTN; PAM sequence: TTG
tatttctagatattttattc

SEQ ID NO: 55107 - DNA, 20 bp, Artificial Sequence
  Description of Artificial Sequence: Synthetic oligonucleotide
  Target: SCN10A; (-) strand; PAM type: YTN; PAM sequence: TTG
taagttgtatttctagatat

SEQ ID NO: 55108 - DNA, 20 bp, Artificial Sequence
  Description of Artificial Sequence: Synthetic oligonucleotide
  Target: SCN10A; (-) strand; PAM type: YTN; PAM sequence: CTT
gtaagttgtatttctagata

SEQ ID NO: 55109 - DNA, 20 bp, Artificial Sequence
  Description of Artificial Sequence: Synthetic oligonucleotide
  Target: SCN10A; (-) strand; PAM type: YTN; PAM sequence: TTC
acatcccttgtaagttgtat

SEQ ID NO: 55110 - DNA, 20 bp, Artificial Sequence
  Description of Artificial Sequence: Synthetic oligonucleotide
  Target: SCN10A; (-) strand; PAM type: YTN; PAM sequence: CTT
cacatcccttgtaagttgta

SEQ ID NO: 55111 - DNA, 20 bp, Artificial Sequence
  Description of Artificial Sequence: Synthetic oligonucleotide
  Target: SCN10A; (-) strand; PAM type: YTN; PAM sequence: TTG
aagaggtccttcacatccct

SEQ ID NO: 55112 - DNA, 20 bp, Artificial Sequence
  Description of Artificial Sequence: Synthetic oligonucleotide
  Target: SCN10A; (-) strand; PAM type: YTN; PAM sequence: CTT
gaagaggtccttcacatccc

SEQ ID NO: 55113 - DNA, 20 bp, Artificial Sequence
  Description of Artificial Sequence: Synthetic oligonucleotide
  Target: SCN10A; (-) strand; PAM type: YTN; PAM sequence: CTC
cttgaagaggtccttcacat

SEQ ID NO: 55114 - DNA, 20 bp, Artificial Sequence
  Description of Artificial Sequence: Synthetic oligonucleotide
  Target: SCN10A; (-) strand; PAM type: YTN; PAM sequence: TTC
tccttgaagaggtccttcac

SEQ ID NO: 55115 - DNA, 20 bp, Artificial Sequence
  Description of Artificial Sequence: Synthetic oligonucleotide
  Target: SCN10A; (-) strand; PAM type: YTN; PAM sequence: TTA
gttctccttgaagaggtcct

SEQ ID NO: 55116 - DNA, 20 bp, Artificial Sequence
  Description of Artificial Sequence: Synthetic oligonucleotide
  Target: SCN10A; (-) strand; PAM type: YTN; PAM sequence: TTT
agttctccttgaagaggtcc

SEQ ID NO: 55117 - DNA, 20 bp, Artificial Sequence
  Description of Artificial Sequence: Synthetic oligonucleotide
  Target: SCN10A; (-) strand; PAM type: YTN; PAM sequence: TTT
tagttctccttgaagaggtc

SEQ ID NO: 55118 - DNA, 20 bp, Artificial Sequence
  Description of Artificial Sequence: Synthetic oligonucleotide
  Target: SCN10A; (-) strand; PAM type: YTN; PAM sequence: TTT
ttagttctccttgaagaggt

SEQ ID NO: 55119 - DNA, 20 bp, Artificial Sequence
  Description of Artificial Sequence: Synthetic oligonucleotide
  Target: SCN10A; (-) strand; PAM type: YTN; PAM sequence: TTG
agcagtgatttttagttctc

SEQ ID NO: 55120 - DNA, 20 bp, Artificial Sequence
  Description of Artificial Sequence: Synthetic oligonucleotide
  Target: SCN10A; (-) strand; PAM type: YTN; PAM sequence: CTT
gagcagtgatttttagttct

SEQ ID NO: 55121 - DNA, 20 bp, Artificial Sequence
  Description of Artificial Sequence: Synthetic oligonucleotide
  Target: SCN10A; (-) strand; PAM type: YTN; PAM sequence: TTC
cttgagcagtgatttttagt

SEQ ID NO: 55122 - DNA, 20 bp, Artificial Sequence
  Description of Artificial Sequence: Synthetic oligonucleotide
  Target: SCN10A; (-) strand; PAM type: YTN; PAM sequence: TTT
ccttgagcagtgatttttag

SEQ ID NO: 55123 - DNA, 20 bp, Artificial Sequence
  Description of Artificial Sequence: Synthetic oligonucleotide
  Target: SCN10A; (-) strand; PAM type: YTN; PAM sequence: TTA
tttccttgagcagtgatttt

SEQ ID NO: 55124 - DNA, 20 bp, Artificial Sequence
  Description of Artificial Sequence: Synthetic oligonucleotide
  Target: SCN10A; (-) strand; PAM type: YTN; PAM sequence: CTT
atttccttgagcagtgattt

SEQ ID NO: 55125 - DNA, 20 bp, Artificial Sequence
  Description of Artificial Sequence: Synthetic oligonucleotide
  Target: SCN10A; (-) strand; PAM type: YTN; PAM sequence: CTC
ttatttccttgagcagtgat

SEQ ID NO: 55126 - DNA, 20 bp, Artificial Sequence
  Description of Artificial Sequence: Synthetic oligonucleotide
  Target: SCN10A; (-) strand; PAM type: YTN; PAM sequence: CTC
tcttatttccttgagcagtg

SEQ ID NO: 55127 - DNA, 20 bp, Artificial Sequence
  Description of Artificial Sequence: Synthetic oligonucleotide
  Target: SCN10A; (-) strand; PAM type: YTN; PAM sequence: TTG
tgtcctctcttatttccttg

SEQ ID NO: 55128 - DNA, 20 bp, Artificial Sequence
  Description of Artificial Sequence: Synthetic oligonucleotide
  Target: SCN10A; (-) strand; PAM type: YTN; PAM sequence: TTT
gtgtcctctcttatttcctt

SEQ ID NO: 55129 - DNA, 20 bp, Artificial Sequence
  Description of Artificial Sequence: Synthetic oligonucleotide
  Target: SCN10A; (-) strand; PAM type: YTN; PAM sequence: TTA
tttgtgtcctctcttatttc

SEQ ID NO: 55130 - DNA, 20 bp, Artificial Sequence
  Description of Artificial Sequence: Synthetic oligonucleotide
  Target: SCN10A; (-) strand; PAM type: YTN; PAM sequence: TTT
atttgtgtcctctcttattt

SEQ ID NO: 55131 - DNA, 20 bp, Artificial Sequence
  Description of Artificial Sequence: Synthetic oligonucleotide
  Target: SCN10A; (-) strand; PAM type: YTN; PAM sequence: TTC
catttatttgtgtcctctct

SEQ ID NO: 55132 - DNA, 20 bp, Artificial Sequence
  Description of Artificial Sequence: Synthetic oligonucleotide
  Target: SCN10A; (-) strand; PAM type: YTN; PAM sequence: TTT
ccatttatttgtgtcctctc

SEQ ID NO: 55133 - DNA, 20 bp, Artificial Sequence
  Description of Artificial Sequence: Synthetic oligonucleotide
  Target: SCN10A; (-) strand; PAM type: YTN; PAM sequence: TTT
tccatttatttgtgtcctct

SEQ ID NO: 55134 - DNA, 20 bp, Artificial Sequence
  Description of Artificial Sequence: Synthetic oligonucleotide
  Target: SCN10A; (-) strand; PAM type: YTN; PAM sequence: TTT
ttccatttatttgtgtcctc

SEQ ID NO: 55135 - DNA, 20 bp, Artificial Sequence
  Description of Artificial Sequence: Synthetic oligonucleotide
  Target: SCN10A; (-) strand; PAM type: YTN; PAM sequence: CTA
tccatgagcatggaatgttt

SEQ ID NO: 55136 - DNA, 20 bp, Artificial Sequence
  Description of Artificial Sequence: Synthetic oligonucleotide
  Target: SCN10A; (-) strand; PAM type: YTN; PAM sequence: TTC
ctatccatgagcatggaatg

SEQ ID NO: 55137 - DNA, 20 bp, Artificial Sequence
  Description of Artificial Sequence: Synthetic oligonucleotide
  Target: SCN10A; (-) strand; PAM type: YTN; PAM sequence: TTT
cctatccatgagcatggaat

SEQ ID NO: 55138 - DNA, 20 bp, Artificial Sequence
  Description of Artificial Sequence: Synthetic oligonucleotide
  Target: SCN10A; (-) strand; PAM type: YTN; PAM sequence: TTT
tcctatccatgagcatggaa

SEQ ID NO: 55139 - DNA, 20 bp, Artificial Sequence
  Description of Artificial Sequence: Synthetic oligonucleotide
  Target: SCN10A; (-) strand; PAM type: YTN; PAM sequence: TTT
ttcctatccatgagcatgga

SEQ ID NO: 55140 - DNA, 20 bp, Artificial Sequence
  Description of Artificial Sequence: Synthetic oligonucleotide
  Target: SCN10A; (-) strand; PAM type: YTN; PAM sequence: TTG
atttttcctatccatgagca

SEQ ID NO: 55141 - DNA, 20 bp, Artificial Sequence
  Description of Artificial Sequence: Synthetic oligonucleotide
  Target: SCN10A; (-) strand; PAM type: YTN; PAM sequence: TTC
acaatattgatttttcctat

SEQ ID NO: 55142 - DNA, 20 bp, Artificial Sequence
  Description of Artificial Sequence: Synthetic oligonucleotide
  Target: SCN10A; (-) strand; PAM type: YTN; PAM sequence: TTT
cacaatattgatttttccta

SEQ ID NO: 55143 - DNA, 20 bp, Artificial Sequence
  Description of Artificial Sequence: Synthetic oligonucleotide
  Target: SCN10A; (-) strand; PAM type: YTN; PAM sequence: TTT
tcacaatattgatttttcct

SEQ ID NO: 55144 - DNA, 20 bp, Artificial Sequence
  Description of Artificial Sequence: Synthetic oligonucleotide
  Target: SCN10A; (-) strand; PAM type: YTN; PAM sequence: TTG
ggcagtatggccattttcac

SEQ ID NO: 55145 - DNA, 20 bp, Artificial Sequence
  Description of Artificial Sequence: Synthetic oligonucleotide
  Target: SCN10A; (-) strand; PAM type: YTN; PAM sequence: TTT
gggcagtatggccattttca

SEQ ID NO: 55146 - DNA, 20 bp, Artificial Sequence
  Description of Artificial Sequence: Synthetic oligonucleotide
  Target: SCN10A; (-) strand; PAM type: YTN; PAM sequence: CTT
tgggcagtatggccattttc

SEQ ID NO: 55147 - DNA, 20 bp, Artificial Sequence
  Description of Artificial Sequence: Synthetic oligonucleotide
  Target: SCN10A; (-) strand; PAM type: YTN; PAM sequence: TTA
ctttgggcagtatggccatt

SEQ ID NO: 55148 - DNA, 20 bp, Artificial Sequence
  Description of Artificial Sequence: Synthetic oligonucleotide
  Target: SCN10A; (-) strand; PAM type: YTN; PAM sequence: CTA
taaattactttgggcagtat

SEQ ID NO: 55149 - DNA, 20 bp, Artificial Sequence
  Description of Artificial Sequence: Synthetic oligonucleotide
  Target: SCN10A; (-) strand; PAM type: YTN; PAM sequence: TTG
aatctataaattactttggg

SEQ ID NO: 55150 - DNA, 20 bp, Artificial Sequence
  Description of Artificial Sequence: Synthetic oligonucleotide
  Target: SCN10A; (-) strand; PAM type: YTN; PAM sequence: TTG
atggggataacattgaatct

SEQ ID NO: 55151 - DNA, 20 bp, Artificial Sequence
  Description of Artificial Sequence: Synthetic oligonucleotide
  Target: SCN10A; (-) strand; PAM type: YTN; PAM sequence: CTT
gatggggataacattgaatc

SEQ ID NO: 55152 - DNA, 20 bp, Artificial Sequence
  Description of Artificial Sequence: Synthetic oligonucleotide
  Target: SCN10A; (-) strand; PAM type: YTN; PAM sequence: CTG
tgaagaaagtcagtggtagc

SEQ ID NO: 55153 - DNA, 20 bp, Artificial Sequence
  Description of Artificial Sequence: Synthetic oligonucleotide
  Target: SCN10A; (-) strand; PAM type: YTN; PAM sequence: TTC
tgtgaagaaagtcagtggta

SEQ ID NO: 55154 - DNA, 20 bp, Artificial Sequence
  Description of Artificial Sequence: Synthetic oligonucleotide
  Target: SCN10A; (-) strand; PAM type: YTN; PAM sequence: CTA
attctgtgaagaaagtcagt

SEQ ID NO: 55155 - DNA, 20 bp, Artificial Sequence
  Description of Artificial Sequence: Synthetic oligonucleotide
  Target: SCN10A; (-) strand; PAM type: YTN; PAM sequence: TTC
taattctgtgaagaaagtca

SEQ ID NO: 55156 - DNA, 20 bp, Artificial Sequence
  Description of Artificial Sequence: Synthetic oligonucleotide
  Target: SCN10A; (-) strand; PAM type: YTN; PAM sequence: TTT
ctaattctgtgaagaaagtc

SEQ ID NO: 55157 - DNA, 20 bp, Artificial Sequence
  Description of Artificial Sequence: Synthetic oligonucleotide
  Target: SCN10A; (-) strand; PAM type: YTN; PAM sequence: TTT
tctaattctgtgaagaaagt

SEQ ID NO: 55158 - DNA, 20 bp, Artificial Sequence
  Description of Artificial Sequence: Synthetic oligonucleotide
  Target: SCN10A; (-) strand; PAM type: YTN; PAM sequence: TTT
ttctaattctgtgaagaaag

SEQ ID NO: 55159 - DNA, 20 bp, Artificial Sequence
  Description of Artificial Sequence: Synthetic oligonucleotide
  Target: SCN10A; (-) strand; PAM type: YTN; PAM sequence: TTA
aagtagatttttctaattct

SEQ ID NO: 55160 - DNA, 20 bp, Artificial Sequence
  Description of Artificial Sequence: Synthetic oligonucleotide
  Target: SCN10A; (-) strand; PAM type: YTN; PAM sequence: TTT
aaagtagatttttctaattc

SEQ ID NO: 55161 - DNA, 20 bp, Artificial Sequence
  Description of Artificial Sequence: Synthetic oligonucleotide
  Target: SCN10A; (-) strand; PAM type: YTN; PAM sequence: TTC
cacatgaaatttaaagtaga

SEQ ID NO: 55162 - DNA, 20 bp, Artificial Sequence
  Description of Artificial Sequence: Synthetic oligonucleotide
  Target: SCN10A; (-) strand; PAM type: YTN; PAM sequence: TTG
ttccacatgaaatttaaagt

SEQ ID NO: 55163 - DNA, 20 bp, Artificial Sequence
  Description of Artificial Sequence: Synthetic oligonucleotide
  Target: SCN10A; (-) strand; PAM type: YTN; PAM sequence: TTT
gttccacatgaaatttaaag

SEQ ID NO: 55164 - DNA, 20 bp, Artificial Sequence
  Description of Artificial Sequence: Synthetic oligonucleotide
  Target: SCN10A; (-) strand; PAM type: YTN; PAM sequence: TTT
tgttccacatgaaatttaaa

SEQ ID NO: 55165 - DNA, 20 bp, Artificial Sequence
  Description of Artificial Sequence: Synthetic oligonucleotide
  Target: SCN10A; (-) strand; PAM type: YTN; PAM sequence: TTT
ttgttccacatgaaatttaa

SEQ ID NO: 55166 - DNA, 20 bp, Artificial Sequence
  Description of Artificial Sequence: Synthetic oligonucleotide
  Target: SCN10A; (-) strand; PAM type: YTN; PAM sequence: TTT
tttgttccacatgaaattta

SEQ ID NO: 55167 - DNA, 20 bp, Artificial Sequence
  Description of Artificial Sequence: Synthetic oligonucleotide
  Target: SCN10A; (-) strand; PAM type: YTN; PAM sequence: CTT
ttttgttccacatgaaattt

SEQ ID NO: 55168 - DNA, 20 bp, Artificial Sequence
  Description of Artificial Sequence: Synthetic oligonucleotide
  Target: SCN10A; (-) strand; PAM type: YTN; PAM sequence: CTC
ttttttgttccacatgaaat

SEQ ID NO: 55169 - DNA, 20 bp, Artificial Sequence
  Description of Artificial Sequence: Synthetic oligonucleotide
  Target: SCN10A; (-) strand; PAM type: YTN; PAM sequence: CTA
tgcgggctcttttttgttcc

SEQ ID NO: 55170 - DNA, 20 bp, Artificial Sequence
  Description of Artificial Sequence: Synthetic oligonucleotide
  Target: SCN10A; (-) strand; PAM type: YTN; PAM sequence: TTG
actatgcgggctcttttttg

SEQ ID NO: 55171 - DNA, 20 bp, Artificial Sequence
  Description of Artificial Sequence: Synthetic oligonucleotide
  Target: SCN10A; (-) strand; PAM type: YTN; PAM sequence: CTT
gactatgcgggctctttttt

SEQ ID NO: 55172 - DNA, 20 bp, Artificial Sequence
  Description of Artificial Sequence: Synthetic oligonucleotide
  Target: SCN10A; (-) strand; PAM type: YTN; PAM sequence: TTG
tcttgactatgcgggctctt

SEQ ID NO: 55173 - DNA, 20 bp, Artificial Sequence
  Description of Artificial Sequence: Synthetic oligonucleotide
  Target: SCN10A; (-) strand; PAM type: YTN; PAM sequence: TTA
gaattgtcttgactatgcgg

SEQ ID NO: 55174 - DNA, 20 bp, Artificial Sequence
  Description of Artificial Sequence: Synthetic oligonucleotide
  Target: SCN10A; (-) strand; PAM type: YTN; PAM sequence: CTT
agaattgtcttgactatgcg

SEQ ID NO: 55175 - DNA, 20 bp, Artificial Sequence
  Description of Artificial Sequence: Synthetic oligonucleotide
  Target: SCN10A; (-) strand; PAM type: YTN; PAM sequence: TTG
cttagaattgtcttgactat

SEQ ID NO: 55176 - DNA, 20 bp, Artificial Sequence
  Description of Artificial Sequence: Synthetic oligonucleotide
  Target: SCN10A; (-) strand; PAM type: YTN; PAM sequence: TTT
gcttagaattgtcttgacta

SEQ ID NO: 55177 - DNA, 20 bp, Artificial Sequence
  Description of Artificial Sequence: Synthetic oligonucleotide
  Target: SCN10A; (-) strand; PAM type: YTN; PAM sequence: TTT
tgcttagaattgtcttgact

SEQ ID NO: 55178 - DNA, 20 bp, Artificial Sequence
  Description of Artificial Sequence: Synthetic oligonucleotide
  Target: SCN10A; (-) strand; PAM type: YTN; PAM sequence: TTT
ttgcttagaattgtcttgac

SEQ ID NO: 55179 - DNA, 20 bp, Artificial Sequence
  Description of Artificial Sequence: Synthetic oligonucleotide
  Target: SCN10A; (-) strand; PAM type: YTN; PAM sequence: CTT
tttgcttagaattgtcttga

SEQ ID NO: 55180 - DNA, 20 bp, Artificial Sequence
  Description of Artificial Sequence: Synthetic oligonucleotide
  Target: SCN10A; (-) strand; PAM type: YTN; PAM sequence: TTC
tttttgcttagaattgtctt

SEQ ID NO: 55181 - DNA, 20 bp, Artificial Sequence
  Description of Artificial Sequence: Synthetic oligonucleotide
  Target: SCN10A; (-) strand; PAM type: YTN; PAM sequence: CTT
ctttttgcttagaattgtct

SEQ ID NO: 55182 - DNA, 20 bp, Artificial Sequence
  Description of Artificial Sequence: Synthetic oligonucleotide
  Target: SCN10A; (-) strand; PAM type: YTN; PAM sequence: TTC
ttctttttgcttagaattgt

SEQ ID NO: 55183 - DNA, 20 bp, Artificial Sequence
  Description of Artificial Sequence: Synthetic oligonucleotide
  Target: SCN10A; (-) strand; PAM type: YTN; PAM sequence: TTT
cttctttttgcttagaattg

SEQ ID NO: 55184 - DNA, 20 bp, Artificial Sequence
  Description of Artificial Sequence: Synthetic oligonucleotide
  Target: SCN10A; (-) strand; PAM type: YTN; PAM sequence: CTT
tcttctttttgcttagaatt

SEQ ID NO: 55185 - DNA, 20 bp, Artificial Sequence
  Description of Artificial Sequence: Synthetic oligonucleotide
  Target: SCN10A; (-) strand; PAM type: YTN; PAM sequence: CTC
caactttcttctttttgctt

SEQ ID NO: 55186 - DNA, 20 bp, Artificial Sequence
  Description of Artificial Sequence: Synthetic oligonucleotide
  Target: SCN10A; (-) strand; PAM type: YTN; PAM sequence: TTG
aagtcaggtagcgtgatgcc

SEQ ID NO: 55187 - DNA, 20 bp, Artificial Sequence
  Description of Artificial Sequence: Synthetic oligonucleotide
  Target: SCN10A; (-) strand; PAM type: YTN; PAM sequence: CTT
gaagtcaggtagcgtgatgc

SEQ ID NO: 55188 - DNA, 20 bp, Artificial Sequence
  Description of Artificial Sequence: Synthetic oligonucleotide
  Target: SCN10A; (-) strand; PAM type: YTN; PAM sequence: TTG
tagtatagcttgaagtcagg

SEQ ID NO: 55189 - DNA, 20 bp, Artificial Sequence
  Description of Artificial Sequence: Synthetic oligonucleotide
  Target: SCN10A; (-) strand; PAM type: YTN; PAM sequence: TTT
gtagtatagcttgaagtcag

SEQ ID NO: 55190 - DNA, 20 bp, Artificial Sequence
  Description of Artificial Sequence: Synthetic oligonucleotide
  Target: SCN10A; (-) strand; PAM type: YTN; PAM sequence: CTT
tgtagtatagcttgaagtca

SEQ ID NO: 55191 - DNA, 20 bp, Artificial Sequence
  Description of Artificial Sequence: Synthetic oligonucleotide
  Target: SCN10A; (-) strand; PAM type: YTN; PAM sequence: CTG
tagctttgtagtatagcttg

SEQ ID NO: 55192 - DNA, 20 bp, Artificial Sequence
  Description of Artificial Sequence: Synthetic oligonucleotide
  Target: SCN10A; (-) strand; PAM type: YTN; PAM sequence: TTA
ctgtagctttgtagtatagc

SEQ ID NO: 55193 - DNA, 20 bp, Artificial Sequence
  Description of Artificial Sequence: Synthetic oligonucleotide
  Target: SCN10A; (-) strand; PAM type: YTN; PAM sequence: TTG
gttactgtagctttgtagta

SEQ ID NO: 55194 - DNA, 20 bp, Artificial Sequence
  Description of Artificial Sequence: Synthetic oligonucleotide
  Target: SCN10A; (-) strand; PAM type: YTN; PAM sequence: TTT
ggttactgtagctttgtagt

SEQ ID NO: 55195 - DNA, 20 bp, Artificial Sequence
  Description of Artificial Sequence: Synthetic oligonucleotide
  Target: SCN10A; (-) strand; PAM type: YTN; PAM sequence: TTT
tggttactgtagctttgtag

SEQ ID NO: 55196 - DNA, 20 bp, Artificial Sequence
  Description of Artificial Sequence: Synthetic oligonucleotide
  Target: SCN10A; (-) strand; PAM type: YTN; PAM sequence: CTG
ttttggttactgtagctttg

SEQ ID NO: 55197 - DNA, 20 bp, Artificial Sequence
  Description of Artificial Sequence: Synthetic oligonucleotide
  Target: SCN10A; (-) strand; PAM type: YTN; PAM sequence: CTC
gctgttttggttactgtagc

SEQ ID NO: 55198 - DNA, 20 bp, Artificial Sequence
  Description of Artificial Sequence: Synthetic oligonucleotide
  Target: SCN10A; (-) strand; PAM type: YTN; PAM sequence: TTG
gtaccagtacctcgctgttt

SEQ ID NO: 55199 - DNA, 20 bp, Artificial Sequence
  Description of Artificial Sequence: Synthetic oligonucleotide
  Target: SCN10A; (-) strand; PAM type: YTN; PAM sequence: TTT
ggtaccagtacctcgctgtt

SEQ ID NO: 55200 - DNA, 20 bp, Artificial Sequence
  Description of Artificial Sequence: Synthetic oligonucleotide
  Target: SCN10A; (-) strand; PAM type: YTN; PAM sequence: TTT
tggtaccagtacctcgctgt

SEQ ID NO: 55201 - DNA, 20 bp, Artificial Sequence
  Description of Artificial Sequence: Synthetic oligonucleotide
  Target: SCN10A; (-) strand; PAM type: YTN; PAM sequence: CTG
ttttggtaccagtacctcgc

SEQ ID NO: 55202 - DNA, 20 bp, Artificial Sequence
  Description of Artificial Sequence: Synthetic oligonucleotide
  Target: SCN10A; (-) strand; PAM type: YTN; PAM sequence: CTA
gatatctgttttggtaccag

SEQ ID NO: 55203 - DNA, 20 bp, Artificial Sequence
  Description of Artificial Sequence: Synthetic oligonucleotide
  Target: SCN10A; (-) strand; PAM type: YTN; PAM sequence: TTG
gtctagatatctgttttggt

SEQ ID NO: 55204 - DNA, 20 bp, Artificial Sequence
  Description of Artificial Sequence: Synthetic oligonucleotide
  Target: SCN10A; (-) strand; PAM type: YTN; PAM sequence: TTC
cattggtctagatatctgtt

SEQ ID NO: 55205 - DNA, 20 bp, Artificial Sequence
  Description of Artificial Sequence: Synthetic oligonucleotide
  Target: SCN10A; (-) strand; PAM type: YTN; PAM sequence: CTG
ttccattggtctagatatct

SEQ ID NO: 55206 - DNA, 20 bp, Artificial Sequence
  Description of Artificial Sequence: Synthetic oligonucleotide
  Target: SCN10A; (-) strand; PAM type: YTN; PAM sequence: TTC
tgttccattggtctagatat

SEQ ID NO: 55207 - DNA, 20 bp, Artificial Sequence
  Description of Artificial Sequence: Synthetic oligonucleotide
  Target: SCN10A; (-) strand; PAM type: YTN; PAM sequence: CTG
ttctgttccattggtctaga

SEQ ID NO: 55208 - DNA, 20 bp, Artificial Sequence
  Description of Artificial Sequence: Synthetic oligonucleotide
  Target: SCN10A; (-) strand; PAM type: YTN; PAM sequence: CTC
tgttctgttccattggtcta

SEQ ID NO: 55209 - DNA, 20 bp, Artificial Sequence
  Description of Artificial Sequence: Synthetic oligonucleotide
  Target: SCN10A; (-) strand; PAM type: YTN; PAM sequence: CTG
aggcctctgttctgttccat

SEQ ID NO: 55210 - DNA, 20 bp, Artificial Sequence
  Description of Artificial Sequence: Synthetic oligonucleotide
  Target: SCN10A; (-) strand; PAM type: YTN; PAM sequence: TTC
tgaggcctctgttctgttcc

SEQ ID NO: 55211 - DNA, 20 bp, Artificial Sequence
  Description of Artificial Sequence: Synthetic oligonucleotide
  Target: SCN10A; (-) strand; PAM type: YTN; PAM sequence: CTT
ctgaggcctctgttctgttc

SEQ ID NO: 55212 - DNA, 20 bp, Artificial Sequence
  Description of Artificial Sequence: Synthetic oligonucleotide
  Target: SCN10A; (-) strand; PAM type: YTN; PAM sequence: TTA
cttctgaggcctctgttctg

SEQ ID NO: 55213 - DNA, 20 bp, Artificial Sequence
  Description of Artificial Sequence: Synthetic oligonucleotide
  Target: SCN10A; (-) strand; PAM type: YTN; PAM sequence: TTG
tagatatgcggtgttacttc

SEQ ID NO: 55214 - DNA, 20 bp, Artificial Sequence
  Description of Artificial Sequence: Synthetic oligonucleotide
  Target: SCN10A; (-) strand; PAM type: YTN; PAM sequence: TTG
tcaaagatcagatggttgta

SEQ ID NO: 55215 - DNA, 20 bp, Artificial Sequence
  Description of Artificial Sequence: Synthetic oligonucleotide
  Target: SCN10A; (-) strand; PAM type: YTN; PAM sequence: TTT
gtcaaagatcagatggttgt

SEQ ID NO: 55216 - DNA, 20 bp, Artificial Sequence
  Description of Artificial Sequence: Synthetic oligonucleotide
  Target: SCN10A; (-) strand; PAM type: YTN; PAM sequence: TTG
tcaagtttgtcaaagatcag

SEQ ID NO: 55217 - DNA, 20 bp, Artificial Sequence
  Description of Artificial Sequence: Synthetic oligonucleotide
  Target: SCN10A; (-) strand; PAM type: YTN; PAM sequence: TTT
gtcaagtttgtcaaagatca

SEQ ID NO: 55218 - DNA, 20 bp, Artificial Sequence
  Description of Artificial Sequence: Synthetic oligonucleotide
  Target: SCN10A; (-) strand; PAM type: YTN; PAM sequence: TTT
tgtcaagtttgtcaaagatc

SEQ ID NO: 55219 - DNA, 20 bp, Artificial Sequence
  Description of Artificial Sequence: Synthetic oligonucleotide
  Target: SCN10A; (-) strand; PAM type: YTN; PAM sequence: CTT
ttgtcaagtttgtcaaagat

SEQ ID NO: 55220 - DNA, 20 bp, Artificial Sequence
  Description of Artificial Sequence: Synthetic oligonucleotide
  Target: SCN10A; (-) strand; PAM type: YTN; PAM sequence: TTG
cttttgtcaagtttgtcaaa

SEQ ID NO: 55221 - DNA, 20 bp, Artificial Sequence
  Description of Artificial Sequence: Synthetic oligonucleotide
  Target: SCN10A; (-) strand; PAM type: YTN; PAM sequence: CTT
gcttttgtcaagtttgtcaa

SEQ ID NO: 55222 - DNA, 20 bp, Artificial Sequence
  Description of Artificial Sequence: Synthetic oligonucleotide
  Target: SCN10A; (-) strand; PAM type: YTN; PAM sequence: TTG
cttgcttttgtcaagtttgt

SEQ ID NO: 55223 - DNA, 20 bp, Artificial Sequence
  Description of Artificial Sequence: Synthetic oligonucleotide
  Target: SCN10A; (-) strand; PAM type: YTN; PAM sequence: TTC
cccattgcttgcttttgtca

SEQ ID NO: 55224 - DNA, 20 bp, Artificial Sequence
  Description of Artificial Sequence: Synthetic oligonucleotide
  Target: SCN10A; (-) strand; PAM type: YTN; PAM sequence: TTT
ccccattgcttgcttttgtc

SEQ ID NO: 55225 - DNA, 20 bp, Artificial Sequence
  Description of Artificial Sequence: Synthetic oligonucleotide
  Target: SCN10A; (-) strand; PAM type: YTN; PAM sequence: CTT
tccccattgcttgcttttgt

SEQ ID NO: 55226 - DNA, 20 bp, Artificial Sequence
  Description of Artificial Sequence: Synthetic oligonucleotide
  Target: SCN10A; (-) strand; PAM type: YTN; PAM sequence: TTA
aatagggaatcctttcccca

SEQ ID NO: 55227 - DNA, 20 bp, Artificial Sequence
  Description of Artificial Sequence: Synthetic oligonucleotide
  Target: SCN10A; (-) strand; PAM type: YTN; PAM sequence: TTA
ttaaatagggaatcctttcc

SEQ ID NO: 55228 - DNA, 20 bp, Artificial Sequence
  Description of Artificial Sequence: Synthetic oligonucleotide
  Target: SCN10A; (-) strand; PAM type: YTN; PAM sequence: TTT
attaaatagggaatcctttc

SEQ ID NO: 55229 - DNA, 20 bp, Artificial Sequence
  Description of Artificial Sequence: Synthetic oligonucleotide
  Target: SCN10A; (-) strand; PAM type: YTN; PAM sequence: TTC
cccacaccatttattaaata

SEQ ID NO: 55230 - DNA, 20 bp, Artificial Sequence
  Description of Artificial Sequence: Synthetic oligonucleotide
  Target: SCN10A; (-) strand; PAM type: YTN; PAM sequence: TTT
ccccacaccatttattaaat

SEQ ID NO: 55231 - DNA, 20 bp, Artificial Sequence
  Description of Artificial Sequence: Synthetic oligonucleotide
  Target: SCN10A; (-) strand; PAM type: YTN; PAM sequence: TTT
tccccacaccatttattaaa

SEQ ID NO: 55232 - DNA, 20 bp, Artificial Sequence
  Description of Artificial Sequence: Synthetic oligonucleotide
  Target: SCN10A; (-) strand; PAM type: YTN; PAM sequence: CTA
gccagttttccccacaccat

SEQ ID NO: 55233 - DNA, 20 bp, Artificial Sequence
  Description of Artificial Sequence: Synthetic oligonucleotide
  Target: SCN10A; (-) strand; PAM type: YTN; PAM sequence: CTA
aggctagccagttttcccca

SEQ ID NO: 55234 - DNA, 20 bp, Artificial Sequence
  Description of Artificial Sequence: Synthetic oligonucleotide
  Target: SCN10A; (-) strand; PAM type: YTN; PAM sequence: CTG
cctaaggctagccagttttc

SEQ ID NO: 55235 - DNA, 20 bp, Artificial Sequence
  Description of Artificial Sequence: Synthetic oligonucleotide
  Target: SCN10A; (-) strand; PAM type: YTN; PAM sequence: TTC
tgcctaaggctagccagttt

SEQ ID NO: 55236 - DNA, 20 bp, Artificial Sequence
  Description of Artificial Sequence: Synthetic oligonucleotide
  Target: SCN10A; (-) strand; PAM type: YTN; PAM sequence: TTT
ctgcctaaggctagccagtt

SEQ ID NO: 55237 - DNA, 20 bp, Artificial Sequence
  Description of Artificial Sequence: Synthetic oligonucleotide
  Target: SCN10A; (-) strand; PAM type: YTN; PAM sequence: TTT
tctgcctaaggctagccagt

SEQ ID NO: 55238 - DNA, 20 bp, Artificial Sequence
  Description of Artificial Sequence: Synthetic oligonucleotide
  Target: SCN10A; (-) strand; PAM type: YTN; PAM sequence: TTC
aattttctgcctaaggctag

SEQ ID NO: 55239 - DNA, 20 bp, Artificial Sequence
  Description of Artificial Sequence: Synthetic oligonucleotide
  Target: SCN10A; (-) strand; PAM type: YTN; PAM sequence: TTT
caattttctgcctaaggcta

SEQ ID NO: 55240 - DNA, 20 bp, Artificial Sequence
  Description of Artificial Sequence: Synthetic oligonucleotide
  Target: SCN10A; (-) strand; PAM type: YTN; PAM sequence: CTA
gtttcaattttctgcctaag

SEQ ID NO: 55241 - DNA, 20 bp, Artificial Sequence
  Description of Artificial Sequence: Synthetic oligonucleotide
  Target: SCN10A; (-) strand; PAM type: YTN; PAM sequence: TTG
tgtaaggtataaggaaggga

SEQ ID NO: 55242 - DNA, 20 bp, Artificial Sequence
  Description of Artificial Sequence: Synthetic oligonucleotide
  Target: SCN10A; (-) strand; PAM type: YTN; PAM sequence: TTT
gtgtaaggtataaggaaggg

SEQ ID NO: 55243 - DNA, 20 bp, Artificial Sequence
  Description of Artificial Sequence: Synthetic oligonucleotide
  Target: SCN10A; (-) strand; PAM type: YTN; PAM sequence: TTT
tgtgtaaggtataaggaagg

SEQ ID NO: 55244 - DNA, 20 bp, Artificial Sequence
  Description of Artificial Sequence: Synthetic oligonucleotide
  Target: SCN10A; (-) strand; PAM type: YTN; PAM sequence: TTT
ttgtgtaaggtataaggaag

SEQ ID NO: 55245 - DNA, 20 bp, Artificial Sequence
  Description of Artificial Sequence: Synthetic oligonucleotide
  Target: SCN10A; (-) strand; PAM type: YTN; PAM sequence: TTA
atttttgtgtaaggtataag

SEQ ID NO: 55246 - DNA, 20 bp, Artificial Sequence
  Description of Artificial Sequence: Synthetic oligonucleotide
  Target: SCN10A; (-) strand; PAM type: YTN; PAM sequence: TTG
agttaatttttgtgtaaggt

SEQ ID NO: 55247 - DNA, 20 bp, Artificial Sequence
  Description of Artificial Sequence: Synthetic oligonucleotide
  Target: SCN10A; (-) strand; PAM type: YTN; PAM sequence: CTT
gagttaatttttgtgtaagg

SEQ ID NO: 55248 - DNA, 20 bp, Artificial Sequence
  Description of Artificial Sequence: Synthetic oligonucleotide
  Target: SCN10A; (-) strand; PAM type: YTN; PAM sequence: CTA
tcttgagttaatttttgtgt

SEQ ID NO: 55249 - DNA, 20 bp, Artificial Sequence
  Description of Artificial Sequence: Synthetic oligonucleotide
  Target: SCN10A; (-) strand; PAM type: YTN; PAM sequence: TTA
atctatcttgagttaatttt

SEQ ID NO: 55250 - DNA, 20 bp, Artificial Sequence
  Description of Artificial Sequence: Synthetic oligonucleotide
  Target: SCN10A; (-) strand; PAM type: YTN; PAM sequence: TTT
aatctatcttgagttaattt

SEQ ID NO: 55251 - DNA, 20 bp, Artificial Sequence
  Description of Artificial Sequence: Synthetic oligonucleotide
  Target: SCN10A; (-) strand; PAM type: YTN; PAM sequence: CTT
taatctatcttgagttaatt

SEQ ID NO: 55252 - DNA, 20 bp, Artificial Sequence
  Description of Artificial Sequence: Synthetic oligonucleotide
  Target: SCN10A; (-) strand; PAM type: YTN; PAM sequence: TTA
agtctttaatctatcttgag

SEQ ID NO: 55253 - DNA, 20 bp, Artificial Sequence
  Description of Artificial Sequence: Synthetic oligonucleotide
  Target: SCN10A; (-) strand; PAM type: YTN; PAM sequence: TTT
aagtctttaatctatcttga

SEQ ID NO: 55254 - DNA, 20 bp, Artificial Sequence
  Description of Artificial Sequence: Synthetic oligonucleotide
  Target: SCN10A; (-) strand; PAM type: YTN; PAM sequence: TTA
tgtttaagtctttaatctat

SEQ ID NO: 55255 - DNA, 20 bp, Artificial Sequence
  Description of Artificial Sequence: Synthetic oligonucleotide
  Target: SCN10A; (-) strand; PAM type: YTN; PAM sequence: CTT
atgtttaagtctttaatcta

SEQ ID NO: 55256 - DNA, 20 bp, Artificial Sequence
  Description of Artificial Sequence: Synthetic oligonucleotide
  Target: SCN10A; (-) strand; PAM type: YTN; PAM sequence: TTA
ggtcttatgtttaagtcttt

SEQ ID NO: 55257 - DNA, 20 bp, Artificial Sequence
  Description of Artificial Sequence: Synthetic oligonucleotide
  Target: SCN10A; (-) strand; PAM type: YTN; PAM sequence: TTT
aggtcttatgtttaagtctt

SEQ ID NO: 55258 - DNA, 20 bp, Artificial Sequence
  Description of Artificial Sequence: Synthetic oligonucleotide
  Target: SCN10A; (-) strand; PAM type: YTN; PAM sequence: TTT
taggtcttatgtttaagtct

SEQ ID NO: 55259 - DNA, 20 bp, Artificial Sequence
  Description of Artificial Sequence: Synthetic oligonucleotide
  Target: SCN10A; (-) strand; PAM type: YTN; PAM sequence: TTA
tggttttaggtcttatgttt

SEQ ID NO: 55260 - DNA, 20 bp, Artificial Sequence
  Description of Artificial Sequence: Synthetic oligonucleotide
  Target: SCN10A; (-) strand; PAM type: YTN; PAM sequence: TTT
atggttttaggtcttatgtt

SEQ ID NO: 55261 - DNA, 20 bp, Artificial Sequence
  Description of Artificial Sequence: Synthetic oligonucleotide
  Target: SCN10A; (-) strand; PAM type: YTN; PAM sequence: TTT
tatggttttaggtcttatgt

SEQ ID NO: 55262 - DNA, 20 bp, Artificial Sequence
  Description of Artificial Sequence: Synthetic oligonucleotide
  Target: SCN10A; (-) strand; PAM type: YTN; PAM sequence: TTT
ttatggttttaggtcttatg

SEQ ID NO: 55263 - DNA, 20 bp, Artificial Sequence
  Description of Artificial Sequence: Synthetic oligonucleotide
  Target: SCN10A; (-) strand; PAM type: YTN; PAM sequence: CTA
gggtttttatggttttaggt

SEQ ID NO: 55264 - DNA, 20 bp, Artificial Sequence
  Description of Artificial Sequence: Synthetic oligonucleotide
  Target: SCN10A; (-) strand; PAM type: YTN; PAM sequence: TTC
tagggtttttatggttttag

SEQ ID NO: 55265 - DNA, 20 bp, Artificial Sequence
  Description of Artificial Sequence: Synthetic oligonucleotide
  Target: SCN10A; (-) strand; PAM type: YTN; PAM sequence: CTT
ctagggtttttatggtttta

SEQ ID NO: 55266 - DNA, 20 bp, Artificial Sequence
  Description of Artificial Sequence: Synthetic oligonucleotide
  Target: SCN10A; (-) strand; PAM type: YTN; PAM sequence: TTC
ttctagggtttttatggttt

SEQ ID NO: 55267 - DNA, 20 bp, Artificial Sequence
  Description of Artificial Sequence: Synthetic oligonucleotide
  Target: SCN10A; (-) strand; PAM type: YTN; PAM sequence: TTT
cttctagggtttttatggtt

SEQ ID NO: 55268 - DNA, 20 bp, Artificial Sequence
  Description of Artificial Sequence: Synthetic oligonucleotide
  Target: SCN10A; (-) strand; PAM type: YTN; PAM sequence: TTT
tcttctagggtttttatggt

SEQ ID NO: 55269 - DNA, 20 bp, Artificial Sequence
  Description of Artificial Sequence: Synthetic oligonucleotide
  Target: SCN10A; (-) strand; PAM type: YTN; PAM sequence: CTA
ggttttcttctagggttttt

SEQ ID NO: 55270 - DNA, 20 bp, Artificial Sequence
  Description of Artificial Sequence: Synthetic oligonucleotide
  Target: SCN10A; (-) strand; PAM type: YTN; PAM sequence: TTG
cctaggttttcttctagggt

SEQ ID NO: 55271 - DNA, 20 bp, Artificial Sequence
  Description of Artificial Sequence: Synthetic oligonucleotide
  Target: SCN10A; (-) strand; PAM type: YTN; PAM sequence: CTG
aagggtattgcctaggtttt

SEQ ID NO: 55272 - DNA, 20 bp, Artificial Sequence
  Description of Artificial Sequence: Synthetic oligonucleotide
  Target: SCN10A; (-) strand; PAM type: YTN; PAM sequence: CTA
tgtcctgaagggtattgcct

SEQ ID NO: 55273 - DNA, 20 bp, Artificial Sequence
  Description of Artificial Sequence: Synthetic oligonucleotide
  Target: SCN10A; (-) strand; PAM type: YTN; PAM sequence: TTG
cccatgcctatgtcctgaag

SEQ ID NO: 55274 - DNA, 20 bp, Artificial Sequence
  Description of Artificial Sequence: Synthetic oligonucleotide
  Target: SCN10A; (-) strand; PAM type: YTN; PAM sequence: TTT
gcccatgcctatgtcctgaa

SEQ ID NO: 55275 - DNA, 20 bp, Artificial Sequence
  Description of Artificial Sequence: Synthetic oligonucleotide
  Target: SCN10A; (-) strand; PAM type: YTN; PAM sequence: CTT
tgcccatgcctatgtcctga

SEQ ID NO: 55276 - DNA, 20 bp, Artificial Sequence
  Description of Artificial Sequence: Synthetic oligonucleotide
  Target: SCN10A; (-) strand; PAM type: YTN; PAM sequence: TTA
gtcataaagcctttgcccat

SEQ ID NO: 55277 - DNA, 20 bp, Artificial Sequence
  Description of Artificial Sequence: Synthetic oligonucleotide
  Target: SCN10A; (-) strand; PAM type: YTN; PAM sequence: TTG
atgtgttagtcataaagcct

SEQ ID NO: 55278 - DNA, 20 bp, Artificial Sequence
  Description of Artificial Sequence: Synthetic oligonucleotide
  Target: SCN10A; (-) strand; PAM type: YTN; PAM sequence: TTT
gatgtgttagtcataaagcc

SEQ ID NO: 55279 - DNA, 20 bp, Artificial Sequence
  Description of Artificial Sequence: Synthetic oligonucleotide
  Target: SCN10A; (-) strand; PAM type: YTN; PAM sequence: TTT
tgatgtgttagtcataaagc

SEQ ID NO: 55280 - DNA, 20 bp, Artificial Sequence
  Description of Artificial Sequence: Synthetic oligonucleotide
  Target: SCN10A; (-) strand; PAM type: YTN; PAM sequence: CTT
ttgatgtgttagtcataaag

SEQ ID NO: 55281 - DNA, 20 bp, Artificial Sequence
  Description of Artificial Sequence: Synthetic oligonucleotide
  Target: SCN10A; (-) strand; PAM type: YTN; PAM sequence: TTG
cttttgatgtgttagtcata

SEQ ID NO: 55282 - DNA, 20 bp, Artificial Sequence
  Description of Artificial Sequence: Synthetic oligonucleotide
  Target: SCN10A; (-) strand; PAM type: YTN; PAM sequence: TTG
tcaccattgcttttgatgtg

SEQ ID NO: 55283 - DNA, 20 bp, Artificial Sequence
  Description of Artificial Sequence: Synthetic oligonucleotide
  Target: SCN10A; (-) strand; PAM type: YTN; PAM sequence: TTT
gtcaccattgcttttgatgt

SEQ ID NO: 55284 - DNA, 20 bp, Artificial Sequence
  Description of Artificial Sequence: Synthetic oligonucleotide
  Target: SCN10A; (-) strand; PAM type: YTN; PAM sequence: TTT
tgtcaccattgcttttgatg

SEQ ID NO: 55285 - DNA, 20 bp, Artificial Sequence
  Description of Artificial Sequence: Synthetic oligonucleotide
  Target: SCN10A; (-) strand; PAM type: YTN; PAM sequence: CTT
ttgtcaccattgcttttgat

SEQ ID NO: 55286 - DNA, 20 bp, Artificial Sequence
  Description of Artificial Sequence: Synthetic oligonucleotide
  Target: SCN10A; (-) strand; PAM type: YTN; PAM sequence: TTG
gcttttgtcaccattgcttt

SEQ ID NO: 55287 - DNA, 20 bp, Artificial Sequence
  Description of Artificial Sequence: Synthetic oligonucleotide
  Target: SCN10A; (-) strand; PAM type: YTN; PAM sequence: TTT
ggcttttgtcaccattgctt

SEQ ID NO: 55288 - DNA, 20 bp, Artificial Sequence
  Description of Artificial Sequence: Synthetic oligonucleotide
  Target: SCN10A; (-) strand; PAM type: YTN; PAM sequence: TTT
tggcttttgtcaccattgct

SEQ ID NO: 55289 - DNA, 20 bp, Artificial Sequence
  Description of Artificial Sequence: Synthetic oligonucleotide
  Target: SCN10A; (-) strand; PAM type: YTN; PAM sequence: TTG
tcaattttggcttttgtcac

SEQ ID NO: 55290 - DNA, 20 bp, Artificial Sequence
  Description of Artificial Sequence: Synthetic oligonucleotide
  Target: SCN10A; (-) strand; PAM type: YTN; PAM sequence: TTT
gtcaattttggcttttgtca

SEQ ID NO: 55291 - DNA, 20 bp, Artificial Sequence
  Description of Artificial Sequence: Synthetic oligonucleotide
  Target: SCN10A; (-) strand; PAM type: YTN; PAM sequence: TTC
catttgtcaattttggcttt

SEQ ID NO: 55292 - DNA, 20 bp, Artificial Sequence
  Description of Artificial Sequence: Synthetic oligonucleotide
  Target: SCN10A; (-) strand; PAM type: YTN; PAM sequence: TTG
gattccatttgtcaattttg

SEQ ID NO: 55293 - DNA, 20 bp, Artificial Sequence
  Description of Artificial Sequence: Synthetic oligonucleotide
  Target: SCN10A; (-) strand; PAM type: YTN; PAM sequence: TTA
attggattccatttgtcaat

SEQ ID NO: 55294 - DNA, 20 bp, Artificial Sequence
  Description of Artificial Sequence: Synthetic oligonucleotide
  Target: SCN10A; (-) strand; PAM type: YTN; PAM sequence: TTT
aattggattccatttgtcaa

SEQ ID NO: 55295 - DNA, 20 bp, Artificial Sequence
  Description of Artificial Sequence: Synthetic oligonucleotide
  Target: SCN10A; (-) strand; PAM type: YTN; PAM sequence: TTA
gtttaattggattccatttg

SEQ ID NO: 55296 - DNA, 20 bp, Artificial Sequence
  Description of Artificial Sequence: Synthetic oligonucleotide
  Target: SCN10A; (-) strand; PAM type: YTN; PAM sequence: TTT
agtttaattggattccattt

SEQ ID NO: 55297 - DNA, 20 bp, Artificial Sequence
  Description of Artificial Sequence: Synthetic oligonucleotide
  Target: SCN10A; (-) strand; PAM type: YTN; PAM sequence: CTT
tagtttaattggattccatt

SEQ ID NO: 55298 - DNA, 20 bp, Artificial Sequence
  Description of Artificial Sequence: Synthetic oligonucleotide
  Target: SCN10A; (-) strand; PAM type: YTN; PAM sequence: CTC
tttagtttaattggattcca

SEQ ID NO: 55299 - DNA, 20 bp, Artificial Sequence
  Description of Artificial Sequence: Synthetic oligonucleotide
  Target: SCN10A; (-) strand; PAM type: YTN; PAM sequence: CTG
tgcagaagctctttagttta

SEQ ID NO: 55300 - DNA, 20 bp, Artificial Sequence
  Description of Artificial Sequence: Synthetic oligonucleotide
  Target: SCN10A; (-) strand; PAM type: YTN; PAM sequence: TTG
ctgtgcagaagctctttagt

SEQ ID NO: 55301 - DNA, 20 bp, Artificial Sequence
  Description of Artificial Sequence: Synthetic oligonucleotide
  Target: SCN10A; (-) strand; PAM type: YTN; PAM sequence: TTT
gctgtgcagaagctctttag

SEQ ID NO: 55302 - DNA, 20 bp, Artificial Sequence
  Description of Artificial Sequence: Synthetic oligonucleotide
  Target: SCN10A; (-) strand; PAM type: YTN; PAM sequence: TTT
tgctgtgcagaagctcttta

SEQ ID NO: 55303 - DNA, 20 bp, Artificial Sequence
  Description of Artificial Sequence: Synthetic oligonucleotide
  Target: SCN10A; (-) strand; PAM type: YTN; PAM sequence: CTT
ttgctgtgcagaagctcttt

SEQ ID NO: 55304 - DNA, 20 bp, Artificial Sequence
  Description of Artificial Sequence: Synthetic oligonucleotide
  Target: SCN10A; (-) strand; PAM type: YTN; PAM sequence: TTC
ttttgctgtgcagaagctct

SEQ ID NO: 55305 - DNA, 20 bp, Artificial Sequence
  Description of Artificial Sequence: Synthetic oligonucleotide
  Target: SCN10A; (-) strand; PAM type: YTN; PAM sequence: TTT
cttttgctgtgcagaagctc

SEQ ID NO: 55306 - DNA, 20 bp, Artificial Sequence
  Description of Artificial Sequence: Synthetic oligonucleotide
  Target: SCN10A; (-) strand; PAM type: YTN; PAM sequence: CTG
atgatagtttcttttgctgt

SEQ ID NO: 55307 - DNA, 20 bp, Artificial Sequence
  Description of Artificial Sequence: Synthetic oligonucleotide
  Target: SCN10A; (-) strand; PAM type: YTN; PAM sequence: CTC
tgatgatagtttcttttgct

SEQ ID NO: 55308 - DNA, 20 bp, Artificial Sequence
  Description of Artificial Sequence: Synthetic oligonucleotide
  Target: SCN10A; (-) strand; PAM type: YTN; PAM sequence: TTC
actctgatgatagtttcttt

SEQ ID NO: 55309 - DNA, 20 bp, Artificial Sequence
  Description of Artificial Sequence: Synthetic oligonucleotide
  Target: SCN10A; (-) strand; PAM type: YTN; PAM sequence: CTA
ttcactctgatgatagtttc

SEQ ID NO: 55310 - DNA, 20 bp, Artificial Sequence
  Description of Artificial Sequence: Synthetic oligonucleotide
  Target: SCN10A; (-) strand; PAM type: YTN; PAM sequence: TTA
cctattcactctgatgatag

SEQ ID NO: 55311 - DNA, 20 bp, Artificial Sequence
  Description of Artificial Sequence: Synthetic oligonucleotide
  Target: SCN10A; (-) strand; PAM type: YTN; PAM sequence: CTG
taggttacctattcactctg

SEQ ID NO: 55312 - DNA, 20 bp, Artificial Sequence
  Description of Artificial Sequence: Synthetic oligonucleotide
  Target: SCN10A; (-) strand; PAM type: YTN; PAM sequence: TTC
tgtaggttacctattcactc

SEQ ID NO: 55313 - DNA, 20 bp, Artificial Sequence
  Description of Artificial Sequence: Synthetic oligonucleotide
  Target: SCN10A; (-) strand; PAM type: YTN; PAM sequence: CTC
ccattctgtaggttacctat

SEQ ID NO: 55314 - DNA, 20 bp, Artificial Sequence
  Description of Artificial Sequence: Synthetic oligonucleotide
  Target: SCN10A; (-) strand; PAM type: YTN; PAM sequence: TTC
tcccattctgtaggttacct

SEQ ID NO: 55315 - DNA, 20 bp, Artificial Sequence
  Description of Artificial Sequence: Synthetic oligonucleotide
  Target: SCN10A; (-) strand; PAM type: YTN; PAM sequence: TTT
ctcccattctgtaggttacc

SEQ ID NO: 55316 - DNA, 20 bp, Artificial Sequence
  Description of Artificial Sequence: Synthetic oligonucleotide
  Target: SCN10A; (-) strand; PAM type: YTN; PAM sequence: TTT
tctcccattctgtaggttac

SEQ ID NO: 55317 - DNA, 20 bp, Artificial Sequence
  Description of Artificial Sequence: Synthetic oligonucleotide
  Target: SCN10A; (-) strand; PAM type: YTN; PAM sequence: TTG
caaaaattttctcccattct

SEQ ID NO: 55318 - DNA, 20 bp, Artificial Sequence
  Description of Artificial Sequence: Synthetic oligonucleotide
  Target: SCN10A; (-) strand; PAM type: YTN; PAM sequence: TTG
atagattgcaaaaattttct

SEQ ID NO: 55319 - DNA, 20 bp, Artificial Sequence
  Description of Artificial Sequence: Synthetic oligonucleotide
  Target: SCN10A; (-) strand; PAM type: YTN; PAM sequence: TTG
tcagattgatagattgcaaa

SEQ ID NO: 55320 - DNA, 20 bp, Artificial Sequence
  Description of Artificial Sequence: Synthetic oligonucleotide
  Target: SCN10A; (-) strand; PAM type: YTN; PAM sequence: TTT
gtcagattgatagattgcaa

SEQ ID NO: 55321 - DNA, 20 bp, Artificial Sequence
  Description of Artificial Sequence: Synthetic oligonucleotide
  Target: SCN10A; (-) strand; PAM type: YTN; PAM sequence: CTT
tgtcagattgatagattgca

SEQ ID NO: 55322 - DNA, 20 bp, Artificial Sequence
  Description of Artificial Sequence: Synthetic oligonucleotide
  Target: SCN10A; (-) strand; PAM type: YTN; PAM sequence: TTA
gccctttgtcagattgatag

SEQ ID NO: 55323 - DNA, 20 bp, Artificial Sequence
  Description of Artificial Sequence: Synthetic oligonucleotide
  Target: SCN10A; (-) strand; PAM type: YTN; PAM sequence: CTG
gatattagccctttgtcaga

SEQ ID NO: 55324 - DNA, 20 bp, Artificial Sequence
  Description of Artificial Sequence: Synthetic oligonucleotide
  Target: SCN10A; (-) strand; PAM type: YTN; PAM sequence: TTC
tggatattagccctttgtca

SEQ ID NO: 55325 - DNA, 20 bp, Artificial Sequence
  Description of Artificial Sequence: Synthetic oligonucleotide
  Target: SCN10A; (-) strand; PAM type: YTN; PAM sequence: TTG
tagattctggatattagccc

SEQ ID NO: 55326 - DNA, 20 bp, Artificial Sequence
  Description of Artificial Sequence: Synthetic oligonucleotide
  Target: SCN10A; (-) strand; PAM type: YTN; PAM sequence: TTT
gtagattctggatattagcc

SEQ ID NO: 55327 - DNA, 20 bp, Artificial Sequence
  Description of Artificial Sequence: Synthetic oligonucleotide
  Target: SCN10A; (-) strand; PAM type: YTN; PAM sequence: TTT
tgtagattctggatattagc

SEQ ID NO: 55328 - DNA, 20 bp, Artificial Sequence
  Description of Artificial Sequence: Synthetic oligonucleotide
  Target: SCN10A; (-) strand; PAM type: YTN; PAM sequence: TTT
ttgtagattctggatattag

SEQ ID NO: 55329 - DNA, 20 bp, Artificial Sequence
  Description of Artificial Sequence: Synthetic oligonucleotide
  Target: SCN10A; (-) strand; PAM type: YTN; PAM sequence: TTT
tttgtagattctggatatta

SEQ ID NO: 55330 - DNA, 20 bp, Artificial Sequence
  Description of Artificial Sequence: Synthetic oligonucleotide
  Target: SCN10A; (-) strand; PAM type: YTN; PAM sequence: TTA
agttttttgtagattctgga

SEQ ID NO: 55331 - DNA, 20 bp, Artificial Sequence
  Description of Artificial Sequence: Synthetic oligonucleotide
  Target: SCN10A; (-) strand; PAM type: YTN; PAM sequence: TTT
aagttttttgtagattctgg

SEQ ID NO: 55332 - DNA, 20 bp, Artificial Sequence
  Description of Artificial Sequence: Synthetic oligonucleotide
  Target: SCN10A; (-) strand; PAM type: YTN; PAM sequence: TTG
tttaagttttttgtagattc

SEQ ID NO: 55333 - DNA, 20 bp, Artificial Sequence
  Description of Artificial Sequence: Synthetic oligonucleotide
  Target: SCN10A; (-) strand; PAM type: YTN; PAM sequence: TTT
gtttaagttttttgtagatt

SEQ ID NO: 55334 - DNA, 20 bp, Artificial Sequence
  Description of Artificial Sequence: Synthetic oligonucleotide
  Target: SCN10A; (-) strand; PAM type: YTN; PAM sequence: TTG
taaatttgtttaagtttttt

SEQ ID NO: 55335 - DNA, 20 bp, Artificial Sequence
  Description of Artificial Sequence: Synthetic oligonucleotide
  Target: SCN10A; (-) strand; PAM type: YTN; PAM sequence: CTT
gtaaatttgtttaagttttt

SEQ ID NO: 55336 - DNA, 20 bp, Artificial Sequence
  Description of Artificial Sequence: Synthetic oligonucleotide
  Target: SCN10A; (-) strand; PAM type: YTN; PAM sequence: TTC
ttgtaaatttgtttaagttt

SEQ ID NO: 55337 - DNA, 20 bp, Artificial Sequence
  Description of Artificial Sequence: Synthetic oligonucleotide
  Target: SCN10A; (-) strand; PAM type: YTN; PAM sequence: TTT
cttgtaaatttgtttaagtt

SEQ ID NO: 55338 - DNA, 20 bp, Artificial Sequence
  Description of Artificial Sequence: Synthetic oligonucleotide
  Target: SCN10A; (-) strand; PAM type: YTN; PAM sequence: TTT
tcttgtaaatttgtttaagt

SEQ ID NO: 55339 - DNA, 20 bp, Artificial Sequence
  Description of Artificial Sequence: Synthetic oligonucleotide
  Target: SCN10A; (-) strand; PAM type: YTN; PAM sequence: TTT
ttcttgtaaatttgtttaag

SEQ ID NO: 55340 - DNA, 20 bp, Artificial Sequence
  Description of Artificial Sequence: Synthetic oligonucleotide
  Target: SCN10A; (-) strand; PAM type: YTN; PAM sequence: TTT
tttcttgtaaatttgtttaa

SEQ ID NO: 55341 - DNA, 20 bp, Artificial Sequence
  Description of Artificial Sequence: Synthetic oligonucleotide
  Target: SCN10A; (-) strand; PAM type: YTN; PAM sequence: TTG
ttttttcttgtaaatttgtt

SEQ ID NO: 55342 - DNA, 20 bp, Artificial Sequence
  Description of Artificial Sequence: Synthetic oligonucleotide
  Target: SCN10A; (-) strand; PAM type: YTN; PAM sequence: TTG
atggagttgttttttcttgt

SEQ ID NO: 55343 - DNA, 20 bp, Artificial Sequence
  Description of Artificial Sequence: Synthetic oligonucleotide
  Target: SCN10A; (-) strand; PAM type: YTN; PAM sequence: TTT
gatggagttgttttttcttg

SEQ ID NO: 55344 - DNA, 20 bp, Artificial Sequence
  Description of Artificial Sequence: Synthetic oligonucleotide
  Target: SCN10A; (-) strand; PAM type: YTN; PAM sequence: TTT
tgatggagttgttttttctt

SEQ ID NO: 55345 - DNA, 20 bp, Artificial Sequence
  Description of Artificial Sequence: Synthetic oligonucleotide
  Target: SCN10A; (-) strand; PAM type: YTN; PAM sequence: TTT
ttgatggagttgttttttct

SEQ ID NO: 55346 - DNA, 20 bp, Artificial Sequence
  Description of Artificial Sequence: Synthetic oligonucleotide
  Target: SCN10A; (-) strand; PAM type: YTN; PAM sequence: CTT
tttgatggagttgttttttc

SEQ ID NO: 55347 - DNA, 20 bp, Artificial Sequence
  Description of Artificial Sequence: Synthetic oligonucleotide
  Target: SCN10A; (-) strand; PAM type: YTN; PAM sequence: TTG
cccactttttgatggagttg

SEQ ID NO: 55348 - DNA, 20 bp, Artificial Sequence
  Description of Artificial Sequence: Synthetic oligonucleotide
  Target: SCN10A; (-) strand; PAM type: YTN; PAM sequence: TTT
gcccactttttgatggagtt

SEQ ID NO: 55349 - DNA, 20 bp, Artificial Sequence
  Description of Artificial Sequence: Synthetic oligonucleotide
  Target: SCN10A; (-) strand; PAM type: YTN; PAM sequence: CTT
tgcccactttttgatggagt

SEQ ID NO: 55350 - DNA, 20 bp, Artificial Sequence
  Description of Artificial Sequence: Synthetic oligonucleotide
  Target: SCN10A; (-) strand; PAM type: YTN; PAM sequence: TTC
atatcctttgcccacttttt

SEQ ID NO: 55351 - DNA, 20 bp, Artificial Sequence
  Description of Artificial Sequence: Synthetic oligonucleotide
  Target: SCN10A; (-) strand; PAM type: YTN; PAM sequence: CTG
ttcatatcctttgcccactt

SEQ ID NO: 55352 - DNA, 20 bp, Artificial Sequence
  Description of Artificial Sequence: Synthetic oligonucleotide
  Target: SCN10A; (-) strand; PAM type: YTN; PAM sequence: TTG
agaagtgtctgttcatatcc

SEQ ID NO: 55353 - DNA, 20 bp, Artificial Sequence
  Description of Artificial Sequence: Synthetic oligonucleotide
  Target: SCN10A; (-) strand; PAM type: YTN; PAM sequence: TTT
gagaagtgtctgttcatatc

SEQ ID NO: 55354 - DNA, 20 bp, Artificial Sequence
  Description of Artificial Sequence: Synthetic oligonucleotide
  Target: SCN10A; (-) strand; PAM type: YTN; PAM sequence: TTT
tgagaagtgtctgttcatat

SEQ ID NO: 55355 - DNA, 20 bp, Artificial Sequence
  Description of Artificial Sequence: Synthetic oligonucleotide
  Target: SCN10A; (-) strand; PAM type: YTN; PAM sequence: CTT
ttgagaagtgtctgttcata

SEQ ID NO: 55356 - DNA, 20 bp, Artificial Sequence
  Description of Artificial Sequence: Synthetic oligonucleotide
  Target: SCN10A; (-) strand; PAM type: YTN; PAM sequence: TTC
ttttgagaagtgtctgttca

SEQ ID NO: 55357 - DNA, 20 bp, Artificial Sequence
  Description of Artificial Sequence: Synthetic oligonucleotide
  Target: SCN10A; (-) strand; PAM type: YTN; PAM sequence: CTT
cttttgagaagtgtctgttc

SEQ ID NO: 55358 - DNA, 20 bp, Artificial Sequence
  Description of Artificial Sequence: Synthetic oligonucleotide
  Target: SCN10A; (-) strand; PAM type: YTN; PAM sequence: CTG
cataaatgtcttcttttgag

SEQ ID NO: 55359 - DNA, 20 bp, Artificial Sequence
  Description of Artificial Sequence: Synthetic oligonucleotide
  Target: SCN10A; (-) strand; PAM type: YTN; PAM sequence: TTG
gctgcataaatgtcttcttt

SEQ ID NO: 55360 - DNA, 20 bp, Artificial Sequence
  Description of Artificial Sequence: Synthetic oligonucleotide
  Target: SCN10A; (-) strand; PAM type: YTN; PAM sequence: TTA
ttggctgcataaatgtcttc

SEQ ID NO: 55361 - DNA, 20 bp, Artificial Sequence
  Description of Artificial Sequence: Synthetic oligonucleotide
  Target: SCN10A; (-) strand; PAM type: YTN; PAM sequence: TTT
attggctgcataaatgtctt

SEQ ID NO: 55362 - DNA, 20 bp, Artificial Sequence
  Description of Artificial Sequence: Synthetic oligonucleotide
  Target: SCN10A; (-) strand; PAM type: YTN; PAM sequence: TTA
tcatatgtttattggctgca

SEQ ID NO: 55363 - DNA, 20 bp, Artificial Sequence
  Description of Artificial Sequence: Synthetic oligonucleotide
  Target: SCN10A; (-) strand; PAM type: YTN; PAM sequence: TTT
atcatatgtttattggctgc

SEQ ID NO: 55364 - DNA, 20 bp, Artificial Sequence
  Description of Artificial Sequence: Synthetic oligonucleotide
  Target: SCN10A; (-) strand; PAM type: YTN; PAM sequence: TTT
tatcatatgtttattggctg

SEQ ID NO: 55365 - DNA, 20 bp, Artificial Sequence
  Description of Artificial Sequence: Synthetic oligonucleotide
  Target: SCN10A; (-) strand; PAM type: YTN; PAM sequence: TTT
ttatcatatgtttattggct

SEQ ID NO: 55366 - DNA, 20 bp, Artificial Sequence
  Description of Artificial Sequence: Synthetic oligonucleotide
  Target: SCN10A; (-) strand; PAM type: YTN; PAM sequence: CTT
tttatcatatgtttattggc

SEQ ID NO: 55367 - DNA, 20 bp, Artificial Sequence
  Description of Artificial Sequence: Synthetic oligonucleotide
  Target: SCN10A; (-) strand; PAM type: YTN; PAM sequence: CTA
atgaccagtgatgatgagct

SEQ ID NO: 55368 - DNA, 20 bp, Artificial Sequence
  Description of Artificial Sequence: Synthetic oligonucleotide
  Target: SCN10A; (-) strand; PAM type: YTN; PAM sequence: CTC
taatgaccagtgatgatgag

SEQ ID NO: 55369 - DNA, 20 bp, Artificial Sequence
  Description of Artificial Sequence: Synthetic oligonucleotide
  Target: SCN10A; (-) strand; PAM type: YTN; PAM sequence: TTC
tctaatgaccagtgatgatg

SEQ ID NO: 55370 - DNA, 20 bp, Artificial Sequence
  Description of Artificial Sequence: Synthetic oligonucleotide
  Target: SCN10A; (-) strand; PAM type: YTN; PAM sequence: TTT
ctctaatgaccagtgatgat

SEQ ID NO: 55371 - DNA, 20 bp, Artificial Sequence
  Description of Artificial Sequence: Synthetic oligonucleotide
  Target: SCN10A; (-) strand; PAM type: YTN; PAM sequence: CTG
gcatttctctaatgaccagt

SEQ ID NO: 55372 - DNA, 20 bp, Artificial Sequence
  Description of Artificial Sequence: Synthetic oligonucleotide
  Target: SCN10A; (-) strand; PAM type: YTN; PAM sequence: TTG
actggcatttctctaatgac

SEQ ID NO: 55373 - DNA, 20 bp, Artificial Sequence
  Description of Artificial Sequence: Synthetic oligonucleotide
  Target: SCN10A; (-) strand; PAM type: YTN; PAM sequence: TTT
gactggcatttctctaatga

SEQ ID NO: 55374 - DNA, 20 bp, Artificial Sequence
  Description of Artificial Sequence: Synthetic oligonucleotide
  Target: SCN10A; (-) strand; PAM type: YTN; PAM sequence: TTT
tgactggcatttctctaatg

SEQ ID NO: 55375 - DNA, 20 bp, Artificial Sequence
  Description of Artificial Sequence: Synthetic oligonucleotide
  Target: SCN10A; (-) strand; PAM type: YTN; PAM sequence: TTG
tggttttgactggcatttct

SEQ ID NO: 55376 - DNA, 20 bp, Artificial Sequence
  Description of Artificial Sequence: Synthetic oligonucleotide
  Target: SCN10A; (-) strand; PAM type: YTN; PAM sequence: CTC
attgtggttttgactggcat

SEQ ID NO: 55377 - DNA, 20 bp, Artificial Sequence
  Description of Artificial Sequence: Synthetic oligonucleotide
  Target: SCN10A; (-) strand; PAM type: YTN; PAM sequence: CTC
catctcattgtggttttgac

SEQ ID NO: 55378 - DNA, 20 bp, Artificial Sequence
  Description of Artificial Sequence: Synthetic oligonucleotide
  Target: SCN10A; (-) strand; PAM type: YTN; PAM sequence: CTG
gtatgagactccatctcatt

SEQ ID NO: 55379 - DNA, 20 bp, Artificial Sequence
  Description of Artificial Sequence: Synthetic oligonucleotide
  Target: SCN10A; (-) strand; PAM type: YTN; PAM sequence: CTA
actggtatgagactccatct

SEQ ID NO: 55380 - DNA, 20 bp, Artificial Sequence
  Description of Artificial Sequence: Synthetic oligonucleotide
  Target: SCN10A; (-) strand; PAM type: YTN; PAM sequence: TTC
taactggtatgagactccat

SEQ ID NO: 55381 - DNA, 20 bp, Artificial Sequence
  Description of Artificial Sequence: Synthetic oligonucleotide
  Target: SCN10A; (-) strand; PAM type: YTN; PAM sequence: CTC
cattctaactggtatgagac

SEQ ID NO: 55382 - DNA, 20 bp, Artificial Sequence
  Description of Artificial Sequence: Synthetic oligonucleotide
  Target: SCN10A; (-) strand; PAM type: YTN; PAM sequence: TTA
atgatctccattctaactgg

SEQ ID NO: 55383 - DNA, 20 bp, Artificial Sequence
  Description of Artificial Sequence: Synthetic oligonucleotide
  Target: SCN10A; (-) strand; PAM type: YTN; PAM sequence: TTT
aatgatctccattctaactg

SEQ ID NO: 55384 - DNA, 20 bp, Artificial Sequence
  Description of Artificial Sequence: Synthetic oligonucleotide
  Target: SCN10A; (-) strand; PAM type: YTN; PAM sequence: TTT
taatgatctccattctaact

SEQ ID NO: 55385 - DNA, 20 bp, Artificial Sequence
  Description of Artificial Sequence: Synthetic oligonucleotide
  Target: SCN10A; (-) strand; PAM type: YTN; PAM sequence: TTT
ttaatgatctccattctaac

SEQ ID NO: 55386 - DNA, 20 bp, Artificial Sequence
  Description of Artificial Sequence: Synthetic oligonucleotide
  Target: SCN10A; (-) strand; PAM type: YTN; PAM sequence: CTT
tttaatgatctccattctaa

SEQ ID NO: 55387 - DNA, 20 bp, Artificial Sequence
  Description of Artificial Sequence: Synthetic oligonucleotide
  Target: SCN10A; (-) strand; PAM type: YTN; PAM sequence: CTG
actttttaatgatctccatt

SEQ ID NO: 55388 - DNA, 20 bp, Artificial Sequence
  Description of Artificial Sequence: Synthetic oligonucleotide
  Target: SCN10A; (-) strand; PAM type: YTN; PAM sequence: TTC
ctgactttttaatgatctcc

SEQ ID NO: 55389 - DNA, 20 bp, Artificial Sequence
  Description of Artificial Sequence: Synthetic oligonucleotide
  Target: SCN10A; (-) strand; PAM type: YTN; PAM sequence: TTT
cctgactttttaatgatctc

SEQ ID NO: 55390 - DNA, 20 bp, Artificial Sequence
  Description of Artificial Sequence: Synthetic oligonucleotide
  Target: SCN10A; (-) strand; PAM type: YTN; PAM sequence: TTG
tttcctgactttttaatgat

SEQ ID NO: 55391 - DNA, 20 bp, Artificial Sequence
  Description of Artificial Sequence: Synthetic oligonucleotide
  Target: SCN10A; (-) strand; PAM type: YTN; PAM sequence: CTG
ttgtttcctgactttttaat

SEQ ID NO: 55392 - DNA, 20 bp, Artificial Sequence
  Description of Artificial Sequence: Synthetic oligonucleotide
  Target: SCN10A; (-) strand; PAM type: YTN; PAM sequence: CTC
cagcatctgttgtttcctga

SEQ ID NO: 55393 - DNA, 20 bp, Artificial Sequence
  Description of Artificial Sequence: Synthetic oligonucleotide
  Target: SCN10A; (-) strand; PAM type: YTN; PAM sequence: CTC
tccagcatctgttgtttcct

SEQ ID NO: 55394 - DNA, 20 bp, Artificial Sequence
  Description of Artificial Sequence: Synthetic oligonucleotide
  Target: SCN10A; (-) strand; PAM type: YTN; PAM sequence: CTC
cacatcctctccagcatctg

SEQ ID NO: 55395 - DNA, 20 bp, Artificial Sequence
  Description of Artificial Sequence: Synthetic oligonucleotide
  Target: SCN10A; (-) strand; PAM type: YTN; PAM sequence: CTC
tccacatcctctccagcatc

SEQ ID NO: 55396 - DNA, 20 bp, Artificial Sequence
  Description of Artificial Sequence: Synthetic oligonucleotide
  Target: SCN10A; (-) strand; PAM type: YTN; PAM sequence: CTA
tctctccacatcctctccag

SEQ ID NO: 55397 - DNA, 20 bp, Artificial Sequence
  Description of Artificial Sequence: Synthetic oligonucleotide
  Target: SCN10A; (-) strand; PAM type: YTN; PAM sequence: TTC
ctatctctccacatcctctc

SEQ ID NO: 55398 - DNA, 20 bp, Artificial Sequence
  Description of Artificial Sequence: Synthetic oligonucleotide
  Target: SCN10A; (-) strand; PAM type: YTN; PAM sequence: CTC
ccaccaacagtgtaaaagca

SEQ ID NO: 55399 - DNA, 20 bp, Artificial Sequence
  Description of Artificial Sequence: Synthetic oligonucleotide
  Target: SCN10A; (-) strand; PAM type: YTN; PAM sequence: TTA
cactcccaccaacagtgtaa

SEQ ID NO: 55400 - DNA, 20 bp, Artificial Sequence
  Description of Artificial Sequence: Synthetic oligonucleotide
  Target: SCN10A; (-) strand; PAM type: YTN; PAM sequence: TTT
acactcccaccaacagtgta

SEQ ID NO: 55401 - DNA, 20 bp, Artificial Sequence
  Description of Artificial Sequence: Synthetic oligonucleotide
  Target: SCN10A; (-) strand; PAM type: YTN; PAM sequence: CTA
atttacactcccaccaacag

SEQ ID NO: 55402 - DNA, 20 bp, Artificial Sequence
  Description of Artificial Sequence: Synthetic oligonucleotide
  Target: SCN10A; (-) strand; PAM type: YTN; PAM sequence: TTG
aactaatttacactcccacc

SEQ ID NO: 55403 - DNA, 20 bp, Artificial Sequence
  Description of Artificial Sequence: Synthetic oligonucleotide
  Target: SCN10A; (-) strand; PAM type: YTN; PAM sequence: TTC
cacaatggttgaactaattt

SEQ ID NO: 55404 - DNA, 20 bp, Artificial Sequence
  Description of Artificial Sequence: Synthetic oligonucleotide
  Target: SCN10A; (-) strand; PAM type: YTN; PAM sequence: CTT
ccacaatggttgaactaatt

SEQ ID NO: 55405 - DNA, 20 bp, Artificial Sequence
  Description of Artificial Sequence: Synthetic oligonucleotide
  Target: SCN10A; (-) strand; PAM type: YTN; PAM sequence: CTG
tcttccacaatggttgaact

SEQ ID NO: 55406 - DNA, 20 bp, Artificial Sequence
  Description of Artificial Sequence: Synthetic oligonucleotide
  Target: SCN10A; (-) strand; PAM type: YTN; PAM sequence: TTG
aggaatcaccacactgtctt

SEQ ID NO: 55407 - DNA, 20 bp, Artificial Sequence
  Description of Artificial Sequence: Synthetic oligonucleotide
  Target: SCN10A; (-) strand; PAM type: YTN; PAM sequence: CTT
gaggaatcaccacactgtct

SEQ ID NO: 55408 - DNA, 20 bp, Artificial Sequence
  Description of Artificial Sequence: Synthetic oligonucleotide
  Target: SCN10A; (-) strand; PAM type: YTN; PAM sequence: CTA
gatccttgaggaatcaccac

SEQ ID NO: 55409 - DNA, 20 bp, Artificial Sequence
  Description of Artificial Sequence: Synthetic oligonucleotide
  Target: SCN10A; (-) strand; PAM type: YTN; PAM sequence: TTC
tagatccttgaggaatcacc

SEQ ID NO: 55410 - DNA, 20 bp, Artificial Sequence
  Description of Artificial Sequence: Synthetic oligonucleotide
  Target: SCN10A; (-) strand; PAM type: YTN; PAM sequence: CTG
gttctagatccttgaggaat

SEQ ID NO: 55411 - DNA, 20 bp, Artificial Sequence
  Description of Artificial Sequence: Synthetic oligonucleotide
  Target: SCN10A; (-) strand; PAM type: YTN; PAM sequence: TTC
tggttctagatccttgagga

SEQ ID NO: 55412 - DNA, 20 bp, Artificial Sequence
  Description of Artificial Sequence: Synthetic oligonucleotide
  Target: SCN10A; (-) strand; PAM type: YTN; PAM sequence: TTT
ctggttctagatccttgagg

SEQ ID NO: 55413 - DNA, 20 bp, Artificial Sequence
  Description of Artificial Sequence: Synthetic oligonucleotide
  Target: SCN10A; (-) strand; PAM type: YTN; PAM sequence: CTG
ggtcaaatggtgtttctggt

SEQ ID NO: 55414 - DNA, 20 bp, Artificial Sequence
  Description of Artificial Sequence: Synthetic oligonucleotide
  Target: SCN10A; (-) strand; PAM type: YTN; PAM sequence: TTG
ctgggtcaaatggtgtttct

SEQ ID NO: 55415 - DNA, 20 bp, Artificial Sequence
  Description of Artificial Sequence: Synthetic oligonucleotide
  Target: SCN10A; (-) strand; PAM type: YTN; PAM sequence: TTG
ggtatatacccagtaatgga

SEQ ID NO: 55416 - DNA, 20 bp, Artificial Sequence
  Description of Artificial Sequence: Synthetic oligonucleotide
  Target: SCN10A; (-) strand; PAM type: YTN; PAM sequence: TTT
gggtatatacccagtaatgg

SEQ ID NO: 55417 - DNA, 20 bp, Artificial Sequence
  Description of Artificial Sequence: Synthetic oligonucleotide
  Target: SCN10A; (-) strand; PAM type: YTN; PAM sequence: CTT
tgggtatatacccagtaatg

SEQ ID NO: 55418 - DNA, 20 bp, Artificial Sequence
  Description of Artificial Sequence: Synthetic oligonucleotide
  Target: SCN10A; (-) strand; PAM type: YTN; PAM sequence: TTA
taatcctttgggtatatacc

SEQ ID NO: 55419 - DNA, 20 bp, Artificial Sequence
  Description of Artificial Sequence: Synthetic oligonucleotide
  Target: SCN10A; (-) strand; PAM type: YTN; PAM sequence: TTT
ataatcctttgggtatatac

SEQ ID NO: 55420 - DNA, 20 bp, Artificial Sequence
  Description of Artificial Sequence: Synthetic oligonucleotide
  Target: SCN10A; (-) strand; PAM type: YTN; PAM sequence: TTA
tagtagaataatttataatc

SEQ ID NO: 55421 - DNA, 20 bp, Artificial Sequence
  Description of Artificial Sequence: Synthetic oligonucleotide
  Target: SCN10A; (-) strand; PAM type: YTN; PAM sequence: TTT
atagtagaataatttataat

SEQ ID NO: 55422 - DNA, 20 bp, Artificial Sequence
  Description of Artificial Sequence: Synthetic oligonucleotide
  Target: SCN10A; (-) strand; PAM type: YTN; PAM sequence: CTT
tatagtagaataatttataa

SEQ ID NO: 55423 - DNA, 20 bp, Artificial Sequence
  Description of Artificial Sequence: Synthetic oligonucleotide
  Target: SCN10A; (-) strand; PAM type: YTN; PAM sequence: TTG
tatctttatagtagaataat

SEQ ID NO: 55424 - DNA, 20 bp, Artificial Sequence
  Description of Artificial Sequence: Synthetic oligonucleotide
  Target: SCN10A; (-) strand; PAM type: YTN; PAM sequence: CTT
gtatctttatagtagaataa

SEQ ID NO: 55425 - DNA, 20 bp, Artificial Sequence
  Description of Artificial Sequence: Synthetic oligonucleotide
  Target: SCN10A; (-) strand; PAM type: YTN; PAM sequence: TTG
tcaatagtgccacaataaac

SEQ ID NO: 55426 - DNA, 20 bp, Artificial Sequence
  Description of Artificial Sequence: Synthetic oligonucleotide
  Target: SCN10A; (-) strand; PAM type: YTN; PAM sequence: CTA
ttgtcaatagtgccacaata

SEQ ID NO: 55427 - DNA, 20 bp, Artificial Sequence
  Description of Artificial Sequence: Synthetic oligonucleotide
  Target: SCN10A; (-) strand; PAM type: YTN; PAM sequence: TTG
ctattgtcaatagtgccaca

SEQ ID NO: 55428 - DNA, 20 bp, Artificial Sequence
  Description of Artificial Sequence: Synthetic oligonucleotide
  Target: SCN10A; (-) strand; PAM type: YTN; PAM sequence: TTT
gctattgtcaatagtgccac

SEQ ID NO: 55429 - DNA, 20 bp, Artificial Sequence
  Description of Artificial Sequence: Synthetic oligonucleotide
  Target: SCN10A; (-) strand; PAM type: YTN; PAM sequence: CTT
tgctattgtcaatagtgcca

SEQ ID NO: 55430 - DNA, 20 bp, Artificial Sequence
  Description of Artificial Sequence: Synthetic oligonucleotide
  Target: SCN10A; (-) strand; PAM type: YTN; PAM sequence: TTC
caagtctttgctattgtcaa

SEQ ID NO: 55431 - DNA, 20 bp, Artificial Sequence
  Description of Artificial Sequence: Synthetic oligonucleotide
  Target: SCN10A; (-) strand; PAM type: YTN; PAM sequence: TTA
gttccaagtctttgctattg

SEQ ID NO: 55432 - DNA, 20 bp, Artificial Sequence
  Description of Artificial Sequence: Synthetic oligonucleotide
  Target: SCN10A; (-) strand; PAM type: YTN; PAM sequence: TTG
ggttagttccaagtctttgc

SEQ ID NO: 55433 - DNA, 20 bp, Artificial Sequence
  Description of Artificial Sequence: Synthetic oligonucleotide
  Target: SCN10A; (-) strand; PAM type: YTN; PAM sequence: TTT
gggttagttccaagtctttg

SEQ ID NO: 55434 - DNA, 20 bp, Artificial Sequence
  Description of Artificial Sequence: Synthetic oligonucleotide
  Target: SCN10A; (-) strand; PAM type: YTN; PAM sequence: CTG
atgggcgtttgggttagttc

SEQ ID NO: 55435 - DNA, 20 bp, Artificial Sequence
  Description of Artificial Sequence: Synthetic oligonucleotide
  Target: SCN10A; (-) strand; PAM type: YTN; PAM sequence: CTA
tcactgatgggcgtttgggt

SEQ ID NO: 55436 - DNA, 20 bp, Artificial Sequence
  Description of Artificial Sequence: Synthetic oligonucleotide
  Target: SCN10A; (-) strand; PAM type: YTN; PAM sequence: TTA
tccagtctatcactgatggg

SEQ ID NO: 55437 - DNA, 20 bp, Artificial Sequence
  Description of Artificial Sequence: Synthetic oligonucleotide
  Target: SCN10A; (-) strand; PAM type: YTN; PAM sequence: TTT
atccagtctatcactgatgg

SEQ ID NO: 55438 - DNA, 20 bp, Artificial Sequence
  Description of Artificial Sequence: Synthetic oligonucleotide
  Target: SCN10A; (-) strand; PAM type: YTN; PAM sequence: CTT
tatccagtctatcactgatg

SEQ ID NO: 55439 - DNA, 20 bp, Artificial Sequence
  Description of Artificial Sequence: Synthetic oligonucleotide
  Target: SCN10A; (-) strand; PAM type: YTN; PAM sequence: TTC
tttatccagtctatcactga

SEQ ID NO: 55440 - DNA, 20 bp, Artificial Sequence
  Description of Artificial Sequence: Synthetic oligonucleotide
  Target: SCN10A; (-) strand; PAM type: YTN; PAM sequence: TTT
ctttatccagtctatcactg

SEQ ID NO: 55441 - DNA, 20 bp, Artificial Sequence
  Description of Artificial Sequence: Synthetic oligonucleotide
  Target: SCN10A; (-) strand; PAM type: YTN; PAM sequence: TTT
tctttatccagtctatcact

SEQ ID NO: 55442 - DNA, 20 bp, Artificial Sequence
  Description of Artificial Sequence: Synthetic oligonucleotide
  Target: SCN10A; (-) strand; PAM type: YTN; PAM sequence: TTC
catggtgtatatgtgccata

SEQ ID NO: 55443 - DNA, 20 bp, Artificial Sequence
  Description of Artificial Sequence: Synthetic oligonucleotide
  Target: SCN10A; (-) strand; PAM type: YTN; PAM sequence: CTG
catagtattccatggtgtat

SEQ ID NO: 55444 - DNA, 20 bp, Artificial Sequence
  Description of Artificial Sequence: Synthetic oligonucleotide
  Target: SCN10A; (-) strand; PAM type: YTN; PAM sequence: TTA
tggctgcatagtattccatg

SEQ ID NO: 55445 - DNA, 20 bp, Artificial Sequence
  Description of Artificial Sequence: Synthetic oligonucleotide
  Target: SCN10A; (-) strand; PAM type: YTN; PAM sequence: TTT
atggctgcatagtattccat

SEQ ID NO: 55446 - DNA, 20 bp, Artificial Sequence
  Description of Artificial Sequence: Synthetic oligonucleotide
  Target: SCN10A; (-) strand; PAM type: YTN; PAM sequence: TTT
tatggctgcatagtattcca

SEQ ID NO: 55447 - DNA, 20 bp, Artificial Sequence
  Description of Artificial Sequence: Synthetic oligonucleotide
  Target: SCN10A; (-) strand; PAM type: YTN; PAM sequence: TTT
ttatggctgcatagtattcc

SEQ ID NO: 55448 - DNA, 20 bp, Artificial Sequence
  Description of Artificial Sequence: Synthetic oligonucleotide
  Target: SCN10A; (-) strand; PAM type: YTN; PAM sequence: TTT
tttatggctgcatagtattc

SEQ ID NO: 55449 - DNA, 20 bp, Artificial Sequence
  Description of Artificial Sequence: Synthetic oligonucleotide
  Target: SCN10A; (-) strand; PAM type: YTN; PAM sequence: CTT
ttttatggctgcatagtatt

SEQ ID NO: 55450 - DNA, 20 bp, Artificial Sequence
  Description of Artificial Sequence: Synthetic oligonucleotide
  Target: SCN10A; (-) strand; PAM type: YTN; PAM sequence: CTC
acccttttttatggctgcat

SEQ ID NO: 55451 - DNA, 20 bp, Artificial Sequence
  Description of Artificial Sequence: Synthetic oligonucleotide
  Target: SCN10A; (-) strand; PAM type: YTN; PAM sequence: CTG
caaagaacatgaactcaccc

SEQ ID NO: 55452 - DNA, 20 bp, Artificial Sequence
  Description of Artificial Sequence: Synthetic oligonucleotide
  Target: SCN10A; (-) strand; PAM type: YTN; PAM sequence: TTC
atccatgtccctgcaaagaa

SEQ ID NO: 55453 - DNA, 20 bp, Artificial Sequence
  Description of Artificial Sequence: Synthetic oligonucleotide
  Target: SCN10A; (-) strand; PAM type: YTN; PAM sequence: CTT
catccatgtccctgcaaaga

SEQ ID NO: 55454 - DNA, 20 bp, Artificial Sequence
  Description of Artificial Sequence: Synthetic oligonucleotide
  Target: SCN10A; (-) strand; PAM type: YTN; PAM sequence: TTC
cagcttcatccatgtccctg

SEQ ID NO: 55455 - DNA, 20 bp, Artificial Sequence
  Description of Artificial Sequence: Synthetic oligonucleotide
  Target: SCN10A; (-) strand; PAM type: YTN; PAM sequence: TTT
ccagcttcatccatgtccct

SEQ ID NO: 55456 - DNA, 20 bp, Artificial Sequence
  Description of Artificial Sequence: Synthetic oligonucleotide
  Target: SCN10A; (-) strand; PAM type: YTN; PAM sequence: CTG
agaatgatggtttccagctt

SEQ ID NO: 55457 - DNA, 20 bp, Artificial Sequence
  Description of Artificial Sequence: Synthetic oligonucleotide
  Target: SCN10A; (-) strand; PAM type: YTN; PAM sequence: TTG
ctgagaatgatggtttccag

SEQ ID NO: 55458 - DNA, 20 bp, Artificial Sequence
  Description of Artificial Sequence: Synthetic oligonucleotide
  Target: SCN10A; (-) strand; PAM type: YTN; PAM sequence: TTT
gctgagaatgatggtttcca

SEQ ID NO: 55459 - DNA, 20 bp, Artificial Sequence
  Description of Artificial Sequence: Synthetic oligonucleotide
  Target: SCN10A; (-) strand; PAM type: YTN; PAM sequence: TTA
tgtcagtttgctgagaatga

SEQ ID NO: 55460 - DNA, 20 bp, Artificial Sequence
  Description of Artificial Sequence: Synthetic oligonucleotide
  Target: SCN10A; (-) strand; PAM type: YTN; PAM sequence: CTT
atgtcagtttgctgagaatg

SEQ ID NO: 55461 - DNA, 20 bp, Artificial Sequence
  Description of Artificial Sequence: Synthetic oligonucleotide
  Target: SCN10A; (-) strand; PAM type: YTN; PAM sequence: TTC
ttatgtcagtttgctgagaa

SEQ ID NO: 55462 - DNA, 20 bp, Artificial Sequence
  Description of Artificial Sequence: Synthetic oligonucleotide
  Target: SCN10A; (-) strand; PAM type: YTN; PAM sequence: CTG
ttcttatgtcagtttgctga

SEQ ID NO: 55463 - DNA, 20 bp, Artificial Sequence
  Description of Artificial Sequence: Synthetic oligonucleotide
  Target: SCN10A; (-) strand; PAM type: YTN; PAM sequence: TTC
tgttcttatgtcagtttgct

SEQ ID NO: 55464 - DNA, 20 bp, Artificial Sequence
  Description of Artificial Sequence: Synthetic oligonucleotide
  Target: SCN10A; (-) strand; PAM type: YTN; PAM sequence: TTT
ctgttcttatgtcagtttgc

SEQ ID NO: 55465 - DNA, 20 bp, Artificial Sequence
  Description of Artificial Sequence: Synthetic oligonucleotide
  Target: SCN10A; (-) strand; PAM type: YTN; PAM sequence: TTT
tctgttcttatgtcagtttg

SEQ ID NO: 55466 - DNA, 20 bp, Artificial Sequence
  Description of Artificial Sequence: Synthetic oligonucleotide
  Target: SCN10A; (-) strand; PAM type: YTN; PAM sequence: TTG
gttttctgttcttatgtcag

SEQ ID NO: 55467 - DNA, 20 bp, Artificial Sequence
  Description of Artificial Sequence: Synthetic oligonucleotide
  Target: SCN10A; (-) strand; PAM type: YTN; PAM sequence: TTT
ggttttctgttcttatgtca

SEQ ID NO: 55468 - DNA, 20 bp, Artificial Sequence
  Description of Artificial Sequence: Synthetic oligonucleotide
  Target: SCN10A; (-) strand; PAM type: YTN; PAM sequence: CTA
tgagtgagaacatgcggtgt

SEQ ID NO: 55469 - DNA, 20 bp, Artificial Sequence
  Description of Artificial Sequence: Synthetic oligonucleotide
  Target: SCN10A; (-) strand; PAM type: YTN; PAM sequence: CTC
ccacctatgagtgagaacat

SEQ ID NO: 55470 - DNA, 20 bp, Artificial Sequence
  Description of Artificial Sequence: Synthetic oligonucleotide
  Target: SCN10A; (-) strand; PAM type: YTN; PAM sequence: TTC
atctcccacctatgagtgag

SEQ ID NO: 55471 - DNA, 20 bp, Artificial Sequence
  Description of Artificial Sequence: Synthetic oligonucleotide
  Target: SCN10A; (-) strand; PAM type: YTN; PAM sequence: TTG
ttcatctcccacctatgagt

SEQ ID NO: 55472 - DNA, 20 bp, Artificial Sequence
  Description of Artificial Sequence: Synthetic oligonucleotide
  Target: SCN10A; (-) strand; PAM type: YTN; PAM sequence: CTC
attgttcatctcccacctat

SEQ ID NO: 55473 - DNA, 20 bp, Artificial Sequence
  Description of Artificial Sequence: Synthetic oligonucleotide
  Target: SCN10A; (-) strand; PAM type: YTN; PAM sequence: CTC
tcattgttcatctcccacct

SEQ ID NO: 55474 - DNA, 20 bp, Artificial Sequence
  Description of Artificial Sequence: Synthetic oligonucleotide
  Target: SCN10A; (-) strand; PAM type: YTN; PAM sequence: CTG
tatccacgtgctctcattgt

SEQ ID NO: 55475 - DNA, 20 bp, Artificial Sequence
  Description of Artificial Sequence: Synthetic oligonucleotide
  Target: SCN10A; (-) strand; PAM type: YTN; PAM sequence: CTC
cctgtatccacgtgctctca

SEQ ID NO: 55476 - DNA, 20 bp, Artificial Sequence
  Description of Artificial Sequence: Synthetic oligonucleotide
  Target: SCN10A; (-) strand; PAM type: YTN; PAM sequence: CTG
gtgtgtgatgtccccctccc

SEQ ID NO: 55477 - DNA, 20 bp, Artificial Sequence
  Description of Artificial Sequence: Synthetic oligonucleotide
  Target: SCN10A; (-) strand; PAM type: YTN; PAM sequence: CTC
aacaggccctggtgtgtgat

SEQ ID NO: 55478 - DNA, 20 bp, Artificial Sequence
  Description of Artificial Sequence: Synthetic oligonucleotide
  Target: SCN10A; (-) strand; PAM type: YTN; PAM sequence: CTA
gcccccaacccctcaacagg

SEQ ID NO: 55479 - DNA, 20 bp, Artificial Sequence
  Description of Artificial Sequence: Synthetic oligonucleotide
  Target: SCN10A; (-) strand; PAM type: YTN; PAM sequence: CTC
ccctagcccccaacccctca

SEQ ID NO: 55480 - DNA, 20 bp, Artificial Sequence
  Description of Artificial Sequence: Synthetic oligonucleotide
  Target: SCN10A; (-) strand; PAM type: YTN; PAM sequence: CTA
tccctcccctagcccccaac

SEQ ID NO: 55481 - DNA, 20 bp, Artificial Sequence
  Description of Artificial Sequence: Synthetic oligonucleotide
  Target: SCN10A; (-) strand; PAM type: YTN; PAM sequence: CTA
atgctatccctcccctagcc

SEQ ID NO: 55482 - DNA, 20 bp, Artificial Sequence
  Description of Artificial Sequence: Synthetic oligonucleotide
  Target: SCN10A; (-) strand; PAM type: YTN; PAM sequence: CTC
ctaatgctatccctccccta

SEQ ID NO: 55483 - DNA, 20 bp, Artificial Sequence
  Description of Artificial Sequence: Synthetic oligonucleotide
  Target: SCN10A; (-) strand; PAM type: YTN; PAM sequence: TTC
tcctaatgctatccctcccc

SEQ ID NO: 55484 - DNA, 20 bp, Artificial Sequence
  Description of Artificial Sequence: Synthetic oligonucleotide
  Target: SCN10A; (-) strand; PAM type: YTN; PAM sequence: TTT
ctcctaatgctatccctccc

SEQ ID NO: 55485 - DNA, 20 bp, Artificial Sequence
  Description of Artificial Sequence: Synthetic oligonucleotide
  Target: SCN10A; (-) strand; PAM type: YTN; PAM sequence: TTA
ggtatttctcctaatgctat

SEQ ID NO: 55486 - DNA, 20 bp, Artificial Sequence
  Description of Artificial Sequence: Synthetic oligonucleotide
  Target: SCN10A; (-) strand; PAM type: YTN; PAM sequence: CTA
cattaggtatttctcctaat

SEQ ID NO: 55487 - DNA, 20 bp, Artificial Sequence
  Description of Artificial Sequence: Synthetic oligonucleotide
  Target: SCN10A; (-) strand; PAM type: YTN; PAM sequence: CTG
cacccatcaacccatcatct

SEQ ID NO: 55488 - DNA, 20 bp, Artificial Sequence
  Description of Artificial Sequence: Synthetic oligonucleotide
  Target: SCN10A; (-) strand; PAM type: YTN; PAM sequence: TTG
ctgcacccatcaacccatca

SEQ ID NO: 55489 - DNA, 20 bp, Artificial Sequence
  Description of Artificial Sequence: Synthetic oligonucleotide
  Target: SCN10A; (-) strand; PAM type: YTN; PAM sequence: TTT
gctgcacccatcaacccatc

SEQ ID NO: 55490 - DNA, 20 bp, Artificial Sequence
  Description of Artificial Sequence: Synthetic oligonucleotide
  Target: SCN10A; (-) strand; PAM type: YTN; PAM sequence: TTA
cataggtatacacatgtcat

SEQ ID NO: 55491 - DNA, 20 bp, Artificial Sequence
  Description of Artificial Sequence: Synthetic oligonucleotide
  Target: SCN10A; (-) strand; PAM type: YTN; PAM sequence: TTG
ttacataggtatacacatgt

SEQ ID NO: 55492 - DNA, 20 bp, Artificial Sequence
  Description of Artificial Sequence: Synthetic oligonucleotide
  Target: SCN10A; (-) strand; PAM type: YTN; PAM sequence: TTT
gttacataggtatacacatg

SEQ ID NO: 55493 - DNA, 20 bp, Artificial Sequence
  Description of Artificial Sequence: Synthetic oligonucleotide
  Target: SCN10A; (-) strand; PAM type: YTN; PAM sequence: CTG
gggtacatgtgcagaaagtg

SEQ ID NO: 55494 - DNA, 20 bp, Artificial Sequence
  Description of Artificial Sequence: Synthetic oligonucleotide
  Target: SCN10A; (-) strand; PAM type: YTN; PAM sequence: TTC
tggggtacatgtgcagaaag

SEQ ID NO: 55495 - DNA, 20 bp, Artificial Sequence
  Description of Artificial Sequence: Synthetic oligonucleotide
  Target: SCN10A; (-) strand; PAM type: YTN; PAM sequence: TTA
agttctggggtacatgtgca

SEQ ID NO: 55496 - DNA, 20 bp, Artificial Sequence
  Description of Artificial Sequence: Synthetic oligonucleotide
  Target: SCN10A; (-) strand; PAM type: YTN; PAM sequence: TTT
aagttctggggtacatgtgc

SEQ ID NO: 55497 - DNA, 20 bp, Artificial Sequence
  Description of Artificial Sequence: Synthetic oligonucleotide
  Target: SCN10A; (-) strand; PAM type: YTN; PAM sequence: CTT
taagttctggggtacatgtg

SEQ ID NO: 55498 - DNA, 20 bp, Artificial Sequence
  Description of Artificial Sequence: Synthetic oligonucleotide
  Target: SCN10A; (-) strand; PAM type: YTN; PAM sequence: TTA
ctttaagttctggggtacat

SEQ ID NO: 55499 - DNA, 20 bp, Artificial Sequence
  Description of Artificial Sequence: Synthetic oligonucleotide
  Target: SCN10A; (-) strand; PAM type: YTN; PAM sequence: TTT
actttaagttctggggtaca

SEQ ID NO: 55500 - DNA, 20 bp, Artificial Sequence
  Description of Artificial Sequence: Synthetic oligonucleotide
  Target: SCN10A; (-) strand; PAM type: YTN; PAM sequence: TTT
tactttaagttctggggtac

SEQ ID NO: 55501 - DNA, 20 bp, Artificial Sequence
  Description of Artificial Sequence: Synthetic oligonucleotide
  Target: SCN10A; (-) strand; PAM type: YTN; PAM sequence: TTA
aattttactttaagttctgg

SEQ ID NO: 55502 - DNA, 20 bp, Artificial Sequence
  Description of Artificial Sequence: Synthetic oligonucleotide
  Target: SCN10A; (-) strand; PAM type: YTN; PAM sequence: TTT
aaattttactttaagttctg

SEQ ID NO: 55503 - DNA, 20 bp, Artificial Sequence
  Description of Artificial Sequence: Synthetic oligonucleotide
  Target: SCN10A; (-) strand; PAM type: YTN; PAM sequence: TTT
taaattttactttaagttct

SEQ ID NO: 55504 - DNA, 20 bp, Artificial Sequence
  Description of Artificial Sequence: Synthetic oligonucleotide
  Target: SCN10A; (-) strand; PAM type: YTN; PAM sequence: TTT
ttaaattttactttaagttc

SEQ ID NO: 55505 - DNA, 20 bp, Artificial Sequence
  Description of Artificial Sequence: Synthetic oligonucleotide
  Target: SCN10A; (-) strand; PAM type: YTN; PAM sequence: TTT
tttaaattttactttaagtt

SEQ ID NO: 55506 - DNA, 20 bp, Artificial Sequence
  Description of Artificial Sequence: Synthetic oligonucleotide
  Target: SCN10A; (-) strand; PAM type: YTN; PAM sequence: CTT
ttttaaattttactttaagt

SEQ ID NO: 55507 - DNA, 20 bp, Artificial Sequence
  Description of Artificial Sequence: Synthetic oligonucleotide
  Target: SCN10A; (-) strand; PAM type: YTN; PAM sequence: TTG
tgaaatgcaaatatataaag

SEQ ID NO: 55508 - DNA, 20 bp, Artificial Sequence
  Description of Artificial Sequence: Synthetic oligonucleotide
  Target: SCN10A; (-) strand; PAM type: YTN; PAM sequence: TTT
gtgaaatgcaaatatataaa

SEQ ID NO: 55509 - DNA, 20 bp, Artificial Sequence
  Description of Artificial Sequence: Synthetic oligonucleotide
  Target: SCN10A; (-) strand; PAM type: YTN; PAM sequence: CTT
tgtgaaatgcaaatatataa

SEQ ID NO: 55510 - DNA, 20 bp, Artificial Sequence
  Description of Artificial Sequence: Synthetic oligonucleotide
  Target: SCN10A; (-) strand; PAM type: YTN; PAM sequence: TTG
ctttgtgaaatgcaaatata

SEQ ID NO: 55511 - DNA, 20 bp, Artificial Sequence
  Description of Artificial Sequence: Synthetic oligonucleotide
  Target: SCN10A; (-) strand; PAM type: YTN; PAM sequence: CTT
gctttgtgaaatgcaaatat

SEQ ID NO: 55512 - DNA, 20 bp, Artificial Sequence
  Description of Artificial Sequence: Synthetic oligonucleotide
  Target: SCN10A; (-) strand; PAM type: YTN; PAM sequence: CTC
acttgctttgtgaaatgcaa

SEQ ID NO: 55513 - DNA, 20 bp, Artificial Sequence
  Description of Artificial Sequence: Synthetic oligonucleotide
  Target: SCN10A; (-) strand; PAM type: YTN; PAM sequence: CTA
ggtggatcaacacctcactt

SEQ ID NO: 55514 - DNA, 20 bp, Artificial Sequence
  Description of Artificial Sequence: Synthetic oligonucleotide
  Target: SCN10A; (-) strand; PAM type: YTN; PAM sequence: TTC
taggtggatcaacacctcac

SEQ ID NO: 55515 - DNA, 20 bp, Artificial Sequence
  Description of Artificial Sequence: Synthetic oligonucleotide
  Target: SCN10A; (-) strand; PAM type: YTN; PAM sequence: TTG
caccacacacaagaatcaat

SEQ ID NO: 55516 - DNA, 20 bp, Artificial Sequence
  Description of Artificial Sequence: Synthetic oligonucleotide
  Target: SCN10A; (-) strand; PAM type: YTN; PAM sequence: TTT
gcaccacacacaagaatcaa

SEQ ID NO: 55517 - DNA, 20 bp, Artificial Sequence
  Description of Artificial Sequence: Synthetic oligonucleotide
  Target: SCN10A; (-) strand; PAM type: YTN; PAM sequence: CTT
tgcaccacacacaagaatca

SEQ ID NO: 55518 - DNA, 20 bp, Artificial Sequence
  Description of Artificial Sequence: Synthetic oligonucleotide
  Target: SCN10A; (-) strand; PAM type: YTN; PAM sequence: TTA
aacatccaactttgcaccac

SEQ ID NO: 55519 - DNA, 20 bp, Artificial Sequence
  Description of Artificial Sequence: Synthetic oligonucleotide
  Target: SCN10A; (-) strand; PAM type: YTN; PAM sequence: CTA
cattaaacatccaactttgc

SEQ ID NO: 55520 - DNA, 20 bp, Artificial Sequence
  Description of Artificial Sequence: Synthetic oligonucleotide
  Target: SCN10A; (-) strand; PAM type: YTN; PAM sequence: CTG
gaaaaactacattaaacatc

SEQ ID NO: 55521 - DNA, 20 bp, Artificial Sequence
  Description of Artificial Sequence: Synthetic oligonucleotide
  Target: SCN10A; (-) strand; PAM type: YTN; PAM sequence: CTC
actggaaaaactacattaaa

SEQ ID NO: 55522 - DNA, 20 bp, Artificial Sequence
  Description of Artificial Sequence: Synthetic oligonucleotide
  Target: SCN10A; (-) strand; PAM type: YTN; PAM sequence: TTA
ggaatctcactggaaaaact

SEQ ID NO: 55523 - DNA, 20 bp, Artificial Sequence
  Description of Artificial Sequence: Synthetic oligonucleotide
  Target: SCN10A; (-) strand; PAM type: YTN; PAM sequence: CTG
aagaattaggaatctcactg

SEQ ID NO: 55524 - DNA, 20 bp, Artificial Sequence
  Description of Artificial Sequence: Synthetic oligonucleotide
  Target: SCN10A; (-) strand; PAM type: YTN; PAM sequence: TTC
aaaaaatgatgctgaagaat

SEQ ID NO: 55525 - DNA, 20 bp, Artificial Sequence
  Description of Artificial Sequence: Synthetic oligonucleotide
  Target: SCN10A; (-) strand; PAM type: YTN; PAM sequence: CTT
caaaaaatgatgctgaagaa

SEQ ID NO: 55526 - DNA, 20 bp, Artificial Sequence
  Description of Artificial Sequence: Synthetic oligonucleotide
  Target: SCN10A; (-) strand; PAM type: YTN; PAM sequence: CTA
atgtgtgaaaaggtggcacc

SEQ ID NO: 55527 - DNA, 20 bp, Artificial Sequence
  Description of Artificial Sequence: Synthetic oligonucleotide
  Target: SCN10A; (-) strand; PAM type: YTN; PAM sequence: TTG
gtcagaataatgtaacagca

SEQ ID NO: 55528 - DNA, 20 bp, Artificial Sequence
  Description of Artificial Sequence: Synthetic oligonucleotide
  Target: SCN10A; (-) strand; PAM type: YTN; PAM sequence: TTG
gtgtaagattggtcagaata

SEQ ID NO: 55529 - DNA, 20 bp, Artificial Sequence
  Description of Artificial Sequence: Synthetic oligonucleotide
  Target: SCN10A; (-) strand; PAM type: YTN; PAM sequence: TTG
aagcagtgtgccattggtgt

SEQ ID NO: 55530 - DNA, 20 bp, Artificial Sequence
  Description of Artificial Sequence: Synthetic oligonucleotide
  Target: SCN10A; (-) strand; PAM type: YTN; PAM sequence: CTA
attgaagcagtgtgccattg

SEQ ID NO: 55531 - DNA, 20 bp, Artificial Sequence
  Description of Artificial Sequence: Synthetic oligonucleotide
  Target: SCN10A; (-) strand; PAM type: YTN; PAM sequence: CTC
taattgaagcagtgtgccat

SEQ ID NO: 55532 - DNA, 20 bp, Artificial Sequence
  Description of Artificial Sequence: Synthetic oligonucleotide
  Target: SCN10A; (-) strand; PAM type: YTN; PAM sequence: CTA
taaagctctaattgaagcag

SEQ ID NO: 55533 - DNA, 20 bp, Artificial Sequence
  Description of Artificial Sequence: Synthetic oligonucleotide
  Target: SCN10A; (-) strand; PAM type: YTN; PAM sequence: TTA
ctataaagctctaattgaag

SEQ ID NO: 55534 - DNA, 20 bp, Artificial Sequence
  Description of Artificial Sequence: Synthetic oligonucleotide
  Target: SCN10A; (-) strand; PAM type: YTN; PAM sequence: TTT
actataaagctctaattgaa

SEQ ID NO: 55535 - DNA, 20 bp, Artificial Sequence
  Description of Artificial Sequence: Synthetic oligonucleotide
  Target: SCN10A; (-) strand; PAM type: YTN; PAM sequence: CTG
gatgtcgagatttactataa

SEQ ID NO: 55536 - DNA, 20 bp, Artificial Sequence
  Description of Artificial Sequence: Synthetic oligonucleotide
  Target: SCN10A; (-) strand; PAM type: YTN; PAM sequence: CTA
ctggatgtcgagatttacta

SEQ ID NO: 55537 - DNA, 20 bp, Artificial Sequence
  Description of Artificial Sequence: Synthetic oligonucleotide
  Target: SCN10A; (-) strand; PAM type: YTN; PAM sequence: TTC
tactggatgtcgagatttac

SEQ ID NO: 55538 - DNA, 20 bp, Artificial Sequence
  Description of Artificial Sequence: Synthetic oligonucleotide
  Target: SCN10A; (-) strand; PAM type: YTN; PAM sequence: CTC
attctactggatgtcgagat

SEQ ID NO: 55539 - DNA, 20 bp, Artificial Sequence
  Description of Artificial Sequence: Synthetic oligonucleotide
  Target: SCN10A; (-) strand; PAM type: YTN; PAM sequence: TTG
aggaagaaatacaaagtggg

SEQ ID NO: 55540 - DNA, 20 bp, Artificial Sequence
  Description of Artificial Sequence: Synthetic oligonucleotide
  Target: SCN10A; (-) strand; PAM type: YTN; PAM sequence: TTT
gaggaagaaatacaaagtgg

SEQ ID NO: 55541 - DNA, 20 bp, Artificial Sequence
  Description of Artificial Sequence: Synthetic oligonucleotide
  Target: SCN10A; (-) strand; PAM type: YTN; PAM sequence: TTT
tgaggaagaaatacaaagtg

SEQ ID NO: 55542 - DNA, 20 bp, Artificial Sequence
  Description of Artificial Sequence: Synthetic oligonucleotide
  Target: SCN10A; (-) strand; PAM type: YTN; PAM sequence: CTT
ttgaggaagaaatacaaagt

SEQ ID NO: 55543 - DNA, 20 bp, Artificial Sequence
  Description of Artificial Sequence: Synthetic oligonucleotide
  Target: SCN10A; (-) strand; PAM type: YTN; PAM sequence: TTA
tagccaagaaacttttgagg

SEQ ID NO: 55544 - DNA, 20 bp, Artificial Sequence
  Description of Artificial Sequence: Synthetic oligonucleotide
  Target: SCN10A; (-) strand; PAM type: YTN; PAM sequence: TTA
aagagcaaattatagccaag

SEQ ID NO: 55545 - DNA, 20 bp, Artificial Sequence
  Description of Artificial Sequence: Synthetic oligonucleotide
  Target: SCN10A; (-) strand; PAM type: YTN; PAM sequence: TTT
aaagagcaaattatagccaa

SEQ ID NO: 55546 - DNA, 20 bp, Artificial Sequence
  Description of Artificial Sequence: Synthetic oligonucleotide
  Target: SCN10A; (-) strand; PAM type: YTN; PAM sequence: TTT
taaagagcaaattatagcca

SEQ ID NO: 55547 - DNA, 20 bp, Artificial Sequence
  Description of Artificial Sequence: Synthetic oligonucleotide
  Target: SCN10A; (-) strand; PAM type: YTN; PAM sequence: TTA
catgaaattttaaagagcaa

SEQ ID NO: 55548 - DNA, 20 bp, Artificial Sequence
  Description of Artificial Sequence: Synthetic oligonucleotide
  Target: SCN10A; (-) strand; PAM type: YTN; PAM sequence: TTT
acatgaaattttaaagagca

SEQ ID NO: 55549 - DNA, 20 bp, Artificial Sequence
  Description of Artificial Sequence: Synthetic oligonucleotide
  Target: SCN10A; (-) strand; PAM type: YTN; PAM sequence: CTC
aaaagtttacatgaaatttt

SEQ ID NO: 55550 - DNA, 20 bp, Artificial Sequence
  Description of Artificial Sequence: Synthetic oligonucleotide
  Target: SCN10A; (-) strand; PAM type: YTN; PAM sequence: TTC
ctcaaaagtttacatgaaat

SEQ ID NO: 55551 - DNA, 20 bp, Artificial Sequence
  Description of Artificial Sequence: Synthetic oligonucleotide
  Target: SCN10A; (-) strand; PAM type: YTN; PAM sequence: CTT
cctcaaaagtttacatgaaa

SEQ ID NO: 55552 - DNA, 20 bp, Artificial Sequence
  Description of Artificial Sequence: Synthetic oligonucleotide
  Target: SCN10A; (-) strand; PAM type: YTN; PAM sequence: TTC
ttcctcaaaagtttacatga

SEQ ID NO: 55553 - DNA, 20 bp, Artificial Sequence
  Description of Artificial Sequence: Synthetic oligonucleotide
  Target: SCN10A; (-) strand; PAM type: YTN; PAM sequence: TTT
cttcctcaaaagtttacatg

SEQ ID NO: 55554 - DNA, 20 bp, Artificial Sequence
  Description of Artificial Sequence: Synthetic oligonucleotide
  Target: SCN10A; (-) strand; PAM type: YTN; PAM sequence: TTT
tcttcctcaaaagtttacat

SEQ ID NO: 55555 - DNA, 20 bp, Artificial Sequence
  Description of Artificial Sequence: Synthetic oligonucleotide
  Target: SCN10A; (-) strand; PAM type: YTN; PAM sequence: TTA
aattttcttcctcaaaagtt

SEQ ID NO: 55556 - DNA, 20 bp, Artificial Sequence
  Description of Artificial Sequence: Synthetic oligonucleotide
  Target: SCN10A; (-) strand; PAM type: YTN; PAM sequence: TTT
aaattttcttcctcaaaagt

SEQ ID NO: 55557 - DNA, 20 bp, Artificial Sequence
  Description of Artificial Sequence: Synthetic oligonucleotide
  Target: SCN10A; (-) strand; PAM type: YTN; PAM sequence: CTT
taaattttcttcctcaaaag

SEQ ID NO: 55558 - DNA, 20 bp, Artificial Sequence
  Description of Artificial Sequence: Synthetic oligonucleotide
  Target: SCN10A; (-) strand; PAM type: YTN; PAM sequence: TTA
aactttaaattttcttcctc

SEQ ID NO: 55559 - DNA, 20 bp, Artificial Sequence
  Description of Artificial Sequence: Synthetic oligonucleotide
  Target: SCN10A; (-) strand; PAM type: YTN; PAM sequence: TTT
aaactttaaattttcttcct

SEQ ID NO: 55560 - DNA, 20 bp, Artificial Sequence
  Description of Artificial Sequence: Synthetic oligonucleotide
  Target: SCN10A; (-) strand; PAM type: YTN; PAM sequence: CTT
taaactttaaattttcttcc

SEQ ID NO: 55561 - DNA, 20 bp, Artificial Sequence
  Description of Artificial Sequence: Synthetic oligonucleotide
  Target: SCN10A; (-) strand; PAM type: YTN; PAM sequence: TTG
acaaactttaaactttaaat

SEQ ID NO: 55562 - DNA, 20 bp, Artificial Sequence
  Description of Artificial Sequence: Synthetic oligonucleotide
  Target: SCN10A; (-) strand; PAM type: YTN; PAM sequence: CTT
gacaaactttaaactttaaa

SEQ ID NO: 55563 - DNA, 20 bp, Artificial Sequence
  Description of Artificial Sequence: Synthetic oligonucleotide
  Target: SCN10A; (-) strand; PAM type: YTN; PAM sequence: TTA
cttgacaaactttaaacttt

SEQ ID NO: 55564 - DNA, 20 bp, Artificial Sequence
  Description of Artificial Sequence: Synthetic oligonucleotide
  Target: SCN10A; (-) strand; PAM type: YTN; PAM sequence: TTG
gtattacttgacaaacttta

SEQ ID NO: 55565 - DNA, 20 bp, Artificial Sequence
  Description of Artificial Sequence: Synthetic oligonucleotide
  Target: SCN10A; (-) strand; PAM type: YTN; PAM sequence: TTT
ggtattacttgacaaacttt

SEQ ID NO: 55566 - DNA, 20 bp, Artificial Sequence
  Description of Artificial Sequence: Synthetic oligonucleotide
  Target: SCN10A; (-) strand; PAM type: YTN; PAM sequence: TTT
tggtattacttgacaaactt

SEQ ID NO: 55567 - DNA, 20 bp, Artificial Sequence
  Description of Artificial Sequence: Synthetic oligonucleotide
  Target: SCN10A; (-) strand; PAM type: YTN; PAM sequence: CTT
ttggtattacttgacaaact

SEQ ID NO: 55568 - DNA, 20 bp, Artificial Sequence
  Description of Artificial Sequence: Synthetic oligonucleotide
  Target: SCN10A; (-) strand; PAM type: YTN; PAM sequence: TTC
ttttggtattacttgacaaa

SEQ ID NO: 55569 - DNA, 20 bp, Artificial Sequence
  Description of Artificial Sequence: Synthetic oligonucleotide
  Target: SCN10A; (-) strand; PAM type: YTN; PAM sequence: CTT
cttttggtattacttgacaa

SEQ ID NO: 55570 - DNA, 20 bp, Artificial Sequence
  Description of Artificial Sequence: Synthetic oligonucleotide
  Target: SCN10A; (-) strand; PAM type: YTN; PAM sequence: TTC
aacaggcttcttttggtatt

SEQ ID NO: 55571 - DNA, 20 bp, Artificial Sequence
  Description of Artificial Sequence: Synthetic oligonucleotide
  Target: SCN10A; (-) strand; PAM type: YTN; PAM sequence: TTT
caacaggcttcttttggtat

SEQ ID NO: 55572 - DNA, 20 bp, Artificial Sequence
  Description of Artificial Sequence: Synthetic oligonucleotide
  Target: SCN10A; (-) strand; PAM type: YTN; PAM sequence: CTC
aaatcaatatttcaacaggc

SEQ ID NO: 55573 - DNA, 20 bp, Artificial Sequence
  Description of Artificial Sequence: Synthetic oligonucleotide
  Target: SCN10A; (-) strand; PAM type: YTN; PAM sequence: TTA
atatgatcctcaaatcaata

SEQ ID NO: 55574 - DNA, 20 bp, Artificial Sequence
  Description of Artificial Sequence: Synthetic oligonucleotide
  Target: SCN10A; (-) strand; PAM type: YTN; PAM sequence: TTT
aatatgatcctcaaatcaat

SEQ ID NO: 55575 - DNA, 20 bp, Artificial Sequence
  Description of Artificial Sequence: Synthetic oligonucleotide
  Target: SCN10A; (-) strand; PAM type: YTN; PAM sequence: TTA
ataaatttaatatgatcctc

SEQ ID NO: 55576 - DNA, 20 bp, Artificial Sequence
  Description of Artificial Sequence: Synthetic oligonucleotide
  Target: SCN10A; (-) strand; PAM type: YTN; PAM sequence: CTC
ccaaaaatgattaataaatt

SEQ ID NO: 55577 - DNA, 20 bp, Artificial Sequence
  Description of Artificial Sequence: Synthetic oligonucleotide
  Target: SCN10A; (-) strand; PAM type: YTN; PAM sequence: TTG
taaagactcccaaaaatgat

SEQ ID NO: 55578 - DNA, 20 bp, Artificial Sequence
  Description of Artificial Sequence: Synthetic oligonucleotide
  Target: SCN10A; (-) strand; PAM type: YTN; PAM sequence: CTC
aatattgtaaagactcccaa

SEQ ID NO: 55579 - DNA, 20 bp, Artificial Sequence
  Description of Artificial Sequence: Synthetic oligonucleotide
  Target: SCN10A; (-) strand; PAM type: YTN; PAM sequence: TTC
aaagtctcaatattgtaaag

SEQ ID NO: 55580 - DNA, 20 bp, Artificial Sequence
  Description of Artificial Sequence: Synthetic oligonucleotide
  Target: SCN10A; (-) strand; PAM type: YTN; PAM sequence: CTC
agattcaaagtctcaatatt

SEQ ID NO: 55581 - DNA, 20 bp, Artificial Sequence
  Description of Artificial Sequence: Synthetic oligonucleotide
  Target: SCN10A; (-) strand; PAM type: YTN; PAM sequence: TTC
tcagattcaaagtctcaata

SEQ ID NO: 55582 - DNA, 20 bp, Artificial Sequence
  Description of Artificial Sequence: Synthetic oligonucleotide
  Target: SCN10A; (-) strand; PAM type: YTN; PAM sequence: TTA
aagaaaaccaaatcagtggg

SEQ ID NO: 55583 - DNA, 20 bp, Artificial Sequence
  Description of Artificial Sequence: Synthetic oligonucleotide
  Target: SCN10A; (-) strand; PAM type: YTN; PAM sequence: TTT
aaagaaaaccaaatcagtgg

SEQ ID NO: 55584 - DNA, 20 bp, Artificial Sequence
  Description of Artificial Sequence: Synthetic oligonucleotide
  Target: SCN10A; (-) strand; PAM type: YTN; PAM sequence: TTT
taaagaaaaccaaatcagtg

SEQ ID NO: 55585 - DNA, 20 bp, Artificial Sequence
  Description of Artificial Sequence: Synthetic oligonucleotide
  Target: SCN10A; (-) strand; PAM type: YTN; PAM sequence: TTT
ttaaagaaaaccaaatcagt

SEQ ID NO: 55586 - DNA, 20 bp, Artificial Sequence
  Description of Artificial Sequence: Synthetic oligonucleotide
  Target: SCN10A; (-) strand; PAM type: YTN; PAM sequence: TTG
tgtaaagtttttaaagaaaa

SEQ ID NO: 55587 - DNA, 20 bp, Artificial Sequence
  Description of Artificial Sequence: Synthetic oligonucleotide
  Target: SCN10A; (-) strand; PAM type: YTN; PAM sequence: TTA
taataagtattgtgtaaagt

SEQ ID NO: 55588 - DNA, 20 bp, Artificial Sequence
  Description of Artificial Sequence: Synthetic oligonucleotide
  Target: SCN10A; (-) strand; PAM type: YTN; PAM sequence: CTA
taaggaaaattataataagt

SEQ ID NO: 55589 - DNA, 20 bp, Artificial Sequence
  Description of Artificial Sequence: Synthetic oligonucleotide
  Target: SCN10A; (-) strand; PAM type: YTN; PAM sequence: CTC
tataaggaaaattataataa

SEQ ID NO: 55590 - DNA, 20 bp, Artificial Sequence
  Description of Artificial Sequence: Synthetic oligonucleotide
  Target: SCN10A; (-) strand; PAM type: YTN; PAM sequence: TTA
tcaaagtataagtgagatct

SEQ ID NO: 55591 - DNA, 20 bp, Artificial Sequence
  Description of Artificial Sequence: Synthetic oligonucleotide
  Target: SCN10A; (-) strand; PAM type: YTN; PAM sequence: CTA
ggaataagattatcaaagta

SEQ ID NO: 55592 - DNA, 20 bp, Artificial Sequence
  Description of Artificial Sequence: Synthetic oligonucleotide
  Target: SCN10A; (-) strand; PAM type: YTN; PAM sequence: TTA
aaatgtcaagtatctaggaa

SEQ ID NO: 55593 - DNA, 20 bp, Artificial Sequence
  Description of Artificial Sequence: Synthetic oligonucleotide
  Target: SCN10A; (-) strand; PAM type: YTN; PAM sequence: TTT
aaaatgtcaagtatctagga

SEQ ID NO: 55594 - DNA, 20 bp, Artificial Sequence
  Description of Artificial Sequence: Synthetic oligonucleotide
  Target: SCN10A; (-) strand; PAM type: YTN; PAM sequence: TTT
taaaatgtcaagtatctagg

SEQ ID NO: 55595 - DNA, 20 bp, Artificial Sequence
  Description of Artificial Sequence: Synthetic oligonucleotide
  Target: SCN10A; (-) strand; PAM type: YTN; PAM sequence: CTG
gcattttaaaatgtcaagta

SEQ ID NO: 55596 - DNA, 20 bp, Artificial Sequence
  Description of Artificial Sequence: Synthetic oligonucleotide
  Target: SCN10A; (-) strand; PAM type: YTN; PAM sequence: TTA
cactggcattttaaaatgtc

SEQ ID NO: 55597 - DNA, 20 bp, Artificial Sequence
  Description of Artificial Sequence: Synthetic oligonucleotide
  Target: SCN10A; (-) strand; PAM type: YTN; PAM sequence: TTT
acactggcattttaaaatgt

SEQ ID NO: 55598 - DNA, 20 bp, Artificial Sequence
  Description of Artificial Sequence: Synthetic oligonucleotide
  Target: SCN10A; (-) strand; PAM type: YTN; PAM sequence: TTA
aaaataccatttacactggc

SEQ ID NO: 55599 - DNA, 20 bp, Artificial Sequence
  Description of Artificial Sequence: Synthetic oligonucleotide
  Target: SCN10A; (-) strand; PAM type: YTN; PAM sequence: TTT
aaaaataccatttacactgg

SEQ ID NO: 55600 - DNA, 20 bp, Artificial Sequence
  Description of Artificial Sequence: Synthetic oligonucleotide
  Target: SCN10A; (-) strand; PAM type: YTN; PAM sequence: TTT
taaaaataccatttacactg

SEQ ID NO: 55601 - DNA, 20 bp, Artificial Sequence
  Description of Artificial Sequence: Synthetic oligonucleotide
  Target: SCN10A; (-) strand; PAM type: YTN; PAM sequence: TTT
ttaaaaataccatttacact

SEQ ID NO: 55602 - DNA, 20 bp, Artificial Sequence
  Description of Artificial Sequence: Synthetic oligonucleotide
  Target: SCN10A; (-) strand; PAM type: YTN; PAM sequence: CTA
gcaacaaacagaaaatagtt

SEQ ID NO: 55603 - DNA, 20 bp, Artificial Sequence
  Description of Artificial Sequence: Synthetic oligonucleotide
  Target: SCN10A; (-) strand; PAM type: YTN; PAM sequence: TTG
tgtatagacactagcaacaa

SEQ ID NO: 55604 - DNA, 20 bp, Artificial Sequence
  Description of Artificial Sequence: Synthetic oligonucleotide
  Target: SCN10A; (-) strand; PAM type: YTN; PAM sequence: TTA
acatacataaatcaattgtg

SEQ ID NO: 55605 - DNA, 20 bp, Artificial Sequence
  Description of Artificial Sequence: Synthetic oligonucleotide
  Target: SCN10A; (-) strand; PAM type: YTN; PAM sequence: CTG
ggtacaaattaacatacata

SEQ ID NO: 55606 - DNA, 20 bp, Artificial Sequence
  Description of Artificial Sequence: Synthetic oligonucleotide
  Target: SCN10A; (-) strand; PAM type: YTN; PAM sequence: TTA
ataaaagagtatagtaaggt

SEQ ID NO: 55607 - DNA, 20 bp, Artificial Sequence
  Description of Artificial Sequence: Synthetic oligonucleotide
  Target: SCN10A; (-) strand; PAM type: YTN; PAM sequence: CTA
gagataaacagtaagaatta

SEQ ID NO: 55608 - DNA, 20 bp, Artificial Sequence
  Description of Artificial Sequence: Synthetic oligonucleotide
  Target: SCN10A; (-) strand; PAM type: YTN; PAM sequence: TTG
tatacataaaatatccaaca

SEQ ID NO: 55609 - DNA, 20 bp, Artificial Sequence
  Description of Artificial Sequence: Synthetic oligonucleotide
  Target: SCN10A; (-) strand; PAM type: YTN; PAM sequence: TTA
cagataataagattgtatac

SEQ ID NO: 55610 - DNA, 20 bp, Artificial Sequence
  Description of Artificial Sequence: Synthetic oligonucleotide
  Target: SCN10A; (-) strand; PAM type: YTN; PAM sequence: TTT
acagataataagattgtata

SEQ ID NO: 55611 - DNA, 20 bp, Artificial Sequence
  Description of Artificial Sequence: Synthetic oligonucleotide
  Target: SCN10A; (-) strand; PAM type: YTN; PAM sequence: CTC
agccagcatagtaaagcaaa

SEQ ID NO: 55612 - DNA, 20 bp, Artificial Sequence
  Description of Artificial Sequence: Synthetic oligonucleotide
  Target: SCN10A; (-) strand; PAM type: YTN; PAM sequence: TTG
taaaggaggtctcagccagc

SEQ ID NO: 55613 - DNA, 20 bp, Artificial Sequence
  Description of Artificial Sequence: Synthetic oligonucleotide
  Target: SCN10A; (-) strand; PAM type: YTN; PAM sequence: TTT
gtaaaggaggtctcagccag

SEQ ID NO: 55614 - DNA, 20 bp, Artificial Sequence
  Description of Artificial Sequence: Synthetic oligonucleotide
  Target: SCN10A; (-) strand; PAM type: YTN; PAM sequence: CTT
tgtaaaggaggtctcagcca

SEQ ID NO: 55615 - DNA, 20 bp, Artificial Sequence
  Description of Artificial Sequence: Synthetic oligonucleotide
  Target: SCN10A; (-) strand; PAM type: YTN; PAM sequence: TTC
cactttgtaaaggaggtctc

SEQ ID NO: 55616 - DNA, 20 bp, Artificial Sequence
  Description of Artificial Sequence: Synthetic oligonucleotide
  Target: SCN10A; (-) strand; PAM type: YTN; PAM sequence: CTC
agttccactttgtaaaggag

SEQ ID NO: 55617 - DNA, 20 bp, Artificial Sequence
  Description of Artificial Sequence: Synthetic oligonucleotide
  Target: SCN10A; (-) strand; PAM type: YTN; PAM sequence: TTC
tcagttccactttgtaaagg

SEQ ID NO: 55618 - DNA, 20 bp, Artificial Sequence
  Description of Artificial Sequence: Synthetic oligonucleotide
  Target: SCN10A; (-) strand; PAM type: YTN; PAM sequence: CTT
ctcagttccactttgtaaag

SEQ ID NO: 55619 - DNA, 20 bp, Artificial Sequence
  Description of Artificial Sequence: Synthetic oligonucleotide
  Target: SCN10A; (-) strand; PAM type: YTN; PAM sequence: TTC
ttctcagttccactttgtaa

SEQ ID NO: 55620 - DNA, 20 bp, Artificial Sequence
  Description of Artificial Sequence: Synthetic oligonucleotide
  Target: SCN10A; (-) strand; PAM type: YTN; PAM sequence: CTG
ttcttctcagttccactttg

SEQ ID NO: 55621 - DNA, 20 bp, Artificial Sequence
  Description of Artificial Sequence: Synthetic oligonucleotide
  Target: SCN10A; (-) strand; PAM type: YTN; PAM sequence: TTG
agatcaaaagaaaaaaaaac

SEQ ID NO: 55622 - DNA, 20 bp, Artificial Sequence
  Description of Artificial Sequence: Synthetic oligonucleotide
  Target: SCN10A; (-) strand; PAM type: YTN; PAM sequence: TTT
gagatcaaaagaaaaaaaaa

SEQ ID NO: 55623 - DNA, 20 bp, Artificial Sequence
  Description of Artificial Sequence: Synthetic oligonucleotide
  Target: SCN10A; (-) strand; PAM type: YTN; PAM sequence: CTT
tgagatcaaaagaaaaaaaa

SEQ ID NO: 55624 - DNA, 20 bp, Artificial Sequence
  Description of Artificial Sequence: Synthetic oligonucleotide
  Target: SCN10A; (-) strand; PAM type: YTN; PAM sequence: TTC
cctttgagatcaaaagaaaa

SEQ ID NO: 55625 - DNA, 20 bp, Artificial Sequence
  Description of Artificial Sequence: Synthetic oligonucleotide
  Target: SCN10A; (-) strand; PAM type: YTN; PAM sequence: TTT
ccctttgagatcaaaagaaa

SEQ ID NO: 55626 - DNA, 20 bp, Artificial Sequence
  Description of Artificial Sequence: Synthetic oligonucleotide
  Target: SCN10A; (-) strand; PAM type: YTN; PAM sequence: CTT
tccctttgagatcaaaagaa

SEQ ID NO: 55627 - DNA, 20 bp, Artificial Sequence
  Description of Artificial Sequence: Synthetic oligonucleotide
  Target: SCN10A; (-) strand; PAM type: YTN; PAM sequence: TTG
tgaacatggaaagctttccc

SEQ ID NO: 55628 - DNA, 20 bp, Artificial Sequence
  Description of Artificial Sequence: Synthetic oligonucleotide
  Target: SCN10A; (-) strand; PAM type: YTN; PAM sequence: TTA
attgtgaacatggaaagctt

SEQ ID NO: 55629 - DNA, 20 bp, Artificial Sequence
  Description of Artificial Sequence: Synthetic oligonucleotide
  Target: SCN10A; (-) strand; PAM type: YTN; PAM sequence: CTT
aattgtgaacatggaaagct

SEQ ID NO: 55630 - DNA, 20 bp, Artificial Sequence
  Description of Artificial Sequence: Synthetic oligonucleotide
  Target: SCN10A; (-) strand; PAM type: YTN; PAM sequence: TTA
aagtatcaagcgtcatactt

SEQ ID NO: 55631 - DNA, 20 bp, Artificial Sequence
  Description of Artificial Sequence: Synthetic oligonucleotide
  Target: SCN10A; (-) strand; PAM type: YTN; PAM sequence: TTT
aaagtatcaagcgtcatact

SEQ ID NO: 55632 - DNA, 20 bp, Artificial Sequence
  Description of Artificial Sequence: Synthetic oligonucleotide
  Target: SCN10A; (-) strand; PAM type: YTN; PAM sequence: TTT
taaagtatcaagcgtcatac

SEQ ID NO: 55633 - DNA, 20 bp, Artificial Sequence
  Description of Artificial Sequence: Synthetic oligonucleotide
  Target: SCN10A; (-) strand; PAM type: YTN; PAM sequence: TTG
ttttaaagtatcaagcgtca

SEQ ID NO: 55634 - DNA, 20 bp, Artificial Sequence
  Description of Artificial Sequence: Synthetic oligonucleotide
  Target: SCN10A; (-) strand; PAM type: YTN; PAM sequence: TTC
attgttttaaagtatcaagc

SEQ ID NO: 55635 - DNA, 20 bp, Artificial Sequence
  Description of Artificial Sequence: Synthetic oligonucleotide
  Target: SCN10A; (-) strand; PAM type: YTN; PAM sequence: CTG
ataaagggtattcattgttt

SEQ ID NO: 55636 - DNA, 20 bp, Artificial Sequence
  Description of Artificial Sequence: Synthetic oligonucleotide
  Target: SCN10A; (-) strand; PAM type: YTN; PAM sequence: CTC
tgataaagggtattcattgt

SEQ ID NO: 55637 - DNA, 20 bp, Artificial Sequence
  Description of Artificial Sequence: Synthetic oligonucleotide
  Target: SCN10A; (-) strand; PAM type: YTN; PAM sequence: TTG
catcactctgataaagggta

SEQ ID NO: 55638 - DNA, 20 bp, Artificial Sequence
  Description of Artificial Sequence: Synthetic oligonucleotide
  Target: SCN10A; (-) strand; PAM type: YTN; PAM sequence: TTA
aaaaggggattgcatcactc

SEQ ID NO: 55639 - DNA, 20 bp, Artificial Sequence
  Description of Artificial Sequence: Synthetic oligonucleotide
  Target: SCN10A; (-) strand; PAM type: YTN; PAM sequence: TTT
aaaaaggggattgcatcact

SEQ ID NO: 55640 - DNA, 20 bp, Artificial Sequence
  Description of Artificial Sequence: Synthetic oligonucleotide
  Target: SCN10A; (-) strand; PAM type: YTN; PAM sequence: TTT
taaaaaggggattgcatcac

SEQ ID NO: 55641 - DNA, 20 bp, Artificial Sequence
  Description of Artificial Sequence: Synthetic oligonucleotide
  Target: SCN10A; (-) strand; PAM type: YTN; PAM sequence: TTA
aagtataataattttaaaaa

SEQ ID NO: 55642 - DNA, 20 bp, Artificial Sequence
  Description of Artificial Sequence: Synthetic oligonucleotide
  Target: SCN10A; (-) strand; PAM type: YTN; PAM sequence: CTT
aaagtataataattttaaaa

SEQ ID NO: 55643 - DNA, 20 bp, Artificial Sequence
  Description of Artificial Sequence: Synthetic oligonucleotide
  Target: SCN10A; (-) strand; PAM type: YTN; PAM sequence: CTG
cacatgtaccccagaactta

SEQ ID NO: 55644 - DNA, 20 bp, Artificial Sequence
  Description of Artificial Sequence: Synthetic oligonucleotide
  Target: SCN10A; (-) strand; PAM type: YTN; PAM sequence: TTC
tgcacatgtaccccagaact

SEQ ID NO: 55645 - DNA, 20 bp, Artificial Sequence
  Description of Artificial Sequence: Synthetic oligonucleotide
  Target: SCN10A; (-) strand; PAM type: YTN; PAM sequence: CTA
tgtaacaaaccggcacgttc

SEQ ID NO: 55646 - DNA, 20 bp, Artificial Sequence
  Description of Artificial Sequence: Synthetic oligonucleotide
  Target: SCN10A; (-) strand; PAM type: YTN; PAM sequence: TTG
aagggtgcagcaaaccacca

SEQ ID NO: 55647 - DNA, 20 bp, Artificial Sequence
  Description of Artificial Sequence: Synthetic oligonucleotide
  Target: SCN10A; (-) strand; PAM type: YTN; PAM sequence: CTA
atgtaaatgacgggttgaag

SEQ ID NO: 55648 - DNA, 20 bp, Artificial Sequence
  Description of Artificial Sequence: Synthetic oligonucleotide
  Target: SCN10A; (-) strand; PAM type: YTN; PAM sequence: TTA
ggagaaatacctaatgtaaa

SEQ ID NO: 55649 - DNA, 20 bp, Artificial Sequence
  Description of Artificial Sequence: Synthetic oligonucleotide
  Target: SCN10A; (-) strand; PAM type: YTN; PAM sequence: CTA
ggggagggatagcattagga

SEQ ID NO: 55650 - DNA, 20 bp, Artificial Sequence
  Description of Artificial Sequence: Synthetic oligonucleotide
  Target: SCN10A; (-) strand; PAM type: YTN; PAM sequence: TTG
aggggtggggggctagggga

SEQ ID NO: 55651 - DNA, 20 bp, Artificial Sequence
  Description of Artificial Sequence: Synthetic oligonucleotide
  Target: SCN10A; (-) strand; PAM type: YTN; PAM sequence: CTG
ttgaggggtggggggctagg

SEQ ID NO: 55652 - DNA, 20 bp, Artificial Sequence
  Description of Artificial Sequence: Synthetic oligonucleotide
  Target: SCN10A; (-) strand; PAM type: YTN; PAM sequence: CTG
gggcctgttgaggggtgggg

SEQ ID NO: 55653 - DNA, 20 bp, Artificial Sequence
  Description of Artificial Sequence: Synthetic oligonucleotide
  Target: SCN10A; (-) strand; PAM type: YTN; PAM sequence: TTG
aacaatgagaacacatggac

SEQ ID NO: 55654 - DNA, 20 bp, Artificial Sequence
  Description of Artificial Sequence: Synthetic oligonucleotide
  Target: SCN10A; (-) strand; PAM type: YTN; PAM sequence: CTC
ataagtgggagttgaacaat

SEQ ID NO: 55655 - DNA, 20 bp, Artificial Sequence
  Description of Artificial Sequence: Synthetic oligonucleotide
  Target: SCN10A; (-) strand; PAM type: YTN; PAM sequence: CTC
actcataagtgggagttgaa

SEQ ID NO: 55656 - DNA, 20 bp, Artificial Sequence
  Description of Artificial Sequence: Synthetic oligonucleotide
  Target: SCN10A; (-) strand; PAM type: YTN; PAM sequence: TTC
tcactcataagtgggagttg

SEQ ID NO: 55657 - DNA, 20 bp, Artificial Sequence
  Description of Artificial Sequence: Synthetic oligonucleotide
  Target: SCN10A; (-) strand; PAM type: YTN; PAM sequence: CTA
acacaagaacagaaaaccaa

SEQ ID NO: 55658 - DNA, 20 bp, Artificial Sequence
  Description of Artificial Sequence: Synthetic oligonucleotide
  Target: SCN10A; (-) strand; PAM type: YTN; PAM sequence: CTC
agcaaactaacacaagaaca

SEQ ID NO: 55659 - DNA, 20 bp, Artificial Sequence
  Description of Artificial Sequence: Synthetic oligonucleotide
  Target: SCN10A; (-) strand; PAM type: YTN; PAM sequence: TTC
tcagcaaactaacacaagaa

SEQ ID NO: 55660 - DNA, 20 bp, Artificial Sequence
  Description of Artificial Sequence: Synthetic oligonucleotide
  Target: SCN10A; (-) strand; PAM type: YTN; PAM sequence: CTG
gaaaccatcattctcagcaa

SEQ ID NO: 55661 - DNA, 20 bp, Artificial Sequence
  Description of Artificial Sequence: Synthetic oligonucleotide
  Target: SCN10A; (-) strand; PAM type: YTN; PAM sequence: TTG
cagggacatggatgaagctg

SEQ ID NO: 55662 - DNA, 20 bp, Artificial Sequence
  Description of Artificial Sequence: Synthetic oligonucleotide
  Target: SCN10A; (-) strand; PAM type: YTN; PAM sequence: TTT
gcagggacatggatgaagct

SEQ ID NO: 55663 - DNA, 20 bp, Artificial Sequence
  Description of Artificial Sequence: Synthetic oligonucleotide
  Target: SCN10A; (-) strand; PAM type: YTN; PAM sequence: CTT
tgcagggacatggatgaagc

SEQ ID NO: 55664 - DNA, 20 bp, Artificial Sequence
  Description of Artificial Sequence: Synthetic oligonucleotide
  Target: SCN10A; (-) strand; PAM type: YTN; PAM sequence: TTC
atgtcctttgcagggacatg

SEQ ID NO: 55665 - DNA, 20 bp, Artificial Sequence
  Description of Artificial Sequence: Synthetic oligonucleotide
  Target: SCN10A; (-) strand; PAM type: YTN; PAM sequence: CTA
tgcagtcataaaaaaggatg

SEQ ID NO: 55666 - DNA, 20 bp, Artificial Sequence
  Description of Artificial Sequence: Synthetic oligonucleotide
  Target: SCN10A; (-) strand; PAM type: YTN; PAM sequence: TTG
aaatagaagggaataaatgt

SEQ ID NO: 55667 - DNA, 20 bp, Artificial Sequence
  Description of Artificial Sequence: Synthetic oligonucleotide
  Target: SCN10A; (-) strand; PAM type: YTN; PAM sequence: TTA
gaaaagttgaaatagaaggg

SEQ ID NO: 55668 - DNA, 20 bp, Artificial Sequence
  Description of Artificial Sequence: Synthetic oligonucleotide
  Target: SCN10A; (-) strand; PAM type: YTN; PAM sequence: CTT
agaaaagttgaaatagaagg

SEQ ID NO: 55669 - DNA, 20 bp, Artificial Sequence
  Description of Artificial Sequence: Synthetic oligonucleotide
  Target: SCN10A; (-) strand; PAM type: YTN; PAM sequence: TTC
ttagaaaagttgaaatagaa

SEQ ID NO: 55670 - DNA, 20 bp, Artificial Sequence
  Description of Artificial Sequence: Synthetic oligonucleotide
  Target: SCN10A; (-) strand; PAM type: YTN; PAM sequence: TTA
aattcttagaaaagttgaaa

SEQ ID NO: 55671 - DNA, 20 bp, Artificial Sequence
  Description of Artificial Sequence: Synthetic oligonucleotide
  Target: SCN10A; (-) strand; PAM type: YTN; PAM sequence: TTT
aaattcttagaaaagttgaa

SEQ ID NO: 55672 - DNA, 20 bp, Artificial Sequence
  Description of Artificial Sequence: Synthetic oligonucleotide
  Target: SCN10A; (-) strand; PAM type: YTN; PAM sequence: TTT
taaattcttagaaaagttga

SEQ ID NO: 55673 - DNA, 20 bp, Artificial Sequence
  Description of Artificial Sequence: Synthetic oligonucleotide
  Target: SCN10A; (-) strand; PAM type: YTN; PAM sequence: TTA
taattttaaattcttagaaa

SEQ ID NO: 55674 - DNA, 20 bp, Artificial Sequence
  Description of Artificial Sequence: Synthetic oligonucleotide
  Target: SCN10A; (-) strand; PAM type: YTN; PAM sequence: TTT
ataattttaaattcttagaa

SEQ ID NO: 55675 - DNA, 20 bp, Artificial Sequence
  Description of Artificial Sequence: Synthetic oligonucleotide
  Target: SCN10A; (-) strand; PAM type: YTN; PAM sequence: TTC
catttataattttaaattct

SEQ ID NO: 55676 - DNA, 20 bp, Artificial Sequence
  Description of Artificial Sequence: Synthetic oligonucleotide
  Target: SCN10A; (-) strand; PAM type: YTN; PAM sequence: TTT
ccatttataattttaaattc

SEQ ID NO: 55677 - DNA, 20 bp, Artificial Sequence
  Description of Artificial Sequence: Synthetic oligonucleotide
  Target: SCN10A; (-) strand; PAM type: YTN; PAM sequence: TTA
atttccatttataattttaa

SEQ ID NO: 55678 - DNA, 20 bp, Artificial Sequence
  Description of Artificial Sequence: Synthetic oligonucleotide
  Target: SCN10A; (-) strand; PAM type: YTN; PAM sequence: TTT
aatttccatttataatttta

SEQ ID NO: 55679 - DNA, 20 bp, Artificial Sequence
  Description of Artificial Sequence: Synthetic oligonucleotide
  Target: SCN10A; (-) strand; PAM type: YTN; PAM sequence: TTG
ataaagtttaatttccattt

SEQ ID NO: 55680 - DNA, 20 bp, Artificial Sequence
  Description of Artificial Sequence: Synthetic oligonucleotide
  Target: SCN10A; (-) strand; PAM type: YTN; PAM sequence: TTT
gataaagtttaatttccatt

SEQ ID NO: 55681 - DNA, 20 bp, Artificial Sequence
  Description of Artificial Sequence: Synthetic oligonucleotide
  Target: SCN10A; (-) strand; PAM type: YTN; PAM sequence: CTA
aaatcatttgataaagttta

SEQ ID NO: 55682 - DNA, 20 bp, Artificial Sequence
  Description of Artificial Sequence: Synthetic oligonucleotide
  Target: SCN10A; (-) strand; PAM type: YTN; PAM sequence: TTG
atgctaaaatcatttgataa

SEQ ID NO: 55683 - DNA, 20 bp, Artificial Sequence
  Description of Artificial Sequence: Synthetic oligonucleotide
  Target: SCN10A; (-) strand; PAM type: YTN; PAM sequence: TTA
attgatgctaaaatcatttg

SEQ ID NO: 55684 - DNA, 20 bp, Artificial Sequence
  Description of Artificial Sequence: Synthetic oligonucleotide
  Target: SCN10A; (-) strand; PAM type: YTN; PAM sequence: CTT
aattgatgctaaaatcattt

SEQ ID NO: 55685 - DNA, 20 bp, Artificial Sequence
  Description of Artificial Sequence: Synthetic oligonucleotide
  Target: SCN10A; (-) strand; PAM type: YTN; PAM sequence: TTC
ttaattgatgctaaaatcat

SEQ ID NO: 55686 - DNA, 20 bp, Artificial Sequence
  Description of Artificial Sequence: Synthetic oligonucleotide
  Target: SCN10A; (-) strand; PAM type: YTN; PAM sequence: CTT
cttaattgatgctaaaatca

SEQ ID NO: 55687 - DNA, 20 bp, Artificial Sequence
  Description of Artificial Sequence: Synthetic oligonucleotide
  Target: SCN10A; (-) strand; PAM type: YTN; PAM sequence: TTA
aaggaaaaggatcacatagt

SEQ ID NO: 55688 - DNA, 20 bp, Artificial Sequence
  Description of Artificial Sequence: Synthetic oligonucleotide
  Target: SCN10A; (-) strand; PAM type: YTN; PAM sequence: TTA
atagattaaaggaaaaggat

SEQ ID NO: 55689 - DNA, 20 bp, Artificial Sequence
  Description of Artificial Sequence: Synthetic oligonucleotide
  Target: SCN10A; (-) strand; PAM type: YTN; PAM sequence: TTA
ttaatagattaaaggaaaag

SEQ ID NO: 55690 - DNA, 20 bp, Artificial Sequence
  Description of Artificial Sequence: Synthetic oligonucleotide
  Target: SCN10A; (-) strand; PAM type: YTN; PAM sequence: TTT
attaatagattaaaggaaaa

SEQ ID NO: 55691 - DNA, 20 bp, Artificial Sequence
  Description of Artificial Sequence: Synthetic oligonucleotide
  Target: SCN10A; (-) strand; PAM type: YTN; PAM sequence: TTT
tattaatagattaaaggaaa

SEQ ID NO: 55692 - DNA, 20 bp, Artificial Sequence
  Description of Artificial Sequence: Synthetic oligonucleotide
  Target: SCN10A; (-) strand; PAM type: YTN; PAM sequence: TTT
ttattaatagattaaaggaa

SEQ ID NO: 55693 - DNA, 20 bp, Artificial Sequence
  Description of Artificial Sequence: Synthetic oligonucleotide
  Target: SCN10A; (-) strand; PAM type: YTN; PAM sequence: TTA
tatttttattaatagattaa

SEQ ID NO: 55694 - DNA, 20 bp, Artificial Sequence
  Description of Artificial Sequence: Synthetic oligonucleotide
  Target: SCN10A; (-) strand; PAM type: YTN; PAM sequence: CTA
atcataacagtaatgcatgc

SEQ ID NO: 55695 - DNA, 20 bp, Artificial Sequence
  Description of Artificial Sequence: Synthetic oligonucleotide
  Target: SCN10A; (-) strand; PAM type: YTN; PAM sequence: TTG
ctaatcataacagtaatgca

SEQ ID NO: 55696 - DNA, 20 bp, Artificial Sequence
  Description of Artificial Sequence: Synthetic oligonucleotide
  Target: SCN10A; (-) strand; PAM type: YTN; PAM sequence: TTT
gctaatcataacagtaatgc

SEQ ID NO: 55697 - DNA, 20 bp, Artificial Sequence
  Description of Artificial Sequence: Synthetic oligonucleotide
  Target: SCN10A; (-) strand; PAM type: YTN; PAM sequence: TTT
tgctaatcataacagtaatg

SEQ ID NO: 55698 - DNA, 20 bp, Artificial Sequence
  Description of Artificial Sequence: Synthetic oligonucleotide
  Target: SCN10A; (-) strand; PAM type: YTN; PAM sequence: TTT
ttgctaatcataacagtaat

SEQ ID NO: 55699 - DNA, 20 bp, Artificial Sequence
  Description of Artificial Sequence: Synthetic oligonucleotide
  Target: SCN10A; (-) strand; PAM type: YTN; PAM sequence: TTT
tttgctaatcataacagtaa

SEQ ID NO: 55700 - DNA, 20 bp, Artificial Sequence
  Description of Artificial Sequence: Synthetic oligonucleotide
  Target: SCN10A; (-) strand; PAM type: YTN; PAM sequence: TTT
ttttgctaatcataacagta

SEQ ID NO: 55701 - DNA, 20 bp, Artificial Sequence
  Description of Artificial Sequence: Synthetic oligonucleotide
  Target: SCN10A; (-) strand; PAM type: YTN; PAM sequence: TTT
tttttgctaatcataacagt

SEQ ID NO: 55702 - DNA, 20 bp, Artificial Sequence
  Description of Artificial Sequence: Synthetic oligonucleotide
  Target: SCN10A; (-) strand; PAM type: YTN; PAM sequence: TTT
ttttttgctaatcataacag

SEQ ID NO: 55703 - DNA, 20 bp, Artificial Sequence
  Description of Artificial Sequence: Synthetic oligonucleotide
  Target: SCN10A; (-) strand; PAM type: YTN; PAM sequence: TTT
tttttttgctaatcataaca

SEQ ID NO: 55704 - DNA, 20 bp, Artificial Sequence
  Description of Artificial Sequence: Synthetic oligonucleotide
  Target: SCN10A; (-) strand; PAM type: YTN; PAM sequence: TTT
ttttttttgctaatcataac

SEQ ID NO: 55705 - DNA, 20 bp, Artificial Sequence
  Description of Artificial Sequence: Synthetic oligonucleotide
  Target: SCN10A; (-) strand; PAM type: YTN; PAM sequence: TTT
tttttttttgctaatcataa

SEQ ID NO: 55706 - DNA, 20 bp, Artificial Sequence
  Description of Artificial Sequence: Synthetic oligonucleotide
  Target: SCN10A; (-) strand; PAM type: YTN; PAM sequence: TTT
ttttttttttgctaatcata

SEQ ID NO: 55707 - DNA, 20 bp, Artificial Sequence
  Description of Artificial Sequence: Synthetic oligonucleotide
  Target: SCN10A; (-) strand; PAM type: YTN; PAM sequence: TTT
tttttttttttgctaatcat

SEQ ID NO: 55708 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttgctaatca

SEQ ID NO: 55709 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttgctaatc

SEQ ID NO: 55710 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttttgctaat

SEQ ID NO: 55711 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttttgctaa

SEQ ID NO: 55712 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttttttgcta

SEQ ID NO: 55713 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttttttgct

SEQ ID NO: 55714 - DNA, 20 bp, Artificial Sequence
  Description of Artificial Sequence: Synthetic oligonucleotide
  Target: SCN10A; (-) strand; PAM type: YTN; PAM sequence: TTT
ttttttttttttttttttgc

SEQ ID NO: 55715 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttttttttg

SEQ ID NO: 55716 - DNA, 20 bp, Artificial Sequence
  Description of Artificial Sequence: Synthetic oligonucleotide
  Target: SCN10A; (-) strand; PAM type: YTN; PAM sequence: TTT
tttttttttttttttttttt

SEQ ID NO: 55717 - DNA, 20 bp, Artificial Sequence
  Description of Artificial Sequence: Synthetic oligonucleotide
  Target: SCN10A; (-) strand; PAM type: YTN; PAM sequence: CTT
tttttttttttttttttttt

SEQ ID NO: 55718 - DNA, 20 bp, Artificial Sequence
  Description of Artificial Sequence: Synthetic oligonucleotide
  Target: SCN10A; (-) strand; PAM type: YTN; PAM sequence: TTC
tttttttttttttttttttt

SEQ ID NO: 55719 - DNA, 20 bp, Artificial Sequence
  Description of Artificial Sequence: Synthetic oligonucleotide
  Target: SCN10A; (-) strand; PAM type: YTN; PAM sequence: TTT
cttttttttttttttttttt

SEQ ID NO: 55720 - DNA, 20 bp, Artificial Sequence
  Description of Artificial Sequence: Synthetic oligonucleotide
  Target: SCN10A; (-) strand; PAM type: YTN; PAM sequence: CTT
tctttttttttttttttttt

SEQ ID NO: 55721 - DNA, 20 bp, Artificial Sequence
  Description of Artificial Sequence: Synthetic oligonucleotide
  Target: SCN10A; (-) strand; PAM type: YTN; PAM sequence: TTG
cagagctttctttttttttt

SEQ ID NO: 55722 - DNA, 20 bp, Artificial Sequence
  Description of Artificial Sequence: Synthetic oligonucleotide
  Target: SCN10A; (-) strand; PAM type: YTN; PAM sequence: TTT
gcagagctttcttttttttt

SEQ ID NO: 55723 - DNA, 20 bp, Artificial Sequence
  Description of Artificial Sequence: Synthetic oligonucleotide
  Target: SCN10A; (-) strand; PAM type: YTN; PAM sequence: CTT
tgcagagctttctttttttt

SEQ ID NO: 55724 - DNA, 20 bp, Artificial Sequence
  Description of Artificial Sequence: Synthetic oligonucleotide
  Target: SCN10A; (-) strand; PAM type: YTN; PAM sequence: TTA
taataacaggtgctttgcag

SEQ ID NO: 55725 - DNA, 20 bp, Artificial Sequence
  Description of Artificial Sequence: Synthetic oligonucleotide
  Target: SCN10A; (-) strand; PAM type: YTN; PAM sequence: TTG
gttataataacaggtgcttt

SEQ ID NO: 55726 - DNA, 20 bp, Artificial Sequence
  Description of Artificial Sequence: Synthetic oligonucleotide
  Target: SCN10A; (-) strand; PAM type: YTN; PAM sequence: TTT
ggttataataacaggtgctt

SEQ ID NO: 55727 - DNA, 20 bp, Artificial Sequence
  Description of Artificial Sequence: Synthetic oligonucleotide
  Target: SCN10A; (-) strand; PAM type: YTN; PAM sequence: CTT
tggttataataacaggtgct

SEQ ID NO: 55728 - DNA, 20 bp, Artificial Sequence
  Description of Artificial Sequence: Synthetic oligonucleotide
  Target: SCN10A; (-) strand; PAM type: YTN; PAM sequence: CTA
acatacctttggttataata

SEQ ID NO: 55729 - DNA, 20 bp, Artificial Sequence
  Description of Artificial Sequence: Synthetic oligonucleotide
  Target: SCN10A; (-) strand; PAM type: YTN; PAM sequence: TTG
aacctaacatacctttggtt

SEQ ID NO: 55730 - DNA, 20 bp, Artificial Sequence
  Description of Artificial Sequence: Synthetic oligonucleotide
  Target: SCN10A; (-) strand; PAM type: YTN; PAM sequence: CTT
gaacctaacatacctttggt

SEQ ID NO: 55731 - DNA, 20 bp, Artificial Sequence
  Description of Artificial Sequence: Synthetic oligonucleotide
  Target: SCN10A; (-) strand; PAM type: YTN; PAM sequence: CTC
cagcttgaacctaacatacc

SEQ ID NO: 55732 - DNA, 20 bp, Artificial Sequence
  Description of Artificial Sequence: Synthetic oligonucleotide
  Target: SCN10A; (-) strand; PAM type: YTN; PAM sequence: TTC
cactccagcttgaacctaac

SEQ ID NO: 55733 - DNA, 20 bp, Artificial Sequence
  Description of Artificial Sequence: Synthetic oligonucleotide
  Target: SCN10A; (-) strand; PAM type: YTN; PAM sequence: CTT
ccactccagcttgaacctaa

SEQ ID NO: 55734 - DNA, 20 bp, Artificial Sequence
  Description of Artificial Sequence: Synthetic oligonucleotide
  Target: SCN10A; (-) strand; PAM type: YTN; PAM sequence: CTG
ggagggatgcttccactcca

SEQ ID NO: 55735 - DNA, 20 bp, Artificial Sequence
  Description of Artificial Sequence: Synthetic oligonucleotide
  Target: SCN10A; (-) strand; PAM type: YTN; PAM sequence: TTC
catatccacacatctgggag

SEQ ID NO: 55736 - DNA, 20 bp, Artificial Sequence
  Description of Artificial Sequence: Synthetic oligonucleotide
  Target: SCN10A; (-) strand; PAM type: YTN; PAM sequence: TTC
caaaaacattccatatccac

SEQ ID NO: 55737 - DNA, 20 bp, Artificial Sequence
  Description of Artificial Sequence: Synthetic oligonucleotide
  Target: SCN10A; (-) strand; PAM type: YTN; PAM sequence: TTT
ccaaaaacattccatatcca

SEQ ID NO: 55738 - DNA, 20 bp, Artificial Sequence
  Description of Artificial Sequence: Synthetic oligonucleotide
  Target: SCN10A; (-) strand; PAM type: YTN; PAM sequence: TTT
tccaaaaacattccatatcc

SEQ ID NO: 55739 - DNA, 20 bp, Artificial Sequence
  Description of Artificial Sequence: Synthetic oligonucleotide
  Target: SCN10A; (-) strand; PAM type: YTN; PAM sequence: CTG
ggagttttccaaaaacattc

SEQ ID NO: 55740 - DNA, 20 bp, Artificial Sequence
  Description of Artificial Sequence: Synthetic oligonucleotide
  Target: SCN10A; (-) strand; PAM type: YTN; PAM sequence: TTC
agaatctgggagttttccaa

SEQ ID NO: 55741 - DNA, 20 bp, Artificial Sequence
  Description of Artificial Sequence: Synthetic oligonucleotide
  Target: SCN10A; (-) strand; PAM type: YTN; PAM sequence: TTT
cagaatctgggagttttcca

SEQ ID NO: 55742 - DNA, 20 bp, Artificial Sequence
  Description of Artificial Sequence: Synthetic oligonucleotide
  Target: SCN10A; (-) strand; PAM type: YTN; PAM sequence: CTA
tagtttcagaatctgggagt

SEQ ID NO: 55743 - DNA, 20 bp, Artificial Sequence
  Description of Artificial Sequence: Synthetic oligonucleotide
  Target: SCN10A; (-) strand; PAM type: YTN; PAM sequence: TTA
gtgggtgaaacccctatagt

SEQ ID NO: 55744 - DNA, 20 bp, Artificial Sequence
  Description of Artificial Sequence: Synthetic oligonucleotide
  Target: SCN10A; (-) strand; PAM type: YTN; PAM sequence: CTA
ggttagtgggtgaaacccct

SEQ ID NO: 55745 - DNA, 20 bp, Artificial Sequence
  Description of Artificial Sequence: Synthetic oligonucleotide
  Target: SCN10A; (-) strand; PAM type: YTN; PAM sequence: TTC
cctaggttagtgggtgaaac

SEQ ID NO: 55746 - DNA, 20 bp, Artificial Sequence
  Description of Artificial Sequence: Synthetic oligonucleotide
  Target: SCN10A; (-) strand; PAM type: YTN; PAM sequence: TTT
ccctaggttagtgggtgaaa

SEQ ID NO: 55747 - DNA, 20 bp, Artificial Sequence
  Description of Artificial Sequence: Synthetic oligonucleotide
  Target: SCN10A; (-) strand; PAM type: YTN; PAM sequence: CTA
tttccctaggttagtgggtg

SEQ ID NO: 55748 - DNA, 20 bp, Artificial Sequence
  Description of Artificial Sequence: Synthetic oligonucleotide
  Target: SCN10A; (-) strand; PAM type: YTN; PAM sequence: TTC
tatttccctaggttagtggg

SEQ ID NO: 55749 - DNA, 20 bp, Artificial Sequence
  Description of Artificial Sequence: Synthetic oligonucleotide
  Target: SCN10A; (-) strand; PAM type: YTN; PAM sequence: TTA
ttctatttccctaggttagt

SEQ ID NO: 55750 - DNA, 20 bp, Artificial Sequence
  Description of Artificial Sequence: Synthetic oligonucleotide
  Target: SCN10A; (-) strand; PAM type: YTN; PAM sequence: CTG
aagttattctatttccctag

SEQ ID NO: 55751 - DNA, 20 bp, Artificial Sequence
  Description of Artificial Sequence: Synthetic oligonucleotide
  Target: SCN10A; (-) strand; PAM type: YTN; PAM sequence: TTC
ctgaagttattctatttccc

SEQ ID NO: 55752 - DNA, 20 bp, Artificial Sequence
  Description of Artificial Sequence: Synthetic oligonucleotide
  Target: SCN10A; (-) strand; PAM type: YTN; PAM sequence: TTA
gtattcctgaagttattcta

SEQ ID NO: 55753 - DNA, 20 bp, Artificial Sequence
  Description of Artificial Sequence: Synthetic oligonucleotide
  Target: SCN10A; (-) strand; PAM type: YTN; PAM sequence: CTT
agtattcctgaagttattct

SEQ ID NO: 55754 - DNA, 20 bp, Artificial Sequence
  Description of Artificial Sequence: Synthetic oligonucleotide
  Target: SCN10A; (-) strand; PAM type: YTN; PAM sequence: CTC
aaagtaaccttagtattcct

SEQ ID NO: 55755 - DNA, 20 bp, Artificial Sequence
  Description of Artificial Sequence: Synthetic oligonucleotide
  Target: SCN10A; (-) strand; PAM type: YTN; PAM sequence: TTC
atatgcctcaaagtaacctt

SEQ ID NO: 55756 - DNA, 20 bp, Artificial Sequence
  Description of Artificial Sequence: Synthetic oligonucleotide
  Target: SCN10A; (-) strand; PAM type: YTN; PAM sequence: CTT
catatgcctcaaagtaacct

SEQ ID NO: 55757 - DNA, 20 bp, Artificial Sequence
  Description of Artificial Sequence: Synthetic oligonucleotide
  Target: SCN10A; (-) strand; PAM type: YTN; PAM sequence: TTA
tcatgcttcatatgcctcaa

SEQ ID NO: 55758 - DNA, 20 bp, Artificial Sequence
  Description of Artificial Sequence: Synthetic oligonucleotide
  Target: SCN10A; (-) strand; PAM type: YTN; PAM sequence: TTA
agttatcatgcttcatatgc

SEQ ID NO: 55759 - DNA, 20 bp, Artificial Sequence
  Description of Artificial Sequence: Synthetic oligonucleotide
  Target: SCN10A; (-) strand; PAM type: YTN; PAM sequence: TTT
aagttatcatgcttcatatg

SEQ ID NO: 55760 - DNA, 20 bp, Artificial Sequence
  Description of Artificial Sequence: Synthetic oligonucleotide
  Target: SCN10A; (-) strand; PAM type: YTN; PAM sequence: CTG
tttaagttatcatgcttcat

SEQ ID NO: 55761 - DNA, 20 bp, Artificial Sequence
  Description of Artificial Sequence: Synthetic oligonucleotide
  Target: SCN10A; (-) strand; PAM type: YTN; PAM sequence: CTC
ataaatgaagctgtttaagt

SEQ ID NO: 55762 - DNA, 20 bp, Artificial Sequence
  Description of Artificial Sequence: Synthetic oligonucleotide
  Target: SCN10A; (-) strand; PAM type: YTN; PAM sequence: TTA
gaaaataactcataaatgaa

SEQ ID NO: 55763 - DNA, 20 bp, Artificial Sequence
  Description of Artificial Sequence: Synthetic oligonucleotide
  Target: SCN10A; (-) strand; PAM type: YTN; PAM sequence: TTT
agaaaataactcataaatga

SEQ ID NO: 55764 - DNA, 20 bp, Artificial Sequence
  Description of Artificial Sequence: Synthetic oligonucleotide
  Target: SCN10A; (-) strand; PAM type: YTN; PAM sequence: CTG
gagtatatttagaaaataac

SEQ ID NO: 55765 - DNA, 20 bp, Artificial Sequence
  Description of Artificial Sequence: Synthetic oligonucleotide
  Target: SCN10A; (-) strand; PAM type: YTN; PAM sequence: CTC
tggagtatatttagaaaata

SEQ ID NO: 55766 - DNA, 20 bp, Artificial Sequence
  Description of Artificial Sequence: Synthetic oligonucleotide
  Target: SCN10A; (-) strand; PAM type: YTN; PAM sequence: CTA
agaacaaatggctctggagt

SEQ ID NO: 55767 - DNA, 20 bp, Artificial Sequence
  Description of Artificial Sequence: Synthetic oligonucleotide
  Target: SCN10A; (-) strand; PAM type: YTN; PAM sequence: CTG
agacagaactaagaacaaat

SEQ ID NO: 55768 - DNA, 20 bp, Artificial Sequence
  Description of Artificial Sequence: Synthetic oligonucleotide
  Target: SCN10A; (-) strand; PAM type: YTN; PAM sequence: CTA
tgaaagagagacaggagcaa

SEQ ID NO: 55769 - DNA, 20 bp, Artificial Sequence
  Description of Artificial Sequence: Synthetic oligonucleotide
  Target: SCN10A; (-) strand; PAM type: YTN; PAM sequence: CTG
ctatgaaagagagacaggag

SEQ ID NO: 55770 - DNA, 20 bp, Artificial Sequence
  Description of Artificial Sequence: Synthetic oligonucleotide
  Target: SCN10A; (-) strand; PAM type: YTN; PAM sequence: TTG
agaaggcctgctatgaaaga

SEQ ID NO: 55771 - DNA, 20 bp, Artificial Sequence
  Description of Artificial Sequence: Synthetic oligonucleotide
  Target: SCN10A; (-) strand; PAM type: YTN; PAM sequence: TTT
gagaaggcctgctatgaaag

SEQ ID NO: 55772 - DNA, 20 bp, Artificial Sequence
  Description of Artificial Sequence: Synthetic oligonucleotide
  Target: SCN10A; (-) strand; PAM type: YTN; PAM sequence: TTT
tgagaaggcctgctatgaaa

SEQ ID NO: 55773 - DNA, 20 bp, Artificial Sequence
  Description of Artificial Sequence: Synthetic oligonucleotide
  Target: SCN10A; (-) strand; PAM type: YTN; PAM sequence: CTT
ttgagaaggcctgctatgaa

SEQ ID NO: 55774 - DNA, 20 bp, Artificial Sequence
  Description of Artificial Sequence: Synthetic oligonucleotide
  Target: SCN10A; (-) strand; PAM type: YTN; PAM sequence: TTA
gagaaggtatgcttttgaga

SEQ ID NO: 55775 - DNA, 20 bp, Artificial Sequence
  Description of Artificial Sequence: Synthetic oligonucleotide
  Target: SCN10A; (-) strand; PAM type: YTN; PAM sequence: CTT
agagaaggtatgcttttgag

SEQ ID NO: 55776 - DNA, 20 bp, Artificial Sequence
  Description of Artificial Sequence: Synthetic oligonucleotide
  Target: SCN10A; (-) strand; PAM type: YTN; PAM sequence: CTA
gatgcacacacaaatgtatg

SEQ ID NO: 55777 - DNA, 20 bp, Artificial Sequence
  Description of Artificial Sequence: Synthetic oligonucleotide
  Target: SCN10A; (-) strand; PAM type: YTN; PAM sequence: CTG
ctagatgcacacacaaatgt

SEQ ID NO: 55778 - DNA, 20 bp, Artificial Sequence
  Description of Artificial Sequence: Synthetic oligonucleotide
  Target: SCN10A; (-) strand; PAM type: YTN; PAM sequence: CTC
acctgctagatgcacacaca

SEQ ID NO: 55779 - DNA, 20 bp, Artificial Sequence
  Description of Artificial Sequence: Synthetic oligonucleotide
  Target: SCN10A; (-) strand; PAM type: YTN; PAM sequence: CTC
actcacctgctagatgcaca

SEQ ID NO: 55780 - DNA, 20 bp, Artificial Sequence
  Description of Artificial Sequence: Synthetic oligonucleotide
  Target: SCN10A; (-) strand; PAM type: YTN; PAM sequence: CTC
gcccccacccccccccaaca

SEQ ID NO: 55781 - DNA, 20 bp, Artificial Sequence
  Description of Artificial Sequence: Synthetic oligonucleotide
  Target: SCN10A; (-) strand; PAM type: YTN; PAM sequence: CTC
ctcgcccccaccccccccca

SEQ ID NO: 55782 - DNA, 20 bp, Artificial Sequence
  Description of Artificial Sequence: Synthetic oligonucleotide
  Target: SCN10A; (-) strand; PAM type: YTN; PAM sequence: CTG
ggaagatgagtctcctcgcc

SEQ ID NO: 55783 - DNA, 20 bp, Artificial Sequence
  Description of Artificial Sequence: Synthetic oligonucleotide
  Target: SCN10A; (-) strand; PAM type: YTN; PAM sequence: CTA
aggtggcctgggaagatgag

SEQ ID NO: 55784 - DNA, 20 bp, Artificial Sequence
  Description of Artificial Sequence: Synthetic oligonucleotide
  Target: SCN10A; (-) strand; PAM type: YTN; PAM sequence: CTG
agtcccagccccagaaagtc

SEQ ID NO: 55785 - DNA, 20 bp, Artificial Sequence
  Description of Artificial Sequence: Synthetic oligonucleotide
  Target: SCN10A; (-) strand; PAM type: YTN; PAM sequence: TTA
aatgcctgagtcccagcccc

SEQ ID NO: 55786 - DNA, 20 bp, Artificial Sequence
  Description of Artificial Sequence: Synthetic oligonucleotide
  Target: SCN10A; (-) strand; PAM type: YTN; PAM sequence: TTT
aaatgcctgagtcccagccc

SEQ ID NO: 55787 - DNA, 20 bp, Artificial Sequence
  Description of Artificial Sequence: Synthetic oligonucleotide
  Target: SCN10A; (-) strand; PAM type: YTN; PAM sequence: TTT
taaatgcctgagtcccagcc

SEQ ID NO: 55788 - DNA, 20 bp, Artificial Sequence
  Description of Artificial Sequence: Synthetic oligonucleotide
  Target: SCN10A; (-) strand; PAM type: YTN; PAM sequence: TTT
ttaaatgcctgagtcccagc

SEQ ID NO: 55789 - DNA, 20 bp, Artificial Sequence
  Description of Artificial Sequence: Synthetic oligonucleotide
  Target: SCN10A; (-) strand; PAM type: YTN; PAM sequence: TTT
tttaaatgcctgagtcccag

SEQ ID NO: 55790 - DNA, 20 bp, Artificial Sequence
  Description of Artificial Sequence: Synthetic oligonucleotide
  Target: SCN10A; (-) strand; PAM type: YTN; PAM sequence: TTG
gggagattttttaaatgcct

SEQ ID NO: 55791 - DNA, 20 bp, Artificial Sequence
  Description of Artificial Sequence: Synthetic oligonucleotide
  Target: SCN10A; (-) strand; PAM type: YTN; PAM sequence: TTT
ggggagattttttaaatgcc

SEQ ID NO: 55792 - DNA, 20 bp, Artificial Sequence
  Description of Artificial Sequence: Synthetic oligonucleotide
  Target: SCN10A; (-) strand; PAM type: YTN; PAM sequence: TTT
tggggagattttttaaatgc

SEQ ID NO: 55793 - DNA, 20 bp, Artificial Sequence
  Description of Artificial Sequence: Synthetic oligonucleotide
  Target: SCN10A; (-) strand; PAM type: YTN; PAM sequence: TTT
ttggggagattttttaaatg

SEQ ID NO: 55794 - DNA, 20 bp, Artificial Sequence
  Description of Artificial Sequence: Synthetic oligonucleotide
  Target: SCN10A; (-) strand; PAM type: YTN; PAM sequence: TTG
caatttttggggagattttt

SEQ ID NO: 55795 - DNA, 20 bp, Artificial Sequence
  Description of Artificial Sequence: Synthetic oligonucleotide
  Target: SCN10A; (-) strand; PAM type: YTN; PAM sequence: CTG
catattgcaatttttgggga

SEQ ID NO: 55796 - DNA, 20 bp, Artificial Sequence
  Description of Artificial Sequence: Synthetic oligonucleotide
  Target: SCN10A; (-) strand; PAM type: YTN; PAM sequence: TTG
gctgcatattgcaatttttg

SEQ ID NO: 55797 - DNA, 20 bp, Artificial Sequence
  Description of Artificial Sequence: Synthetic oligonucleotide
  Target: SCN10A; (-) strand; PAM type: YTN; PAM sequence: TTT
ggctgcatattgcaattttt

SEQ ID NO: 55798 - DNA, 20 bp, Artificial Sequence
  Description of Artificial Sequence: Synthetic oligonucleotide
  Target: SCN10A; (-) strand; PAM type: YTN; PAM sequence: CTT
tggctgcatattgcaatttt

SEQ ID NO: 55799 - DNA, 20 bp, Artificial Sequence
  Description of Artificial Sequence: Synthetic oligonucleotide
  Target: SCN10A; (-) strand; PAM type: YTN; PAM sequence: CTC
aactttggctgcatattgca

SEQ ID NO: 55800 - DNA, 20 bp, Artificial Sequence
  Description of Artificial Sequence: Synthetic oligonucleotide
  Target: SCN10A; (-) strand; PAM type: YTN; PAM sequence: TTC
tcaactttggctgcatattg

SEQ ID NO: 55801 - DNA, 20 bp, Artificial Sequence
  Description of Artificial Sequence: Synthetic oligonucleotide
  Target: SCN10A; (-) strand; PAM type: YTN; PAM sequence: TTA
gtggttctcaactttggctg

SEQ ID NO: 55802 - DNA, 20 bp, Artificial Sequence
  Description of Artificial Sequence: Synthetic oligonucleotide
  Target: SCN10A; (-) strand; PAM type: YTN; PAM sequence: TTC
aaagagatacagattagtgg

SEQ ID NO: 55803 - DNA, 20 bp, Artificial Sequence
  Description of Artificial Sequence: Synthetic oligonucleotide
  Target: SCN10A; (-) strand; PAM type: YTN; PAM sequence: TTT
caaagagatacagattagtg

SEQ ID NO: 55804 - DNA, 20 bp, Artificial Sequence
  Description of Artificial Sequence: Synthetic oligonucleotide
  Target: SCN10A; (-) strand; PAM type: YTN; PAM sequence: TTC
agtttcaaagagatacagat

SEQ ID NO: 55805 - DNA, 20 bp, Artificial Sequence
  Description of Artificial Sequence: Synthetic oligonucleotide
  Target: SCN10A; (-) strand; PAM type: YTN; PAM sequence: TTT
cagtttcaaagagatacaga

SEQ ID NO: 55806 - DNA, 20 bp, Artificial Sequence
  Description of Artificial Sequence: Synthetic oligonucleotide
  Target: SCN10A; (-) strand; PAM type: YTN; PAM sequence: TTT
tcagtttcaaagagatacag

SEQ ID NO: 55807 - DNA, 20 bp, Artificial Sequence
  Description of Artificial Sequence: Synthetic oligonucleotide
  Target: SCN10A; (-) strand; PAM type: YTN; PAM sequence: TTC
ataaacatacatgattttca

SEQ ID NO: 55808 - DNA, 20 bp, Artificial Sequence
  Description of Artificial Sequence: Synthetic oligonucleotide
  Target: SCN10A; (-) strand; PAM type: YTN; PAM sequence: TTT
cataaacatacatgattttc

SEQ ID NO: 55809 - DNA, 20 bp, Artificial Sequence
  Description of Artificial Sequence: Synthetic oligonucleotide
  Target: SCN10A; (-) strand; PAM type: YTN; PAM sequence: TTG
tttcataaacatacatgatt

SEQ ID NO: 55810 - DNA, 20 bp, Artificial Sequence
  Description of Artificial Sequence: Synthetic oligonucleotide
  Target: SCN10A; (-) strand; PAM type: YTN; PAM sequence: TTT
gtttcataaacatacatgat

SEQ ID NO: 55811 - DNA, 20 bp, Artificial Sequence
  Description of Artificial Sequence: Synthetic oligonucleotide
  Target: SCN10A; (-) strand; PAM type: YTN; PAM sequence: CTG
tgagatttgtttcataaaca

SEQ ID NO: 55812 - DNA, 20 bp, Artificial Sequence
  Description of Artificial Sequence: Synthetic oligonucleotide
  Target: SCN10A; (-) strand; PAM type: YTN; PAM sequence: TTC
tgtgagatttgtttcataaa

SEQ ID NO: 55813 - DNA, 20 bp, Artificial Sequence
  Description of Artificial Sequence: Synthetic oligonucleotide
  Target: SCN10A; (-) strand; PAM type: YTN; PAM sequence: CTT
ctgtgagatttgtttcataa

SEQ ID NO: 55814 - DNA, 20 bp, Artificial Sequence
  Description of Artificial Sequence: Synthetic oligonucleotide
  Target: SCN10A; (-) strand; PAM type: YTN; PAM sequence: CTC
cttctgtgagatttgtttca

SEQ ID NO: 55815 - DNA, 20 bp, Artificial Sequence
  Description of Artificial Sequence: Synthetic oligonucleotide
  Target: SCN10A; (-) strand; PAM type: YTN; PAM sequence: CTC
tccttctgtgagatttgttt

SEQ ID NO: 55816 - DNA, 20 bp, Artificial Sequence
  Description of Artificial Sequence: Synthetic oligonucleotide
  Target: SCN10A; (-) strand; PAM type: YTN; PAM sequence: TTG
taataaccaggtctctcctt

SEQ ID NO: 55817 - DNA, 20 bp, Artificial Sequence
  Description of Artificial Sequence: Synthetic oligonucleotide
  Target: SCN10A; (-) strand; PAM type: YTN; PAM sequence: TTT
gtaataaccaggtctctcct

SEQ ID NO: 55818 - DNA, 20 bp, Artificial Sequence
  Description of Artificial Sequence: Synthetic oligonucleotide
  Target: SCN10A; (-) strand; PAM type: YTN; PAM sequence: CTT
tgtaataaccaggtctctcc

SEQ ID NO: 55819 - DNA, 20 bp, Artificial Sequence
  Description of Artificial Sequence: Synthetic oligonucleotide
  Target: SCN10A; (-) strand; PAM type: YTN; PAM sequence: CTA
tatgtctttgtaataaccag

SEQ ID NO: 55820 - DNA, 20 bp, Artificial Sequence
  Description of Artificial Sequence: Synthetic oligonucleotide
  Target: SCN10A; (-) strand; PAM type: YTN; PAM sequence: TTG
tctatatgtctttgtaataa

SEQ ID NO: 55821 - DNA, 20 bp, Artificial Sequence
  Description of Artificial Sequence: Synthetic oligonucleotide
  Target: SCN10A; (-) strand; PAM type: YTN; PAM sequence: CTC
attgtctatatgtctttgta

SEQ ID NO: 55822 - DNA, 20 bp, Artificial Sequence
  Description of Artificial Sequence: Synthetic oligonucleotide
  Target: SCN10A; (-) strand; PAM type: YTN; PAM sequence: CTG
aatctcattgtctatatgtc

SEQ ID NO: 55823 - DNA, 20 bp, Artificial Sequence
  Description of Artificial Sequence: Synthetic oligonucleotide
  Target: SCN10A; (-) strand; PAM type: YTN; PAM sequence: CTC
atgtgggtaatgctgaatct

SEQ ID NO: 55824 - DNA, 20 bp, Artificial Sequence
  Description of Artificial Sequence: Synthetic oligonucleotide
  Target: SCN10A; (-) strand; PAM type: YTN; PAM sequence: CTG
ccatgcctcatgtgggtaat

SEQ ID NO: 55825 - DNA, 20 bp, Artificial Sequence
  Description of Artificial Sequence: Synthetic oligonucleotide
  Target: SCN10A; (-) strand; PAM type: YTN; PAM sequence: TTA
tcctgccatgcctcatgtgg

SEQ ID NO: 55826 - DNA, 20 bp, Artificial Sequence
  Description of Artificial Sequence: Synthetic oligonucleotide
  Target: SCN10A; (-) strand; PAM type: YTN; PAM sequence: TTT
atcctgccatgcctcatgtg

SEQ ID NO: 55827 - DNA, 20 bp, Artificial Sequence
  Description of Artificial Sequence: Synthetic oligonucleotide
  Target: SCN10A; (-) strand; PAM type: YTN; PAM sequence: TTA
tttatcctgccatgcctcat

SEQ ID NO: 55828 - DNA, 20 bp, Artificial Sequence
  Description of Artificial Sequence: Synthetic oligonucleotide
  Target: SCN10A; (-) strand; PAM type: YTN; PAM sequence: TTT
atttatcctgccatgcctca

SEQ ID NO: 55829 - DNA, 20 bp, Artificial Sequence
  Description of Artificial Sequence: Synthetic oligonucleotide
  Target: SCN10A; (-) strand; PAM type: YTN; PAM sequence: TTT
tatttatcctgccatgcctc

SEQ ID NO: 55830 - DNA, 20 bp, Artificial Sequence
  Description of Artificial Sequence: Synthetic oligonucleotide
  Target: SCN10A; (-) strand; PAM type: YTN; PAM sequence: CTT
ttatttatcctgccatgcct

SEQ ID NO: 55831 - DNA, 20 bp, Artificial Sequence
  Description of Artificial Sequence: Synthetic oligonucleotide
  Target: SCN10A; (-) strand; PAM type: YTN; PAM sequence: TTG
tcttttatttatcctgccat

SEQ ID NO: 55832 - DNA, 20 bp, Artificial Sequence
  Description of Artificial Sequence: Synthetic oligonucleotide
  Target: SCN10A; (-) strand; PAM type: YTN; PAM sequence: TTT
gtcttttatttatcctgcca

SEQ ID NO: 55833 - DNA, 20 bp, Artificial Sequence
  Description of Artificial Sequence: Synthetic oligonucleotide
  Target: SCN10A; (-) strand; PAM type: YTN; PAM sequence: CTT
tgtcttttatttatcctgcc

SEQ ID NO: 55834 - DNA, 20 bp, Artificial Sequence
  Description of Artificial Sequence: Synthetic oligonucleotide
  Target: SCN10A; (-) strand; PAM type: YTN; PAM sequence: TTG
gcagtctttgtcttttattt

SEQ ID NO: 55835 - DNA, 20 bp, Artificial Sequence
  Description of Artificial Sequence: Synthetic oligonucleotide
  Target: SCN10A; (-) strand; PAM type: YTN; PAM sequence: CTT
ggcagtctttgtcttttatt

SEQ ID NO: 55836 - DNA, 20 bp, Artificial Sequence
  Description of Artificial Sequence: Synthetic oligonucleotide
  Target: SCN10A; (-) strand; PAM type: YTN; PAM sequence: TTC
acttggcagtctttgtcttt

SEQ ID NO: 55837 - DNA, 20 bp, Artificial Sequence
  Description of Artificial Sequence: Synthetic oligonucleotide
  Target: SCN10A; (-) strand; PAM type: YTN; PAM sequence: CTT
cacttggcagtctttgtctt

SEQ ID NO: 55838 - DNA, 20 bp, Artificial Sequence
  Description of Artificial Sequence: Synthetic oligonucleotide
  Target: SCN10A; (-) strand; PAM type: YTN; PAM sequence: TTC
cttcacttggcagtctttgt

SEQ ID NO: 55839 - DNA, 20 bp, Artificial Sequence
  Description of Artificial Sequence: Synthetic oligonucleotide
  Target: SCN10A; (-) strand; PAM type: YTN; PAM sequence: CTT
ccttcacttggcagtctttg

SEQ ID NO: 55840 - DNA, 20 bp, Artificial Sequence
  Description of Artificial Sequence: Synthetic oligonucleotide
  Target: SCN10A; (-) strand; PAM type: YTN; PAM sequence: TTC
ttccttcacttggcagtctt

SEQ ID NO: 55841 - DNA, 20 bp, Artificial Sequence
  Description of Artificial Sequence: Synthetic oligonucleotide
  Target: SCN10A; (-) strand; PAM type: YTN; PAM sequence: TTT
cttccttcacttggcagtct

SEQ ID NO: 55842 - DNA, 20 bp, Artificial Sequence
  Description of Artificial Sequence: Synthetic oligonucleotide
  Target: SCN10A; (-) strand; PAM type: YTN; PAM sequence: TTT
tcttccttcacttggcagtc

SEQ ID NO: 55843 - DNA, 20 bp, Artificial Sequence
  Description of Artificial Sequence: Synthetic oligonucleotide
  Target: SCN10A; (-) strand; PAM type: YTN; PAM sequence: CTT
ttcttccttcacttggcagt

SEQ ID NO: 55844 - DNA, 20 bp, Artificial Sequence
  Description of Artificial Sequence: Synthetic oligonucleotide
  Target: SCN10A; (-) strand; PAM type: YTN; PAM sequence: TTC
ttttcttccttcacttggca

SEQ ID NO: 55845 - DNA, 20 bp, Artificial Sequence
  Description of Artificial Sequence: Synthetic oligonucleotide
  Target: SCN10A; (-) strand; PAM type: YTN; PAM sequence: TTT
cttttcttccttcacttggc

SEQ ID NO: 55846 - DNA, 20 bp, Artificial Sequence
  Description of Artificial Sequence: Synthetic oligonucleotide
  Target: SCN10A; (-) strand; PAM type: YTN; PAM sequence: CTT
tcttttcttccttcacttgg

SEQ ID NO: 55847 - DNA, 20 bp, Artificial Sequence
  Description of Artificial Sequence: Synthetic oligonucleotide
  Target: SCN10A; (-) strand; PAM type: YTN; PAM sequence: TTG
ctttcttttcttccttcact

SEQ ID NO: 55848 - DNA, 20 bp, Artificial Sequence
  Description of Artificial Sequence: Synthetic oligonucleotide
  Target: SCN10A; (-) strand; PAM type: YTN; PAM sequence: TTT
gctttcttttcttccttcac

SEQ ID NO: 55849 - DNA, 20 bp, Artificial Sequence
  Description of Artificial Sequence: Synthetic oligonucleotide
  Target: SCN10A; (-) strand; PAM type: YTN; PAM sequence: TTT
tgctttcttttcttccttca

SEQ ID NO: 55850 - DNA, 20 bp, Artificial Sequence
  Description of Artificial Sequence: Synthetic oligonucleotide
  Target: SCN10A; (-) strand; PAM type: YTN; PAM sequence: TTT
ttgctttcttttcttccttc

SEQ ID NO: 55851 - DNA, 20 bp, Artificial Sequence
  Description of Artificial Sequence: Synthetic oligonucleotide
  Target: SCN10A; (-) strand; PAM type: YTN; PAM sequence: CTT
tttgctttcttttcttcctt

SEQ ID NO: 55852 - DNA, 20 bp, Artificial Sequence
  Description of Artificial Sequence: Synthetic oligonucleotide
  Target: SCN10A; (-) strand; PAM type: YTN; PAM sequence: CTC
tttttgctttcttttcttcc

SEQ ID NO: 55853 - DNA, 20 bp, Artificial Sequence
  Description of Artificial Sequence: Synthetic oligonucleotide
  Target: SCN10A; (-) strand; PAM type: YTN; PAM sequence: TTG
taccatctctttttgctttc

SEQ ID NO: 55854 - DNA, 20 bp, Artificial Sequence
  Description of Artificial Sequence: Synthetic oligonucleotide
  Target: SCN10A; (-) strand; PAM type: YTN; PAM sequence: TTA
ttgtaccatctctttttgct

SEQ ID NO: 55855 - DNA, 20 bp, Artificial Sequence
  Description of Artificial Sequence: Synthetic oligonucleotide
  Target: SCN10A; (-) strand; PAM type: YTN; PAM sequence: CTA
tcattattgtaccatctctt

SEQ ID NO: 55856 - DNA, 20 bp, Artificial Sequence
  Description of Artificial Sequence: Synthetic oligonucleotide
  Target: SCN10A; (-) strand; PAM type: YTN; PAM sequence: TTG
ctatcattattgtaccatct

SEQ ID NO: 55857 - DNA, 20 bp, Artificial Sequence
  Description of Artificial Sequence: Synthetic oligonucleotide
  Target: SCN10A; (-) strand; PAM type: YTN; PAM sequence: TTT
gctatcattattgtaccatc

SEQ ID NO: 55858 - DNA, 20 bp, Artificial Sequence
  Description of Artificial Sequence: Synthetic oligonucleotide
  Target: SCN10A; (-) strand; PAM type: YTN; PAM sequence: TTG
agtgagtagatttgctatca

SEQ ID NO: 55859 - DNA, 20 bp, Artificial Sequence
  Description of Artificial Sequence: Synthetic oligonucleotide
  Target: SCN10A; (-) strand; PAM type: YTN; PAM sequence: TTC
cagagaaaattgagtgagta

SEQ ID NO: 55860 - DNA, 20 bp, Artificial Sequence
  Description of Artificial Sequence: Synthetic oligonucleotide
  Target: SCN10A; (-) strand; PAM type: YTN; PAM sequence: CTT
ccagagaaaattgagtgagt

SEQ ID NO: 55861 - DNA, 20 bp, Artificial Sequence
  Description of Artificial Sequence: Synthetic oligonucleotide
  Target: SCN10A; (-) strand; PAM type: YTN; PAM sequence: CTG
accttccagagaaaattgag

SEQ ID NO: 55862 - DNA, 20 bp, Artificial Sequence
  Description of Artificial Sequence: Synthetic oligonucleotide
  Target: SCN10A; (-) strand; PAM type: YTN; PAM sequence: TTG
tgtgtgcatgacccgaactg

SEQ ID NO: 55863 - DNA, 20 bp, Artificial Sequence
  Description of Artificial Sequence: Synthetic oligonucleotide
  Target: SCN10A; (-) strand; PAM type: YTN; PAM sequence: TTA
attgtgtgtgcatgacccga

SEQ ID NO: 55864 - DNA, 20 bp, Artificial Sequence
  Description of Artificial Sequence: Synthetic oligonucleotide
  Target: SCN10A; (-) strand; PAM type: YTN; PAM sequence: TTG
gttaattgtgtgtgcatgac

SEQ ID NO: 55865 - DNA, 20 bp, Artificial Sequence
  Description of Artificial Sequence: Synthetic oligonucleotide
  Target: SCN10A; (-) strand; PAM type: YTN; PAM sequence: TTT
ggttaattgtgtgtgcatga

SEQ ID NO: 55866 - DNA, 20 bp, Artificial Sequence
  Description of Artificial Sequence: Synthetic oligonucleotide
  Target: SCN10A; (-) strand; PAM type: YTN; PAM sequence: TTT
tggttaattgtgtgtgcatg

SEQ ID NO: 55867 - DNA, 20 bp, Artificial Sequence
  Description of Artificial Sequence: Synthetic oligonucleotide
  Target: SCN10A; (-) strand; PAM type: YTN; PAM sequence: CTA
ttttggttaattgtgtgtgc

SEQ ID NO: 55868 - DNA, 20 bp, Artificial Sequence
  Description of Artificial Sequence: Synthetic oligonucleotide
  Target: SCN10A; (-) strand; PAM type: YTN; PAM sequence: TTA
cggtcactattttggttaat

SEQ ID NO: 55869 - DNA, 20 bp, Artificial Sequence
  Description of Artificial Sequence: Synthetic oligonucleotide
  Target: SCN10A; (-) strand; PAM type: YTN; PAM sequence: TTA
ttacggtcactattttggtt

SEQ ID NO: 55870 - DNA, 20 bp, Artificial Sequence
  Description of Artificial Sequence: Synthetic oligonucleotide
  Target: SCN10A; (-) strand; PAM type: YTN; PAM sequence: TTT
attacggtcactattttggt

SEQ ID NO: 55871 - DNA, 20 bp, Artificial Sequence
  Description of Artificial Sequence: Synthetic oligonucleotide
  Target: SCN10A; (-) strand; PAM type: YTN; PAM sequence: TTA
tttattacggtcactatttt

SEQ ID NO: 55872 - DNA, 20 bp, Artificial Sequence
  Description of Artificial Sequence: Synthetic oligonucleotide
  Target: SCN10A; (-) strand; PAM type: YTN; PAM sequence: TTT
atttattacggtcactattt

SEQ ID NO: 55873 - DNA, 20 bp, Artificial Sequence
  Description of Artificial Sequence: Synthetic oligonucleotide
  Target: SCN10A; (-) strand; PAM type: YTN; PAM sequence: TTC
agtttatttattacggtcac

SEQ ID NO: 55874 - DNA, 20 bp, Artificial Sequence
  Description of Artificial Sequence: Synthetic oligonucleotide
  Target: SCN10A; (-) strand; PAM type: YTN; PAM sequence: TTC
aggtggttcagtttatttat

SEQ ID NO: 55875 - DNA, 20 bp, Artificial Sequence
  Description of Artificial Sequence: Synthetic oligonucleotide
  Target: SCN10A; (-) strand; PAM type: YTN; PAM sequence: TTT
caggtggttcagtttattta

SEQ ID NO: 55876 - DNA, 20 bp, Artificial Sequence
  Description of Artificial Sequence: Synthetic oligonucleotide
  Target: SCN10A; (-) strand; PAM type: YTN; PAM sequence: CTT
tcaggtggttcagtttattt

SEQ ID NO: 55877 - DNA, 20 bp, Artificial Sequence
  Description of Artificial Sequence: Synthetic oligonucleotide
  Target: SCN10A; (-) strand; PAM type: YTN; PAM sequence: TTA
acacaggcctttcaggtggt

SEQ ID NO: 55878 - DNA, 20 bp, Artificial Sequence
  Description of Artificial Sequence: Synthetic oligonucleotide
  Target: SCN10A; (-) strand; PAM type: YTN; PAM sequence: CTT
aacacaggcctttcaggtgg

SEQ ID NO: 55879 - DNA, 20 bp, Artificial Sequence
  Description of Artificial Sequence: Synthetic oligonucleotide
  Target: SCN10A; (-) strand; PAM type: YTN; PAM sequence: TTC
cttaacacaggcctttcagg

SEQ ID NO: 55880 - DNA, 20 bp, Artificial Sequence
  Description of Artificial Sequence: Synthetic oligonucleotide
  Target: SCN10A; (-) strand; PAM type: YTN; PAM sequence: TTT
ccttaacacaggcctttcag

SEQ ID NO: 55881 - DNA, 20 bp, Artificial Sequence
  Description of Artificial Sequence: Synthetic oligonucleotide
  Target: SCN10A; (-) strand; PAM type: YTN; PAM sequence: TTT
tccttaacacaggcctttca

SEQ ID NO: 55882 - DNA, 20 bp, Artificial Sequence
  Description of Artificial Sequence: Synthetic oligonucleotide
  Target: SCN10A; (-) strand; PAM type: YTN; PAM sequence: CTT
ttccttaacacaggcctttc

SEQ ID NO: 55883 - DNA, 20 bp, Artificial Sequence
  Description of Artificial Sequence: Synthetic oligonucleotide
  Target: SCN10A; (-) strand; PAM type: YTN; PAM sequence: CTC
agcttttccttaacacaggc

SEQ ID NO: 55884 - DNA, 20 bp, Artificial Sequence
  Description of Artificial Sequence: Synthetic oligonucleotide
  Target: SCN10A; (-) strand; PAM type: YTN; PAM sequence: TTG
gtgatctcagcttttcctta

SEQ ID NO: 55885 - DNA, 20 bp, Artificial Sequence
  Description of Artificial Sequence: Synthetic oligonucleotide
  Target: SCN10A; (-) strand; PAM type: YTN; PAM sequence: CTT
ggtgatctcagcttttcctt

SEQ ID NO: 55886 - DNA, 20 bp, Artificial Sequence
  Description of Artificial Sequence: Synthetic oligonucleotide
  Target: SCN10A; (-) strand; PAM type: YTN; PAM sequence: CTA
gatgacatcacagagacttg

SEQ ID NO: 55887 - DNA, 20 bp, Artificial Sequence
  Description of Artificial Sequence: Synthetic oligonucleotide
  Target: SCN10A; (-) strand; PAM type: YTN; PAM sequence: TTC
agcatcaaggtgatcctaga

SEQ ID NO: 55888 - DNA, 20 bp, Artificial Sequence
  Description of Artificial Sequence: Synthetic oligonucleotide
  Target: SCN10A; (-) strand; PAM type: YTN; PAM sequence: TTA
tgaatgtaatcattcagcat

SEQ ID NO: 55889 - DNA, 20 bp, Artificial Sequence
  Description of Artificial Sequence: Synthetic oligonucleotide
  Target: SCN10A; (-) strand; PAM type: YTN; PAM sequence: TTT
atgaatgtaatcattcagca

SEQ ID NO: 55890 - DNA, 20 bp, Artificial Sequence
  Description of Artificial Sequence: Synthetic oligonucleotide
  Target: SCN10A; (-) strand; PAM type: YTN; PAM sequence: CTA
agatttatgaatgtaatcat

SEQ ID NO: 55891 - DNA, 20 bp, Artificial Sequence
  Description of Artificial Sequence: Synthetic oligonucleotide
  Target: SCN10A; (-) strand; PAM type: YTN; PAM sequence: TTG
gctaagatttatgaatgtaa

SEQ ID NO: 55892 - DNA, 20 bp, Artificial Sequence
  Description of Artificial Sequence: Synthetic oligonucleotide
  Target: SCN10A; (-) strand; PAM type: YTN; PAM sequence: CTA
atattggctaagatttatga

SEQ ID NO: 55893 - DNA, 20 bp, Artificial Sequence
  Description of Artificial Sequence: Synthetic oligonucleotide
  Target: SCN10A; (-) strand; PAM type: YTN; PAM sequence: TTA
tgtgacaagatcataaagct

SEQ ID NO: 55894 - DNA, 20 bp, Artificial Sequence
  Description of Artificial Sequence: Synthetic oligonucleotide
  Target: SCN10A; (-) strand; PAM type: YTN; PAM sequence: TTA
ttatgtgacaagatcataaa

SEQ ID NO: 55895 - DNA, 20 bp, Artificial Sequence
  Description of Artificial Sequence: Synthetic oligonucleotide
  Target: SCN10A; (-) strand; PAM type: YTN; PAM sequence: TTA
gtggttattatgtgacaaga

SEQ ID NO: 55896 - DNA, 20 bp, Artificial Sequence
  Description of Artificial Sequence: Synthetic oligonucleotide
  Target: SCN10A; (-) strand; PAM type: YTN; PAM sequence: CTC
agtaaatgttagtggttatt

SEQ ID NO: 55897 - DNA, 20 bp, Artificial Sequence
  Description of Artificial Sequence: Synthetic oligonucleotide
  Target: SCN10A; (-) strand; PAM type: YTN; PAM sequence: TTA
ggcactcagtaaatgttagt

SEQ ID NO: 55898 - DNA, 20 bp, Artificial Sequence
  Description of Artificial Sequence: Synthetic oligonucleotide
  Target: SCN10A; (-) strand; PAM type: YTN; PAM sequence: CTT
aggcactcagtaaatgttag

SEQ ID NO: 55899 - DNA, 20 bp, Artificial Sequence
  Description of Artificial Sequence: Synthetic oligonucleotide
  Target: SCN10A; (-) strand; PAM type: YTN; PAM sequence: CTA
gcttaggcactcagtaaatg

SEQ ID NO: 55900 - DNA, 20 bp, Artificial Sequence
  Description of Artificial Sequence: Synthetic oligonucleotide
  Target: SCN10A; (-) strand; PAM type: YTN; PAM sequence: CTC
agcctagcttaggcactcag

SEQ ID NO: 55901 - DNA, 20 bp, Artificial Sequence
  Description of Artificial Sequence: Synthetic oligonucleotide
  Target: SCN10A; (-) strand; PAM type: YTN; PAM sequence: TTA
gaagtaacatggacaaagta

SEQ ID NO: 55902 - DNA, 20 bp, Artificial Sequence
  Description of Artificial Sequence: Synthetic oligonucleotide
  Target: SCN10A; (-) strand; PAM type: YTN; PAM sequence: TTG
tattagaagtaacatggaca

SEQ ID NO: 55903 - DNA, 20 bp, Artificial Sequence
  Description of Artificial Sequence: Synthetic oligonucleotide
  Target: SCN10A; (-) strand; PAM type: YTN; PAM sequence: CTG
tagatcagttgtattagaag

SEQ ID NO: 55904 - DNA, 20 bp, Artificial Sequence
  Description of Artificial Sequence: Synthetic oligonucleotide
  Target: SCN10A; (-) strand; PAM type: YTN; PAM sequence: TTA
tacccacctgtagatcagtt

SEQ ID NO: 55905 - DNA, 20 bp, Artificial Sequence
  Description of Artificial Sequence: Synthetic oligonucleotide
  Target: SCN10A; (-) strand; PAM type: YTN; PAM sequence: TTT
atacccacctgtagatcagt

SEQ ID NO: 55906 - DNA, 20 bp, Artificial Sequence
  Description of Artificial Sequence: Synthetic oligonucleotide
  Target: SCN10A; (-) strand; PAM type: YTN; PAM sequence: TTC
aaaatgtagatatttatacc

SEQ ID NO: 55907 - DNA, 20 bp, Artificial Sequence
  Description of Artificial Sequence: Synthetic oligonucleotide
  Target: SCN10A; (-) strand; PAM type: YTN; PAM sequence: CTT
caaaatgtagatatttatac

SEQ ID NO: 55908 - DNA, 20 bp, Artificial Sequence
  Description of Artificial Sequence: Synthetic oligonucleotide
  Target: SCN10A; (-) strand; PAM type: YTN; PAM sequence: CTC
agcttcaaaatgtagatatt

SEQ ID NO: 55909 - DNA, 20 bp, Artificial Sequence
  Description of Artificial Sequence: Synthetic oligonucleotide
  Target: SCN10A; (-) strand; PAM type: YTN; PAM sequence: TTC
tcagcttcaaaatgtagata

SEQ ID NO: 55910 - DNA, 20 bp, Artificial Sequence
  Description of Artificial Sequence: Synthetic oligonucleotide
  Target: SCN10A; (-) strand; PAM type: YTN; PAM sequence: TTT
ctcagcttcaaaatgtagat

SEQ ID NO: 55911 - DNA, 20 bp, Artificial Sequence
  Description of Artificial Sequence: Synthetic oligonucleotide
  Target: SCN10A; (-) strand; PAM type: YTN; PAM sequence: CTG
tttctcagcttcaaaatgta

SEQ ID NO: 55912 - DNA, 20 bp, Artificial Sequence
  Description of Artificial Sequence: Synthetic oligonucleotide
  Target: SCN10A; (-) strand; PAM type: YTN; PAM sequence: TTG
tcagcctgtttctcagcttc

SEQ ID NO: 55913 - DNA, 20 bp, Artificial Sequence
  Description of Artificial Sequence: Synthetic oligonucleotide
  Target: SCN10A; (-) strand; PAM type: YTN; PAM sequence: TTT
gtcagcctgtttctcagctt

SEQ ID NO: 55914 - DNA, 20 bp, Artificial Sequence
  Description of Artificial Sequence: Synthetic oligonucleotide
  Target: SCN10A; (-) strand; PAM type: YTN; PAM sequence: TTT
tgtcagcctgtttctcagct

SEQ ID NO: 55915 - DNA, 20 bp, Artificial Sequence
  Description of Artificial Sequence: Synthetic oligonucleotide
  Target: SCN10A; (-) strand; PAM type: YTN; PAM sequence: TTT
ttgtcagcctgtttctcagc

SEQ ID NO: 55916 - DNA, 20 bp, Artificial Sequence
  Description of Artificial Sequence: Synthetic oligonucleotide
  Target: SCN10A; (-) strand; PAM type: YTN; PAM sequence: TTT
tttgtcagcctgtttctcag

SEQ ID NO: 55917 - DNA, 20 bp, Artificial Sequence
  Description of Artificial Sequence: Synthetic oligonucleotide
  Target: SCN10A; (-) strand; PAM type: YTN; PAM sequence: TTA
ttttttgtcagcctgtttct

SEQ ID NO: 55918 - DNA, 20 bp, Artificial Sequence
  Description of Artificial Sequence: Synthetic oligonucleotide
  Target: SCN10A; (-) strand; PAM type: YTN; PAM sequence: TTT
attttttgtcagcctgtttc

SEQ ID NO: 55919 - DNA, 20 bp, Artificial Sequence
  Description of Artificial Sequence: Synthetic oligonucleotide
  Target: SCN10A; (-) strand; PAM type: YTN; PAM sequence: TTT
tattttttgtcagcctgttt

SEQ ID NO: 55920 - DNA, 20 bp, Artificial Sequence
  Description of Artificial Sequence: Synthetic oligonucleotide
  Target: SCN10A; (-) strand; PAM type: YTN; PAM sequence: CTT
ttattttttgtcagcctgtt

SEQ ID NO: 55921 - DNA, 20 bp, Artificial Sequence
  Description of Artificial Sequence: Synthetic oligonucleotide
  Target: SCN10A; (-) strand; PAM type: YTN; PAM sequence: TTA
acttttattttttgtcagcc

SEQ ID NO: 55922 - DNA, 20 bp, Artificial Sequence
  Description of Artificial Sequence: Synthetic oligonucleotide
  Target: SCN10A; (-) strand; PAM type: YTN; PAM sequence: TTT
aacttttattttttgtcagc

SEQ ID NO: 55923 - DNA, 20 bp, Artificial Sequence
  Description of Artificial Sequence: Synthetic oligonucleotide
  Target: SCN10A; (-) strand; PAM type: YTN; PAM sequence: TTA
tttaacttttattttttgtc

SEQ ID NO: 55924 - DNA, 20 bp, Artificial Sequence
  Description of Artificial Sequence: Synthetic oligonucleotide
  Target: SCN10A; (-) strand; PAM type: YTN; PAM sequence: CTG
agaaaagttatttaactttt

SEQ ID NO: 55925 - DNA, 20 bp, Artificial Sequence
  Description of Artificial Sequence: Synthetic oligonucleotide
  Target: SCN10A; (-) strand; PAM type: YTN; PAM sequence: CTG
catgacctgagaaaagttat

SEQ ID NO: 55926 - DNA, 20 bp, Artificial Sequence
  Description of Artificial Sequence: Synthetic oligonucleotide
  Target: SCN10A; (-) strand; PAM type: YTN; PAM sequence: CTA
gctgcatgacctgagaaaag

SEQ ID NO: 55927 - DNA, 20 bp, Artificial Sequence
  Description of Artificial Sequence: Synthetic oligonucleotide
  Target: SCN10A; (-) strand; PAM type: YTN; PAM sequence: TTG
actagctgcatgacctgaga

SEQ ID NO: 55928 - DNA, 20 bp, Artificial Sequence
  Description of Artificial Sequence: Synthetic oligonucleotide
  Target: SCN10A; (-) strand; PAM type: YTN; PAM sequence: CTG
cagcatggttgactagctgc

SEQ ID NO: 55929 - DNA, 20 bp, Artificial Sequence
  Description of Artificial Sequence: Synthetic oligonucleotide
  Target: SCN10A; (-) strand; PAM type: YTN; PAM sequence: CTC
tgcagcatggttgactagct

SEQ ID NO: 55930 - DNA, 20 bp, Artificial Sequence
  Description of Artificial Sequence: Synthetic oligonucleotide
  Target: SCN10A; (-) strand; PAM type: YTN; PAM sequence: TTC
acatctctgcagcatggttg

SEQ ID NO: 55931 - DNA, 20 bp, Artificial Sequence
  Description of Artificial Sequence: Synthetic oligonucleotide
  Target: SCN10A; (-) strand; PAM type: YTN; PAM sequence: TTA
tcaaacagataagagttcac

SEQ ID NO: 55932 - DNA, 20 bp, Artificial Sequence
  Description of Artificial Sequence: Synthetic oligonucleotide
  Target: SCN10A; (-) strand; PAM type: YTN; PAM sequence: TTG
ttatcaaacagataagagtt

SEQ ID NO: 55933 - DNA, 20 bp, Artificial Sequence
  Description of Artificial Sequence: Synthetic oligonucleotide
  Target: SCN10A; (-) strand; PAM type: YTN; PAM sequence: TTT
gttatcaaacagataagagt

SEQ ID NO: 55934 - DNA, 20 bp, Artificial Sequence
  Description of Artificial Sequence: Synthetic oligonucleotide
  Target: SCN10A; (-) strand; PAM type: YTN; PAM sequence: CTC
agagtttgttatcaaacaga

SEQ ID NO: 55935 - DNA, 20 bp, Artificial Sequence
  Description of Artificial Sequence: Synthetic oligonucleotide
  Target: SCN10A; (-) strand; PAM type: YTN; PAM sequence: TTG
ctcagagtttgttatcaaac

SEQ ID NO: 55936 - DNA, 20 bp, Artificial Sequence
  Description of Artificial Sequence: Synthetic oligonucleotide
  Target: SCN10A; (-) strand; PAM type: YTN; PAM sequence: CTT
gctcagagtttgttatcaaa

SEQ ID NO: 55937 - DNA, 20 bp, Artificial Sequence
  Description of Artificial Sequence: Synthetic oligonucleotide
  Target: SCN10A; (-) strand; PAM type: YTN; PAM sequence: CTA
tcttgctcagagtttgttat

SEQ ID NO: 55938 - DNA, 20 bp, Artificial Sequence
  Description of Artificial Sequence: Synthetic oligonucleotide
  Target: SCN10A; (-) strand; PAM type: YTN; PAM sequence: TTC
tatcttgctcagagtttgtt

SEQ ID NO: 55939 - DNA, 20 bp, Artificial Sequence
  Description of Artificial Sequence: Synthetic oligonucleotide
  Target: SCN10A; (-) strand; PAM type: YTN; PAM sequence: CTT
ctatcttgctcagagtttgt

SEQ ID NO: 55940 - DNA, 20 bp, Artificial Sequence
  Description of Artificial Sequence: Synthetic oligonucleotide
  Target: SCN10A; (-) strand; PAM type: YTN; PAM sequence: TTC
cttctatcttgctcagagtt

SEQ ID NO: 55941 - DNA, 20 bp, Artificial Sequence
  Description of Artificial Sequence: Synthetic oligonucleotide
  Target: SCN10A; (-) strand; PAM type: YTN; PAM sequence: TTT
ccttctatcttgctcagagt

SEQ ID NO: 55942 - DNA, 20 bp, Artificial Sequence
  Description of Artificial Sequence: Synthetic oligonucleotide
  Target: SCN10A; (-) strand; PAM type: YTN; PAM sequence: CTG
tttccttctatcttgctcag

SEQ ID NO: 55943 - DNA, 20 bp, Artificial Sequence
  Description of Artificial Sequence: Synthetic oligonucleotide
  Target: SCN10A; (-) strand; PAM type: YTN; PAM sequence: TTG
gaaaagggagtctgtttcct

SEQ ID NO: 55944 - DNA, 20 bp, Artificial Sequence
  Description of Artificial Sequence: Synthetic oligonucleotide
  Target: SCN10A; (-) strand; PAM type: YTN; PAM sequence: TTT
ggaaaagggagtctgtttcc

SEQ ID NO: 55945 - DNA, 20 bp, Artificial Sequence
  Description of Artificial Sequence: Synthetic oligonucleotide
  Target: SCN10A; (-) strand; PAM type: YTN; PAM sequence: TTT
tggaaaagggagtctgtttc

SEQ ID NO: 55946 - DNA, 20 bp, Artificial Sequence
  Description of Artificial Sequence: Synthetic oligonucleotide
  Target: SCN10A; (-) strand; PAM type: YTN; PAM sequence: TTC
ggggcagaaggacattttgg

SEQ ID NO: 55947 - DNA, 20 bp, Artificial Sequence
  Description of Artificial Sequence: Synthetic oligonucleotide
  Target: SCN10A; (-) strand; PAM type: YTN; PAM sequence: CTT
cggggcagaaggacattttg

SEQ ID NO: 55948 - DNA, 20 bp, Artificial Sequence
  Description of Artificial Sequence: Synthetic oligonucleotide
  Target: SCN10A; (-) strand; PAM type: YTN; PAM sequence: CTG
aaatgaaggcttcggggcag

SEQ ID NO: 55949 - DNA, 20 bp, Artificial Sequence
  Description of Artificial Sequence: Synthetic oligonucleotide
  Target: SCN10A; (-) strand; PAM type: YTN; PAM sequence: TTG
tatactgaaatgaaggcttc

SEQ ID NO: 55950 - DNA, 20 bp, Artificial Sequence
  Description of Artificial Sequence: Synthetic oligonucleotide
  Target: SCN10A; (-) strand; PAM type: YTN; PAM sequence: TTT
gtatactgaaatgaaggctt

SEQ ID NO: 55951 - DNA, 20 bp, Artificial Sequence
  Description of Artificial Sequence: Synthetic oligonucleotide
  Target: SCN10A; (-) strand; PAM type: YTN; PAM sequence: TTT
tgtatactgaaatgaaggct

SEQ ID NO: 55952 - DNA, 20 bp, Artificial Sequence
  Description of Artificial Sequence: Synthetic oligonucleotide
  Target: SCN10A; (-) strand; PAM type: YTN; PAM sequence: TTC
aggccattttgtatactgaa

SEQ ID NO: 55953 - DNA, 20 bp, Artificial Sequence
  Description of Artificial Sequence: Synthetic oligonucleotide
  Target: SCN10A; (-) strand; PAM type: YTN; PAM sequence: TTT
caggccattttgtatactga

SEQ ID NO: 55954 - DNA, 20 bp, Artificial Sequence
  Description of Artificial Sequence: Synthetic oligonucleotide
  Target: SCN10A; (-) strand; PAM type: YTN; PAM sequence: TTG
ccagatgaaatttcaggcca

SEQ ID NO: 55955 - DNA, 20 bp, Artificial Sequence
  Description of Artificial Sequence: Synthetic oligonucleotide
  Target: SCN10A; (-) strand; PAM type: YTN; PAM sequence: TTT
gccagatgaaatttcaggcc

SEQ ID NO: 55956 - DNA, 20 bp, Artificial Sequence
  Description of Artificial Sequence: Synthetic oligonucleotide
  Target: SCN10A; (-) strand; PAM type: YTN; PAM sequence: TTA
gaataaaaaagacatttgcc

SEQ ID NO: 55957 - DNA, 20 bp, Artificial Sequence
  Description of Artificial Sequence: Synthetic oligonucleotide
  Target: SCN10A; (-) strand; PAM type: YTN; PAM sequence: TTT
agaataaaaaagacatttgc

SEQ ID NO: 55958 - DNA, 20 bp, Artificial Sequence
  Description of Artificial Sequence: Synthetic oligonucleotide
  Target: SCN10A; (-) strand; PAM type: YTN; PAM sequence: TTT
tagaataaaaaagacatttg

SEQ ID NO: 55959 - DNA, 20 bp, Artificial Sequence
  Description of Artificial Sequence: Synthetic oligonucleotide
  Target: SCN10A; (-) strand; PAM type: YTN; PAM sequence: CTT
ttagaataaaaaagacattt

SEQ ID NO: 55960 - DNA, 20 bp, Artificial Sequence
  Description of Artificial Sequence: Synthetic oligonucleotide
  Target: SCN10A; (-) strand; PAM type: YTN; PAM sequence: TTG
tcttttagaataaaaaagac

SEQ ID NO: 55961 - DNA, 20 bp, Artificial Sequence
  Description of Artificial Sequence: Synthetic oligonucleotide
  Target: SCN10A; (-) strand; PAM type: YTN; PAM sequence: TTT
gtcttttagaataaaaaaga

SEQ ID NO: 55962 - DNA, 20 bp, Artificial Sequence
  Description of Artificial Sequence: Synthetic oligonucleotide
  Target: SCN10A; (-) strand; PAM type: YTN; PAM sequence: CTT
tgtcttttagaataaaaaag

SEQ ID NO: 55963 - DNA, 20 bp, Artificial Sequence
  Description of Artificial Sequence: Synthetic oligonucleotide
  Target: SCN10A; (-) strand; PAM type: YTN; PAM sequence: TTC
tttgtcttttagaataaaaa

SEQ ID NO: 55964 - DNA, 20 bp, Artificial Sequence
  Description of Artificial Sequence: Synthetic oligonucleotide
  Target: SCN10A; (-) strand; PAM type: YTN; PAM sequence: TTT
ctttgtcttttagaataaaa

SEQ ID NO: 55965 - DNA, 20 bp, Artificial Sequence
  Description of Artificial Sequence: Synthetic oligonucleotide
  Target: SCN10A; (-) strand; PAM type: YTN; PAM sequence: TTT
tctttgtcttttagaataaa

SEQ ID NO: 55966 - DNA, 20 bp, Artificial Sequence
  Description of Artificial Sequence: Synthetic oligonucleotide
  Target: SCN10A; (-) strand; PAM type: YTN; PAM sequence: CTT
ttctttgtcttttagaataa

SEQ ID NO: 55967 - DNA, 20 bp, Artificial Sequence
  Description of Artificial Sequence: Synthetic oligonucleotide
  Target: SCN10A; (-) strand; PAM type: YTN; PAM sequence: CTA
acttttctttgtcttttaga

SEQ ID NO: 55968 - DNA, 20 bp, Artificial Sequence
  Description of Artificial Sequence: Synthetic oligonucleotide
  Target: SCN10A; (-) strand; PAM type: YTN; PAM sequence: TTC
taacttttctttgtctttta

SEQ ID NO: 55969 - DNA, 20 bp, Artificial Sequence
  Description of Artificial Sequence: Synthetic oligonucleotide
  Target: SCN10A; (-) strand; PAM type: YTN; PAM sequence: TTT
ctaacttttctttgtctttt

SEQ ID NO: 55970 - DNA, 20 bp, Artificial Sequence
  Description of Artificial Sequence: Synthetic oligonucleotide
  Target: SCN10A; (-) strand; PAM type: YTN; PAM sequence: CTC
caagtttctaacttttcttt

SEQ ID NO: 55971 - DNA, 20 bp, Artificial Sequence
  Description of Artificial Sequence: Synthetic oligonucleotide
  Target: SCN10A; (-) strand; PAM type: YTN; PAM sequence: TTA
tctccaagtttctaactttt

SEQ ID NO: 55972 - DNA, 20 bp, Artificial Sequence
  Description of Artificial Sequence: Synthetic oligonucleotide
  Target: SCN10A; (-) strand; PAM type: YTN; PAM sequence: CTT
atctccaagtttctaacttt

SEQ ID NO: 55973 - DNA, 20 bp, Artificial Sequence
  Description of Artificial Sequence: Synthetic oligonucleotide
  Target: SCN10A; (-) strand; PAM type: YTN; PAM sequence: TTC
acttatctccaagtttctaa

SEQ ID NO: 55974 - DNA, 20 bp, Artificial Sequence
  Description of Artificial Sequence: Synthetic oligonucleotide
  Target: SCN10A; (-) strand; PAM type: YTN; PAM sequence: CTT
cacttatctccaagtttcta

SEQ ID NO: 55975 - DNA, 20 bp, Artificial Sequence
  Description of Artificial Sequence: Synthetic oligonucleotide
  Target: SCN10A; (-) strand; PAM type: YTN; PAM sequence: CTC
ttcacttatctccaagtttc

SEQ ID NO: 55976 - DNA, 20 bp, Artificial Sequence
  Description of Artificial Sequence: Synthetic oligonucleotide
  Target: SCN10A; (-) strand; PAM type: YTN; PAM sequence: TTG
tacctcttcacttatctcca

SEQ ID NO: 55977 - DNA, 20 bp, Artificial Sequence
  Description of Artificial Sequence: Synthetic oligonucleotide
  Target: SCN10A; (-) strand; PAM type: YTN; PAM sequence: TTT
gtacctcttcacttatctcc

SEQ ID NO: 55978 - DNA, 20 bp, Artificial Sequence
  Description of Artificial Sequence: Synthetic oligonucleotide
  Target: SCN10A; (-) strand; PAM type: YTN; PAM sequence: TTC
ccatgaaagtttgtacctct

SEQ ID NO: 55979 - DNA, 20 bp, Artificial Sequence
  Description of Artificial Sequence: Synthetic oligonucleotide
  Target: SCN10A; (-) strand; PAM type: YTN; PAM sequence: CTA
attcccatgaaagtttgtac

SEQ ID NO: 55980 - DNA, 20 bp, Artificial Sequence
  Description of Artificial Sequence: Synthetic oligonucleotide
  Target: SCN10A; (-) strand; PAM type: YTN; PAM sequence: CTG
atgaaactaattcccatgaa

SEQ ID NO: 55981 - DNA, 20 bp, Artificial Sequence
  Description of Artificial Sequence: Synthetic oligonucleotide
  Target: SCN10A; (-) strand; PAM type: YTN; PAM sequence: TTA
cccaaacaatctgatgaaac

SEQ ID NO: 55982 - DNA, 20 bp, Artificial Sequence
  Description of Artificial Sequence: Synthetic oligonucleotide
  Target: SCN10A; (-) strand; PAM type: YTN; PAM sequence: CTA
agttacccaaacaatctgat

SEQ ID NO: 55983 - DNA, 20 bp, Artificial Sequence
  Description of Artificial Sequence: Synthetic oligonucleotide
  Target: SCN10A; (-) strand; PAM type: YTN; PAM sequence: CTC
aactaagttacccaaacaat

SEQ ID NO: 55984 - DNA, 20 bp, Artificial Sequence
  Description of Artificial Sequence: Synthetic oligonucleotide
  Target: SCN10A; (-) strand; PAM type: YTN; PAM sequence: CTG
atctcaactaagttacccaa

SEQ ID NO: 55985 - DNA, 20 bp, Artificial Sequence
  Description of Artificial Sequence: Synthetic oligonucleotide
  Target: SCN10A; (-) strand; PAM type: YTN; PAM sequence: CTC
ggtggaactgatctcaacta

SEQ ID NO: 55986 - DNA, 20 bp, Artificial Sequence
  Description of Artificial Sequence: Synthetic oligonucleotide
  Target: SCN10A; (-) strand; PAM type: YTN; PAM sequence: TTC
ctcggtggaactgatctcaa

SEQ ID NO: 55987 - DNA, 20 bp, Artificial Sequence
  Description of Artificial Sequence: Synthetic oligonucleotide
  Target: SCN10A; (-) strand; PAM type: YTN; PAM sequence: TTT
cctcggtggaactgatctca

SEQ ID NO: 55988 - DNA, 20 bp, Artificial Sequence
  Description of Artificial Sequence: Synthetic oligonucleotide
  Target: SCN10A; (-) strand; PAM type: YTN; PAM sequence: CTA
cccagaagaccatttcctcg

SEQ ID NO: 55989 - DNA, 20 bp, Artificial Sequence
  Description of Artificial Sequence: Synthetic oligonucleotide
  Target: SCN10A; (-) strand; PAM type: YTN; PAM sequence: TTC
ctacccagaagaccatttcc

SEQ ID NO: 55990 - DNA, 20 bp, Artificial Sequence
  Description of Artificial Sequence: Synthetic oligonucleotide
  Target: SCN10A; (-) strand; PAM type: YTN; PAM sequence: CTC
caccgttcctacccagaaga

SEQ ID NO: 55991 - DNA, 20 bp, Artificial Sequence
  Description of Artificial Sequence: Synthetic oligonucleotide
  Target: SCN10A; (-) strand; PAM type: YTN; PAM sequence: CTG
cctccaccgttcctacccag

SEQ ID NO: 55992 - DNA, 20 bp, Artificial Sequence
  Description of Artificial Sequence: Synthetic oligonucleotide
  Target: SCN10A; (-) strand; PAM type: YTN; PAM sequence: CTG
tgcctgcctccaccgttcct

SEQ ID NO: 55993 - DNA, 20 bp, Artificial Sequence
  Description of Artificial Sequence: Synthetic oligonucleotide
  Target: SCN10A; (-) strand; PAM type: YTN; PAM sequence: TTC
cctgtgcctgcctccaccgt

SEQ ID NO: 55994 - DNA, 20 bp, Artificial Sequence
  Description of Artificial Sequence: Synthetic oligonucleotide
  Target: SCN10A; (-) strand; PAM type: YTN; PAM sequence: TTT
ccctgtgcctgcctccaccg

SEQ ID NO: 55995 - DNA, 20 bp, Artificial Sequence
  Description of Artificial Sequence: Synthetic oligonucleotide
  Target: SCN10A; (-) strand; PAM type: YTN; PAM sequence: TTC
atttccctgtgcctgcctcc

SEQ ID NO: 55996 - DNA, 20 bp, Artificial Sequence
  Description of Artificial Sequence: Synthetic oligonucleotide
  Target: SCN10A; (-) strand; PAM type: YTN; PAM sequence: TTT
catttccctgtgcctgcctc

SEQ ID NO: 55997 - DNA, 20 bp, Artificial Sequence
  Description of Artificial Sequence: Synthetic oligonucleotide
  Target: SCN10A; (-) strand; PAM type: YTN; PAM sequence: CTG
agccagtatttcatttccct

SEQ ID NO: 55998 - DNA, 20 bp, Artificial Sequence
  Description of Artificial Sequence: Synthetic oligonucleotide
  Target: SCN10A; (-) strand; PAM type: YTN; PAM sequence: TTC
ctgagccagtatttcatttc

SEQ ID NO: 55999 - DNA, 20 bp, Artificial Sequence
  Description of Artificial Sequence: Synthetic oligonucleotide
  Target: SCN10A; (-) strand; PAM type: YTN; PAM sequence: CTT
cctgagccagtatttcattt

SEQ ID NO: 56000 - DNA, 20 bp, Artificial Sequence
  Description of Artificial Sequence: Synthetic oligonucleotide
  Target: SCN10A; (-) strand; PAM type: YTN; PAM sequence: TTC
ttcctgagccagtatttcat

SEQ ID NO: 56001 - DNA, 20 bp, Artificial Sequence
  Description of Artificial Sequence: Synthetic oligonucleotide
  Target: SCN10A; (-) strand; PAM type: YTN; PAM sequence: TTT
cttcctgagccagtatttca

SEQ ID NO: 56002 - DNA, 20 bp, Artificial Sequence
  Description of Artificial Sequence: Synthetic oligonucleotide
  Target: SCN10A; (-) strand; PAM type: YTN; PAM sequence: TTT
tcttcctgagccagtatttc

SEQ ID NO: 56003 - DNA, 20 bp, Artificial Sequence
  Description of Artificial Sequence: Synthetic oligonucleotide
  Target: SCN10A; (-) strand; PAM type: YTN; PAM sequence: TTG
gggttttcttcctgagccag

SEQ ID NO: 56004 - DNA, 20 bp, Artificial Sequence
  Description of Artificial Sequence: Synthetic oligonucleotide
  Target: SCN10A; (-) strand; PAM type: YTN; PAM sequence: CTT
ggggttttcttcctgagcca

SEQ ID NO: 56005 - DNA, 20 bp, Artificial Sequence
  Description of Artificial Sequence: Synthetic oligonucleotide
  Target: SCN10A; (-) strand; PAM type: YTN; PAM sequence: CTA
cttggggttttcttcctgag

SEQ ID NO: 56006 - DNA, 20 bp, Artificial Sequence
  Description of Artificial Sequence: Synthetic oligonucleotide
  Target: SCN10A; (-) strand; PAM type: YTN; PAM sequence: CTA
atcctacttggggttttctt

SEQ ID NO: 56007 - DNA, 20 bp, Artificial Sequence
  Description of Artificial Sequence: Synthetic oligonucleotide
  Target: SCN10A; (-) strand; PAM type: YTN; PAM sequence: CTC
cagcctaatcctacttgggg

SEQ ID NO: 56008 - DNA, 20 bp, Artificial Sequence
  Description of Artificial Sequence: Synthetic oligonucleotide
  Target: SCN10A; (-) strand; PAM type: YTN; PAM sequence: CTC
cactccagcctaatcctact

SEQ ID NO: 56009 - DNA, 20 bp, Artificial Sequence
  Description of Artificial Sequence: Synthetic oligonucleotide
  Target: SCN10A; (-) strand; PAM type: YTN; PAM sequence: TTC
tccactccagcctaatccta

SEQ ID NO: 56010 - DNA, 20 bp, Artificial Sequence
  Description of Artificial Sequence: Synthetic oligonucleotide
  Target: SCN10A; (-) strand; PAM type: YTN; PAM sequence: TTC
agagttctccactccagcct

SEQ ID NO: 56011 - DNA, 20 bp, Artificial Sequence
  Description of Artificial Sequence: Synthetic oligonucleotide
  Target: SCN10A; (-) strand; PAM type: YTN; PAM sequence: CTA
ttcagagttctccactccag

SEQ ID NO: 56012 - DNA, 20 bp, Artificial Sequence
  Description of Artificial Sequence: Synthetic oligonucleotide
  Target: SCN10A; (-) strand; PAM type: YTN; PAM sequence: CTA
gctattcagagttctccact

SEQ ID NO: 56013 - DNA, 20 bp, Artificial Sequence
  Description of Artificial Sequence: Synthetic oligonucleotide
  Target: SCN10A; (-) strand; PAM type: YTN; PAM sequence: CTC
tagctattcagagttctcca

SEQ ID NO: 56014 - DNA, 20 bp, Artificial Sequence
  Description of Artificial Sequence: Synthetic oligonucleotide
  Target: SCN10A; (-) strand; PAM type: YTN; PAM sequence: CTC
cactctagctattcagagtt

SEQ ID NO: 56015 - DNA, 20 bp, Artificial Sequence
  Description of Artificial Sequence: Synthetic oligonucleotide
  Target: SCN10A; (-) strand; PAM type: YTN; PAM sequence: TTC
tccactctagctattcagag

SEQ ID NO: 56016 - DNA, 20 bp, Artificial Sequence
  Description of Artificial Sequence: Synthetic oligonucleotide
  Target: SCN10A; (-) strand; PAM type: YTN; PAM sequence: CTG
tcaatattctccactctagc

SEQ ID NO: 56017 - DNA, 20 bp, Artificial Sequence
  Description of Artificial Sequence: Synthetic oligonucleotide
  Target: SCN10A; (-) strand; PAM type: YTN; PAM sequence: CTG
ctgtcaatattctccactct

SEQ ID NO: 56018 - DNA, 20 bp, Artificial Sequence
  Description of Artificial Sequence: Synthetic oligonucleotide
  Target: SCN10A; (-) strand; PAM type: YTN; PAM sequence: TTG
cccatagtctgctgtcaata

SEQ ID NO: 56019 - DNA, 20 bp, Artificial Sequence
  Description of Artificial Sequence: Synthetic oligonucleotide
  Target: SCN10A; (-) strand; PAM type: YTN; PAM sequence: TTT
gcccatagtctgctgtcaat

SEQ ID NO: 56020 - DNA, 20 bp, Artificial Sequence
  Description of Artificial Sequence: Synthetic oligonucleotide
  Target: SCN10A; (-) strand; PAM type: YTN; PAM sequence: CTT
tgcccatagtctgctgtcaa

SEQ ID NO: 56021 - DNA, 20 bp, Artificial Sequence
  Description of Artificial Sequence: Synthetic oligonucleotide
  Target: SCN10A; (-) strand; PAM type: YTN; PAM sequence: TTG
ataatccctttgcccatagt

SEQ ID NO: 56022 - DNA, 20 bp, Artificial Sequence
  Description of Artificial Sequence: Synthetic oligonucleotide
  Target: SCN10A; (-) strand; PAM type: YTN; PAM sequence: TTT
gataatccctttgcccatag

SEQ ID NO: 56023 - DNA, 20 bp, Artificial Sequence
  Description of Artificial Sequence: Synthetic oligonucleotide
  Target: SCN10A; (-) strand; PAM type: YTN; PAM sequence: TTT
tgataatccctttgcccata

SEQ ID NO: 56024 - DNA, 20 bp, Artificial Sequence
  Description of Artificial Sequence: Synthetic oligonucleotide
  Target: SCN10A; (-) strand; PAM type: YTN; PAM sequence: CTT
ttgataatccctttgcccat

SEQ ID NO: 56025 - DNA, 20 bp, Artificial Sequence
  Description of Artificial Sequence: Synthetic oligonucleotide
  Target: SCN10A; (-) strand; PAM type: YTN; PAM sequence: CTC
cccttttgataatccctttg

SEQ ID NO: 56026 - DNA, 20 bp, Artificial Sequence
  Description of Artificial Sequence: Synthetic oligonucleotide
  Target: SCN10A; (-) strand; PAM type: YTN; PAM sequence: CTC
cctccccttttgataatccc

SEQ ID NO: 56027 - DNA, 20 bp, Artificial Sequence
  Description of Artificial Sequence: Synthetic oligonucleotide
  Target: SCN10A; (-) strand; PAM type: YTN; PAM sequence: TTC
aatgtctccctccccttttg

SEQ ID NO: 56028 - DNA, 20 bp, Artificial Sequence
  Description of Artificial Sequence: Synthetic oligonucleotide
  Target: SCN10A; (-) strand; PAM type: YTN; PAM sequence: TTT
caatgtctccctcccctttt

SEQ ID NO: 56029 - DNA, 20 bp, Artificial Sequence
  Description of Artificial Sequence: Synthetic oligonucleotide
  Target: SCN10A; (-) strand; PAM type: YTN; PAM sequence: CTT
tcaatgtctccctccccttt

SEQ ID NO: 56030 - DNA, 20 bp, Artificial Sequence
  Description of Artificial Sequence: Synthetic oligonucleotide
  Target: SCN10A; (-) strand; PAM type: YTN; PAM sequence: TTC
ctttcaatgtctccctcccc

SEQ ID NO: 56031 - DNA, 20 bp, Artificial Sequence
  Description of Artificial Sequence: Synthetic oligonucleotide
  Target: SCN10A; (-) strand; PAM type: YTN; PAM sequence: CTT
cctttcaatgtctccctccc

SEQ ID NO: 56032 - DNA, 20 bp, Artificial Sequence
  Description of Artificial Sequence: Synthetic oligonucleotide
  Target: SCN10A; (-) strand; PAM type: YTN; PAM sequence: TTC
cacccaccttcctttcaatg

SEQ ID NO: 56033 - DNA, 20 bp, Artificial Sequence
  Description of Artificial Sequence: Synthetic oligonucleotide
  Target: SCN10A; (-) strand; PAM type: YTN; PAM sequence: CTT
ccacccaccttcctttcaat

SEQ ID NO: 56034 - DNA, 20 bp, Artificial Sequence
  Description of Artificial Sequence: Synthetic oligonucleotide
  Target: SCN10A; (-) strand; PAM type: YTN; PAM sequence: TTC
cccttccacccaccttcctt

SEQ ID NO: 56035 - DNA, 20 bp, Artificial Sequence
  Description of Artificial Sequence: Synthetic oligonucleotide
  Target: SCN10A; (-) strand; PAM type: YTN; PAM sequence: TTT
ccccttccacccaccttcct

SEQ ID NO: 56036 - DNA, 20 bp, Artificial Sequence
  Description of Artificial Sequence: Synthetic oligonucleotide
  Target: SCN10A; (-) strand; PAM type: YTN; PAM sequence: TTT
tccccttccacccaccttcc

SEQ ID NO: 56037 - DNA, 20 bp, Artificial Sequence
  Description of Artificial Sequence: Synthetic oligonucleotide
  Target: SCN10A; (-) strand; PAM type: YTN; PAM sequence: CTA
ttttccccttccacccacct

SEQ ID NO: 56038 - DNA, 20 bp, Artificial Sequence
  Description of Artificial Sequence: Synthetic oligonucleotide
  Target: SCN10A; (-) strand; PAM type: YTN; PAM sequence: TTC
tattttccccttccacccac

SEQ ID NO: 56039 - DNA, 20 bp, Artificial Sequence
  Description of Artificial Sequence: Synthetic oligonucleotide
  Target: SCN10A; (-) strand; PAM type: YTN; PAM sequence: CTT
ctattttccccttccaccca

SEQ ID NO: 56040 - DNA, 20 bp, Artificial Sequence
  Description of Artificial Sequence: Synthetic oligonucleotide
  Target: SCN10A; (-) strand; PAM type: YTN; PAM sequence: TTC
ccttctattttccccttcca

SEQ ID NO: 56041 - DNA, 20 bp, Artificial Sequence
  Description of Artificial Sequence: Synthetic oligonucleotide
  Target: SCN10A; (-) strand; PAM type: YTN; PAM sequence: CTT
cccttctattttccccttcc

SEQ ID NO: 56042 - DNA, 20 bp, Artificial Sequence
  Description of Artificial Sequence: Synthetic oligonucleotide
  Target: SCN10A; (-) strand; PAM type: YTN; PAM sequence: TTC
ttcccttctattttcccctt

SEQ ID NO: 56043 - DNA, 20 bp, Artificial Sequence
  Description of Artificial Sequence: Synthetic oligonucleotide
  Target: SCN10A; (-) strand; PAM type: YTN; PAM sequence: TTT
cttcccttctattttcccct

SEQ ID NO: 56044 - DNA, 20 bp, Artificial Sequence
  Description of Artificial Sequence: Synthetic oligonucleotide
  Target: SCN10A; (-) strand; PAM type: YTN; PAM sequence: CTC
cccaccaacatttcttccct

SEQ ID NO: 56045 - DNA, 20 bp, Artificial Sequence
  Description of Artificial Sequence: Synthetic oligonucleotide
  Target: SCN10A; (-) strand; PAM type: YTN; PAM sequence: TTC
tccccaccaacatttcttcc

SEQ ID NO: 56046 - DNA, 20 bp, Artificial Sequence
  Description of Artificial Sequence: Synthetic oligonucleotide
  Target: SCN10A; (-) strand; PAM type: YTN; PAM sequence: TTA
gattctccccaccaacattt

SEQ ID NO: 56047 - DNA, 20 bp, Artificial Sequence
  Description of Artificial Sequence: Synthetic oligonucleotide
  Target: SCN10A; (-) strand; PAM type: YTN; PAM sequence: TTT
agattctccccaccaacatt

SEQ ID NO: 56048 - DNA, 20 bp, Artificial Sequence
  Description of Artificial Sequence: Synthetic oligonucleotide
  Target: SCN10A; (-) strand; PAM type: YTN; PAM sequence: CTT
tagattctccccaccaacat

SEQ ID NO: 56049 - DNA, 20 bp, Artificial Sequence
  Description of Artificial Sequence: Synthetic oligonucleotide
  Target: SCN10A; (-) strand; PAM type: YTN; PAM sequence: TTA
cctttagattctccccacca

SEQ ID NO: 56050 - DNA, 20 bp, Artificial Sequence
  Description of Artificial Sequence: Synthetic oligonucleotide
  Target: SCN10A; (-) strand; PAM type: YTN; PAM sequence: TTT
acctttagattctccccacc

SEQ ID NO: 56051 - DNA, 20 bp, Artificial Sequence
  Description of Artificial Sequence: Synthetic oligonucleotide
  Target: SCN10A; (-) strand; PAM type: YTN; PAM sequence: CTA
agaaaaatgtccaagtggga

SEQ ID NO: 56052 - DNA, 20 bp, Artificial Sequence
  Description of Artificial Sequence: Synthetic oligonucleotide
  Target: SCN10A; (-) strand; PAM type: YTN; PAM sequence: TTC
ctaagaaaaatgtccaagtg

SEQ ID NO: 56053 - DNA, 20 bp, Artificial Sequence
  Description of Artificial Sequence: Synthetic oligonucleotide
  Target: SCN10A; (-) strand; PAM type: YTN; PAM sequence: CTA
ttcctaagaaaaatgtccaa

SEQ ID NO: 56054 - DNA, 20 bp, Artificial Sequence
  Description of Artificial Sequence: Synthetic oligonucleotide
  Target: SCN10A; (-) strand; PAM type: YTN; PAM sequence: TTG
ggagcccagctattcctaag

SEQ ID NO: 56055 - DNA, 20 bp, Artificial Sequence
  Description of Artificial Sequence: Synthetic oligonucleotide
  Target: SCN10A; (-) strand; PAM type: YTN; PAM sequence: CTG
ttgggagcccagctattcct

SEQ ID NO: 56056 - DNA, 20 bp, Artificial Sequence
  Description of Artificial Sequence: Synthetic oligonucleotide
  Target: SCN10A; (-) strand; PAM type: YTN; PAM sequence: TTA
ggaagcactgttgggagccc

SEQ ID NO: 56057 - DNA, 20 bp, Artificial Sequence
  Description of Artificial Sequence: Synthetic oligonucleotide
  Target: SCN10A; (-) strand; PAM type: YTN; PAM sequence: CTT
aggaagcactgttgggagcc

SEQ ID NO: 56058 - DNA, 20 bp, Artificial Sequence
  Description of Artificial Sequence: Synthetic oligonucleotide
  Target: SCN10A; (-) strand; PAM type: YTN; PAM sequence: TTC
cttaggaagcactgttggga

SEQ ID NO: 56059 - DNA, 20 bp, Artificial Sequence
  Description of Artificial Sequence: Synthetic oligonucleotide
  Target: SCN10A; (-) strand; PAM type: YTN; PAM sequence: TTT
ccttaggaagcactgttggg

SEQ ID NO: 56060 - DNA, 20 bp, Artificial Sequence
  Description of Artificial Sequence: Synthetic oligonucleotide
  Target: SCN10A; (-) strand; PAM type: YTN; PAM sequence: TTT
tccttaggaagcactgttgg

SEQ ID NO: 56061 - DNA, 20 bp, Artificial Sequence
  Description of Artificial Sequence: Synthetic oligonucleotide
  Target: SCN10A; (-) strand; PAM type: YTN; PAM sequence: TTT
ttccttaggaagcactgttg

SEQ ID NO: 56062 - DNA, 20 bp, Artificial Sequence
  Description of Artificial Sequence: Synthetic oligonucleotide
  Target: SCN10A; (-) strand; PAM type: YTN; PAM sequence: TTA
tttttccttaggaagcactg

SEQ ID NO: 56063 - DNA, 20 bp, Artificial Sequence
  Description of Artificial Sequence: Synthetic oligonucleotide
  Target: SCN10A; (-) strand; PAM type: YTN; PAM sequence: TTT
atttttccttaggaagcact

SEQ ID NO: 56064 - DNA, 20 bp, Artificial Sequence
  Description of Artificial Sequence: Synthetic oligonucleotide
  Target: SCN10A; (-) strand; PAM type: YTN; PAM sequence: TTT
tatttttccttaggaagcac

SEQ ID NO: 56065 - DNA, 20 bp, Artificial Sequence
  Description of Artificial Sequence: Synthetic oligonucleotide
  Target: SCN10A; (-) strand; PAM type: YTN; PAM sequence: TTC
aagttttatttttccttagg

SEQ ID NO: 56066 - DNA, 20 bp, Artificial Sequence
  Description of Artificial Sequence: Synthetic oligonucleotide
  Target: SCN10A; (-) strand; PAM type: YTN; PAM sequence: CTT
caagttttatttttccttag

SEQ ID NO: 56067 - DNA, 20 bp, Artificial Sequence
  Description of Artificial Sequence: Synthetic oligonucleotide
  Target: SCN10A; (-) strand; PAM type: YTN; PAM sequence: TTA
tcttcaagttttatttttcc

SEQ ID NO: 56068 - DNA, 20 bp, Artificial Sequence
  Description of Artificial Sequence: Synthetic oligonucleotide
  Target: SCN10A; (-) strand; PAM type: YTN; PAM sequence: TTT
atcttcaagttttatttttc

SEQ ID NO: 56069 - DNA, 20 bp, Artificial Sequence
  Description of Artificial Sequence: Synthetic oligonucleotide
  Target: SCN10A; (-) strand; PAM type: YTN; PAM sequence: CTG
taggtcaagtttatcttcaa

SEQ ID NO: 56070 - DNA, 20 bp, Artificial Sequence
  Description of Artificial Sequence: Synthetic oligonucleotide
  Target: SCN10A; (-) strand; PAM type: YTN; PAM sequence: CTC
tgtaggtcaagtttatcttc

SEQ ID NO: 56071 - DNA, 20 bp, Artificial Sequence
  Description of Artificial Sequence: Synthetic oligonucleotide
  Target: SCN10A; (-) strand; PAM type: YTN; PAM sequence: CTC
tctgtaggtcaagtttatct

SEQ ID NO: 56072 - DNA, 20 bp, Artificial Sequence
  Description of Artificial Sequence: Synthetic oligonucleotide
  Target: SCN10A; (-) strand; PAM type: YTN; PAM sequence: CTC
tctctgtaggtcaagtttat

SEQ ID NO: 56073 - DNA, 20 bp, Artificial Sequence
  Description of Artificial Sequence: Synthetic oligonucleotide
  Target: SCN10A; (-) strand; PAM type: YTN; PAM sequence: TTG
tactctctctgtaggtcaag

SEQ ID NO: 56074 - DNA, 20 bp, Artificial Sequence
  Description of Artificial Sequence: Synthetic oligonucleotide
  Target: SCN10A; (-) strand; PAM type: YTN; PAM sequence: TTG
aaaaatgagtgttgtactct

SEQ ID NO: 56075 - DNA, 20 bp, Artificial Sequence
  Description of Artificial Sequence: Synthetic oligonucleotide
  Target: SCN10A; (-) strand; PAM type: YTN; PAM sequence: CTC
aaattgaaaaatgagtgttg

SEQ ID NO: 56076 - DNA, 20 bp, Artificial Sequence
  Description of Artificial Sequence: Synthetic oligonucleotide
  Target: SCN10A; (-) strand; PAM type: YTN; PAM sequence: CTG
ctcaaattgaaaaatgagtg

SEQ ID NO: 56077 - DNA, 20 bp, Artificial Sequence
  Description of Artificial Sequence: Synthetic oligonucleotide
  Target: SCN10A; (-) strand; PAM type: YTN; PAM sequence: TTC
tgctcaaattgaaaaatgag

SEQ ID NO: 56078 - DNA, 20 bp, Artificial Sequence
  Description of Artificial Sequence: Synthetic oligonucleotide
  Target: SCN10A; (-) strand; PAM type: YTN; PAM sequence: CTT
ctgctcaaattgaaaaatga

SEQ ID NO: 56079 - DNA, 20 bp, Artificial Sequence
  Description of Artificial Sequence: Synthetic oligonucleotide
  Target: SCN10A; (-) strand; PAM type: YTN; PAM sequence: TTA
aatacttctgctcaaattga

SEQ ID NO: 56080 - DNA, 20 bp, Artificial Sequence
  Description of Artificial Sequence: Synthetic oligonucleotide
  Target: SCN10A; (-) strand; PAM type: YTN; PAM sequence: TTT
aaatacttctgctcaaattg

SEQ ID NO: 56081 - DNA, 20 bp, Artificial Sequence
  Description of Artificial Sequence: Synthetic oligonucleotide
  Target: SCN10A; (-) strand; PAM type: YTN; PAM sequence: CTA
aaatacatttaaatacttct

SEQ ID NO: 56082 - DNA, 20 bp, Artificial Sequence
  Description of Artificial Sequence: Synthetic oligonucleotide
  Target: SCN10A; (-) strand; PAM type: YTN; PAM sequence: TTA
cagaaaactaaaatacattt

SEQ ID NO: 56083 - DNA, 20 bp, Artificial Sequence
  Description of Artificial Sequence: Synthetic oligonucleotide
  Target: SCN10A; (-) strand; PAM type: YTN; PAM sequence: TTT
acagaaaactaaaatacatt

SEQ ID NO: 56084 - DNA, 20 bp, Artificial Sequence
  Description of Artificial Sequence: Synthetic oligonucleotide
  Target: SCN10A; (-) strand; PAM type: YTN; PAM sequence: CTA
gacacatcaaggcatttaca

SEQ ID NO: 56085 - DNA, 20 bp, Artificial Sequence
  Description of Artificial Sequence: Synthetic oligonucleotide
  Target: SCN10A; (-) strand; PAM type: YTN; PAM sequence: CTG
taaaactagacacatcaagg

SEQ ID NO: 56086 - DNA, 20 bp, Artificial Sequence
  Description of Artificial Sequence: Synthetic oligonucleotide
  Target: SCN10A; (-) strand; PAM type: YTN; PAM sequence: CTA
agtaactgtaaaactagaca

SEQ ID NO: 56087 - DNA, 20 bp, Artificial Sequence
  Description of Artificial Sequence: Synthetic oligonucleotide
  Target: SCN10A; (-) strand; PAM type: YTN; PAM sequence: TTC
ctaagtaactgtaaaactag

SEQ ID NO: 56088 - DNA, 20 bp, Artificial Sequence
  Description of Artificial Sequence: Synthetic oligonucleotide
  Target: SCN10A; (-) strand; PAM type: YTN; PAM sequence: TTC
ataatagatgtgttcctaag

SEQ ID NO: 56089 - DNA, 20 bp, Artificial Sequence
  Description of Artificial Sequence: Synthetic oligonucleotide
  Target: SCN10A; (-) strand; PAM type: YTN; PAM sequence: TTT
cataatagatgtgttcctaa

SEQ ID NO: 56090 - DNA, 20 bp, Artificial Sequence
  Description of Artificial Sequence: Synthetic oligonucleotide
  Target: SCN10A; (-) strand; PAM type: YTN; PAM sequence: TTT
tcataatagatgtgttccta

SEQ ID NO: 56091 - DNA, 20 bp, Artificial Sequence
  Description of Artificial Sequence: Synthetic oligonucleotide
  Target: SCN10A; (-) strand; PAM type: YTN; PAM sequence: CTT
ttcataatagatgtgttcct

SEQ ID NO: 56092 - DNA, 20 bp, Artificial Sequence
  Description of Artificial Sequence: Synthetic oligonucleotide
  Target: SCN10A; (-) strand; PAM type: YTN; PAM sequence: TTC
cttttcataatagatgtgtt

SEQ ID NO: 56093 - DNA, 20 bp, Artificial Sequence
  Description of Artificial Sequence: Synthetic oligonucleotide
  Target: SCN10A; (-) strand; PAM type: YTN; PAM sequence: TTT
ccttttcataatagatgtgt

SEQ ID NO: 56094 - DNA, 20 bp, Artificial Sequence
  Description of Artificial Sequence: Synthetic oligonucleotide
  Target: SCN10A; (-) strand; PAM type: YTN; PAM sequence: TTT
tccttttcataatagatgtg

SEQ ID NO: 56095 - DNA, 20 bp, Artificial Sequence
  Description of Artificial Sequence: Synthetic oligonucleotide
  Target: SCN10A; (-) strand; PAM type: YTN; PAM sequence: TTA
atagaattttccttttcata

SEQ ID NO: 56096 - DNA, 20 bp, Artificial Sequence
  Description of Artificial Sequence: Synthetic oligonucleotide
  Target: SCN10A; (-) strand; PAM type: YTN; PAM sequence: TTA
attaatagaattttcctttt

SEQ ID NO: 56097 - DNA, 20 bp, Artificial Sequence
  Description of Artificial Sequence: Synthetic oligonucleotide
  Target: SCN10A; (-) strand; PAM type: YTN; PAM sequence: TTT
aattaatagaattttccttt

SEQ ID NO: 56098 - DNA, 20 bp, Artificial Sequence
  Description of Artificial Sequence: Synthetic oligonucleotide
  Target: SCN10A; (-) strand; PAM type: YTN; PAM sequence: TTG
taagtcagcaggaaaatgtg

SEQ ID NO: 56099 - DNA, 20 bp, Artificial Sequence
  Description of Artificial Sequence: Synthetic oligonucleotide
  Target: SCN10A; (-) strand; PAM type: YTN; PAM sequence: TTA
attgtaagtcagcaggaaaa

SEQ ID NO: 56100 - DNA, 20 bp, Artificial Sequence
  Description of Artificial Sequence: Synthetic oligonucleotide
  Target: SCN10A; (-) strand; PAM type: YTN; PAM sequence: TTT
aattgtaagtcagcaggaaa

SEQ ID NO: 56101 - DNA, 20 bp, Artificial Sequence
  Description of Artificial Sequence: Synthetic oligonucleotide
  Target: SCN10A; (-) strand; PAM type: YTN; PAM sequence: TTA
atttaattgtaagtcagcag

SEQ ID NO: 56102 - DNA, 20 bp, Artificial Sequence
  Description of Artificial Sequence: Synthetic oligonucleotide
  Target: SCN10A; (-) strand; PAM type: YTN; PAM sequence: CTT
aatttaattgtaagtcagca

SEQ ID NO: 56103 - DNA, 20 bp, Artificial Sequence
  Description of Artificial Sequence: Synthetic oligonucleotide
  Target: SCN10A; (-) strand; PAM type: YTN; PAM sequence: TTC
ttaatttaattgtaagtcag

SEQ ID NO: 56104 - DNA, 20 bp, Artificial Sequence
  Description of Artificial Sequence: Synthetic oligonucleotide
  Target: SCN10A; (-) strand; PAM type: YTN; PAM sequence: TTT
cttaatttaattgtaagtca

SEQ ID NO: 56105 - DNA, 20 bp, Artificial Sequence
  Description of Artificial Sequence: Synthetic oligonucleotide
  Target: SCN10A; (-) strand; PAM type: YTN; PAM sequence: TTC
cccccatgtgagcatatttc

SEQ ID NO: 56106 - DNA, 20 bp, Artificial Sequence
  Description of Artificial Sequence: Synthetic oligonucleotide
  Target: SCN10A; (-) strand; PAM type: YTN; PAM sequence: TTT
ccccccatgtgagcatattt

SEQ ID NO: 56107 - DNA, 20 bp, Artificial Sequence
  Description of Artificial Sequence: Synthetic oligonucleotide
  Target: SCN10A; (-) strand; PAM type: YTN; PAM sequence: TTA
acatttccccccatgtgagc

SEQ ID NO: 56108 - DNA, 20 bp, Artificial Sequence
  Description of Artificial Sequence: Synthetic oligonucleotide
  Target: SCN10A; (-) strand; PAM type: YTN; PAM sequence: TTG
gattaacatttccccccatg

SEQ ID NO: 56109 - DNA, 20 bp, Artificial Sequence
  Description of Artificial Sequence: Synthetic oligonucleotide
  Target: SCN10A; (-) strand; PAM type: YTN; PAM sequence: CTT
ggattaacatttccccccat

SEQ ID NO: 56110 - DNA, 20 bp, Artificial Sequence
  Description of Artificial Sequence: Synthetic oligonucleotide
  Target: SCN10A; (-) strand; PAM type: YTN; PAM sequence: TTA
atccttggattaacatttcc

SEQ ID NO: 56111 - DNA, 20 bp, Artificial Sequence
  Description of Artificial Sequence: Synthetic oligonucleotide
  Target: SCN10A; (-) strand; PAM type: YTN; PAM sequence: TTT
aatccttggattaacatttc

SEQ ID NO: 56112 - DNA, 20 bp, Artificial Sequence
  Description of Artificial Sequence: Synthetic oligonucleotide
  Target: SCN10A; (-) strand; PAM type: YTN; PAM sequence: TTA
gtttaatccttggattaaca

SEQ ID NO: 56113 - DNA, 20 bp, Artificial Sequence
  Description of Artificial Sequence: Synthetic oligonucleotide
  Target: SCN10A; (-) strand; PAM type: YTN; PAM sequence: TTT
agtttaatccttggattaac

SEQ ID NO: 56114 - DNA, 20 bp, Artificial Sequence
  Description of Artificial Sequence: Synthetic oligonucleotide
  Target: SCN10A; (-) strand; PAM type: YTN; PAM sequence: TTT
tagtttaatccttggattaa

SEQ ID NO: 56115 - DNA, 20 bp, Artificial Sequence
  Description of Artificial Sequence: Synthetic oligonucleotide
  Target: SCN10A; (-) strand; PAM type: YTN; PAM sequence: TTG
gagacacgattttagtttaa

SEQ ID NO: 56116 - DNA, 20 bp, Artificial Sequence
  Description of Artificial Sequence: Synthetic oligonucleotide
  Target: SCN10A; (-) strand; PAM type: YTN; PAM sequence: TTG
tagaattggagacacgattt

SEQ ID NO: 56117 - DNA, 20 bp, Artificial Sequence
  Description of Artificial Sequence: Synthetic oligonucleotide
  Target: SCN10A; (-) strand; PAM type: YTN; PAM sequence: TTT
gtagaattggagacacgatt

SEQ ID NO: 56118 - DNA, 20 bp, Artificial Sequence
  Description of Artificial Sequence: Synthetic oligonucleotide
  Target: SCN10A; (-) strand; PAM type: YTN; PAM sequence: TTA
aatatttgtagaattggaga

SEQ ID NO: 56119 - DNA, 20 bp, Artificial Sequence
  Description of Artificial Sequence: Synthetic oligonucleotide
  Target: SCN10A; (-) strand; PAM type: YTN; PAM sequence: TTT
aaatatttgtagaattggag

SEQ ID NO: 56120 - DNA, 20 bp, Artificial Sequence
  Description of Artificial Sequence: Synthetic oligonucleotide
  Target: SCN10A; (-) strand; PAM type: YTN; PAM sequence: TTT
taaatatttgtagaattgga

SEQ ID NO: 56121 - DNA, 20 bp, Artificial Sequence
  Description of Artificial Sequence: Synthetic oligonucleotide
  Target: SCN10A; (-) strand; PAM type: YTN; PAM sequence: CTT
ttaaatatttgtagaattgg

SEQ ID NO: 56122 - DNA, 20 bp, Artificial Sequence
  Description of Artificial Sequence: Synthetic oligonucleotide
  Target: SCN10A; (-) strand; PAM type: YTN; PAM sequence: TTA
cttttaaatatttgtagaat

SEQ ID NO: 56123 - DNA, 20 bp, Artificial Sequence
  Description of Artificial Sequence: Synthetic oligonucleotide
  Target: SCN10A; (-) strand; PAM type: YTN; PAM sequence: TTA
tacataagatatattacttt

SEQ ID NO: 56124 - DNA, 20 bp, Artificial Sequence
  Description of Artificial Sequence: Synthetic oligonucleotide
  Target: SCN10A; (-) strand; PAM type: YTN; PAM sequence: CTA
atattatacataagatatat

SEQ ID NO: 56125 - DNA, 20 bp, Artificial Sequence
  Description of Artificial Sequence: Synthetic oligonucleotide
  Target: SCN10A; (-) strand; PAM type: YTN; PAM sequence: TTC
ataactaatattatacataa

SEQ ID NO: 56126 - DNA, 20 bp, Artificial Sequence
  Description of Artificial Sequence: Synthetic oligonucleotide
  Target: SCN10A; (-) strand; PAM type: YTN; PAM sequence: TTT
cataactaatattatacata

SEQ ID NO: 56127 - DNA, 20 bp, Artificial Sequence
  Description of Artificial Sequence: Synthetic oligonucleotide
  Target: SCN10A; (-) strand; PAM type: YTN; PAM sequence: TTT
tcataactaatattatacat

SEQ ID NO: 56128 - DNA, 20 bp, Artificial Sequence
  Description of Artificial Sequence: Synthetic oligonucleotide
  Target: SCN10A; (-) strand; PAM type: YTN; PAM sequence: CTA
tgaatgttttcataactaat

SEQ ID NO: 56129 - DNA, 20 bp, Artificial Sequence
  Description of Artificial Sequence: Synthetic oligonucleotide
  Target: SCN10A; (-) strand; PAM type: YTN; PAM sequence: TTG
ctatgaatgttttcataact

SEQ ID NO: 56130 - DNA, 20 bp, Artificial Sequence
  Description of Artificial Sequence: Synthetic oligonucleotide
  Target: SCN10A; (-) strand; PAM type: YTN; PAM sequence: TTT
gctatgaatgttttcataac

SEQ ID NO: 56131 - DNA, 20 bp, Artificial Sequence
  Description of Artificial Sequence: Synthetic oligonucleotide
  Target: SCN10A; (-) strand; PAM type: YTN; PAM sequence: CTA
atcacatttgctatgaatgt

SEQ ID NO: 56132 - DNA, 20 bp, Artificial Sequence
  Description of Artificial Sequence: Synthetic oligonucleotide
  Target: SCN10A; (-) strand; PAM type: YTN; PAM sequence: TTC
taatcacatttgctatgaat

SEQ ID NO: 56133 - DNA, 20 bp, Artificial Sequence
  Description of Artificial Sequence: Synthetic oligonucleotide
  Target: SCN10A; (-) strand; PAM type: YTN; PAM sequence: TTC
accaaaaatataattctaat

SEQ ID NO: 56134 - DNA, 20 bp, Artificial Sequence
  Description of Artificial Sequence: Synthetic oligonucleotide
  Target: SCN10A; (-) strand; PAM type: YTN; PAM sequence: TTT
caccaaaaatataattctaa

SEQ ID NO: 56135 - DNA, 20 bp, Artificial Sequence
  Description of Artificial Sequence: Synthetic oligonucleotide
  Target: SCN10A; (-) strand; PAM type: YTN; PAM sequence: TTA
atatttcaccaaaaatataa

SEQ ID NO: 56136 - DNA, 20 bp, Artificial Sequence
  Description of Artificial Sequence: Synthetic oligonucleotide
  Target: SCN10A; (-) strand; PAM type: YTN; PAM sequence: TTA
ttaatatttcaccaaaaata

SEQ ID NO: 56137 - DNA, 20 bp, Artificial Sequence
  Description of Artificial Sequence: Synthetic oligonucleotide
  Target: SCN10A; (-) strand; PAM type: YTN; PAM sequence: CTA
ttattaatatttcaccaaaa

SEQ ID NO: 56138 - DNA, 20 bp, Artificial Sequence
  Description of Artificial Sequence: Synthetic oligonucleotide
  Target: SCN10A; (-) strand; PAM type: YTN; PAM sequence: CTC
agggccctattattaatatt

SEQ ID NO: 56139 - DNA, 20 bp, Artificial Sequence
  Description of Artificial Sequence: Synthetic oligonucleotide
  Target: SCN10A; (-) strand; PAM type: YTN; PAM sequence: TTC
tcagggccctattattaata

SEQ ID NO: 56140 - DNA, 20 bp, Artificial Sequence
  Description of Artificial Sequence: Synthetic oligonucleotide
  Target: SCN10A; (-) strand; PAM type: YTN; PAM sequence: CTA
gaattctcagggccctatta

SEQ ID NO: 56141 - DNA, 20 bp, Artificial Sequence
  Description of Artificial Sequence: Synthetic oligonucleotide
  Target: SCN10A; (-) strand; PAM type: YTN; PAM sequence: CTC
cagccccaaaagatactaga

SEQ ID NO: 56142 - DNA, 20 bp, Artificial Sequence
  Description of Artificial Sequence: Synthetic oligonucleotide
  Target: SCN10A; (-) strand; PAM type: YTN; PAM sequence: TTG
gtaactccagccccaaaaga

SEQ ID NO: 56143 - DNA, 20 bp, Artificial Sequence
  Description of Artificial Sequence: Synthetic oligonucleotide
  Target: SCN10A; (-) strand; PAM type: YTN; PAM sequence: TTT
ggtaactccagccccaaaag

SEQ ID NO: 56144 - DNA, 20 bp, Artificial Sequence
  Description of Artificial Sequence: Synthetic oligonucleotide
  Target: SCN10A; (-) strand; PAM type: YTN; PAM sequence: CTC
ataaatttggtaactccagc

SEQ ID NO: 56145 - DNA, 20 bp, Artificial Sequence
  Description of Artificial Sequence: Synthetic oligonucleotide
  Target: SCN10A; (-) strand; PAM type: YTN; PAM sequence: TTA
aatctcataaatttggtaac

SEQ ID NO: 56146 - DNA, 20 bp, Artificial Sequence
  Description of Artificial Sequence: Synthetic oligonucleotide
  Target: SCN10A; (-) strand; PAM type: YTN; PAM sequence: TTT
aaatctcataaatttggtaa

SEQ ID NO: 56147 - DNA, 20 bp, Artificial Sequence
  Description of Artificial Sequence: Synthetic oligonucleotide
  Target: SCN10A; (-) strand; PAM type: YTN; PAM sequence: CTG
catttaaatctcataaattt

SEQ ID NO: 56148 - DNA, 20 bp, Artificial Sequence
  Description of Artificial Sequence: Synthetic oligonucleotide
  Target: SCN10A; (-) strand; PAM type: YTN; PAM sequence: CTC
acaaaagtctgcatttaaat

SEQ ID NO: 56149 - DNA, 20 bp, Artificial Sequence
  Description of Artificial Sequence: Synthetic oligonucleotide
  Target: SCN10A; (-) strand; PAM type: YTN; PAM sequence: TTC
ctcacaaaagtctgcattta

SEQ ID NO: 56150 - DNA, 20 bp, Artificial Sequence
  Description of Artificial Sequence: Synthetic oligonucleotide
  Target: SCN10A; (-) strand; PAM type: YTN; PAM sequence: CTT
cctcacaaaagtctgcattt

SEQ ID NO: 56151 - DNA, 20 bp, Artificial Sequence
  Description of Artificial Sequence: Synthetic oligonucleotide
  Target: SCN10A; (-) strand; PAM type: YTN; PAM sequence: CTC
ttcctcacaaaagtctgcat

SEQ ID NO: 56152 - DNA, 20 bp, Artificial Sequence
  Description of Artificial Sequence: Synthetic oligonucleotide
  Target: SCN10A; (-) strand; PAM type: YTN; PAM sequence: TTG
agggggtctcttcctcacaa

SEQ ID NO: 56153 - DNA, 20 bp, Artificial Sequence
  Description of Artificial Sequence: Synthetic oligonucleotide
  Target: SCN10A; (-) strand; PAM type: YTN; PAM sequence: CTG
ttgagggggtctcttcctca

SEQ ID NO: 56154 - DNA, 20 bp, Artificial Sequence
  Description of Artificial Sequence: Synthetic oligonucleotide
  Target: SCN10A; (-) strand; PAM type: YTN; PAM sequence: CTG
gacagaaaagctgttgaggg

SEQ ID NO: 56155 - DNA, 20 bp, Artificial Sequence
  Description of Artificial Sequence: Synthetic oligonucleotide
  Target: SCN10A; (-) strand; PAM type: YTN; PAM sequence: TTG
gtagagtcacagctggacag

SEQ ID NO: 56156 - DNA, 20 bp, Artificial Sequence
  Description of Artificial Sequence: Synthetic oligonucleotide
  Target: SCN10A; (-) strand; PAM type: YTN; PAM sequence: CTT
ggtagagtcacagctggaca

SEQ ID NO: 56157 - DNA, 20 bp, Artificial Sequence
  Description of Artificial Sequence: Synthetic oligonucleotide
  Target: SCN10A; (-) strand; PAM type: YTN; PAM sequence: TTG
cttggtagagtcacagctgg

SEQ ID NO: 56158 - DNA, 20 bp, Artificial Sequence
  Description of Artificial Sequence: Synthetic oligonucleotide
  Target: SCN10A; (-) strand; PAM type: YTN; PAM sequence: TTG
atgagtaaataattgcttgg

SEQ ID NO: 56159 - DNA, 20 bp, Artificial Sequence
  Description of Artificial Sequence: Synthetic oligonucleotide
  Target: SCN10A; (-) strand; PAM type: YTN; PAM sequence: TTT
gatgagtaaataattgcttg

SEQ ID NO: 56160 - DNA, 20 bp, Artificial Sequence
  Description of Artificial Sequence: Synthetic oligonucleotide
  Target: SCN10A; (-) strand; PAM type: YTN; PAM sequence: TTG
agatttgatgagtaaataat

SEQ ID NO: 56161 - DNA, 20 bp, Artificial Sequence
  Description of Artificial Sequence: Synthetic oligonucleotide
  Target: SCN10A; (-) strand; PAM type: YTN; PAM sequence: CTT
gagatttgatgagtaaataa

SEQ ID NO: 56162 - DNA, 20 bp, Artificial Sequence
  Description of Artificial Sequence: Synthetic oligonucleotide
  Target: SCN10A; (-) strand; PAM type: YTN; PAM sequence: TTC
atcttgagatttgatgagta

SEQ ID NO: 56163 - DNA, 20 bp, Artificial Sequence
  Description of Artificial Sequence: Synthetic oligonucleotide
  Target: SCN10A; (-) strand; PAM type: YTN; PAM sequence: CTT
catcttgagatttgatgagt

SEQ ID NO: 56164 - DNA, 20 bp, Artificial Sequence
  Description of Artificial Sequence: Synthetic oligonucleotide
  Target: SCN10A; (-) strand; PAM type: YTN; PAM sequence: CTC
ttcatcttgagatttgatga

SEQ ID NO: 56165 - DNA, 20 bp, Artificial Sequence
  Description of Artificial Sequence: Synthetic oligonucleotide
  Target: SCN10A; (-) strand; PAM type: YTN; PAM sequence: TTC
tcttcatcttgagatttgat

SEQ ID NO: 56166 - DNA, 20 bp, Artificial Sequence
  Description of Artificial Sequence: Synthetic oligonucleotide
  Target: SCN10A; (-) strand; PAM type: YTN; PAM sequence: CTA
aaaagaaccaagtgaccagt

SEQ ID NO: 56167 - DNA, 20 bp, Artificial Sequence
  Description of Artificial Sequence: Synthetic oligonucleotide
  Target: SCN10A; (-) strand; PAM type: YTN; PAM sequence: TTA
gaaataaaatcccctaaaaa

SEQ ID NO: 56168 - DNA, 20 bp, Artificial Sequence
  Description of Artificial Sequence: Synthetic oligonucleotide
  Target: SCN10A; (-) strand; PAM type: YTN; PAM sequence: CTA
attagaaataaaatccccta

SEQ ID NO: 56169 - DNA, 20 bp, Artificial Sequence
  Description of Artificial Sequence: Synthetic oligonucleotide
  Target: SCN10A; (-) strand; PAM type: YTN; PAM sequence: CTG
gataagtaagaaacagctaa

SEQ ID NO: 56170 - DNA, 20 bp, Artificial Sequence
  Description of Artificial Sequence: Synthetic oligonucleotide
  Target: SCN10A; (-) strand; PAM type: YTN; PAM sequence: TTA
catctggataagtaagaaac

SEQ ID NO: 56171 - DNA, 20 bp, Artificial Sequence
  Description of Artificial Sequence: Synthetic oligonucleotide
  Target: SCN10A; (-) strand; PAM type: YTN; PAM sequence: TTG
aattacatctggataagtaa

SEQ ID NO: 56172 - DNA, 20 bp, Artificial Sequence
  Description of Artificial Sequence: Synthetic oligonucleotide
  Target: SCN10A; (-) strand; PAM type: YTN; PAM sequence: CTG
gttgaattacatctggataa

SEQ ID NO: 56173 - DNA, 20 bp, Artificial Sequence
  Description of Artificial Sequence: Synthetic oligonucleotide
  Target: SCN10A; (-) strand; PAM type: YTN; PAM sequence: TTC
tggttgaattacatctggat

SEQ ID NO: 56174 - DNA, 20 bp, Artificial Sequence
  Description of Artificial Sequence: Synthetic oligonucleotide
  Target: SCN10A; (-) strand; PAM type: YTN; PAM sequence: TTA
tggattctggttgaattaca

SEQ ID NO: 56175 - DNA, 20 bp, Artificial Sequence
  Description of Artificial Sequence: Synthetic oligonucleotide
  Target: SCN10A; (-) strand; PAM type: YTN; PAM sequence: TTT
atggattctggttgaattac

SEQ ID NO: 56176 - DNA, 20 bp, Artificial Sequence
  Description of Artificial Sequence: Synthetic oligonucleotide
  Target: SCN10A; (-) strand; PAM type: YTN; PAM sequence: CTT
tatggattctggttgaatta

SEQ ID NO: 56177 - DNA, 20 bp, Artificial Sequence
  Description of Artificial Sequence: Synthetic oligonucleotide
  Target: SCN10A; (-) strand; PAM type: YTN; PAM sequence: CTC
tttatggattctggttgaat

SEQ ID NO: 56178 - DNA, 20 bp, Artificial Sequence
  Description of Artificial Sequence: Synthetic oligonucleotide
  Target: SCN10A; (-) strand; PAM type: YTN; PAM sequence: CTC
ctctttatggattctggttg

SEQ ID NO: 56179 - DNA, 20 bp, Artificial Sequence
  Description of Artificial Sequence: Synthetic oligonucleotide
  Target: SCN10A; (-) strand; PAM type: YTN; PAM sequence: TTA
caaataaagagaaatcacaa

SEQ ID NO: 56180 - DNA, 20 bp, Artificial Sequence
  Description of Artificial Sequence: Synthetic oligonucleotide
  Target: SCN10A; (-) strand; PAM type: YTN; PAM sequence: TTA
catggaaattacaaataaag

SEQ ID NO: 56181 - DNA, 20 bp, Artificial Sequence
  Description of Artificial Sequence: Synthetic oligonucleotide
  Target: SCN10A; (-) strand; PAM type: YTN; PAM sequence: TTC
aaaatatatacaattacatg

SEQ ID NO: 56182 - DNA, 20 bp, Artificial Sequence
  Description of Artificial Sequence: Synthetic oligonucleotide
  Target: SCN10A; (-) strand; PAM type: YTN; PAM sequence: TTT
caaaatatatacaattacat

SEQ ID NO: 56183 - DNA, 20 bp, Artificial Sequence
  Description of Artificial Sequence: Synthetic oligonucleotide
  Target: SCN10A; (-) strand; PAM type: YTN; PAM sequence: TTT
tcaaaatatatacaattaca

SEQ ID NO: 56184 - DNA, 20 bp, Artificial Sequence
  Description of Artificial Sequence: Synthetic oligonucleotide
  Target: SCN10A; (-) strand; PAM type: YTN; PAM sequence: TTT
ttcaaaatatatacaattac

SEQ ID NO: 56185 - DNA, 20 bp, Artificial Sequence
  Description of Artificial Sequence: Synthetic oligonucleotide
  Target: SCN10A; (-) strand; PAM type: YTN; PAM sequence: CTT
tttcaaaatatatacaatta

SEQ ID NO: 56186 - DNA, 20 bp, Artificial Sequence
  Description of Artificial Sequence: Synthetic oligonucleotide
  Target: SCN10A; (-) strand; PAM type: YTN; PAM sequence: TTG
ctttttcaaaatatatacaa

SEQ ID NO: 56187 - DNA, 20 bp, Artificial Sequence
  Description of Artificial Sequence: Synthetic oligonucleotide
  Target: SCN10A; (-) strand; PAM type: YTN; PAM sequence: TTG
ttgctttttcaaaatatata

SEQ ID NO: 56188 - DNA, 20 bp, Artificial Sequence
  Description of Artificial Sequence: Synthetic oligonucleotide
  Target: SCN10A; (-) strand; PAM type: YTN; PAM sequence: TTG
ggtagttgttgctttttcaa

SEQ ID NO: 56189 - DNA, 20 bp, Artificial Sequence
  Description of Artificial Sequence: Synthetic oligonucleotide
  Target: SCN10A; (-) strand; PAM type: YTN; PAM sequence: CTT
gggtagttgttgctttttca

SEQ ID NO: 56190 - DNA, 20 bp, Artificial Sequence
  Description of Artificial Sequence: Synthetic oligonucleotide
  Target: SCN10A; (-) strand; PAM type: YTN; PAM sequence: CTG
cttgggtagttgttgctttt

SEQ ID NO: 56191 - DNA, 20 bp, Artificial Sequence
  Description of Artificial Sequence: Synthetic oligonucleotide
  Target: SCN10A; (-) strand; PAM type: YTN; PAM sequence: CTC
tgcttgggtagttgttgctt

SEQ ID NO: 56192 - DNA, 20 bp, Artificial Sequence
  Description of Artificial Sequence: Synthetic oligonucleotide
  Target: SCN10A; (-) strand; PAM type: YTN; PAM sequence: CTC
aatgtgtcgtctctgcttgg

SEQ ID NO: 56193 - DNA, 20 bp, Artificial Sequence
  Description of Artificial Sequence: Synthetic oligonucleotide
  Target: SCN10A; (-) strand; PAM type: YTN; PAM sequence: CTC
tcaatgtgtcgtctctgctt

SEQ ID NO: 56194 - DNA, 20 bp, Artificial Sequence
  Description of Artificial Sequence: Synthetic oligonucleotide
  Target: SCN10A; (-) strand; PAM type: YTN; PAM sequence: TTC
tctcaatgtgtcgtctctgc

SEQ ID NO: 56195 - DNA, 20 bp, Artificial Sequence
  Description of Artificial Sequence: Synthetic oligonucleotide
  Target: SCN10A; (-) strand; PAM type: YTN; PAM sequence: TTA
ttctctcaatgtgtcgtctc

SEQ ID NO: 56196 - DNA, 20 bp, Artificial Sequence
  Description of Artificial Sequence: Synthetic oligonucleotide
  Target: SCN10A; (-) strand; PAM type: YTN; PAM sequence: CTA
cagtgaggaagtagggtgga

SEQ ID NO: 56197 - DNA, 20 bp, Artificial Sequence
  Description of Artificial Sequence: Synthetic oligonucleotide
  Target: SCN10A; (-) strand; PAM type: YTN; PAM sequence: CTG
cgtagagcagtatctacagt

SEQ ID NO: 56198 - DNA, 20 bp, Artificial Sequence
  Description of Artificial Sequence: Synthetic oligonucleotide
  Target: SCN10A; (-) strand; PAM type: YTN; PAM sequence: CTG
catcctgcgtagagcagtat

SEQ ID NO: 56199 - DNA, 20 bp, Artificial Sequence
  Description of Artificial Sequence: Synthetic oligonucleotide
  Target: SCN10A; (-) strand; PAM type: YTN; PAM sequence: TTA
agaagtccagcctgcatcct

SEQ ID NO: 56200 - DNA, 20 bp, Artificial Sequence
  Description of Artificial Sequence: Synthetic oligonucleotide
  Target: SCN10A; (-) strand; PAM type: YTN; PAM sequence: CTA
gttaagaagtccagcctgca

SEQ ID NO: 56201 - DNA, 20 bp, Artificial Sequence
  Description of Artificial Sequence: Synthetic oligonucleotide
  Target: SCN10A; (-) strand; PAM type: YTN; PAM sequence: TTA
tccaagaccatgtagctagt

SEQ ID NO: 56202 - DNA, 20 bp, Artificial Sequence
  Description of Artificial Sequence: Synthetic oligonucleotide
  Target: SCN10A; (-) strand; PAM type: YTN; PAM sequence: TTA
agtaaattatccaagaccat

SEQ ID NO: 56203 - DNA, 20 bp, Artificial Sequence
  Description of Artificial Sequence: Synthetic oligonucleotide
  Target: SCN10A; (-) strand; PAM type: YTN; PAM sequence: CTG
acacacagaggcattaagta

SEQ ID NO: 56204 - DNA, 20 bp, Artificial Sequence
  Description of Artificial Sequence: Synthetic oligonucleotide
  Target: SCN10A; (-) strand; PAM type: YTN; PAM sequence: TTA
cagataatgaaactgacaca

SEQ ID NO: 56205 - DNA, 20 bp, Artificial Sequence
  Description of Artificial Sequence: Synthetic oligonucleotide
  Target: SCN10A; (-) strand; PAM type: YTN; PAM sequence: TTT
acagataatgaaactgacac

SEQ ID NO: 56206 - DNA, 20 bp, Artificial Sequence
  Description of Artificial Sequence: Synthetic oligonucleotide
  Target: SCN10A; (-) strand; PAM type: YTN; PAM sequence: TTT
tacagataatgaaactgaca

SEQ ID NO: 56207 - DNA, 20 bp, Artificial Sequence
  Description of Artificial Sequence: Synthetic oligonucleotide
  Target: SCN10A; (-) strand; PAM type: YTN; PAM sequence: TTA
ccatccccattttacagata

SEQ ID NO: 56208 - DNA, 20 bp, Artificial Sequence
  Description of Artificial Sequence: Synthetic oligonucleotide
  Target: SCN10A; (-) strand; PAM type: YTN; PAM sequence: CTG
aagtagagattaccatcccc

SEQ ID NO: 56209 - DNA, 20 bp, Artificial Sequence
  Description of Artificial Sequence: Synthetic oligonucleotide
  Target: SCN10A; (-) strand; PAM type: YTN; PAM sequence: CTC
tgaagtagagattaccatcc

SEQ ID NO: 56210 - DNA, 20 bp, Artificial Sequence
  Description of Artificial Sequence: Synthetic oligonucleotide
  Target: SCN10A; (-) strand; PAM type: YTN; PAM sequence: TTC
aaaagcctctgaagtagaga

SEQ ID NO: 56211 - DNA, 20 bp, Artificial Sequence
  Description of Artificial Sequence: Synthetic oligonucleotide
  Target: SCN10A; (-) strand; PAM type: YTN; PAM sequence: CTA
agtgtcaataccatcatcag

SEQ ID NO: 56212 - DNA, 20 bp, Artificial Sequence
  Description of Artificial Sequence: Synthetic oligonucleotide
  Target: SCN10A; (-) strand; PAM type: YTN; PAM sequence: TTC
ctaagtgtcaataccatcat

SEQ ID NO: 56213 - DNA, 20 bp, Artificial Sequence
  Description of Artificial Sequence: Synthetic oligonucleotide
  Target: SCN10A; (-) strand; PAM type: YTN; PAM sequence: CTT
cctaagtgtcaataccatca

SEQ ID NO: 56214 - DNA, 20 bp, Artificial Sequence
  Description of Artificial Sequence: Synthetic oligonucleotide
  Target: SCN10A; (-) strand; PAM type: YTN; PAM sequence: CTA
aatacttcctaagtgtcaat

SEQ ID NO: 56215 - DNA, 20 bp, Artificial Sequence
  Description of Artificial Sequence: Synthetic oligonucleotide
  Target: SCN10A; (-) strand; PAM type: YTN; PAM sequence: TTG
ctaaatacttcctaagtgtc

SEQ ID NO: 56216 - DNA, 20 bp, Artificial Sequence
  Description of Artificial Sequence: Synthetic oligonucleotide
  Target: SCN10A; (-) strand; PAM type: YTN; PAM sequence: CTT
gctaaatacttcctaagtgt

SEQ ID NO: 56217 - DNA, 20 bp, Artificial Sequence
  Description of Artificial Sequence: Synthetic oligonucleotide
  Target: SCN10A; (-) strand; PAM type: YTN; PAM sequence: CTC
acttgctaaatacttcctaa

SEQ ID NO: 56218 - DNA, 20 bp, Artificial Sequence
  Description of Artificial Sequence: Synthetic oligonucleotide
  Target: SCN10A; (-) strand; PAM type: YTN; PAM sequence: CTC
tcacttgctaaatacttcct

SEQ ID NO: 56219 - DNA, 20 bp, Artificial Sequence
  Description of Artificial Sequence: Synthetic oligonucleotide
  Target: SCN10A; (-) strand; PAM type: YTN; PAM sequence: TTA
atgacaatacagtctctcac

SEQ ID NO: 56220 - DNA, 20 bp, Artificial Sequence
  Description of Artificial Sequence: Synthetic oligonucleotide
  Target: SCN10A; (-) strand; PAM type: YTN; PAM sequence: TTT
aatgacaatacagtctctca

SEQ ID NO: 56221 - DNA, 20 bp, Artificial Sequence
  Description of Artificial Sequence: Synthetic oligonucleotide
  Target: SCN10A; (-) strand; PAM type: YTN; PAM sequence: CTA
cagaaggatatttaatgaca

SEQ ID NO: 56222 - DNA, 20 bp, Artificial Sequence
  Description of Artificial Sequence: Synthetic oligonucleotide
  Target: SCN10A; (-) strand; PAM type: YTN; PAM sequence: TTC
tacagaaggatatttaatga

SEQ ID NO: 56223 - DNA, 20 bp, Artificial Sequence
  Description of Artificial Sequence: Synthetic oligonucleotide
  Target: SCN10A; (-) strand; PAM type: YTN; PAM sequence: TTC
agattctacagaaggatatt

SEQ ID NO: 56224 - DNA, 20 bp, Artificial Sequence
  Description of Artificial Sequence: Synthetic oligonucleotide
  Target: SCN10A; (-) strand; PAM type: YTN; PAM sequence: TTT
cagattctacagaaggatat

SEQ ID NO: 56225 - DNA, 20 bp, Artificial Sequence
  Description of Artificial Sequence: Synthetic oligonucleotide
  Target: SCN10A; (-) strand; PAM type: YTN; PAM sequence: TTT
tcagattctacagaaggata

SEQ ID NO: 56226 - DNA, 20 bp, Artificial Sequence
  Description of Artificial Sequence: Synthetic oligonucleotide
  Target: SCN10A; (-) strand; PAM type: YTN; PAM sequence: TTG
aattttcagattctacagaa

SEQ ID NO: 56227 - DNA, 20 bp, Artificial Sequence
  Description of Artificial Sequence: Synthetic oligonucleotide
  Target: SCN10A; (-) strand; PAM type: YTN; PAM sequence: CTT
gaattttcagattctacaga

SEQ ID NO: 56228 - DNA, 20 bp, Artificial Sequence
  Description of Artificial Sequence: Synthetic oligonucleotide
  Target: SCN10A; (-) strand; PAM type: YTN; PAM sequence: CTG
aatcttgaattttcagattc

SEQ ID NO: 56229 - DNA, 20 bp, Artificial Sequence
  Description of Artificial Sequence: Synthetic oligonucleotide
  Target: SCN10A; (-) strand; PAM type: YTN; PAM sequence: CTG
agctgaatcttgaattttca

SEQ ID NO: 56230 - DNA, 20 bp, Artificial Sequence
  Description of Artificial Sequence: Synthetic oligonucleotide
  Target: SCN10A; (-) strand; PAM type: YTN; PAM sequence: TTC
tgagctgaatcttgaatttt

SEQ ID NO: 56231 - DNA, 20 bp, Artificial Sequence
  Description of Artificial Sequence: Synthetic oligonucleotide
  Target: SCN10A; (-) strand; PAM type: YTN; PAM sequence: TTT
ctgagctgaatcttgaattt

SEQ ID NO: 56232 - DNA, 20 bp, Artificial Sequence
  Description of Artificial Sequence: Synthetic oligonucleotide
  Target: SCN10A; (-) strand; PAM type: YTN; PAM sequence: TTT
tctgagctgaatcttgaatt

SEQ ID NO: 56233 - DNA, 20 bp, Artificial Sequence
  Description of Artificial Sequence: Synthetic oligonucleotide
  Target: SCN10A; (-) strand; PAM type: YTN; PAM sequence: TTA
cgttttctgagctgaatctt

SEQ ID NO: 56234 - DNA, 20 bp, Artificial Sequence
  Description of Artificial Sequence: Synthetic oligonucleotide
  Target: SCN10A; (-) strand; PAM type: YTN; PAM sequence: CTG
gccagcaagaattacgtttt

SEQ ID NO: 56235 - DNA, 20 bp, Artificial Sequence
  Description of Artificial Sequence: Synthetic oligonucleotide
  Target: SCN10A; (-) strand; PAM type: YTN; PAM sequence: CTG
gctggccagcaagaattacg

SEQ ID NO: 56236 - DNA, 20 bp, Artificial Sequence
  Description of Artificial Sequence: Synthetic oligonucleotide
  Target: SCN10A; (-) strand; PAM type: YTN; PAM sequence: TTC
tggctggccagcaagaatta

SEQ ID NO: 56237 - DNA, 20 bp, Artificial Sequence
  Description of Artificial Sequence: Synthetic oligonucleotide
  Target: SCN10A; (-) strand; PAM type: YTN; PAM sequence: TTT
ctggctggccagcaagaatt

SEQ ID NO: 56238 - DNA, 20 bp, Artificial Sequence
  Description of Artificial Sequence: Synthetic oligonucleotide
  Target: SCN10A; (-) strand; PAM type: YTN; PAM sequence: CTT
tctggctggccagcaagaat

SEQ ID NO: 56239 - DNA, 20 bp, Artificial Sequence
  Description of Artificial Sequence: Synthetic oligonucleotide
  Target: SCN10A; (-) strand; PAM type: YTN; PAM sequence: TTC
tttctggctggccagcaaga

SEQ ID NO: 56240 - DNA, 20 bp, Artificial Sequence
  Description of Artificial Sequence: Synthetic oligonucleotide
  Target: SCN10A; (-) strand; PAM type: YTN; PAM sequence: TTT
ctttctggctggccagcaag

SEQ ID NO: 56241 - DNA, 20 bp, Artificial Sequence
  Description of Artificial Sequence: Synthetic oligonucleotide
  Target: SCN10A; (-) strand; PAM type: YTN; PAM sequence: TTT
tctttctggctggccagcaa

SEQ ID NO: 56242 - DNA, 20 bp, Artificial Sequence
  Description of Artificial Sequence: Synthetic oligonucleotide
  Target: SCN10A; (-) strand; PAM type: YTN; PAM sequence: TTT
ttctttctggctggccagca

SEQ ID NO: 56243 - DNA, 20 bp, Artificial Sequence
  Description of Artificial Sequence: Synthetic oligonucleotide
  Target: SCN10A; (-) strand; PAM type: YTN; PAM sequence: TTT
tttctttctggctggccagc

SEQ ID NO: 56244 - DNA, 20 bp, Artificial Sequence
  Description of Artificial Sequence: Synthetic oligonucleotide
  Target: SCN10A; (-) strand; PAM type: YTN; PAM sequence: TTT
ttttctttctggctggccag

SEQ ID NO: 56245 - DNA, 20 bp, Artificial Sequence
  Description of Artificial Sequence: Synthetic oligonucleotide
  Target: SCN10A; (-) strand; PAM type: YTN; PAM sequence: TTA
catttttttctttctggctg

SEQ ID NO: 56246 - DNA, 20 bp, Artificial Sequence
  Description of Artificial Sequence: Synthetic oligonucleotide
  Target: SCN10A; (-) strand; PAM type: YTN; PAM sequence: TTT
acatttttttctttctggct

SEQ ID NO: 56247 - DNA, 20 bp, Artificial Sequence
  Description of Artificial Sequence: Synthetic oligonucleotide
  Target: SCN10A; (-) strand; PAM type: YTN; PAM sequence: TTT
tacatttttttctttctggc

SEQ ID NO: 56248 - DNA, 20 bp, Artificial Sequence
  Description of Artificial Sequence: Synthetic oligonucleotide
  Target: SCN10A; (-) strand; PAM type: YTN; PAM sequence: TTT
ttacatttttttctttctgg

SEQ ID NO: 56249 - DNA, 20 bp, Artificial Sequence
  Description of Artificial Sequence: Synthetic oligonucleotide
  Target: SCN10A; (-) strand; PAM type: YTN; PAM sequence: CTT
tttacatttttttctttctg

SEQ ID NO: 56250 - DNA, 20 bp, Artificial Sequence
  Description of Artificial Sequence: Synthetic oligonucleotide
  Target: SCN10A; (-) strand; PAM type: YTN; PAM sequence: CTC
tttttacatttttttctttc

SEQ ID NO: 56251 - DNA, 20 bp, Artificial Sequence
  Description of Artificial Sequence: Synthetic oligonucleotide
  Target: SCN10A; (-) strand; PAM type: YTN; PAM sequence: TTC
tctttttacatttttttctt

SEQ ID NO: 56252 - DNA, 20 bp, Artificial Sequence
  Description of Artificial Sequence: Synthetic oligonucleotide
  Target: SCN10A; (-) strand; PAM type: YTN; PAM sequence: TTT
ctctttttacatttttttct

SEQ ID NO: 56253 - DNA, 20 bp, Artificial Sequence
  Description of Artificial Sequence: Synthetic oligonucleotide
  Target: SCN10A; (-) strand; PAM type: YTN; PAM sequence: TTT
tctctttttacatttttttc

SEQ ID NO: 56254 - DNA, 20 bp, Artificial Sequence
  Description of Artificial Sequence: Synthetic oligonucleotide
  Target: SCN10A; (-) strand; PAM type: YTN; PAM sequence: TTA
cgttttctctttttacattt

SEQ ID NO: 56255 - DNA, 20 bp, Artificial Sequence
  Description of Artificial Sequence: Synthetic oligonucleotide
  Target: SCN10A; (-) strand; PAM type: YTN; PAM sequence: TTG
cattacgttttctcttttta

SEQ ID NO: 56256 - DNA, 20 bp, Artificial Sequence
  Description of Artificial Sequence: Synthetic oligonucleotide
  Target: SCN10A; (-) strand; PAM type: YTN; PAM sequence: TTG
atgaagttgcattacgtttt

SEQ ID NO: 56257 - DNA, 20 bp, Artificial Sequence
  Description of Artificial Sequence: Synthetic oligonucleotide
  Target: SCN10A; (-) strand; PAM type: YTN; PAM sequence: CTT
gatgaagttgcattacgttt

SEQ ID NO: 56258 - DNA, 20 bp, Artificial Sequence
  Description of Artificial Sequence: Synthetic oligonucleotide
  Target: SCN10A; (-) strand; PAM type: YTN; PAM sequence: CTG
cacagcttgatgaagttgca

SEQ ID NO: 56259 - DNA, 20 bp, Artificial Sequence
  Description of Artificial Sequence: Synthetic oligonucleotide
  Target: SCN10A; (-) strand; PAM type: YTN; PAM sequence: CTC
aacatgaagctgcacagctt

SEQ ID NO: 56260 - DNA, 20 bp, Artificial Sequence
  Description of Artificial Sequence: Synthetic oligonucleotide
  Target: SCN10A; (-) strand; PAM type: YTN; PAM sequence: CTG
cacactcaacatgaagctgc

SEQ ID NO: 56261 - DNA, 20 bp, Artificial Sequence
  Description of Artificial Sequence: Synthetic oligonucleotide
  Target: SCN10A; (-) strand; PAM type: YTN; PAM sequence: CTA
tctgcacactcaacatgaag

SEQ ID NO: 56262 - DNA, 20 bp, Artificial Sequence
  Description of Artificial Sequence: Synthetic oligonucleotide
  Target: SCN10A; (-) strand; PAM type: YTN; PAM sequence: TTG
gcacagtcatctatctgcac

SEQ ID NO: 56263 - DNA, 20 bp, Artificial Sequence
  Description of Artificial Sequence: Synthetic oligonucleotide
  Target: SCN10A; (-) strand; PAM type: YTN; PAM sequence: CTT
ggcacagtcatctatctgca

SEQ ID NO: 56264 - DNA, 20 bp, Artificial Sequence
  Description of Artificial Sequence: Synthetic oligonucleotide
  Target: SCN10A; (-) strand; PAM type: YTN; PAM sequence: CTG
gtaaccttggcacagtcatc

SEQ ID NO: 56265 - DNA, 20 bp, Artificial Sequence
  Description of Artificial Sequence: Synthetic oligonucleotide
  Target: SCN10A; (-) strand; PAM type: YTN; PAM sequence: TTG
agctggtaaccttggcacag

SEQ ID NO: 56266 - DNA, 20 bp, Artificial Sequence
  Description of Artificial Sequence: Synthetic oligonucleotide
  Target: SCN10A; (-) strand; PAM type: YTN; PAM sequence: TTG
tcattgagctggtaaccttg

SEQ ID NO: 56267 - DNA, 20 bp, Artificial Sequence
  Description of Artificial Sequence: Synthetic oligonucleotide
  Target: SCN10A; (-) strand; PAM type: YTN; PAM sequence: CTG
gacagttgtcattgagctgg

SEQ ID NO: 56268 - DNA, 20 bp, Artificial Sequence
  Description of Artificial Sequence: Synthetic oligonucleotide
  Target: SCN10A; (-) strand; PAM type: YTN; PAM sequence: TTC
tggacagttgtcattgagct

SEQ ID NO: 56269 - DNA, 20 bp, Artificial Sequence
  Description of Artificial Sequence: Synthetic oligonucleotide
  Target: SCN10A; (-) strand; PAM type: YTN; PAM sequence: TTT
ctggacagttgtcattgagc

SEQ ID NO: 56270 - DNA, 20 bp, Artificial Sequence
  Description of Artificial Sequence: Synthetic oligonucleotide
  Target: SCN10A; (-) strand; PAM type: YTN; PAM sequence: TTG
gatttctggacagttgtcat

SEQ ID NO: 56271 - DNA, 20 bp, Artificial Sequence
  Description of Artificial Sequence: Synthetic oligonucleotide
  Target: SCN10A; (-) strand; PAM type: YTN; PAM sequence: TTG
ttggatttctggacagttgt

SEQ ID NO: 56272 - DNA, 20 bp, Artificial Sequence
  Description of Artificial Sequence: Synthetic oligonucleotide
  Target: SCN10A; (-) strand; PAM type: YTN; PAM sequence: CTG
aggcagattgttggatttct

SEQ ID NO: 56273 - DNA, 20 bp, Artificial Sequence
  Description of Artificial Sequence: Synthetic oligonucleotide
  Target: SCN10A; (-) strand; PAM type: YTN; PAM sequence: CTC
tgaggcagattgttggattt

SEQ ID NO: 56274 - DNA, 20 bp, Artificial Sequence
  Description of Artificial Sequence: Synthetic oligonucleotide
  Target: SCN10A; (-) strand; PAM type: YTN; PAM sequence: CTA
actctgaggcagattgttgg

SEQ ID NO: 56275 - DNA, 20 bp, Artificial Sequence
  Description of Artificial Sequence: Synthetic oligonucleotide
  Target: SCN10A; (-) strand; PAM type: YTN; PAM sequence: CTC
cctaactctgaggcagattg

SEQ ID NO: 56276 - DNA, 20 bp, Artificial Sequence
  Description of Artificial Sequence: Synthetic oligonucleotide
  Target: SCN10A; (-) strand; PAM type: YTN; PAM sequence: CTG
ctccctaactctgaggcaga

SEQ ID NO: 56277 - DNA, 20 bp, Artificial Sequence
  Description of Artificial Sequence: Synthetic oligonucleotide
  Target: SCN10A; (-) strand; PAM type: YTN; PAM sequence: CTA
ccctgctccctaactctgag

SEQ ID NO: 56278 - DNA, 20 bp, Artificial Sequence
  Description of Artificial Sequence: Synthetic oligonucleotide
  Target: SCN10A; (-) strand; PAM type: YTN; PAM sequence: TTC
taccctgctccctaactctg

SEQ ID NO: 56279 - DNA, 20 bp, Artificial Sequence
  Description of Artificial Sequence: Synthetic oligonucleotide
  Target: SCN10A; (-) strand; PAM type: YTN; PAM sequence: TTC
agtaaaaaagagttctaccc

SEQ ID NO: 56280 - DNA, 20 bp, Artificial Sequence
  Description of Artificial Sequence: Synthetic oligonucleotide
  Target: SCN10A; (-) strand; PAM type: YTN; PAM sequence: CTT
cagtaaaaaagagttctacc

SEQ ID NO: 56281 - DNA, 20 bp, Artificial Sequence
  Description of Artificial Sequence: Synthetic oligonucleotide
  Target: SCN10A; (-) strand; PAM type: YTN; PAM sequence: TTA
gaaggcttcagtaaaaaaga

SEQ ID NO: 56282 - DNA, 20 bp, Artificial Sequence
  Description of Artificial Sequence: Synthetic oligonucleotide
  Target: SCN10A; (-) strand; PAM type: YTN; PAM sequence: CTT
agaaggcttcagtaaaaaag

SEQ ID NO: 56283 - DNA, 20 bp, Artificial Sequence
  Description of Artificial Sequence: Synthetic oligonucleotide
  Target: SCN10A; (-) strand; PAM type: YTN; PAM sequence: TTC
ttagaaggcttcagtaaaaa

SEQ ID NO: 56284 - DNA, 20 bp, Artificial Sequence
  Description of Artificial Sequence: Synthetic oligonucleotide
  Target: SCN10A; (-) strand; PAM type: YTN; PAM sequence: TTT
cttagaaggcttcagtaaaa

SEQ ID NO: 56285 - DNA, 20 bp, Artificial Sequence
  Description of Artificial Sequence: Synthetic oligonucleotide
  Target: SCN10A; (-) strand; PAM type: YTN; PAM sequence: TTT
tcttagaaggcttcagtaaa

SEQ ID NO: 56286 - DNA, 20 bp, Artificial Sequence
  Description of Artificial Sequence: Synthetic oligonucleotide
  Target: SCN10A; (-) strand; PAM type: YTN; PAM sequence: CTT
ttcttagaaggcttcagtaa

SEQ ID NO: 56287 - DNA, 20 bp, Artificial Sequence
  Description of Artificial Sequence: Synthetic oligonucleotide
  Target: SCN10A; (-) strand; PAM type: YTN; PAM sequence: CTG
acaaatggtaaccagccttt

SEQ ID NO: 56288 - DNA, 20 bp, Artificial Sequence
  Description of Artificial Sequence: Synthetic oligonucleotide
  Target: SCN10A; (-) strand; PAM type: YTN; PAM sequence: TTG
cctgacaaatggtaaccagc

SEQ ID NO: 56289 - DNA, 20 bp, Artificial Sequence
  Description of Artificial Sequence: Synthetic oligonucleotide
  Target: SCN10A; (-) strand; PAM type: YTN; PAM sequence: CTC
agttgcctgacaaatggtaa

SEQ ID NO: 56290 - DNA, 20 bp, Artificial Sequence
  Description of Artificial Sequence: Synthetic oligonucleotide
  Target: SCN10A; (-) strand; PAM type: YTN; PAM sequence: CTG
cctcagttgcctgacaaatg

SEQ ID NO: 56291 - DNA, 20 bp, Artificial Sequence
  Description of Artificial Sequence: Synthetic oligonucleotide
  Target: SCN10A; (-) strand; PAM type: YTN; PAM sequence: TTG
atgtacaagaatacacctgc

SEQ ID NO: 56292 - DNA, 20 bp, Artificial Sequence
  Description of Artificial Sequence: Synthetic oligonucleotide
  Target: SCN10A; (-) strand; PAM type: YTN; PAM sequence: TTG
caggaggttgatgtacaaga

SEQ ID NO: 56293 - DNA, 20 bp, Artificial Sequence
  Description of Artificial Sequence: Synthetic oligonucleotide
  Target: SCN10A; (-) strand; PAM type: YTN; PAM sequence: CTT
gcaggaggttgatgtacaag

SEQ ID NO: 56294 - DNA, 20 bp, Artificial Sequence
  Description of Artificial Sequence: Synthetic oligonucleotide
  Target: SCN10A; (-) strand; PAM type: YTN; PAM sequence: CTG
gcttgcaggaggttgatgta

SEQ ID NO: 56295 - DNA, 20 bp, Artificial Sequence
  Description of Artificial Sequence: Synthetic oligonucleotide
  Target: SCN10A; (-) strand; PAM type: YTN; PAM sequence: TTA
gccctggcttgcaggaggtt

SEQ ID NO: 56296 - DNA, 20 bp, Artificial Sequence
  Description of Artificial Sequence: Synthetic oligonucleotide
  Target: SCN10A; (-) strand; PAM type: YTN; PAM sequence: TTT
agccctggcttgcaggaggt

SEQ ID NO: 56297 - DNA, 20 bp, Artificial Sequence
  Description of Artificial Sequence: Synthetic oligonucleotide
  Target: SCN10A; (-) strand; PAM type: YTN; PAM sequence: TTA
tgacaaatttagccctggct

SEQ ID NO: 56298 - DNA, 20 bp, Artificial Sequence
  Description of Artificial Sequence: Synthetic oligonucleotide
  Target: SCN10A; (-) strand; PAM type: YTN; PAM sequence: TTT
atgacaaatttagccctggc

SEQ ID NO: 56299 - DNA, 20 bp, Artificial Sequence
  Description of Artificial Sequence: Synthetic oligonucleotide
  Target: SCN10A; (-) strand; PAM type: YTN; PAM sequence: CTT
tatgacaaatttagccctgg

SEQ ID NO: 56300 - DNA, 20 bp, Artificial Sequence
  Description of Artificial Sequence: Synthetic oligonucleotide
  Target: SCN10A; (-) strand; PAM type: YTN; PAM sequence: TTC
tttatgacaaatttagccct

SEQ ID NO: 56301 - DNA, 20 bp, Artificial Sequence
  Description of Artificial Sequence: Synthetic oligonucleotide
  Target: SCN10A; (-) strand; PAM type: YTN; PAM sequence: TTG
gaagttctttatgacaaatt

SEQ ID NO: 56302 - DNA, 20 bp, Artificial Sequence
  Description of Artificial Sequence: Synthetic oligonucleotide
  Target: SCN10A; (-) strand; PAM type: YTN; PAM sequence: TTG
gtcatcggaaggattggaag

SEQ ID NO: 56303 - DNA, 20 bp, Artificial Sequence
  Description of Artificial Sequence: Synthetic oligonucleotide
  Target: SCN10A; (-) strand; PAM type: YTN; PAM sequence: CTT
ggtcatcggaaggattggaa

SEQ ID NO: 56304 - DNA, 20 bp, Artificial Sequence
  Description of Artificial Sequence: Synthetic oligonucleotide
  Target: SCN10A; (-) strand; PAM type: YTN; PAM sequence: CTA
agatccttggtcatcggaag

SEQ ID NO: 56305 - DNA, 20 bp, Artificial Sequence
  Description of Artificial Sequence: Synthetic oligonucleotide
  Target: SCN10A; (-) strand; PAM type: YTN; PAM sequence: CTA
atgacctaagatccttggtc

SEQ ID NO: 56306 - DNA, 20 bp, Artificial Sequence
  Description of Artificial Sequence: Synthetic oligonucleotide
  Target: SCN10A; (-) strand; PAM type: YTN; PAM sequence: CTA
atggaaagatcctaatgacc

SEQ ID NO: 56307 - DNA, 20 bp, Artificial Sequence
  Description of Artificial Sequence: Synthetic oligonucleotide
  Target: SCN10A; (-) strand; PAM type: YTN; PAM sequence: CTG
ggtgatcctaatggaaagat

SEQ ID NO: 56308 - DNA, 20 bp, Artificial Sequence
  Description of Artificial Sequence: Synthetic oligonucleotide
  Target: SCN10A; (-) strand; PAM type: YTN; PAM sequence: TTC
ctgggtgatcctaatggaaa

SEQ ID NO: 56309 - DNA, 20 bp, Artificial Sequence
  Description of Artificial Sequence: Synthetic oligonucleotide
  Target: SCN10A; (-) strand; PAM type: YTN; PAM sequence: CTT
cctgggtgatcctaatggaa

SEQ ID NO: 56310 - DNA, 20 bp, Artificial Sequence
  Description of Artificial Sequence: Synthetic oligonucleotide
  Target: SCN10A; (-) strand; PAM type: YTN; PAM sequence: CTA
agatcttcctgggtgatcct

SEQ ID NO: 56311 - DNA, 20 bp, Artificial Sequence
  Description of Artificial Sequence: Synthetic oligonucleotide
  Target: SCN10A; (-) strand; PAM type: YTN; PAM sequence: TTC
ctaagatcttcctgggtgat

SEQ ID NO: 56312 - DNA, 20 bp, Artificial Sequence
  Description of Artificial Sequence: Synthetic oligonucleotide
  Target: SCN10A; (-) strand; PAM type: YTN; PAM sequence: TTT
cctaagatcttcctgggtga

SEQ ID NO: 56313 - DNA, 20 bp, Artificial Sequence
  Description of Artificial Sequence: Synthetic oligonucleotide
  Target: SCN10A; (-) strand; PAM type: YTN; PAM sequence: TTG
gtttcctaagatcttcctgg

SEQ ID NO: 56314 - DNA, 20 bp, Artificial Sequence
  Description of Artificial Sequence: Synthetic oligonucleotide
  Target: SCN10A; (-) strand; PAM type: YTN; PAM sequence: TTT
ggtttcctaagatcttcctg

SEQ ID NO: 56315 - DNA, 20 bp, Artificial Sequence
  Description of Artificial Sequence: Synthetic oligonucleotide
  Target: SCN10A; (-) strand; PAM type: YTN; PAM sequence: TTG
gtttggtttcctaagatctt

SEQ ID NO: 56316 - DNA, 20 bp, Artificial Sequence
  Description of Artificial Sequence: Synthetic oligonucleotide
  Target: SCN10A; (-) strand; PAM type: YTN; PAM sequence: TTT
ggtttggtttcctaagatct

SEQ ID NO: 56317 - DNA, 20 bp, Artificial Sequence
  Description of Artificial Sequence: Synthetic oligonucleotide
  Target: SCN10A; (-) strand; PAM type: YTN; PAM sequence: CTT
tggtttggtttcctaagatc

SEQ ID NO: 56318 - DNA, 20 bp, Artificial Sequence
  Description of Artificial Sequence: Synthetic oligonucleotide
  Target: SCN10A; (-) strand; PAM type: YTN; PAM sequence: CTA
gtagaaaaaagatactttgg

SEQ ID NO: 56319 - DNA, 20 bp, Artificial Sequence
  Description of Artificial Sequence: Synthetic oligonucleotide
  Target: SCN10A; (-) strand; PAM type: YTN; PAM sequence: TTG
caaggcaagccaaactagta

SEQ ID NO: 56320 - DNA, 20 bp, Artificial Sequence
  Description of Artificial Sequence: Synthetic oligonucleotide
  Target: SCN10A; (-) strand; PAM type: YTN; PAM sequence: TTT
gcaaggcaagccaaactagt

SEQ ID NO: 56321 - DNA, 20 bp, Artificial Sequence
  Description of Artificial Sequence: Synthetic oligonucleotide
  Target: SCN10A; (-) strand; PAM type: YTN; PAM sequence: TTT
tgcaaggcaagccaaactag

SEQ ID NO: 56322 - DNA, 20 bp, Artificial Sequence
  Description of Artificial Sequence: Synthetic oligonucleotide
  Target: SCN10A; (-) strand; PAM type: YTN; PAM sequence: TTC
aggggattttgcaaggcaag

SEQ ID NO: 56323 - DNA, 20 bp, Artificial Sequence
  Description of Artificial Sequence: Synthetic oligonucleotide
  Target: SCN10A; (-) strand; PAM type: YTN; PAM sequence: TTT
caggggattttgcaaggcaa

SEQ ID NO: 56324 - DNA, 20 bp, Artificial Sequence
  Description of Artificial Sequence: Synthetic oligonucleotide
  Target: SCN10A; (-) strand; PAM type: YTN; PAM sequence: CTT
tcaggggattttgcaaggca

SEQ ID NO: 56325 - DNA, 20 bp, Artificial Sequence
  Description of Artificial Sequence: Synthetic oligonucleotide
  Target: SCN10A; (-) strand; PAM type: YTN; PAM sequence: CTG
ctttcaggggattttgcaag

SEQ ID NO: 56326 - DNA, 20 bp, Artificial Sequence
  Description of Artificial Sequence: Synthetic oligonucleotide
  Target: SCN10A; (-) strand; PAM type: YTN; PAM sequence: TTA
ggtaatgtcagaagctgctt

SEQ ID NO: 56327 - DNA, 20 bp, Artificial Sequence
  Description of Artificial Sequence: Synthetic oligonucleotide
  Target: SCN10A; (-) strand; PAM type: YTN; PAM sequence: TTT
aggtaatgtcagaagctgct

SEQ ID NO: 56328 - DNA, 20 bp, Artificial Sequence
  Description of Artificial Sequence: Synthetic oligonucleotide
  Target: SCN10A; (-) strand; PAM type: YTN; PAM sequence: TTT
taggtaatgtcagaagctgc

SEQ ID NO: 56329 - DNA, 20 bp, Artificial Sequence
  Description of Artificial Sequence: Synthetic oligonucleotide
  Target: SCN10A; (-) strand; PAM type: YTN; PAM sequence: TTG
ttttaggtaatgtcagaagc

SEQ ID NO: 56330 - DNA, 20 bp, Artificial Sequence
  Description of Artificial Sequence: Synthetic oligonucleotide
  Target: SCN10A; (-) strand; PAM type: YTN; PAM sequence: CTA
tatgaattgttttaggtaat

SEQ ID NO: 56331 - DNA, 20 bp, Artificial Sequence
  Description of Artificial Sequence: Synthetic oligonucleotide
  Target: SCN10A; (-) strand; PAM type: YTN; PAM sequence: CTA
ctatatgaattgttttaggt

SEQ ID NO: 56332 - DNA, 20 bp, Artificial Sequence
  Description of Artificial Sequence: Synthetic oligonucleotide
  Target: SCN10A; (-) strand; PAM type: YTN; PAM sequence: TTG
gtcaaatgtctactatatga

SEQ ID NO: 56333 - DNA, 20 bp, Artificial Sequence
  Description of Artificial Sequence: Synthetic oligonucleotide
  Target: SCN10A; (-) strand; PAM type: YTN; PAM sequence: TTA
gagacacattggtcaaatgt

SEQ ID NO: 56334 - DNA, 20 bp, Artificial Sequence
  Description of Artificial Sequence: Synthetic oligonucleotide
  Target: SCN10A; (-) strand; PAM type: YTN; PAM sequence: CTG
taatgattagagacacattg

SEQ ID NO: 56335 - DNA, 20 bp, Artificial Sequence
  Description of Artificial Sequence: Synthetic oligonucleotide
  Target: SCN10A; (-) strand; PAM type: YTN; PAM sequence: TTC
atgccatacaagactgtaat

SEQ ID NO: 56336 - DNA, 20 bp, Artificial Sequence
  Description of Artificial Sequence: Synthetic oligonucleotide
  Target: SCN10A; (-) strand; PAM type: YTN; PAM sequence: CTG
atgttcatgccatacaagac

SEQ ID NO: 56337 - DNA, 20 bp, Artificial Sequence
  Description of Artificial Sequence: Synthetic oligonucleotide
  Target: SCN10A; (-) strand; PAM type: YTN; PAM sequence: TTA
aaatgtcaataatctgatgt

SEQ ID NO: 56338 - DNA, 20 bp, Artificial Sequence
  Description of Artificial Sequence: Synthetic oligonucleotide
  Target: SCN10A; (-) strand; PAM type: YTN; PAM sequence: TTT
aaaatgtcaataatctgatg

SEQ ID NO: 56339 - DNA, 20 bp, Artificial Sequence
  Description of Artificial Sequence: Synthetic oligonucleotide
  Target: SCN10A; (-) strand; PAM type: YTN; PAM sequence: CTA
gcaggtttaaaatgtcaata

SEQ ID NO: 56340 - DNA, 20 bp, Artificial Sequence
  Description of Artificial Sequence: Synthetic oligonucleotide
  Target: SCN10A; (-) strand; PAM type: YTN; PAM sequence: CTA
ctagcaggtttaaaatgtca

SEQ ID NO: 56341 - DNA, 20 bp, Artificial Sequence
  Description of Artificial Sequence: Synthetic oligonucleotide
  Target: SCN10A; (-) strand; PAM type: YTN; PAM sequence: CTC
aaaaactactagcaggttta

SEQ ID NO: 56342 - DNA, 20 bp, Artificial Sequence
  Description of Artificial Sequence: Synthetic oligonucleotide
  Target: SCN10A; (-) strand; PAM type: YTN; PAM sequence: TTA
ctcaaaaactactagcaggt

SEQ ID NO: 56343 - DNA, 20 bp, Artificial Sequence
  Description of Artificial Sequence: Synthetic oligonucleotide
  Target: SCN10A; (-) strand; PAM type: YTN; PAM sequence: TTA
acatcacaaattactcaaaa

SEQ ID NO: 56344 - DNA, 20 bp, Artificial Sequence
  Description of Artificial Sequence: Synthetic oligonucleotide
  Target: SCN10A; (-) strand; PAM type: YTN; PAM sequence: CTG
ttaacatcacaaattactca

SEQ ID NO: 56345 - DNA, 20 bp, Artificial Sequence
  Description of Artificial Sequence: Synthetic oligonucleotide
  Target: SCN10A; (-) strand; PAM type: YTN; PAM sequence: TTG
gtcatggggcactgttaaca

SEQ ID NO: 56346 - DNA, 20 bp, Artificial Sequence
  Description of Artificial Sequence: Synthetic oligonucleotide
  Target: SCN10A; (-) strand; PAM type: YTN; PAM sequence: CTC
attggtcatggggcactgtt

SEQ ID NO: 56347 - DNA, 20 bp, Artificial Sequence
  Description of Artificial Sequence: Synthetic oligonucleotide
  Target: SCN10A; (-) strand; PAM type: YTN; PAM sequence: CTC
aatgggacctcattggtcat

SEQ ID NO: 56348 - DNA, 20 bp, Artificial Sequence
  Description of Artificial Sequence: Synthetic oligonucleotide
  Target: SCN10A; (-) strand; PAM type: YTN; PAM sequence: CTC
ccagagggcaaggaaaacag

SEQ ID NO: 56349 - DNA, 20 bp, Artificial Sequence
  Description of Artificial Sequence: Synthetic oligonucleotide
  Target: SCN10A; (-) strand; PAM type: YTN; PAM sequence: CTG
ggcaaaagagcagcacctcc

SEQ ID NO: 56350 - DNA, 20 bp, Artificial Sequence
  Description of Artificial Sequence: Synthetic oligonucleotide
  Target: SCN10A; (-) strand; PAM type: YTN; PAM sequence: TTA
ctgggcaaaagagcagcacc

SEQ ID NO: 56351 - DNA, 20 bp, Artificial Sequence
  Description of Artificial Sequence: Synthetic oligonucleotide
  Target: SCN10A; (-) strand; PAM type: YTN; PAM sequence: CTT
actgggcaaaagagcagcac

SEQ ID NO: 56352 - DNA, 20 bp, Artificial Sequence
  Description of Artificial Sequence: Synthetic oligonucleotide
  Target: SCN10A; (-) strand; PAM type: YTN; PAM sequence: CTG
cttactgggcaaaagagcag

SEQ ID NO: 56353 - DNA, 20 bp, Artificial Sequence
  Description of Artificial Sequence: Synthetic oligonucleotide
  Target: SCN10A; (-) strand; PAM type: YTN; PAM sequence: CTG
agaagtggctgcttactggg

SEQ ID NO: 56354 - DNA, 20 bp, Artificial Sequence
  Description of Artificial Sequence: Synthetic oligonucleotide
  Target: SCN10A; (-) strand; PAM type: YTN; PAM sequence: CTG
tgccatagccatgctgagaa

SEQ ID NO: 56355 - DNA, 20 bp, Artificial Sequence
  Description of Artificial Sequence: Synthetic oligonucleotide
  Target: SCN10A; (-) strand; PAM type: YTN; PAM sequence: CTC
tgtgccatagccatgctgag

SEQ ID NO: 56356 - DNA, 20 bp, Artificial Sequence
  Description of Artificial Sequence: Synthetic oligonucleotide
  Target: SCN10A; (-) strand; PAM type: YTN; PAM sequence: TTG
ctctgtgccatagccatgct

SEQ ID NO: 56357 - DNA, 20 bp, Artificial Sequence
  Description of Artificial Sequence: Synthetic oligonucleotide
  Target: SCN10A; (-) strand; PAM type: YTN; PAM sequence: TTG
ttgctctgtgccatagccat

SEQ ID NO: 56358 - DNA, 20 bp, Artificial Sequence
  Description of Artificial Sequence: Synthetic oligonucleotide
  Target: SCN10A; (-) strand; PAM type: YTN; PAM sequence: TTG
ggcagatgagataggcatga

SEQ ID NO: 56359 - DNA, 20 bp, Artificial Sequence
  Description of Artificial Sequence: Synthetic oligonucleotide
  Target: SCN10A; (-) strand; PAM type: YTN; PAM sequence: TTT
gggcagatgagataggcatg

SEQ ID NO: 56360 - DNA, 20 bp, Artificial Sequence
  Description of Artificial Sequence: Synthetic oligonucleotide
  Target: SCN10A; (-) strand; PAM type: YTN; PAM sequence: CTT
tgggcagatgagataggcat

SEQ ID NO: 56361 - DNA, 20 bp, Artificial Sequence
  Description of Artificial Sequence: Synthetic oligonucleotide
  Target: SCN10A; (-) strand; PAM type: YTN; PAM sequence: TTC
tttgggcagatgagataggc

SEQ ID NO: 56362 - DNA, 20 bp, Artificial Sequence
  Description of Artificial Sequence: Synthetic oligonucleotide
  Target: SCN10A; (-) strand; PAM type: YTN; PAM sequence: CTT
ctttgggcagatgagatagg

SEQ ID NO: 56363 - DNA, 20 bp, Artificial Sequence
  Description of Artificial Sequence: Synthetic oligonucleotide
  Target: SCN10A; (-) strand; PAM type: YTN; PAM sequence: TTC
cccacaacacaacaggcagt

SEQ ID NO: 56364 - DNA, 20 bp, Artificial Sequence
  Description of Artificial Sequence: Synthetic oligonucleotide
  Target: SCN10A; (-) strand; PAM type: YTN; PAM sequence: TTT
ccccacaacacaacaggcag

SEQ ID NO: 56365 - DNA, 20 bp, Artificial Sequence
  Description of Artificial Sequence: Synthetic oligonucleotide
  Target: SCN10A; (-) strand; PAM type: YTN; PAM sequence: CTT
tccccacaacacaacaggca

SEQ ID NO: 56366 - DNA, 20 bp, Artificial Sequence
  Description of Artificial Sequence: Synthetic oligonucleotide
  Target: SCN10A; (-) strand; PAM type: YTN; PAM sequence: CTC
accacggtgtgtggtccgct

SEQ ID NO: 56367 - DNA, 20 bp, Artificial Sequence
  Description of Artificial Sequence: Synthetic oligonucleotide
  Target: SCN10A; (-) strand; PAM type: YTN; PAM sequence: TTC
tcaccacggtgtgtggtccg

SEQ ID NO: 56368 - DNA, 20 bp, Artificial Sequence
  Description of Artificial Sequence: Synthetic oligonucleotide
  Target: SCN10A; (-) strand; PAM type: YTN; PAM sequence: CTG
atgcccccagacacattctc

SEQ ID NO: 56369 - DNA, 20 bp, Artificial Sequence
  Description of Artificial Sequence: Synthetic oligonucleotide
  Target: SCN10A; (-) strand; PAM type: YTN; PAM sequence: TTG
ctgatgcccccagacacatt

SEQ ID NO: 56370 - DNA, 20 bp, Artificial Sequence
  Description of Artificial Sequence: Synthetic oligonucleotide
  Target: SCN10A; (-) strand; PAM type: YTN; PAM sequence: TTT
gctgatgcccccagacacat

SEQ ID NO: 56371 - DNA, 20 bp, Artificial Sequence
  Description of Artificial Sequence: Synthetic oligonucleotide
  Target: SCN10A; (-) strand; PAM type: YTN; PAM sequence: TTA
tgaggggaggtttgctgatg

SEQ ID NO: 56372 - DNA, 20 bp, Artificial Sequence
  Description of Artificial Sequence: Synthetic oligonucleotide
  Target: SCN10A; (-) strand; PAM type: YTN; PAM sequence: TTT
atgaggggaggtttgctgat

SEQ ID NO: 56373 - DNA, 20 bp, Artificial Sequence
  Description of Artificial Sequence: Synthetic oligonucleotide
  Target: SCN10A; (-) strand; PAM type: YTN; PAM sequence: CTT
tatgaggggaggtttgctga

SEQ ID NO: 56374 - DNA, 20 bp, Artificial Sequence
  Description of Artificial Sequence: Synthetic oligonucleotide
  Target: SCN10A; (-) strand; PAM type: YTN; PAM sequence: CTC
tttatgaggggaggtttgct

SEQ ID NO: 56375 - DNA, 20 bp, Artificial Sequence
  Description of Artificial Sequence: Synthetic oligonucleotide
  Target: SCN10A; (-) strand; PAM type: YTN; PAM sequence: TTG
aaaaacatcctctttatgag

SEQ ID NO: 56376 - DNA, 20 bp, Artificial Sequence
  Description of Artificial Sequence: Synthetic oligonucleotide
  Target: SCN10A; (-) strand; PAM type: YTN; PAM sequence: CTT
gaaaaacatcctctttatga

SEQ ID NO: 56377 - DNA, 20 bp, Artificial Sequence
  Description of Artificial Sequence: Synthetic oligonucleotide
  Target: SCN10A; (-) strand; PAM type: YTN; PAM sequence: CTG
tggatgcacaacttgaaaaa

SEQ ID NO: 56378 - DNA, 20 bp, Artificial Sequence
  Description of Artificial Sequence: Synthetic oligonucleotide
  Target: SCN10A; (-) strand; PAM type: YTN; PAM sequence: CTA
gacacacctgtggatgcaca

SEQ ID NO: 56379 - DNA, 20 bp, Artificial Sequence
  Description of Artificial Sequence: Synthetic oligonucleotide
  Target: SCN10A; (-) strand; PAM type: YTN; PAM sequence: CTA
atctagacacacctgtggat

SEQ ID NO: 56380 - DNA, 20 bp, Artificial Sequence
  Description of Artificial Sequence: Synthetic oligonucleotide
  Target: SCN10A; (-) strand; PAM type: YTN; PAM sequence: CTC
agactaatctagacacacct

SEQ ID NO: 56381 - DNA, 20 bp, Artificial Sequence
  Description of Artificial Sequence: Synthetic oligonucleotide
  Target: SCN10A; (-) strand; PAM type: YTN; PAM sequence: TTC
acctcagactaatctagaca

SEQ ID NO: 56382 - DNA, 20 bp, Artificial Sequence
  Description of Artificial Sequence: Synthetic oligonucleotide
  Target: SCN10A; (-) strand; PAM type: YTN; PAM sequence: TTG
gattcacctcagactaatct

SEQ ID NO: 56383 - DNA, 20 bp, Artificial Sequence
  Description of Artificial Sequence: Synthetic oligonucleotide
  Target: SCN10A; (-) strand; PAM type: YTN; PAM sequence: TTT
ggattcacctcagactaatc

SEQ ID NO: 56384 - DNA, 20 bp, Artificial Sequence
  Description of Artificial Sequence: Synthetic oligonucleotide
  Target: SCN10A; (-) strand; PAM type: YTN; PAM sequence: TTA
tgcaacacacaggtggtttg

SEQ ID NO: 56385 - DNA, 20 bp, Artificial Sequence
  Description of Artificial Sequence: Synthetic oligonucleotide
  Target: SCN10A; (-) strand; PAM type: YTN; PAM sequence: TTT
atgcaacacacaggtggttt

SEQ ID NO: 56386 - DNA, 20 bp, Artificial Sequence
  Description of Artificial Sequence: Synthetic oligonucleotide
  Target: SCN10A; (-) strand; PAM type: YTN; PAM sequence: TTA
atgtgtcccacaccccaaag

SEQ ID NO: 56387 - DNA, 20 bp, Artificial Sequence
  Description of Artificial Sequence: Synthetic oligonucleotide
  Target: SCN10A; (-) strand; PAM type: YTN; PAM sequence: TTT
aatgtgtcccacaccccaaa

SEQ ID NO: 56388 - DNA, 20 bp, Artificial Sequence
  Description of Artificial Sequence: Synthetic oligonucleotide
  Target: SCN10A; (-) strand; PAM type: YTN; PAM sequence: CTT
taatgtgtcccacaccccaa

SEQ ID NO: 56389 - DNA, 20 bp, Artificial Sequence
  Description of Artificial Sequence: Synthetic oligonucleotide
  Target: SCN10A; (-) strand; PAM type: YTN; PAM sequence: TTG
ggcctttaatgtgtcccaca

SEQ ID NO: 56390 - DNA, 20 bp, Artificial Sequence
  Description of Artificial Sequence: Synthetic oligonucleotide
  Target: SCN10A; (-) strand; PAM type: YTN; PAM sequence: CTT
gggcctttaatgtgtcccac

SEQ ID NO: 56391 - DNA, 20 bp, Artificial Sequence
  Description of Artificial Sequence: Synthetic oligonucleotide
  Target: SCN10A; (-) strand; PAM type: YTN; PAM sequence: TTG
aaaaaatggcttgggccttt

SEQ ID NO: 56392 - DNA, 20 bp, Artificial Sequence
  Description of Artificial Sequence: Synthetic oligonucleotide
  Target: SCN10A; (-) strand; PAM type: YTN; PAM sequence: TTA
gattgaaaaaatggcttggg

SEQ ID NO: 56393 - DNA, 20 bp, Artificial Sequence
  Description of Artificial Sequence: Synthetic oligonucleotide
  Target: SCN10A; (-) strand; PAM type: YTN; PAM sequence: TTG
aatcccaaaagtacaatgag

SEQ ID NO: 56394 - DNA, 20 bp, Artificial Sequence
  Description of Artificial Sequence: Synthetic oligonucleotide
  Target: SCN10A; (-) strand; PAM type: YTN; PAM sequence: TTA
tccaattgaatcccaaaagt

SEQ ID NO: 56395 - DNA, 20 bp, Artificial Sequence
  Description of Artificial Sequence: Synthetic oligonucleotide
  Target: SCN10A; (-) strand; PAM type: YTN; PAM sequence: CTT
atccaattgaatcccaaaag

SEQ ID NO: 56396 - DNA, 20 bp, Artificial Sequence
  Description of Artificial Sequence: Synthetic oligonucleotide
  Target: SCN10A; (-) strand; PAM type: YTN; PAM sequence: TTA
gcaacagagcccttatccaa

SEQ ID NO: 56397 - DNA, 20 bp, Artificial Sequence
  Description of Artificial Sequence: Synthetic oligonucleotide
  Target: SCN10A; (-) strand; PAM type: YTN; PAM sequence: TTA
gaggttagcaacagagccct

SEQ ID NO: 56398 - DNA, 20 bp, Artificial Sequence
  Description of Artificial Sequence: Synthetic oligonucleotide
  Target: SCN10A; (-) strand; PAM type: YTN; PAM sequence: TTT
agaggttagcaacagagccc

SEQ ID NO: 56399 - DNA, 20 bp, Artificial Sequence
  Description of Artificial Sequence: Synthetic oligonucleotide
  Target: SCN10A; (-) strand; PAM type: YTN; PAM sequence: CTT
tagaggttagcaacagagcc

SEQ ID NO: 56400 - DNA, 20 bp, Artificial Sequence
  Description of Artificial Sequence: Synthetic oligonucleotide
  Target: SCN10A; (-) strand; PAM type: YTN; PAM sequence: TTC
tttagaggttagcaacagag

SEQ ID NO: 56401 - DNA, 20 bp, Artificial Sequence
  Description of Artificial Sequence: Synthetic oligonucleotide
  Target: SCN10A; (-) strand; PAM type: YTN; PAM sequence: CTT
ctttagaggttagcaacaga

SEQ ID NO: 56402 - DNA, 20 bp, Artificial Sequence
  Description of Artificial Sequence: Synthetic oligonucleotide
  Target: SCN10A; (-) strand; PAM type: YTN; PAM sequence: CTG
tgtccagtaccttctttaga

SEQ ID NO: 56403 - DNA, 20 bp, Artificial Sequence
  Description of Artificial Sequence: Synthetic oligonucleotide
  Target: SCN10A; (-) strand; PAM type: YTN; PAM sequence: CTA
ctgtgtccagtaccttcttt

SEQ ID NO: 56404 - DNA, 20 bp, Artificial Sequence
  Description of Artificial Sequence: Synthetic oligonucleotide
  Target: SCN10A; (-) strand; PAM type: YTN; PAM sequence: TTG
cctactgtgtccagtacctt

SEQ ID NO: 56405 - DNA, 20 bp, Artificial Sequence
  Description of Artificial Sequence: Synthetic oligonucleotide
  Target: SCN10A; (-) strand; PAM type: YTN; PAM sequence: CTT
gcctactgtgtccagtacct

SEQ ID NO: 56406 - DNA, 20 bp, Artificial Sequence
  Description of Artificial Sequence: Synthetic oligonucleotide
  Target: SCN10A; (-) strand; PAM type: YTN; PAM sequence: TTA
gaccttgcctactgtgtcca

SEQ ID NO: 56407 - DNA, 20 bp, Artificial Sequence
  Description of Artificial Sequence: Synthetic oligonucleotide
  Target: SCN10A; (-) strand; PAM type: YTN; PAM sequence: TTA
caattagaccttgcctactg

SEQ ID NO: 56408 - DNA, 20 bp, Artificial Sequence
  Description of Artificial Sequence: Synthetic oligonucleotide
  Target: SCN10A; (-) strand; PAM type: YTN; PAM sequence: TTC
cacgtgttacaattagacct

SEQ ID NO: 56409 - DNA, 20 bp, Artificial Sequence
  Description of Artificial Sequence: Synthetic oligonucleotide
  Target: SCN10A; (-) strand; PAM type: YTN; PAM sequence: CTT
ccacgtgttacaattagacc

SEQ ID NO: 56410 - DNA, 20 bp, Artificial Sequence
  Description of Artificial Sequence: Synthetic oligonucleotide
  Target: SCN10A; (-) strand; PAM type: YTN; PAM sequence: CTC
ttccacgtgttacaattaga

SEQ ID NO: 56411 - DNA, 20 bp, Artificial Sequence
  Description of Artificial Sequence: Synthetic oligonucleotide
  Target: SCN10A; (-) strand; PAM type: YTN; PAM sequence: TTG
cctcttccacgtgttacaat

SEQ ID NO: 56412 - DNA, 20 bp, Artificial Sequence
  Description of Artificial Sequence: Synthetic oligonucleotide
  Target: SCN10A; (-) strand; PAM type: YTN; PAM sequence: TTG
cacgattgcctcttccacgt

SEQ ID NO: 56413 - DNA, 20 bp, Artificial Sequence
  Description of Artificial Sequence: Synthetic oligonucleotide
  Target: SCN10A; (-) strand; PAM type: YTN; PAM sequence: TTT
gcacgattgcctcttccacg

SEQ ID NO: 56414 - DNA, 20 bp, Artificial Sequence
  Description of Artificial Sequence: Synthetic oligonucleotide
  Target: SCN10A; (-) strand; PAM type: YTN; PAM sequence: CTT
tgcacgattgcctcttccac

SEQ ID NO: 56415 - DNA, 20 bp, Artificial Sequence
  Description of Artificial Sequence: Synthetic oligonucleotide
  Target: SCN10A; (-) strand; PAM type: YTN; PAM sequence: CTC
atatcctttgcacgattgcc

SEQ ID NO: 56416 - DNA, 20 bp, Artificial Sequence
  Description of Artificial Sequence: Synthetic oligonucleotide
  Target: SCN10A; (-) strand; PAM type: YTN; PAM sequence: CTG
tccactcatatcctttgcac

SEQ ID NO: 56417 - DNA, 20 bp, Artificial Sequence
  Description of Artificial Sequence: Synthetic oligonucleotide
  Target: SCN10A; (-) strand; PAM type: YTN; PAM sequence: CTG
atcagaagaacggccatcaa

SEQ ID NO: 56418 - DNA, 20 bp, Artificial Sequence
  Description of Artificial Sequence: Synthetic oligonucleotide
  Target: SCN10A; (-) strand; PAM type: YTN; PAM sequence: TTC
aacctgatcagaagaacggc

SEQ ID NO: 56419 - DNA, 20 bp, Artificial Sequence
  Description of Artificial Sequence: Synthetic oligonucleotide
  Target: SCN10A; (-) strand; PAM type: YTN; PAM sequence: TTT
caacctgatcagaagaacgg

SEQ ID NO: 56420 - DNA, 20 bp, Artificial Sequence
  Description of Artificial Sequence: Synthetic oligonucleotide
  Target: SCN10A; (-) strand; PAM type: YTN; PAM sequence: CTT
tcaacctgatcagaagaacg

SEQ ID NO: 56421 - DNA, 20 bp, Artificial Sequence
  Description of Artificial Sequence: Synthetic oligonucleotide
  Target: SCN10A; (-) strand; PAM type: YTN; PAM sequence: TTC
agtcctttcaacctgatcag

SEQ ID NO: 56422 - DNA, 20 bp, Artificial Sequence
  Description of Artificial Sequence: Synthetic oligonucleotide
  Target: SCN10A; (-) strand; PAM type: YTN; PAM sequence: CTA
ttcagtcctttcaacctgat

SEQ ID NO: 56423 - DNA, 20 bp, Artificial Sequence
  Description of Artificial Sequence: Synthetic oligonucleotide
  Target: SCN10A; (-) strand; PAM type: YTN; PAM sequence: CTG
tggctattcagtcctttcaa

SEQ ID NO: 56424 - DNA, 20 bp, Artificial Sequence
  Description of Artificial Sequence: Synthetic oligonucleotide
  Target: SCN10A; (-) strand; PAM type: YTN; PAM sequence: CTC
gggccctgtggctattcagt

SEQ ID NO: 56425 - DNA, 20 bp, Artificial Sequence
  Description of Artificial Sequence: Synthetic oligonucleotide
  Target: SCN10A; (-) strand; PAM type: YTN; PAM sequence: TTA
gtgccactcgggccctgtgg

SEQ ID NO: 56426 - DNA, 20 bp, Artificial Sequence
  Description of Artificial Sequence: Synthetic oligonucleotide
  Target: SCN10A; (-) strand; PAM type: YTN; PAM sequence: TTT
agtgccactcgggccctgtg

SEQ ID NO: 56427 - DNA, 20 bp, Artificial Sequence
  Description of Artificial Sequence: Synthetic oligonucleotide
  Target: SCN10A; (-) strand; PAM type: YTN; PAM sequence: TTC
ccggtttagtgccactcggg

SEQ ID NO: 56428 - DNA, 20 bp, Artificial Sequence
  Description of Artificial Sequence: Synthetic oligonucleotide
  Target: SCN10A; (-) strand; PAM type: YTN; PAM sequence: TTT
cccggtttagtgccactcgg

SEQ ID NO: 56429 - DNA, 20 bp, Artificial Sequence
  Description of Artificial Sequence: Synthetic oligonucleotide
  Target: SCN10A; (-) strand; PAM type: YTN; PAM sequence: CTG
aacaaagggaggaccatttc

SEQ ID NO: 56430 - DNA, 20 bp, Artificial Sequence
  Description of Artificial Sequence: Synthetic oligonucleotide
  Target: SCN10A; (-) strand; PAM type: YTN; PAM sequence: TTA
tggtgctgaacaaagggagg

SEQ ID NO: 56431 - DNA, 20 bp, Artificial Sequence
  Description of Artificial Sequence: Synthetic oligonucleotide
  Target: SCN10A; (-) strand; PAM type: YTN; PAM sequence: TTT
atggtgctgaacaaagggag

SEQ ID NO: 56432 - DNA, 20 bp, Artificial Sequence
  Description of Artificial Sequence: Synthetic oligonucleotide
  Target: SCN10A; (-) strand; PAM type: YTN; PAM sequence: TTC
agacatttatggtgctgaac

SEQ ID NO: 56433 - DNA, 20 bp, Artificial Sequence
  Description of Artificial Sequence: Synthetic oligonucleotide
  Target: SCN10A; (-) strand; PAM type: YTN; PAM sequence: TTT
cagacatttatggtgctgaa

SEQ ID NO: 56434 - DNA, 20 bp, Artificial Sequence
  Description of Artificial Sequence: Synthetic oligonucleotide
  Target: SCN10A; (-) strand; PAM type: YTN; PAM sequence: TTG
tttcagacatttatggtgct

SEQ ID NO: 56435 - DNA, 20 bp, Artificial Sequence
  Description of Artificial Sequence: Synthetic oligonucleotide
  Target: SCN10A; (-) strand; PAM type: YTN; PAM sequence: TTT
gtttcagacatttatggtgc

SEQ ID NO: 56436 - DNA, 20 bp, Artificial Sequence
  Description of Artificial Sequence: Synthetic oligonucleotide
  Target: SCN10A; (-) strand; PAM type: YTN; PAM sequence: TTT
tgtttcagacatttatggtg

SEQ ID NO: 56437 - DNA, 20 bp, Artificial Sequence
  Description of Artificial Sequence: Synthetic oligonucleotide
  Target: SCN10A; (-) strand; PAM type: YTN; PAM sequence: TTG
ttttgtttcagacatttatg

SEQ ID NO: 56438 - DNA, 20 bp, Artificial Sequence
  Description of Artificial Sequence: Synthetic oligonucleotide
  Target: SCN10A; (-) strand; PAM type: YTN; PAM sequence: TTT
gttttgtttcagacatttat

SEQ ID NO: 56439 - DNA, 20 bp, Artificial Sequence
  Description of Artificial Sequence: Synthetic oligonucleotide
  Target: SCN10A; (-) strand; PAM type: YTN; PAM sequence: TTT
tgttttgtttcagacattta

SEQ ID NO: 56440 - DNA, 20 bp, Artificial Sequence
  Description of Artificial Sequence: Synthetic oligonucleotide
  Target: SCN10A; (-) strand; PAM type: YTN; PAM sequence: CTG
ttttgttttgtttcagacat

SEQ ID NO: 56441 - DNA, 20 bp, Artificial Sequence
  Description of Artificial Sequence: Synthetic oligonucleotide
  Target: SCN10A; (-) strand; PAM type: YTN; PAM sequence: TTC
tgttttgttttgtttcagac

SEQ ID NO: 56442 - DNA, 20 bp, Artificial Sequence
  Description of Artificial Sequence: Synthetic oligonucleotide
  Target: SCN10A; (-) strand; PAM type: YTN; PAM sequence: TTT
ctgttttgttttgtttcaga

SEQ ID NO: 56443 - DNA, 20 bp, Artificial Sequence
  Description of Artificial Sequence: Synthetic oligonucleotide
  Target: SCN10A; (-) strand; PAM type: YTN; PAM sequence: CTT
tctgttttgttttgtttcag

SEQ ID NO: 56444 - DNA, 20 bp, Artificial Sequence
  Description of Artificial Sequence: Synthetic oligonucleotide
  Target: SCN10A; (-) strand; PAM type: YTN; PAM sequence: TTG
gaggtccactttctgttttg

SEQ ID NO: 56445 - DNA, 20 bp, Artificial Sequence
  Description of Artificial Sequence: Synthetic oligonucleotide
  Target: SCN10A; (-) strand; PAM type: YTN; PAM sequence: CTC
attggaggtccactttctgt

SEQ ID NO: 56446 - DNA, 20 bp, Artificial Sequence
  Description of Artificial Sequence: Synthetic oligonucleotide
  Target: SCN10A; (-) strand; PAM type: YTN; PAM sequence: TTC
tcattggaggtccactttct

SEQ ID NO: 56447 - DNA, 20 bp, Artificial Sequence
  Description of Artificial Sequence: Synthetic oligonucleotide
  Target: SCN10A; (-) strand; PAM type: YTN; PAM sequence: TTT
ctcattggaggtccactttc

SEQ ID NO: 56448 - DNA, 20 bp, Artificial Sequence
  Description of Artificial Sequence: Synthetic oligonucleotide
  Target: SCN10A; (-) strand; PAM type: YTN; PAM sequence: TTG
tttctcattggaggtccact

SEQ ID NO: 56449 - DNA, 20 bp, Artificial Sequence
  Description of Artificial Sequence: Synthetic oligonucleotide
  Target: SCN10A; (-) strand; PAM type: YTN; PAM sequence: CTT
gtttctcattggaggtccac

SEQ ID NO: 56450 - DNA, 20 bp, Artificial Sequence
  Description of Artificial Sequence: Synthetic oligonucleotide
  Target: SCN10A; (-) strand; PAM type: YTN; PAM sequence: TTG
tataaggaatcttgtttctc

SEQ ID NO: 56451 - DNA, 20 bp, Artificial Sequence
  Description of Artificial Sequence: Synthetic oligonucleotide
  Target: SCN10A; (-) strand; PAM type: YTN; PAM sequence: TTA
aaaacatggttgtataagga

SEQ ID NO: 56452 - DNA, 20 bp, Artificial Sequence
  Description of Artificial Sequence: Synthetic oligonucleotide
  Target: SCN10A; (-) strand; PAM type: YTN; PAM sequence: TTT
aaaaacatggttgtataagg

SEQ ID NO: 56453 - DNA, 20 bp, Artificial Sequence
  Description of Artificial Sequence: Synthetic oligonucleotide
  Target: SCN10A; (-) strand; PAM type: YTN; PAM sequence: CTC
atgtttaaaaacatggttgt

SEQ ID NO: 56454 - DNA, 20 bp, Artificial Sequence
  Description of Artificial Sequence: Synthetic oligonucleotide
  Target: SCN10A; (-) strand; PAM type: YTN; PAM sequence: CTC
tcatgtttaaaaacatggtt

SEQ ID NO: 56455 - DNA, 20 bp, Artificial Sequence
  Description of Artificial Sequence: Synthetic oligonucleotide
  Target: SCN10A; (-) strand; PAM type: YTN; PAM sequence: CTG
agataatgcctctcatgttt

SEQ ID NO: 56456 - DNA, 20 bp, Artificial Sequence
  Description of Artificial Sequence: Synthetic oligonucleotide
  Target: SCN10A; (-) strand; PAM type: YTN; PAM sequence: CTC
ataagcctgagataatgcct

SEQ ID NO: 56457 - DNA, 20 bp, Artificial Sequence
  Description of Artificial Sequence: Synthetic oligonucleotide
  Target: SCN10A; (-) strand; PAM type: YTN; PAM sequence: TTG
ctcataagcctgagataatg

SEQ ID NO: 56458 - DNA, 20 bp, Artificial Sequence
  Description of Artificial Sequence: Synthetic oligonucleotide
  Target: SCN10A; (-) strand; PAM type: YTN; PAM sequence: CTT
gctcataagcctgagataat

SEQ ID NO: 56459 - DNA, 20 bp, Artificial Sequence
  Description of Artificial Sequence: Synthetic oligonucleotide
  Target: SCN10A; (-) strand; PAM type: YTN; PAM sequence: TTC
ttgctcataagcctgagata

SEQ ID NO: 56460 - DNA, 20 bp, Artificial Sequence
  Description of Artificial Sequence: Synthetic oligonucleotide
  Target: SCN10A; (-) strand; PAM type: YTN; PAM sequence: CTT
cttgctcataagcctgagat

SEQ ID NO: 56461 - DNA, 20 bp, Artificial Sequence
  Description of Artificial Sequence: Synthetic oligonucleotide
  Target: SCN10A; (-) strand; PAM type: YTN; PAM sequence: TTC
ccagagcccttcttgctcat

SEQ ID NO: 56462 - DNA, 20 bp, Artificial Sequence
  Description of Artificial Sequence: Synthetic oligonucleotide
  Target: SCN10A; (-) strand; PAM type: YTN; PAM sequence: CTG
tagttcccagagcccttctt

SEQ ID NO: 56463 - DNA, 20 bp, Artificial Sequence
  Description of Artificial Sequence: Synthetic oligonucleotide
  Target: SCN10A; (-) strand; PAM type: YTN; PAM sequence: TTG
acctgtagttcccagagccc

SEQ ID NO: 56464 - DNA, 20 bp, Artificial Sequence
  Description of Artificial Sequence: Synthetic oligonucleotide
  Target: SCN10A; (-) strand; PAM type: YTN; PAM sequence: CTC
attgacctgtagttcccaga

SEQ ID NO: 56465 - DNA, 20 bp, Artificial Sequence
  Description of Artificial Sequence: Synthetic oligonucleotide
  Target: SCN10A; (-) strand; PAM type: YTN; PAM sequence: CTC
tcattgacctgtagttccca

SEQ ID NO: 56466 - DNA, 20 bp, Artificial Sequence
  Description of Artificial Sequence: Synthetic oligonucleotide
  Target: SCN10A; (-) strand; PAM type: YTN; PAM sequence: TTG
actctcattgacctgtagtt

SEQ ID NO: 56467 - DNA, 20 bp, Artificial Sequence
  Description of Artificial Sequence: Synthetic oligonucleotide
  Target: SCN10A; (-) strand; PAM type: YTN; PAM sequence: TTT
gactctcattgacctgtagt

SEQ ID NO: 56468 - DNA, 20 bp, Artificial Sequence
  Description of Artificial Sequence: Synthetic oligonucleotide
  Target: SCN10A; (-) strand; PAM type: YTN; PAM sequence: CTG
catttgactctcattgacct

SEQ ID NO: 56469 - DNA, 20 bp, Artificial Sequence
  Description of Artificial Sequence: Synthetic oligonucleotide
  Target: SCN10A; (-) strand; PAM type: YTN; PAM sequence: CTG
tacctgcatttgactctcat

SEQ ID NO: 56470 - DNA, 20 bp, Artificial Sequence
  Description of Artificial Sequence: Synthetic oligonucleotide
  Target: SCN10A; (-) strand; PAM type: YTN; PAM sequence: CTC
tgtacctgcatttgactctc

SEQ ID NO: 56471 - DNA, 20 bp, Artificial Sequence
  Description of Artificial Sequence: Synthetic oligonucleotide
  Target: SCN10A; (-) strand; PAM type: YTN; PAM sequence: CTC
tctgtacctgcatttgactc

SEQ ID NO: 56472 - DNA, 20 bp, Artificial Sequence
  Description of Artificial Sequence: Synthetic oligonucleotide
  Target: SCN10A; (-) strand; PAM type: YTN; PAM sequence: CTG
cctctctgtacctgcatttg

SEQ ID NO: 56473 - DNA, 20 bp, Artificial Sequence
  Description of Artificial Sequence: Synthetic oligonucleotide
  Target: SCN10A; (-) strand; PAM type: YTN; PAM sequence: CTC
tgcctctctgtacctgcatt

SEQ ID NO: 56474 - DNA, 20 bp, Artificial Sequence
  Description of Artificial Sequence: Synthetic oligonucleotide
  Target: SCN10A; (-) strand; PAM type: YTN; PAM sequence: CTC
tctgcctctctgtacctgca

SEQ ID NO: 56475 - DNA, 20 bp, Artificial Sequence
  Description of Artificial Sequence: Synthetic oligonucleotide
  Target: SCN10A; (-) strand; PAM type: YTN; PAM sequence: TTG
atcctctctgcctctctgta

SEQ ID NO: 56476 - DNA, 20 bp, Artificial Sequence
  Description of Artificial Sequence: Synthetic oligonucleotide
  Target: SCN10A; (-) strand; PAM type: YTN; PAM sequence: CTT
gatcctctctgcctctctgt

SEQ ID NO: 56477 - DNA, 20 bp, Artificial Sequence
  Description of Artificial Sequence: Synthetic oligonucleotide
  Target: SCN10A; (-) strand; PAM type: YTN; PAM sequence: TTA
gtccttgatcctctctgcct

SEQ ID NO: 56478 - DNA, 20 bp, Artificial Sequence
  Description of Artificial Sequence: Synthetic oligonucleotide
  Target: SCN10A; (-) strand; PAM type: YTN; PAM sequence: TTT
agtccttgatcctctctgcc

SEQ ID NO: 56479 - DNA, 20 bp, Artificial Sequence
  Description of Artificial Sequence: Synthetic oligonucleotide
  Target: SCN10A; (-) strand; PAM type: YTN; PAM sequence: TTT
tagtccttgatcctctctgc

SEQ ID NO: 56480 - DNA, 20 bp, Artificial Sequence
  Description of Artificial Sequence: Synthetic oligonucleotide
  Target: SCN10A; (-) strand; PAM type: YTN; PAM sequence: CTT
ttagtccttgatcctctctg

SEQ ID NO: 56481 - DNA, 20 bp, Artificial Sequence
  Description of Artificial Sequence: Synthetic oligonucleotide
  Target: SCN10A; (-) strand; PAM type: YTN; PAM sequence: CTG
agagggtgaggatatggctt

SEQ ID NO: 56482 - DNA, 20 bp, Artificial Sequence
  Description of Artificial Sequence: Synthetic oligonucleotide
  Target: SCN10A; (-) strand; PAM type: YTN; PAM sequence: TTG
ctgagagggtgaggatatgg

SEQ ID NO: 56483 - DNA, 20 bp, Artificial Sequence
  Description of Artificial Sequence: Synthetic oligonucleotide
  Target: SCN10A; (-) strand; PAM type: YTN; PAM sequence: CTT
gctgagagggtgaggatatg

SEQ ID NO: 56484 - DNA, 20 bp, Artificial Sequence
  Description of Artificial Sequence: Synthetic oligonucleotide
  Target: SCN10A; (-) strand; PAM type: YTN; PAM sequence: CTG
tcagtcccagagatgaggat

SEQ ID NO: 56485 - DNA, 20 bp, Artificial Sequence
  Description of Artificial Sequence: Synthetic oligonucleotide
  Target: SCN10A; (-) strand; PAM type: YTN; PAM sequence: TTG
gtgcactgtcagtcccagag

SEQ ID NO: 56486 - DNA, 20 bp, Artificial Sequence
  Description of Artificial Sequence: Synthetic oligonucleotide
  Target: SCN10A; (-) strand; PAM type: YTN; PAM sequence: CTT
ggtgcactgtcagtcccaga

SEQ ID NO: 56487 - DNA, 20 bp, Artificial Sequence
  Description of Artificial Sequence: Synthetic oligonucleotide
  Target: SCN10A; (-) strand; PAM type: YTN; PAM sequence: CTC
atcttggtgcactgtcagtc

SEQ ID NO: 56488 - DNA, 20 bp, Artificial Sequence
  Description of Artificial Sequence: Synthetic oligonucleotide
  Target: SCN10A; (-) strand; PAM type: YTN; PAM sequence: CTC
agtgggctcatcttggtgca

SEQ ID NO: 56489 - DNA, 20 bp, Artificial Sequence
  Description of Artificial Sequence: Synthetic oligonucleotide
  Target: SCN10A; (-) strand; PAM type: YTN; PAM sequence: TTA
aagtaccctcagtgggctca

SEQ ID NO: 56490 - DNA, 20 bp, Artificial Sequence
  Description of Artificial Sequence: Synthetic oligonucleotide
  Target: SCN10A; (-) strand; PAM type: YTN; PAM sequence: CTG
tccattaaagtaccctcagt

SEQ ID NO: 56491 - DNA, 20 bp, Artificial Sequence
  Description of Artificial Sequence: Synthetic oligonucleotide
  Target: SCN10A; (-) strand; PAM type: YTN; PAM sequence: CTG
tctgtccattaaagtaccct

SEQ ID NO: 56492 - DNA, 20 bp, Artificial Sequence
  Description of Artificial Sequence: Synthetic oligonucleotide
  Target: SCN10A; (-) strand; PAM type: YTN; PAM sequence: TTG
gctgtctgtccattaaagta

SEQ ID NO: 56493 - DNA, 20 bp, Artificial Sequence
  Description of Artificial Sequence: Synthetic oligonucleotide
  Target: SCN10A; (-) strand; PAM type: YTN; PAM sequence: CTG
aggattggctgtctgtccat

SEQ ID NO: 56494 - DNA, 20 bp, Artificial Sequence
  Description of Artificial Sequence: Synthetic oligonucleotide
  Target: SCN10A; (-) strand; PAM type: YTN; PAM sequence: TTA
ccagcctgaggattggctgt

SEQ ID NO: 56495 - DNA, 20 bp, Artificial Sequence
  Description of Artificial Sequence: Synthetic oligonucleotide
  Target: SCN10A; (-) strand; PAM type: YTN; PAM sequence: CTT
accagcctgaggattggctg

SEQ ID NO: 56496 - DNA, 20 bp, Artificial Sequence
  Description of Artificial Sequence: Synthetic oligonucleotide
  Target: SCN10A; (-) strand; PAM type: YTN; PAM sequence: CTC
ttaccagcctgaggattggc

SEQ ID NO: 56497 - DNA, 20 bp, Artificial Sequence
  Description of Artificial Sequence: Synthetic oligonucleotide
  Target: SCN10A; (-) strand; PAM type: YTN; PAM sequence: CTG
ggcataacacctcttaccag

SEQ ID NO: 56498 - DNA, 20 bp, Artificial Sequence
  Description of Artificial Sequence: Synthetic oligonucleotide
  Target: SCN10A; (-) strand; PAM type: YTN; PAM sequence: CTC
ccctgggcataacacctctt

SEQ ID NO: 56499 - DNA, 20 bp, Artificial Sequence
  Description of Artificial Sequence: Synthetic oligonucleotide
  Target: SCN10A; (-) strand; PAM type: YTN; PAM sequence: TTG
ccagagtcctcccctgggca

SEQ ID NO: 56500 - DNA, 20 bp, Artificial Sequence
  Description of Artificial Sequence: Synthetic oligonucleotide
  Target: SCN10A; (-) strand; PAM type: YTN; PAM sequence: CTG
ttgccagagtcctcccctgg

SEQ ID NO: 56501 - DNA, 20 bp, Artificial Sequence
  Description of Artificial Sequence: Synthetic oligonucleotide
  Target: SCN10A; (-) strand; PAM type: YTN; PAM sequence: TTC
accatcctgttgccagagtc

SEQ ID NO: 56502 - DNA, 20 bp, Artificial Sequence
  Description of Artificial Sequence: Synthetic oligonucleotide
  Target: SCN10A; (-) strand; PAM type: YTN; PAM sequence: CTT
caccatcctgttgccagagt

SEQ ID NO: 56503 - DNA, 20 bp, Artificial Sequence
  Description of Artificial Sequence: Synthetic oligonucleotide
  Target: SCN10A; (-) strand; PAM type: YTN; PAM sequence: TTA
aatgcaaccataacttcacc

SEQ ID NO: 56504 - DNA, 20 bp, Artificial Sequence
  Description of Artificial Sequence: Synthetic oligonucleotide
  Target: SCN10A; (-) strand; PAM type: YTN; PAM sequence: TTG
tcagaagagaaattaaatgc

SEQ ID NO: 56505 - DNA, 20 bp, Artificial Sequence
  Description of Artificial Sequence: Synthetic oligonucleotide
  Target: SCN10A; (-) strand; PAM type: YTN; PAM sequence: CTT
gtcagaagagaaattaaatg

SEQ ID NO: 56506 - DNA, 20 bp, Artificial Sequence
  Description of Artificial Sequence: Synthetic oligonucleotide
  Target: SCN10A; (-) strand; PAM type: YTN; PAM sequence: CTC
ttgtcagaagagaaattaaa

SEQ ID NO: 56507 - DNA, 20 bp, Artificial Sequence
  Description of Artificial Sequence: Synthetic oligonucleotide
  Target: SCN10A; (-) strand; PAM type: YTN; PAM sequence: TTC
tcttgtcagaagagaaatta

SEQ ID NO: 56508 - DNA, 20 bp, Artificial Sequence
  Description of Artificial Sequence: Synthetic oligonucleotide
  Target: SCN10A; (-) strand; PAM type: YTN; PAM sequence: TTA
caaaacaaggatggttctct

SEQ ID NO: 56509 - DNA, 20 bp, Artificial Sequence
  Description of Artificial Sequence: Synthetic oligonucleotide
  Target: SCN10A; (-) strand; PAM type: YTN; PAM sequence: TTA
agagacagagatgtagaagg

SEQ ID NO: 56510 - DNA, 20 bp, Artificial Sequence
  Description of Artificial Sequence: Synthetic oligonucleotide
  Target: SCN10A; (-) strand; PAM type: YTN; PAM sequence: TTT
aagagacagagatgtagaag

SEQ ID NO: 56511 - DNA, 20 bp, Artificial Sequence
  Description of Artificial Sequence: Synthetic oligonucleotide
  Target: SCN10A; (-) strand; PAM type: YTN; PAM sequence: CTC
agagggagaaaccaggagag

SEQ ID NO: 56512 - DNA, 20 bp, Artificial Sequence
  Description of Artificial Sequence: Synthetic oligonucleotide
  Target: SCN10A; (-) strand; PAM type: YTN; PAM sequence: CTA
aatcctcagagggagaaacc

SEQ ID NO: 56513 - DNA, 20 bp, Artificial Sequence
  Description of Artificial Sequence: Synthetic oligonucleotide
  Target: SCN10A; (-) strand; PAM type: YTN; PAM sequence: CTC
ctaaatcctcagagggagaa

SEQ ID NO: 56514 - DNA, 20 bp, Artificial Sequence
  Description of Artificial Sequence: Synthetic oligonucleotide
  Target: SCN10A; (-) strand; PAM type: YTN; PAM sequence: TTC
atatcctcctaaatcctcag

SEQ ID NO: 56515 - DNA, 20 bp, Artificial Sequence
  Description of Artificial Sequence: Synthetic oligonucleotide
  Target: SCN10A; (-) strand; PAM type: YTN; PAM sequence: CTC
ccatgccaagagttcatatc

SEQ ID NO: 56516 - DNA, 20 bp, Artificial Sequence
  Description of Artificial Sequence: Synthetic oligonucleotide
  Target: SCN10A; (-) strand; PAM type: YTN; PAM sequence: CTC
tcccatgccaagagttcata

SEQ ID NO: 56517 - DNA, 20 bp, Artificial Sequence
  Description of Artificial Sequence: Synthetic oligonucleotide
  Target: SCN10A; (-) strand; PAM type: YTN; PAM sequence: CTC
ctctcccatgccaagagttc

SEQ ID NO: 56518 - DNA, 20 bp, Artificial Sequence
  Description of Artificial Sequence: Synthetic oligonucleotide
  Target: SCN10A; (-) strand; PAM type: YTN; PAM sequence: TTC
ctcctctcccatgccaagag

SEQ ID NO: 56519 - DNA, 20 bp, Artificial Sequence
  Description of Artificial Sequence: Synthetic oligonucleotide
  Target: SCN10A; (-) strand; PAM type: YTN; PAM sequence: CTT
cctcctctcccatgccaaga

SEQ ID NO: 56520 - DNA, 20 bp, Artificial Sequence
  Description of Artificial Sequence: Synthetic oligonucleotide
  Target: SCN10A; (-) strand; PAM type: YTN; PAM sequence: TTC
ttcctcctctcccatgccaa

SEQ ID NO: 56521 - DNA, 20 bp, Artificial Sequence
  Description of Artificial Sequence: Synthetic oligonucleotide
  Target: SCN10A; (-) strand; PAM type: YTN; PAM sequence: TTT
cttcctcctctcccatgcca

SEQ ID NO: 56522 - DNA, 20 bp, Artificial Sequence
  Description of Artificial Sequence: Synthetic oligonucleotide
  Target: SCN10A; (-) strand; PAM type: YTN; PAM sequence: CTT
tcttcctcctctcccatgcc

SEQ ID NO: 56523 - DNA, 20 bp, Artificial Sequence
  Description of Artificial Sequence: Synthetic oligonucleotide
  Target: SCN10A; (-) strand; PAM type: YTN; PAM sequence: CTG
aatatctttcttcctcctct

SEQ ID NO: 56524 - DNA, 20 bp, Artificial Sequence
  Description of Artificial Sequence: Synthetic oligonucleotide
  Target: SCN10A; (-) strand; PAM type: YTN; PAM sequence: CTA
gcagagtaaataaaaaggca

SEQ ID NO: 56525 - DNA, 20 bp, Artificial Sequence
  Description of Artificial Sequence: Synthetic oligonucleotide
  Target: SCN10A; (-) strand; PAM type: YTN; PAM sequence: CTC
aaatatggctagcagagtaa

SEQ ID NO: 56526 - DNA, 20 bp, Artificial Sequence
  Description of Artificial Sequence: Synthetic oligonucleotide
  Target: SCN10A; (-) strand; PAM type: YTN; PAM sequence: TTA
ggaggacaggaatcagccat

SEQ ID NO: 56527 - DNA, 20 bp, Artificial Sequence
  Description of Artificial Sequence: Synthetic oligonucleotide
  Target: SCN10A; (-) strand; PAM type: YTN; PAM sequence: TTG
ggagttaggaggacaggaat

SEQ ID NO: 56528 - DNA, 20 bp, Artificial Sequence
  Description of Artificial Sequence: Synthetic oligonucleotide
  Target: SCN10A; (-) strand; PAM type: YTN; PAM sequence: TTT
gggagttaggaggacaggaa

SEQ ID NO: 56529 - DNA, 20 bp, Artificial Sequence
  Description of Artificial Sequence: Synthetic oligonucleotide
  Target: SCN10A; (-) strand; PAM type: YTN; PAM sequence: CTA
cgagccaaaaaatggtgaat

SEQ ID NO: 56530 - DNA, 20 bp, Artificial Sequence
  Description of Artificial Sequence: Synthetic oligonucleotide
  Target: SCN10A; (-) strand; PAM type: YTN; PAM sequence: TTC
tacgagccaaaaaatggtga

SEQ ID NO: 56531 - DNA, 20 bp, Artificial Sequence
  Description of Artificial Sequence: Synthetic oligonucleotide
  Target: SCN10A; (-) strand; PAM type: YTN; PAM sequence: TTG
atgttctacgagccaaaaaa

SEQ ID NO: 56532 - DNA, 20 bp, Artificial Sequence
  Description of Artificial Sequence: Synthetic oligonucleotide
  Target: SCN10A; (-) strand; PAM type: YTN; PAM sequence: TTT
gatgttctacgagccaaaaa

SEQ ID NO: 56533 - DNA, 20 bp, Artificial Sequence
  Description of Artificial Sequence: Synthetic oligonucleotide
  Target: SCN10A; (-) strand; PAM type: YTN; PAM sequence: TTT
tgatgttctacgagccaaaa

SEQ ID NO: 56534 - DNA, 20 bp, Artificial Sequence
  Description of Artificial Sequence: Synthetic oligonucleotide
  Target: SCN10A; (-) strand; PAM type: YTN; PAM sequence: TTT
ttgatgttctacgagccaaa

SEQ ID NO: 56535 - DNA, 20 bp, Artificial Sequence
  Description of Artificial Sequence: Synthetic oligonucleotide
  Target: SCN10A; (-) strand; PAM type: YTN; PAM sequence: TTG
tatttttgatgttctacgag

SEQ ID NO: 56536 - DNA, 20 bp, Artificial Sequence
  Description of Artificial Sequence: Synthetic oligonucleotide
  Target: SCN10A; (-) strand; PAM type: YTN; PAM sequence: CTG
tgttgtatttttgatgttct

SEQ ID NO: 56537 - DNA, 20 bp, Artificial Sequence
  Description of Artificial Sequence: Synthetic oligonucleotide
  Target: SCN10A; (-) strand; PAM type: YTN; PAM sequence: CTC
acctgtgttgtatttttgat

SEQ ID NO: 56538 - DNA, 20 bp, Artificial Sequence
  Description of Artificial Sequence: Synthetic oligonucleotide
  Target: SCN10A; (-) strand; PAM type: YTN; PAM sequence: TTA
tctcacctgtgttgtatttt

SEQ ID NO: 56539 - DNA, 20 bp, Artificial Sequence
  Description of Artificial Sequence: Synthetic oligonucleotide
  Target: SCN10A; (-) strand; PAM type: YTN; PAM sequence: TTC
atgacaattatctcacctgt

SEQ ID NO: 56540 - DNA, 20 bp, Artificial Sequence
  Description of Artificial Sequence: Synthetic oligonucleotide
  Target: SCN10A; (-) strand; PAM type: YTN; PAM sequence: CTT
catgacaattatctcacctg

SEQ ID NO: 56541 - DNA, 20 bp, Artificial Sequence
  Description of Artificial Sequence: Synthetic oligonucleotide
  Target: SCN10A; (-) strand; PAM type: YTN; PAM sequence: TTC
ttcatgacaattatctcacc

SEQ ID NO: 56542 - DNA, 20 bp, Artificial Sequence
  Description of Artificial Sequence: Synthetic oligonucleotide
  Target: SCN10A; (-) strand; PAM type: YTN; PAM sequence: CTT
cttcatgacaattatctcac

SEQ ID NO: 56543 - DNA, 20 bp, Artificial Sequence
  Description of Artificial Sequence: Synthetic oligonucleotide
  Target: SCN10A; (-) strand; PAM type: YTN; PAM sequence: TTA
aacaagagcttcttcatgac

SEQ ID NO: 56544 - DNA, 20 bp, Artificial Sequence
  Description of Artificial Sequence: Synthetic oligonucleotide
  Target: SCN10A; (-) strand; PAM type: YTN; PAM sequence: TTT
aaacaagagcttcttcatga

SEQ ID NO: 56545 - DNA, 20 bp, Artificial Sequence
  Description of Artificial Sequence: Synthetic oligonucleotide
  Target: SCN10A; (-) strand; PAM type: YTN; PAM sequence: TTG
agaatcagtagtttaaacaa

SEQ ID NO: 56546 - DNA, 20 bp, Artificial Sequence
  Description of Artificial Sequence: Synthetic oligonucleotide
  Target: SCN10A; (-) strand; PAM type: YTN; PAM sequence: TTT
gagaatcagtagtttaaaca

SEQ ID NO: 56547 - DNA, 20 bp, Artificial Sequence
  Description of Artificial Sequence: Synthetic oligonucleotide
  Target: SCN10A; (-) strand; PAM type: YTN; PAM sequence: CTG
aaatcaaaaagtttgagaat

SEQ ID NO: 56548 - DNA, 20 bp, Artificial Sequence
  Description of Artificial Sequence: Synthetic oligonucleotide
  Target: SCN10A; (-) strand; PAM type: YTN; PAM sequence: TTG
agagtaataatccctgaaat

SEQ ID NO: 56549 - DNA, 20 bp, Artificial Sequence
  Description of Artificial Sequence: Synthetic oligonucleotide
  Target: SCN10A; (-) strand; PAM type: YTN; PAM sequence: TTT
gagagtaataatccctgaaa

SEQ ID NO: 56550 - DNA, 20 bp, Artificial Sequence
  Description of Artificial Sequence: Synthetic oligonucleotide
  Target: SCN10A; (-) strand; PAM type: YTN; PAM sequence: CTC
aataaggtttgagagtaata

SEQ ID NO: 56551 - DNA, 20 bp, Artificial Sequence
  Description of Artificial Sequence: Synthetic oligonucleotide
  Target: SCN10A; (-) strand; PAM type: YTN; PAM sequence: TTG
gggtcctcaataaggtttga

SEQ ID NO: 56552 - DNA, 20 bp, Artificial Sequence
  Description of Artificial Sequence: Synthetic oligonucleotide
  Target: SCN10A; (-) strand; PAM type: YTN; PAM sequence: TTT
ggggtcctcaataaggtttg

SEQ ID NO: 56553 - DNA, 20 bp, Artificial Sequence
  Description of Artificial Sequence: Synthetic oligonucleotide
  Target: SCN10A; (-) strand; PAM type: YTN; PAM sequence: TTA
tttggggtcctcaataaggt

SEQ ID NO: 56554 - DNA, 20 bp, Artificial Sequence
  Description of Artificial Sequence: Synthetic oligonucleotide
  Target: SCN10A; (-) strand; PAM type: YTN; PAM sequence: CTG
gcataaacaaaaaggtatca

SEQ ID NO: 56555 - DNA, 20 bp, Artificial Sequence
  Description of Artificial Sequence: Synthetic oligonucleotide
  Target: SCN10A; (-) strand; PAM type: YTN; PAM sequence: CTA
atatgatatacatatatctg

SEQ ID NO: 56556 - DNA, 20 bp, Artificial Sequence
  Description of Artificial Sequence: Synthetic oligonucleotide
  Target: SCN10A; (-) strand; PAM type: YTN; PAM sequence: TTC
taatatgatatacatatatc

SEQ ID NO: 56557 - DNA, 20 bp, Artificial Sequence
  Description of Artificial Sequence: Synthetic oligonucleotide
  Target: SCN10A; (-) strand; PAM type: YTN; PAM sequence: TTT
ctaatatgatatacatatat

SEQ ID NO: 56558 - DNA, 20 bp, Artificial Sequence
  Description of Artificial Sequence: Synthetic oligonucleotide
  Target: SCN10A; (-) strand; PAM type: YTN; PAM sequence: TTA
atttctaatatgatatacat

SEQ ID NO: 56559 - DNA, 20 bp, Artificial Sequence
  Description of Artificial Sequence: Synthetic oligonucleotide
  Target: SCN10A; (-) strand; PAM type: YTN; PAM sequence: TTA
tgtatatataggtatataag

SEQ ID NO: 56560 - DNA, 20 bp, Artificial Sequence
  Description of Artificial Sequence: Synthetic oligonucleotide
  Target: SCN10A; (-) strand; PAM type: YTN; PAM sequence: CTA
gttatgtatatataggtata

SEQ ID NO: 56561 - DNA, 20 bp, Artificial Sequence
  Description of Artificial Sequence: Synthetic oligonucleotide
  Target: SCN10A; (-) strand; PAM type: YTN; PAM sequence: CTA
gaccatgtagctagttatgt

SEQ ID NO: 56562 - DNA, 20 bp, Artificial Sequence
  Description of Artificial Sequence: Synthetic oligonucleotide
  Target: SCN10A; (-) strand; PAM type: YTN; PAM sequence: CTA
tgtatatacatacaactaga

SEQ ID NO: 56563 - DNA, 20 bp, Artificial Sequence
  Description of Artificial Sequence: Synthetic oligonucleotide
  Target: SCN10A; (-) strand; PAM type: YTN; PAM sequence: CTA
tatatatacatacaactatg

SEQ ID NO: 56564 - DNA, 20 bp, Artificial Sequence
  Description of Artificial Sequence: Synthetic oligonucleotide
  Target: SCN10A; (-) strand; PAM type: YTN; PAM sequence: CTA
tacactatatatatacatac

SEQ ID NO: 56565 - DNA, 20 bp, Artificial Sequence
  Description of Artificial Sequence: Synthetic oligonucleotide
  Target: SCN10A; (-) strand; PAM type: YTN; PAM sequence: CTA
atatgagatatatatacaca

SEQ ID NO: 56566 - DNA, 20 bp, Artificial Sequence
  Description of Artificial Sequence: Synthetic oligonucleotide
  Target: SCN10A; (-) strand; PAM type: YTN; PAM sequence: TTC
taatatgagatatatataca

SEQ ID NO: 56567 - DNA, 20 bp, Artificial Sequence
  Description of Artificial Sequence: Synthetic oligonucleotide
  Target: SCN10A; (-) strand; PAM type: YTN; PAM sequence: TTT
ctaatatgagatatatatac

SEQ ID NO: 56568 - DNA, 20 bp, Artificial Sequence
  Description of Artificial Sequence: Synthetic oligonucleotide
  Target: SCN10A; (-) strand; PAM type: YTN; PAM sequence: TTG
aatttctaatatgagatata

SEQ ID NO: 56569 - DNA, 20 bp, Artificial Sequence
  Description of Artificial Sequence: Synthetic oligonucleotide
  Target: SCN10A; (-) strand; PAM type: YTN; PAM sequence: TTT
gaatttctaatatgagatat

SEQ ID NO: 56570 - DNA, 20 bp, Artificial Sequence
  Description of Artificial Sequence: Synthetic oligonucleotide
  Target: SCN10A; (-) strand; PAM type: YTN; PAM sequence: TTT
tgaatttctaatatgagata

SEQ ID NO: 56571 - DNA, 20 bp, Artificial Sequence
  Description of Artificial Sequence: Synthetic oligonucleotide
  Target: SCN10A; (-) strand; PAM type: YTN; PAM sequence: CTG
agttttgaatttctaatatg

SEQ ID NO: 56572 - DNA, 20 bp, Artificial Sequence
  Description of Artificial Sequence: Synthetic oligonucleotide
  Target: SCN10A; (-) strand; PAM type: YTN; PAM sequence: TTC
ctgagttttgaatttctaat

SEQ ID NO: 56573 - DNA, 20 bp, Artificial Sequence
  Description of Artificial Sequence: Synthetic oligonucleotide
  Target: SCN10A; (-) strand; PAM type: YTN; PAM sequence: TTT
cctgagttttgaatttctaa

SEQ ID NO: 56574 - DNA, 20 bp, Artificial Sequence
  Description of Artificial Sequence: Synthetic oligonucleotide
  Target: SCN10A; (-) strand; PAM type: YTN; PAM sequence: TTA
aaatttcctgagttttgaat

SEQ ID NO: 56575 - DNA, 20 bp, Artificial Sequence
  Description of Artificial Sequence: Synthetic oligonucleotide
  Target: SCN10A; (-) strand; PAM type: YTN; PAM sequence: TTT
aaaatttcctgagttttgaa

SEQ ID NO: 56576 - DNA, 20 bp, Artificial Sequence
  Description of Artificial Sequence: Synthetic oligonucleotide
  Target: SCN10A; (-) strand; PAM type: YTN; PAM sequence: TTT
taaaatttcctgagttttga

SEQ ID NO: 56577 - DNA, 20 bp, Artificial Sequence
  Description of Artificial Sequence: Synthetic oligonucleotide
  Target: SCN10A; (-) strand; PAM type: YTN; PAM sequence: TTC
ccgtgttttaaaatttcctg

SEQ ID NO: 56578 - DNA, 20 bp, Artificial Sequence
  Description of Artificial Sequence: Synthetic oligonucleotide
  Target: SCN10A; (-) strand; PAM type: YTN; PAM sequence: CTG
tatattcccgtgttttaaaa

SEQ ID NO: 56579 - DNA, 20 bp, Artificial Sequence
  Description of Artificial Sequence: Synthetic oligonucleotide
  Target: SCN10A; (-) strand; PAM type: YTN; PAM sequence: CTG
gaatgtgtgcctgtatattc

SEQ ID NO: 56580 - DNA, 20 bp, Artificial Sequence
  Description of Artificial Sequence: Synthetic oligonucleotide
  Target: SCN10A; (-) strand; PAM type: YTN; PAM sequence: CTA
ctggaatgtgtgcctgtata

SEQ ID NO: 56581 - DNA, 20 bp, Artificial Sequence
  Description of Artificial Sequence: Synthetic oligonucleotide
  Target: SCN10A; (-) strand; PAM type: YTN; PAM sequence: CTA
aaagctactggaatgtgtgc

SEQ ID NO: 56582 - DNA, 20 bp, Artificial Sequence
  Description of Artificial Sequence: Synthetic oligonucleotide
  Target: SCN10A; (-) strand; PAM type: YTN; PAM sequence: CTC
taaaagctactggaatgtgt

SEQ ID NO: 56583 - DNA, 20 bp, Artificial Sequence
  Description of Artificial Sequence: Synthetic oligonucleotide
  Target: SCN10A; (-) strand; PAM type: YTN; PAM sequence: TTG
atgggggatgatgtcatcac

SEQ ID NO: 56584 - DNA, 20 bp, Artificial Sequence
  Description of Artificial Sequence: Synthetic oligonucleotide
  Target: SCN10A; (-) strand; PAM type: YTN; PAM sequence: CTA
ttgatgggggatgatgtcat

SEQ ID NO: 56585 - DNA, 20 bp, Artificial Sequence
  Description of Artificial Sequence: Synthetic oligonucleotide
  Target: SCN10A; (-) strand; PAM type: YTN; PAM sequence: TTG
gtgaatatagaggctattga

SEQ ID NO: 56586 - DNA, 20 bp, Artificial Sequence
  Description of Artificial Sequence: Synthetic oligonucleotide
  Target: SCN10A; (-) strand; PAM type: YTN; PAM sequence: TTA
tgatcatacattggtgaata

SEQ ID NO: 56587 - DNA, 20 bp, Artificial Sequence
  Description of Artificial Sequence: Synthetic oligonucleotide
  Target: SCN10A; (-) strand; PAM type: YTN; PAM sequence: CTT
atgatcatacattggtgaat

SEQ ID NO: 56588 - DNA, 20 bp, Artificial Sequence
  Description of Artificial Sequence: Synthetic oligonucleotide
  Target: SCN10A; (-) strand; PAM type: YTN; PAM sequence: CTC
ttatgatcatacattggtga

SEQ ID NO: 56589 - DNA, 20 bp, Artificial Sequence
  Description of Artificial Sequence: Synthetic oligonucleotide
  Target: SCN10A; (-) strand; PAM type: YTN; PAM sequence: TTC
tcttatgatcatacattggt

SEQ ID NO: 56590 - DNA, 20 bp, Artificial Sequence
  Description of Artificial Sequence: Synthetic oligonucleotide
  Target: SCN10A; (-) strand; PAM type: YTN; PAM sequence: TTT
ctcttatgatcatacattgg

SEQ ID NO: 56591 - DNA, 20 bp, Artificial Sequence
  Description of Artificial Sequence: Synthetic oligonucleotide
  Target: SCN10A; (-) strand; PAM type: YTN; PAM sequence: CTT
tctcttatgatcatacattg

SEQ ID NO: 56592 - DNA, 20 bp, Artificial Sequence
  Description of Artificial Sequence: Synthetic oligonucleotide
  Target: SCN10A; (-) strand; PAM type: YTN; PAM sequence: TTC
acacactttctcttatgatc

SEQ ID NO: 56593 - DNA, 20 bp, Artificial Sequence
  Description of Artificial Sequence: Synthetic oligonucleotide
  Target: SCN10A; (-) strand; PAM type: YTN; PAM sequence: TTT
cacacactttctcttatgat

SEQ ID NO: 56594 - DNA, 20 bp, Artificial Sequence
  Description of Artificial Sequence: Synthetic oligonucleotide
  Target: SCN10A; (-) strand; PAM type: YTN; PAM sequence: TTT
tcacacactttctcttatga

SEQ ID NO: 56595 - DNA, 20 bp, Artificial Sequence
  Description of Artificial Sequence: Synthetic oligonucleotide
  Target: SCN10A; (-) strand; PAM type: YTN; PAM sequence: TTT
ttcacacactttctcttatg

SEQ ID NO: 56596 - DNA, 20 bp, Artificial Sequence
  Description of Artificial Sequence: Synthetic oligonucleotide
  Target: SCN10A; (-) strand; PAM type: YTN; PAM sequence: CTT
tttcacacactttctcttat

SEQ ID NO: 56597 - DNA, 20 bp, Artificial Sequence
  Description of Artificial Sequence: Synthetic oligonucleotide
  Target: SCN10A; (-) strand; PAM type: YTN; PAM sequence: TTG
tctttttcacacactttctc

SEQ ID NO: 56598 - DNA, 20 bp, Artificial Sequence
  Description of Artificial Sequence: Synthetic oligonucleotide
  Target: SCN10A; (-) strand; PAM type: YTN; PAM sequence: TTT
gtctttttcacacactttct

SEQ ID NO: 56599 - DNA, 20 bp, Artificial Sequence
  Description of Artificial Sequence: Synthetic oligonucleotide
  Target: SCN10A; (-) strand; PAM type: YTN; PAM sequence: TTG
gatgtaatttgtctttttca

SEQ ID NO: 56600 - DNA, 20 bp, Artificial Sequence
  Description of Artificial Sequence: Synthetic oligonucleotide
  Target: SCN10A; (-) strand; PAM type: YTN; PAM sequence: CTT
ggatgtaatttgtctttttc

SEQ ID NO: 56601 - DNA, 20 bp, Artificial Sequence
  Description of Artificial Sequence: Synthetic oligonucleotide
  Target: SCN10A; (-) strand; PAM type: YTN; PAM sequence: TTG
tataacaatacttggatgta

SEQ ID NO: 56602 - DNA, 20 bp, Artificial Sequence
  Description of Artificial Sequence: Synthetic oligonucleotide
  Target: SCN10A; (-) strand; PAM type: YTN; PAM sequence: CTA
ttgtataacaatacttggat

SEQ ID NO: 56603 - DNA, 20 bp, Artificial Sequence
  Description of Artificial Sequence: Synthetic oligonucleotide
  Target: SCN10A; (-) strand; PAM type: YTN; PAM sequence: TTA
taaaatgaaaactattgtat

SEQ ID NO: 56604 - DNA, 20 bp, Artificial Sequence
  Description of Artificial Sequence: Synthetic oligonucleotide
  Target: SCN10A; (-) strand; PAM type: YTN; PAM sequence: TTT
ataaaatgaaaactattgta

SEQ ID NO: 56605 - DNA, 20 bp, Artificial Sequence
  Description of Artificial Sequence: Synthetic oligonucleotide
  Target: SCN10A; (-) strand; PAM type: YTN; PAM sequence: TTA
gtgggtttataaaatgaaaa

SEQ ID NO: 56606 - DNA, 20 bp, Artificial Sequence
  Description of Artificial Sequence: Synthetic oligonucleotide
  Target: SCN10A; (-) strand; PAM type: YTN; PAM sequence: TTT
agtgggtttataaaatgaaa

SEQ ID NO: 56607 - DNA, 20 bp, Artificial Sequence
  Description of Artificial Sequence: Synthetic oligonucleotide
  Target: SCN10A; (-) strand; PAM type: YTN; PAM sequence: TTT
tagtgggtttataaaatgaa

SEQ ID NO: 56608 - DNA, 20 bp, Artificial Sequence
  Description of Artificial Sequence: Synthetic oligonucleotide
  Target: SCN10A; (-) strand; PAM type: YTN; PAM sequence: CTG
ttttagtgggtttataaaat

SEQ ID NO: 56609 - DNA, 20 bp, Artificial Sequence
  Description of Artificial Sequence: Synthetic oligonucleotide
  Target: SCN10A; (-) strand; PAM type: YTN; PAM sequence: CTG
gtgtccccaaaactgtttta

SEQ ID NO: 56610 - DNA, 20 bp, Artificial Sequence
  Description of Artificial Sequence: Synthetic oligonucleotide
  Target: SCN10A; (-) strand; PAM type: YTN; PAM sequence: TTG
gaacccctggtgtccccaaa

SEQ ID NO: 56611 - DNA, 20 bp, Artificial Sequence
  Description of Artificial Sequence: Synthetic oligonucleotide
  Target: SCN10A; (-) strand; PAM type: YTN; PAM sequence: CTT
ggaacccctggtgtccccaa

SEQ ID NO: 56612 - DNA, 20 bp, Artificial Sequence
  Description of Artificial Sequence: Synthetic oligonucleotide
  Target: SCN10A; (-) strand; PAM type: YTN; PAM sequence: CTA
tgatcttggaacccctggtg

SEQ ID NO: 56613 - DNA, 20 bp, Artificial Sequence
  Description of Artificial Sequence: Synthetic oligonucleotide
  Target: SCN10A; (-) strand; PAM type: YTN; PAM sequence: CTC
aactatgatcttggaacccc

SEQ ID NO: 56614 - DNA, 20 bp, Artificial Sequence
  Description of Artificial Sequence: Synthetic oligonucleotide
  Target: SCN10A; (-) strand; PAM type: YTN; PAM sequence: TTA
agccagtggtcctcaactat

SEQ ID NO: 56615 - DNA, 20 bp, Artificial Sequence
  Description of Artificial Sequence: Synthetic oligonucleotide
  Target: SCN10A; (-) strand; PAM type: YTN; PAM sequence: TTT
aagccagtggtcctcaacta

SEQ ID NO: 56616 - DNA, 20 bp, Artificial Sequence
  Description of Artificial Sequence: Synthetic oligonucleotide
  Target: SCN10A; (-) strand; PAM type: YTN; PAM sequence: TTG
ggggaggagcatggcggtga

SEQ ID NO: 56617 - DNA, 20 bp, Artificial Sequence
  Description of Artificial Sequence: Synthetic oligonucleotide
  Target: SCN10A; (-) strand; PAM type: YTN; PAM sequence: TTG
aggttgggggaggagcatgg

SEQ ID NO: 56618 - DNA, 20 bp, Artificial Sequence
  Description of Artificial Sequence: Synthetic oligonucleotide
  Target: SCN10A; (-) strand; PAM type: YTN; PAM sequence: CTT
gaggttgggggaggagcatg

SEQ ID NO: 56619 - DNA, 20 bp, Artificial Sequence
  Description of Artificial Sequence: Synthetic oligonucleotide
  Target: SCN10A; (-) strand; PAM type: YTN; PAM sequence: TTG
caggtggagagcagacatct

SEQ ID NO: 56620 - DNA, 20 bp, Artificial Sequence
  Description of Artificial Sequence: Synthetic oligonucleotide
  Target: SCN10A; (-) strand; PAM type: YTN; PAM sequence: TTT
gcaggtggagagcagacatc

SEQ ID NO: 56621 - DNA, 20 bp, Artificial Sequence
  Description of Artificial Sequence: Synthetic oligonucleotide
  Target: SCN10A; (-) strand; PAM type: YTN; PAM sequence: CTT
tgcaggtggagagcagacat

SEQ ID NO: 56622 - DNA, 20 bp, Artificial Sequence
  Description of Artificial Sequence: Synthetic oligonucleotide
  Target: SCN10A; (-) strand; PAM type: YTN; PAM sequence: CTC
tttgcaggtggagagcagac

SEQ ID NO: 56623 - DNA, 20 bp, Artificial Sequence
  Description of Artificial Sequence: Synthetic oligonucleotide
  Target: SCN10A; (-) strand; PAM type: YTN; PAM sequence: TTG
ggtctctttgcaggtggaga

SEQ ID NO: 56624 - DNA, 20 bp, Artificial Sequence
  Description of Artificial Sequence: Synthetic oligonucleotide
  Target: SCN10A; (-) strand; PAM type: YTN; PAM sequence: CTC
cagaggagttgggtctcttt

SEQ ID NO: 56625 - DNA, 20 bp, Artificial Sequence
  Description of Artificial Sequence: Synthetic oligonucleotide
  Target: SCN10A; (-) strand; PAM type: YTN; PAM sequence: CTG
gggcctccagaggagttggg

SEQ ID NO: 56626 - DNA, 20 bp, Artificial Sequence
  Description of Artificial Sequence: Synthetic oligonucleotide
  Target: SCN10A; (-) strand; PAM type: YTN; PAM sequence: CTG
gcctggggcctccagaggag

SEQ ID NO: 56627 - DNA, 20 bp, Artificial Sequence
  Description of Artificial Sequence: Synthetic oligonucleotide
  Target: SCN10A; (-) strand; PAM type: YTN; PAM sequence: CTC
tggcctggggcctccagagg

SEQ ID NO: 56628 - DNA, 20 bp, Artificial Sequence
  Description of Artificial Sequence: Synthetic oligonucleotide
  Target: SCN10A; (-) strand; PAM type: YTN; PAM sequence: TTG
gatgacctctggcctggggc

SEQ ID NO: 56629 - DNA, 20 bp, Artificial Sequence
  Description of Artificial Sequence: Synthetic oligonucleotide
  Target: SCN10A; (-) strand; PAM type: YTN; PAM sequence: CTT
ggatgacctctggcctgggg

SEQ ID NO: 56630 - DNA, 20 bp, Artificial Sequence
  Description of Artificial Sequence: Synthetic oligonucleotide
  Target: SCN10A; (-) strand; PAM type: YTN; PAM sequence: TTC
ccttggatgacctctggcct

SEQ ID NO: 56631 - DNA, 20 bp, Artificial Sequence
  Description of Artificial Sequence: Synthetic oligonucleotide
  Target: SCN10A; (-) strand; PAM type: YTN; PAM sequence: CTG
ttcccttggatgacctctgg

SEQ ID NO: 56632 - DNA, 20 bp, Artificial Sequence
  Description of Artificial Sequence: Synthetic oligonucleotide
  Target: SCN10A; (-) strand; PAM type: YTN; PAM sequence: TTG
gctgttcccttggatgacct

SEQ ID NO: 56633 - DNA, 20 bp, Artificial Sequence
  Description of Artificial Sequence: Synthetic oligonucleotide
  Target: SCN10A; (-) strand; PAM type: YTN; PAM sequence: TTC
agggaaagttggctgttccc

SEQ ID NO: 56634 - DNA, 20 bp, Artificial Sequence
  Description of Artificial Sequence: Synthetic oligonucleotide
  Target: SCN10A; (-) strand; PAM type: YTN; PAM sequence: TTT
cagggaaagttggctgttcc

SEQ ID NO: 56635 - DNA, 20 bp, Artificial Sequence
  Description of Artificial Sequence: Synthetic oligonucleotide
  Target: SCN10A; (-) strand; PAM type: YTN; PAM sequence: CTT
tcagggaaagttggctgttc

SEQ ID NO: 56636 - DNA, 20 bp, Artificial Sequence
  Description of Artificial Sequence: Synthetic oligonucleotide
  Target: SCN10A; (-) strand; PAM type: YTN; PAM sequence: CTG
cagagctttcagggaaagtt

SEQ ID NO: 56637 - DNA, 20 bp, Artificial Sequence
  Description of Artificial Sequence: Synthetic oligonucleotide
  Target: SCN10A; (-) strand; PAM type: YTN; PAM sequence: CTG
ctgcagagctttcagggaaa

SEQ ID NO: 56638 - DNA, 20 bp, Artificial Sequence
  Description of Artificial Sequence: Synthetic oligonucleotide
  Target: SCN10A; (-) strand; PAM type: YTN; PAM sequence: TTC
aaaagcagataactgctgca

SEQ ID NO: 56639 - DNA, 20 bp, Artificial Sequence
  Description of Artificial Sequence: Synthetic oligonucleotide
  Target: SCN10A; (-) strand; PAM type: YTN; PAM sequence: CTT
caaaagcagataactgctgc

SEQ ID NO: 56640 - DNA, 20 bp, Artificial Sequence
  Description of Artificial Sequence: Synthetic oligonucleotide
  Target: SCN10A; (-) strand; PAM type: YTN; PAM sequence: CTA
aacccacatcttcaaaagca

SEQ ID NO: 56641 - DNA, 20 bp, Artificial Sequence
  Description of Artificial Sequence: Synthetic oligonucleotide
  Target: SCN10A; (-) strand; PAM type: YTN; PAM sequence: CTA
actaaacccacatcttcaaa

SEQ ID NO: 56642 - DNA, 20 bp, Artificial Sequence
  Description of Artificial Sequence: Synthetic oligonucleotide
  Target: SCN10A; (-) strand; PAM type: YTN; PAM sequence: TTA
tgatagaaactaactaaacc

SEQ ID NO: 56643 - DNA, 20 bp, Artificial Sequence
  Description of Artificial Sequence: Synthetic oligonucleotide
  Target: SCN10A; (-) strand; PAM type: YTN; PAM sequence: TTT
atgatagaaactaactaaac

SEQ ID NO: 56644 - DNA, 20 bp, Artificial Sequence
  Description of Artificial Sequence: Synthetic oligonucleotide
  Target: SCN10A; (-) strand; PAM type: YTN; PAM sequence: TTA
tgacatttatgatagaaact

SEQ ID NO: 56645 - DNA, 20 bp, Artificial Sequence
  Description of Artificial Sequence: Synthetic oligonucleotide
  Target: SCN10A; (-) strand; PAM type: YTN; PAM sequence: TTT
atgacatttatgatagaaac

SEQ ID NO: 56646 - DNA, 20 bp, Artificial Sequence
  Description of Artificial Sequence: Synthetic oligonucleotide
  Target: SCN10A; (-) strand; PAM type: YTN; PAM sequence: TTT
tatgacatttatgatagaaa

SEQ ID NO: 56647 - DNA, 20 bp, Artificial Sequence
  Description of Artificial Sequence: Synthetic oligonucleotide
  Target: SCN10A; (-) strand; PAM type: YTN; PAM sequence: TTT
ttatgacatttatgatagaa

SEQ ID NO: 56648 - DNA, 20 bp, Artificial Sequence
  Description of Artificial Sequence: Synthetic oligonucleotide
  Target: SCN10A; (-) strand; PAM type: YTN; PAM sequence: TTG
aatttttatgacatttatga

SEQ ID NO: 56649 - DNA, 20 bp, Artificial Sequence
  Description of Artificial Sequence: Synthetic oligonucleotide
  Target: SCN10A; (-) strand; PAM type: YTN; PAM sequence: TTT
gaatttttatgacatttatg

SEQ ID NO: 56650 - DNA, 20 bp, Artificial Sequence
  Description of Artificial Sequence: Synthetic oligonucleotide
  Target: SCN10A; (-) strand; PAM type: YTN; PAM sequence: CTT
tgaatttttatgacatttat

SEQ ID NO: 56651 - DNA, 20 bp, Artificial Sequence
  Description of Artificial Sequence: Synthetic oligonucleotide
  Target: SCN10A; (-) strand; PAM type: YTN; PAM sequence: CTC
tttgaatttttatgacattt

SEQ ID NO: 56652 - DNA, 20 bp, Artificial Sequence
  Description of Artificial Sequence: Synthetic oligonucleotide
  Target: SCN10A; (-) strand; PAM type: YTN; PAM sequence: TTG
atgatctctttgaattttta

SEQ ID NO: 56653 - DNA, 20 bp, Artificial Sequence
  Description of Artificial Sequence: Synthetic oligonucleotide
  Target: SCN10A; (-) strand; PAM type: YTN; PAM sequence: TTT
gatgatctctttgaattttt

SEQ ID NO: 56654 - DNA, 20 bp, Artificial Sequence
  Description of Artificial Sequence: Synthetic oligonucleotide
  Target: SCN10A; (-) strand; PAM type: YTN; PAM sequence: TTA
tttgatgatctctttgaatt

SEQ ID NO: 56655 - DNA, 20 bp, Artificial Sequence
  Description of Artificial Sequence: Synthetic oligonucleotide
  Target: SCN10A; (-) strand; PAM type: YTN; PAM sequence: CTT
atttgatgatctctttgaat

SEQ ID NO: 56656 - DNA, 20 bp, Artificial Sequence
  Description of Artificial Sequence: Synthetic oligonucleotide
  Target: SCN10A; (-) strand; PAM type: YTN; PAM sequence: CTA
acttatttgatgatctcttt

SEQ ID NO: 56657 - DNA, 20 bp, Artificial Sequence
  Description of Artificial Sequence: Synthetic oligonucleotide
  Target: SCN10A; (-) strand; PAM type: YTN; PAM sequence: CTC
taacttatttgatgatctct

SEQ ID NO: 56658 - DNA, 20 bp, Artificial Sequence
  Description of Artificial Sequence: Synthetic oligonucleotide
  Target: SCN10A; (-) strand; PAM type: YTN; PAM sequence: TTA
acaaccaaaaaaaatatata

SEQ ID NO: 56659 - DNA, 20 bp, Artificial Sequence
  Description of Artificial Sequence: Synthetic oligonucleotide
  Target: SCN10A; (-) strand; PAM type: YTN; PAM sequence: TTC
cgttaacaaccaaaaaaaat

SEQ ID NO: 56660 - DNA, 20 bp, Artificial Sequence
  Description of Artificial Sequence: Synthetic oligonucleotide
  Target: SCN10A; (-) strand; PAM type: YTN; PAM sequence: CTA
aagattccgttaacaaccaa

SEQ ID NO: 56661 - DNA, 20 bp, Artificial Sequence
  Description of Artificial Sequence: Synthetic oligonucleotide
  Target: SCN10A; (-) strand; PAM type: YTN; PAM sequence: CTG
ctaaagattccgttaacaac

SEQ ID NO: 56662 - DNA, 20 bp, Artificial Sequence
  Description of Artificial Sequence: Synthetic oligonucleotide
  Target: SCN10A; (-) strand; PAM type: YTN; PAM sequence: CTG
ggtgatgtggcagtctgcta

SEQ ID NO: 56663 - DNA, 20 bp, Artificial Sequence
  Description of Artificial Sequence: Synthetic oligonucleotide
  Target: SCN10A; (-) strand; PAM type: YTN; PAM sequence: TTG
gccctgggtgatgtggcagt

SEQ ID NO: 56664 - DNA, 20 bp, Artificial Sequence
  Description of Artificial Sequence: Synthetic oligonucleotide
  Target: SCN10A; (-) strand; PAM type: YTN; PAM sequence: CTT
ggccctgggtgatgtggcag

SEQ ID NO: 56665 - DNA, 20 bp, Artificial Sequence
  Description of Artificial Sequence: Synthetic oligonucleotide
  Target: SCN10A; (-) strand; PAM type: YTN; PAM sequence: CTC
cttggccctgggtgatgtgg

SEQ ID NO: 56666 - DNA, 20 bp, Artificial Sequence
  Description of Artificial Sequence: Synthetic oligonucleotide
  Target: SCN10A; (-) strand; PAM type: YTN; PAM sequence: CTC
ggtcccacccagcccagaaa

SEQ ID NO: 56667 - DNA, 20 bp, Artificial Sequence
  Description of Artificial Sequence: Synthetic oligonucleotide
  Target: SCN10A; (-) strand; PAM type: YTN; PAM sequence: TTG
gagaggaagtctcggtccca

SEQ ID NO: 56668 - DNA, 20 bp, Artificial Sequence
  Description of Artificial Sequence: Synthetic oligonucleotide
  Target: SCN10A; (-) strand; PAM type: YTN; PAM sequence: CTT
ggagaggaagtctcggtccc

SEQ ID NO: 56669 - DNA, 20 bp, Artificial Sequence
  Description of Artificial Sequence: Synthetic oligonucleotide
  Target: SCN10A; (-) strand; PAM type: YTN; PAM sequence: CTC
ttggagaggaagtctcggtc

SEQ ID NO: 56670 - DNA, 20 bp, Artificial Sequence
  Description of Artificial Sequence: Synthetic oligonucleotide
  Target: SCN10A; (-) strand; PAM type: YTN; PAM sequence: CTC
agctcttggagaggaagtct

SEQ ID NO: 56671 - DNA, 20 bp, Artificial Sequence
  Description of Artificial Sequence: Synthetic oligonucleotide
  Target: SCN10A; (-) strand; PAM type: YTN; PAM sequence: CTC
tcagctcttggagaggaagt

SEQ ID NO: 56672 - DNA, 20 bp, Artificial Sequence
  Description of Artificial Sequence: Synthetic oligonucleotide
  Target: SCN10A; (-) strand; PAM type: YTN; PAM sequence: CTG
ctctcagctcttggagagga

SEQ ID NO: 56673 - DNA, 20 bp, Artificial Sequence
  Description of Artificial Sequence: Synthetic oligonucleotide
  Target: SCN10A; (-) strand; PAM type: YTN; PAM sequence: CTA
gtaggaatgtctgctctcag

SEQ ID NO: 56674 - DNA, 20 bp, Artificial Sequence
  Description of Artificial Sequence: Synthetic oligonucleotide
  Target: SCN10A; (-) strand; PAM type: YTN; PAM sequence: CTA
ctagtaggaatgtctgctct

SEQ ID NO: 56675 - DNA, 20 bp, Artificial Sequence
  Description of Artificial Sequence: Synthetic oligonucleotide
  Target: SCN10A; (-) strand; PAM type: YTN; PAM sequence: CTA
cagcacacaccgggtaagag

SEQ ID NO: 56676 - DNA, 20 bp, Artificial Sequence
  Description of Artificial Sequence: Synthetic oligonucleotide
  Target: SCN10A; (-) strand; PAM type: YTN; PAM sequence: TTC
tacagcacacaccgggtaag

SEQ ID NO: 56677 - DNA, 20 bp, Artificial Sequence
  Description of Artificial Sequence: Synthetic oligonucleotide
  Target: SCN10A; (-) strand; PAM type: YTN; PAM sequence: CTA
gatccgttctacagcacaca

SEQ ID NO: 56678 - DNA, 20 bp, Artificial Sequence
  Description of Artificial Sequence: Synthetic oligonucleotide
  Target: SCN10A; (-) strand; PAM type: YTN; PAM sequence: CTG
gaggatctagatccgttcta

SEQ ID NO: 56679 - DNA, 20 bp, Artificial Sequence
  Description of Artificial Sequence: Synthetic oligonucleotide
  Target: SCN10A; (-) strand; PAM type: YTN; PAM sequence: CTG
atcggggagcccctggagga

SEQ ID NO: 56680 - DNA, 20 bp, Artificial Sequence
  Description of Artificial Sequence: Synthetic oligonucleotide
  Target: SCN10A; (-) strand; PAM type: YTN; PAM sequence: CTC
ccagcagaactgatcgggga

SEQ ID NO: 56681 - DNA, 20 bp, Artificial Sequence
  Description of Artificial Sequence: Synthetic oligonucleotide
  Target: SCN10A; (-) strand; PAM type: YTN; PAM sequence: CTA
tggtgagctcccagcagaac

SEQ ID NO: 56682 - DNA, 20 bp, Artificial Sequence
  Description of Artificial Sequence: Synthetic oligonucleotide
  Target: SCN10A; (-) strand; PAM type: YTN; PAM sequence: TTC
tatggtgagctcccagcaga

SEQ ID NO: 56683 - DNA, 20 bp, Artificial Sequence
  Description of Artificial Sequence: Synthetic oligonucleotide
  Target: SCN10A; (-) strand; PAM type: YTN; PAM sequence: CTG
cccaagttctatggtgagct

SEQ ID NO: 56684 - DNA, 20 bp, Artificial Sequence
  Description of Artificial Sequence: Synthetic oligonucleotide
  Target: SCN10A; (-) strand; PAM type: YTN; PAM sequence: CTG
caaccagctgcccaagttct

SEQ ID NO: 56685 - DNA, 20 bp, Artificial Sequence
  Description of Artificial Sequence: Synthetic oligonucleotide
  Target: SCN10A; (-) strand; PAM type: YTN; PAM sequence: TTG
aaagcctgcaaccagctgcc

SEQ ID NO: 56686 - DNA, 20 bp, Artificial Sequence
  Description of Artificial Sequence: Synthetic oligonucleotide
  Target: SCN10A; (-) strand; PAM type: YTN; PAM sequence: CTT
gaaagcctgcaaccagctgc

SEQ ID NO: 56687 - DNA, 20 bp, Artificial Sequence
  Description of Artificial Sequence: Synthetic oligonucleotide
  Target: SCN10A; (-) strand; PAM type: YTN; PAM sequence: CTG
gacttgaaagcctgcaacca

SEQ ID NO: 56688 - DNA, 20 bp, Artificial Sequence
  Description of Artificial Sequence: Synthetic oligonucleotide
  Target: SCN10A; (-) strand; PAM type: YTN; PAM sequence: CTC
ggccccagctggacttgaaa

SEQ ID NO: 56689 - DNA, 20 bp, Artificial Sequence
  Description of Artificial Sequence: Synthetic oligonucleotide
  Target: SCN10A; (-) strand; PAM type: YTN; PAM sequence: CTG
ccaagcagggaacaaagaaa

SEQ ID NO: 56690 - DNA, 20 bp, Artificial Sequence
  Description of Artificial Sequence: Synthetic oligonucleotide
  Target: SCN10A; (-) strand; PAM type: YTN; PAM sequence: TTG
ctgccaagcagggaacaaag

SEQ ID NO: 56691 - DNA, 20 bp, Artificial Sequence
  Description of Artificial Sequence: Synthetic oligonucleotide
  Target: SCN10A; (-) strand; PAM type: YTN; PAM sequence: CTG
gtggagatagagaagcaaat

SEQ ID NO: 56692 - DNA, 20 bp, Artificial Sequence
  Description of Artificial Sequence: Synthetic oligonucleotide
  Target: SCN10A; (-) strand; PAM type: YTN; PAM sequence: CTC
cggagtcactggtggagata

SEQ ID NO: 56693 - DNA, 20 bp, Artificial Sequence
  Description of Artificial Sequence: Synthetic oligonucleotide
  Target: SCN10A; (-) strand; PAM type: YTN; PAM sequence: TTA
ctccggagtcactggtggag

SEQ ID NO: 56694 - DNA, 20 bp, Artificial Sequence
  Description of Artificial Sequence: Synthetic oligonucleotide
  Target: SCN10A; (-) strand; PAM type: YTN; PAM sequence: TTT
actccggagtcactggtgga

SEQ ID NO: 56695 - DNA, 20 bp, Artificial Sequence
  Description of Artificial Sequence: Synthetic oligonucleotide
  Target: SCN10A; (-) strand; PAM type: YTN; PAM sequence: CTT
tactccggagtcactggtgg

SEQ ID NO: 56696 - DNA, 20 bp, Artificial Sequence
  Description of Artificial Sequence: Synthetic oligonucleotide
  Target: SCN10A; (-) strand; PAM type: YTN; PAM sequence: TTC
cgtcgctttactccggagtc

SEQ ID NO: 56697 - DNA, 20 bp, Artificial Sequence
  Description of Artificial Sequence: Synthetic oligonucleotide
  Target: SCN10A; (-) strand; PAM type: YTN; PAM sequence: CTT
ccgtcgctttactccggagt

SEQ ID NO: 56698 - DNA, 20 bp, Artificial Sequence
  Description of Artificial Sequence: Synthetic oligonucleotide
  Target: SCN10A; (-) strand; PAM type: YTN; PAM sequence: CTA
acaacttccgtcgctttact

SEQ ID NO: 56699 - DNA, 20 bp, Artificial Sequence
  Description of Artificial Sequence: Synthetic oligonucleotide
  Target: SCN10A; (-) strand; PAM type: YTN; PAM sequence: CTC
gaaactaacaacttccgtcg

SEQ ID NO: 56700 - DNA, 20 bp, Artificial Sequence
  Description of Artificial Sequence: Synthetic oligonucleotide
  Target: SCN10A; (-) strand; PAM type: YTN; PAM sequence: TTG
gatccctcgaaactaacaac

SEQ ID NO: 56701 - DNA, 20 bp, Artificial Sequence
  Description of Artificial Sequence: Synthetic oligonucleotide
  Target: SCN10A; (-) strand; PAM type: YTN; PAM sequence: TTC
cccattggatccctcgaaac

SEQ ID NO: 56702 - DNA, 20 bp, Artificial Sequence
  Description of Artificial Sequence: Synthetic oligonucleotide
  Target: SCN10A; (-) strand; PAM type: YTN; PAM sequence: CTG
aagaagaatgagaagatgga

SEQ ID NO: 56703 - DNA, 20 bp, Artificial Sequence
  Description of Artificial Sequence: Synthetic oligonucleotide
  Target: SCN10A; (-) strand; PAM type: YTN; PAM sequence: TTC
ctgaagaagaatgagaagat

SEQ ID NO: 56704 - DNA, 20 bp, Artificial Sequence
  Description of Artificial Sequence: Synthetic oligonucleotide
  Target: SCN10A; (-) strand; PAM type: YTN; PAM sequence: CTT
cctgaagaagaatgagaaga

SEQ ID NO: 56705 - DNA, 20 bp, Artificial Sequence
  Description of Artificial Sequence: Synthetic oligonucleotide
  Target: SCN10A; (-) strand; PAM type: YTN; PAM sequence: TTA
taagagtataaatacttcct

SEQ ID NO: 56706 - DNA, 20 bp, Artificial Sequence
  Description of Artificial Sequence: Synthetic oligonucleotide
  Target: SCN10A; (-) strand; PAM type: YTN; PAM sequence: CTT
ataagagtataaatacttcc

SEQ ID NO: 56707 - DNA, 20 bp, Artificial Sequence
  Description of Artificial Sequence: Synthetic oligonucleotide
  Target: SCN10A; (-) strand; PAM type: YTN; PAM sequence: CTC
ttataagagtataaatactt

SEQ ID NO: 56708 - DNA, 20 bp, Artificial Sequence
  Description of Artificial Sequence: Synthetic oligonucleotide
  Target: SCN10A; (-) strand; PAM type: YTN; PAM sequence: TTA
tgtccactcttataagagta

SEQ ID NO: 56709 - DNA, 20 bp, Artificial Sequence
  Description of Artificial Sequence: Synthetic oligonucleotide
  Target: SCN10A; (-) strand; PAM type: YTN; PAM sequence: CTG
tggttatgtccactcttata

SEQ ID NO: 56710 - DNA, 20 bp, Artificial Sequence
  Description of Artificial Sequence: Synthetic oligonucleotide
  Target: SCN10A; (-) strand; PAM type: YTN; PAM sequence: CTC
tgtggttatgtccactctta

SEQ ID NO: 56711 - DNA, 20 bp, Artificial Sequence
  Description of Artificial Sequence: Synthetic oligonucleotide
  Target: SCN10A; (-) strand; PAM type: YTN; PAM sequence: CTC
tctgtggttatgtccactct

SEQ ID NO: 56712 - DNA, 20 bp, Artificial Sequence
  Description of Artificial Sequence: Synthetic oligonucleotide
  Target: SCN10A; (-) strand; PAM type: YTN; PAM sequence: CTG
tcacctctctgtggttatgt

SEQ ID NO: 56713 - DNA, 20 bp, Artificial Sequence
  Description of Artificial Sequence: Synthetic oligonucleotide
  Target: SCN10A; (-) strand; PAM type: YTN; PAM sequence: CTG
acaatcaagatgggacagat

SEQ ID NO: 56714 - DNA, 20 bp, Artificial Sequence
  Description of Artificial Sequence: Synthetic oligonucleotide
  Target: SCN10A; (-) strand; PAM type: YTN; PAM sequence: TTC
tgacaatcaagatgggacag

SEQ ID NO: 56715 - DNA, 20 bp, Artificial Sequence
  Description of Artificial Sequence: Synthetic oligonucleotide
  Target: SCN10A; (-) strand; PAM type: YTN; PAM sequence: CTG
ttctgacaatcaagatggga

SEQ ID NO: 56716 - DNA, 20 bp, Artificial Sequence
  Description of Artificial Sequence: Synthetic oligonucleotide
  Target: SCN10A; (-) strand; PAM type: YTN; PAM sequence: TTC
agggaggggccagatatgag

SEQ ID NO: 56717 - DNA, 20 bp, Artificial Sequence
  Description of Artificial Sequence: Synthetic oligonucleotide
  Target: SCN10A; (-) strand; PAM type: YTN; PAM sequence: CTG
ggaggagccaagtgtgagtt

SEQ ID NO: 56718 - DNA, 20 bp, Artificial Sequence
  Description of Artificial Sequence: Synthetic oligonucleotide
  Target: SCN10A; (-) strand; PAM type: YTN; PAM sequence: TTC
ctgggaggagccaagtgtga

SEQ ID NO: 56719 - DNA, 20 bp, Artificial Sequence
  Description of Artificial Sequence: Synthetic oligonucleotide
  Target: SCN10A; (-) strand; PAM type: YTN; PAM sequence: TTG
caggggaatgggttcctggg

SEQ ID NO: 56720 - DNA, 20 bp, Artificial Sequence
  Description of Artificial Sequence: Synthetic oligonucleotide
  Target: SCN10A; (-) strand; PAM type: YTN; PAM sequence: CTT
gcaggggaatgggttcctgg

SEQ ID NO: 56721 - DNA, 20 bp, Artificial Sequence
  Description of Artificial Sequence: Synthetic oligonucleotide
  Target: SCN10A; (-) strand; PAM type: YTN; PAM sequence: CTG
aatgccttgcaggggaatgg

SEQ ID NO: 56722 - DNA, 20 bp, Artificial Sequence
  Description of Artificial Sequence: Synthetic oligonucleotide
  Target: SCN10A; (-) strand; PAM type: YTN; PAM sequence: CTC
ccctgaatgccttgcagggg

SEQ ID NO: 56723 - DNA, 20 bp, Artificial Sequence
  Description of Artificial Sequence: Synthetic oligonucleotide
  Target: SCN10A; (-) strand; PAM type: YTN; PAM sequence: TTG
aataaacagcctcccctgaa

SEQ ID NO: 56724 - DNA, 20 bp, Artificial Sequence
  Description of Artificial Sequence: Synthetic oligonucleotide
  Target: SCN10A; (-) strand; PAM type: YTN; PAM sequence: CTG
gaggagggttgaataaacag

SEQ ID NO: 56725 - DNA, 20 bp, Artificial Sequence
  Description of Artificial Sequence: Synthetic oligonucleotide
  Target: SCN10A; (-) strand; PAM type: YTN; PAM sequence: CTG
aggcacctggaggagggttg

SEQ ID NO: 56726 - DNA, 20 bp, Artificial Sequence
  Description of Artificial Sequence: Synthetic oligonucleotide
  Target: SCN10A; (-) strand; PAM type: YTN; PAM sequence: CTG
gtggtggtggtaggatggta

SEQ ID NO: 56727 - DNA, 20 bp, Artificial Sequence
  Description of Artificial Sequence: Synthetic oligonucleotide
  Target: SCN10A; (-) strand; PAM type: YTN; PAM sequence: CTA
aatctggtggtggtggtagg

SEQ ID NO: 56728 - DNA, 20 bp, Artificial Sequence
  Description of Artificial Sequence: Synthetic oligonucleotide
  Target: SCN10A; (-) strand; PAM type: YTN; PAM sequence: CTG
gaaatgaggagagagggcag

SEQ ID NO: 56729 - DNA, 20 bp, Artificial Sequence
  Description of Artificial Sequence: Synthetic oligonucleotide
  Target: SCN10A; (-) strand; PAM type: YTN; PAM sequence: CTC
agtggtcctggaaatgagga

SEQ ID NO: 56730 - DNA, 20 bp, Artificial Sequence
  Description of Artificial Sequence: Synthetic oligonucleotide
  Target: SCN10A; (-) strand; PAM type: YTN; PAM sequence: CTG
gaactcagtggtcctggaaa

SEQ ID NO: 56731 - DNA, 20 bp, Artificial Sequence
  Description of Artificial Sequence: Synthetic oligonucleotide
  Target: SCN10A; (-) strand; PAM type: YTN; PAM sequence: TTG
atgaatatgggagagtgcct

SEQ ID NO: 56732 - DNA, 20 bp, Artificial Sequence
  Description of Artificial Sequence: Synthetic oligonucleotide
  Target: SCN10A; (-) strand; PAM type: YTN; PAM sequence: TTT
gatgaatatgggagagtgcc

SEQ ID NO: 56733 - DNA, 20 bp, Artificial Sequence
  Description of Artificial Sequence: Synthetic oligonucleotide
  Target: SCN10A; (-) strand; PAM type: YTN; PAM sequence: CTT
tgatgaatatgggagagtgc

SEQ ID NO: 56734 - DNA, 20 bp, Artificial Sequence
  Description of Artificial Sequence: Synthetic oligonucleotide
  Target: SCN10A; (-) strand; PAM type: YTN; PAM sequence: CTA
taaaccaaagtctttgatga

SEQ ID NO: 56735 - DNA, 20 bp, Artificial Sequence
  Description of Artificial Sequence: Synthetic oligonucleotide
  Target: SCN10A; (-) strand; PAM type: YTN; PAM sequence: TTA
agataaagtagactataaac

SEQ ID NO: 56736 - DNA, 20 bp, Artificial Sequence
  Description of Artificial Sequence: Synthetic oligonucleotide
  Target: SCN10A; (-) strand; PAM type: YTN; PAM sequence: CTT
aagataaagtagactataaa

SEQ ID NO: 56737 - DNA, 20 bp, Artificial Sequence
  Description of Artificial Sequence: Synthetic oligonucleotide
  Target: SCN10A; (-) strand; PAM type: YTN; PAM sequence: TTG
tgataagaaagtagcatgag

SEQ ID NO: 56738 - DNA, 20 bp, Artificial Sequence
  Description of Artificial Sequence: Synthetic oligonucleotide
  Target: SCN10A; (-) strand; PAM type: YTN; PAM sequence: TTG
acaatgtcaataaataaaag

SEQ ID NO: 56739 - DNA, 20 bp, Artificial Sequence
  Description of Artificial Sequence: Synthetic oligonucleotide
  Target: SCN10A; (-) strand; PAM type: YTN; PAM sequence: TTC
aaacaggtggagaaatgttg

SEQ ID NO: 56740 - DNA, 20 bp, Artificial Sequence
  Description of Artificial Sequence: Synthetic oligonucleotide
  Target: SCN10A; (-) strand; PAM type: YTN; PAM sequence: TTG
gaggtccaaatgaaattcaa

SEQ ID NO: 56741 - DNA, 20 bp, Artificial Sequence
  Description of Artificial Sequence: Synthetic oligonucleotide
  Target: SCN10A; (-) strand; PAM type: YTN; PAM sequence: CTT
ggaggtccaaatgaaattca

SEQ ID NO: 56742 - DNA, 20 bp, Artificial Sequence
  Description of Artificial Sequence: Synthetic oligonucleotide
  Target: SCN10A; (-) strand; PAM type: YTN; PAM sequence: CTC
cagtaacttggaggtccaaa

SEQ ID NO: 56743 - DNA, 20 bp, Artificial Sequence
  Description of Artificial Sequence: Synthetic oligonucleotide
  Target: SCN10A; (-) strand; PAM type: YTN; PAM sequence: TTC
tccagtaacttggaggtcca

SEQ ID NO: 56744 - DNA, 20 bp, Artificial Sequence
  Description of Artificial Sequence: Synthetic oligonucleotide
  Target: SCN10A; (-) strand; PAM type: YTN; PAM sequence: CTG
gagttctccagtaacttgga

SEQ ID NO: 56745 - DNA, 20 bp, Artificial Sequence
  Description of Artificial Sequence: Synthetic oligonucleotide
  Target: SCN10A; (-) strand; PAM type: YTN; PAM sequence: CTC
caataatctggagttctcca

SEQ ID NO: 56746 - DNA, 20 bp, Artificial Sequence
  Description of Artificial Sequence: Synthetic oligonucleotide
  Target: SCN10A; (-) strand; PAM type: YTN; PAM sequence: TTC
tccaataatctggagttctc

SEQ ID NO: 56747 - DNA, 20 bp, Artificial Sequence
  Description of Artificial Sequence: Synthetic oligonucleotide
  Target: SCN10A; (-) strand; PAM type: YTN; PAM sequence: TTG
gaggtcccaatgaaattctc

SEQ ID NO: 56748 - DNA, 20 bp, Artificial Sequence
  Description of Artificial Sequence: Synthetic oligonucleotide
  Target: SCN10A; (-) strand; PAM type: YTN; PAM sequence: CTG
gaggtcccagagaaattgga

SEQ ID NO: 56749 - DNA, 20 bp, Artificial Sequence
  Description of Artificial Sequence: Synthetic oligonucleotide
  Target: SCN10A; (-) strand; PAM type: YTN; PAM sequence: CTG
aacctggaggtcccagagaa

SEQ ID NO: 56750 - DNA, 20 bp, Artificial Sequence
  Description of Artificial Sequence: Synthetic oligonucleotide
  Target: SCN10A; (-) strand; PAM type: YTN; PAM sequence: TTC
agccacagactgaacctgga

SEQ ID NO: 56751 - DNA, 20 bp, Artificial Sequence
  Description of Artificial Sequence: Synthetic oligonucleotide
  Target: SCN10A; (-) strand; PAM type: YTN; PAM sequence: TTA
tggggaaaagtgttcagcca

SEQ ID NO: 56752 - DNA, 20 bp, Artificial Sequence
  Description of Artificial Sequence: Synthetic oligonucleotide
  Target: SCN10A; (-) strand; PAM type: YTN; PAM sequence: CTG
gttatggggaaaagtgttca

SEQ ID NO: 56753 - DNA, 20 bp, Artificial Sequence
  Description of Artificial Sequence: Synthetic oligonucleotide
  Target: SCN10A; (-) strand; PAM type: YTN; PAM sequence: CTA
atctggttatggggaaaagt

SEQ ID NO: 56754 - DNA, 20 bp, Artificial Sequence
  Description of Artificial Sequence: Synthetic oligonucleotide
  Target: SCN10A; (-) strand; PAM type: YTN; PAM sequence: TTG
tggaccacaggtctaatctg

SEQ ID NO: 56755 - DNA, 20 bp, Artificial Sequence
  Description of Artificial Sequence: Synthetic oligonucleotide
  Target: SCN10A; (-) strand; PAM type: YTN; PAM sequence: TTA
ggataagggtgagggagtgg

SEQ ID NO: 56756 - DNA, 20 bp, Artificial Sequence
  Description of Artificial Sequence: Synthetic oligonucleotide
  Target: SCN10A; (-) strand; PAM type: YTN; PAM sequence: TTT
aggataagggtgagggagtg

SEQ ID NO: 56757 - DNA, 20 bp, Artificial Sequence
  Description of Artificial Sequence: Synthetic oligonucleotide
  Target: SCN10A; (-) strand; PAM type: YTN; PAM sequence: TTG
ggatttaggataagggtgag

SEQ ID NO: 56758 - DNA, 20 bp, Artificial Sequence
  Description of Artificial Sequence: Synthetic oligonucleotide
  Target: SCN10A; (-) strand; PAM type: YTN; PAM sequence: CTT
gggatttaggataagggtga

SEQ ID NO: 56759 - DNA, 20 bp, Artificial Sequence
  Description of Artificial Sequence: Synthetic oligonucleotide
  Target: SCN10A; (-) strand; PAM type: YTN; PAM sequence: TTA
gccttgggatttaggataag

SEQ ID NO: 56760 - DNA, 20 bp, Artificial Sequence
  Description of Artificial Sequence: Synthetic oligonucleotide
  Target: SCN10A; (-) strand; PAM type: YTN; PAM sequence: CTT
agccttgggatttaggataa

SEQ ID NO: 56761 - DNA, 20 bp, Artificial Sequence
  Description of Artificial Sequence: Synthetic oligonucleotide
  Target: SCN10A; (-) strand; PAM type: YTN; PAM sequence: TTG
acttagccttgggatttagg

SEQ ID NO: 56762 - DNA, 20 bp, Artificial Sequence
  Description of Artificial Sequence: Synthetic oligonucleotide
  Target: SCN10A; (-) strand; PAM type: YTN; PAM sequence: CTA
gattgacttagccttgggat

SEQ ID NO: 56763 - DNA, 20 bp, Artificial Sequence
  Description of Artificial Sequence: Synthetic oligonucleotide
  Target: SCN10A; (-) strand; PAM type: YTN; PAM sequence: TTC
tagattgacttagccttggg

SEQ ID NO: 56764 - DNA, 20 bp, Artificial Sequence
  Description of Artificial Sequence: Synthetic oligonucleotide
  Target: SCN10A; (-) strand; PAM type: YTN; PAM sequence: CTG
ttctagattgacttagcctt

SEQ ID NO: 56765 - DNA, 20 bp, Artificial Sequence
  Description of Artificial Sequence: Synthetic oligonucleotide
  Target: SCN10A; (-) strand; PAM type: YTN; PAM sequence: TTC
aggggaactgttctagattg

SEQ ID NO: 56766 - DNA, 20 bp, Artificial Sequence
  Description of Artificial Sequence: Synthetic oligonucleotide
  Target: SCN10A; (-) strand; PAM type: YTN; PAM sequence: CTC
agcagttcaggggaactgtt

SEQ ID NO: 56767 - DNA, 20 bp, Artificial Sequence
  Description of Artificial Sequence: Synthetic oligonucleotide
  Target: SCN10A; (-) strand; PAM type: YTN; PAM sequence: TTC
cccataacccctcagcagtt

SEQ ID NO: 56768 - DNA, 20 bp, Artificial Sequence
  Description of Artificial Sequence: Synthetic oligonucleotide
  Target: SCN10A; (-) strand; PAM type: YTN; PAM sequence: CTG
aggttccccataacccctca

SEQ ID NO: 56769 - DNA, 20 bp, Artificial Sequence
  Description of Artificial Sequence: Synthetic oligonucleotide
  Target: SCN10A; (-) strand; PAM type: YTN; PAM sequence: TTC
ccaggcaatactgaggttcc

SEQ ID NO: 56770 - DNA, 20 bp, Artificial Sequence
  Description of Artificial Sequence: Synthetic oligonucleotide
  Target: SCN10A; (-) strand; PAM type: YTN; PAM sequence: CTA
gggataccatatgattccca

SEQ ID NO: 56771 - DNA, 20 bp, Artificial Sequence
  Description of Artificial Sequence: Synthetic oligonucleotide
  Target: SCN10A; (-) strand; PAM type: YTN; PAM sequence: CTG
actagggataccatatgatt

SEQ ID NO: 56772 - DNA, 20 bp, Artificial Sequence
  Description of Artificial Sequence: Synthetic oligonucleotide
  Target: SCN10A; (-) strand; PAM type: YTN; PAM sequence: CTG
ctgactagggataccatatg

SEQ ID NO: 56773 - DNA, 20 bp, Artificial Sequence
  Description of Artificial Sequence: Synthetic oligonucleotide
  Target: SCN10A; (-) strand; PAM type: YTN; PAM sequence: CTA
gaagaaactgctgactaggg

SEQ ID NO: 56774 - DNA, 20 bp, Artificial Sequence
  Description of Artificial Sequence: Synthetic oligonucleotide
  Target: SCN10A; (-) strand; PAM type: YTN; PAM sequence: CTC
agactagaagaaactgctga

SEQ ID NO: 56775 - DNA, 20 bp, Artificial Sequence
  Description of Artificial Sequence: Synthetic oligonucleotide
  Target: SCN10A; (-) strand; PAM type: YTN; PAM sequence: TTG
aaacctcagactagaagaaa

SEQ ID NO: 56776 - DNA, 20 bp, Artificial Sequence
  Description of Artificial Sequence: Synthetic oligonucleotide
  Target: SCN10A; (-) strand; PAM type: YTN; PAM sequence: TTT
gaaacctcagactagaagaa

SEQ ID NO: 56777 - DNA, 20 bp, Artificial Sequence
  Description of Artificial Sequence: Synthetic oligonucleotide
  Target: SCN10A; (-) strand; PAM type: YTN; PAM sequence: CTG
caagggaagacagggaatag

SEQ ID NO: 56778 - DNA, 20 bp, Artificial Sequence
  Description of Artificial Sequence: Synthetic oligonucleotide
  Target: SCN10A; (-) strand; PAM type: YTN; PAM sequence: TTA
ctgcaagggaagacagggaa

SEQ ID NO: 56779 - DNA, 20 bp, Artificial Sequence
  Description of Artificial Sequence: Synthetic oligonucleotide
  Target: SCN10A; (-) strand; PAM type: YTN; PAM sequence: CTT
actgcaagggaagacaggga

SEQ ID NO: 56780 - DNA, 20 bp, Artificial Sequence
  Description of Artificial Sequence: Synthetic oligonucleotide
  Target: SCN10A; (-) strand; PAM type: YTN; PAM sequence: TTG
gcttactgcaagggaagaca

SEQ ID NO: 56781 - DNA, 20 bp, Artificial Sequence
  Description of Artificial Sequence: Synthetic oligonucleotide
  Target: SCN10A; (-) strand; PAM type: YTN; PAM sequence: CTA
ggaaatatggtcattggctt

SEQ ID NO: 56782 - DNA, 20 bp, Artificial Sequence
  Description of Artificial Sequence: Synthetic oligonucleotide
  Target: SCN10A; (-) strand; PAM type: YTN; PAM sequence: CTC
catgaactaggaaatatggt

SEQ ID NO: 56783 - DNA, 20 bp, Artificial Sequence
  Description of Artificial Sequence: Synthetic oligonucleotide
  Target: SCN10A; (-) strand; PAM type: YTN; PAM sequence: TTC
tccatgaactaggaaatatg

SEQ ID NO: 56784 - DNA, 20 bp, Artificial Sequence
  Description of Artificial Sequence: Synthetic oligonucleotide
  Target: SCN10A; (-) strand; PAM type: YTN; PAM sequence: TTT
ctccatgaactaggaaatat

SEQ ID NO: 56785 - DNA, 20 bp, Artificial Sequence
  Description of Artificial Sequence: Synthetic oligonucleotide
  Target: SCN10A; (-) strand; PAM type: YTN; PAM sequence: TTT
tctccatgaactaggaaata

SEQ ID NO: 56786 - DNA, 20 bp, Artificial Sequence
  Description of Artificial Sequence: Synthetic oligonucleotide
  Target: SCN10A; (-) strand; PAM type: YTN; PAM sequence: TTT
ttctccatgaactaggaaat

SEQ ID NO: 56787 - DNA, 20 bp, Artificial Sequence
  Description of Artificial Sequence: Synthetic oligonucleotide
  Target: SCN10A; (-) strand; PAM type: YTN; PAM sequence: CTG
tttttctccatgaactagga

SEQ ID NO: 56788 - DNA, 20 bp, Artificial Sequence
  Description of Artificial Sequence: Synthetic oligonucleotide
  Target: SCN10A; (-) strand; PAM type: YTN; PAM sequence: TTC
tgtttttctccatgaactag

SEQ ID NO: 56789 - DNA, 20 bp, Artificial Sequence
  Description of Artificial Sequence: Synthetic oligonucleotide
  Target: SCN10A; (-) strand; PAM type: YTN; PAM sequence: TTG
gcagagttctgtttttctcc

SEQ ID NO: 56790 - DNA, 20 bp, Artificial Sequence
  Description of Artificial Sequence: Synthetic oligonucleotide
  Target: SCN10A; (-) strand; PAM type: YTN; PAM sequence: TTG
atggtatgaagttggcagag

SEQ ID NO: 56791 - DNA, 20 bp, Artificial Sequence
  Description of Artificial Sequence: Synthetic oligonucleotide
  Target: SCN10A; (-) strand; PAM type: YTN; PAM sequence: TTT
gatggtatgaagttggcaga

SEQ ID NO: 56792 - DNA, 20 bp, Artificial Sequence
  Description of Artificial Sequence: Synthetic oligonucleotide
  Target: SCN10A; (-) strand; PAM type: YTN; PAM sequence: TTG
gaggtttgatggtatgaagt

SEQ ID NO: 56793 - DNA, 20 bp, Artificial Sequence
  Description of Artificial Sequence: Synthetic oligonucleotide
  Target: SCN10A; (-) strand; PAM type: YTN; PAM sequence: CTG
cagacacaggtgagttggag

SEQ ID NO: 56794 - DNA, 20 bp, Artificial Sequence
  Description of Artificial Sequence: Synthetic oligonucleotide
  Target: SCN10A; (-) strand; PAM type: YTN; PAM sequence: TTG
taagagaagggaaggaggaa

SEQ ID NO: 56795 - DNA, 20 bp, Artificial Sequence
  Description of Artificial Sequence: Synthetic oligonucleotide
  Target: SCN10A; (-) strand; PAM type: YTN; PAM sequence: CTC
atgttgtaagagaagggaag

SEQ ID NO: 56796 - DNA, 20 bp, Artificial Sequence
  Description of Artificial Sequence: Synthetic oligonucleotide
  Target: SCN10A; (-) strand; PAM type: YTN; PAM sequence: CTC
tcatgttgtaagagaaggga

SEQ ID NO: 56797 - DNA, 20 bp, Artificial Sequence
  Description of Artificial Sequence: Synthetic oligonucleotide
  Target: SCN10A; (-) strand; PAM type: YTN; PAM sequence: TTA
gaatgtaggaagatacctct

SEQ ID NO: 56798 - DNA, 20 bp, Artificial Sequence
  Description of Artificial Sequence: Synthetic oligonucleotide
  Target: SCN10A; (-) strand; PAM type: YTN; PAM sequence: CTT
agaatgtaggaagatacctc

SEQ ID NO: 56799 - DNA, 20 bp, Artificial Sequence
  Description of Artificial Sequence: Synthetic oligonucleotide
  Target: SCN10A; (-) strand; PAM type: YTN; PAM sequence: CTA
agcagagggaaaggaatggt

SEQ ID NO: 56800 - DNA, 20 bp, Artificial Sequence
  Description of Artificial Sequence: Synthetic oligonucleotide
  Target: SCN10A; (-) strand; PAM type: YTN; PAM sequence: CTG
gcagacaaggagagagaaaa

SEQ ID NO: 56801 - DNA, 20 bp, Artificial Sequence
  Description of Artificial Sequence: Synthetic oligonucleotide
  Target: SCN10A; (-) strand; PAM type: YTN; PAM sequence: CTG
ataggaaagagctggcagac

SEQ ID NO: 56802 - DNA, 20 bp, Artificial Sequence
  Description of Artificial Sequence: Synthetic oligonucleotide
  Target: SCN10A; (-) strand; PAM type: YTN; PAM sequence: TTA
aatgctgataggaaagagct

SEQ ID NO: 56803 - DNA, 20 bp, Artificial Sequence
  Description of Artificial Sequence: Synthetic oligonucleotide
  Target: SCN10A; (-) strand; PAM type: YTN; PAM sequence: TTT
aaatgctgataggaaagagc

SEQ ID NO: 56804 - DNA, 20 bp, Artificial Sequence
  Description of Artificial Sequence: Synthetic oligonucleotide
  Target: SCN10A; (-) strand; PAM type: YTN; PAM sequence: CTT
taaatgctgataggaaagag

SEQ ID NO: 56805 - DNA, 20 bp, Artificial Sequence
  Description of Artificial Sequence: Synthetic oligonucleotide
  Target: SCN10A; (-) strand; PAM type: YTN; PAM sequence: TTA
agcatctttaaatgctgata

SEQ ID NO: 56806 - DNA, 20 bp, Artificial Sequence
  Description of Artificial Sequence: Synthetic oligonucleotide
  Target: SCN10A; (-) strand; PAM type: YTN; PAM sequence: TTG
gaggaaagttaagcatcttt

SEQ ID NO: 56807 - DNA, 20 bp, Artificial Sequence
  Description of Artificial Sequence: Synthetic oligonucleotide
  Target: SCN10A; (-) strand; PAM type: YTN; PAM sequence: TTA
aagttggaggaaagttaagc

SEQ ID NO: 56808 - DNA, 20 bp, Artificial Sequence
  Description of Artificial Sequence: Synthetic oligonucleotide
  Target: SCN10A; (-) strand; PAM type: YTN; PAM sequence: TTT
aaagttggaggaaagttaag

SEQ ID NO: 56809 - DNA, 20 bp, Artificial Sequence
  Description of Artificial Sequence: Synthetic oligonucleotide
  Target: SCN10A; (-) strand; PAM type: YTN; PAM sequence: TTT
taaagttggaggaaagttaa

SEQ ID NO: 56810 - DNA, 20 bp, Artificial Sequence
  Description of Artificial Sequence: Synthetic oligonucleotide
  Target: SCN10A; (-) strand; PAM type: YTN; PAM sequence: TTT
ttaaagttggaggaaagtta

SEQ ID NO: 56811 - DNA, 20 bp, Artificial Sequence
  Description of Artificial Sequence: Synthetic oligonucleotide
  Target: SCN10A; (-) strand; PAM type: YTN; PAM sequence: CTG
catcaagggaaagtttttaa

SEQ ID NO: 56812 - DNA, 20 bp, Artificial Sequence
  Description of Artificial Sequence: Synthetic oligonucleotide
  Target: SCN10A; (-) strand; PAM type: YTN; PAM sequence: CTC
tgcatcaagggaaagttttt

SEQ ID NO: 56813 - DNA, 20 bp, Artificial Sequence
  Description of Artificial Sequence: Synthetic oligonucleotide
  Target: SCN10A; (-) strand; PAM type: YTN; PAM sequence: CTG
gatgggctctgcatcaaggg

SEQ ID NO: 56814 - DNA, 20 bp, Artificial Sequence
  Description of Artificial Sequence: Synthetic oligonucleotide
  Target: SCN10A; (-) strand; PAM type: YTN; PAM sequence: TTA
aaagccaatagagaacagga

SEQ ID NO: 56815 - DNA, 20 bp, Artificial Sequence
  Description of Artificial Sequence: Synthetic oligonucleotide
  Target: SCN10A; (-) strand; PAM type: YTN; PAM sequence: TTA
ttaaaagccaatagagaaca

SEQ ID NO: 56816 - DNA, 20 bp, Artificial Sequence
  Description of Artificial Sequence: Synthetic oligonucleotide
  Target: SCN10A; (-) strand; PAM type: YTN; PAM sequence: TTT
attaaaagccaatagagaac

SEQ ID NO: 56817 - DNA, 20 bp, Artificial Sequence
  Description of Artificial Sequence: Synthetic oligonucleotide
  Target: SCN10A; (-) strand; PAM type: YTN; PAM sequence: CTT
tattaaaagccaatagagaa

SEQ ID NO: 56818 - DNA, 20 bp, Artificial Sequence
  Description of Artificial Sequence: Synthetic oligonucleotide
  Target: SCN10A; (-) strand; PAM type: YTN; PAM sequence: CTG
gaaacagtgagtagaagtaa

SEQ ID NO: 56819 - DNA, 20 bp, Artificial Sequence
  Description of Artificial Sequence: Synthetic oligonucleotide
  Target: SCN10A; (-) strand; PAM type: YTN; PAM sequence: CTG
aaaagtgactggaaacagtg

SEQ ID NO: 56820 - DNA, 20 bp, Artificial Sequence
  Description of Artificial Sequence: Synthetic oligonucleotide
  Target: SCN10A; (-) strand; PAM type: YTN; PAM sequence: TTC
aaagactgaaaagtgactgg

SEQ ID NO: 56821 - DNA, 20 bp, Artificial Sequence
  Description of Artificial Sequence: Synthetic oligonucleotide
  Target: SCN10A; (-) strand; PAM type: YTN; PAM sequence: CTT
caaagactgaaaagtgactg

SEQ ID NO: 56822 - DNA, 20 bp, Artificial Sequence
  Description of Artificial Sequence: Synthetic oligonucleotide
  Target: SCN10A; (-) strand; PAM type: YTN; PAM sequence: TTA
gtgagataggagggcaaaat

SEQ ID NO: 56823 - DNA, 20 bp, Artificial Sequence
  Description of Artificial Sequence: Synthetic oligonucleotide
  Target: SCN10A; (-) strand; PAM type: YTN; PAM sequence: TTT
agtgagataggagggcaaaa

SEQ ID NO: 56824 - DNA, 20 bp, Artificial Sequence
  Description of Artificial Sequence: Synthetic oligonucleotide
  Target: SCN10A; (-) strand; PAM type: YTN; PAM sequence: TTT
tagtgagataggagggcaaa

SEQ ID NO: 56825 - DNA, 20 bp, Artificial Sequence
  Description of Artificial Sequence: Synthetic oligonucleotide
  Target: SCN10A; (-) strand; PAM type: YTN; PAM sequence: CTG
caaggaagcattttagtgag

SEQ ID NO: 56826 - DNA, 20 bp, Artificial Sequence
  Description of Artificial Sequence: Synthetic oligonucleotide
  Target: SCN10A; (-) strand; PAM type: YTN; PAM sequence: TTG
tatccctgcaaggaagcatt

SEQ ID NO: 56827 - DNA, 20 bp, Artificial Sequence
  Description of Artificial Sequence: Synthetic oligonucleotide
  Target: SCN10A; (-) strand; PAM type: YTN; PAM sequence: CTT
gtatccctgcaaggaagcat

SEQ ID NO: 56828 - DNA, 20 bp, Artificial Sequence
  Description of Artificial Sequence: Synthetic oligonucleotide
  Target: SCN10A; (-) strand; PAM type: YTN; PAM sequence: CTC
ttgtatccctgcaaggaagc

SEQ ID NO: 56829 - DNA, 20 bp, Artificial Sequence
  Description of Artificial Sequence: Synthetic oligonucleotide
  Target: SCN10A; (-) strand; PAM type: YTN; PAM sequence: TTA
gccacaaggcaatctcttgt

SEQ ID NO: 56830 - DNA, 20 bp, Artificial Sequence
  Description of Artificial Sequence: Synthetic oligonucleotide
  Target: SCN10A; (-) strand; PAM type: YTN; PAM sequence: TTT
agccacaaggcaatctcttg

SEQ ID NO: 56831 - DNA, 20 bp, Artificial Sequence
  Description of Artificial Sequence: Synthetic oligonucleotide
  Target: SCN10A; (-) strand; PAM type: YTN; PAM sequence: CTT
tagccacaaggcaatctctt

SEQ ID NO: 56832 - DNA, 20 bp, Artificial Sequence
  Description of Artificial Sequence: Synthetic oligonucleotide
  Target: SCN10A; (-) strand; PAM type: YTN; PAM sequence: CTG
actttagccacaaggcaatc

SEQ ID NO: 56833 - DNA, 20 bp, Artificial Sequence
  Description of Artificial Sequence: Synthetic oligonucleotide
  Target: SCN10A; (-) strand; PAM type: YTN; PAM sequence: CTG
agaagggccccctgacttta

SEQ ID NO: 56834 - DNA, 20 bp, Artificial Sequence
  Description of Artificial Sequence: Synthetic oligonucleotide
  Target: SCN10A; (-) strand; PAM type: YTN; PAM sequence: CTC
aaaaaaaaaaaaagaaaaag

SEQ ID NO: 56835 - DNA, 20 bp, Artificial Sequence
  Description of Artificial Sequence: Synthetic oligonucleotide
  Target: SCN10A; (-) strand; PAM type: YTN; PAM sequence: CTG
tctcaaaaaaaaaaaaagaa

SEQ ID NO: 56836 - DNA, 20 bp, Artificial Sequence
  Description of Artificial Sequence: Synthetic oligonucleotide
  Target: SCN10A; (-) strand; PAM type: YTN; PAM sequence: CTA
gtccgggtgacagtgatacc

SEQ ID NO: 56837 - DNA, 20 bp, Artificial Sequence
  Description of Artificial Sequence: Synthetic oligonucleotide
  Target: SCN10A; (-) strand; PAM type: YTN; PAM sequence: CTC
tagtccgggtgacagtgata

SEQ ID NO: 56838 - DNA, 20 bp, Artificial Sequence
  Description of Artificial Sequence: Synthetic oligonucleotide
  Target: SCN10A; (-) strand; PAM type: YTN; PAM sequence: CTG
cactctagtccgggtgacag

SEQ ID NO: 56839 - DNA, 20 bp, Artificial Sequence
  Description of Artificial Sequence: Synthetic oligonucleotide
  Target: SCN10A; (-) strand; PAM type: YTN; PAM sequence: TTG
caccactgcactctagtccg

SEQ ID NO: 56840 - DNA, 20 bp, Artificial Sequence
  Description of Artificial Sequence: Synthetic oligonucleotide
  Target: SCN10A; (-) strand; PAM type: YTN; PAM sequence: TTG
cagtgagcagagattgcacc

SEQ ID NO: 56841 - DNA, 20 bp, Artificial Sequence
  Description of Artificial Sequence: Synthetic oligonucleotide
  Target: SCN10A; (-) strand; PAM type: YTN; PAM sequence: TTG
agcccaggagacagaggttg

SEQ ID NO: 56842 - DNA, 20 bp, Artificial Sequence
  Description of Artificial Sequence: Synthetic oligonucleotide
  Target: SCN10A; (-) strand; PAM type: YTN; PAM sequence: CTT
gagcccaggagacagaggtt

SEQ ID NO: 56843 - DNA, 20 bp, Artificial Sequence
  Description of Artificial Sequence: Synthetic oligonucleotide
  Target: SCN10A; (-) strand; PAM type: YTN; PAM sequence: TTG
cttgagcccaggagacagag

SEQ ID NO: 56844 - DNA, 20 bp, Artificial Sequence
  Description of Artificial Sequence: Synthetic oligonucleotide
  Target: SCN10A; (-) strand; PAM type: YTN; PAM sequence: CTG
aggtgggagaattgcttgag

SEQ ID NO: 56845 - DNA, 20 bp, Artificial Sequence
  Description of Artificial Sequence: Synthetic oligonucleotide
  Target: SCN10A; (-) strand; PAM type: YTN; PAM sequence: TTC
gggaggctgaggtgggagaa

SEQ ID NO: 56846 - DNA, 20 bp, Artificial Sequence
  Description of Artificial Sequence: Synthetic oligonucleotide
  Target: SCN10A; (-) strand; PAM type: YTN; PAM sequence: CTA
ttcgggaggctgaggtggga

SEQ ID NO: 56847 - DNA, 20 bp, Artificial Sequence
  Description of Artificial Sequence: Synthetic oligonucleotide
  Target: SCN10A; (-) strand; PAM type: YTN; PAM sequence: CTA
tagcccagctattcgggagg

SEQ ID NO: 56848 - DNA, 20 bp, Artificial Sequence
  Description of Artificial Sequence: Synthetic oligonucleotide
  Target: SCN10A; (-) strand; PAM type: YTN; PAM sequence: CTA
gccgagtgtggtgacatgtg

SEQ ID NO: 56849 - DNA, 20 bp, Artificial Sequence
  Description of Artificial Sequence: Synthetic oligonucleotide
  Target: SCN10A; (-) strand; PAM type: YTN; PAM sequence: TTC
aaaactagccgagtgtggtg

SEQ ID NO: 56850 - DNA, 20 bp, Artificial Sequence
  Description of Artificial Sequence: Synthetic oligonucleotide
  Target: SCN10A; (-) strand; PAM type: YTN; PAM sequence: TTT
caaaactagccgagtgtggt

SEQ ID NO: 56851 - DNA, 20 bp, Artificial Sequence
  Description of Artificial Sequence: Synthetic oligonucleotide
  Target: SCN10A; (-) strand; PAM type: YTN; PAM sequence: TTT
tcaaaactagccgagtgtgg

SEQ ID NO: 56852 - DNA, 20 bp, Artificial Sequence
  Description of Artificial Sequence: Synthetic oligonucleotide
  Target: SCN10A; (-) strand; PAM type: YTN; PAM sequence: TTT
ttcaaaactagccgagtgtg

SEQ ID NO: 56853 - DNA, 20 bp, Artificial Sequence
  Description of Artificial Sequence: Synthetic oligonucleotide
  Target: SCN10A; (-) strand; PAM type: YTN; PAM sequence: TTT
tttcaaaactagccgagtgt

SEQ ID NO: 56854 - DNA, 20 bp, Artificial Sequence
  Description of Artificial Sequence: Synthetic oligonucleotide
  Target: SCN10A; (-) strand; PAM type: YTN; PAM sequence: CTA
caaaaaaattttttcaaaac

SEQ ID NO: 56855 - DNA, 20 bp, Artificial Sequence
  Description of Artificial Sequence: Synthetic oligonucleotide
  Target: SCN10A; (-) strand; PAM type: YTN; PAM sequence: CTG
cctacaaaaaaattttttca

SEQ ID NO: 56856 - DNA, 20 bp, Artificial Sequence
  Description of Artificial Sequence: Synthetic oligonucleotide
  Target: SCN10A; (-) strand; PAM type: YTN; PAM sequence: CTG
gacaatatagtggtacactg

SEQ ID NO: 56857 - DNA, 20 bp, Artificial Sequence
  Description of Artificial Sequence: Synthetic oligonucleotide
  Target: SCN10A; (-) strand; PAM type: YTN; PAM sequence: CTG
agatgggcctggacaatata

SEQ ID NO: 56858 - DNA, 20 bp, Artificial Sequence
  Description of Artificial Sequence: Synthetic oligonucleotide
  Target: SCN10A; (-) strand; PAM type: YTN; PAM sequence: TTG
tcaaaacagccaataggacc

SEQ ID NO: 56859 - DNA, 20 bp, Artificial Sequence
  Description of Artificial Sequence: Synthetic oligonucleotide
  Target: SCN10A; (-) strand; PAM type: YTN; PAM sequence: TTA
aggaggaaattgtcaaaaca

SEQ ID NO: 56860 - DNA, 20 bp, Artificial Sequence
  Description of Artificial Sequence: Synthetic oligonucleotide
  Target: SCN10A; (-) strand; PAM type: YTN; PAM sequence: TTT
aaggaggaaattgtcaaaac

SEQ ID NO: 56861 - DNA, 20 bp, Artificial Sequence
  Description of Artificial Sequence: Synthetic oligonucleotide
  Target: SCN10A; (-) strand; PAM type: YTN; PAM sequence: TTT
taaggaggaaattgtcaaaa

SEQ ID NO: 56862 - DNA, 20 bp, Artificial Sequence
  Description of Artificial Sequence: Synthetic oligonucleotide
  Target: SCN10A; (-) strand; PAM type: YTN; PAM sequence: TTA
ggaaaaccaagagagtgtca

SEQ ID NO: 56863 - DNA, 20 bp, Artificial Sequence
  Description of Artificial Sequence: Synthetic oligonucleotide
  Target: SCN10A; (-) strand; PAM type: YTN; PAM sequence: CTG
agaaggagaagagagaaagt

SEQ ID NO: 56864 - DNA, 20 bp, Artificial Sequence
  Description of Artificial Sequence: Synthetic oligonucleotide
  Target: SCN10A; (-) strand; PAM type: YTN; PAM sequence: CTG
agaaaggagagactgagaag

SEQ ID NO: 56865 - DNA, 20 bp, Artificial Sequence
  Description of Artificial Sequence: Synthetic oligonucleotide
  Target: SCN10A; (-) strand; PAM type: YTN; PAM sequence: TTC
acaatcatgtatgggaaaag

SEQ ID NO: 56866 - DNA, 20 bp, Artificial Sequence
  Description of Artificial Sequence: Synthetic oligonucleotide
  Target: SCN10A; (-) strand; PAM type: YTN; PAM sequence: TTA
ttcacaatcatgtatgggaa

SEQ ID NO: 56867 - DNA, 20 bp, Artificial Sequence
  Description of Artificial Sequence: Synthetic oligonucleotide
  Target: SCN10A; (-) strand; PAM type: YTN; PAM sequence: CTG
aaaacaaaagatagagtgcc

SEQ ID NO: 56868 - DNA, 20 bp, Artificial Sequence
  Description of Artificial Sequence: Synthetic oligonucleotide
  Target: SCN10A; (-) strand; PAM type: YTN; PAM sequence: TTC
tgaaaacaaaagatagagtg

SEQ ID NO: 56869 - DNA, 20 bp, Artificial Sequence
  Description of Artificial Sequence: Synthetic oligonucleotide
  Target: SCN10A; (-) strand; PAM type: YTN; PAM sequence: TTA
ttctgaaaacaaaagataga

SEQ ID NO: 56870 - DNA, 20 bp, Artificial Sequence
  Description of Artificial Sequence: Synthetic oligonucleotide
  Target: SCN10A; (-) strand; PAM type: YTN; PAM sequence: TTA
ttattctgaaaacaaaagat

SEQ ID NO: 56871 - DNA, 20 bp, Artificial Sequence
  Description of Artificial Sequence: Synthetic oligonucleotide
  Target: SCN10A; (-) strand; PAM type: YTN; PAM sequence: TTG
ttattattctgaaaacaaaa

SEQ ID NO: 56872 - DNA, 20 bp, Artificial Sequence
  Description of Artificial Sequence: Synthetic oligonucleotide
  Target: SCN10A; (-) strand; PAM type: YTN; PAM sequence: CTA
ttgttattattctgaaaaca

SEQ ID NO: 56873 - DNA, 20 bp, Artificial Sequence
  Description of Artificial Sequence: Synthetic oligonucleotide
  Target: SCN10A; (-) strand; PAM type: YTN; PAM sequence: TTA
ctattgttattattctgaaa

SEQ ID NO: 56874 - DNA, 20 bp, Artificial Sequence
  Description of Artificial Sequence: Synthetic oligonucleotide
  Target: SCN10A; (-) strand; PAM type: YTN; PAM sequence: TTG
ttactattgttattattctg

SEQ ID NO: 56875 - DNA, 20 bp, Artificial Sequence
  Description of Artificial Sequence: Synthetic oligonucleotide
  Target: SCN10A; (-) strand; PAM type: YTN; PAM sequence: TTG
aagttgttactattgttatt

SEQ ID NO: 56876 - DNA, 20 bp, Artificial Sequence
  Description of Artificial Sequence: Synthetic oligonucleotide
  Target: SCN10A; (-) strand; PAM type: YTN; PAM sequence: CTG
ttgaagttgttactattgtt

SEQ ID NO: 56877 - DNA, 20 bp, Artificial Sequence
  Description of Artificial Sequence: Synthetic oligonucleotide
  Target: SCN10A; (-) strand; PAM type: YTN; PAM sequence: CTA
gcgctgttgaagttgttact

SEQ ID NO: 56878 - DNA, 20 bp, Artificial Sequence
  Description of Artificial Sequence: Synthetic oligonucleotide
  Target: SCN10A; (-) strand; PAM type: YTN; PAM sequence: CTC
agtaaatgctagcgctgttg

SEQ ID NO: 56879 - DNA, 20 bp, Artificial Sequence
  Description of Artificial Sequence: Synthetic oligonucleotide
  Target: SCN10A; (-) strand; PAM type: YTN; PAM sequence: CTG
aaatacagtggaatctcagt

SEQ ID NO: 56880 - DNA, 20 bp, Artificial Sequence
  Description of Artificial Sequence: Synthetic oligonucleotide
  Target: SCN10A; (-) strand; PAM type: YTN; PAM sequence: TTA
atccagagtctgaaatacag

SEQ ID NO: 56881 - DNA, 20 bp, Artificial Sequence
  Description of Artificial Sequence: Synthetic oligonucleotide
  Target: SCN10A; (-) strand; PAM type: YTN; PAM sequence: CTT
aatccagagtctgaaataca

SEQ ID NO: 56882 - DNA, 20 bp, Artificial Sequence
  Description of Artificial Sequence: Synthetic oligonucleotide
  Target: SCN10A; (-) strand; PAM type: YTN; PAM sequence: TTG
cttaatccagagtctgaaat

SEQ ID NO: 56883 - DNA, 20 bp, Artificial Sequence
  Description of Artificial Sequence: Synthetic oligonucleotide
  Target: SCN10A; (-) strand; PAM type: YTN; PAM sequence: TTA
atgtaataatgcatgaaaat

SEQ ID NO: 56884 - DNA, 20 bp, Artificial Sequence
  Description of Artificial Sequence: Synthetic oligonucleotide
  Target: SCN10A; (-) strand; PAM type: YTN; PAM sequence: TTC
acaggtacagtgatagttaa

SEQ ID NO: 56885 - DNA, 20 bp, Artificial Sequence
  Description of Artificial Sequence: Synthetic oligonucleotide
  Target: SCN10A; (-) strand; PAM type: YTN; PAM sequence: CTT
cacaggtacagtgatagtta

SEQ ID NO: 56886 - DNA, 20 bp, Artificial Sequence
  Description of Artificial Sequence: Synthetic oligonucleotide
  Target: SCN10A; (-) strand; PAM type: YTN; PAM sequence: TTA
gagataatacttcacaggta

SEQ ID NO: 56887 - DNA, 20 bp, Artificial Sequence
  Description of Artificial Sequence: Synthetic oligonucleotide
  Target: SCN10A; (-) strand; PAM type: YTN; PAM sequence: TTA
tatattagagataatacttc

SEQ ID NO: 56888 - DNA, 20 bp, Artificial Sequence
  Description of Artificial Sequence: Synthetic oligonucleotide
  Target: SCN10A; (-) strand; PAM type: YTN; PAM sequence: TTT
atatattagagataatactt

SEQ ID NO: 56889 - DNA, 20 bp, Artificial Sequence
  Description of Artificial Sequence: Synthetic oligonucleotide
  Target: SCN10A; (-) strand; PAM type: YTN; PAM sequence: TTA
tttatatattagagataata

SEQ ID NO: 56890 - DNA, 20 bp, Artificial Sequence
  Description of Artificial Sequence: Synthetic oligonucleotide
  Target: SCN10A; (-) strand; PAM type: YTN; PAM sequence: CTT
atttatatattagagataat

SEQ ID NO: 56891 - DNA, 20 bp, Artificial Sequence
  Description of Artificial Sequence: Synthetic oligonucleotide
  Target: SCN10A; (-) strand; PAM type: YTN; PAM sequence: CTG
gtatcttatttatatattag

SEQ ID NO: 56892 - DNA, 20 bp, Artificial Sequence
  Description of Artificial Sequence: Synthetic oligonucleotide
  Target: SCN10A; (-) strand; PAM type: YTN; PAM sequence: CTC
tggtatcttatttatatatt

SEQ ID NO: 56893 - DNA, 20 bp, Artificial Sequence
  Description of Artificial Sequence: Synthetic oligonucleotide
  Target: SCN10A; (-) strand; PAM type: YTN; PAM sequence: CTG
ctctggtatcttatttatat

SEQ ID NO: 56894 - DNA, 20 bp, Artificial Sequence
  Description of Artificial Sequence: Synthetic oligonucleotide
  Target: SCN10A; (-) strand; PAM type: YTN; PAM sequence: TTG
ctgctctggtatcttattta

SEQ ID NO: 56895 - DNA, 20 bp, Artificial Sequence
  Description of Artificial Sequence: Synthetic oligonucleotide
  Target: SCN10A; (-) strand; PAM type: YTN; PAM sequence: TTT
gctgctctggtatcttattt

SEQ ID NO: 56896 - DNA, 20 bp, Artificial Sequence
  Description of Artificial Sequence: Synthetic oligonucleotide
  Target: SCN10A; (-) strand; PAM type: YTN; PAM sequence: CTT
tgctgctctggtatcttatt

SEQ ID NO: 56897 - DNA, 20 bp, Artificial Sequence
  Description of Artificial Sequence: Synthetic oligonucleotide
  Target: SCN10A; (-) strand; PAM type: YTN; PAM sequence: TTA
actttgctgctctggtatct

SEQ ID NO: 56898 - DNA, 20 bp, Artificial Sequence
  Description of Artificial Sequence: Synthetic oligonucleotide
  Target: SCN10A; (-) strand; PAM type: YTN; PAM sequence: TTT
aactttgctgctctggtatc

SEQ ID NO: 56899 - DNA, 20 bp, Artificial Sequence
  Description of Artificial Sequence: Synthetic oligonucleotide
  Target: SCN10A; (-) strand; PAM type: YTN; PAM sequence: TTT
taactttgctgctctggtat

SEQ ID NO: 56900 - DNA, 20 bp, Artificial Sequence
  Description of Artificial Sequence: Synthetic oligonucleotide
  Target: SCN10A; (-) strand; PAM type: YTN; PAM sequence: TTG
gaaattttaactttgctgct

SEQ ID NO: 56901 - DNA, 20 bp, Artificial Sequence
  Description of Artificial Sequence: Synthetic oligonucleotide
  Target: SCN10A; (-) strand; PAM type: YTN; PAM sequence: CTT
ggaaattttaactttgctgc

SEQ ID NO: 56902 - DNA, 20 bp, Artificial Sequence
  Description of Artificial Sequence: Synthetic oligonucleotide
  Target: SCN10A; (-) strand; PAM type: YTN; PAM sequence: TTA
gtaatgtgatcttggaaatt

SEQ ID NO: 56903 - DNA, 20 bp, Artificial Sequence
  Description of Artificial Sequence: Synthetic oligonucleotide
  Target: SCN10A; (-) strand; PAM type: YTN; PAM sequence: CTC
attagtaatgtgatcttgga

SEQ ID NO: 56904 - DNA, 20 bp, Artificial Sequence
  Description of Artificial Sequence: Synthetic oligonucleotide
  Target: SCN10A; (-) strand; PAM type: YTN; PAM sequence: CTG
ccactcattagtaatgtgat

SEQ ID NO: 56905 - DNA, 20 bp, Artificial Sequence
  Description of Artificial Sequence: Synthetic oligonucleotide
  Target: SCN10A; (-) strand; PAM type: YTN; PAM sequence: TTC
tgccactcattagtaatgtg

SEQ ID NO: 56906 - DNA, 20 bp, Artificial Sequence
  Description of Artificial Sequence: Synthetic oligonucleotide
  Target: SCN10A; (-) strand; PAM type: YTN; PAM sequence: TTA
agtaccgttctgccactcat

SEQ ID NO: 56907 - DNA, 20 bp, Artificial Sequence
  Description of Artificial Sequence: Synthetic oligonucleotide
  Target: SCN10A; (-) strand; PAM type: YTN; PAM sequence: TTT
aagtaccgttctgccactca

SEQ ID NO: 56908 - DNA, 20 bp, Artificial Sequence
  Description of Artificial Sequence: Synthetic oligonucleotide
  Target: SCN10A; (-) strand; PAM type: YTN; PAM sequence: CTG
agtttaagtaccgttctgcc

SEQ ID NO: 56909 - DNA, 20 bp, Artificial Sequence
  Description of Artificial Sequence: Synthetic oligonucleotide
  Target: SCN10A; (-) strand; PAM type: YTN; PAM sequence: TTG
tggcaaacatacctgagttt

SEQ ID NO: 56910 - DNA, 20 bp, Artificial Sequence
  Description of Artificial Sequence: Synthetic oligonucleotide
  Target: SCN10A; (-) strand; PAM type: YTN; PAM sequence: TTC
caagagattgtggcaaacat

SEQ ID NO: 56911 - DNA, 20 bp, Artificial Sequence
  Description of Artificial Sequence: Synthetic oligonucleotide
  Target: SCN10A; (-) strand; PAM type: YTN; PAM sequence: TTT
ccaagagattgtggcaaaca

SEQ ID NO: 56912 - DNA, 20 bp, Artificial Sequence
  Description of Artificial Sequence: Synthetic oligonucleotide
  Target: SCN10A; (-) strand; PAM type: YTN; PAM sequence: CTG
catataaatgagaagtgaag

SEQ ID NO: 56913 - DNA, 20 bp, Artificial Sequence
  Description of Artificial Sequence: Synthetic oligonucleotide
  Target: SCN10A; (-) strand; PAM type: YTN; PAM sequence: CTC
agtcatctgcatataaatga

SEQ ID NO: 56914 - DNA, 20 bp, Artificial Sequence
  Description of Artificial Sequence: Synthetic oligonucleotide
  Target: SCN10A; (-) strand; PAM type: YTN; PAM sequence: CTA
cagataaagactcagtcatc

SEQ ID NO: 56915 - DNA, 20 bp, Artificial Sequence
  Description of Artificial Sequence: Synthetic oligonucleotide
  Target: SCN10A; (-) strand; PAM type: YTN; PAM sequence: CTG
agagctacagataaagactc

SEQ ID NO: 56916 - DNA, 20 bp, Artificial Sequence
  Description of Artificial Sequence: Synthetic oligonucleotide
  Target: SCN10A; (-) strand; PAM type: YTN; PAM sequence: TTC
tgagagctacagataaagac

SEQ ID NO: 56917 - DNA, 20 bp, Artificial Sequence
  Description of Artificial Sequence: Synthetic oligonucleotide
  Target: SCN10A; (-) strand; PAM type: YTN; PAM sequence: CTT
ctgagagctacagataaaga

SEQ ID NO: 56918 - DNA, 20 bp, Artificial Sequence
  Description of Artificial Sequence: Synthetic oligonucleotide
  Target: SCN10A; (-) strand; PAM type: YTN; PAM sequence: CTG
agccccatggacttctgaga

SEQ ID NO: 56919 - DNA, 20 bp, Artificial Sequence
  Description of Artificial Sequence: Synthetic oligonucleotide
  Target: SCN10A; (-) strand; PAM type: YTN; PAM sequence: CTG
aagtggagagatcaaatgaa

SEQ ID NO: 56920 - DNA, 20 bp, Artificial Sequence
  Description of Artificial Sequence: Synthetic oligonucleotide
  Target: SCN10A; (-) strand; PAM type: YTN; PAM sequence: CTC
atgagacactgaagtggaga

SEQ ID NO: 56921 - DNA, 20 bp, Artificial Sequence
  Description of Artificial Sequence: Synthetic oligonucleotide
  Target: SCN10A; (-) strand; PAM type: YTN; PAM sequence: TTG
aggtgctcatgagacactga

SEQ ID NO: 56922 - DNA, 20 bp, Artificial Sequence
  Description of Artificial Sequence: Synthetic oligonucleotide
  Target: SCN10A; (-) strand; PAM type: YTN; PAM sequence: CTT
gaggtgctcatgagacactg

SEQ ID NO: 56923 - DNA, 20 bp, Artificial Sequence
  Description of Artificial Sequence: Synthetic oligonucleotide
  Target: SCN10A; (-) strand; PAM type: YTN; PAM sequence: CTG
agcttgaggtgctcatgaga

SEQ ID NO: 56924 - DNA, 20 bp, Artificial Sequence
  Description of Artificial Sequence: Synthetic oligonucleotide
  Target: SCN10A; (-) strand; PAM type: YTN; PAM sequence: TTG
gggcatgctgagcttgaggt

SEQ ID NO: 56925 - DNA, 20 bp, Artificial Sequence
  Description of Artificial Sequence: Synthetic oligonucleotide
  Target: SCN10A; (-) strand; PAM type: YTN; PAM sequence: TTT
ggggcatgctgagcttgagg

SEQ ID NO: 56926 - DNA, 20 bp, Artificial Sequence
  Description of Artificial Sequence: Synthetic oligonucleotide
  Target: SCN10A; (-) strand; PAM type: YTN; PAM sequence: TTA
gtttggggcatgctgagctt

SEQ ID NO: 56927 - DNA, 20 bp, Artificial Sequence
  Description of Artificial Sequence: Synthetic oligonucleotide
  Target: SCN10A; (-) strand; PAM type: YTN; PAM sequence: TTT
agtttggggcatgctgagct

SEQ ID NO: 56928 - DNA, 20 bp, Artificial Sequence
  Description of Artificial Sequence: Synthetic oligonucleotide
  Target: SCN10A; (-) strand; PAM type: YTN; PAM sequence: TTA
tgagtttagtttggggcatg

SEQ ID NO: 56929 - DNA, 20 bp, Artificial Sequence
  Description of Artificial Sequence: Synthetic oligonucleotide
  Target: SCN10A; (-) strand; PAM type: YTN; PAM sequence: TTA
gaaagaagtgaggagataat

SEQ ID NO: 56930 - DNA, 20 bp, Artificial Sequence
  Description of Artificial Sequence: Synthetic oligonucleotide
  Target: SCN10A; (-) strand; PAM type: YTN; PAM sequence: CTA
atggcagtaaaaagacatag

SEQ ID NO: 56931 - DNA, 20 bp, Artificial Sequence
  Description of Artificial Sequence: Synthetic oligonucleotide
  Target: SCN10A; (-) strand; PAM type: YTN; PAM sequence: TTG
gggctaatggcagtaaaaag

SEQ ID NO: 56932 - DNA, 20 bp, Artificial Sequence
  Description of Artificial Sequence: Synthetic oligonucleotide
  Target: SCN10A; (-) strand; PAM type: YTN; PAM sequence: TTT
ggggctaatggcagtaaaaa

SEQ ID NO: 56933 - DNA, 20 bp, Artificial Sequence
  Description of Artificial Sequence: Synthetic oligonucleotide
  Target: SCN10A; (-) strand; PAM type: YTN; PAM sequence: CTA
tttggggctaatggcagtaa

SEQ ID NO: 56934 - DNA, 20 bp, Artificial Sequence
  Description of Artificial Sequence: Synthetic oligonucleotide
  Target: SCN10A; (-) strand; PAM type: YTN; PAM sequence: TTG
tggacagacacagaaacagg

SEQ ID NO: 56935 - DNA, 20 bp, Artificial Sequence
  Description of Artificial Sequence: Synthetic oligonucleotide
  Target: SCN10A; (-) strand; PAM type: YTN; PAM sequence: TTA
tggtacccaggttgtggaca

SEQ ID NO: 56936 - DNA, 20 bp, Artificial Sequence
  Description of Artificial Sequence: Synthetic oligonucleotide
  Target: SCN10A; (-) strand; PAM type: YTN; PAM sequence: TTG
tatgtggaatgaaatagaaa

SEQ ID NO: 56937 - DNA, 20 bp, Artificial Sequence
  Description of Artificial Sequence: Synthetic oligonucleotide
  Target: SCN10A; (-) strand; PAM type: YTN; PAM sequence: TTG
attgtatgtggaatgaaata

SEQ ID NO: 56938 - DNA, 20 bp, Artificial Sequence
  Description of Artificial Sequence: Synthetic oligonucleotide
  Target: SCN10A; (-) strand; PAM type: YTN; PAM sequence: TTT
gattgtatgtggaatgaaat

SEQ ID NO: 56939 - DNA, 20 bp, Artificial Sequence
  Description of Artificial Sequence: Synthetic oligonucleotide
  Target: SCN10A; (-) strand; PAM type: YTN; PAM sequence: CTA
gatgtttgattgtatgtgga

SEQ ID NO: 56940 - DNA, 20 bp, Artificial Sequence
  Description of Artificial Sequence: Synthetic oligonucleotide
  Target: SCN10A; (-) strand; PAM type: YTN; PAM sequence: TTA
aggaggcagaagcaacagca

SEQ ID NO: 56941 - DNA, 20 bp, Artificial Sequence
  Description of Artificial Sequence: Synthetic oligonucleotide
  Target: SCN10A; (-) strand; PAM type: YTN; PAM sequence: TTA
gagagatatgaagagaagat

SEQ ID NO: 56942 - DNA, 20 bp, Artificial Sequence
  Description of Artificial Sequence: Synthetic oligonucleotide
  Target: SCN10A; (-) strand; PAM type: YTN; PAM sequence: TTG
gaccagcagtatgatggaga

SEQ ID NO: 56943 - DNA, 20 bp, Artificial Sequence
  Description of Artificial Sequence: Synthetic oligonucleotide
  Target: SCN10A; (-) strand; PAM type: YTN; PAM sequence: CTA
aaggggaatcaaaatgacac

SEQ ID NO: 56944 - DNA, 20 bp, Artificial Sequence
  Description of Artificial Sequence: Synthetic oligonucleotide
  Target: SCN10A; (-) strand; PAM type: YTN; PAM sequence: TTA
gaaaggactaaaggggaatc

SEQ ID NO: 56945 - DNA, 20 bp, Artificial Sequence
  Description of Artificial Sequence: Synthetic oligonucleotide
  Target: SCN10A; (-) strand; PAM type: YTN; PAM sequence: TTG
gagaataggttagaaaggac

SEQ ID NO: 56946 - DNA, 20 bp, Artificial Sequence
  Description of Artificial Sequence: Synthetic oligonucleotide
  Target: SCN10A; (-) strand; PAM type: YTN; PAM sequence: CTG
ttggagaataggttagaaag

SEQ ID NO: 56947 - DNA, 20 bp, Artificial Sequence
  Description of Artificial Sequence: Synthetic oligonucleotide
  Target: SCN10A; (-) strand; PAM type: YTN; PAM sequence: TTG
gccactgttggagaataggt

SEQ ID NO: 56948 - DNA, 20 bp, Artificial Sequence
  Description of Artificial Sequence: Synthetic oligonucleotide
  Target: SCN10A; (-) strand; PAM type: YTN; PAM sequence: TTT
ggccactgttggagaatagg

SEQ ID NO: 56949 - DNA, 20 bp, Artificial Sequence
  Description of Artificial Sequence: Synthetic oligonucleotide
  Target: SCN10A; (-) strand; PAM type: YTN; PAM sequence: TTA
gaaatatcatttggccactg

SEQ ID NO: 56950 - DNA, 20 bp, Artificial Sequence
  Description of Artificial Sequence: Synthetic oligonucleotide
  Target: SCN10A; (-) strand; PAM type: YTN; PAM sequence: TTT
agaaatatcatttggccact

SEQ ID NO: 56951 - DNA, 20 bp, Artificial Sequence
  Description of Artificial Sequence: Synthetic oligonucleotide
  Target: SCN10A; (-) strand; PAM type: YTN; PAM sequence: TTT
tagaaatatcatttggccac

SEQ ID NO: 56952 - DNA, 20 bp, Artificial Sequence
  Description of Artificial Sequence: Synthetic oligonucleotide
  Target: SCN10A; (-) strand; PAM type: YTN; PAM sequence: TTC
attttagaaatatcatttgg

SEQ ID NO: 56953 - DNA, 20 bp, Artificial Sequence
  Description of Artificial Sequence: Synthetic oligonucleotide
  Target: SCN10A; (-) strand; PAM type: YTN; PAM sequence: TTT
cattttagaaatatcatttg

SEQ ID NO: 56954 - DNA, 20 bp, Artificial Sequence
  Description of Artificial Sequence: Synthetic oligonucleotide
  Target: SCN10A; (-) strand; PAM type: YTN; PAM sequence: TTT
tcattttagaaatatcattt

SEQ ID NO: 56955 - DNA, 20 bp, Artificial Sequence
  Description of Artificial Sequence: Synthetic oligonucleotide
  Target: SCN10A; (-) strand; PAM type: YTN; PAM sequence: TTA
aataaagatatcacataacc

SEQ ID NO: 56956 - DNA, 20 bp, Artificial Sequence
  Description of Artificial Sequence: Synthetic oligonucleotide
  Target: SCN10A; (-) strand; PAM type: YTN; PAM sequence: TTT
aaataaagatatcacataac

SEQ ID NO: 56957 - DNA, 20 bp, Artificial Sequence
  Description of Artificial Sequence: Synthetic oligonucleotide
  Target: SCN10A; (-) strand; PAM type: YTN; PAM sequence: TTT
taaataaagatatcacataa

SEQ ID NO: 56958 - DNA, 20 bp, Artificial Sequence
  Description of Artificial Sequence: Synthetic oligonucleotide
  Target: SCN10A; (-) strand; PAM type: YTN; PAM sequence: TTA
gaatgattttaaataaagat

SEQ ID NO: 56959 - DNA, 20 bp, Artificial Sequence
  Description of Artificial Sequence: Synthetic oligonucleotide
  Target: SCN10A; (-) strand; PAM type: YTN; PAM sequence: TTT
agaatgattttaaataaaga

SEQ ID NO: 56960 - DNA, 20 bp, Artificial Sequence
  Description of Artificial Sequence: Synthetic oligonucleotide
  Target: SCN10A; (-) strand; PAM type: YTN; PAM sequence: CTT
tagaatgattttaaataaag

SEQ ID NO: 56961 - DNA, 20 bp, Artificial Sequence
  Description of Artificial Sequence: Synthetic oligonucleotide
  Target: SCN10A; (-) strand; PAM type: YTN; PAM sequence: CTA
tggagagctttagaatgatt

SEQ ID NO: 56962 - DNA, 20 bp, Artificial Sequence
  Description of Artificial Sequence: Synthetic oligonucleotide
  Target: SCN10A; (-) strand; PAM type: YTN; PAM sequence: TTG
agtgctatggagagctttag

SEQ ID NO: 56963 - DNA, 20 bp, Artificial Sequence
  Description of Artificial Sequence: Synthetic oligonucleotide
  Target: SCN10A; (-) strand; PAM type: YTN; PAM sequence: CTT
gagtgctatggagagcttta

SEQ ID NO: 56964 - DNA, 20 bp, Artificial Sequence
  Description of Artificial Sequence: Synthetic oligonucleotide
  Target: SCN10A; (-) strand; PAM type: YTN; PAM sequence: TTA
tcttgagtgctatggagagc

SEQ ID NO: 56965 - DNA, 20 bp, Artificial Sequence
  Description of Artificial Sequence: Synthetic oligonucleotide
  Target: SCN10A; (-) strand; PAM type: YTN; PAM sequence: TTG
ggttatcttgagtgctatgg

SEQ ID NO: 56966 - DNA, 20 bp, Artificial Sequence
  Description of Artificial Sequence: Synthetic oligonucleotide
  Target: SCN10A; (-) strand; PAM type: YTN; PAM sequence: TTT
gggttatcttgagtgctatg

SEQ ID NO: 56967 - DNA, 20 bp, Artificial Sequence
  Description of Artificial Sequence: Synthetic oligonucleotide
  Target: SCN10A; (-) strand; PAM type: YTN; PAM sequence: CTG
gagaggtcagcgcacagttt

SEQ ID NO: 56968 - DNA, 20 bp, Artificial Sequence
  Description of Artificial Sequence: Synthetic oligonucleotide
  Target: SCN10A; (-) strand; PAM type: YTN; PAM sequence: CTA
ccatgctggagaggtcagcg

SEQ ID NO: 56969 - DNA, 20 bp, Artificial Sequence
  Description of Artificial Sequence: Synthetic oligonucleotide
  Target: SCN10A; (-) strand; PAM type: YTN; PAM sequence: CTG
gggactaccatgctggagag

SEQ ID NO: 56970 - DNA, 20 bp, Artificial Sequence
  Description of Artificial Sequence: Synthetic oligonucleotide
  Target: SCN10A; (-) strand; PAM type: YTN; PAM sequence: TTA
taaaagtagtgtggctgggg

SEQ ID NO: 56971 - DNA, 20 bp, Artificial Sequence
  Description of Artificial Sequence: Synthetic oligonucleotide
  Target: SCN10A; (-) strand; PAM type: YTN; PAM sequence: CTT
ataaaagtagtgtggctggg

SEQ ID NO: 56972 - DNA, 20 bp, Artificial Sequence
  Description of Artificial Sequence: Synthetic oligonucleotide
  Target: SCN10A; (-) strand; PAM type: YTN; PAM sequence: TTC
aaggataaacttataaaagt

SEQ ID NO: 56973 - DNA, 20 bp, Artificial Sequence
  Description of Artificial Sequence: Synthetic oligonucleotide
  Target: SCN10A; (-) strand; PAM type: YTN; PAM sequence: TTA
acataaaaaagaatgggtca

SEQ ID NO: 56974 - DNA, 20 bp, Artificial Sequence
  Description of Artificial Sequence: Synthetic oligonucleotide
  Target: SCN10A; (-) strand; PAM type: YTN; PAM sequence: CTT
aacataaaaaagaatgggtc

SEQ ID NO: 56975 - DNA, 20 bp, Artificial Sequence
  Description of Artificial Sequence: Synthetic oligonucleotide
  Target: SCN10A; (-) strand; PAM type: YTN; PAM sequence: TTA
ggcaaaggaaggggaatatg

SEQ ID NO: 56976 - DNA, 20 bp, Artificial Sequence
  Description of Artificial Sequence: Synthetic oligonucleotide
  Target: SCN10A; (-) strand; PAM type: YTN; PAM sequence: TTT
aggcaaaggaaggggaatat

SEQ ID NO: 56977 - DNA, 20 bp, Artificial Sequence
  Description of Artificial Sequence: Synthetic oligonucleotide
  Target: SCN10A; (-) strand; PAM type: YTN; PAM sequence: TTT
taggcaaaggaaggggaata

SEQ ID NO: 56978 - DNA, 20 bp, Artificial Sequence
  Description of Artificial Sequence: Synthetic oligonucleotide
  Target: SCN10A; (-) strand; PAM type: YTN; PAM sequence: TTA
gccagacaaaataaagtgga

SEQ ID NO: 56979 - DNA, 20 bp, Artificial Sequence
  Description of Artificial Sequence: Synthetic oligonucleotide
  Target: SCN10A; (-) strand; PAM type: YTN; PAM sequence: CTC
aaagccaagagtacaagaat

SEQ ID NO: 56980 - DNA, 20 bp, Artificial Sequence
  Description of Artificial Sequence: Synthetic oligonucleotide
  Target: SCN10A; (-) strand; PAM type: YTN; PAM sequence: TTG
tctcaaagccaagagtacaa

SEQ ID NO: 56981 - DNA, 20 bp, Artificial Sequence
  Description of Artificial Sequence: Synthetic oligonucleotide
  Target: SCN10A; (-) strand; PAM type: YTN; PAM sequence: TTC
atataggtcagaaatggaag

SEQ ID NO: 56982 - DNA, 20 bp, Artificial Sequence
  Description of Artificial Sequence: Synthetic oligonucleotide
  Target: SCN10A; (-) strand; PAM type: YTN; PAM sequence: CTT
catataggtcagaaatggaa

SEQ ID NO: 56983 - DNA, 20 bp, Artificial Sequence
  Description of Artificial Sequence: Synthetic oligonucleotide
  Target: SCN10A; (-) strand; PAM type: YTN; PAM sequence: CTA
acatagacttcatataggtc

SEQ ID NO: 56984 - DNA, 20 bp, Artificial Sequence
  Description of Artificial Sequence: Synthetic oligonucleotide
  Target: SCN10A; (-) strand; PAM type: YTN; PAM sequence: TTA
tgggaacatgaaacaggaat

SEQ ID NO: 56985 - DNA, 20 bp, Artificial Sequence
  Description of Artificial Sequence: Synthetic oligonucleotide
  Target: SCN10A; (-) strand; PAM type: YTN; PAM sequence: TTA
tagagaaagtgcagagagtt

SEQ ID NO: 56986 - DNA, 20 bp, Artificial Sequence
  Description of Artificial Sequence: Synthetic oligonucleotide
  Target: SCN10A; (-) strand; PAM type: YTN; PAM sequence: TTT
atagagaaagtgcagagagt

SEQ ID NO: 56987 - DNA, 20 bp, Artificial Sequence
  Description of Artificial Sequence: Synthetic oligonucleotide
  Target: SCN10A; (-) strand; PAM type: YTN; PAM sequence: TTA
caaatcagatgtttatagag

SEQ ID NO: 56988 - DNA, 20 bp, Artificial Sequence
  Description of Artificial Sequence: Synthetic oligonucleotide
  Target: SCN10A; (-) strand; PAM type: YTN; PAM sequence: TTG
gtagaaacaatagaaaggca

SEQ ID NO: 56989 - DNA, 20 bp, Artificial Sequence
  Description of Artificial Sequence: Synthetic oligonucleotide
  Target: SCN10A; (-) strand; PAM type: YTN; PAM sequence: TTT
ggtagaaacaatagaaaggc

SEQ ID NO: 56990 - DNA, 20 bp, Artificial Sequence
  Description of Artificial Sequence: Synthetic oligonucleotide
  Target: SCN10A; (-) strand; PAM type: YTN; PAM sequence: TTA
caatttggtagaaacaatag

SEQ ID NO: 56991 - DNA, 20 bp, Artificial Sequence
  Description of Artificial Sequence: Synthetic oligonucleotide
  Target: SCN10A; (-) strand; PAM type: YTN; PAM sequence: CTT
acaatttggtagaaacaata

SEQ ID NO: 56992 - DNA, 20 bp, Artificial Sequence
  Description of Artificial Sequence: Synthetic oligonucleotide
  Target: SCN10A; (-) strand; PAM type: YTN; PAM sequence: CTG
agcttacaatttggtagaaa

SEQ ID NO: 56993 - DNA, 20 bp, Artificial Sequence
  Description of Artificial Sequence: Synthetic oligonucleotide
  Target: SCN10A; (-) strand; PAM type: YTN; PAM sequence: CTC
actgagcttacaatttggta

SEQ ID NO: 56994 - DNA, 20 bp, Artificial Sequence
  Description of Artificial Sequence: Synthetic oligonucleotide
  Target: SCN10A; (-) strand; PAM type: YTN; PAM sequence: CTC
tcactgagcttacaatttgg

SEQ ID NO: 56995 - DNA, 20 bp, Artificial Sequence
  Description of Artificial Sequence: Synthetic oligonucleotide
  Target: SCN10A; (-) strand; PAM type: YTN; PAM sequence: CTG
aacaaaatagatgtgagtcc

SEQ ID NO: 56996 - DNA, 20 bp, Artificial Sequence
  Description of Artificial Sequence: Synthetic oligonucleotide
  Target: SCN10A; (-) strand; PAM type: YTN; PAM sequence: CTG
gaaaatcaatgctgaacaaa

SEQ ID NO: 56997 - DNA, 20 bp, Artificial Sequence
  Description of Artificial Sequence: Synthetic oligonucleotide
  Target: SCN10A; (-) strand; PAM type: YTN; PAM sequence: TTC
tggaaaatcaatgctgaaca

SEQ ID NO: 56998 - DNA, 20 bp, Artificial Sequence
  Description of Artificial Sequence: Synthetic oligonucleotide
  Target: SCN10A; (-) strand; PAM type: YTN; PAM sequence: CTA
ggttctggaaaatcaatgct

SEQ ID NO: 56999 - DNA, 20 bp, Artificial Sequence
  Description of Artificial Sequence: Synthetic oligonucleotide
  Target: SCN10A; (-) strand; PAM type: YTN; PAM sequence: CTG
tactaggttctggaaaatca

SEQ ID NO: 57000 - DNA, 20 bp, Artificial Sequence
  Description of Artificial Sequence: Synthetic oligonucleotide
  Target: SCN10A; (-) strand; PAM type: YTN; PAM sequence: TTC
caggcactgtactaggttct

SEQ ID NO: 57001 - DNA, 20 bp, Artificial Sequence
  Description of Artificial Sequence: Synthetic oligonucleotide
  Target: SCN10A; (-) strand; PAM type: YTN; PAM sequence: TTA
gttccaggcactgtactagg

SEQ ID NO: 57002 - DNA, 20 bp, Artificial Sequence
  Description of Artificial Sequence: Synthetic oligonucleotide
  Target: SCN10A; (-) strand; PAM type: YTN; PAM sequence: CTA
gttagttccaggcactgtac

SEQ ID NO: 57003 - DNA, 20 bp, Artificial Sequence
  Description of Artificial Sequence: Synthetic oligonucleotide
  Target: SCN10A; (-) strand; PAM type: YTN; PAM sequence: CTG
tatctagttagttccaggca

SEQ ID NO: 57004 - DNA, 20 bp, Artificial Sequence
  Description of Artificial Sequence: Synthetic oligonucleotide
  Target: SCN10A; (-) strand; PAM type: YTN; PAM sequence: TTC
tgtatctagttagttccagg

SEQ ID NO: 57005 - DNA, 20 bp, Artificial Sequence
  Description of Artificial Sequence: Synthetic oligonucleotide
  Target: SCN10A; (-) strand; PAM type: YTN; PAM sequence: CTA
ttctgtatctagttagttcc

SEQ ID NO: 57006 - DNA, 20 bp, Artificial Sequence
  Description of Artificial Sequence: Synthetic oligonucleotide
  Target: SCN10A; (-) strand; PAM type: YTN; PAM sequence: CTA
tctattctgtatctagttag

SEQ ID NO: 57007 - DNA, 20 bp, Artificial Sequence
  Description of Artificial Sequence: Synthetic oligonucleotide
  Target: SCN10A; (-) strand; PAM type: YTN; PAM sequence: TTC
atgcaacaactatctattct

SEQ ID NO: 57008 - DNA, 20 bp, Artificial Sequence
  Description of Artificial Sequence: Synthetic oligonucleotide
  Target: SCN10A; (-) strand; PAM type: YTN; PAM sequence: CTA
ttcatgcaacaactatctat

SEQ ID NO: 57009 - DNA, 20 bp, Artificial Sequence
  Description of Artificial Sequence: Synthetic oligonucleotide
  Target: SCN10A; (-) strand; PAM type: YTN; PAM sequence: CTC
tattcatgcaacaactatct

SEQ ID NO: 57010 - DNA, 20 bp, Artificial Sequence
  Description of Artificial Sequence: Synthetic oligonucleotide
  Target: SCN10A; (-) strand; PAM type: YTN; PAM sequence: TTA
tctctattcatgcaacaact

SEQ ID NO: 57011 - DNA, 20 bp, Artificial Sequence
  Description of Artificial Sequence: Synthetic oligonucleotide
  Target: SCN10A; (-) strand; PAM type: YTN; PAM sequence: TTC
gccattatctctattcatgc

SEQ ID NO: 57012 - DNA, 20 bp, Artificial Sequence
  Description of Artificial Sequence: Synthetic oligonucleotide
  Target: SCN10A; (-) strand; PAM type: YTN; PAM sequence: TTT
cgccattatctctattcatg

SEQ ID NO: 57013 - DNA, 20 bp, Artificial Sequence
  Description of Artificial Sequence: Synthetic oligonucleotide
  Target: SCN10A; (-) strand; PAM type: YTN; PAM sequence: TTA
agtttcgccattatctctat

SEQ ID NO: 57014 - DNA, 20 bp, Artificial Sequence
  Description of Artificial Sequence: Synthetic oligonucleotide
  Target: SCN10A; (-) strand; PAM type: YTN; PAM sequence: CTA
ttaagtttcgccattatctc

SEQ ID NO: 57015 - DNA, 20 bp, Artificial Sequence
  Description of Artificial Sequence: Synthetic oligonucleotide
  Target: SCN10A; (-) strand; PAM type: YTN; PAM sequence: TTC
agctattaagtttcgccatt

SEQ ID NO: 57016 - DNA, 20 bp, Artificial Sequence
  Description of Artificial Sequence: Synthetic oligonucleotide
  Target: SCN10A; (-) strand; PAM type: YTN; PAM sequence: TTT
cagctattaagtttcgccat

SEQ ID NO: 57017 - DNA, 20 bp, Artificial Sequence
  Description of Artificial Sequence: Synthetic oligonucleotide
  Target: SCN10A; (-) strand; PAM type: YTN; PAM sequence: TTT
tcagctattaagtttcgcca

SEQ ID NO: 57018 - DNA, 20 bp, Artificial Sequence
  Description of Artificial Sequence: Synthetic oligonucleotide
  Target: SCN10A; (-) strand; PAM type: YTN; PAM sequence: TTT
ttcagctattaagtttcgcc

SEQ ID NO: 57019 - DNA, 20 bp, Artificial Sequence
  Description of Artificial Sequence: Synthetic oligonucleotide
  Target: SCN10A; (-) strand; PAM type: YTN; PAM sequence: TTA
gtttttcagctattaagttt

SEQ ID NO: 57020 - DNA, 20 bp, Artificial Sequence
  Description of Artificial Sequence: Synthetic oligonucleotide
  Target: SCN10A; (-) strand; PAM type: YTN; PAM sequence: TTT
agtttttcagctattaagtt

SEQ ID NO: 57021 - DNA, 20 bp, Artificial Sequence
  Description of Artificial Sequence: Synthetic oligonucleotide
  Target: SCN10A; (-) strand; PAM type: YTN; PAM sequence: CTT
tagtttttcagctattaagt

SEQ ID NO: 57022 - DNA, 20 bp, Artificial Sequence
  Description of Artificial Sequence: Synthetic oligonucleotide
  Target: SCN10A; (-) strand; PAM type: YTN; PAM sequence: TTC
tttagtttttcagctattaa

SEQ ID NO: 57023 - DNA, 20 bp, Artificial Sequence
  Description of Artificial Sequence: Synthetic oligonucleotide
  Target: SCN10A; (-) strand; PAM type: YTN; PAM sequence: CTG
aacaaaatgttctttagttt

SEQ ID NO: 57024 - DNA, 20 bp, Artificial Sequence
  Description of Artificial Sequence: Synthetic oligonucleotide
  Target: SCN10A; (-) strand; PAM type: YTN; PAM sequence: TTC
tgaacaaaatgttctttagt

SEQ ID NO: 57025 - DNA, 20 bp, Artificial Sequence
  Description of Artificial Sequence: Synthetic oligonucleotide
  Target: SCN10A; (-) strand; PAM type: YTN; PAM sequence: TTT
ctgaacaaaatgttctttag

SEQ ID NO: 57026 - DNA, 20 bp, Artificial Sequence
  Description of Artificial Sequence: Synthetic oligonucleotide
  Target: SCN10A; (-) strand; PAM type: YTN; PAM sequence: TTT
tctgaacaaaatgttcttta

SEQ ID NO: 57027 - DNA, 20 bp, Artificial Sequence
  Description of Artificial Sequence: Synthetic oligonucleotide
  Target: SCN10A; (-) strand; PAM type: YTN; PAM sequence: TTT
ttctgaacaaaatgttcttt

SEQ ID NO: 57028 - DNA, 20 bp, Artificial Sequence
  Description of Artificial Sequence: Synthetic oligonucleotide
  Target: SCN10A; (-) strand; PAM type: YTN; PAM sequence: CTG
catttttctgaacaaaatgt

SEQ ID NO: 57029 - DNA, 20 bp, Artificial Sequence
  Description of Artificial Sequence: Synthetic oligonucleotide
  Target: SCN10A; (-) strand; PAM type: YTN; PAM sequence: TTG
ctgcatttttctgaacaaaa

SEQ ID NO: 57030 - DNA, 20 bp, Artificial Sequence
  Description of Artificial Sequence: Synthetic oligonucleotide
  Target: SCN10A; (-) strand; PAM type: YTN; PAM sequence: TTT
gctgcatttttctgaacaaa

SEQ ID NO: 57031 - DNA, 20 bp, Artificial Sequence
  Description of Artificial Sequence: Synthetic oligonucleotide
  Target: SCN10A; (-) strand; PAM type: YTN; PAM sequence: TTT
tgctgcatttttctgaacaa

SEQ ID NO: 57032 - DNA, 20 bp, Artificial Sequence
  Description of Artificial Sequence: Synthetic oligonucleotide
  Target: SCN10A; (-) strand; PAM type: YTN; PAM sequence: TTT
ttgctgcatttttctgaaca

SEQ ID NO: 57033 - DNA, 20 bp, Artificial Sequence
  Description of Artificial Sequence: Synthetic oligonucleotide
  Target: SCN10A; (-) strand; PAM type: YTN; PAM sequence: CTG
tgatttttgctgcatttttc

SEQ ID NO: 57034 - DNA, 20 bp, Artificial Sequence
  Description of Artificial Sequence: Synthetic oligonucleotide
  Target: SCN10A; (-) strand; PAM type: YTN; PAM sequence: TTG
gatctgtgatttttgctgca

SEQ ID NO: 57035 - DNA, 20 bp, Artificial Sequence
  Description of Artificial Sequence: Synthetic oligonucleotide
  Target: SCN10A; (-) strand; PAM type: YTN; PAM sequence: TTA
ttggatctgtgatttttgct

SEQ ID NO: 57036 - DNA, 20 bp, Artificial Sequence
  Description of Artificial Sequence: Synthetic oligonucleotide
  Target: SCN10A; (-) strand; PAM type: YTN; PAM sequence: CTA
ttattggatctgtgattttt

SEQ ID NO: 57037 - DNA, 20 bp, Artificial Sequence
  Description of Artificial Sequence: Synthetic oligonucleotide
  Target: SCN10A; (-) strand; PAM type: YTN; PAM sequence: TTC
ctattattggatctgtgatt

SEQ ID NO: 57038 - DNA, 20 bp, Artificial Sequence
  Description of Artificial Sequence: Synthetic oligonucleotide
  Target: SCN10A; (-) strand; PAM type: YTN; PAM sequence: TTA
tattcctattattggatctg

SEQ ID NO: 57039 - DNA, 20 bp, Artificial Sequence
  Description of Artificial Sequence: Synthetic oligonucleotide
  Target: SCN10A; (-) strand; PAM type: YTN; PAM sequence: CTT
atattcctattattggatct

SEQ ID NO: 57040 - DNA, 20 bp, Artificial Sequence
  Description of Artificial Sequence: Synthetic oligonucleotide
  Target: SCN10A; (-) strand; PAM type: YTN; PAM sequence: TTC
cttatattcctattattgga

SEQ ID NO: 57041 - DNA, 20 bp, Artificial Sequence
  Description of Artificial Sequence: Synthetic oligonucleotide
  Target: SCN10A; (-) strand; PAM type: YTN; PAM sequence: TTG
gttccttatattcctattat

SEQ ID NO: 57042 - DNA, 20 bp, Artificial Sequence
  Description of Artificial Sequence: Synthetic oligonucleotide
  Target: SCN10A; (-) strand; PAM type: YTN; PAM sequence: TTT
ggttccttatattcctatta

SEQ ID NO: 57043 - DNA, 20 bp, Artificial Sequence
  Description of Artificial Sequence: Synthetic oligonucleotide
  Target: SCN10A; (-) strand; PAM type: YTN; PAM sequence: CTT
tggttccttatattcctatt

SEQ ID NO: 57044 - DNA, 20 bp, Artificial Sequence
  Description of Artificial Sequence: Synthetic oligonucleotide
  Target: SCN10A; (-) strand; PAM type: YTN; PAM sequence: CTC
tttggttccttatattccta

SEQ ID NO: 57045 - DNA, 20 bp, Artificial Sequence
  Description of Artificial Sequence: Synthetic oligonucleotide
  Target: SCN10A; (-) strand; PAM type: YTN; PAM sequence: CTC
aataatctctttggttcctt

SEQ ID NO: 57046 - DNA, 20 bp, Artificial Sequence
  Description of Artificial Sequence: Synthetic oligonucleotide
  Target: SCN10A; (-) strand; PAM type: YTN; PAM sequence: TTA
aaatgtcaatagactcaata

SEQ ID NO: 57047 - DNA, 20 bp, Artificial Sequence
  Description of Artificial Sequence: Synthetic oligonucleotide
  Target: SCN10A; (-) strand; PAM type: YTN; PAM sequence: TTT
aaaatgtcaatagactcaat

SEQ ID NO: 57048 - DNA, 20 bp, Artificial Sequence
  Description of Artificial Sequence: Synthetic oligonucleotide
  Target: SCN10A; (-) strand; PAM type: YTN; PAM sequence: CTT
taaaatgtcaatagactcaa

SEQ ID NO: 57049 - DNA, 20 bp, Artificial Sequence
  Description of Artificial Sequence: Synthetic oligonucleotide
  Target: SCN10A; (-) strand; PAM type: YTN; PAM sequence: TTG
gggtgtgtgagctttaaaat

SEQ ID NO: 57050 - DNA, 20 bp, Artificial Sequence
  Description of Artificial Sequence: Synthetic oligonucleotide
  Target: SCN10A; (-) strand; PAM type: YTN; PAM sequence: TTT
ggggtgtgtgagctttaaaa

SEQ ID NO: 57051 - DNA, 20 bp, Artificial Sequence
  Description of Artificial Sequence: Synthetic oligonucleotide
  Target: SCN10A; (-) strand; PAM type: YTN; PAM sequence: CTT
tggggtgtgtgagctttaaa

SEQ ID NO: 57052 - DNA, 20 bp, Artificial Sequence
  Description of Artificial Sequence: Synthetic oligonucleotide
  Target: SCN10A; (-) strand; PAM type: YTN; PAM sequence: TTG
actttggggtgtgtgagctt

SEQ ID NO: 57053 - DNA, 20 bp, Artificial Sequence
  Description of Artificial Sequence: Synthetic oligonucleotide
  Target: SCN10A; (-) strand; PAM type: YTN; PAM sequence: CTT
gactttggggtgtgtgagct

SEQ ID NO: 57054 - DNA, 20 bp, Artificial Sequence
  Description of Artificial Sequence: Synthetic oligonucleotide
  Target: SCN10A; (-) strand; PAM type: YTN; PAM sequence: CTG
cttgactttggggtgtgtga

SEQ ID NO: 57055 - DNA, 20 bp, Artificial Sequence
  Description of Artificial Sequence: Synthetic oligonucleotide
  Target: SCN10A; (-) strand; PAM type: YTN; PAM sequence: CTG
ccaccatctgcttgactttg

SEQ ID NO: 57056 - DNA, 20 bp, Artificial Sequence
  Description of Artificial Sequence: Synthetic oligonucleotide
  Target: SCN10A; (-) strand; PAM type: YTN; PAM sequence: CTC
tgccaccatctgcttgactt

SEQ ID NO: 57057 - DNA, 20 bp, Artificial Sequence
  Description of Artificial Sequence: Synthetic oligonucleotide
  Target: SCN10A; (-) strand; PAM type: YTN; PAM sequence: CTG
cctctgccaccatctgcttg

SEQ ID NO: 57058 - DNA, 20 bp, Artificial Sequence
  Description of Artificial Sequence: Synthetic oligonucleotide
  Target: SCN10A; (-) strand; PAM type: YTN; PAM sequence: TTA
agcactgcctctgccaccat

SEQ ID NO: 57059 - DNA, 20 bp, Artificial Sequence
  Description of Artificial Sequence: Synthetic oligonucleotide
  Target: SCN10A; (-) strand; PAM type: YTN; PAM sequence: TTT
aagcactgcctctgccacca

SEQ ID NO: 57060 - DNA, 20 bp, Artificial Sequence
  Description of Artificial Sequence: Synthetic oligonucleotide
  Target: SCN10A; (-) strand; PAM type: YTN; PAM sequence: TTG
atttaagcactgcctctgcc

SEQ ID NO: 57061 - DNA, 20 bp, Artificial Sequence
  Description of Artificial Sequence: Synthetic oligonucleotide
  Target: SCN10A; (-) strand; PAM type: YTN; PAM sequence: TTT
gatttaagcactgcctctgc

SEQ ID NO: 57062 - DNA, 20 bp, Artificial Sequence
  Description of Artificial Sequence: Synthetic oligonucleotide
  Target: SCN10A; (-) strand; PAM type: YTN; PAM sequence: CTC
catcataggggtatttgatt

SEQ ID NO: 57063 - DNA, 20 bp, Artificial Sequence
  Description of Artificial Sequence: Synthetic oligonucleotide
  Target: SCN10A; (-) strand; PAM type: YTN; PAM sequence: CTA
ggtatggtgggagcaagcag

SEQ ID NO: 57064 - DNA, 20 bp, Artificial Sequence
  Description of Artificial Sequence: Synthetic oligonucleotide
  Target: SCN10A; (-) strand; PAM type: YTN; PAM sequence: CTC
taggtatggtgggagcaagc

SEQ ID NO: 57065 - DNA, 20 bp, Artificial Sequence
  Description of Artificial Sequence: Synthetic oligonucleotide
  Target: SCN10A; (-) strand; PAM type: YTN; PAM sequence: TTC
aagaaatacctctaggtatg

SEQ ID NO: 57066 - DNA, 20 bp, Artificial Sequence
  Description of Artificial Sequence: Synthetic oligonucleotide
  Target: SCN10A; (-) strand; PAM type: YTN; PAM sequence: TTG
gattcaagaaatacctctag

SEQ ID NO: 57067 - DNA, 20 bp, Artificial Sequence
  Description of Artificial Sequence: Synthetic oligonucleotide
  Target: SCN10A; (-) strand; PAM type: YTN; PAM sequence: CTA
tatcacagaggtattggatt

SEQ ID NO: 57068 - DNA, 20 bp, Artificial Sequence
  Description of Artificial Sequence: Synthetic oligonucleotide
  Target: SCN10A; (-) strand; PAM type: YTN; PAM sequence: CTG
gtgacaataagcagtgtcta

SEQ ID NO: 57069 - DNA, 20 bp, Artificial Sequence
  Description of Artificial Sequence: Synthetic oligonucleotide
  Target: SCN10A; (-) strand; PAM type: YTN; PAM sequence: CTA
gggctggtgacaataagcag

SEQ ID NO: 57070 - DNA, 20 bp, Artificial Sequence
  Description of Artificial Sequence: Synthetic oligonucleotide
  Target: SCN10A; (-) strand; PAM type: YTN; PAM sequence: CTC
tagggctggtgacaataagc

SEQ ID NO: 57071 - DNA, 20 bp, Artificial Sequence
  Description of Artificial Sequence: Synthetic oligonucleotide
  Target: SCN10A; (-) strand; PAM type: YTN; PAM sequence: CTG
cctctagggctggtgacaat

SEQ ID NO: 57072 - DNA, 20 bp, Artificial Sequence
  Description of Artificial Sequence: Synthetic oligonucleotide
  Target: SCN10A; (-) strand; PAM type: YTN; PAM sequence: TTG
ggtaccagagctgcctctag

SEQ ID NO: 57073 - DNA, 20 bp, Artificial Sequence
  Description of Artificial Sequence: Synthetic oligonucleotide
  Target: SCN10A; (-) strand; PAM type: YTN; PAM sequence: CTA
catatgggtattgggtacca

SEQ ID NO: 57074 - DNA, 20 bp, Artificial Sequence
  Description of Artificial Sequence: Synthetic oligonucleotide
  Target: SCN10A; (-) strand; PAM type: YTN; PAM sequence: CTC
ctacatatgggtattgggta

SEQ ID NO: 57075 - DNA, 20 bp, Artificial Sequence
  Description of Artificial Sequence: Synthetic oligonucleotide
  Target: SCN10A; (-) strand; PAM type: YTN; PAM sequence: CTG
gtgacaaccagcagagcctc

SEQ ID NO: 57076 - DNA, 20 bp, Artificial Sequence
  Description of Artificial Sequence: Synthetic oligonucleotide
  Target: SCN10A; (-) strand; PAM type: YTN; PAM sequence: TTC
aatgcatggaaggactggtg

SEQ ID NO: 57077 - DNA, 20 bp, Artificial Sequence
  Description of Artificial Sequence: Synthetic oligonucleotide
  Target: SCN10A; (-) strand; PAM type: YTN; PAM sequence: CTT
caatgcatggaaggactggt

SEQ ID NO: 57078 - DNA, 20 bp, Artificial Sequence
  Description of Artificial Sequence: Synthetic oligonucleotide
  Target: SCN10A; (-) strand; PAM type: YTN; PAM sequence: CTC
ccaggacttcaatgcatgga

SEQ ID NO: 57079 - DNA, 20 bp, Artificial Sequence
  Description of Artificial Sequence: Synthetic oligonucleotide
  Target: SCN10A; (-) strand; PAM type: YTN; PAM sequence: CTC
ctcccaggacttcaatgcat

SEQ ID NO: 57080 - DNA, 20 bp, Artificial Sequence
  Description of Artificial Sequence: Synthetic oligonucleotide
  Target: SCN10A; (-) strand; PAM type: YTN; PAM sequence: TTA
aggaagaggaatggtgtcag

SEQ ID NO: 57081 - DNA, 20 bp, Artificial Sequence
  Description of Artificial Sequence: Synthetic oligonucleotide
  Target: SCN10A; (-) strand; PAM type: YTN; PAM sequence: CTC
agaagaaagtaatggaggac

SEQ ID NO: 57082 - DNA, 20 bp, Artificial Sequence
  Description of Artificial Sequence: Synthetic oligonucleotide
  Target: SCN10A; (-) strand; PAM type: YTN; PAM sequence: CTC
tcagaagaaagtaatggagg

SEQ ID NO: 57083 - DNA, 20 bp, Artificial Sequence
  Description of Artificial Sequence: Synthetic oligonucleotide
  Target: SCN10A; (-) strand; PAM type: YTN; PAM sequence: CTA
caaataggcaggaggagagg

SEQ ID NO: 57084 - DNA, 20 bp, Artificial Sequence
  Description of Artificial Sequence: Synthetic oligonucleotide
  Target: SCN10A; (-) strand; PAM type: YTN; PAM sequence: TTC
cgtaagaaacagatcaacta

SEQ ID NO: 57085 - DNA, 20 bp, Artificial Sequence
  Description of Artificial Sequence: Synthetic oligonucleotide
  Target: SCN10A; (-) strand; PAM type: YTN; PAM sequence: TTG
aaaagttccgtaagaaacag

SEQ ID NO: 57086 - DNA, 20 bp, Artificial Sequence
  Description of Artificial Sequence: Synthetic oligonucleotide
  Target: SCN10A; (-) strand; PAM type: YTN; PAM sequence: TTT
gaaaagttccgtaagaaaca

SEQ ID NO: 57087 - DNA, 20 bp, Artificial Sequence
  Description of Artificial Sequence: Synthetic oligonucleotide
  Target: SCN10A; (-) strand; PAM type: YTN; PAM sequence: CTT
tgaaaagttccgtaagaaac

SEQ ID NO: 57088 - DNA, 20 bp, Artificial Sequence
  Description of Artificial Sequence: Synthetic oligonucleotide
  Target: SCN10A; (-) strand; PAM type: YTN; PAM sequence: TTG
actttgaaaagttccgtaag

SEQ ID NO: 57089 - DNA, 20 bp, Artificial Sequence
  Description of Artificial Sequence: Synthetic oligonucleotide
  Target: SCN10A; (-) strand; PAM type: YTN; PAM sequence: TTA
tgtaatgtaggttgactttg

SEQ ID NO: 57090 - DNA, 20 bp, Artificial Sequence
  Description of Artificial Sequence: Synthetic oligonucleotide
  Target: SCN10A; (-) strand; PAM type: YTN; PAM sequence: TTC
aattatgtaatgtaggttga

SEQ ID NO: 57091 - DNA, 20 bp, Artificial Sequence
  Description of Artificial Sequence: Synthetic oligonucleotide
  Target: SCN10A; (-) strand; PAM type: YTN; PAM sequence: TTA
gaagaaaatagaagacagat

SEQ ID NO: 57092 - DNA, 20 bp, Artificial Sequence
  Description of Artificial Sequence: Synthetic oligonucleotide
  Target: SCN10A; (-) strand; PAM type: YTN; PAM sequence: CTA
agttagaagaaaatagaaga

SEQ ID NO: 57093 - DNA, 20 bp, Artificial Sequence
  Description of Artificial Sequence: Synthetic oligonucleotide
  Target: SCN10A; (-) strand; PAM type: YTN; PAM sequence: TTC
taagttagaagaaaatagaa

SEQ ID NO: 57094 - DNA, 20 bp, Artificial Sequence
  Description of Artificial Sequence: Synthetic oligonucleotide
  Target: SCN10A; (-) strand; PAM type: YTN; PAM sequence: CTT
ctaagttagaagaaaataga

SEQ ID NO: 57095 - DNA, 20 bp, Artificial Sequence
  Description of Artificial Sequence: Synthetic oligonucleotide
  Target: SCN10A; (-) strand; PAM type: YTN; PAM sequence: TTG
ggcacacaacacatagaact

SEQ ID NO: 57096 - DNA, 20 bp, Artificial Sequence
  Description of Artificial Sequence: Synthetic oligonucleotide
  Target: SCN10A; (-) strand; PAM type: YTN; PAM sequence: TTT
gggcacacaacacatagaac

SEQ ID NO: 57097 - DNA, 20 bp, Artificial Sequence
  Description of Artificial Sequence: Synthetic oligonucleotide
  Target: SCN10A; (-) strand; PAM type: YTN; PAM sequence: TTA
atcagaatttgggcacacaa

SEQ ID NO: 57098 - DNA, 20 bp, Artificial Sequence
  Description of Artificial Sequence: Synthetic oligonucleotide
  Target: SCN10A; (-) strand; PAM type: YTN; PAM sequence: TTG
cataaatacaccatgttaat

SEQ ID NO: 57099 - DNA, 20 bp, Artificial Sequence
  Description of Artificial Sequence: Synthetic oligonucleotide
  Target: SCN10A; (-) strand; PAM type: YTN; PAM sequence: TTG
aatggtcattgcataaatac

SEQ ID NO: 57100 - DNA, 20 bp, Artificial Sequence
  Description of Artificial Sequence: Synthetic oligonucleotide
  Target: SCN10A; (-) strand; PAM type: YTN; PAM sequence: TTT
gaatggtcattgcataaata

SEQ ID NO: 57101 - DNA, 20 bp, Artificial Sequence
  Description of Artificial Sequence: Synthetic oligonucleotide
  Target: SCN10A; (-) strand; PAM type: YTN; PAM sequence: CTG
aagtcaacagtgtttgaatg

SEQ ID NO: 57102 - DNA, 20 bp, Artificial Sequence
  Description of Artificial Sequence: Synthetic oligonucleotide
  Target: SCN10A; (-) strand; PAM type: YTN; PAM sequence: TTA
aagacactgaagtcaacagt

SEQ ID NO: 57103 - DNA, 20 bp, Artificial Sequence
  Description of Artificial Sequence: Synthetic oligonucleotide
  Target: SCN10A; (-) strand; PAM type: YTN; PAM sequence: CTC
agaagggaagaattaaagac

SEQ ID NO: 57104 - DNA, 20 bp, Artificial Sequence
  Description of Artificial Sequence: Synthetic oligonucleotide
  Target: SCN10A; (-) strand; PAM type: YTN; PAM sequence: TTC
tcagaagggaagaattaaag

SEQ ID NO: 57105 - DNA, 20 bp, Artificial Sequence
  Description of Artificial Sequence: Synthetic oligonucleotide
  Target: SCN10A; (-) strand; PAM type: YTN; PAM sequence: TTT
ctcagaagggaagaattaaa

SEQ ID NO: 57106 - DNA, 20 bp, Artificial Sequence
  Description of Artificial Sequence: Synthetic oligonucleotide
  Target: SCN10A; (-) strand; PAM type: YTN; PAM sequence: TTG
tttctcagaagggaagaatt

SEQ ID NO: 57107 - DNA, 20 bp, Artificial Sequence
  Description of Artificial Sequence: Synthetic oligonucleotide
  Target: SCN10A; (-) strand; PAM type: YTN; PAM sequence: TTT
gtttctcagaagggaagaat

SEQ ID NO: 57108 - DNA, 20 bp, Artificial Sequence
  Description of Artificial Sequence: Synthetic oligonucleotide
  Target: SCN10A; (-) strand; PAM type: YTN; PAM sequence: CTT
tgtttctcagaagggaagaa

SEQ ID NO: 57109 - DNA, 20 bp, Artificial Sequence
  Description of Artificial Sequence: Synthetic oligonucleotide
  Target: SCN10A; (-) strand; PAM type: YTN; PAM sequence: TTA
atctttgtttctcagaaggg

SEQ ID NO: 57110 - DNA, 20 bp, Artificial Sequence
  Description of Artificial Sequence: Synthetic oligonucleotide
  Target: SCN10A; (-) strand; PAM type: YTN; PAM sequence: CTT
aatctttgtttctcagaagg

SEQ ID NO: 57111 - DNA, 20 bp, Artificial Sequence
  Description of Artificial Sequence: Synthetic oligonucleotide
  Target: SCN10A; (-) strand; PAM type: YTN; PAM sequence: TTA
acttaatctttgtttctcag

SEQ ID NO: 57112 - DNA, 20 bp, Artificial Sequence
  Description of Artificial Sequence: Synthetic oligonucleotide
  Target: SCN10A; (-) strand; PAM type: YTN; PAM sequence: CTA
gacaaggaagagaaagttaa

SEQ ID NO: 57113 - DNA, 20 bp, Artificial Sequence
  Description of Artificial Sequence: Synthetic oligonucleotide
  Target: SCN10A; (-) strand; PAM type: YTN; PAM sequence: CTC
ccctagacaaggaagagaaa

SEQ ID NO: 57114 - DNA, 20 bp, Artificial Sequence
  Description of Artificial Sequence: Synthetic oligonucleotide
  Target: SCN10A; (-) strand; PAM type: YTN; PAM sequence: TTC
tcccctagacaaggaagaga

SEQ ID NO: 57115 - DNA, 20 bp, Artificial Sequence
  Description of Artificial Sequence: Synthetic oligonucleotide
  Target: SCN10A; (-) strand; PAM type: YTN; PAM sequence: CTT
ctcccctagacaaggaagag

SEQ ID NO: 57116 - DNA, 20 bp, Artificial Sequence
  Description of Artificial Sequence: Synthetic oligonucleotide
  Target: SCN10A; (-) strand; PAM type: YTN; PAM sequence: CTC
ttctcccctagacaaggaag

SEQ ID NO: 57117 - DNA, 20 bp, Artificial Sequence
  Description of Artificial Sequence: Synthetic oligonucleotide
  Target: SCN10A; (-) strand; PAM type: YTN; PAM sequence: CTA
taagtatctcttctccccta

SEQ ID NO: 57118 - DNA, 20 bp, Artificial Sequence
  Description of Artificial Sequence: Synthetic oligonucleotide
  Target: SCN10A; (-) strand; PAM type: YTN; PAM sequence: TTC
caaactataagtatctcttc

SEQ ID NO: 57119 - DNA, 20 bp, Artificial Sequence
  Description of Artificial Sequence: Synthetic oligonucleotide
  Target: SCN10A; (-) strand; PAM type: YTN; PAM sequence: TTG
gttccaaactataagtatct

SEQ ID NO: 57120 - DNA, 20 bp, Artificial Sequence
  Description of Artificial Sequence: Synthetic oligonucleotide
  Target: SCN10A; (-) strand; PAM type: YTN; PAM sequence: TTT
ggttccaaactataagtatc

SEQ ID NO: 57121 - DNA, 20 bp, Artificial Sequence
  Description of Artificial Sequence: Synthetic oligonucleotide
  Target: SCN10A; (-) strand; PAM type: YTN; PAM sequence: TTC
aaatttggttccaaactata

SEQ ID NO: 57122 - DNA, 20 bp, Artificial Sequence
  Description of Artificial Sequence: Synthetic oligonucleotide
  Target: SCN10A; (-) strand; PAM type: YTN; PAM sequence: CTG
ggattcaaatttggttccaa

SEQ ID NO: 57123 - DNA, 20 bp, Artificial Sequence
  Description of Artificial Sequence: Synthetic oligonucleotide
  Target: SCN10A; (-) strand; PAM type: YTN; PAM sequence: CTG
agtcctgggattcaaatttg

SEQ ID NO: 57124 - DNA, 20 bp, Artificial Sequence
  Description of Artificial Sequence: Synthetic oligonucleotide
  Target: SCN10A; (-) strand; PAM type: YTN; PAM sequence: CTA
aacaactgagtcctgggatt

SEQ ID NO: 57125 - DNA, 20 bp, Artificial Sequence
  Description of Artificial Sequence: Synthetic oligonucleotide
  Target: SCN10A; (-) strand; PAM type: YTN; PAM sequence: TTA
ctaaacaactgagtcctggg

SEQ ID NO: 57126 - DNA, 20 bp, Artificial Sequence
  Description of Artificial Sequence: Synthetic oligonucleotide
  Target: SCN10A; (-) strand; PAM type: YTN; PAM sequence: TTG
ttactaaacaactgagtcct

SEQ ID NO: 57127 - DNA, 20 bp, Artificial Sequence
  Description of Artificial Sequence: Synthetic oligonucleotide
  Target: SCN10A; (-) strand; PAM type: YTN; PAM sequence: TTG
cattgttactaaacaactga

SEQ ID NO: 57128 - DNA, 20 bp, Artificial Sequence
  Description of Artificial Sequence: Synthetic oligonucleotide
  Target: SCN10A; (-) strand; PAM type: YTN; PAM sequence: CTT
gcattgttactaaacaactg

SEQ ID NO: 57129 - DNA, 20 bp, Artificial Sequence
  Description of Artificial Sequence: Synthetic oligonucleotide
  Target: SCN10A; (-) strand; PAM type: YTN; PAM sequence: TTC
ttgcattgttactaaacaac

SEQ ID NO: 57130 - DNA, 20 bp, Artificial Sequence
  Description of Artificial Sequence: Synthetic oligonucleotide
  Target: SCN10A; (-) strand; PAM type: YTN; PAM sequence: CTG
agagaattcttgcattgtta

SEQ ID NO: 57131 - DNA, 20 bp, Artificial Sequence
  Description of Artificial Sequence: Synthetic oligonucleotide
  Target: SCN10A; (-) strand; PAM type: YTN; PAM sequence: TTC
cagtgtcactgagagaattc

SEQ ID NO: 57132 - DNA, 20 bp, Artificial Sequence
  Description of Artificial Sequence: Synthetic oligonucleotide
  Target: SCN10A; (-) strand; PAM type: YTN; PAM sequence: TTG
cattccagtgtcactgagag

SEQ ID NO: 57133 - DNA, 20 bp, Artificial Sequence
  Description of Artificial Sequence: Synthetic oligonucleotide
  Target: SCN10A; (-) strand; PAM type: YTN; PAM sequence: CTC
aacattgcattccagtgtca

SEQ ID NO: 57134 - DNA, 20 bp, Artificial Sequence
  Description of Artificial Sequence: Synthetic oligonucleotide
  Target: SCN10A; (-) strand; PAM type: YTN; PAM sequence: CTC
aatcctcaacattgcattcc

SEQ ID NO: 57135 - DNA, 20 bp, Artificial Sequence
  Description of Artificial Sequence: Synthetic oligonucleotide
  Target: SCN10A; (-) strand; PAM type: YTN; PAM sequence: TTC
tcaatcctcaacattgcatt

SEQ ID NO: 57136 - DNA, 20 bp, Artificial Sequence
  Description of Artificial Sequence: Synthetic oligonucleotide
  Target: SCN10A; (-) strand; PAM type: YTN; PAM sequence: CTG
ttctcaatcctcaacattgc

SEQ ID NO: 57137 - DNA, 20 bp, Artificial Sequence
  Description of Artificial Sequence: Synthetic oligonucleotide
  Target: SCN10A; (-) strand; PAM type: YTN; PAM sequence: TTA
gtcctgttctcaatcctcaa

SEQ ID NO: 57138 - DNA, 20 bp, Artificial Sequence
  Description of Artificial Sequence: Synthetic oligonucleotide
  Target: SCN10A; (-) strand; PAM type: YTN; PAM sequence: CTT
agtcctgttctcaatcctca

SEQ ID NO: 57139 - DNA, 20 bp, Artificial Sequence
  Description of Artificial Sequence: Synthetic oligonucleotide
  Target: SCN10A; (-) strand; PAM type: YTN; PAM sequence: CTG
gcttagtcctgttctcaatc

SEQ ID NO: 57140 - DNA, 20 bp, Artificial Sequence
  Description of Artificial Sequence: Synthetic oligonucleotide
  Target: SCN10A; (-) strand; PAM type: YTN; PAM sequence: TTC
tggcttagtcctgttctcaa

SEQ ID NO: 57141 - DNA, 20 bp, Artificial Sequence
  Description of Artificial Sequence: Synthetic oligonucleotide
  Target: SCN10A; (-) strand; PAM type: YTN; PAM sequence: CTG
gaattctggcttagtcctgt

SEQ ID NO: 57142 - DNA, 20 bp, Artificial Sequence
  Description of Artificial Sequence: Synthetic oligonucleotide
  Target: SCN10A; (-) strand; PAM type: YTN; PAM sequence: CTC
caggacctggaattctggct

SEQ ID NO: 57143 - DNA, 20 bp, Artificial Sequence
  Description of Artificial Sequence: Synthetic oligonucleotide
  Target: SCN10A; (-) strand; PAM type: YTN; PAM sequence: CTC
cagctccaggacctggaatt

SEQ ID NO: 57144 - DNA, 20 bp, Artificial Sequence
  Description of Artificial Sequence: Synthetic oligonucleotide
  Target: SCN10A; (-) strand; PAM type: YTN; PAM sequence: CTC
aagctccagctccaggacct

SEQ ID NO: 57145 - DNA, 20 bp, Artificial Sequence
  Description of Artificial Sequence: Synthetic oligonucleotide
  Target: SCN10A; (-) strand; PAM type: YTN; PAM sequence: TTG
acctcaagctccagctccag

SEQ ID NO: 57146 - DNA, 20 bp, Artificial Sequence
  Description of Artificial Sequence: Synthetic oligonucleotide
  Target: SCN10A; (-) strand; PAM type: YTN; PAM sequence: TTT
gacctcaagctccagctcca

SEQ ID NO: 57147 - DNA, 20 bp, Artificial Sequence
  Description of Artificial Sequence: Synthetic oligonucleotide
  Target: SCN10A; (-) strand; PAM type: YTN; PAM sequence: CTT
tgacctcaagctccagctcc

SEQ ID NO: 57148 - DNA, 20 bp, Artificial Sequence
  Description of Artificial Sequence: Synthetic oligonucleotide
  Target: SCN10A; (-) strand; PAM type: YTN; PAM sequence: CTG
ctttgacctcaagctccagc

SEQ ID NO: 57149 - DNA, 20 bp, Artificial Sequence
  Description of Artificial Sequence: Synthetic oligonucleotide
  Target: SCN10A; (-) strand; PAM type: YTN; PAM sequence: CTG
agtctgctttgacctcaagc

SEQ ID NO: 57150 - DNA, 20 bp, Artificial Sequence
  Description of Artificial Sequence: Synthetic oligonucleotide
  Target: SCN10A; (-) strand; PAM type: YTN; PAM sequence: CTC
atagctgagtctgctttgac

SEQ ID NO: 57151 - DNA, 20 bp, Artificial Sequence
  Description of Artificial Sequence: Synthetic oligonucleotide
  Target: SCN10A; (-) strand; PAM type: YTN; PAM sequence: TTG
gcatgaagtcagtctcatag

SEQ ID NO: 57152 - DNA, 20 bp, Artificial Sequence
  Description of Artificial Sequence: Synthetic oligonucleotide
  Target: SCN10A; (-) strand; PAM type: YTN; PAM sequence: TTT
ggcatgaagtcagtctcata

SEQ ID NO: 57153 - DNA, 20 bp, Artificial Sequence
  Description of Artificial Sequence: Synthetic oligonucleotide
  Target: SCN10A; (-) strand; PAM type: YTN; PAM sequence: TTA
tggtcatttggcatgaagtc

SEQ ID NO: 57154 - DNA, 20 bp, Artificial Sequence
  Description of Artificial Sequence: Synthetic oligonucleotide
  Target: SCN10A; (-) strand; PAM type: YTN; PAM sequence: TTA
tggtagcccagaataattat

SEQ ID NO: 57155 - DNA, 20 bp, Artificial Sequence
  Description of Artificial Sequence: Synthetic oligonucleotide
  Target: SCN10A; (-) strand; PAM type: YTN; PAM sequence: TTT
atggtagcccagaataatta

SEQ ID NO: 57156 - DNA, 20 bp, Artificial Sequence
  Description of Artificial Sequence: Synthetic oligonucleotide
  Target: SCN10A; (-) strand; PAM type: YTN; PAM sequence: CTG
gagggatttatggtagccca

SEQ ID NO: 57157 - DNA, 20 bp, Artificial Sequence
  Description of Artificial Sequence: Synthetic oligonucleotide
  Target: SCN10A; (-) strand; PAM type: YTN; PAM sequence: TTA
gctggagggatttatggtag

SEQ ID NO: 57158 - DNA, 20 bp, Artificial Sequence
  Description of Artificial Sequence: Synthetic oligonucleotide
  Target: SCN10A; (-) strand; PAM type: YTN; PAM sequence: CTT
agctggagggatttatggta

SEQ ID NO: 57159 - DNA, 20 bp, Artificial Sequence
  Description of Artificial Sequence: Synthetic oligonucleotide
  Target: SCN10A; (-) strand; PAM type: YTN; PAM sequence: TTG
tccttagctggagggattta

SEQ ID NO: 57160 - DNA, 20 bp, Artificial Sequence
  Description of Artificial Sequence: Synthetic oligonucleotide
  Target: SCN10A; (-) strand; PAM type: YTN; PAM sequence: TTT
gtccttagctggagggattt

SEQ ID NO: 57161 - DNA, 20 bp, Artificial Sequence
  Description of Artificial Sequence: Synthetic oligonucleotide
  Target: SCN10A; (-) strand; PAM type: YTN; PAM sequence: TTT
tgtccttagctggagggatt

SEQ ID NO: 57162 - DNA, 20 bp, Artificial Sequence
  Description of Artificial Sequence: Synthetic oligonucleotide
  Target: SCN10A; (-) strand; PAM type: YTN; PAM sequence: TTG
aaaacaattttgtccttagc

SEQ ID NO: 57163 - DNA, 20 bp, Artificial Sequence
  Description of Artificial Sequence: Synthetic oligonucleotide
  Target: SCN10A; (-) strand; PAM type: YTN; PAM sequence: TTC
ccaccccaatgttgaaaaca

SEQ ID NO: 57164 - DNA, 20 bp, Artificial Sequence
  Description of Artificial Sequence: Synthetic oligonucleotide
  Target: SCN10A; (-) strand; PAM type: YTN; PAM sequence: CTA
caaattcccaccccaatgtt

SEQ ID NO: 57165 - DNA, 20 bp, Artificial Sequence
  Description of Artificial Sequence: Synthetic oligonucleotide
  Target: SCN10A; (-) strand; PAM type: YTN; PAM sequence: CTA
catcacatcactacaaattc

SEQ ID NO: 57166 - DNA, 20 bp, Artificial Sequence
  Description of Artificial Sequence: Synthetic oligonucleotide
  Target: SCN10A; (-) strand; PAM type: YTN; PAM sequence: CTC
atacctacatcacatcacta

SEQ ID NO: 57167 - DNA, 20 bp, Artificial Sequence
  Description of Artificial Sequence: Synthetic oligonucleotide
  Target: SCN10A; (-) strand; PAM type: YTN; PAM sequence: CTG
gtccctcatacctacatcac

SEQ ID NO: 57168 - DNA, 20 bp, Artificial Sequence
  Description of Artificial Sequence: Synthetic oligonucleotide
  Target: SCN10A; (-) strand; PAM type: YTN; PAM sequence: TTA
aaagaaggactggtccctca

SEQ ID NO: 57169 - DNA, 20 bp, Artificial Sequence
  Description of Artificial Sequence: Synthetic oligonucleotide
  Target: SCN10A; (-) strand; PAM type: YTN; PAM sequence: CTT
aaaagaaggactggtccctc

SEQ ID NO: 57170 - DNA, 20 bp, Artificial Sequence
  Description of Artificial Sequence: Synthetic oligonucleotide
  Target: SCN10A; (-) strand; PAM type: YTN; PAM sequence: CTG
atgggaaagtcttaaaagaa

SEQ ID NO: 57171 - DNA, 20 bp, Artificial Sequence
  Description of Artificial Sequence: Synthetic oligonucleotide
  Target: SCN10A; (-) strand; PAM type: YTN; PAM sequence: TTC
tgatgggaaagtcttaaaag

SEQ ID NO: 57172 - DNA, 20 bp, Artificial Sequence
  Description of Artificial Sequence: Synthetic oligonucleotide
  Target: SCN10A; (-) strand; PAM type: YTN; PAM sequence: CTT
ctgatgggaaagtcttaaaa

SEQ ID NO: 57173 - DNA, 20 bp, Artificial Sequence
  Description of Artificial Sequence: Synthetic oligonucleotide
  Target: SCN10A; (-) strand; PAM type: YTN; PAM sequence: CTA
tcacttctgatgggaaagtc

SEQ ID NO: 57174 - DNA, 20 bp, Artificial Sequence
  Description of Artificial Sequence: Synthetic oligonucleotide
  Target: SCN10A; (-) strand; PAM type: YTN; PAM sequence: TTC
aatcaagggatcccaagtcc

SEQ ID NO: 57175 - DNA, 20 bp, Artificial Sequence
  Description of Artificial Sequence: Synthetic oligonucleotide
  Target: SCN10A; (-) strand; PAM type: YTN; PAM sequence: CTT
caatcaagggatcccaagtc

SEQ ID NO: 57176 - DNA, 20 bp, Artificial Sequence
  Description of Artificial Sequence: Synthetic oligonucleotide
  Target: SCN10A; (-) strand; PAM type: YTN; PAM sequence: CTG
ggtaatagatgggaatatag

SEQ ID NO: 57177 - DNA, 20 bp, Artificial Sequence
  Description of Artificial Sequence: Synthetic oligonucleotide
  Target: SCN10A; (-) strand; PAM type: YTN; PAM sequence: CTC
agaatgtcatgtaaagacac

SEQ ID NO: 57178 - DNA, 20 bp, Artificial Sequence
  Description of Artificial Sequence: Synthetic oligonucleotide
  Target: SCN10A; (-) strand; PAM type: YTN; PAM sequence: TTC
tcagaatgtcatgtaaagac

SEQ ID NO: 57179 - DNA, 20 bp, Artificial Sequence
  Description of Artificial Sequence: Synthetic oligonucleotide
  Target: SCN10A; (-) strand; PAM type: YTN; PAM sequence: TTT
ctcagaatgtcatgtaaaga

SEQ ID NO: 57180 - DNA, 20 bp, Artificial Sequence
  Description of Artificial Sequence: Synthetic oligonucleotide
  Target: SCN10A; (-) strand; PAM type: YTN; PAM sequence: TTT
tctcagaatgtcatgtaaag

SEQ ID NO: 57181 - DNA, 20 bp, Artificial Sequence
  Description of Artificial Sequence: Synthetic oligonucleotide
  Target: SCN10A; (-) strand; PAM type: YTN; PAM sequence: TTG
caccccaatagttttctcag

SEQ ID NO: 57182 - DNA, 20 bp, Artificial Sequence
  Description of Artificial Sequence: Synthetic oligonucleotide
  Target: SCN10A; (-) strand; PAM type: YTN; PAM sequence: CTT
gcaccccaatagttttctca

SEQ ID NO: 57183 - DNA, 20 bp, Artificial Sequence
  Description of Artificial Sequence: Synthetic oligonucleotide
  Target: SCN10A; (-) strand; PAM type: YTN; PAM sequence: CTA
cttgcaccccaatagttttc

SEQ ID NO: 57184 - DNA, 20 bp, Artificial Sequence
  Description of Artificial Sequence: Synthetic oligonucleotide
  Target: SCN10A; (-) strand; PAM type: YTN; PAM sequence: CTC
agataaactacttgcacccc

SEQ ID NO: 57185 - DNA, 20 bp, Artificial Sequence
  Description of Artificial Sequence: Synthetic oligonucleotide
  Target: SCN10A; (-) strand; PAM type: YTN; PAM sequence: CTC
tcagataaactacttgcacc

SEQ ID NO: 57186 - DNA, 20 bp, Artificial Sequence
  Description of Artificial Sequence: Synthetic oligonucleotide
  Target: SCN10A; (-) strand; PAM type: YTN; PAM sequence: CTA
gaaatagctctcagataaac

SEQ ID NO: 57187 - DNA, 20 bp, Artificial Sequence
  Description of Artificial Sequence: Synthetic oligonucleotide
  Target: SCN10A; (-) strand; PAM type: YTN; PAM sequence: TTC
ctagaaatagctctcagata

SEQ ID NO: 57188 - DNA, 20 bp, Artificial Sequence
  Description of Artificial Sequence: Synthetic oligonucleotide
  Target: SCN10A; (-) strand; PAM type: YTN; PAM sequence: CTA
tgacattcctagaaatagct

SEQ ID NO: 57189 - DNA, 20 bp, Artificial Sequence
  Description of Artificial Sequence: Synthetic oligonucleotide
  Target: SCN10A; (-) strand; PAM type: YTN; PAM sequence: TTC
tatgacattcctagaaatag

SEQ ID NO: 57190 - DNA, 20 bp, Artificial Sequence
  Description of Artificial Sequence: Synthetic oligonucleotide
  Target: SCN10A; (-) strand; PAM type: YTN; PAM sequence: CTT
ctatgacattcctagaaata

SEQ ID NO: 57191 - DNA, 20 bp, Artificial Sequence
  Description of Artificial Sequence: Synthetic oligonucleotide
  Target: SCN10A; (-) strand; PAM type: YTN; PAM sequence: CTC
ttctatgacattcctagaaa

SEQ ID NO: 57192 - DNA, 20 bp, Artificial Sequence
  Description of Artificial Sequence: Synthetic oligonucleotide
  Target: SCN10A; (-) strand; PAM type: YTN; PAM sequence: CTC
tcttctatgacattcctaga

SEQ ID NO: 57193 - DNA, 20 bp, Artificial Sequence
  Description of Artificial Sequence: Synthetic oligonucleotide
  Target: SCN10A; (-) strand; PAM type: YTN; PAM sequence: TTC
ctctcttctatgacattcct

SEQ ID NO: 57194 - DNA, 20 bp, Artificial Sequence
  Description of Artificial Sequence: Synthetic oligonucleotide
  Target: SCN10A; (-) strand; PAM type: YTN; PAM sequence: TTT
cctctcttctatgacattcc

SEQ ID NO: 57195 - DNA, 20 bp, Artificial Sequence
  Description of Artificial Sequence: Synthetic oligonucleotide
  Target: SCN10A; (-) strand; PAM type: YTN; PAM sequence: TTT
tcctctcttctatgacattc

SEQ ID NO: 57196 - DNA, 20 bp, Artificial Sequence
  Description of Artificial Sequence: Synthetic oligonucleotide
  Target: SCN10A; (-) strand; PAM type: YTN; PAM sequence: CTT
ttcctctcttctatgacatt

SEQ ID NO: 57197 - DNA, 20 bp, Artificial Sequence
  Description of Artificial Sequence: Synthetic oligonucleotide
  Target: SCN10A; (-) strand; PAM type: YTN; PAM sequence: TTA
cttttcctctcttctatgac

SEQ ID NO: 57198 - DNA, 20 bp, Artificial Sequence
  Description of Artificial Sequence: Synthetic oligonucleotide
  Target: SCN10A; (-) strand; PAM type: YTN; PAM sequence: TTA
tgttacttttcctctcttct

SEQ ID NO: 57199 - DNA, 20 bp, Artificial Sequence
  Description of Artificial Sequence: Synthetic oligonucleotide
  Target: SCN10A; (-) strand; PAM type: YTN; PAM sequence: CTT
atgttacttttcctctcttc

SEQ ID NO: 57200 - DNA, 20 bp, Artificial Sequence
  Description of Artificial Sequence: Synthetic oligonucleotide
  Target: SCN10A; (-) strand; PAM type: YTN; PAM sequence: TTC
ttatgttacttttcctctct

SEQ ID NO: 57201 - DNA, 20 bp, Artificial Sequence
  Description of Artificial Sequence: Synthetic oligonucleotide
  Target: SCN10A; (-) strand; PAM type: YTN; PAM sequence: CTT
cttatgttacttttcctctc

SEQ ID NO: 57202 - DNA, 20 bp, Artificial Sequence
  Description of Artificial Sequence: Synthetic oligonucleotide
  Target: SCN10A; (-) strand; PAM type: YTN; PAM sequence: TTC
ttcttatgttacttttcctc

SEQ ID NO: 57203 - DNA, 20 bp, Artificial Sequence
  Description of Artificial Sequence: Synthetic oligonucleotide
  Target: SCN10A; (-) strand; PAM type: YTN; PAM sequence: CTT
cttcttatgttacttttcct

SEQ ID NO: 57204 - DNA, 20 bp, Artificial Sequence
  Description of Artificial Sequence: Synthetic oligonucleotide
  Target: SCN10A; (-) strand; PAM type: YTN; PAM sequence: TTC
ttcttcttatgttacttttc

SEQ ID NO: 57205 - DNA, 20 bp, Artificial Sequence
  Description of Artificial Sequence: Synthetic oligonucleotide
  Target: SCN10A; (-) strand; PAM type: YTN; PAM sequence: TTT
cttcttcttatgttactttt

SEQ ID NO: 57206 - DNA, 20 bp, Artificial Sequence
  Description of Artificial Sequence: Synthetic oligonucleotide
  Target: SCN10A; (-) strand; PAM type: YTN; PAM sequence: CTT
tcttcttcttatgttacttt

SEQ ID NO: 57207 - DNA, 20 bp, Artificial Sequence
  Description of Artificial Sequence: Synthetic oligonucleotide
  Target: SCN10A; (-) strand; PAM type: YTN; PAM sequence: CTG
ctttcttcttcttatgttac

SEQ ID NO: 57208 - DNA, 20 bp, Artificial Sequence
  Description of Artificial Sequence: Synthetic oligonucleotide
  Target: SCN10A; (-) strand; PAM type: YTN; PAM sequence: CTC
ataaaaatactgctttcttc

SEQ ID NO: 57209 - DNA, 20 bp, Artificial Sequence
  Description of Artificial Sequence: Synthetic oligonucleotide
  Target: SCN10A; (-) strand; PAM type: YTN; PAM sequence: TTG
cccataagagtaaatggctc

SEQ ID NO: 57210 - DNA, 20 bp, Artificial Sequence
  Description of Artificial Sequence: Synthetic oligonucleotide
  Target: SCN10A; (-) strand; PAM type: YTN; PAM sequence: TTT
gcccataagagtaaatggct

SEQ ID NO: 57211 - DNA, 20 bp, Artificial Sequence
  Description of Artificial Sequence: Synthetic oligonucleotide
  Target: SCN10A; (-) strand; PAM type: YTN; PAM sequence: CTG
agcccagtttgcccataaga

SEQ ID NO: 57212 - DNA, 20 bp, Artificial Sequence
  Description of Artificial Sequence: Synthetic oligonucleotide
  Target: SCN10A; (-) strand; PAM type: YTN; PAM sequence: TTC
tgagcccagtttgcccataa

SEQ ID NO: 57213 - DNA, 20 bp, Artificial Sequence
  Description of Artificial Sequence: Synthetic oligonucleotide
  Target: SCN10A; (-) strand; PAM type: YTN; PAM sequence: CTC
agtgaaacaattctgagccc

SEQ ID NO: 57214 - DNA, 20 bp, Artificial Sequence
  Description of Artificial Sequence: Synthetic oligonucleotide
  Target: SCN10A; (-) strand; PAM type: YTN; PAM sequence: TTA
cccctcagtgaaacaattct

SEQ ID NO: 57215 - DNA, 20 bp, Artificial Sequence
  Description of Artificial Sequence: Synthetic oligonucleotide
  Target: SCN10A; (-) strand; PAM type: YTN; PAM sequence: CTT
acccctcagtgaaacaattc

SEQ ID NO: 57216 - DNA, 20 bp, Artificial Sequence
  Description of Artificial Sequence: Synthetic oligonucleotide
  Target: SCN10A; (-) strand; PAM type: YTN; PAM sequence: CTA
gtatccttacccctcagtga

SEQ ID NO: 57217 - DNA, 20 bp, Artificial Sequence
  Description of Artificial Sequence: Synthetic oligonucleotide
  Target: SCN10A; (-) strand; PAM type: YTN; PAM sequence: CTG
gtagataaaaccctagtatc

SEQ ID NO: 57218 - DNA, 20 bp, Artificial Sequence
  Description of Artificial Sequence: Synthetic oligonucleotide
  Target: SCN10A; (-) strand; PAM type: YTN; PAM sequence: TTA
aaatcccaggacaaccgtca

SEQ ID NO: 57219 - DNA, 20 bp, Artificial Sequence
  Description of Artificial Sequence: Synthetic oligonucleotide
  Target: SCN10A; (-) strand; PAM type: YTN; PAM sequence: CTG
tagagttaaaatcccaggac

SEQ ID NO: 57220 - DNA, 20 bp, Artificial Sequence
  Description of Artificial Sequence: Synthetic oligonucleotide
  Target: SCN10A; (-) strand; PAM type: YTN; PAM sequence: TTC
tgtagagttaaaatcccagg

SEQ ID NO: 57221 - DNA, 20 bp, Artificial Sequence
  Description of Artificial Sequence: Synthetic oligonucleotide
  Target: SCN10A; (-) strand; PAM type: YTN; PAM sequence: CTG
aagtaagttctgtagagtta

SEQ ID NO: 57222 - DNA, 20 bp, Artificial Sequence
  Description of Artificial Sequence: Synthetic oligonucleotide
  Target: SCN10A; (-) strand; PAM type: YTN; PAM sequence: CTG
gccactgaagtaagttctgt

SEQ ID NO: 57223 - DNA, 20 bp, Artificial Sequence
  Description of Artificial Sequence: Synthetic oligonucleotide
  Target: SCN10A; (-) strand; PAM type: YTN; PAM sequence: CTC
tggccactgaagtaagttct

SEQ ID NO: 57224 - DNA, 20 bp, Artificial Sequence
  Description of Artificial Sequence: Synthetic oligonucleotide
  Target: SCN10A; (-) strand; PAM type: YTN; PAM sequence: TTC
tctggccactgaagtaagtt

SEQ ID NO: 57225 - DNA, 20 bp, Artificial Sequence
  Description of Artificial Sequence: Synthetic oligonucleotide
  Target: SCN10A; (-) strand; PAM type: YTN; PAM sequence: TTT
ctctggccactgaagtaagt

SEQ ID NO: 57226 - DNA, 20 bp, Artificial Sequence
  Description of Artificial Sequence: Synthetic oligonucleotide
  Target: SCN10A; (-) strand; PAM type: YTN; PAM sequence: CTT
tctctggccactgaagtaag

SEQ ID NO: 57227 - DNA, 20 bp, Artificial Sequence
  Description of Artificial Sequence: Synthetic oligonucleotide
  Target: SCN10A; (-) strand; PAM type: YTN; PAM sequence: CTG
cccagggctttctctggcca

SEQ ID NO: 57228 - DNA, 20 bp, Artificial Sequence
  Description of Artificial Sequence: Synthetic oligonucleotide
  Target: SCN10A; (-) strand; PAM type: YTN; PAM sequence: CTG
tctgcccagggctttctctg

SEQ ID NO: 57229 - DNA, 20 bp, Artificial Sequence
  Description of Artificial Sequence: Synthetic oligonucleotide
  Target: SCN10A; (-) strand; PAM type: YTN; PAM sequence: CTC
tgtctgcccagggctttctc

SEQ ID NO: 57230 - DNA, 20 bp, Artificial Sequence
  Description of Artificial Sequence: Synthetic oligonucleotide
  Target: SCN10A; (-) strand; PAM type: YTN; PAM sequence: CTG
cctctgtctgcccagggctt

SEQ ID NO: 57231 - DNA, 20 bp, Artificial Sequence
  Description of Artificial Sequence: Synthetic oligonucleotide
  Target: SCN10A; (-) strand; PAM type: YTN; PAM sequence: TTC
ctgcctctgtctgcccaggg

SEQ ID NO: 57232 - DNA, 20 bp, Artificial Sequence
  Description of Artificial Sequence: Synthetic oligonucleotide
  Target: SCN10A; (-) strand; PAM type: YTN; PAM sequence: CTT
cctgcctctgtctgcccagg

SEQ ID NO: 57233 - DNA, 20 bp, Artificial Sequence
  Description of Artificial Sequence: Synthetic oligonucleotide
  Target: SCN10A; (-) strand; PAM type: YTN; PAM sequence: CTA
catgtgacttcctgcctctg

SEQ ID NO: 57234 - DNA, 20 bp, Artificial Sequence
  Description of Artificial Sequence: Synthetic oligonucleotide
  Target: SCN10A; (-) strand; PAM type: YTN; PAM sequence: TTC
ctacatgtgacttcctgcct

SEQ ID NO: 57235 - DNA, 20 bp, Artificial Sequence
  Description of Artificial Sequence: Synthetic oligonucleotide
  Target: SCN10A; (-) strand; PAM type: YTN; PAM sequence: CTT
cctacatgtgacttcctgcc

SEQ ID NO: 57236 - DNA, 20 bp, Artificial Sequence
  Description of Artificial Sequence: Synthetic oligonucleotide
  Target: SCN10A; (-) strand; PAM type: YTN; PAM sequence: CTA
gaccagaggtcaccagcaga

SEQ ID NO: 57237 - DNA, 20 bp, Artificial Sequence
  Description of Artificial Sequence: Synthetic oligonucleotide
  Target: SCN10A; (-) strand; PAM type: YTN; PAM sequence: TTC
ccagggatctagaccagagg

SEQ ID NO: 57238 - DNA, 20 bp, Artificial Sequence
  Description of Artificial Sequence: Synthetic oligonucleotide
  Target: SCN10A; (-) strand; PAM type: YTN; PAM sequence: TTT
cccagggatctagaccagag

SEQ ID NO: 57239 - DNA, 20 bp, Artificial Sequence
  Description of Artificial Sequence: Synthetic oligonucleotide
  Target: SCN10A; (-) strand; PAM type: YTN; PAM sequence: CTC
atttcccagggatctagacc

SEQ ID NO: 57240 - DNA, 20 bp, Artificial Sequence
  Description of Artificial Sequence: Synthetic oligonucleotide
  Target: SCN10A; (-) strand; PAM type: YTN; PAM sequence: TTG
ctcatttcccagggatctag

SEQ ID NO: 57241 - DNA, 20 bp, Artificial Sequence
  Description of Artificial Sequence: Synthetic oligonucleotide
  Target: SCN10A; (-) strand; PAM type: YTN; PAM sequence: CTT
gctcatttcccagggatcta

SEQ ID NO: 57242 - DNA, 20 bp, Artificial Sequence
  Description of Artificial Sequence: Synthetic oligonucleotide
  Target: SCN10A; (-) strand; PAM type: YTN; PAM sequence: CTG
caccttgctcatttcccagg

SEQ ID NO: 57243 - DNA, 20 bp, Artificial Sequence
  Description of Artificial Sequence: Synthetic oligonucleotide
  Target: SCN10A; (-) strand; PAM type: YTN; PAM sequence: CTA
tctgcaccttgctcatttcc

SEQ ID NO: 57244 - DNA, 20 bp, Artificial Sequence
  Description of Artificial Sequence: Synthetic oligonucleotide
  Target: SCN10A; (-) strand; PAM type: YTN; PAM sequence: CTA
tagccgtcactatctgcacc

SEQ ID NO: 57245 - DNA, 20 bp, Artificial Sequence
  Description of Artificial Sequence: Synthetic oligonucleotide
  Target: SCN10A; (-) strand; PAM type: YTN; PAM sequence: TTG
caaggactatagccgtcact

SEQ ID NO: 57246 - DNA, 20 bp, Artificial Sequence
  Description of Artificial Sequence: Synthetic oligonucleotide
  Target: SCN10A; (-) strand; PAM type: YTN; PAM sequence: TTA
aggttgcaaggactatagcc

SEQ ID NO: 57247 - DNA, 20 bp, Artificial Sequence
  Description of Artificial Sequence: Synthetic oligonucleotide
  Target: SCN10A; (-) strand; PAM type: YTN; PAM sequence: TTC
ccaattaaggttgcaaggac

SEQ ID NO: 57248 - DNA, 20 bp, Artificial Sequence
  Description of Artificial Sequence: Synthetic oligonucleotide
  Target: SCN10A; (-) strand; PAM type: YTN; PAM sequence: CTA
aaatagggattcccaattaa

SEQ ID NO: 57249 - DNA, 20 bp, Artificial Sequence
  Description of Artificial Sequence: Synthetic oligonucleotide
  Target: SCN10A; (-) strand; PAM type: YTN; PAM sequence: CTC
taaaatagggattcccaatt

SEQ ID NO: 57250 - DNA, 20 bp, Artificial Sequence
  Description of Artificial Sequence: Synthetic oligonucleotide
  Target: SCN10A; (-) strand; PAM type: YTN; PAM sequence: CTA
gactctaaaatagggattcc

SEQ ID NO: 57251 - DNA, 20 bp, Artificial Sequence
  Description of Artificial Sequence: Synthetic oligonucleotide
  Target: SCN10A; (-) strand; PAM type: YTN; PAM sequence: TTC
aactagactctaaaataggg

SEQ ID NO: 57252 - DNA, 20 bp, Artificial Sequence
  Description of Artificial Sequence: Synthetic oligonucleotide
  Target: SCN10A; (-) strand; PAM type: YTN; PAM sequence: CTA
cattcaactagactctaaaa

SEQ ID NO: 57253 - DNA, 20 bp, Artificial Sequence
  Description of Artificial Sequence: Synthetic oligonucleotide
  Target: SCN10A; (-) strand; PAM type: YTN; PAM sequence: TTC
cccactacattcaactagac

SEQ ID NO: 57254 - DNA, 20 bp, Artificial Sequence
  Description of Artificial Sequence: Synthetic oligonucleotide
  Target: SCN10A; (-) strand; PAM type: YTN; PAM sequence: TTT
ccccactacattcaactaga

SEQ ID NO: 57255 - DNA, 20 bp, Artificial Sequence
  Description of Artificial Sequence: Synthetic oligonucleotide
  Target: SCN10A; (-) strand; PAM type: YTN; PAM sequence: CTT
tccccactacattcaactag

SEQ ID NO: 57256 - DNA, 20 bp, Artificial Sequence
  Description of Artificial Sequence: Synthetic oligonucleotide
  Target: SCN10A; (-) strand; PAM type: YTN; PAM sequence: CTC
acaaaggatgtgctttcccc

SEQ ID NO: 57257 - DNA, 20 bp, Artificial Sequence
  Description of Artificial Sequence: Synthetic oligonucleotide
  Target: SCN10A; (-) strand; PAM type: YTN; PAM sequence: CTA
cctcacaaaggatgtgcttt

SEQ ID NO: 57258 - DNA, 20 bp, Artificial Sequence
  Description of Artificial Sequence: Synthetic oligonucleotide
  Target: SCN10A; (-) strand; PAM type: YTN; PAM sequence: TTG
atatggctacctcacaaagg

SEQ ID NO: 57259 - DNA, 20 bp, Artificial Sequence
  Description of Artificial Sequence: Synthetic oligonucleotide
  Target: SCN10A; (-) strand; PAM type: YTN; PAM sequence: TTT
gatatggctacctcacaaag

SEQ ID NO: 57260 - DNA, 20 bp, Artificial Sequence
  Description of Artificial Sequence: Synthetic oligonucleotide
  Target: SCN10A; (-) strand; PAM type: YTN; PAM sequence: CTA
taacacatacatttgatatg

SEQ ID NO: 57261 - DNA, 20 bp, Artificial Sequence
  Description of Artificial Sequence: Synthetic oligonucleotide
  Target: SCN10A; (-) strand; PAM type: YTN; PAM sequence: CTA
atcctataacacatacattt

SEQ ID NO: 57262 - DNA, 20 bp, Artificial Sequence
  Description of Artificial Sequence: Synthetic oligonucleotide
  Target: SCN10A; (-) strand; PAM type: YTN; PAM sequence: TTA
atccaagaagtgagtatcag

SEQ ID NO: 57263 - DNA, 20 bp, Artificial Sequence
  Description of Artificial Sequence: Synthetic oligonucleotide
  Target: SCN10A; (-) strand; PAM type: YTN; PAM sequence: CTC
agccattaatccaagaagtg

SEQ ID NO: 57264 - DNA, 20 bp, Artificial Sequence
  Description of Artificial Sequence: Synthetic oligonucleotide
  Target: SCN10A; (-) strand; PAM type: YTN; PAM sequence: CTC
ctcagccattaatccaagaa

SEQ ID NO: 57265 - DNA, 20 bp, Artificial Sequence
  Description of Artificial Sequence: Synthetic oligonucleotide
  Target: SCN10A; (-) strand; PAM type: YTN; PAM sequence: CTC
ctcctcagccattaatccaa

SEQ ID NO: 57266 - DNA, 20 bp, Artificial Sequence
  Description of Artificial Sequence: Synthetic oligonucleotide
  Target: SCN10A; (-) strand; PAM type: YTN; PAM sequence: TTG
tctcctcctcagccattaat

SEQ ID NO: 57267 - DNA, 20 bp, Artificial Sequence
  Description of Artificial Sequence: Synthetic oligonucleotide
  Target: SCN10A; (-) strand; PAM type: YTN; PAM sequence: TTG
gattgtctcctcctcagcca

SEQ ID NO: 57268 - DNA, 20 bp, Artificial Sequence
  Description of Artificial Sequence: Synthetic oligonucleotide
  Target: SCN10A; (-) strand; PAM type: YTN; PAM sequence: CTT
ggattgtctcctcctcagcc

SEQ ID NO: 57269 - DNA, 20 bp, Artificial Sequence
  Description of Artificial Sequence: Synthetic oligonucleotide
  Target: SCN10A; (-) strand; PAM type: YTN; PAM sequence: TTC
ttggattgtctcctcctcag

SEQ ID NO: 57270 - DNA, 20 bp, Artificial Sequence
  Description of Artificial Sequence: Synthetic oligonucleotide
  Target: SCN10A; (-) strand; PAM type: YTN; PAM sequence: TTT
cttggattgtctcctcctca

SEQ ID NO: 57271 - DNA, 20 bp, Artificial Sequence
  Description of Artificial Sequence: Synthetic oligonucleotide
  Target: SCN10A; (-) strand; PAM type: YTN; PAM sequence: CTA
gaatagatatttcttggatt

SEQ ID NO: 57272 - DNA, 20 bp, Artificial Sequence
  Description of Artificial Sequence: Synthetic oligonucleotide
  Target: SCN10A; (-) strand; PAM type: YTN; PAM sequence: CTA
aactagaatagatatttctt

SEQ ID NO: 57273 - DNA, 20 bp, Artificial Sequence
  Description of Artificial Sequence: Synthetic oligonucleotide
  Target: SCN10A; (-) strand; PAM type: YTN; PAM sequence: TTG
gagctaaactagaatagata

SEQ ID NO: 57274 - DNA, 20 bp, Artificial Sequence
  Description of Artificial Sequence: Synthetic oligonucleotide
  Target: SCN10A; (-) strand; PAM type: YTN; PAM sequence: CTT
ggagctaaactagaatagat

SEQ ID NO: 57275 - DNA, 20 bp, Artificial Sequence
  Description of Artificial Sequence: Synthetic oligonucleotide
  Target: SCN10A; (-) strand; PAM type: YTN; PAM sequence: TTG
aaagccagggccgagcttgg

SEQ ID NO: 57276 - DNA, 20 bp, Artificial Sequence
  Description of Artificial Sequence: Synthetic oligonucleotide
  Target: SCN10A; (-) strand; PAM type: YTN; PAM sequence: TTT
gaaagccagggccgagcttg

SEQ ID NO: 57277 - DNA, 20 bp, Artificial Sequence
  Description of Artificial Sequence: Synthetic oligonucleotide
  Target: SCN10A; (-) strand; PAM type: YTN; PAM sequence: CTG
tttgaaagccagggccgagc

SEQ ID NO: 57278 - DNA, 20 bp, Artificial Sequence
  Description of Artificial Sequence: Synthetic oligonucleotide
  Target: SCN10A; (-) strand; PAM type: YTN; PAM sequence: CTC
atgcagactgtttgaaagcc

SEQ ID NO: 57279 - DNA, 20 bp, Artificial Sequence
  Description of Artificial Sequence: Synthetic oligonucleotide
  Target: SCN10A; (-) strand; PAM type: YTN; PAM sequence: CTG
caaaaactcatgcagactgt

SEQ ID NO: 57280 - DNA, 20 bp, Artificial Sequence
  Description of Artificial Sequence: Synthetic oligonucleotide
  Target: SCN10A; (-) strand; PAM type: YTN; PAM sequence: TTA
agggaatatacctgcaaaaa

SEQ ID NO: 57281 - DNA, 20 bp, Artificial Sequence
  Description of Artificial Sequence: Synthetic oligonucleotide
  Target: SCN10A; (-) strand; PAM type: YTN; PAM sequence: CTT
aagggaatatacctgcaaaa

SEQ ID NO: 57282 - DNA, 20 bp, Artificial Sequence
  Description of Artificial Sequence: Synthetic oligonucleotide
  Target: SCN10A; (-) strand; PAM type: YTN; PAM sequence: TTA
aacttaagggaatatacctg

SEQ ID NO: 57283 - DNA, 20 bp, Artificial Sequence
  Description of Artificial Sequence: Synthetic oligonucleotide
  Target: SCN10A; (-) strand; PAM type: YTN; PAM sequence: CTA
ttaaacttaagggaatatac

SEQ ID NO: 57284 - DNA, 20 bp, Artificial Sequence
  Description of Artificial Sequence: Synthetic oligonucleotide
  Target: SCN10A; (-) strand; PAM type: YTN; PAM sequence: TTA
gcaggaacagctattaaact

SEQ ID NO: 57285 - DNA, 20 bp, Artificial Sequence
  Description of Artificial Sequence: Synthetic oligonucleotide
  Target: SCN10A; (-) strand; PAM type: YTN; PAM sequence: CTT
agcaggaacagctattaaac

SEQ ID NO: 57286 - DNA, 20 bp, Artificial Sequence
  Description of Artificial Sequence: Synthetic oligonucleotide
  Target: SCN10A; (-) strand; PAM type: YTN; PAM sequence: TTG
cttagcaggaacagctatta

SEQ ID NO: 57287 - DNA, 20 bp, Artificial Sequence
  Description of Artificial Sequence: Synthetic oligonucleotide
  Target: SCN10A; (-) strand; PAM type: YTN; PAM sequence: CTT
gcttagcaggaacagctatt

SEQ ID NO: 57288 - DNA, 20 bp, Artificial Sequence
  Description of Artificial Sequence: Synthetic oligonucleotide
  Target: SCN10A; (-) strand; PAM type: YTN; PAM sequence: CTG
aatgcccaccgaatagaaag

SEQ ID NO: 57289 - DNA, 20 bp, Artificial Sequence
  Description of Artificial Sequence: Synthetic oligonucleotide
  Target: SCN10A; (-) strand; PAM type: YTN; PAM sequence: TTG
ggagggctgaatgcccaccg

SEQ ID NO: 57290 - DNA, 20 bp, Artificial Sequence
  Description of Artificial Sequence: Synthetic oligonucleotide
  Target: SCN10A; (-) strand; PAM type: YTN; PAM sequence: CTT
gggagggctgaatgcccacc

SEQ ID NO: 57291 - DNA, 20 bp, Artificial Sequence
  Description of Artificial Sequence: Synthetic oligonucleotide
  Target: SCN10A; (-) strand; PAM type: YTN; PAM sequence: TTC
atcttgggagggctgaatgc

SEQ ID NO: 57292 - DNA, 20 bp, Artificial Sequence
  Description of Artificial Sequence: Synthetic oligonucleotide
  Target: SCN10A; (-) strand; PAM type: YTN; PAM sequence: TTG
gttcatcttgggagggctga

SEQ ID NO: 57293 - DNA, 20 bp, Artificial Sequence
  Description of Artificial Sequence: Synthetic oligonucleotide
  Target: SCN10A; (-) strand; PAM type: YTN; PAM sequence: CTG
ttggttcatcttgggagggc

SEQ ID NO: 57294 - DNA, 20 bp, Artificial Sequence
  Description of Artificial Sequence: Synthetic oligonucleotide
  Target: SCN10A; (-) strand; PAM type: YTN; PAM sequence: CTC
aaaaaaaaaaaaaaaaaaaa

SEQ ID NO: 57295 - DNA, 20 bp, Artificial Sequence
  Description of Artificial Sequence: Synthetic oligonucleotide
  Target: SCN10A; (-) strand; PAM type: YTN; PAM sequence: TTG
tctcaaaaaaaaaaaaaaaa

SEQ ID NO: 57296 - DNA, 20 bp, Artificial Sequence
  Description of Artificial Sequence: Synthetic oligonucleotide
  Target: SCN10A; (-) strand; PAM type: YTN; PAM sequence: CTT
gtctcaaaaaaaaaaaaaaa

SEQ ID NO: 57297 - DNA, 20 bp, Artificial Sequence
  Description of Artificial Sequence: Synthetic oligonucleotide
  Target: SCN10A; (-) strand; PAM type: YTN; PAM sequence: CTG
gacaacagagtgagaacttg

SEQ ID NO: 57298 - DNA, 20 bp, Artificial Sequence
  Description of Artificial Sequence: Synthetic oligonucleotide
  Target: SCN10A; (-) strand; PAM type: YTN; PAM sequence: CTC
cagcctggacaacagagtga

SEQ ID NO: 57299 - DNA, 20 bp, Artificial Sequence
  Description of Artificial Sequence: Synthetic oligonucleotide
  Target: SCN10A; (-) strand; PAM type: YTN; PAM sequence: CTG
cactccagcctggacaacag

SEQ ID NO: 57300 - DNA, 20 bp, Artificial Sequence
  Description of Artificial Sequence: Synthetic oligonucleotide
  Target: SCN10A; (-) strand; PAM type: YTN; PAM sequence: TTG
tgccactgcactccagcctg

SEQ ID NO: 57301 - DNA, 20 bp, Artificial Sequence
  Description of Artificial Sequence: Synthetic oligonucleotide
  Target: SCN10A; (-) strand; PAM type: YTN; PAM sequence: CTG
tgattgtgccactgcactcc

SEQ ID NO: 57302 - DNA, 20 bp, Artificial Sequence
  Description of Artificial Sequence: Synthetic oligonucleotide
  Target: SCN10A; (-) strand; PAM type: YTN; PAM sequence: CTG
caatgagctgtgattgtgcc

SEQ ID NO: 57303 - DNA, 20 bp, Artificial Sequence
  Description of Artificial Sequence: Synthetic oligonucleotide
  Target: SCN10A; (-) strand; PAM type: YTN; PAM sequence: TTG
aacatgggaggtcaaggctg

SEQ ID NO: 57304 - DNA, 20 bp, Artificial Sequence
  Description of Artificial Sequence: Synthetic oligonucleotide
  Target: SCN10A; (-) strand; PAM type: YTN; PAM sequence: CTT
gaacatgggaggtcaaggct

SEQ ID NO: 57305 - DNA, 20 bp, Artificial Sequence
  Description of Artificial Sequence: Synthetic oligonucleotide
  Target: SCN10A; (-) strand; PAM type: YTN; PAM sequence: CTG
aggtgggaggatcacttgaa

SEQ ID NO: 57306 - DNA, 20 bp, Artificial Sequence
  Description of Artificial Sequence: Synthetic oligonucleotide
  Target: SCN10A; (-) strand; PAM type: YTN; PAM sequence: TTG
ggaggctgaggtgggaggat

SEQ ID NO: 57307 - DNA, 20 bp, Artificial Sequence
  Description of Artificial Sequence: Synthetic oligonucleotide
  Target: SCN10A; (-) strand; PAM type: YTN; PAM sequence: CTT
gggaggctgaggtgggagga

SEQ ID NO: 57308 - DNA, 20 bp, Artificial Sequence
  Description of Artificial Sequence: Synthetic oligonucleotide
  Target: SCN10A; (-) strand; PAM type: YTN; PAM sequence: CTA
cttgggaggctgaggtggga

SEQ ID NO: 57309 - DNA, 20 bp, Artificial Sequence
  Description of Artificial Sequence: Synthetic oligonucleotide
  Target: SCN10A; (-) strand; PAM type: YTN; PAM sequence: TTC
cactacttgggaggctgagg

SEQ ID NO: 57310 - DNA, 20 bp, Artificial Sequence
  Description of Artificial Sequence: Synthetic oligonucleotide
  Target: SCN10A; (-) strand; PAM type: YTN; PAM sequence: CTG
tagttccactacttgggagg

SEQ ID NO: 57311 - DNA, 20 bp, Artificial Sequence
  Description of Artificial Sequence: Synthetic oligonucleotide
  Target: SCN10A; (-) strand; PAM type: YTN; PAM sequence: TTA
gccaggcgtggtggcacata

SEQ ID NO: 57312 - DNA, 20 bp, Artificial Sequence
  Description of Artificial Sequence: Synthetic oligonucleotide
  Target: SCN10A; (-) strand; PAM type: YTN; PAM sequence: CTG
gggaacatggaaaaacccca

SEQ ID NO: 57313 - DNA, 20 bp, Artificial Sequence
  Description of Artificial Sequence: Synthetic oligonucleotide
  Target: SCN10A; (-) strand; PAM type: YTN; PAM sequence: TTG
agaccagcctggggaacatg

SEQ ID NO: 57314 - DNA, 20 bp, Artificial Sequence
  Description of Artificial Sequence: Synthetic oligonucleotide
  Target: SCN10A; (-) strand; PAM type: YTN; PAM sequence: TTT
gagaccagcctggggaacat

SEQ ID NO: 57315 - DNA, 20 bp, Artificial Sequence
  Description of Artificial Sequence: Synthetic oligonucleotide
  Target: SCN10A; (+) strand; PAM type: YTN; PAM sequence: TTG
tttgaattttattctatggc

SEQ ID NO: 57316 - DNA, 20 bp, Artificial Sequence
  Description of Artificial Sequence: Synthetic oligonucleotide
  Target: SCN10A; (+) strand; PAM type: YTN; PAM sequence: TTT
gaattttattctatggccag

SEQ ID NO: 57317 - DNA, 20 bp, Artificial Sequence
  Description of Artificial Sequence: Synthetic oligonucleotide
  Target: SCN10A; (+) strand; PAM type: YTN; PAM sequence: TTG
aattttattctatggccagg

SEQ ID NO: 57318 - DNA, 20 bp, Artificial Sequence
  Description of Artificial Sequence: Synthetic oligonucleotide
  Target: SCN10A; (+) strand; PAM type: YTN; PAM sequence: TTT
tattctatggccaggcatac

SEQ ID NO: 57319 - DNA, 20 bp, Artificial Sequence
  Description of Artificial Sequence: Synthetic oligonucleotide
  Target: SCN10A; (+) strand; PAM type: YTN; PAM sequence: TTT
attctatggccaggcatacg

SEQ ID NO: 57320 - DNA, 20 bp, Artificial Sequence
  Description of Artificial Sequence: Synthetic oligonucleotide
  Target: SCN10A; (+) strand; PAM type: YTN; PAM sequence: TTA
ttctatggccaggcatacgg

SEQ ID NO: 57321 - DNA, 20 bp, Artificial Sequence
  Description of Artificial Sequence: Synthetic oligonucleotide
  Target: SCN10A; (+) strand; PAM type: YTN; PAM sequence: TTC
tatggccaggcatacggact

SEQ ID NO: 57322 - DNA, 20 bp, Artificial Sequence
  Description of Artificial Sequence: Synthetic oligonucleotide
  Target: SCN10A; (+) strand; PAM type: YTN; PAM sequence: CTA
tggccaggcatacggactat

SEQ ID NO: 57323 - DNA, 20 bp, Artificial Sequence
  Description of Artificial Sequence: Synthetic oligonucleotide
  Target: SCN10A; (+) strand; PAM type: YTN; PAM sequence: CTA
tttttgtaaatgtgccctat

SEQ ID NO: 57324 - DNA, 20 bp, Artificial Sequence
  Description of Artificial Sequence: Synthetic oligonucleotide
  Target: SCN10A; (+) strand; PAM type: YTN; PAM sequence: TTT
ttgtaaatgtgccctatgta

SEQ ID NO: 57325 - DNA, 20 bp, Artificial Sequence
  Description of Artificial Sequence: Synthetic oligonucleotide
  Target: SCN10A; (+) strand; PAM type: YTN; PAM sequence: TTT
tgtaaatgtgccctatgtac

SEQ ID NO: 57326 - DNA, 20 bp, Artificial Sequence
  Description of Artificial Sequence: Synthetic oligonucleotide
  Target: SCN10A; (+) strand; PAM type: YTN; PAM sequence: TTT
gtaaatgtgccctatgtact

SEQ ID NO: 57327 - DNA, 20 bp, Artificial Sequence
  Description of Artificial Sequence: Synthetic oligonucleotide
  Target: SCN10A; (+) strand; PAM type: YTN; PAM sequence: TTG
taaatgtgccctatgtactt

SEQ ID NO: 57328 - DNA, 20 bp, Artificial Sequence
  Description of Artificial Sequence: Synthetic oligonucleotide
  Target: SCN10A; (+) strand; PAM type: YTN; PAM sequence: CTA
tgtacttgtatttgtaccct

SEQ ID NO: 57329 - DNA, 20 bp, Artificial Sequence
  Description of Artificial Sequence: Synthetic oligonucleotide
  Target: SCN10A; (+) strand; PAM type: YTN; PAM sequence: CTT
gtatttgtacccttttggta

SEQ ID NO: 57330 - DNA, 20 bp, Artificial Sequence
  Description of Artificial Sequence: Synthetic oligonucleotide
  Target: SCN10A; (+) strand; PAM type: YTN; PAM sequence: TTG
tatttgtacccttttggtaa

SEQ ID NO: 57331 - DNA, 20 bp, Artificial Sequence
  Description of Artificial Sequence: Synthetic oligonucleotide
  Target: SCN10A; (+) strand; PAM type: YTN; PAM sequence: TTT
gtacccttttggtaacctta

SEQ ID NO: 57332 - DNA, 20 bp, Artificial Sequence
  Description of Artificial Sequence: Synthetic oligonucleotide
  Target: SCN10A; (+) strand; PAM type: YTN; PAM sequence: TTG
tacccttttggtaaccttag

SEQ ID NO: 57333 - DNA, 20 bp, Artificial Sequence
  Description of Artificial Sequence: Synthetic oligonucleotide
  Target: SCN10A; (+) strand; PAM type: YTN; PAM sequence: CTT
ttggtaaccttaggttttgt

SEQ ID NO: 57334 - DNA, 20 bp, Artificial Sequence
  Description of Artificial Sequence: Synthetic oligonucleotide
  Target: SCN10A; (+) strand; PAM type: YTN; PAM sequence: TTT
tggtaaccttaggttttgtg

SEQ ID NO: 57335 - DNA, 20 bp, Artificial Sequence
  Description of Artificial Sequence: Synthetic oligonucleotide
  Target: SCN10A; (+) strand; PAM type: YTN; PAM sequence: TTT
ggtaaccttaggttttgtgt

SEQ ID NO: 57336 - DNA, 20 bp, Artificial Sequence
  Description of Artificial Sequence: Synthetic oligonucleotide
  Target: SCN10A; (+) strand; PAM type: YTN; PAM sequence: TTG
gtaaccttaggttttgtgtg

SEQ ID NO: 57337 - DNA, 20 bp, Artificial Sequence
  Description of Artificial Sequence: Synthetic oligonucleotide
  Target: SCN10A; (+) strand; PAM type: YTN; PAM sequence: CTT
aggttttgtgtggctttctg

SEQ ID NO: 57338 - DNA, 20 bp, Artificial Sequence
  Description of Artificial Sequence: Synthetic oligonucleotide
  Target: SCN10A; (+) strand; PAM type: YTN; PAM sequence: TTA
ggttttgtgtggctttctgt

SEQ ID NO: 57339 - DNA, 20 bp, Artificial Sequence
  Description of Artificial Sequence: Synthetic oligonucleotide
  Target: SCN10A; (+) strand; PAM type: YTN; PAM sequence: TTT
tgtgtggctttctgtaaaca

SEQ ID NO: 57340 - DNA, 20 bp, Artificial Sequence
  Description of Artificial Sequence: Synthetic oligonucleotide
  Target: SCN10A; (+) strand; PAM type: YTN; PAM sequence: TTT
gtgtggctttctgtaaacag

SEQ ID NO: 57341 - DNA, 20 bp, Artificial Sequence
  Description of Artificial Sequence: Synthetic oligonucleotide
  Target: SCN10A; (+) strand; PAM type: YTN; PAM sequence: TTG
tgtggctttctgtaaacaga

SEQ ID NO: 57342 - DNA, 20 bp, Artificial Sequence
  Description of Artificial Sequence: Synthetic oligonucleotide
  Target: SCN10A; (+) strand; PAM type: YTN; PAM sequence: CTT
tctgtaaacagaatttattt

SEQ ID NO: 57343 - DNA, 20 bp, Artificial Sequence
  Description of Artificial Sequence: Synthetic oligonucleotide
  Target: SCN10A; (+) strand; PAM type: YTN; PAM sequence: TTT
ctgtaaacagaatttatttg

SEQ ID NO: 57344 - DNA, 20 bp, Artificial Sequence
  Description of Artificial Sequence: Synthetic oligonucleotide
  Target: SCN10A; (+) strand; PAM type: YTN; PAM sequence: TTC
tgtaaacagaatttatttga

SEQ ID NO: 57345 - DNA, 20 bp, Artificial Sequence
  Description of Artificial Sequence: Synthetic oligonucleotide
  Target: SCN10A; (+) strand; PAM type: YTN; PAM sequence: CTG
taaacagaatttatttgaat

SEQ ID NO: 57346 - DNA, 20 bp, Artificial Sequence
  Description of Artificial Sequence: Synthetic oligonucleotide
  Target: SCN10A; (+) strand; PAM type: YTN; PAM sequence: TTT
atttgaatttttaaaaatct

SEQ ID NO: 57347 - DNA, 20 bp, Artificial Sequence
  Description of Artificial Sequence: Synthetic oligonucleotide
  Target: SCN10A; (+) strand; PAM type: YTN; PAM sequence: TTA
tttgaatttttaaaaatctt

SEQ ID NO: 57348 - DNA, 20 bp, Artificial Sequence
  Description of Artificial Sequence: Synthetic oligonucleotide
  Target: SCN10A; (+) strand; PAM type: YTN; PAM sequence: TTT
gaatttttaaaaatcttgac

SEQ ID NO: 57349 - DNA, 20 bp, Artificial Sequence
  Description of Artificial Sequence: Synthetic oligonucleotide
  Target: SCN10A; (+) strand; PAM type: YTN; PAM sequence: TTG
aatttttaaaaatcttgact

SEQ ID NO: 57350 - DNA, 20 bp, Artificial Sequence
  Description of Artificial Sequence: Synthetic oligonucleotide
  Target: SCN10A; (+) strand; PAM type: YTN; PAM sequence: TTT
ttaaaaatcttgactgacac

SEQ ID NO: 57351 - DNA, 20 bp, Artificial Sequence
  Description of Artificial Sequence: Synthetic oligonucleotide
  Target: SCN10A; (+) strand; PAM type: YTN; PAM sequence: TTT
taaaaatcttgactgacact

SEQ ID NO: 57352 - DNA, 20 bp, Artificial Sequence
  Description of Artificial Sequence: Synthetic oligonucleotide
  Target: SCN10A; (+) strand; PAM type: YTN; PAM sequence: TTT
aaaaatcttgactgacactc

SEQ ID NO: 57353 - DNA, 20 bp, Artificial Sequence
  Description of Artificial Sequence: Synthetic oligonucleotide
  Target: SCN10A; (+) strand; PAM type: YTN; PAM sequence: TTA
aaaatcttgactgacactct

SEQ ID NO: 57354 - DNA, 20 bp, Artificial Sequence
  Description of Artificial Sequence: Synthetic oligonucleotide
  Target: SCN10A; (+) strand; PAM type: YTN; PAM sequence: CTT
gactgacactctttttccca

SEQ ID NO: 57355 - DNA, 20 bp, Artificial Sequence
  Description of Artificial Sequence: Synthetic oligonucleotide
  Target: SCN10A; (+) strand; PAM type: YTN; PAM sequence: TTG
actgacactctttttcccag

SEQ ID NO: 57356 - DNA, 20 bp, Artificial Sequence
  Description of Artificial Sequence: Synthetic oligonucleotide
  Target: SCN10A; (+) strand; PAM type: YTN; PAM sequence: CTG
acactctttttcccagagtc

SEQ ID NO: 57357 - DNA, 20 bp, Artificial Sequence
  Description of Artificial Sequence: Synthetic oligonucleotide
  Target: SCN10A; (+) strand; PAM type: YTN; PAM sequence: CTC
tttttcccagagtccattta

SEQ ID NO: 57358 - DNA, 20 bp, Artificial Sequence
  Description of Artificial Sequence: Synthetic oligonucleotide
  Target: SCN10A; (+) strand; PAM type: YTN; PAM sequence: CTT
tttcccagagtccatttaaa

SEQ ID NO: 57359 - DNA, 20 bp, Artificial Sequence
  Description of Artificial Sequence: Synthetic oligonucleotide
  Target: SCN10A; (+) strand; PAM type: YTN; PAM sequence: TTT
ttcccagagtccatttaaat

SEQ ID NO: 57360 - DNA, 20 bp, Artificial Sequence
  Description of Artificial Sequence: Synthetic oligonucleotide
  Target: SCN10A; (+) strand; PAM type: YTN; PAM sequence: TTT
tcccagagtccatttaaatt

SEQ ID NO: 57361 - DNA, 20 bp, Artificial Sequence
  Description of Artificial Sequence: Synthetic oligonucleotide
  Target: SCN10A; (+) strand; PAM type: YTN; PAM sequence: TTT
cccagagtccatttaaattt

SEQ ID NO: 57362 - DNA, 20 bp, Artificial Sequence
  Description of Artificial Sequence: Synthetic oligonucleotide
  Target: SCN10A; (+) strand; PAM type: YTN; PAM sequence: TTC
ccagagtccatttaaattta

SEQ ID NO: 57363 - DNA, 20 bp, Artificial Sequence
  Description of Artificial Sequence: Synthetic oligonucleotide
  Target: SCN10A; (+) strand; PAM type: YTN; PAM sequence: TTT
aaatttaatgtaatttatga

SEQ ID NO: 57364 - DNA, 20 bp, Artificial Sequence
  Description of Artificial Sequence: Synthetic oligonucleotide
  Target: SCN10A; (+) strand; PAM type: YTN; PAM sequence: TTA
aatttaatgtaatttatgaa

SEQ ID NO: 57365 - DNA, 20 bp, Artificial Sequence
  Description of Artificial Sequence: Synthetic oligonucleotide
  Target: SCN10A; (+) strand; PAM type: YTN; PAM sequence: TTT
aatgtaatttatgaatattt

SEQ ID NO: 57366 - DNA, 20 bp, Artificial Sequence
  Description of Artificial Sequence: Synthetic oligonucleotide
  Target: SCN10A; (+) strand; PAM type: YTN; PAM sequence: TTA
atgtaatttatgaatatttt

SEQ ID NO: 57367 - DNA, 20 bp, Artificial Sequence
  Description of Artificial Sequence: Synthetic oligonucleotide
  Target: SCN10A; (+) strand; PAM type: YTN; PAM sequence: TTT
atgaatatttttgtttttga

SEQ ID NO: 57368 - DNA, 20 bp, Artificial Sequence
  Description of Artificial Sequence: Synthetic oligonucleotide
  Target: SCN10A; (+) strand; PAM type: YTN; PAM sequence: TTA
tgaatatttttgtttttgaa

SEQ ID NO: 57369 - DNA, 20 bp, Artificial Sequence
  Description of Artificial Sequence: Synthetic oligonucleotide
  Target: SCN10A; (+) strand; PAM type: YTN; PAM sequence: TTT
ttgtttttgaatatactact

SEQ ID NO: 57370 - DNA, 20 bp, Artificial Sequence
  Description of Artificial Sequence: Synthetic oligonucleotide
  Target: SCN10A; (+) strand; PAM type: YTN; PAM sequence: TTT
tgtttttgaatatactactt

SEQ ID NO: 57371 - DNA, 20 bp, Artificial Sequence
  Description of Artificial Sequence: Synthetic oligonucleotide
  Target: SCN10A; (+) strand; PAM type: YTN; PAM sequence: TTT
gtttttgaatatactacttt

SEQ ID NO: 57372 - DNA, 20 bp, Artificial Sequence
  Description of Artificial Sequence: Synthetic oligonucleotide
  Target: SCN10A; (+) strand; PAM type: YTN; PAM sequence: TTG
tttttgaatatactacttta

SEQ ID NO: 57373 - DNA, 20 bp, Artificial Sequence
  Description of Artificial Sequence: Synthetic oligonucleotide
  Target: SCN10A; (+) strand; PAM type: YTN; PAM sequence: TTT
ttgaatatactactttactc

SEQ ID NO: 57374 - DNA, 20 bp, Artificial Sequence
  Description of Artificial Sequence: Synthetic oligonucleotide
  Target: SCN10A; (+) strand; PAM type: YTN; PAM sequence: TTT
tgaatatactactttactct

SEQ ID NO: 57375 - DNA, 20 bp, Artificial Sequence
  Description of Artificial Sequence: Synthetic oligonucleotide
  Target: SCN10A; (+) strand; PAM type: YTN; PAM sequence: TTT
gaatatactactttactctg

SEQ ID NO: 57376 - DNA, 20 bp, Artificial Sequence
  Description of Artificial Sequence: Synthetic oligonucleotide
  Target: SCN10A; (+) strand; PAM type: YTN; PAM sequence: TTG
aatatactactttactctgt

SEQ ID NO: 57377 - DNA, 20 bp, Artificial Sequence
  Description of Artificial Sequence: Synthetic oligonucleotide
  Target: SCN10A; (+) strand; PAM type: YTN; PAM sequence: CTA
ctttactctgtcttttctat

SEQ ID NO: 57378 - DNA, 20 bp, Artificial Sequence
  Description of Artificial Sequence: Synthetic oligonucleotide
  Target: SCN10A; (+) strand; PAM type: YTN; PAM sequence: CTT
tactctgtcttttctatttg

SEQ ID NO: 57379 - DNA, 20 bp, Artificial Sequence
  Description of Artificial Sequence: Synthetic oligonucleotide
  Target: SCN10A; (+) strand; PAM type: YTN; PAM sequence: TTT
actctgtcttttctatttgt

SEQ ID NO: 57380 - DNA, 20 bp, Artificial Sequence
  Description of Artificial Sequence: Synthetic oligonucleotide
  Target: SCN10A; (+) strand; PAM type: YTN; PAM sequence: TTA
ctctgtcttttctatttgtt

SEQ ID NO: 57381 - DNA, 20 bp, Artificial Sequence
  Description of Artificial Sequence: Synthetic oligonucleotide
  Target: SCN10A; (+) strand; PAM type: YTN; PAM sequence: CTC
tgtcttttctatttgtttct

SEQ ID NO: 57382 - DNA, 20 bp, Artificial Sequence
  Description of Artificial Sequence: Synthetic oligonucleotide
  Target: SCN10A; (+) strand; PAM type: YTN; PAM sequence: CTG
tcttttctatttgtttcttt

SEQ ID NO: 57383 - DNA, 20 bp, Artificial Sequence
  Description of Artificial Sequence: Synthetic oligonucleotide
  Target: SCN10A; (+) strand; PAM type: YTN; PAM sequence: CTT
ttctatttgtttcttttatt

SEQ ID NO: 57384 - DNA, 20 bp, Artificial Sequence
  Description of Artificial Sequence: Synthetic oligonucleotide
  Target: SCN10A; (+) strand; PAM type: YTN; PAM sequence: TTT
tctatttgtttcttttattc

SEQ ID NO: 57385 - DNA, 20 bp, Artificial Sequence
  Description of Artificial Sequence: Synthetic oligonucleotide
  Target: SCN10A; (+) strand; PAM type: YTN; PAM sequence: TTT
ctatttgtttcttttattct

SEQ ID NO: 57386 - DNA, 20 bp, Artificial Sequence
  Description of Artificial Sequence: Synthetic oligonucleotide
  Target: SCN10A; (+) strand; PAM type: YTN; PAM sequence: TTC
tatttgtttcttttattctg

SEQ ID NO: 57387 - DNA, 20 bp, Artificial Sequence
  Description of Artificial Sequence: Synthetic oligonucleotide
  Target: SCN10A; (+) strand; PAM type: YTN; PAM sequence: CTA
tttgtttcttttattctgta

SEQ ID NO: 57388 - DNA, 20 bp, Artificial Sequence
  Description of Artificial Sequence: Synthetic oligonucleotide
  Target: SCN10A; (+) strand; PAM type: YTN; PAM sequence: TTT
gtttcttttattctgtatgt

SEQ ID NO: 57389 - DNA, 20 bp, Artificial Sequence
  Description of Artificial Sequence: Synthetic oligonucleotide
  Target: SCN10A; (+) strand; PAM type: YTN; PAM sequence: TTG
tttcttttattctgtatgtc

SEQ ID NO: 57390 - DNA, 20 bp, Artificial Sequence
  Description of Artificial Sequence: Synthetic oligonucleotide
  Target: SCN10A; (+) strand; PAM type: YTN; PAM sequence: TTT
cttttattctgtatgtctct

SEQ ID NO: 57391 - DNA, 20 bp, Artificial Sequence
  Description of Artificial Sequence: Synthetic oligonucleotide
  Target: SCN10A; (+) strand; PAM type: YTN; PAM sequence: TTC
ttttattctgtatgtctcta

SEQ ID NO: 57392 - DNA, 20 bp, Artificial Sequence
  Description of Artificial Sequence: Synthetic oligonucleotide
  Target: SCN10A; (+) strand; PAM type: YTN; PAM sequence: CTT
ttattctgtatgtctctata

SEQ ID NO: 57393 - DNA, 20 bp, Artificial Sequence
  Description of Artificial Sequence: Synthetic oligonucleotide
  Target: SCN10A; (+) strand; PAM type: YTN; PAM sequence: TTT
tattctgtatgtctctatat

SEQ ID NO: 57394 - DNA, 20 bp, Artificial Sequence
  Description of Artificial Sequence: Synthetic oligonucleotide
  Target: SCN10A; (+) strand; PAM type: YTN; PAM sequence: TTT
attctgtatgtctctatatc

SEQ ID NO: 57395 - DNA, 20 bp, Artificial Sequence
  Description of Artificial Sequence: Synthetic oligonucleotide
  Target: SCN10A; (+) strand; PAM type: YTN; PAM sequence: TTA
ttctgtatgtctctatatcc

SEQ ID NO: 57396 - DNA, 20 bp, Artificial Sequence
  Description of Artificial Sequence: Synthetic oligonucleotide
  Target: SCN10A; (+) strand; PAM type: YTN; PAM sequence: TTC
tgtatgtctctatatcccgg

SEQ ID NO: 57397 - DNA, 20 bp, Artificial Sequence
  Description of Artificial Sequence: Synthetic oligonucleotide
  Target: SCN10A; (+) strand; PAM type: YTN; PAM sequence: CTG
tatgtctctatatcccgggt

SEQ ID NO: 57398 - DNA, 20 bp, Artificial Sequence
  Description of Artificial Sequence: Synthetic oligonucleotide
  Target: SCN10A; (+) strand; PAM type: YTN; PAM sequence: CTC
tatatcccgggtttttttaa

SEQ ID NO: 57399 - DNA, 20 bp, Artificial Sequence
  Description of Artificial Sequence: Synthetic oligonucleotide
  Target: SCN10A; (+) strand; PAM type: YTN; PAM sequence: CTA
tatcccgggtttttttaatt

SEQ ID NO: 57400 - DNA, 20 bp, Artificial Sequence
  Description of Artificial Sequence: Synthetic oligonucleotide
  Target: SCN10A; (+) strand; PAM type: YTN; PAM sequence: TTT
ttttaattattattatactt

SEQ ID NO: 57401 - DNA, 20 bp, Artificial Sequence
  Description of Artificial Sequence: Synthetic oligonucleotide
  Target: SCN10A; (+) strand; PAM type: YTN; PAM sequence: TTT
tttaattattattatacttt

SEQ ID NO: 57402 - DNA, 20 bp, Artificial Sequence
  Description of Artificial Sequence: Synthetic oligonucleotide
  Target: SCN10A; (+) strand; PAM type: YTN; PAM sequence: TTT
ttaattattattatacttta

SEQ ID NO: 57403 - DNA, 20 bp, Artificial Sequence
  Description of Artificial Sequence: Synthetic oligonucleotide
  Target: SCN10A; (+) strand; PAM type: YTN; PAM sequence: TTT
taattattattatactttaa

SEQ ID NO: 57404 - DNA, 20 bp, Artificial Sequence
  Description of Artificial Sequence: Synthetic oligonucleotide
  Target: SCN10A; (+) strand; PAM type: YTN; PAM sequence: TTT
aattattattatactttaag

SEQ ID NO: 57405 - DNA, 20 bp, Artificial Sequence
  Description of Artificial Sequence: Synthetic oligonucleotide
  Target: SCN10A; (+) strand; PAM type: YTN; PAM sequence: TTA
attattattatactttaagt

SEQ ID NO: 57406 - DNA, 20 bp, Artificial Sequence
  Description of Artificial Sequence: Synthetic oligonucleotide
  Target: SCN10A; (+) strand; PAM type: YTN; PAM sequence: TTA
ttattatactttaagtttta

SEQ ID NO: 57407 - DNA, 20 bp, Artificial Sequence
  Description of Artificial Sequence: Synthetic oligonucleotide
  Target: SCN10A; (+) strand; PAM type: YTN; PAM sequence: TTA
ttatactttaagttttagga

SEQ ID NO: 57408 - DNA, 20 bp, Artificial Sequence
  Description of Artificial Sequence: Synthetic oligonucleotide
  Target: SCN10A; (+) strand; PAM type: YTN; PAM sequence: TTA
tactttaagttttaggatac

SEQ ID NO: 57409 - DNA, 20 bp, Artificial Sequence
  Description of Artificial Sequence: Synthetic oligonucleotide
  Target: SCN10A; (+) strand; PAM type: YTN; PAM sequence: CTT
taagttttaggatacatgag

SEQ ID NO: 57410 - DNA, 20 bp, Artificial Sequence
  Description of Artificial Sequence: Synthetic oligonucleotide
  Target: SCN10A; (+) strand; PAM type: YTN; PAM sequence: TTT
aagttttaggatacatgagc

SEQ ID NO: 57411 - DNA, 20 bp, Artificial Sequence
  Description of Artificial Sequence: Synthetic oligonucleotide
  Target: SCN10A; (+) strand; PAM type: YTN; PAM sequence: TTA
agttttaggatacatgagca

SEQ ID NO: 57412 - DNA, 20 bp, Artificial Sequence
  Description of Artificial Sequence: Synthetic oligonucleotide
  Target: SCN10A; (+) strand; PAM type: YTN; PAM sequence: TTT
taggatacatgagcacaacg

SEQ ID NO: 57413 - DNA, 20 bp, Artificial Sequence
  Description of Artificial Sequence: Synthetic oligonucleotide
  Target: SCN10A; (+) strand; PAM type: YTN; PAM sequence: TTT
aggatacatgagcacaacgt

SEQ ID NO: 57414 - DNA, 20 bp, Artificial Sequence
  Description of Artificial Sequence: Synthetic oligonucleotide
  Target: SCN10A; (+) strand; PAM type: YTN; PAM sequence: TTA
ggatacatgagcacaacgtg

SEQ ID NO: 57415 - DNA, 20 bp, Artificial Sequence
  Description of Artificial Sequence: Synthetic oligonucleotide
  Target: SCN10A; (+) strand; PAM type: YTN; PAM sequence: TTT
gttacatatgtatacatgtg

SEQ ID NO: 57416 - DNA, 20 bp, Artificial Sequence
  Description of Artificial Sequence: Synthetic oligonucleotide
  Target: SCN10A; (+) strand; PAM type: YTN; PAM sequence: TTG
ttacatatgtatacatgtgc

SEQ ID NO: 57417 - DNA, 20 bp, Artificial Sequence
  Description of Artificial Sequence: Synthetic oligonucleotide
  Target: SCN10A; (+) strand; PAM type: YTN; PAM sequence: TTA
catatgtatacatgtgccat

SEQ ID NO: 57418 - DNA, 20 bp, Artificial Sequence
  Description of Artificial Sequence: Synthetic oligonucleotide
  Target: SCN10A; (+) strand; PAM type: YTN; PAM sequence: TTG
gtgtgctgcacccattaact

SEQ ID NO: 57419 - DNA, 20 bp, Artificial Sequence
  Description of Artificial Sequence: Synthetic oligonucleotide
  Target: SCN10A; (+) strand; PAM type: YTN; PAM sequence: CTG
cacccattaacttgtcattt

SEQ ID NO: 57420 - DNA, 20 bp, Artificial Sequence
  Description of Artificial Sequence: Synthetic oligonucleotide
  Target: SCN10A; (+) strand; PAM type: YTN; PAM sequence: TTA
acttgtcatttacattaggt

SEQ ID NO: 57421 - DNA, 20 bp, Artificial Sequence
  Description of Artificial Sequence: Synthetic oligonucleotide
  Target: SCN10A; (+) strand; PAM type: YTN; PAM sequence: CTT
gtcatttacattaggtatat

SEQ ID NO: 57422 - DNA, 20 bp, Artificial Sequence
  Description of Artificial Sequence: Synthetic oligonucleotide
  Target: SCN10A; (+) strand; PAM type: YTN; PAM sequence: TTG
tcatttacattaggtatatc

SEQ ID NO: 57423 - DNA, 20 bp, Artificial Sequence
  Description of Artificial Sequence: Synthetic oligonucleotide
  Target: SCN10A; (+) strand; PAM type: YTN; PAM sequence: TTT
acattaggtatatctcctaa

SEQ ID NO: 57424 - DNA, 20 bp, Artificial Sequence
  Description of Artificial Sequence: Synthetic oligonucleotide
  Target: SCN10A; (+) strand; PAM type: YTN; PAM sequence: TTA
cattaggtatatctcctaat

SEQ ID NO: 57425 - DNA, 20 bp, Artificial Sequence
  Description of Artificial Sequence: Synthetic oligonucleotide
  Target: SCN10A; (+) strand; PAM type: YTN; PAM sequence: TTA
ggtatatctcctaatgctat

SEQ ID NO: 57426 - DNA, 20 bp, Artificial Sequence
  Description of Artificial Sequence: Synthetic oligonucleotide
  Target: SCN10A; (+) strand; PAM type: YTN; PAM sequence: CTC
ctaatgctatccctcccccc

SEQ ID NO: 57427 - DNA, 20 bp, Artificial Sequence
  Description of Artificial Sequence: Synthetic oligonucleotide
  Target: SCN10A; (+) strand; PAM type: YTN; PAM sequence: CTA
atgctatccctcccccctcc

SEQ ID NO: 57428 - DNA, 20 bp, Artificial Sequence
  Description of Artificial Sequence: Synthetic oligonucleotide
  Target: SCN10A; (+) strand; PAM type: YTN; PAM sequence: CTA
tccctcccccctccctccac

SEQ ID NO: 57429 - DNA, 20 bp, Artificial Sequence
  Description of Artificial Sequence: Synthetic oligonucleotide
  Target: SCN10A; (+) strand; PAM type: YTN; PAM sequence: CTC
ccccctccctccaccccaca

SEQ ID NO: 57430 - DNA, 20 bp, Artificial Sequence
  Description of Artificial Sequence: Synthetic oligonucleotide
  Target: SCN10A; (+) strand; PAM type: YTN; PAM sequence: CTC
cctccaccccacaactgtcc

SEQ ID NO: 57431 - DNA, 20 bp, Artificial Sequence
  Description of Artificial Sequence: Synthetic oligonucleotide
  Target: SCN10A; (+) strand; PAM type: YTN; PAM sequence: CTC
caccccacaactgtccccgg

SEQ ID NO: 57432 - DNA, 20 bp, Artificial Sequence
  Description of Artificial Sequence: Synthetic oligonucleotide
  Target: SCN10A; (+) strand; PAM type: YTN; PAM sequence: CTG
tccccggtgtgtgatgttcc

SEQ ID NO: 57433 - DNA, 20 bp, Artificial Sequence
  Description of Artificial Sequence: Synthetic oligonucleotide
  Target: SCN10A; (+) strand; PAM type: YTN; PAM sequence: TTC
cccttcctgtgtccatgtgt

SEQ ID NO: 57434 - DNA, 20 bp, Artificial Sequence
  Description of Artificial Sequence: Synthetic oligonucleotide
  Target: SCN10A; (+) strand; PAM type: YTN; PAM sequence: CTT
cctgtgtccatgtgttctta

SEQ ID NO: 57435 - DNA, 20 bp, Artificial Sequence
  Description of Artificial Sequence: Synthetic oligonucleotide
  Target: SCN10A; (+) strand; PAM type: YTN; PAM sequence: TTC
ctgtgtccatgtgttcttat

SEQ ID NO: 57436 - DNA, 20 bp, Artificial Sequence
  Description of Artificial Sequence: Synthetic oligonucleotide
  Target: SCN10A; (+) strand; PAM type: YTN; PAM sequence: CTG
tgtccatgtgttcttattgt

SEQ ID NO: 57437 - DNA, 20 bp, Artificial Sequence
  Description of Artificial Sequence: Synthetic oligonucleotide
  Target: SCN10A; (+) strand; PAM type: YTN; PAM sequence: TTC
ttattgttcaattcccacct

SEQ ID NO: 57438 - DNA, 20 bp, Artificial Sequence
  Description of Artificial Sequence: Synthetic oligonucleotide
  Target: SCN10A; (+) strand; PAM type: YTN; PAM sequence: CTT
attgttcaattcccacctat

SEQ ID NO: 57439 - DNA, 20 bp, Artificial Sequence
  Description of Artificial Sequence: Synthetic oligonucleotide
  Target: SCN10A; (+) strand; PAM type: YTN; PAM sequence: TTA
ttgttcaattcccacctatg

SEQ ID NO: 57440 - DNA, 20 bp, Artificial Sequence
  Description of Artificial Sequence: Synthetic oligonucleotide
  Target: SCN10A; (+) strand; PAM type: YTN; PAM sequence: TTG
ttcaattcccacctatgagt

SEQ ID NO: 57441 - DNA, 20 bp, Artificial Sequence
  Description of Artificial Sequence: Synthetic oligonucleotide
  Target: SCN10A; (+) strand; PAM type: YTN; PAM sequence: TTC
aattcccacctatgagtgag

SEQ ID NO: 57442 - DNA, 20 bp, Artificial Sequence
  Description of Artificial Sequence: Synthetic oligonucleotide
  Target: SCN10A; (+) strand; PAM type: YTN; PAM sequence: TTC
ccacctatgagtgagaacat

SEQ ID NO: 57443 - DNA, 20 bp, Artificial Sequence
  Description of Artificial Sequence: Synthetic oligonucleotide
  Target: SCN10A; (+) strand; PAM type: YTN; PAM sequence: CTA
tgagtgagaacatgcggtgt

SEQ ID NO: 57444 - DNA, 20 bp, Artificial Sequence
  Description of Artificial Sequence: Synthetic oligonucleotide
  Target: SCN10A; (+) strand; PAM type: YTN; PAM sequence: TTT
ggttttttttgtccttgcga

SEQ ID NO: 57445 - DNA, 20 bp, Artificial Sequence
  Description of Artificial Sequence: Synthetic oligonucleotide
  Target: SCN10A; (+) strand; PAM type: YTN; PAM sequence: TTG
gttttttttgtccttgcgat

SEQ ID NO: 57446 - DNA, 20 bp, Artificial Sequence
  Description of Artificial Sequence: Synthetic oligonucleotide
  Target: SCN10A; (+) strand; PAM type: YTN; PAM sequence: TTT
tttttgtccttgcgatagtt

SEQ ID NO: 57447 - DNA, 20 bp, Artificial Sequence
  Description of Artificial Sequence: Synthetic oligonucleotide
  Target: SCN10A; (+) strand; PAM type: YTN; PAM sequence: TTT
ttttgtccttgcgatagttt

SEQ ID NO: 57448 - DNA, 20 bp, Artificial Sequence
  Description of Artificial Sequence: Synthetic oligonucleotide
  Target: SCN10A; (+) strand; PAM type: YTN; PAM sequence: TTT
tttgtccttgcgatagtttg

SEQ ID NO: 57449 - DNA, 20 bp, Artificial Sequence
  Description of Artificial Sequence: Synthetic oligonucleotide
  Target: SCN10A; (+) strand; PAM type: YTN; PAM sequence: TTT
ttgtccttgcgatagtttgc

SEQ ID NO: 57450 - DNA, 20 bp, Artificial Sequence
  Description of Artificial Sequence: Synthetic oligonucleotide
  Target: SCN10A; (+) strand; PAM type: YTN; PAM sequence: TTT
tgtccttgcgatagtttgct

SEQ ID NO: 57451 - DNA, 20 bp, Artificial Sequence
  Description of Artificial Sequence: Synthetic oligonucleotide
  Target: SCN10A; (+) strand; PAM type: YTN; PAM sequence: TTT
gtccttgcgatagtttgctg

SEQ ID NO: 57452 - DNA, 20 bp, Artificial Sequence
  Description of Artificial Sequence: Synthetic oligonucleotide
  Target: SCN10A; (+) strand; PAM type: YTN; PAM sequence: TTG
tccttgcgatagtttgctga

SEQ ID NO: 57453 - DNA, 20 bp, Artificial Sequence
  Description of Artificial Sequence: Synthetic oligonucleotide
  Target: SCN10A; (+) strand; PAM type: YTN; PAM sequence: CTT
gcgatagtttgctgagaatg

SEQ ID NO: 57454 - DNA, 20 bp, Artificial Sequence
  Description of Artificial Sequence: Synthetic oligonucleotide
  Target: SCN10A; (+) strand; PAM type: YTN; PAM sequence: TTG
cgatagtttgctgagaatga

SEQ ID NO: 57455 - DNA, 20 bp, Artificial Sequence
  Description of Artificial Sequence: Synthetic oligonucleotide
  Target: SCN10A; (+) strand; PAM type: YTN; PAM sequence: TTT
gctgagaatgatggtttcca

SEQ ID NO: 57456 - DNA, 20 bp, Artificial Sequence
  Description of Artificial Sequence: Synthetic oligonucleotide
  Target: SCN10A; (+) strand; PAM type: YTN; PAM sequence: TTG
ctgagaatgatggtttccag

SEQ ID NO: 57457 - DNA, 20 bp, Artificial Sequence
  Description of Artificial Sequence: Synthetic oligonucleotide
  Target: SCN10A; (+) strand; PAM type: YTN; PAM sequence: CTG
agaatgatggtttccagctt

SEQ ID NO: 57458 - DNA, 20 bp, Artificial Sequence
  Description of Artificial Sequence: Synthetic oligonucleotide
  Target: SCN10A; (+) strand; PAM type: YTN; PAM sequence: TTT
ccagcttcatccatgtccct

SEQ ID NO: 57459 - DNA, 20 bp, Artificial Sequence
  Description of Artificial Sequence: Synthetic oligonucleotide
  Target: SCN10A; (+) strand; PAM type: YTN; PAM sequence: TTC
cagcttcatccatgtccctg

SEQ ID NO: 57460 - DNA, 20 bp, Artificial Sequence
  Description of Artificial Sequence: Synthetic oligonucleotide
  Target: SCN10A; (+) strand; PAM type: YTN; PAM sequence: CTT
catccatgtccctgcaaagg

SEQ ID NO: 57461 - DNA, 20 bp, Artificial Sequence
  Description of Artificial Sequence: Synthetic oligonucleotide
  Target: SCN10A; (+) strand; PAM type: YTN; PAM sequence: TTC
atccatgtccctgcaaagga

SEQ ID NO: 57462 - DNA, 20 bp, Artificial Sequence
  Description of Artificial Sequence: Synthetic oligonucleotide
  Target: SCN10A; (+) strand; PAM type: YTN; PAM sequence: CTG
caaaggacatgaactcatca

SEQ ID NO: 57463 - DNA, 20 bp, Artificial Sequence
  Description of Artificial Sequence: Synthetic oligonucleotide
  Target: SCN10A; (+) strand; PAM type: YTN; PAM sequence: CTC
atcattttttatggctgcat

SEQ ID NO: 57464 - DNA, 20 bp, Artificial Sequence
  Description of Artificial Sequence: Synthetic oligonucleotide
  Target: SCN10A; (+) strand; PAM type: YTN; PAM sequence: TTT
tttatggctgcatagtattc

SEQ ID NO: 57465 - DNA, 20 bp, Artificial Sequence
  Description of Artificial Sequence: Synthetic oligonucleotide
  Target: SCN10A; (+) strand; PAM type: YTN; PAM sequence: TTT
ttatggctgcatagtattcc

SEQ ID NO: 57466 - DNA, 20 bp, Artificial Sequence
  Description of Artificial Sequence: Synthetic oligonucleotide
  Target: SCN10A; (+) strand; PAM type: YTN; PAM sequence: TTT
tatggctgcatagtattcca

SEQ ID NO: 57467 - DNA, 20 bp, Artificial Sequence
  Description of Artificial Sequence: Synthetic oligonucleotide
  Target: SCN10A; (+) strand; PAM type: YTN; PAM sequence: TTT
atggctgcatagtattccat

SEQ ID NO: 57468 - DNA, 20 bp, Artificial Sequence
  Description of Artificial Sequence: Synthetic oligonucleotide
  Target: SCN10A; (+) strand; PAM type: YTN; PAM sequence: TTA
tggctgcatagtattccatg

SEQ ID NO: 57469 - DNA, 20 bp, Artificial Sequence
  Description of Artificial Sequence: Synthetic oligonucleotide
  Target: SCN10A; (+) strand; PAM type: YTN; PAM sequence: CTG
catagtattccatggtgtat

SEQ ID NO: 57470 - DNA, 20 bp, Artificial Sequence
  Description of Artificial Sequence: Synthetic oligonucleotide
  Target: SCN10A; (+) strand; PAM type: YTN; PAM sequence: TTC
catggtgtatatgtgccaca

SEQ ID NO: 57471 - DNA, 20 bp, Artificial Sequence
  Description of Artificial Sequence: Synthetic oligonucleotide
  Target: SCN10A; (+) strand; PAM type: YTN; PAM sequence: TTT
tcttaatccagtctatcact

SEQ ID NO: 57472 - DNA, 20 bp, Artificial Sequence
  Description of Artificial Sequence: Synthetic oligonucleotide
  Target: SCN10A; (+) strand; PAM type: YTN; PAM sequence: TTT
cttaatccagtctatcactg

SEQ ID NO: 57473 - DNA, 20 bp, Artificial Sequence
  Description of Artificial Sequence: Synthetic oligonucleotide
  Target: SCN10A; (+) strand; PAM type: YTN; PAM sequence: TTC
ttaatccagtctatcactgt

SEQ ID NO: 57474 - DNA, 20 bp, Artificial Sequence
  Description of Artificial Sequence: Synthetic oligonucleotide
  Target: SCN10A; (+) strand; PAM type: YTN; PAM sequence: CTT
aatccagtctatcactgttg

SEQ ID NO: 57475 - DNA, 20 bp, Artificial Sequence
  Description of Artificial Sequence: Synthetic oligonucleotide
  Target: SCN10A; (+) strand; PAM type: YTN; PAM sequence: TTA
atccagtctatcactgttgg

SEQ ID NO: 57476 - DNA, 20 bp, Artificial Sequence
  Description of Artificial Sequence: Synthetic oligonucleotide
  Target: SCN10A; (+) strand; PAM type: YTN; PAM sequence: CTA
tcactgttggacatttgggt

SEQ ID NO: 57477 - DNA, 20 bp, Artificial Sequence
  Description of Artificial Sequence: Synthetic oligonucleotide
  Target: SCN10A; (+) strand; PAM type: YTN; PAM sequence: CTG
ttggacatttgggttggttc

SEQ ID NO: 57478 - DNA, 20 bp, Artificial Sequence
  Description of Artificial Sequence: Synthetic oligonucleotide
  Target: SCN10A; (+) strand; PAM type: YTN; PAM sequence: TTG
gacatttgggttggttccaa

SEQ ID NO: 57479 - DNA, 20 bp, Artificial Sequence
  Description of Artificial Sequence: Synthetic oligonucleotide
  Target: SCN10A; (+) strand; PAM type: YTN; PAM sequence: TTT
gggttggttccaagtctttg

SEQ ID NO: 57480 - DNA, 20 bp, Artificial Sequence
  Description of Artificial Sequence: Synthetic oligonucleotide
  Target: SCN10A; (+) strand; PAM type: YTN; PAM sequence: TTG
ggttggttccaagtctttgc

SEQ ID NO: 57481 - DNA, 20 bp, Artificial Sequence
  Description of Artificial Sequence: Synthetic oligonucleotide
  Target: SCN10A; (+) strand; PAM type: YTN; PAM sequence: TTG
gttccaagtctttgctattg

SEQ ID NO: 57482 - DNA, 20 bp, Artificial Sequence
  Description of Artificial Sequence: Synthetic oligonucleotide
  Target: SCN10A; (+) strand; PAM type: YTN; PAM sequence: TTC
caagtctttgctattgtgaa

SEQ ID NO: 57483 - DNA, 20 bp, Artificial Sequence
  Description of Artificial Sequence: Synthetic oligonucleotide
  Target: SCN10A; (+) strand; PAM type: YTN; PAM sequence: CTT
tgctattgtgaatagtgcca

SEQ ID NO: 57484 - DNA, 20 bp, Artificial Sequence
  Description of Artificial Sequence: Synthetic oligonucleotide
  Target: SCN10A; (+) strand; PAM type: YTN; PAM sequence: TTT
gctattgtgaatagtgccac

SEQ ID NO: 57485 - DNA, 20 bp, Artificial Sequence
  Description of Artificial Sequence: Synthetic oligonucleotide
  Target: SCN10A; (+) strand; PAM type: YTN; PAM sequence: TTG
ctattgtgaatagtgccaca

SEQ ID NO: 57486 - DNA, 20 bp, Artificial Sequence
  Description of Artificial Sequence: Synthetic oligonucleotide
  Target: SCN10A; (+) strand; PAM type: YTN; PAM sequence: CTA
ttgtgaatagtgccacaata

SEQ ID NO: 57487 - DNA, 20 bp, Artificial Sequence
  Description of Artificial Sequence: Synthetic oligonucleotide
  Target: SCN10A; (+) strand; PAM type: YTN; PAM sequence: TTG
tgaatagtgccacaataaac

SEQ ID NO: 57488 - DNA, 20 bp, Artificial Sequence
  Description of Artificial Sequence: Synthetic oligonucleotide
  Target: SCN10A; (+) strand; PAM type: YTN; PAM sequence: CTT
tatagcagtatgatttataa

SEQ ID NO: 57489 - DNA, 20 bp, Artificial Sequence
  Description of Artificial Sequence: Synthetic oligonucleotide
  Target: SCN10A; (+) strand; PAM type: YTN; PAM sequence: TTT
atagcagtatgatttataat

SEQ ID NO: 57490 - DNA, 20 bp, Artificial Sequence
  Description of Artificial Sequence: Synthetic oligonucleotide
  Target: SCN10A; (+) strand; PAM type: YTN; PAM sequence: TTA
tagcagtatgatttataatc

SEQ ID NO: 57491 - DNA, 20 bp, Artificial Sequence
  Description of Artificial Sequence: Synthetic oligonucleotide
  Target: SCN10A; (+) strand; PAM type: YTN; PAM sequence: TTT
ataatcctttgggtatatac

SEQ ID NO: 57492 - DNA, 20 bp, Artificial Sequence
  Description of Artificial Sequence: Synthetic oligonucleotide
  Target: SCN10A; (+) strand; PAM type: YTN; PAM sequence: TTA
taatcctttgggtatatacc

SEQ ID NO: 57493 - DNA, 20 bp, Artificial Sequence
  Description of Artificial Sequence: Synthetic oligonucleotide
  Target: SCN10A; (+) strand; PAM type: YTN; PAM sequence: CTT
tgggtatatacccagtaatg

SEQ ID NO: 57494 - DNA, 20 bp, Artificial Sequence
  Description of Artificial Sequence: Synthetic oligonucleotide
  Target: SCN10A; (+) strand; PAM type: YTN; PAM sequence: TTT
gggtatatacccagtaatgg

SEQ ID NO: 57495 - DNA, 20 bp, Artificial Sequence
  Description of Artificial Sequence: Synthetic oligonucleotide
  Target: SCN10A; (+) strand; PAM type: YTN; PAM sequence: TTG
ggtatatacccagtaatggg

SEQ ID NO: 57496 - DNA, 20 bp, Artificial Sequence
  Description of Artificial Sequence: Synthetic oligonucleotide
  Target: SCN10A; (+) strand; PAM type: YTN; PAM sequence: CTG
ggtcaaatggtatttctggt

SEQ ID NO: 57497 - DNA, 20 bp, Artificial Sequence
  Description of Artificial Sequence: Synthetic oligonucleotide
  Target: SCN10A; (+) strand; PAM type: YTN; PAM sequence: TTT
ctggttctagatccctgagg

SEQ ID NO: 57498 - DNA, 20 bp, Artificial Sequence
  Description of Artificial Sequence: Synthetic oligonucleotide
  Target: SCN10A; (+) strand; PAM type: YTN; PAM sequence: TTC
tggttctagatccctgagga

SEQ ID NO: 57499 - DNA, 20 bp, Artificial Sequence
  Description of Artificial Sequence: Synthetic oligonucleotide
  Target: SCN10A; (+) strand; PAM type: YTN; PAM sequence: CTG
gttctagatccctgaggaat

SEQ ID NO: 57500 - DNA, 20 bp, Artificial Sequence
  Description of Artificial Sequence: Synthetic oligonucleotide
  Target: SCN10A; (+) strand; PAM type: YTN; PAM sequence: TTC
tagatccctgaggaattgcc

SEQ ID NO: 57501 - DNA, 20 bp, Artificial Sequence
  Description of Artificial Sequence: Synthetic oligonucleotide
  Target: SCN10A; (+) strand; PAM type: YTN; PAM sequence: CTA
gatccctgaggaattgccac

SEQ ID NO: 57502 - DNA, 20 bp, Artificial Sequence
  Description of Artificial Sequence: Synthetic oligonucleotide
  Target: SCN10A; (+) strand; PAM type: YTN; PAM sequence: CTG
aggaattgccacaccgactt

SEQ ID NO: 57503 - DNA, 20 bp, Artificial Sequence
  Description of Artificial Sequence: Synthetic oligonucleotide
  Target: SCN10A; (+) strand; PAM type: YTN; PAM sequence: TTG
ccacaccgacttccacaatg

SEQ ID NO: 57504 - DNA, 20 bp, Artificial Sequence
  Description of Artificial Sequence: Synthetic oligonucleotide
  Target: SCN10A; (+) strand; PAM type: YTN; PAM sequence: CTT
ccacaatgattgaactagtt

SEQ ID NO: 57505 - DNA, 20 bp, Artificial Sequence
  Description of Artificial Sequence: Synthetic oligonucleotide
  Target: SCN10A; (+) strand; PAM type: YTN; PAM sequence: TTC
cacaatgattgaactagttt

SEQ ID NO: 57506 - DNA, 20 bp, Artificial Sequence
  Description of Artificial Sequence: Synthetic oligonucleotide
  Target: SCN10A; (+) strand; PAM type: YTN; PAM sequence: TTG
aactagtttacagacccacc

SEQ ID NO: 57507 - DNA, 20 bp, Artificial Sequence
  Description of Artificial Sequence: Synthetic oligonucleotide
  Target: SCN10A; (+) strand; PAM type: YTN; PAM sequence: CTA
gtttacagacccaccaacag

SEQ ID NO: 57508 - DNA, 20 bp, Artificial Sequence
  Description of Artificial Sequence: Synthetic oligonucleotide
  Target: SCN10A; (+) strand; PAM type: YTN; PAM sequence: TTT
acagacccaccaacagtgta

SEQ ID NO: 57509 - DNA, 20 bp, Artificial Sequence
  Description of Artificial Sequence: Synthetic oligonucleotide
  Target: SCN10A; (+) strand; PAM type: YTN; PAM sequence: TTA
cagacccaccaacagtgtaa

SEQ ID NO: 57510 - DNA, 20 bp, Artificial Sequence
  Description of Artificial Sequence: Synthetic oligonucleotide
  Target: SCN10A; (+) strand; PAM type: YTN; PAM sequence: TTC
ctatttctccacatcctctc

SEQ ID NO: 57511 - DNA, 20 bp, Artificial Sequence
  Description of Artificial Sequence: Synthetic oligonucleotide
  Target: SCN10A; (+) strand; PAM type: YTN; PAM sequence: CTA
tttctccacatcctctccag

SEQ ID NO: 57512 - DNA, 20 bp, Artificial Sequence
  Description of Artificial Sequence: Synthetic oligonucleotide
  Target: SCN10A; (+) strand; PAM type: YTN; PAM sequence: TTT
ctccacatcctctccagcac

SEQ ID NO: 57513 - DNA, 20 bp, Artificial Sequence
  Description of Artificial Sequence: Synthetic oligonucleotide
  Target: SCN10A; (+) strand; PAM type: YTN; PAM sequence: TTC
tccacatcctctccagcacc

SEQ ID NO: 57514 - DNA, 20 bp, Artificial Sequence
  Description of Artificial Sequence: Synthetic oligonucleotide
  Target: SCN10A; (+) strand; PAM type: YTN; PAM sequence: CTC
cacatcctctccagcacctg

SEQ ID NO: 57515 - DNA, 20 bp, Artificial Sequence
  Description of Artificial Sequence: Synthetic oligonucleotide
  Target: SCN10A; (+) strand; PAM type: YTN; PAM sequence: CTC
tccagcacctgttgtttcct

SEQ ID NO: 57516 - DNA, 20 bp, Artificial Sequence
  Description of Artificial Sequence: Synthetic oligonucleotide
  Target: SCN10A; (+) strand; PAM type: YTN; PAM sequence: CTC
cagcacctgttgtttcctga

SEQ ID NO: 57517 - DNA, 20 bp, Artificial Sequence
  Description of Artificial Sequence: Synthetic oligonucleotide
  Target: SCN10A; (+) strand; PAM type: YTN; PAM sequence: CTG
ttgtttcctgactttttaat

SEQ ID NO: 57518 - DNA, 20 bp, Artificial Sequence
  Description of Artificial Sequence: Synthetic oligonucleotide
  Target: SCN10A; (+) strand; PAM type: YTN; PAM sequence: TTG
tttcctgactttttaatgat

SEQ ID NO: 57519 - DNA, 20 bp, Artificial Sequence
  Description of Artificial Sequence: Synthetic oligonucleotide
  Target: SCN10A; (+) strand; PAM type: YTN; PAM sequence: TTT
cctgactttttaatgatcgc

SEQ ID NO: 57520 - DNA, 20 bp, Artificial Sequence
  Description of Artificial Sequence: Synthetic oligonucleotide
  Target: SCN10A; (+) strand; PAM type: YTN; PAM sequence: TTC
ctgactttttaatgatcgcc

SEQ ID NO: 57521 - DNA, 20 bp, Artificial Sequence
  Description of Artificial Sequence: Synthetic oligonucleotide
  Target: SCN10A; (+) strand; PAM type: YTN; PAM sequence: CTG
actttttaatgatcgccatt

SEQ ID NO: 57522 - DNA, 20 bp, Artificial Sequence
  Description of Artificial Sequence: Synthetic oligonucleotide
  Target: SCN10A; (+) strand; PAM type: YTN; PAM sequence: CTT
tttaatgatcgccattctaa

SEQ ID NO: 57523 - DNA, 20 bp, Artificial Sequence
  Description of Artificial Sequence: Synthetic oligonucleotide
  Target: SCN10A; (+) strand; PAM type: YTN; PAM sequence: TTT
ttaatgatcgccattctaac

SEQ ID NO: 57524 - DNA, 20 bp, Artificial Sequence
  Description of Artificial Sequence: Synthetic oligonucleotide
  Target: SCN10A; (+) strand; PAM type: YTN; PAM sequence: TTT
taatgatcgccattctaact

SEQ ID NO: 57525 - DNA, 20 bp, Artificial Sequence
  Description of Artificial Sequence: Synthetic oligonucleotide
  Target: SCN10A; (+) strand; PAM type: YTN; PAM sequence: TTT
aatgatcgccattctaactg

SEQ ID NO: 57526 - DNA, 20 bp, Artificial Sequence
  Description of Artificial Sequence: Synthetic oligonucleotide
  Target: SCN10A; (+) strand; PAM type: YTN; PAM sequence: TTA
atgatcgccattctaactgg

SEQ ID NO: 57527 - DNA, 20 bp, Artificial Sequence
  Description of Artificial Sequence: Synthetic oligonucleotide
  Target: SCN10A; (+) strand; PAM type: YTN; PAM sequence: TTC
taactggtgtgagatggtat

SEQ ID NO: 57528 - DNA, 20 bp, Artificial Sequence
  Description of Artificial Sequence: Synthetic oligonucleotide
  Target: SCN10A; (+) strand; PAM type: YTN; PAM sequence: CTA
actggtgtgagatggtatct

SEQ ID NO: 57529 - DNA, 20 bp, Artificial Sequence
  Description of Artificial Sequence: Synthetic oligonucleotide
  Target: SCN10A; (+) strand; PAM type: YTN; PAM sequence: CTG
gtgtgagatggtatctcatt

SEQ ID NO: 57530 - DNA, 20 bp, Artificial Sequence
  Description of Artificial Sequence: Synthetic oligonucleotide
  Target: SCN10A; (+) strand; PAM type: YTN; PAM sequence: CTC
attgtggttttgatttgcat

SEQ ID NO: 57531 - DNA, 20 bp, Artificial Sequence
  Description of Artificial Sequence: Synthetic oligonucleotide
  Target: SCN10A; (+) strand; PAM type: YTN; PAM sequence: TTG
tggttttgatttgcatttct

SEQ ID NO: 57532 - DNA, 20 bp, Artificial Sequence
  Description of Artificial Sequence: Synthetic oligonucleotide
  Target: SCN10A; (+) strand; PAM type: YTN; PAM sequence: TTT
tgatttgcatttctctgatg

SEQ ID NO: 57533 - DNA, 20 bp, Artificial Sequence
  Description of Artificial Sequence: Synthetic oligonucleotide
  Target: SCN10A; (+) strand; PAM type: YTN; PAM sequence: TTT
gatttgcatttctctgatgg

SEQ ID NO: 57534 - DNA, 20 bp, Artificial Sequence
  Description of Artificial Sequence: Synthetic oligonucleotide
  Target: SCN10A; (+) strand; PAM type: YTN; PAM sequence: TTG
atttgcatttctctgatggc

SEQ ID NO: 57535 - DNA, 20 bp, Artificial Sequence
  Description of Artificial Sequence: Synthetic oligonucleotide
  Target: SCN10A; (+) strand; PAM type: YTN; PAM sequence: TTT
gcatttctctgatggccagt

SEQ ID NO: 57536 - DNA, 20 bp, Artificial Sequence
  Description of Artificial Sequence: Synthetic oligonucleotide
  Target: SCN10A; (+) strand; PAM type: YTN; PAM sequence: TTG
catttctctgatggccagtg

SEQ ID NO: 57537 - DNA, 20 bp, Artificial Sequence
  Description of Artificial Sequence: Synthetic oligonucleotide
  Target: SCN10A; (+) strand; PAM type: YTN; PAM sequence: TTT
ctctgatggccagtgatgat

SEQ ID NO: 57538 - DNA, 20 bp, Artificial Sequence
  Description of Artificial Sequence: Synthetic oligonucleotide
  Target: SCN10A; (+) strand; PAM type: YTN; PAM sequence: TTC
tctgatggccagtgatgatg

SEQ ID NO: 57539 - DNA, 20 bp, Artificial Sequence
  Description of Artificial Sequence: Synthetic oligonucleotide
  Target: SCN10A; (+) strand; PAM type: YTN; PAM sequence: CTC
tgatggccagtgatgatgag

SEQ ID NO: 57540 - DNA, 20 bp, Artificial Sequence
  Description of Artificial Sequence: Synthetic oligonucleotide
  Target: SCN10A; (+) strand; PAM type: YTN; PAM sequence: CTG
atggccagtgatgatgagca

SEQ ID NO: 57541 - DNA, 20 bp, Artificial Sequence
  Description of Artificial Sequence: Synthetic oligonucleotide
  Target: SCN10A; (+) strand; PAM type: YTN; PAM sequence: TTT
tttcatgtgttttttggctg

SEQ ID NO: 57542 - DNA, 20 bp, Artificial Sequence
  Description of Artificial Sequence: Synthetic oligonucleotide
  Target: SCN10A; (+) strand; PAM type: YTN; PAM sequence: TTT
ttcatgtgttttttggctgc

SEQ ID NO: 57543 - DNA, 20 bp, Artificial Sequence
  Description of Artificial Sequence: Synthetic oligonucleotide
  Target: SCN10A; (+) strand; PAM type: YTN; PAM sequence: TTT
tcatgtgttttttggctgca

SEQ ID NO: 57544 - DNA, 20 bp, Artificial Sequence
  Description of Artificial Sequence: Synthetic oligonucleotide
  Target: SCN10A; (+) strand; PAM type: YTN; PAM sequence: TTT
catgtgttttttggctgcat

SEQ ID NO: 57545 - DNA, 20 bp, Artificial Sequence
  Description of Artificial Sequence: Synthetic oligonucleotide
  Target: SCN10A; (+) strand; PAM type: YTN; PAM sequence: TTC
atgtgttttttggctgcata

SEQ ID NO: 57546 - DNA, 20 bp, Artificial Sequence
  Description of Artificial Sequence: Synthetic oligonucleotide
  Target: SCN10A; (+) strand; PAM type: YTN; PAM sequence: TTT
tttggctgcataaatgtctt

SEQ ID NO: 57547 - DNA, 20 bp, Artificial Sequence
  Description of Artificial Sequence: Synthetic oligonucleotide
  Target: SCN10A; (+) strand; PAM type: YTN; PAM sequence: TTT
ttggctgcataaatgtcttc

SEQ ID NO: 57548 - DNA, 20 bp, Artificial Sequence
  Description of Artificial Sequence: Synthetic oligonucleotide
  Target: SCN10A; (+) strand; PAM type: YTN; PAM sequence: TTT
tggctgcataaatgtcttct

SEQ ID NO: 57549 - DNA, 20 bp, Artificial Sequence
  Description of Artificial Sequence: Synthetic oligonucleotide
  Target: SCN10A; (+) strand; PAM type: YTN; PAM sequence: TTT
ggctgcataaatgtcttctt

SEQ ID NO: 57550 - DNA, 20 bp, Artificial Sequence
  Description of Artificial Sequence: Synthetic oligonucleotide
  Target: SCN10A; (+) strand; PAM type: YTN; PAM sequence: TTG
gctgcataaatgtcttcttt

SEQ ID NO: 57551 - DNA, 20 bp, Artificial Sequence
  Description of Artificial Sequence: Synthetic oligonucleotide
  Target: SCN10A; (+) strand; PAM type: YTN; PAM sequence: CTG
cataaatgtcttcttttgag

SEQ ID NO: 57552 - DNA, 20 bp, Artificial Sequence
  Description of Artificial Sequence: Synthetic oligonucleotide
  Target: SCN10A; (+) strand; PAM type: YTN; PAM sequence: CTT
cttttgagaagtgtctgttc

SEQ ID NO: 57553 - DNA, 20 bp, Artificial Sequence
  Description of Artificial Sequence: Synthetic oligonucleotide
  Target: SCN10A; (+) strand; PAM type: YTN; PAM sequence: TTC
ttttgagaagtgtctgttca

SEQ ID NO: 57554 - DNA, 20 bp, Artificial Sequence
  Description of Artificial Sequence: Synthetic oligonucleotide
  Target: SCN10A; (+) strand; PAM type: YTN; PAM sequence: CTT
ttgagaagtgtctgttcata

SEQ ID NO: 57555 - DNA, 20 bp, Artificial Sequence
  Description of Artificial Sequence: Synthetic oligonucleotide
  Target: SCN10A; (+) strand; PAM type: YTN; PAM sequence: TTT
tgagaagtgtctgttcatat

SEQ ID NO: 57556 - DNA, 20 bp, Artificial Sequence
  Description of Artificial Sequence: Synthetic oligonucleotide
  Target: SCN10A; (+) strand; PAM type: YTN; PAM sequence: TTT
gagaagtgtctgttcatatc

SEQ ID NO: 57557 - DNA, 20 bp, Artificial Sequence
  Description of Artificial Sequence: Synthetic oligonucleotide
  Target: SCN10A; (+) strand; PAM type: YTN; PAM sequence: TTG
agaagtgtctgttcatatcc

SEQ ID NO: 57558 - DNA, 20 bp, Artificial Sequence
  Description of Artificial Sequence: Synthetic oligonucleotide
  Target: SCN10A; (+) strand; PAM type: YTN; PAM sequence: CTG
ttcatatccttcgcccactt

SEQ ID NO: 57559 - DNA, 20 bp, Artificial Sequence
  Description of Artificial Sequence: Synthetic oligonucleotide
  Target: SCN10A; (+) strand; PAM type: YTN; PAM sequence: TTC
atatccttcgcccacttttt

SEQ ID NO: 57560 - DNA, 20 bp, Artificial Sequence
  Description of Artificial Sequence: Synthetic oligonucleotide
  Target: SCN10A; (+) strand; PAM type: YTN; PAM sequence: CTT
cgcccactttttgatgggat

SEQ ID NO: 57561 - DNA, 20 bp, Artificial Sequence
  Description of Artificial Sequence: Synthetic oligonucleotide
  Target: SCN10A; (+) strand; PAM type: YTN; PAM sequence: TTC
gcccactttttgatgggatt

SEQ ID NO: 57562 - DNA, 20 bp, Artificial Sequence
  Description of Artificial Sequence: Synthetic oligonucleotide
  Target: SCN10A; (+) strand; PAM type: YTN; PAM sequence: CTT
tttgatgggatttttttcct

SEQ ID NO: 57563 - DNA, 20 bp, Artificial Sequence
  Description of Artificial Sequence: Synthetic oligonucleotide
  Target: SCN10A; (+) strand; PAM type: YTN; PAM sequence: TTT
ttgatgggatttttttcctt

SEQ ID NO: 57564 - DNA, 20 bp, Artificial Sequence
  Description of Artificial Sequence: Synthetic oligonucleotide
  Target: SCN10A; (+) strand; PAM type: YTN; PAM sequence: TTT
tgatgggatttttttccttg

SEQ ID NO: 57565 - DNA, 20 bp, Artificial Sequence
  Description of Artificial Sequence: Synthetic oligonucleotide
  Target: SCN10A; (+) strand; PAM type: YTN; PAM sequence: TTT
gatgggatttttttccttgt

SEQ ID NO: 57566 - DNA, 20 bp, Artificial Sequence
  Description of Artificial Sequence: Synthetic oligonucleotide
  Target: SCN10A; (+) strand; PAM type: YTN; PAM sequence: TTG
atgggatttttttccttgta

SEQ ID NO: 57567 - DNA, 20 bp, Artificial Sequence
  Description of Artificial Sequence: Synthetic oligonucleotide
  Target: SCN10A; (+) strand; PAM type: YTN; PAM sequence: TTT
ttttccttgtaaatttgttt

SEQ ID NO: 57568 - DNA, 20 bp, Artificial Sequence
  Description of Artificial Sequence: Synthetic oligonucleotide
  Target: SCN10A; (+) strand; PAM type: YTN; PAM sequence: TTT
tttccttgtaaatttgtttg

SEQ ID NO: 57569 - DNA, 20 bp, Artificial Sequence
  Description of Artificial Sequence: Synthetic oligonucleotide
  Target: SCN10A; (+) strand; PAM type: YTN; PAM sequence: TTT
ttccttgtaaatttgtttga

SEQ ID NO: 57570 - DNA, 20 bp, Artificial Sequence
  Description of Artificial Sequence: Synthetic oligonucleotide
  Target: SCN10A; (+) strand; PAM type: YTN; PAM sequence: TTT
tccttgtaaatttgtttgag

SEQ ID NO: 57571 - DNA, 20 bp, Artificial Sequence
  Description of Artificial Sequence: Synthetic oligonucleotide
  Target: SCN10A; (+) strand; PAM type: YTN; PAM sequence: TTT
ccttgtaaatttgtttgagt

SEQ ID NO: 57572 - DNA, 20 bp, Artificial Sequence
  Description of Artificial Sequence: Synthetic oligonucleotide
  Target: SCN10A; (+) strand; PAM type: YTN; PAM sequence: TTC
cttgtaaatttgtttgagtt

SEQ ID NO: 57573 - DNA, 20 bp, Artificial Sequence
  Description of Artificial Sequence: Synthetic oligonucleotide
  Target: SCN10A; (+) strand; PAM type: YTN; PAM sequence: CTT
gtaaatttgtttgagttcat

SEQ ID NO: 57574 - DNA, 20 bp, Artificial Sequence
  Description of Artificial Sequence: Synthetic oligonucleotide
  Target: SCN10A; (+) strand; PAM type: YTN; PAM sequence: TTG
taaatttgtttgagttcatt

SEQ ID NO: 57575 - DNA, 20 bp, Artificial Sequence
  Description of Artificial Sequence: Synthetic oligonucleotide
  Target: SCN10A; (+) strand; PAM type: YTN; PAM sequence: TTT
gtttgagttcattgtagatt

SEQ ID NO: 57576 - DNA, 20 bp, Artificial Sequence
  Description of Artificial Sequence: Synthetic oligonucleotide
  Target: SCN10A; (+) strand; PAM type: YTN; PAM sequence: TTG
tttgagttcattgtagattc

SEQ ID NO: 57577 - DNA, 20 bp, Artificial Sequence
  Description of Artificial Sequence: Synthetic oligonucleotide
  Target: SCN10A; (+) strand; PAM type: YTN; PAM sequence: TTT
gagttcattgtagattctgg

SEQ ID NO: 57578 - DNA, 20 bp, Artificial Sequence
  Description of Artificial Sequence: Synthetic oligonucleotide
  Target: SCN10A; (+) strand; PAM type: YTN; PAM sequence: TTG
agttcattgtagattctgga

SEQ ID NO: 57579 - DNA, 20 bp, Artificial Sequence
  Description of Artificial Sequence: Synthetic oligonucleotide
  Target: SCN10A; (+) strand; PAM type: YTN; PAM sequence: TTC
attgtagattctggatatta

SEQ ID NO: 57580 - DNA, 20 bp, Artificial Sequence
  Description of Artificial Sequence: Synthetic oligonucleotide
  Target: SCN10A; (+) strand; PAM type: YTN; PAM sequence: TTG
tagattctggatattagccc

SEQ ID NO: 57581 - DNA, 20 bp, Artificial Sequence
  Description of Artificial Sequence: Synthetic oligonucleotide
  Target: SCN10A; (+) strand; PAM type: YTN; PAM sequence: TTC
tggatattagcccttcgtca

SEQ ID NO: 57582 - DNA, 20 bp, Artificial Sequence
  Description of Artificial Sequence: Synthetic oligonucleotide
  Target: SCN10A; (+) strand; PAM type: YTN; PAM sequence: CTG
gatattagcccttcgtcaga

SEQ ID NO: 57583 - DNA, 20 bp, Artificial Sequence
  Description of Artificial Sequence: Synthetic oligonucleotide
  Target: SCN10A; (+) strand; PAM type: YTN; PAM sequence: TTA
gcccttcgtcagatgagtag

SEQ ID NO: 57584 - DNA, 20 bp, Artificial Sequence
  Description of Artificial Sequence: Synthetic oligonucleotide
  Target: SCN10A; (+) strand; PAM type: YTN; PAM sequence: CTT
cgtcagatgagtaggttgca

SEQ ID NO: 57585 - DNA, 20 bp, Artificial Sequence
  Description of Artificial Sequence: Synthetic oligonucleotide
  Target: SCN10A; (+) strand; PAM type: YTN; PAM sequence: TTC
gtcagatgagtaggttgcaa

SEQ ID NO: 57586 - DNA, 20 bp, Artificial Sequence
  Description of Artificial Sequence: Synthetic oligonucleotide
  Target: SCN10A; (+) strand; PAM type: YTN; PAM sequence: TTG
caaaaattttctcccatcct

SEQ ID NO: 57587 - DNA, 20 bp, Artificial Sequence
  Description of Artificial Sequence: Synthetic oligonucleotide
  Target: SCN10A; (+) strand; PAM type: YTN; PAM sequence: TTT
tctcccatcctgtaggtttc

SEQ ID NO: 57588 - DNA, 20 bp, Artificial Sequence
  Description of Artificial Sequence: Synthetic oligonucleotide
  Target: SCN10A; (+) strand; PAM type: YTN; PAM sequence: TTT
ctcccatcctgtaggtttct

SEQ ID NO: 57589 - DNA, 20 bp, Artificial Sequence
  Description of Artificial Sequence: Synthetic oligonucleotide
  Target: SCN10A; (+) strand; PAM type: YTN; PAM sequence: TTC
tcccatcctgtaggtttctg

SEQ ID NO: 57590 - DNA, 20 bp, Artificial Sequence
  Description of Artificial Sequence: Synthetic oligonucleotide
  Target: SCN10A; (+) strand; PAM type: YTN; PAM sequence: CTC
ccatcctgtaggtttctgtt

SEQ ID NO: 57591 - DNA, 20 bp, Artificial Sequence
  Description of Artificial Sequence: Synthetic oligonucleotide
  Target: SCN10A; (+) strand; PAM type: YTN; PAM sequence: CTG
taggtttctgttcactctga

SEQ ID NO: 57592 - DNA, 20 bp, Artificial Sequence
  Description of Artificial Sequence: Synthetic oligonucleotide
  Target: SCN10A; (+) strand; PAM type: YTN; PAM sequence: TTT
ctgttcactctgatggtggt

SEQ ID NO: 57593 - DNA, 20 bp, Artificial Sequence
  Description of Artificial Sequence: Synthetic oligonucleotide
  Target: SCN10A; (+) strand; PAM type: YTN; PAM sequence: TTC
tgttcactctgatggtggtt

SEQ ID NO: 57594 - DNA, 20 bp, Artificial Sequence
  Description of Artificial Sequence: Synthetic oligonucleotide
  Target: SCN10A; (+) strand; PAM type: YTN; PAM sequence: CTG
ttcactctgatggtggtttc

SEQ ID NO: 57595 - DNA, 20 bp, Artificial Sequence
  Description of Artificial Sequence: Synthetic oligonucleotide
  Target: SCN10A; (+) strand; PAM type: YTN; PAM sequence: TTC
actctgatggtggtttcttt

SEQ ID NO: 57596 - DNA, 20 bp, Artificial Sequence
  Description of Artificial Sequence: Synthetic oligonucleotide
  Target: SCN10A; (+) strand; PAM type: YTN; PAM sequence: CTC
tgatggtggtttcttttgct

SEQ ID NO: 57597 - DNA, 20 bp, Artificial Sequence
  Description of Artificial Sequence: Synthetic oligonucleotide
  Target: SCN10A; (+) strand; PAM type: YTN; PAM sequence: CTG
atggtggtttcttttgctgc

SEQ ID NO: 57598 - DNA, 20 bp, Artificial Sequence
  Description of Artificial Sequence: Synthetic oligonucleotide
  Target: SCN10A; (+) strand; PAM type: YTN; PAM sequence: TTT
cttttgctgctcagaagctc

SEQ ID NO: 57599 - DNA, 20 bp, Artificial Sequence
  Description of Artificial Sequence: Synthetic oligonucleotide
  Target: SCN10A; (+) strand; PAM type: YTN; PAM sequence: TTC
ttttgctgctcagaagctct

SEQ ID NO: 57600 - DNA, 20 bp, Artificial Sequence
  Description of Artificial Sequence: Synthetic oligonucleotide
  Target: SCN10A; (+) strand; PAM type: YTN; PAM sequence: CTT
ttgctgctcagaagctcttt

SEQ ID NO: 57601 - DNA, 20 bp, Artificial Sequence
  Description of Artificial Sequence: Synthetic oligonucleotide
  Target: SCN10A; (+) strand; PAM type: YTN; PAM sequence: TTT
tgctgctcagaagctcttta

SEQ ID NO: 57602 - DNA, 20 bp, Artificial Sequence
  Description of Artificial Sequence: Synthetic oligonucleotide
  Target: SCN10A; (+) strand; PAM type: YTN; PAM sequence: TTT
gctgctcagaagctctttag

SEQ ID NO: 57603 - DNA, 20 bp, Artificial Sequence
  Description of Artificial Sequence: Synthetic oligonucleotide
  Target: SCN10A; (+) strand; PAM type: YTN; PAM sequence: TTG
ctgctcagaagctctttagt

SEQ ID NO: 57604 - DNA, 20 bp, Artificial Sequence
  Description of Artificial Sequence: Synthetic oligonucleotide
  Target: SCN10A; (+) strand; PAM type: YTN; PAM sequence: CTG
ctcagaagctctttagttta

SEQ ID NO: 57605 - DNA, 20 bp, Artificial Sequence
  Description of Artificial Sequence: Synthetic oligonucleotide
  Target: SCN10A; (+) strand; PAM type: YTN; PAM sequence: CTC
agaagctctttagtttaatg

SEQ ID NO: 57606 - DNA, 20 bp, Artificial Sequence
  Description of Artificial Sequence: Synthetic oligonucleotide
  Target: SCN10A; (+) strand; PAM type: YTN; PAM sequence: CTC
tttagtttaatgagatccca

SEQ ID NO: 57607 - DNA, 20 bp, Artificial Sequence
  Description of Artificial Sequence: Synthetic oligonucleotide
  Target: SCN10A; (+) strand; PAM type: YTN; PAM sequence: CTT
tagtttaatgagatcccatt

SEQ ID NO: 57608 - DNA, 20 bp, Artificial Sequence
  Description of Artificial Sequence: Synthetic oligonucleotide
  Target: SCN10A; (+) strand; PAM type: YTN; PAM sequence: TTT
agtttaatgagatcccattt

SEQ ID NO: 57609 - DNA, 20 bp, Artificial Sequence
  Description of Artificial Sequence: Synthetic oligonucleotide
  Target: SCN10A; (+) strand; PAM type: YTN; PAM sequence: TTA
gtttaatgagatcccatttg

SEQ ID NO: 57610 - DNA, 20 bp, Artificial Sequence
  Description of Artificial Sequence: Synthetic oligonucleotide
  Target: SCN10A; (+) strand; PAM type: YTN; PAM sequence: TTT
aatgagatcccatttgtcaa

SEQ ID NO: 57611 - DNA, 20 bp, Artificial Sequence
  Description of Artificial Sequence: Synthetic oligonucleotide
  Target: SCN10A; (+) strand; PAM type: YTN; PAM sequence: TTA
atgagatcccatttgtcaat

SEQ ID NO: 57612 - DNA, 20 bp, Artificial Sequence
  Description of Artificial Sequence: Synthetic oligonucleotide
  Target: SCN10A; (+) strand; PAM type: YTN; PAM sequence: TTT
gtcaattttgacttttgttg

SEQ ID NO: 57613 - DNA, 20 bp, Artificial Sequence
  Description of Artificial Sequence: Synthetic oligonucleotide
  Target: SCN10A; (+) strand; PAM type: YTN; PAM sequence: TTG
tcaattttgacttttgttgc

SEQ ID NO: 57614 - DNA, 20 bp, Artificial Sequence
  Description of Artificial Sequence: Synthetic oligonucleotide
  Target: SCN10A; (+) strand; PAM type: YTN; PAM sequence: TTT
tgacttttgttgccattgct

SEQ ID NO: 57615 - DNA, 20 bp, Artificial Sequence
  Description of Artificial Sequence: Synthetic oligonucleotide
  Target: SCN10A; (+) strand; PAM type: YTN; PAM sequence: TTT
gacttttgttgccattgctt

SEQ ID NO: 57616 - DNA, 20 bp, Artificial Sequence
  Description of Artificial Sequence: Synthetic oligonucleotide
  Target: SCN10A; (+) strand; PAM type: YTN; PAM sequence: TTG
acttttgttgccattgcttt

SEQ ID NO: 57617 - DNA, 20 bp, Artificial Sequence
  Description of Artificial Sequence: Synthetic oligonucleotide
  Target: SCN10A; (+) strand; PAM type: YTN; PAM sequence: CTT
ttgttgccattgcttttggt

SEQ ID NO: 57618 - DNA, 20 bp, Artificial Sequence
  Description of Artificial Sequence: Synthetic oligonucleotide
  Target: SCN10A; (+) strand; PAM type: YTN; PAM sequence: TTT
tgttgccattgcttttggtg

SEQ ID NO: 57619 - DNA, 20 bp, Artificial Sequence
  Description of Artificial Sequence: Synthetic oligonucleotide
  Target: SCN10A; (+) strand; PAM type: YTN; PAM sequence: TTT
gttgccattgcttttggtgt

SEQ ID NO: 57620 - DNA, 20 bp, Artificial Sequence
  Description of Artificial Sequence: Synthetic oligonucleotide
  Target: SCN10A; (+) strand; PAM type: YTN; PAM sequence: TTG
ttgccattgcttttggtgtt

SEQ ID NO: 57621 - DNA, 20 bp, Artificial Sequence
  Description of Artificial Sequence: Synthetic oligonucleotide
  Target: SCN10A; (+) strand; PAM type: YTN; PAM sequence: TTG
ccattgcttttggtgtttta

SEQ ID NO: 57622 - DNA, 20 bp, Artificial Sequence
  Description of Artificial Sequence: Synthetic oligonucleotide
  Target: SCN10A; (+) strand; PAM type: YTN; PAM sequence: TTG
cttttggtgttttagacatg

SEQ ID NO: 57623 - DNA, 20 bp, Artificial Sequence
  Description of Artificial Sequence: Synthetic oligonucleotide
  Target: SCN10A; (+) strand; PAM type: YTN; PAM sequence: CTT
ttggtgttttagacatgaag

SEQ ID NO: 57624 - DNA, 20 bp, Artificial Sequence
  Description of Artificial Sequence: Synthetic oligonucleotide
  Target: SCN10A; (+) strand; PAM type: YTN; PAM sequence: TTT
tggtgttttagacatgaagt

SEQ ID NO: 57625 - DNA, 20 bp, Artificial Sequence
  Description of Artificial Sequence: Synthetic oligonucleotide
  Target: SCN10A; (+) strand; PAM type: YTN; PAM sequence: TTT
ggtgttttagacatgaagtc

SEQ ID NO: 57626 - DNA, 20 bp, Artificial Sequence
  Description of Artificial Sequence: Synthetic oligonucleotide
  Target: SCN10A; (+) strand; PAM type: YTN; PAM sequence: TTG
gtgttttagacatgaagtcc

SEQ ID NO: 57627 - DNA, 20 bp, Artificial Sequence
  Description of Artificial Sequence: Synthetic oligonucleotide
  Target: SCN10A; (+) strand; PAM type: YTN; PAM sequence: TTT
tagacatgaagtccttgccc

SEQ ID NO: 57628 - DNA, 20 bp, Artificial Sequence
  Description of Artificial Sequence: Synthetic oligonucleotide
  Target: SCN10A; (+) strand; PAM type: YTN; PAM sequence: TTT
agacatgaagtccttgccca

SEQ ID NO: 57629 - DNA, 20 bp, Artificial Sequence
  Description of Artificial Sequence: Synthetic oligonucleotide
  Target: SCN10A; (+) strand; PAM type: YTN; PAM sequence: TTA
gacatgaagtccttgcccat

SEQ ID NO: 57630 - DNA, 20 bp, Artificial Sequence
  Description of Artificial Sequence: Synthetic oligonucleotide
  Target: SCN10A; (+) strand; PAM type: YTN; PAM sequence: CTT
gcccatgcctatgtcctgaa

SEQ ID NO: 57631 - DNA, 20 bp, Artificial Sequence
  Description of Artificial Sequence: Synthetic oligonucleotide
  Target: SCN10A; (+) strand; PAM type: YTN; PAM sequence: TTG
cccatgcctatgtcctgaat

SEQ ID NO: 57632 - DNA, 20 bp, Artificial Sequence
  Description of Artificial Sequence: Synthetic oligonucleotide
  Target: SCN10A; (+) strand; PAM type: YTN; PAM sequence: CTA
tgtcctgaatggtattgcct

SEQ ID NO: 57633 - DNA, 20 bp, Artificial Sequence
  Description of Artificial Sequence: Synthetic oligonucleotide
  Target: SCN10A; (+) strand; PAM type: YTN; PAM sequence: CTG
aatggtattgcctaggttct

SEQ ID NO: 57634 - DNA, 20 bp, Artificial Sequence
  Description of Artificial Sequence: Synthetic oligonucleotide
  Target: SCN10A; (+) strand; PAM type: YTN; PAM sequence: TTG
cctaggttctcttctagggt

SEQ ID NO: 57635 - DNA, 20 bp, Artificial Sequence
  Description of Artificial Sequence: Synthetic oligonucleotide
  Target: SCN10A; (+) strand; PAM type: YTN; PAM sequence: CTA
ggttctcttctagggttttt

SEQ ID NO: 57636 - DNA, 20 bp, Artificial Sequence
  Description of Artificial Sequence: Synthetic oligonucleotide
  Target: SCN10A; (+) strand; PAM type: YTN; PAM sequence: TTC
tcttctagggtttttatggt

SEQ ID NO: 57637 - DNA, 20 bp, Artificial Sequence
  Description of Artificial Sequence: Synthetic oligonucleotide
  Target: SCN10A; (+) strand; PAM type: YTN; PAM sequence: CTC
ttctagggtttttatggttt

SEQ ID NO: 57638 - DNA, 20 bp, Artificial Sequence
  Description of Artificial Sequence: Synthetic oligonucleotide
  Target: SCN10A; (+) strand; PAM type: YTN; PAM sequence: CTT
ctagggtttttatggtttta

SEQ ID NO: 57639 - DNA, 20 bp, Artificial Sequence
  Description of Artificial Sequence: Synthetic oligonucleotide
  Target: SCN10A; (+) strand; PAM type: YTN; PAM sequence: TTC
tagggtttttatggttttag

SEQ ID NO: 57640 - DNA, 20 bp, Artificial Sequence
  Description of Artificial Sequence: Synthetic oligonucleotide
  Target: SCN10A; (+) strand; PAM type: YTN; PAM sequence: CTA
gggtttttatggttttaggt

SEQ ID NO: 57641 - DNA, 20 bp, Artificial Sequence
  Description of Artificial Sequence: Synthetic oligonucleotide
  Target: SCN10A; (+) strand; PAM type: YTN; PAM sequence: TTT
ttatggttttaggtctaaca

SEQ ID NO: 57642 - DNA, 20 bp, Artificial Sequence
  Description of Artificial Sequence: Synthetic oligonucleotide
  Target: SCN10A; (+) strand; PAM type: YTN; PAM sequence: TTT
tatggttttaggtctaacat

SEQ ID NO: 57643 - DNA, 20 bp, Artificial Sequence
  Description of Artificial Sequence: Synthetic oligonucleotide
  Target: SCN10A; (+) strand; PAM type: YTN; PAM sequence: TTT
atggttttaggtctaacatt

SEQ ID NO: 57644 - DNA, 20 bp, Artificial Sequence
  Description of Artificial Sequence: Synthetic oligonucleotide
  Target: SCN10A; (+) strand; PAM type: YTN; PAM sequence: TTA
tggttttaggtctaacattt

SEQ ID NO: 57645 - DNA, 20 bp, Artificial Sequence
  Description of Artificial Sequence: Synthetic oligonucleotide
  Target: SCN10A; (+) strand; PAM type: YTN; PAM sequence: TTT
taggtctaacatttaagtct

SEQ ID NO: 57646 - DNA, 20 bp, Artificial Sequence
  Description of Artificial Sequence: Synthetic oligonucleotide
  Target: SCN10A; (+) strand; PAM type: YTN; PAM sequence: TTT
aggtctaacatttaagtctt

SEQ ID NO: 57647 - DNA, 20 bp, Artificial Sequence
  Description of Artificial Sequence: Synthetic oligonucleotide
  Target: SCN10A; (+) strand; PAM type: YTN; PAM sequence: TTA
ggtctaacatttaagtcttt

SEQ ID NO: 57648 - DNA, 20 bp, Artificial Sequence
  Description of Artificial Sequence: Synthetic oligonucleotide
  Target: SCN10A; (+) strand; PAM type: YTN; PAM sequence: CTA
acatttaagtctttaatcca

SEQ ID NO: 57649 - DNA, 20 bp, Artificial Sequence
  Description of Artificial Sequence: Synthetic oligonucleotide
  Target: SCN10A; (+) strand; PAM type: YTN; PAM sequence: TTT
aagtctttaatccatcttga

SEQ ID NO: 57650 - DNA, 20 bp, Artificial Sequence
  Description of Artificial Sequence: Synthetic oligonucleotide
  Target: SCN10A; (+) strand; PAM type: YTN; PAM sequence: TTA
agtctttaatccatcttgaa

SEQ ID NO: 57651 - DNA, 20 bp, Artificial Sequence
  Description of Artificial Sequence: Synthetic oligonucleotide
  Target: SCN10A; (+) strand; PAM type: YTN; PAM sequence: CTT
taatccatcttgaattaatt

SEQ ID NO: 57652 - DNA, 20 bp, Artificial Sequence
  Description of Artificial Sequence: Synthetic oligonucleotide
  Target: SCN10A; (+) strand; PAM type: YTN; PAM sequence: TTT
aatccatcttgaattaattt

SEQ ID NO: 57653 - DNA, 20 bp, Artificial Sequence
  Description of Artificial Sequence: Synthetic oligonucleotide
  Target: SCN10A; (+) strand; PAM type: YTN; PAM sequence: TTA
atccatcttgaattaatttt

SEQ ID NO: 57654 - DNA, 20 bp, Artificial Sequence
  Description of Artificial Sequence: Synthetic oligonucleotide
  Target: SCN10A; (+) strand; PAM type: YTN; PAM sequence: CTT
gaattaatttttgtataagg

SEQ ID NO: 57655 - DNA, 20 bp, Artificial Sequence
  Description of Artificial Sequence: Synthetic oligonucleotide
  Target: SCN10A; (+) strand; PAM type: YTN; PAM sequence: TTG
aattaatttttgtataaggt

SEQ ID NO: 57656 - DNA, 20 bp, Artificial Sequence
  Description of Artificial Sequence: Synthetic oligonucleotide
  Target: SCN10A; (+) strand; PAM type: YTN; PAM sequence: TTA
atttttgtataaggtgtaag

SEQ ID NO: 57657 - DNA, 20 bp, Artificial Sequence
  Description of Artificial Sequence: Synthetic oligonucleotide
  Target: SCN10A; (+) strand; PAM type: YTN; PAM sequence: TTT
ttgtataaggtgtaaggaag

SEQ ID NO: 57658 - DNA, 20 bp, Artificial Sequence
  Description of Artificial Sequence: Synthetic oligonucleotide
  Target: SCN10A; (+) strand; PAM type: YTN; PAM sequence: TTT
tgtataaggtgtaaggaagg

SEQ ID NO: 57659 - DNA, 20 bp, Artificial Sequence
  Description of Artificial Sequence: Synthetic oligonucleotide
  Target: SCN10A; (+) strand; PAM type: YTN; PAM sequence: TTT
gtataaggtgtaaggaaggg

SEQ ID NO: 57660 - DNA, 20 bp, Artificial Sequence
  Description of Artificial Sequence: Synthetic oligonucleotide
  Target: SCN10A; (+) strand; PAM type: YTN; PAM sequence: TTG
tataaggtgtaaggaaggga

SEQ ID NO: 57661 - DNA, 20 bp, Artificial Sequence
  Description of Artificial Sequence: Synthetic oligonucleotide
  Target: SCN10A; (+) strand; PAM type: YTN; PAM sequence: TTT
cagctttctccatatggcta

SEQ ID NO: 57662 - DNA, 20 bp, Artificial Sequence
  Description of Artificial Sequence: Synthetic oligonucleotide
  Target: SCN10A; (+) strand; PAM type: YTN; PAM sequence: TTC
agctttctccatatggctag

SEQ ID NO: 57663 - DNA, 20 bp, Artificial Sequence
  Description of Artificial Sequence: Synthetic oligonucleotide
  Target: SCN10A; (+) strand; PAM type: YTN; PAM sequence: CTT
tctccatatggctagccagt

SEQ ID NO: 57664 - DNA, 20 bp, Artificial Sequence
  Description of Artificial Sequence: Synthetic oligonucleotide
  Target: SCN10A; (+) strand; PAM type: YTN; PAM sequence: TTT
ctccatatggctagccagtt

SEQ ID NO: 57665 - DNA, 20 bp, Artificial Sequence
  Description of Artificial Sequence: Synthetic oligonucleotide
  Target: SCN10A; (+) strand; PAM type: YTN; PAM sequence: TTC
tccatatggctagccagttt

SEQ ID NO: 57666 - DNA, 20 bp, Artificial Sequence
  Description of Artificial Sequence: Synthetic oligonucleotide
  Target: SCN10A; (+) strand; PAM type: YTN; PAM sequence: CTC
catatggctagccagttttc

SEQ ID NO: 57667 - DNA, 20 bp, Artificial Sequence
  Description of Artificial Sequence: Synthetic oligonucleotide
  Target: SCN10A; (+) strand; PAM type: YTN; PAM sequence: CTA
gccagttttcccagcaccat

SEQ ID NO: 57668 - DNA, 20 bp, Artificial Sequence
  Description of Artificial Sequence: Synthetic oligonucleotide
  Target: SCN10A; (+) strand; PAM type: YTN; PAM sequence: TTT
tcccagcaccatttattaaa

SEQ ID NO: 57669 - DNA, 20 bp, Artificial Sequence
  Description of Artificial Sequence: Synthetic oligonucleotide
  Target: SCN10A; (+) strand; PAM type: YTN; PAM sequence: TTT
cccagcaccatttattaaat

SEQ ID NO: 57670 - DNA, 20 bp, Artificial Sequence
  Description of Artificial Sequence: Synthetic oligonucleotide
  Target: SCN10A; (+) strand; PAM type: YTN; PAM sequence: TTC
ccagcaccatttattaaata

SEQ ID NO: 57671 - DNA, 20 bp, Artificial Sequence
  Description of Artificial Sequence: Synthetic oligonucleotide
  Target: SCN10A; (+) strand; PAM type: YTN; PAM sequence: TTT
attaaatagggaatcctttc

SEQ ID NO: 57672 - DNA, 20 bp, Artificial Sequence
  Description of Artificial Sequence: Synthetic oligonucleotide
  Target: SCN10A; (+) strand; PAM type: YTN; PAM sequence: TTA
ttaaatagggaatcctttcc

SEQ ID NO: 57673 - DNA, 20 bp, Artificial Sequence
  Description of Artificial Sequence: Synthetic oligonucleotide
  Target: SCN10A; (+) strand; PAM type: YTN; PAM sequence: TTA
aatagggaatcctttcccca

SEQ ID NO: 57674 - DNA, 20 bp, Artificial Sequence
  Description of Artificial Sequence: Synthetic oligonucleotide
  Target: SCN10A; (+) strand; PAM type: YTN; PAM sequence: CTT
tccccatttcttgtttttgt

SEQ ID NO: 57675 - DNA, 20 bp, Artificial Sequence
  Description of Artificial Sequence: Synthetic oligonucleotide
  Target: SCN10A; (+) strand; PAM type: YTN; PAM sequence: TTT
ccccatttcttgtttttgtc

SEQ ID NO: 57676 - DNA, 20 bp, Artificial Sequence
  Description of Artificial Sequence: Synthetic oligonucleotide
  Target: SCN10A; (+) strand; PAM type: YTN; PAM sequence: TTC
cccatttcttgtttttgtca

SEQ ID NO: 57677 - DNA, 20 bp, Artificial Sequence
  Description of Artificial Sequence: Synthetic oligonucleotide
  Target: SCN10A; (+) strand; PAM type: YTN; PAM sequence: TTT
cttgtttttgtcaggtttgt

SEQ ID NO: 57678 - DNA, 20 bp, Artificial Sequence
  Description of Artificial Sequence: Synthetic oligonucleotide
  Target: SCN10A; (+) strand; PAM type: YTN; PAM sequence: TTC
ttgtttttgtcaggtttgtc

SEQ ID NO: 57679 - DNA, 20 bp, Artificial Sequence
  Description of Artificial Sequence: Synthetic oligonucleotide
  Target: SCN10A; (+) strand; PAM type: YTN; PAM sequence: CTT
gtttttgtcaggtttgtcaa

SEQ ID NO: 57680 - DNA, 20 bp, Artificial Sequence
  Description of Artificial Sequence: Synthetic oligonucleotide
  Target: SCN10A; (+) strand; PAM type: YTN; PAM sequence: TTG
tttttgtcaggtttgtcaaa

SEQ ID NO: 57681 - DNA, 20 bp, Artificial Sequence
  Description of Artificial Sequence: Synthetic oligonucleotide
  Target: SCN10A; (+) strand; PAM type: YTN; PAM sequence: TTT
ttgtcaggtttgtcaaagat

SEQ ID NO: 57682 - DNA, 20 bp, Artificial Sequence
  Description of Artificial Sequence: Synthetic oligonucleotide
  Target: SCN10A; (+) strand; PAM type: YTN; PAM sequence: TTT
tgtcaggtttgtcaaagatc

SEQ ID NO: 57683 - DNA, 20 bp, Artificial Sequence
  Description of Artificial Sequence: Synthetic oligonucleotide
  Target: SCN10A; (+) strand; PAM type: YTN; PAM sequence: TTT
gtcaggtttgtcaaagatca

SEQ ID NO: 57684 - DNA, 20 bp, Artificial Sequence
  Description of Artificial Sequence: Synthetic oligonucleotide
  Target: SCN10A; (+) strand; PAM type: YTN; PAM sequence: TTG
tcaggtttgtcaaagatcag

SEQ ID NO: 57685 - DNA, 20 bp, Artificial Sequence
  Description of Artificial Sequence: Synthetic oligonucleotide
  Target: SCN10A; (+) strand; PAM type: YTN; PAM sequence: TTT
gtcaaagatcagatagttgt

SEQ ID NO: 57686 - DNA, 20 bp, Artificial Sequence
  Description of Artificial Sequence: Synthetic oligonucleotide
  Target: SCN10A; (+) strand; PAM type: YTN; PAM sequence: TTG
tcaaagatcagatagttgta

SEQ ID NO: 57687 - DNA, 20 bp, Artificial Sequence
  Description of Artificial Sequence: Synthetic oligonucleotide
  Target: SCN10A; (+) strand; PAM type: YTN; PAM sequence: TTG
tagatatgcggcattatttc

SEQ ID NO: 57688 - DNA, 20 bp, Artificial Sequence
  Description of Artificial Sequence: Synthetic oligonucleotide
  Target: SCN10A; (+) strand; PAM type: YTN; PAM sequence: TTA
tttctgagggctctgttctg

SEQ ID NO: 57689 - DNA, 20 bp, Artificial Sequence
  Description of Artificial Sequence: Synthetic oligonucleotide
  Target: SCN10A; (+) strand; PAM type: YTN; PAM sequence: TTT
ctgagggctctgttctgttc

SEQ ID NO: 57690 - DNA, 20 bp, Artificial Sequence
  Description of Artificial Sequence: Synthetic oligonucleotide
  Target: SCN10A; (+) strand; PAM type: YTN; PAM sequence: TTC
tgagggctctgttctgttcc

SEQ ID NO: 57691 - DNA, 20 bp, Artificial Sequence
  Description of Artificial Sequence: Synthetic oligonucleotide
  Target: SCN10A; (+) strand; PAM type: YTN; PAM sequence: CTG
agggctctgttctgttccat

SEQ ID NO: 57692 - DNA, 20 bp, Artificial Sequence
  Description of Artificial Sequence: Synthetic oligonucleotide
  Target: SCN10A; (+) strand; PAM type: YTN; PAM sequence: CTC
tgttctgttccattggtcta

SEQ ID NO: 57693 - DNA, 20 bp, Artificial Sequence
  Description of Artificial Sequence: Synthetic oligonucleotide
  Target: SCN10A; (+) strand; PAM type: YTN; PAM sequence: CTG
ttctgttccattggtctata

SEQ ID NO: 57694 - DNA, 20 bp, Artificial Sequence
  Description of Artificial Sequence: Synthetic oligonucleotide
  Target: SCN10A; (+) strand; PAM type: YTN; PAM sequence: TTC
tgttccattggtctatatct

SEQ ID NO: 57695 - DNA, 20 bp, Artificial Sequence
  Description of Artificial Sequence: Synthetic oligonucleotide
  Target: SCN10A; (+) strand; PAM type: YTN; PAM sequence: CTG
ttccattggtctatatctct

SEQ ID NO: 57696 - DNA, 20 bp, Artificial Sequence
  Description of Artificial Sequence: Synthetic oligonucleotide
  Target: SCN10A; (+) strand; PAM type: YTN; PAM sequence: TTC
cattggtctatatctctgtt

SEQ ID NO: 57697 - DNA, 20 bp, Artificial Sequence
  Description of Artificial Sequence: Synthetic oligonucleotide
  Target: SCN10A; (+) strand; PAM type: YTN; PAM sequence: TTG
gtctatatctctgttttggt

SEQ ID NO: 57698 - DNA, 20 bp, Artificial Sequence
  Description of Artificial Sequence: Synthetic oligonucleotide
  Target: SCN10A; (+) strand; PAM type: YTN; PAM sequence: CTA
tatctctgttttggtaccag

SEQ ID NO: 57699 - DNA, 20 bp, Artificial Sequence
  Description of Artificial Sequence: Synthetic oligonucleotide
  Target: SCN10A; (+) strand; PAM type: YTN; PAM sequence: CTC
tgttttggtaccagtaccat

SEQ ID NO: 57700 - DNA, 20 bp, Artificial Sequence
  Description of Artificial Sequence: Synthetic oligonucleotide
  Target: SCN10A; (+) strand; PAM type: YTN; PAM sequence: CTG
ttttggtaccagtaccatgc

SEQ ID NO: 57701 - DNA, 20 bp, Artificial Sequence
  Description of Artificial Sequence: Synthetic oligonucleotide
  Target: SCN10A; (+) strand; PAM type: YTN; PAM sequence: TTT
tggtaccagtaccatgctgt

SEQ ID NO: 57702 - DNA, 20 bp, Artificial Sequence
  Description of Artificial Sequence: Synthetic oligonucleotide
  Target: SCN10A; (+) strand; PAM type: YTN; PAM sequence: TTT
ggtaccagtaccatgctgtt

SEQ ID NO: 57703 - DNA, 20 bp, Artificial Sequence
  Description of Artificial Sequence: Synthetic oligonucleotide
  Target: SCN10A; (+) strand; PAM type: YTN; PAM sequence: TTG
gtaccagtaccatgctgttt

SEQ ID NO: 57704 - DNA, 20 bp, Artificial Sequence
  Description of Artificial Sequence: Synthetic oligonucleotide
  Target: SCN10A; (+) strand; PAM type: YTN; PAM sequence: CTG
ttttggttactgtagccttg

SEQ ID NO: 57705 - DNA, 20 bp, Artificial Sequence
  Description of Artificial Sequence: Synthetic oligonucleotide
  Target: SCN10A; (+) strand; PAM type: YTN; PAM sequence: TTT
tggttactgtagccttgtaa

SEQ ID NO: 57706 - DNA, 20 bp, Artificial Sequence
  Description of Artificial Sequence: Synthetic oligonucleotide
  Target: SCN10A; (+) strand; PAM type: YTN; PAM sequence: TTT
ggttactgtagccttgtaat

SEQ ID NO: 57707 - DNA, 20 bp, Artificial Sequence
  Description of Artificial Sequence: Synthetic oligonucleotide
  Target: SCN10A; (+) strand; PAM type: YTN; PAM sequence: TTG
gttactgtagccttgtaata

SEQ ID NO: 57708 - DNA, 20 bp, Artificial Sequence
  Description of Artificial Sequence: Synthetic oligonucleotide
  Target: SCN10A; (+) strand; PAM type: YTN; PAM sequence: TTA
ctgtagccttgtaatatagt

SEQ ID NO: 57709 - DNA, 20 bp, Artificial Sequence
  Description of Artificial Sequence: Synthetic oligonucleotide
  Target: SCN10A; (+) strand; PAM type: YTN; PAM sequence: CTG
tagccttgtaatatagtttg

SEQ ID NO: 57710 - DNA, 20 bp, Artificial Sequence
  Description of Artificial Sequence: Synthetic oligonucleotide
  Target: SCN10A; (+) strand; PAM type: YTN; PAM sequence: CTT
gtaatatagtttgaagtcag

SEQ ID NO: 57711 - DNA, 20 bp, Artificial Sequence
  Description of Artificial Sequence: Synthetic oligonucleotide
  Target: SCN10A; (+) strand; PAM type: YTN; PAM sequence: TTG
taatatagtttgaagtcagg

SEQ ID NO: 57712 - DNA, 20 bp, Artificial Sequence
  Description of Artificial Sequence: Synthetic oligonucleotide
  Target: SCN10A; (+) strand; PAM type: YTN; PAM sequence: TTT
gaagtcaggtagcgtgatgc

SEQ ID NO: 57713 - DNA, 20 bp, Artificial Sequence
  Description of Artificial Sequence: Synthetic oligonucleotide
  Target: SCN10A; (+) strand; PAM type: YTN; PAM sequence: TTG
aagtcaggtagcgtgatgcc

SEQ ID NO: 57714 - DNA, 20 bp, Artificial Sequence
  Description of Artificial Sequence: Synthetic oligonucleotide
  Target: SCN10A; (+) strand; PAM type: YTN; PAM sequence: CTC
cagctttgttatacaccaat

SEQ ID NO: 57715 - DNA, 20 bp, Artificial Sequence
  Description of Artificial Sequence: Synthetic oligonucleotide
  Target: SCN10A; (+) strand; PAM type: YTN; PAM sequence: CTT
tgttatacaccaataacaga

SEQ ID NO: 57716 - DNA, 20 bp, Artificial Sequence
  Description of Artificial Sequence: Synthetic oligonucleotide
  Target: SCN10A; (+) strand; PAM type: YTN; PAM sequence: TTT
gttatacaccaataacagac

SEQ ID NO: 57717 - DNA, 20 bp, Artificial Sequence
  Description of Artificial Sequence: Synthetic oligonucleotide
  Target: SCN10A; (+) strand; PAM type: YTN; PAM sequence: TTG
ttatacaccaataacagaca

SEQ ID NO: 57718 - DNA, 20 bp, Artificial Sequence
  Description of Artificial Sequence: Synthetic oligonucleotide
  Target: SCN10A; (+) strand; PAM type: YTN; PAM sequence: TTA
tacaccaataacagacaaac

SEQ ID NO: 57719 - DNA, 20 bp, Artificial Sequence
  Description of Artificial Sequence: Synthetic oligonucleotide
  Target: SCN10A; (+) strand; PAM type: YTN; PAM sequence: CTC
ccattcacaattgcttcaaa

SEQ ID NO: 57720 - DNA, 20 bp, Artificial Sequence
  Description of Artificial Sequence: Synthetic oligonucleotide
  Target: SCN10A; (+) strand; PAM type: YTN; PAM sequence: TTC
acaattgcttcaaagagaat

SEQ ID NO: 57721 - DNA, 20 bp, Artificial Sequence
  Description of Artificial Sequence: Synthetic oligonucleotide
  Target: SCN10A; (+) strand; PAM type: YTN; PAM sequence: TTG
cttcaaagagaataaaatac

SEQ ID NO: 57722 - DNA, 20 bp, Artificial Sequence
  Description of Artificial Sequence: Synthetic oligonucleotide
  Target: SCN10A; (+) strand; PAM type: YTN; PAM sequence: CTT
caaagagaataaaataccta

SEQ ID NO: 57723 - DNA, 20 bp, Artificial Sequence
  Description of Artificial Sequence: Synthetic oligonucleotide
  Target: SCN10A; (+) strand; PAM type: YTN; PAM sequence: TTC
aaagagaataaaatacctag

SEQ ID NO: 57724 - DNA, 20 bp, Artificial Sequence
  Description of Artificial Sequence: Synthetic oligonucleotide
  Target: SCN10A; (+) strand; PAM type: YTN; PAM sequence: CTA
ggaatgcaacttacaaggga

SEQ ID NO: 57725 - DNA, 20 bp, Artificial Sequence
  Description of Artificial Sequence: Synthetic oligonucleotide
  Target: SCN10A; (+) strand; PAM type: YTN; PAM sequence: CTT
acaagggatgtgaaggacct

SEQ ID NO: 57726 - DNA, 20 bp, Artificial Sequence
  Description of Artificial Sequence: Synthetic oligonucleotide
  Target: SCN10A; (+) strand; PAM type: YTN; PAM sequence: TTA
caagggatgtgaaggacctc

SEQ ID NO: 57727 - DNA, 20 bp, Artificial Sequence
  Description of Artificial Sequence: Synthetic oligonucleotide
  Target: SCN10A; (+) strand; PAM type: YTN; PAM sequence: CTC
ttcaaggagaactacaaacc

SEQ ID NO: 57728 - DNA, 20 bp, Artificial Sequence
  Description of Artificial Sequence: Synthetic oligonucleotide
  Target: SCN10A; (+) strand; PAM type: YTN; PAM sequence: CTT
caaggagaactacaaaccac

SEQ ID NO: 57729 - DNA, 20 bp, Artificial Sequence
  Description of Artificial Sequence: Synthetic oligonucleotide
  Target: SCN10A; (+) strand; PAM type: YTN; PAM sequence: TTC
aaggagaactacaaaccact

SEQ ID NO: 57730 - DNA, 20 bp, Artificial Sequence
  Description of Artificial Sequence: Synthetic oligonucleotide
  Target: SCN10A; (+) strand; PAM type: YTN; PAM sequence: CTA
caaaccactgctcagtgaaa

SEQ ID NO: 57731 - DNA, 20 bp, Artificial Sequence
  Description of Artificial Sequence: Synthetic oligonucleotide
  Target: SCN10A; (+) strand; PAM type: YTN; PAM sequence: CTG
ctcagtgaaataaaagagga

SEQ ID NO: 57732 - DNA, 20 bp, Artificial Sequence
  Description of Artificial Sequence: Synthetic oligonucleotide
  Target: SCN10A; (+) strand; PAM type: YTN; PAM sequence: CTC
agtgaaataaaagaggatac

SEQ ID NO: 57733 - DNA, 20 bp, Artificial Sequence
  Description of Artificial Sequence: Synthetic oligonucleotide
  Target: SCN10A; (+) strand; PAM type: YTN; PAM sequence: CTC
catgctcatgggtaggaaga

SEQ ID NO: 57734 - DNA, 20 bp, Artificial Sequence
  Description of Artificial Sequence: Synthetic oligonucleotide
  Target: SCN10A; (+) strand; PAM type: YTN; PAM sequence: CTC
atgggtaggaagaatcaata

SEQ ID NO: 57735 - DNA, 20 bp, Artificial Sequence
  Description of Artificial Sequence: Synthetic oligonucleotide
  Target: SCN10A; (+) strand; PAM type: YTN; PAM sequence: CTT
gaaaatggccatactgccca

SEQ ID NO: 57736 - DNA, 20 bp, Artificial Sequence
  Description of Artificial Sequence: Synthetic oligonucleotide
  Target: SCN10A; (+) strand; PAM type: YTN; PAM sequence: TTG
aaaatggccatactgcccaa

SEQ ID NO: 57737 - DNA, 20 bp, Artificial Sequence
  Description of Artificial Sequence: Synthetic oligonucleotide
  Target: SCN10A; (+) strand; PAM type: YTN; PAM sequence: CTG
cccaaggtaatttatagatt

SEQ ID NO: 57738 - DNA, 20 bp, Artificial Sequence
  Description of Artificial Sequence: Synthetic oligonucleotide
  Target: SCN10A; (+) strand; PAM type: YTN; PAM sequence: TTT
atagattcaatgccatcccc

SEQ ID NO: 57739 - DNA, 20 bp, Artificial Sequence
  Description of Artificial Sequence: Synthetic oligonucleotide
  Target: SCN10A; (+) strand; PAM type: YTN; PAM sequence: TTA
tagattcaatgccatcccca

SEQ ID NO: 57740 - DNA, 20 bp, Artificial Sequence
  Description of Artificial Sequence: Synthetic oligonucleotide
  Target: SCN10A; (+) strand; PAM type: YTN; PAM sequence: TTC
aatgccatccccatcaagct

SEQ ID NO: 57741 - DNA, 20 bp, Artificial Sequence
  Description of Artificial Sequence: Synthetic oligonucleotide
  Target: SCN10A; (+) strand; PAM type: YTN; PAM sequence: CTA
ccaatgactttcttctcaga

SEQ ID NO: 57742 - DNA, 20 bp, Artificial Sequence
  Description of Artificial Sequence: Synthetic oligonucleotide
  Target: SCN10A; (+) strand; PAM type: YTN; PAM sequence: CTT
tcttctcagaattggaaaaa

SEQ ID NO: 57743 - DNA, 20 bp, Artificial Sequence
  Description of Artificial Sequence: Synthetic oligonucleotide
  Target: SCN10A; (+) strand; PAM type: YTN; PAM sequence: TTT
cttctcagaattggaaaaaa

SEQ ID NO: 57744 - DNA, 20 bp, Artificial Sequence
  Description of Artificial Sequence: Synthetic oligonucleotide
  Target: SCN10A; (+) strand; PAM type: YTN; PAM sequence: TTC
ttctcagaattggaaaaaac

SEQ ID NO: 57745 - DNA, 20 bp, Artificial Sequence
  Description of Artificial Sequence: Synthetic oligonucleotide
  Target: SCN10A; (+) strand; PAM type: YTN; PAM sequence: CTT
ctcagaattggaaaaaacta

SEQ ID NO: 57746 - DNA, 20 bp, Artificial Sequence
  Description of Artificial Sequence: Synthetic oligonucleotide
  Target: SCN10A; (+) strand; PAM type: YTN; PAM sequence: TTC
tcagaattggaaaaaactac

SEQ ID NO: 57747 - DNA, 20 bp, Artificial Sequence
  Description of Artificial Sequence: Synthetic oligonucleotide
  Target: SCN10A; (+) strand; PAM type: YTN; PAM sequence: CTC
agaattggaaaaaactactt

SEQ ID NO: 57748 - DNA, 20 bp, Artificial Sequence
  Description of Artificial Sequence: Synthetic oligonucleotide
  Target: SCN10A; (+) strand; PAM type: YTN; PAM sequence: TTG
gaaaaaactactttaaagtt

SEQ ID NO: 57749 - DNA, 20 bp, Artificial Sequence
  Description of Artificial Sequence: Synthetic oligonucleotide
  Target: SCN10A; (+) strand; PAM type: YTN; PAM sequence: CTA
ctttaaagttcatacggaac

SEQ ID NO: 57750 - DNA, 20 bp, Artificial Sequence
  Description of Artificial Sequence: Synthetic oligonucleotide
  Target: SCN10A; (+) strand; PAM type: YTN; PAM sequence: CTT
taaagttcatacggaaccaa

SEQ ID NO: 57751 - DNA, 20 bp, Artificial Sequence
  Description of Artificial Sequence: Synthetic oligonucleotide
  Target: SCN10A; (+) strand; PAM type: YTN; PAM sequence: TTT
aaagttcatacggaaccaaa

SEQ ID NO: 57752 - DNA, 20 bp, Artificial Sequence
  Description of Artificial Sequence: Synthetic oligonucleotide
  Target: SCN10A; (+) strand; PAM type: YTN; PAM sequence: TTA
aagttcatacggaaccaaaa

SEQ ID NO: 57753 - DNA, 20 bp, Artificial Sequence
  Description of Artificial Sequence: Synthetic oligonucleotide
  Target: SCN10A; (+) strand; PAM type: YTN; PAM sequence: TTC
atacggaaccaaaaaagagc

SEQ ID NO: 57754 - DNA, 20 bp, Artificial Sequence
  Description of Artificial Sequence: Synthetic oligonucleotide
  Target: SCN10A; (+) strand; PAM type: YTN; PAM sequence: TTG
ccaagtcaatcctaatcctg

SEQ ID NO: 57755 - DNA, 20 bp, Artificial Sequence
  Description of Artificial Sequence: Synthetic oligonucleotide
  Target: SCN10A; (+) strand; PAM type: YTN; PAM sequence: CTA
atcctgttttttttttaacc

SEQ ID NO: 57756 - DNA, 20 bp, Artificial Sequence
  Description of Artificial Sequence: Synthetic oligonucleotide
  Target: SCN10A; (+) strand; PAM type: YTN; PAM sequence: CTG
ttttttttttaaccttactt

SEQ ID NO: 57757 - DNA, 20 bp, Artificial Sequence
  Description of Artificial Sequence: Synthetic oligonucleotide
  Target: SCN10A; (+) strand; PAM type: YTN; PAM sequence: TTT
tttttttaaccttacttttt

SEQ ID NO: 57758 - DNA, 20 bp, Artificial Sequence
  Description of Artificial Sequence: Synthetic oligonucleotide
  Target: SCN10A; (+) strand; PAM type: YTN; PAM sequence: TTT
ttttttaaccttactttttt

SEQ ID NO: 57759 - DNA, 20 bp, Artificial Sequence
  Description of Artificial Sequence: Synthetic oligonucleotide
  Target: SCN10A; (+) strand; PAM type: YTN; PAM sequence: TTT
tttttaaccttacttttttg

SEQ ID NO: 57760 - DNA, 20 bp, Artificial Sequence
  Description of Artificial Sequence: Synthetic oligonucleotide
  Target: SCN10A; (+) strand; PAM type: YTN; PAM sequence: TTT
ttttaaccttacttttttga

SEQ ID NO: 57761 - DNA, 20 bp, Artificial Sequence
  Description of Artificial Sequence: Synthetic oligonucleotide
  Target: SCN10A; (+) strand; PAM type: YTN; PAM sequence: TTT
tttaaccttacttttttgat

SEQ ID NO: 57762 - DNA, 20 bp, Artificial Sequence
  Description of Artificial Sequence: Synthetic oligonucleotide
  Target: SCN10A; (+) strand; PAM type: YTN; PAM sequence: TTT
ttaaccttacttttttgatt

SEQ ID NO: 57763 - DNA, 20 bp, Artificial Sequence
  Description of Artificial Sequence: Synthetic oligonucleotide
  Target: SCN10A; (+) strand; PAM type: YTN; PAM sequence: TTT
taaccttacttttttgattg

SEQ ID NO: 57764 - DNA, 20 bp, Artificial Sequence
  Description of Artificial Sequence: Synthetic oligonucleotide
  Target: SCN10A; (+) strand; PAM type: YTN; PAM sequence: TTT
aaccttacttttttgattgg

SEQ ID NO: 57765 - DNA, 20 bp, Artificial Sequence
  Description of Artificial Sequence: Synthetic oligonucleotide
  Target: SCN10A; (+) strand; PAM type: YTN; PAM sequence: TTA
accttacttttttgattggc

SEQ ID NO: 57766 - DNA, 20 bp, Artificial Sequence
  Description of Artificial Sequence: Synthetic oligonucleotide
  Target: SCN10A; (+) strand; PAM type: YTN; PAM sequence: CTT
acttttttgattggctaatt

SEQ ID NO: 57767 - DNA, 20 bp, Artificial Sequence
  Description of Artificial Sequence: Synthetic oligonucleotide
  Target: SCN10A; (+) strand; PAM type: YTN; PAM sequence: TTA
cttttttgattggctaattg

SEQ ID NO: 57768 - DNA, 20 bp, Artificial Sequence
  Description of Artificial Sequence: Synthetic oligonucleotide
  Target: SCN10A; (+) strand; PAM type: YTN; PAM sequence: CTT
ttttgattggctaattgttt

SEQ ID NO: 57769 - DNA, 20 bp, Artificial Sequence
  Description of Artificial Sequence: Synthetic oligonucleotide
  Target: SCN10A; (+) strand; PAM type: YTN; PAM sequence: TTT
tttgattggctaattgtttc

SEQ ID NO: 57770 - DNA, 20 bp, Artificial Sequence
  Description of Artificial Sequence: Synthetic oligonucleotide
  Target: SCN10A; (+) strand; PAM type: YTN; PAM sequence: TTT
ttgattggctaattgtttct

SEQ ID NO: 57771 - DNA, 20 bp, Artificial Sequence
  Description of Artificial Sequence: Synthetic oligonucleotide
  Target: SCN10A; (+) strand; PAM type: YTN; PAM sequence: TTT
tgattggctaattgtttctt

SEQ ID NO: 57772 - DNA, 20 bp, Artificial Sequence
  Description of Artificial Sequence: Synthetic oligonucleotide
  Target: SCN10A; (+) strand; PAM type: YTN; PAM sequence: TTT
gattggctaattgtttctta

SEQ ID NO: 57773 - DNA, 20 bp, Artificial Sequence
  Description of Artificial Sequence: Synthetic oligonucleotide
  Target: SCN10A; (+) strand; PAM type: YTN; PAM sequence: TTG
attggctaattgtttcttag

SEQ ID NO: 57774 - DNA, 20 bp, Artificial Sequence
  Description of Artificial Sequence: Synthetic oligonucleotide
  Target: SCN10A; (+) strand; PAM type: YTN; PAM sequence: TTG
gctaattgtttcttagcata

SEQ ID NO: 57775 - DNA, 20 bp, Artificial Sequence
  Description of Artificial Sequence: Synthetic oligonucleotide
  Target: SCN10A; (+) strand; PAM type: YTN; PAM sequence: CTA
attgtttcttagcatagttc

SEQ ID NO: 57776 - DNA, 20 bp, Artificial Sequence
  Description of Artificial Sequence: Synthetic oligonucleotide
  Target: SCN10A; (+) strand; PAM type: YTN; PAM sequence: TTG
tttcttagcatagttccccc

SEQ ID NO: 57777 - DNA, 20 bp, Artificial Sequence
  Description of Artificial Sequence: Synthetic oligonucleotide
  Target: SCN10A; (+) strand; PAM type: YTN; PAM sequence: TTT
cttagcatagttcccccttg

SEQ ID NO: 57778 - DNA, 20 bp, Artificial Sequence
  Description of Artificial Sequence: Synthetic oligonucleotide
  Target: SCN10A; (+) strand; PAM type: YTN; PAM sequence: TTC
ttagcatagttcccccttgt

SEQ ID NO: 57779 - DNA, 20 bp, Artificial Sequence
  Description of Artificial Sequence: Synthetic oligonucleotide
  Target: SCN10A; (+) strand; PAM type: YTN; PAM sequence: CTT
agcatagttcccccttgtcc

SEQ ID NO: 57780 - DNA, 20 bp, Artificial Sequence
  Description of Artificial Sequence: Synthetic oligonucleotide
  Target: SCN10A; (+) strand; PAM type: YTN; PAM sequence: TTA
gcatagttcccccttgtcct

SEQ ID NO: 57781 - DNA, 20 bp, Artificial Sequence
  Description of Artificial Sequence: Synthetic oligonucleotide
  Target: SCN10A; (+) strand; PAM type: YTN; PAM sequence: TTC
ccccttgtcctactttggaa

SEQ ID NO: 57782 - DNA, 20 bp, Artificial Sequence
  Description of Artificial Sequence: Synthetic oligonucleotide
  Target: SCN10A; (+) strand; PAM type: YTN; PAM sequence: CTT
gtcctactttggaaatgata

SEQ ID NO: 57783 - DNA, 20 bp, Artificial Sequence
  Description of Artificial Sequence: Synthetic oligonucleotide
  Target: SCN10A; (+) strand; PAM type: YTN; PAM sequence: TTG
tcctactttggaaatgatat

SEQ ID NO: 57784 - DNA, 20 bp, Artificial Sequence
  Description of Artificial Sequence: Synthetic oligonucleotide
  Target: SCN10A; (+) strand; PAM type: YTN; PAM sequence: CTA
ctttggaaatgatatactct

SEQ ID NO: 57785 - DNA, 20 bp, Artificial Sequence
  Description of Artificial Sequence: Synthetic oligonucleotide
  Target: SCN10A; (+) strand; PAM type: YTN; PAM sequence: CTT
tggaaatgatatactctatt

SEQ ID NO: 57786 - DNA, 20 bp, Artificial Sequence
  Description of Artificial Sequence: Synthetic oligonucleotide
  Target: SCN10A; (+) strand; PAM type: YTN; PAM sequence: TTT
ggaaatgatatactctattt

SEQ ID NO: 57787 - DNA, 20 bp, Artificial Sequence
  Description of Artificial Sequence: Synthetic oligonucleotide
  Target: SCN10A; (+) strand; PAM type: YTN; PAM sequence: TTG
gaaatgatatactctatttc

SEQ ID NO: 57788 - DNA, 20 bp, Artificial Sequence
  Description of Artificial Sequence: Synthetic oligonucleotide
  Target: SCN10A; (+) strand; PAM type: YTN; PAM sequence: CTC
tatttctgatttgttactgg

SEQ ID NO: 57789 - DNA, 20 bp, Artificial Sequence
  Description of Artificial Sequence: Synthetic oligonucleotide
  Target: SCN10A; (+) strand; PAM type: YTN; PAM sequence: CTA
tttctgatttgttactggca

SEQ ID NO: 57790 - DNA, 20 bp, Artificial Sequence
  Description of Artificial Sequence: Synthetic oligonucleotide
  Target: SCN10A; (+) strand; PAM type: YTN; PAM sequence: TTT
ctgatttgttactggcaacc

SEQ ID NO: 57791 - DNA, 20 bp, Artificial Sequence
  Description of Artificial Sequence: Synthetic oligonucleotide
  Target: SCN10A; (+) strand; PAM type: YTN; PAM sequence: TTC
tgatttgttactggcaaccc

SEQ ID NO: 57792 - DNA, 20 bp, Artificial Sequence
  Description of Artificial Sequence: Synthetic oligonucleotide
  Target: SCN10A; (+) strand; PAM type: YTN; PAM sequence: CTG
atttgttactggcaacccta

SEQ ID NO: 57793 - DNA, 20 bp, Artificial Sequence
  Description of Artificial Sequence: Synthetic oligonucleotide
  Target: SCN10A; (+) strand; PAM type: YTN; PAM sequence: TTT
gttactggcaaccctaataa

SEQ ID NO: 57794 - DNA, 20 bp, Artificial Sequence
  Description of Artificial Sequence: Synthetic oligonucleotide
  Target: SCN10A; (+) strand; PAM type: YTN; PAM sequence: TTG
ttactggcaaccctaataat

SEQ ID NO: 57795 - DNA, 20 bp, Artificial Sequence
  Description of Artificial Sequence: Synthetic oligonucleotide
  Target: SCN10A; (+) strand; PAM type: YTN; PAM sequence: TTA
ctggcaaccctaataattaa

SEQ ID NO: 57796 - DNA, 20 bp, Artificial Sequence
  Description of Artificial Sequence: Synthetic oligonucleotide
  Target: SCN10A; (+) strand; PAM type: YTN; PAM sequence: CTG
gcaaccctaataattaagtc

SEQ ID NO: 57797 - DNA, 20 bp, Artificial Sequence
  Description of Artificial Sequence: Synthetic oligonucleotide
  Target: SCN10A; (+) strand; PAM type: YTN; PAM sequence: CTA
ataattaagtcattcattct

SEQ ID NO: 57798 - DNA, 20 bp, Artificial Sequence
  Description of Artificial Sequence: Synthetic oligonucleotide
  Target: SCN10A; (+) strand; PAM type: YTN; PAM sequence: TTA
agtcattcattcttaagtta

SEQ ID NO: 57799 - DNA, 20 bp, Artificial Sequence
  Description of Artificial Sequence: Synthetic oligonucleotide
  Target: SCN10A; (+) strand; PAM type: YTN; PAM sequence: TTC
attcttaagttacacagtct

SEQ ID NO: 57800 - DNA, 20 bp, Artificial Sequence
  Description of Artificial Sequence: Synthetic oligonucleotide
  Target: SCN10A; (+) strand; PAM type: YTN; PAM sequence: TTC
ttaagttacacagtctaatg

SEQ ID NO: 57801 - DNA, 20 bp, Artificial Sequence
  Description of Artificial Sequence: Synthetic oligonucleotide
  Target: SCN10A; (+) strand; PAM type: YTN; PAM sequence: CTT
aagttacacagtctaatgat

SEQ ID NO: 57802 - DNA, 20 bp, Artificial Sequence
  Description of Artificial Sequence: Synthetic oligonucleotide
  Target: SCN10A; (+) strand; PAM type: YTN; PAM sequence: TTA
agttacacagtctaatgata

SEQ ID NO: 57803 - DNA, 20 bp, Artificial Sequence
  Description of Artificial Sequence: Synthetic oligonucleotide
  Target: SCN10A; (+) strand; PAM type: YTN; PAM sequence: TTA
cacagtctaatgataataaa

SEQ ID NO: 57804 - DNA, 20 bp, Artificial Sequence
  Description of Artificial Sequence: Synthetic oligonucleotide
  Target: SCN10A; (+) strand; PAM type: YTN; PAM sequence: CTA
atgataataaaaacctttac

SEQ ID NO: 57805 - DNA, 20 bp, Artificial Sequence
  Description of Artificial Sequence: Synthetic oligonucleotide
  Target: SCN10A; (+) strand; PAM type: YTN; PAM sequence: CTT
tacttttttttactttttag

SEQ ID NO: 57806 - DNA, 20 bp, Artificial Sequence
  Description of Artificial Sequence: Synthetic oligonucleotide
  Target: SCN10A; (+) strand; PAM type: YTN; PAM sequence: TTT
acttttttttactttttagc

SEQ ID NO: 57807 - DNA, 20 bp, Artificial Sequence
  Description of Artificial Sequence: Synthetic oligonucleotide
  Target: SCN10A; (+) strand; PAM type: YTN; PAM sequence: TTA
cttttttttactttttagca

SEQ ID NO: 57808 - DNA, 20 bp, Artificial Sequence
  Description of Artificial Sequence: Synthetic oligonucleotide
  Target: SCN10A; (+) strand; PAM type: YTN; PAM sequence: CTT
ttttttactttttagcatta

SEQ ID NO: 57809 - DNA, 20 bp, Artificial Sequence
  Description of Artificial Sequence: Synthetic oligonucleotide
  Target: SCN10A; (+) strand; PAM type: YTN; PAM sequence: TTT
tttttactttttagcattag

SEQ ID NO: 57810 - DNA, 20 bp, Artificial Sequence
  Description of Artificial Sequence: Synthetic oligonucleotide
  Target: SCN10A; (+) strand; PAM type: YTN; PAM sequence: TTT
ttttactttttagcattagg

SEQ ID NO: 57811 - DNA, 20 bp, Artificial Sequence
  Description of Artificial Sequence: Synthetic oligonucleotide
  Target: SCN10A; (+) strand; PAM type: YTN; PAM sequence: TTT
tttactttttagcattagga

SEQ ID NO: 57812 - DNA, 20 bp, Artificial Sequence
  Description of Artificial Sequence: Synthetic oligonucleotide
  Target: SCN10A; (+) strand; PAM type: YTN; PAM sequence: TTT
ttactttttagcattaggag

SEQ ID NO: 57813 - DNA, 20 bp, Artificial Sequence
  Description of Artificial Sequence: Synthetic oligonucleotide
  Target: SCN10A; (+) strand; PAM type: YTN; PAM sequence: TTT
tactttttagcattaggaga

SEQ ID NO: 57814 - DNA, 20 bp, Artificial Sequence
  Description of Artificial Sequence: Synthetic oligonucleotide
  Target: SCN10A; (+) strand; PAM type: YTN; PAM sequence: TTT
actttttagcattaggagaa

SEQ ID NO: 57815 - DNA, 20 bp, Artificial Sequence
  Description of Artificial Sequence: Synthetic oligonucleotide
  Target: SCN10A; (+) strand; PAM type: YTN; PAM sequence: TTA
ctttttagcattaggagaaa

SEQ ID NO: 57816 - DNA, 20 bp, Artificial Sequence
  Description of Artificial Sequence: Synthetic oligonucleotide
  Target: SCN10A; (+) strand; PAM type: YTN; PAM sequence: CTT
tttagcattaggagaaatac

SEQ ID NO: 57817 - DNA, 20 bp, Artificial Sequence
  Description of Artificial Sequence: Synthetic oligonucleotide
  Target: SCN10A; (+) strand; PAM type: YTN; PAM sequence: TTT
ttagcattaggagaaatacc

SEQ ID NO: 57818 - DNA, 20 bp, Artificial Sequence
  Description of Artificial Sequence: Synthetic oligonucleotide
  Target: SCN10A; (+) strand; PAM type: YTN; PAM sequence: TTT
tagcattaggagaaatacct

SEQ ID NO: 57819 - DNA, 20 bp, Artificial Sequence
  Description of Artificial Sequence: Synthetic oligonucleotide
  Target: SCN10A; (+) strand; PAM type: YTN; PAM sequence: TTT
agcattaggagaaataccta

SEQ ID NO: 57820 - DNA, 20 bp, Artificial Sequence
  Description of Artificial Sequence: Synthetic oligonucleotide
  Target: SCN10A; (+) strand; PAM type: YTN; PAM sequence: TTA
gcattaggagaaatacctaa

SEQ ID NO: 57821 - DNA, 20 bp, Artificial Sequence
  Description of Artificial Sequence: Synthetic oligonucleotide
  Target: SCN10A; (+) strand; PAM type: YTN; PAM sequence: TTA
ggagaaatacctaatgtaga

SEQ ID NO: 57822 - DNA, 20 bp, Artificial Sequence
  Description of Artificial Sequence: Synthetic oligonucleotide
  Target: SCN10A; (+) strand; PAM type: YTN; PAM sequence: CTA
atgtagatgacgggttgatg

SEQ ID NO: 57823 - DNA, 20 bp, Artificial Sequence
  Description of Artificial Sequence: Synthetic oligonucleotide
  Target: SCN10A; (+) strand; PAM type: YTN; PAM sequence: TTG
atgggtgcagcaaaccaaca

SEQ ID NO: 57824 - DNA, 20 bp, Artificial Sequence
  Description of Artificial Sequence: Synthetic oligonucleotide
  Target: SCN10A; (+) strand; PAM type: YTN; PAM sequence: CTA
tataacaaacatgtacattg

SEQ ID NO: 57825 - DNA, 20 bp, Artificial Sequence
  Description of Artificial Sequence: Synthetic oligonucleotide
  Target: SCN10A; (+) strand; PAM type: YTN; PAM sequence: TTG
tgcacatgtaccctagaatt

SEQ ID NO: 57826 - DNA, 20 bp, Artificial Sequence
  Description of Artificial Sequence: Synthetic oligonucleotide
  Target: SCN10A; (+) strand; PAM type: YTN; PAM sequence: CTA
gaatttaaagtataatttta

SEQ ID NO: 57827 - DNA, 20 bp, Artificial Sequence
  Description of Artificial Sequence: Synthetic oligonucleotide
  Target: SCN10A; (+) strand; PAM type: YTN; PAM sequence: TTT
aaagtataattttaaaaaaa

SEQ ID NO: 57828 - DNA, 20 bp, Artificial Sequence
  Description of Artificial Sequence: Synthetic oligonucleotide
  Target: SCN10A; (+) strand; PAM type: YTN; PAM sequence: TTA
aagtataattttaaaaaaag

SEQ ID NO: 57829 - DNA, 20 bp, Artificial Sequence
  Description of Artificial Sequence: Synthetic oligonucleotide
  Target: SCN10A; (+) strand; PAM type: YTN; PAM sequence: TTT
taaaaaaagaaaaaaaagga

SEQ ID NO: 57830 - DNA, 20 bp, Artificial Sequence
  Description of Artificial Sequence: Synthetic oligonucleotide
  Target: SCN10A; (+) strand; PAM type: YTN; PAM sequence: TTT
aaaaaaagaaaaaaaaggaa

SEQ ID NO: 57831 - DNA, 20 bp, Artificial Sequence
  Description of Artificial Sequence: Synthetic oligonucleotide
  Target: SCN10A; (+) strand; PAM type: YTN; PAM sequence: TTA
aaaaaagaaaaaaaaggaat

SEQ ID NO: 57832 - DNA, 20 bp, Artificial Sequence
  Description of Artificial Sequence: Synthetic oligonucleotide
  Target: SCN10A; (+) strand; PAM type: YTN; PAM sequence: TTG
tctttttaatttatttgtaa

SEQ ID NO: 57833 - DNA, 20 bp, Artificial Sequence
  Description of Artificial Sequence: Synthetic oligonucleotide
  Target: SCN10A; (+) strand; PAM type: YTN; PAM sequence: CTT
tttaatttatttgtaaacct

SEQ ID NO: 57834 - DNA, 20 bp, Artificial Sequence
  Description of Artificial Sequence: Synthetic oligonucleotide
  Target: SCN10A; (+) strand; PAM type: YTN; PAM sequence: TTT
ttaatttatttgtaaacctt

SEQ ID NO: 57835 - DNA, 20 bp, Artificial Sequence
  Description of Artificial Sequence: Synthetic oligonucleotide
  Target: SCN10A; (+) strand; PAM type: YTN; PAM sequence: TTT
taatttatttgtaaaccttc

SEQ ID NO: 57836 - DNA, 20 bp, Artificial Sequence
  Description of Artificial Sequence: Synthetic oligonucleotide
  Target: SCN10A; (+) strand; PAM type: YTN; PAM sequence: TTT
aatttatttgtaaaccttca

SEQ ID NO: 57837 - DNA, 20 bp, Artificial Sequence
  Description of Artificial Sequence: Synthetic oligonucleotide
  Target: SCN10A; (+) strand; PAM type: YTN; PAM sequence: TTA
atttatttgtaaaccttcag

SEQ ID NO: 57838 - DNA, 20 bp, Artificial Sequence
  Description of Artificial Sequence: Synthetic oligonucleotide
  Target: SCN10A; (+) strand; PAM type: YTN; PAM sequence: TTT
atttgtaaaccttcagcctg

SEQ ID NO: 57839 - DNA, 20 bp, Artificial Sequence
  Description of Artificial Sequence: Synthetic oligonucleotide
  Target: SCN10A; (+) strand; PAM type: YTN; PAM sequence: TTA
tttgtaaaccttcagcctgt

SEQ ID NO: 57840 - DNA, 20 bp, Artificial Sequence
  Description of Artificial Sequence: Synthetic oligonucleotide
  Target: SCN10A; (+) strand; PAM type: YTN; PAM sequence: TTT
gtaaaccttcagcctgtgtt

SEQ ID NO: 57841 - DNA, 20 bp, Artificial Sequence
  Description of Artificial Sequence: Synthetic oligonucleotide
  Target: SCN10A; (+) strand; PAM type: YTN; PAM sequence: TTG
taaaccttcagcctgtgttc

SEQ ID NO: 57842 - DNA, 20 bp, Artificial Sequence
  Description of Artificial Sequence: Synthetic oligonucleotide
  Target: SCN10A; (+) strand; PAM type: YTN; PAM sequence: CTT
cagcctgtgttcagctccag

SEQ ID NO: 57843 - DNA, 20 bp, Artificial Sequence
  Description of Artificial Sequence: Synthetic oligonucleotide
  Target: SCN10A; (+) strand; PAM type: YTN; PAM sequence: TTC
agcctgtgttcagctccaga

SEQ ID NO: 57844 - DNA, 20 bp, Artificial Sequence
  Description of Artificial Sequence: Synthetic oligonucleotide
  Target: SCN10A; (+) strand; PAM type: YTN; PAM sequence: CTG
tgttcagctccagactgaag

SEQ ID NO: 57845 - DNA, 20 bp, Artificial Sequence
  Description of Artificial Sequence: Synthetic oligonucleotide
  Target: SCN10A; (+) strand; PAM type: YTN; PAM sequence: TTC
agctccagactgaagatctg

SEQ ID NO: 57846 - DNA, 20 bp, Artificial Sequence
  Description of Artificial Sequence: Synthetic oligonucleotide
  Target: SCN10A; (+) strand; PAM type: YTN; PAM sequence: CTC
cagactgaagatctgtctta

SEQ ID NO: 57847 - DNA, 20 bp, Artificial Sequence
  Description of Artificial Sequence: Synthetic oligonucleotide
  Target: SCN10A; (+) strand; PAM type: YTN; PAM sequence: CTG
aagatctgtcttatcttgca

SEQ ID NO: 57848 - DNA, 20 bp, Artificial Sequence
  Description of Artificial Sequence: Synthetic oligonucleotide
  Target: SCN10A; (+) strand; PAM type: YTN; PAM sequence: CTG
tcttatcttgcatccctaac

SEQ ID NO: 57849 - DNA, 20 bp, Artificial Sequence
  Description of Artificial Sequence: Synthetic oligonucleotide
  Target: SCN10A; (+) strand; PAM type: YTN; PAM sequence: CTT
atcttgcatccctaacactt

SEQ ID NO: 57850 - DNA, 20 bp, Artificial Sequence
  Description of Artificial Sequence: Synthetic oligonucleotide
  Target: SCN10A; (+) strand; PAM type: YTN; PAM sequence: TTA
tcttgcatccctaacactta

SEQ ID NO: 57851 - DNA, 20 bp, Artificial Sequence
  Description of Artificial Sequence: Synthetic oligonucleotide
  Target: SCN10A; (+) strand; PAM type: YTN; PAM sequence: CTT
gcatccctaacacttaggaa

SEQ ID NO: 57852 - DNA, 20 bp, Artificial Sequence
  Description of Artificial Sequence: Synthetic oligonucleotide
  Target: SCN10A; (+) strand; PAM type: YTN; PAM sequence: TTG
catccctaacacttaggaaa

SEQ ID NO: 57853 - DNA, 20 bp, Artificial Sequence
  Description of Artificial Sequence: Synthetic oligonucleotide
  Target: SCN10A; (+) strand; PAM type: YTN; PAM sequence: CTA
acacttaggaaagtgacttc

SEQ ID NO: 57854 - DNA, 20 bp, Artificial Sequence
  Description of Artificial Sequence: Synthetic oligonucleotide
  Target: SCN10A; (+) strand; PAM type: YTN; PAM sequence: CTT
aggaaagtgacttcactttt

SEQ ID NO: 57855 - DNA, 20 bp, Artificial Sequence
  Description of Artificial Sequence: Synthetic oligonucleotide
  Target: SCN10A; (+) strand; PAM type: YTN; PAM sequence: TTA
ggaaagtgacttcacttttg

SEQ ID NO: 57856 - DNA, 20 bp, Artificial Sequence
  Description of Artificial Sequence: Synthetic oligonucleotide
  Target: SCN10A; (+) strand; PAM type: YTN; PAM sequence: CTT
cacttttgtcttaagcaaat

SEQ ID NO: 57857 - DNA, 20 bp, Artificial Sequence
  Description of Artificial Sequence: Synthetic oligonucleotide
  Target: SCN10A; (+) strand; PAM type: YTN; PAM sequence: TTC
acttttgtcttaagcaaatg

SEQ ID NO: 57858 - DNA, 20 bp, Artificial Sequence
  Description of Artificial Sequence: Synthetic oligonucleotide
  Target: SCN10A; (+) strand; PAM type: YTN; PAM sequence: CTT
ttgtcttaagcaaatgctcc

SEQ ID NO: 57859 - DNA, 20 bp, Artificial Sequence
  Description of Artificial Sequence: Synthetic oligonucleotide
  Target: SCN10A; (+) strand; PAM type: YTN; PAM sequence: TTT
tgtcttaagcaaatgctcca

SEQ ID NO: 57860 - DNA, 20 bp, Artificial Sequence
  Description of Artificial Sequence: Synthetic oligonucleotide
  Target: SCN10A; (+) strand; PAM type: YTN; PAM sequence: TTT
gtcttaagcaaatgctccag

SEQ ID NO: 57861 - DNA, 20 bp, Artificial Sequence
  Description of Artificial Sequence: Synthetic oligonucleotide
  Target: SCN10A; (+) strand; PAM type: YTN; PAM sequence: TTG
tcttaagcaaatgctccagc

SEQ ID NO: 57862 - DNA, 20 bp, Artificial Sequence
  Description of Artificial Sequence: Synthetic oligonucleotide
  Target: SCN10A; (+) strand; PAM type: YTN; PAM sequence: CTT
aagcaaatgctccagcacac

SEQ ID NO: 57863 - DNA, 20 bp, Artificial Sequence
  Description of Artificial Sequence: Synthetic oligonucleotide
  Target: SCN10A; (+) strand; PAM type: YTN; PAM sequence: TTA
agcaaatgctccagcacacc

SEQ ID NO: 57864 - DNA, 20 bp, Artificial Sequence
  Description of Artificial Sequence: Synthetic oligonucleotide
  Target: SCN10A; (+) strand; PAM type: YTN; PAM sequence: CTC
cagcacaccagggctctgcc

SEQ ID NO: 57865 - DNA, 20 bp, Artificial Sequence
  Description of Artificial Sequence: Synthetic oligonucleotide
  Target: SCN10A; (+) strand; PAM type: YTN; PAM sequence: CTC
tgccgatacctactattctg

SEQ ID NO: 57866 - DNA, 20 bp, Artificial Sequence
  Description of Artificial Sequence: Synthetic oligonucleotide
  Target: SCN10A; (+) strand; PAM type: YTN; PAM sequence: CTG
ccgatacctactattctgtg

SEQ ID NO: 57867 - DNA, 20 bp, Artificial Sequence
  Description of Artificial Sequence: Synthetic oligonucleotide
  Target: SCN10A; (+) strand; PAM type: YTN; PAM sequence: CTA
ctattctgtgttaagtggat

SEQ ID NO: 57868 - DNA, 20 bp, Artificial Sequence
  Description of Artificial Sequence: Synthetic oligonucleotide
  Target: SCN10A; (+) strand; PAM type: YTN; PAM sequence: CTA
ttctgtgttaagtggatgtt

SEQ ID NO: 57869 - DNA, 20 bp, Artificial Sequence
  Description of Artificial Sequence: Synthetic oligonucleotide
  Target: SCN10A; (+) strand; PAM type: YTN; PAM sequence: TTC
tgtgttaagtggatgttctg

SEQ ID NO: 57870 - DNA, 20 bp, Artificial Sequence
  Description of Artificial Sequence: Synthetic oligonucleotide
  Target: SCN10A; (+) strand; PAM type: YTN; PAM sequence: CTG
tgttaagtggatgttctgaa

SEQ ID NO: 57871 - DNA, 20 bp, Artificial Sequence
  Description of Artificial Sequence: Synthetic oligonucleotide
  Target: SCN10A; (+) strand; PAM type: YTN; PAM sequence: TTA
agtggatgttctgaatgtta

SEQ ID NO: 57872 - DNA, 20 bp, Artificial Sequence
  Description of Artificial Sequence: Synthetic oligonucleotide
  Target: SCN10A; (+) strand; PAM type: YTN; PAM sequence: TTC
tgaatgttatttgccatctg

SEQ ID NO: 57873 - DNA, 20 bp, Artificial Sequence
  Description of Artificial Sequence: Synthetic oligonucleotide
  Target: SCN10A; (+) strand; PAM type: YTN; PAM sequence: CTG
aatgttatttgccatctgtg

SEQ ID NO: 57874 - DNA, 20 bp, Artificial Sequence
  Description of Artificial Sequence: Synthetic oligonucleotide
  Target: SCN10A; (+) strand; PAM type: YTN; PAM sequence: TTA
tttgccatctgtgtctatgt

SEQ ID NO: 57875 - DNA, 20 bp, Artificial Sequence
  Description of Artificial Sequence: Synthetic oligonucleotide
  Target: SCN10A; (+) strand; PAM type: YTN; PAM sequence: TTT
gccatctgtgtctatgtgtt

SEQ ID NO: 57876 - DNA, 20 bp, Artificial Sequence
  Description of Artificial Sequence: Synthetic oligonucleotide
  Target: SCN10A; (+) strand; PAM type: YTN; PAM sequence: TTG
ccatctgtgtctatgtgtta

SEQ ID NO: 57877 - DNA, 20 bp, Artificial Sequence
  Description of Artificial Sequence: Synthetic oligonucleotide
  Target: SCN10A; (+) strand; PAM type: YTN; PAM sequence: CTG
tgtctatgtgttatgcagtt

SEQ ID NO: 57878 - DNA, 20 bp, Artificial Sequence
  Description of Artificial Sequence: Synthetic oligonucleotide
  Target: SCN10A; (+) strand; PAM type: YTN; PAM sequence: CTA
tgtgttatgcagtttaatgg

SEQ ID NO: 57879 - DNA, 20 bp, Artificial Sequence
  Description of Artificial Sequence: Synthetic oligonucleotide
  Target: SCN10A; (+) strand; PAM type: YTN; PAM sequence: TTA
tgcagtttaatggtataaaa

SEQ ID NO: 57880 - DNA, 20 bp, Artificial Sequence
  Description of Artificial Sequence: Synthetic oligonucleotide
  Target: SCN10A; (+) strand; PAM type: YTN; PAM sequence: TTT
aatggtataaaaagttaggg

SEQ ID NO: 57881 - DNA, 20 bp, Artificial Sequence
  Description of Artificial Sequence: Synthetic oligonucleotide
  Target: SCN10A; (+) strand; PAM type: YTN; PAM sequence: TTA
atggtataaaaagttagggc

SEQ ID NO: 57882 - DNA, 20 bp, Artificial Sequence
  Description of Artificial Sequence: Synthetic oligonucleotide
  Target: SCN10A; (+) strand; PAM type: YTN; PAM sequence: TTA
gggcggtgtttatggtggag

SEQ ID NO: 57883 - DNA, 20 bp, Artificial Sequence
  Description of Artificial Sequence: Synthetic oligonucleotide
  Target: SCN10A; (+) strand; PAM type: YTN; PAM sequence: TTT
atggtggaggcatacttttg

SEQ ID NO: 57884 - DNA, 20 bp, Artificial Sequence
  Description of Artificial Sequence: Synthetic oligonucleotide
  Target: SCN10A; (+) strand; PAM type: YTN; PAM sequence: TTA
tggtggaggcatacttttga

SEQ ID NO: 57885 - DNA, 20 bp, Artificial Sequence
  Description of Artificial Sequence: Synthetic oligonucleotide
  Target: SCN10A; (+) strand; PAM type: YTN; PAM sequence: CTT
ttgagaacttgcaggttcca

SEQ ID NO: 57886 - DNA, 20 bp, Artificial Sequence
  Description of Artificial Sequence: Synthetic oligonucleotide
  Target: SCN10A; (+) strand; PAM type: YTN; PAM sequence: TTT
tgagaacttgcaggttccag

SEQ ID NO: 57887 - DNA, 20 bp, Artificial Sequence
  Description of Artificial Sequence: Synthetic oligonucleotide
  Target: SCN10A; (+) strand; PAM type: YTN; PAM sequence: TTT
gagaacttgcaggttccaga

SEQ ID NO: 57888 - DNA, 20 bp, Artificial Sequence
  Description of Artificial Sequence: Synthetic oligonucleotide
  Target: SCN10A; (+) strand; PAM type: YTN; PAM sequence: TTG
agaacttgcaggttccagat

SEQ ID NO: 57889 - DNA, 20 bp, Artificial Sequence
  Description of Artificial Sequence: Synthetic oligonucleotide
  Target: SCN10A; (+) strand; PAM type: YTN; PAM sequence: CTT
gcaggttccagatatttgta

SEQ ID NO: 57890 - DNA, 20 bp, Artificial Sequence
  Description of Artificial Sequence: Synthetic oligonucleotide
  Target: SCN10A; (+) strand; PAM type: YTN; PAM sequence: TTG
caggttccagatatttgtac

SEQ ID NO: 57891 - DNA, 20 bp, Artificial Sequence
  Description of Artificial Sequence: Synthetic oligonucleotide
  Target: SCN10A; (+) strand; PAM type: YTN; PAM sequence: TTC
cagatatttgtacagtcagc

SEQ ID NO: 57892 - DNA, 20 bp, Artificial Sequence
  Description of Artificial Sequence: Synthetic oligonucleotide
  Target: SCN10A; (+) strand; PAM type: YTN; PAM sequence: TTT
gtacagtcagcatcattatc

SEQ ID NO: 57893 - DNA, 20 bp, Artificial Sequence
  Description of Artificial Sequence: Synthetic oligonucleotide
  Target: SCN10A; (+) strand; PAM type: YTN; PAM sequence: TTG
tacagtcagcatcattatcc

SEQ ID NO: 57894 - DNA, 20 bp, Artificial Sequence
  Description of Artificial Sequence: Synthetic oligonucleotide
  Target: SCN10A; (+) strand; PAM type: YTN; PAM sequence: TTA
tcctgtctcttatctccctt

SEQ ID NO: 57895 - DNA, 20 bp, Artificial Sequence
  Description of Artificial Sequence: Synthetic oligonucleotide
  Target: SCN10A; (+) strand; PAM type: YTN; PAM sequence: CTG
tctcttatctcccttcagtg

SEQ ID NO: 57896 - DNA, 20 bp, Artificial Sequence
  Description of Artificial Sequence: Synthetic oligonucleotide
  Target: SCN10A; (+) strand; PAM type: YTN; PAM sequence: CTC
ttatctcccttcagtgctaa

SEQ ID NO: 57897 - DNA, 20 bp, Artificial Sequence
  Description of Artificial Sequence: Synthetic oligonucleotide
  Target: SCN10A; (+) strand; PAM type: YTN; PAM sequence: CTT
atctcccttcagtgctaagg

SEQ ID NO: 57898 - DNA, 20 bp, Artificial Sequence
  Description of Artificial Sequence: Synthetic oligonucleotide
  Target: SCN10A; (+) strand; PAM type: YTN; PAM sequence: TTA
tctcccttcagtgctaaggt

SEQ ID NO: 57899 - DNA, 20 bp, Artificial Sequence
  Description of Artificial Sequence: Synthetic oligonucleotide
  Target: SCN10A; (+) strand; PAM type: YTN; PAM sequence: CTC
ccttcagtgctaaggtatcc

SEQ ID NO: 57900 - DNA, 20 bp, Artificial Sequence
  Description of Artificial Sequence: Synthetic oligonucleotide
  Target: SCN10A; (+) strand; PAM type: YTN; PAM sequence: CTT
cagtgctaaggtatcctcac

SEQ ID NO: 57901 - DNA, 20 bp, Artificial Sequence
  Description of Artificial Sequence: Synthetic oligonucleotide
  Target: SCN10A; (+) strand; PAM type: YTN; PAM sequence: TTC
agtgctaaggtatcctcaca

SEQ ID NO: 57902 - DNA, 20 bp, Artificial Sequence
  Description of Artificial Sequence: Synthetic oligonucleotide
  Target: SCN10A; (+) strand; PAM type: YTN; PAM sequence: CTA
aggtatcctcacattctggg

SEQ ID NO: 57903 - DNA, 20 bp, Artificial Sequence
  Description of Artificial Sequence: Synthetic oligonucleotide
  Target: SCN10A; (+) strand; PAM type: YTN; PAM sequence: CTC
acattctgggccagagagat

SEQ ID NO: 57904 - DNA, 20 bp, Artificial Sequence
  Description of Artificial Sequence: Synthetic oligonucleotide
  Target: SCN10A; (+) strand; PAM type: YTN; PAM sequence: TTC
tgggccagagagattctagt

SEQ ID NO: 57905 - DNA, 20 bp, Artificial Sequence
  Description of Artificial Sequence: Synthetic oligonucleotide
  Target: SCN10A; (+) strand; PAM type: YTN; PAM sequence: CTG
ggccagagagattctagttt

SEQ ID NO: 57906 - DNA, 20 bp, Artificial Sequence
  Description of Artificial Sequence: Synthetic oligonucleotide
  Target: SCN10A; (+) strand; PAM type: YTN; PAM sequence: TTC
tagttttacctcttgtgggt

SEQ ID NO: 57907 - DNA, 20 bp, Artificial Sequence
  Description of Artificial Sequence: Synthetic oligonucleotide
  Target: SCN10A; (+) strand; PAM type: YTN; PAM sequence: CTA
gttttacctcttgtgggtgg

SEQ ID NO: 57908 - DNA, 20 bp, Artificial Sequence
  Description of Artificial Sequence: Synthetic oligonucleotide
  Target: SCN10A; (+) strand; PAM type: YTN; PAM sequence: TTT
tacctcttgtgggtggggtt

SEQ ID NO: 57909 - DNA, 20 bp, Artificial Sequence
  Description of Artificial Sequence: Synthetic oligonucleotide
  Target: SCN10A; (+) strand; PAM type: YTN; PAM sequence: TTT
acctcttgtgggtggggttg

SEQ ID NO: 57910 - DNA, 20 bp, Artificial Sequence
  Description of Artificial Sequence: Synthetic oligonucleotide
  Target: SCN10A; (+) strand; PAM type: YTN; PAM sequence: TTA
cctcttgtgggtggggttga

SEQ ID NO: 57911 - DNA, 20 bp, Artificial Sequence
  Description of Artificial Sequence: Synthetic oligonucleotide
  Target: SCN10A; (+) strand; PAM type: YTN; PAM sequence: CTC
ttgtgggtggggttgagaag

SEQ ID NO: 57912 - DNA, 20 bp, Artificial Sequence
  Description of Artificial Sequence: Synthetic oligonucleotide
  Target: SCN10A; (+) strand; PAM type: YTN; PAM sequence: CTT
gtgggtggggttgagaaggt

SEQ ID NO: 57913 - DNA, 20 bp, Artificial Sequence
  Description of Artificial Sequence: Synthetic oligonucleotide
  Target: SCN10A; (+) strand; PAM type: YTN; PAM sequence: TTG
tgggtggggttgagaaggta

SEQ ID NO: 57914 - DNA, 20 bp, Artificial Sequence
  Description of Artificial Sequence: Synthetic oligonucleotide
  Target: SCN10A; (+) strand; PAM type: YTN; PAM sequence: TTG
agaaggtagctctggttctc

SEQ ID NO: 57915 - DNA, 20 bp, Artificial Sequence
  Description of Artificial Sequence: Synthetic oligonucleotide
  Target: SCN10A; (+) strand; PAM type: YTN; PAM sequence: CTC
tggttctcaggttggctccc

SEQ ID NO: 57916 - DNA, 20 bp, Artificial Sequence
  Description of Artificial Sequence: Synthetic oligonucleotide
  Target: SCN10A; (+) strand; PAM type: YTN; PAM sequence: CTG
gttctcaggttggctcccat

SEQ ID NO: 57917 - DNA, 20 bp, Artificial Sequence
  Description of Artificial Sequence: Synthetic oligonucleotide
  Target: SCN10A; (+) strand; PAM type: YTN; PAM sequence: TTC
tcaggttggctcccatggaa

SEQ ID NO: 57918 - DNA, 20 bp, Artificial Sequence
  Description of Artificial Sequence: Synthetic oligonucleotide
  Target: SCN10A; (+) strand; PAM type: YTN; PAM sequence: CTC
aggttggctcccatggaaat

SEQ ID NO: 57919 - DNA, 20 bp, Artificial Sequence
  Description of Artificial Sequence: Synthetic oligonucleotide
  Target: SCN10A; (+) strand; PAM type: YTN; PAM sequence: TTG
gctcccatggaaatctagtt

SEQ ID NO: 57920 - DNA, 20 bp, Artificial Sequence
  Description of Artificial Sequence: Synthetic oligonucleotide
  Target: SCN10A; (+) strand; PAM type: YTN; PAM sequence: CTC
ccatggaaatctagtttcta

SEQ ID NO: 57921 - DNA, 20 bp, Artificial Sequence
  Description of Artificial Sequence: Synthetic oligonucleotide
  Target: SCN10A; (+) strand; PAM type: YTN; PAM sequence: CTA
gtttctaccttgtaattgta

SEQ ID NO: 57922 - DNA, 20 bp, Artificial Sequence
  Description of Artificial Sequence: Synthetic oligonucleotide
  Target: SCN10A; (+) strand; PAM type: YTN; PAM sequence: TTT
ctaccttgtaattgtaccac

SEQ ID NO: 57923 - DNA, 20 bp, Artificial Sequence
  Description of Artificial Sequence: Synthetic oligonucleotide
  Target: SCN10A; (+) strand; PAM type: YTN; PAM sequence: TTC
taccttgtaattgtaccacc

SEQ ID NO: 57924 - DNA, 20 bp, Artificial Sequence
  Description of Artificial Sequence: Synthetic oligonucleotide
  Target: SCN10A; (+) strand; PAM type: YTN; PAM sequence: CTA
ccttgtaattgtaccaccag

SEQ ID NO: 57925 - DNA, 20 bp, Artificial Sequence
  Description of Artificial Sequence: Synthetic oligonucleotide
  Target: SCN10A; (+) strand; PAM type: YTN; PAM sequence: CTT
gtaattgtaccaccaggtga

SEQ ID NO: 57926 - DNA, 20 bp, Artificial Sequence
  Description of Artificial Sequence: Synthetic oligonucleotide
  Target: SCN10A; (+) strand; PAM type: YTN; PAM sequence: TTG
taattgtaccaccaggtgaa

SEQ ID NO: 57927 - DNA, 20 bp, Artificial Sequence
  Description of Artificial Sequence: Synthetic oligonucleotide
  Target: SCN10A; (+) strand; PAM type: YTN; PAM sequence: TTG
taccaccaggtgaacttgga

SEQ ID NO: 57928 - DNA, 20 bp, Artificial Sequence
  Description of Artificial Sequence: Synthetic oligonucleotide
  Target: SCN10A; (+) strand; PAM type: YTN; PAM sequence: CTT
ggaaactggctctagtgaaa

SEQ ID NO: 57929 - DNA, 20 bp, Artificial Sequence
  Description of Artificial Sequence: Synthetic oligonucleotide
  Target: SCN10A; (+) strand; PAM type: YTN; PAM sequence: TTG
gaaactggctctagtgaaat

SEQ ID NO: 57930 - DNA, 20 bp, Artificial Sequence
  Description of Artificial Sequence: Synthetic oligonucleotide
  Target: SCN10A; (+) strand; PAM type: YTN; PAM sequence: CTG
gctctagtgaaattttcaaa

SEQ ID NO: 57931 - DNA, 20 bp, Artificial Sequence
  Description of Artificial Sequence: Synthetic oligonucleotide
  Target: SCN10A; (+) strand; PAM type: YTN; PAM sequence: CTC
tagtgaaattttcaaaagat

SEQ ID NO: 57932 - DNA, 20 bp, Artificial Sequence
  Description of Artificial Sequence: Synthetic oligonucleotide
  Target: SCN10A; (+) strand; PAM type: YTN; PAM sequence: CTA
gtgaaattttcaaaagataa

SEQ ID NO: 57933 - DNA, 20 bp, Artificial Sequence
  Description of Artificial Sequence: Synthetic oligonucleotide
  Target: SCN10A; (+) strand; PAM type: YTN; PAM sequence: TTT
tcaaaagataatcttgcatt

SEQ ID NO: 57934 - DNA, 20 bp, Artificial Sequence
  Description of Artificial Sequence: Synthetic oligonucleotide
  Target: SCN10A; (+) strand; PAM type: YTN; PAM sequence: TTT
caaaagataatcttgcattt

SEQ ID NO: 57935 - DNA, 20 bp, Artificial Sequence
  Description of Artificial Sequence: Synthetic oligonucleotide
  Target: SCN10A; (+) strand; PAM type: YTN; PAM sequence: TTC
aaaagataatcttgcatttg

SEQ ID NO: 57936 - DNA, 20 bp, Artificial Sequence
  Description of Artificial Sequence: Synthetic oligonucleotide
  Target: SCN10A; (+) strand; PAM type: YTN; PAM sequence: CTT
gcatttggatacatttccaa

SEQ ID NO: 57937 - DNA, 20 bp, Artificial Sequence
  Description of Artificial Sequence: Synthetic oligonucleotide
  Target: SCN10A; (+) strand; PAM type: YTN; PAM sequence: TTG
catttggatacatttccaaa

SEQ ID NO: 57938 - DNA, 20 bp, Artificial Sequence
  Description of Artificial Sequence: Synthetic oligonucleotide
  Target: SCN10A; (+) strand; PAM type: YTN; PAM sequence: TTT
ggatacatttccaaaaactc

SEQ ID NO: 57939 - DNA, 20 bp, Artificial Sequence
  Description of Artificial Sequence: Synthetic oligonucleotide
  Target: SCN10A; (+) strand; PAM type: YTN; PAM sequence: TTG
gatacatttccaaaaactcc

SEQ ID NO: 57940 - DNA, 20 bp, Artificial Sequence
  Description of Artificial Sequence: Synthetic oligonucleotide
  Target: SCN10A; (+) strand; PAM type: YTN; PAM sequence: TTT
ccaaaaactccgtgtcatgc

SEQ ID NO: 57941 - DNA, 20 bp, Artificial Sequence
  Description of Artificial Sequence: Synthetic oligonucleotide
  Target: SCN10A; (+) strand; PAM type: YTN; PAM sequence: TTC
caaaaactccgtgtcatgca

SEQ ID NO: 57942 - DNA, 20 bp, Artificial Sequence
  Description of Artificial Sequence: Synthetic oligonucleotide
  Target: SCN10A; (+) strand; PAM type: YTN; PAM sequence: CTC
cgtgtcatgcaagatgtgta

SEQ ID NO: 57943 - DNA, 20 bp, Artificial Sequence
  Description of Artificial Sequence: Synthetic oligonucleotide
  Target: SCN10A; (+) strand; PAM type: YTN; PAM sequence: TTG
catcccttttccaatgtttc

SEQ ID NO: 57944 - DNA, 20 bp, Artificial Sequence
  Description of Artificial Sequence: Synthetic oligonucleotide
  Target: SCN10A; (+) strand; PAM type: YTN; PAM sequence: CTT
ttccaatgtttcccattaca

SEQ ID NO: 57945 - DNA, 20 bp, Artificial Sequence
  Description of Artificial Sequence: Synthetic oligonucleotide
  Target: SCN10A; (+) strand; PAM type: YTN; PAM sequence: TTT
tccaatgtttcccattacaa

SEQ ID NO: 57946 - DNA, 20 bp, Artificial Sequence
  Description of Artificial Sequence: Synthetic oligonucleotide
  Target: SCN10A; (+) strand; PAM type: YTN; PAM sequence: TTT
ccaatgtttcccattacaat

SEQ ID NO: 57947 - DNA, 20 bp, Artificial Sequence
  Description of Artificial Sequence: Synthetic oligonucleotide
  Target: SCN10A; (+) strand; PAM type: YTN; PAM sequence: TTC
caatgtttcccattacaatt

SEQ ID NO: 57948 - DNA, 20 bp, Artificial Sequence
  Description of Artificial Sequence: Synthetic oligonucleotide
  Target: SCN10A; (+) strand; PAM type: YTN; PAM sequence: TTT
cccattacaatttaggaaat

SEQ ID NO: 57949 - DNA, 20 bp, Artificial Sequence
  Description of Artificial Sequence: Synthetic oligonucleotide
  Target: SCN10A; (+) strand; PAM type: YTN; PAM sequence: TTC
ccattacaatttaggaaatg

SEQ ID NO: 57950 - DNA, 20 bp, Artificial Sequence
  Description of Artificial Sequence: Synthetic oligonucleotide
  Target: SCN10A; (+) strand; PAM type: YTN; PAM sequence: TTA
caatttaggaaatgcatttg

SEQ ID NO: 57951 - DNA, 20 bp, Artificial Sequence
  Description of Artificial Sequence: Synthetic oligonucleotide
  Target: SCN10A; (+) strand; PAM type: YTN; PAM sequence: TTT
aggaaatgcatttgtgcaga

SEQ ID NO: 57952 - DNA, 20 bp, Artificial Sequence
  Description of Artificial Sequence: Synthetic oligonucleotide
  Target: SCN10A; (+) strand; PAM type: YTN; PAM sequence: TTA
ggaaatgcatttgtgcagaa

SEQ ID NO: 57953 - DNA, 20 bp, Artificial Sequence
  Description of Artificial Sequence: Synthetic oligonucleotide
  Target: SCN10A; (+) strand; PAM type: YTN; PAM sequence: TTT
gtgcagaaaaaatgagaaat

SEQ ID NO: 57954 - DNA, 20 bp, Artificial Sequence
  Description of Artificial Sequence: Synthetic oligonucleotide
  Target: SCN10A; (+) strand; PAM type: YTN; PAM sequence: TTG
tgcagaaaaaatgagaaatg

SEQ ID NO: 57955 - DNA, 20 bp, Artificial Sequence
  Description of Artificial Sequence: Synthetic oligonucleotide
  Target: SCN10A; (+) strand; PAM type: YTN; PAM sequence: TTA
gtttccctgggatgctgtaa

SEQ ID NO: 57956 - DNA, 20 bp, Artificial Sequence
  Description of Artificial Sequence: Synthetic oligonucleotide
  Target: SCN10A; (+) strand; PAM type: YTN; PAM sequence: TTT
ccctgggatgctgtaacaaa

SEQ ID NO: 57957 - DNA, 20 bp, Artificial Sequence
  Description of Artificial Sequence: Synthetic oligonucleotide
  Target: SCN10A; (+) strand; PAM type: YTN; PAM sequence: TTC
cctgggatgctgtaacaaat

SEQ ID NO: 57958 - DNA, 20 bp, Artificial Sequence
  Description of Artificial Sequence: Synthetic oligonucleotide
  Target: SCN10A; (+) strand; PAM type: YTN; PAM sequence: CTG
ggatgctgtaacaaattacc

SEQ ID NO: 57959 - DNA, 20 bp, Artificial Sequence
  Description of Artificial Sequence: Synthetic oligonucleotide
  Target: SCN10A; (+) strand; PAM type: YTN; PAM sequence: CTG
taacaaattaccagaaacta

SEQ ID NO: 57960 - DNA, 20 bp, Artificial Sequence
  Description of Artificial Sequence: Synthetic oligonucleotide
  Target: SCN10A; (+) strand; PAM type: YTN; PAM sequence: TTA
ccagaaactaggtagatgac

SEQ ID NO: 57961 - DNA, 20 bp, Artificial Sequence
  Description of Artificial Sequence: Synthetic oligonucleotide
  Target: SCN10A; (+) strand; PAM type: YTN; PAM sequence: CTA
ggtagatgacaataatagaa

SEQ ID NO: 57962 - DNA, 20 bp, Artificial Sequence
  Description of Artificial Sequence: Synthetic oligonucleotide
  Target: SCN10A; (+) strand; PAM type: YTN; PAM sequence: TTT
attctcttacacttctgagg

SEQ ID NO: 57963 - DNA, 20 bp, Artificial Sequence
  Description of Artificial Sequence: Synthetic oligonucleotide
  Target: SCN10A; (+) strand; PAM type: YTN; PAM sequence: TTA
ttctcttacacttctgaggc

SEQ ID NO: 57964 - DNA, 20 bp, Artificial Sequence
  Description of Artificial Sequence: Synthetic oligonucleotide
  Target: SCN10A; (+) strand; PAM type: YTN; PAM sequence: TTC
tcttacacttctgaggctag

SEQ ID NO: 57965 - DNA, 20 bp, Artificial Sequence
  Description of Artificial Sequence: Synthetic oligonucleotide
  Target: SCN10A; (+) strand; PAM type: YTN; PAM sequence: CTC
ttacacttctgaggctagat

SEQ ID NO: 57966 - DNA, 20 bp, Artificial Sequence
  Description of Artificial Sequence: Synthetic oligonucleotide
  Target: SCN10A; (+) strand; PAM type: YTN; PAM sequence: CTT
acacttctgaggctagatgt

SEQ ID NO: 57967 - DNA, 20 bp, Artificial Sequence
  Description of Artificial Sequence: Synthetic oligonucleotide
  Target: SCN10A; (+) strand; PAM type: YTN; PAM sequence: TTA
cacttctgaggctagatgtc

SEQ ID NO: 57968 - DNA, 20 bp, Artificial Sequence
  Description of Artificial Sequence: Synthetic oligonucleotide
  Target: SCN10A; (+) strand; PAM type: YTN; PAM sequence: CTT
ctgaggctagatgtctaaaa

SEQ ID NO: 57969 - DNA, 20 bp, Artificial Sequence
  Description of Artificial Sequence: Synthetic oligonucleotide
  Target: SCN10A; (+) strand; PAM type: YTN; PAM sequence: TTC
tgaggctagatgtctaaaat

SEQ ID NO: 57970 - DNA, 20 bp, Artificial Sequence
  Description of Artificial Sequence: Synthetic oligonucleotide
  Target: SCN10A; (+) strand; PAM type: YTN; PAM sequence: CTG
aggctagatgtctaaaatca

SEQ ID NO: 57971 - DNA, 20 bp, Artificial Sequence
  Description of Artificial Sequence: Synthetic oligonucleotide
  Target: SCN10A; (+) strand; PAM type: YTN; PAM sequence: CTA
gatgtctaaaatcaaggtat

SEQ ID NO: 57972 - DNA, 20 bp, Artificial Sequence
  Description of Artificial Sequence: Synthetic oligonucleotide
  Target: SCN10A; (+) strand; PAM type: YTN; PAM sequence: CTA
aaatcaaggtattggcagag

SEQ ID NO: 57973 - DNA, 20 bp, Artificial Sequence
  Description of Artificial Sequence: Synthetic oligonucleotide
  Target: SCN10A; (+) strand; PAM type: YTN; PAM sequence: TTG
gcagagccatgttccctctg

SEQ ID NO: 57974 - DNA, 20 bp, Artificial Sequence
  Description of Artificial Sequence: Synthetic oligonucleotide
  Target: SCN10A; (+) strand; PAM type: YTN; PAM sequence: TTC
cctctgaagcccgcaggtga

SEQ ID NO: 57975 - DNA, 20 bp, Artificial Sequence
  Description of Artificial Sequence: Synthetic oligonucleotide
  Target: SCN10A; (+) strand; PAM type: YTN; PAM sequence: CTC
tgaagcccgcaggtgagaac

SEQ ID NO: 57976 - DNA, 20 bp, Artificial Sequence
  Description of Artificial Sequence: Synthetic oligonucleotide
  Target: SCN10A; (+) strand; PAM type: YTN; PAM sequence: CTG
aagcccgcaggtgagaaccg

SEQ ID NO: 57977 - DNA, 20 bp, Artificial Sequence
  Description of Artificial Sequence: Synthetic oligonucleotide
  Target: SCN10A; (+) strand; PAM type: YTN; PAM sequence: TTG
ccttccatgtctcctcctag

SEQ ID NO: 57978 - DNA, 20 bp, Artificial Sequence
  Description of Artificial Sequence: Synthetic oligonucleotide
  Target: SCN10A; (+) strand; PAM type: YTN; PAM sequence: CTT
ccatgtctcctcctagcttc

SEQ ID NO: 57979 - DNA, 20 bp, Artificial Sequence
  Description of Artificial Sequence: Synthetic oligonucleotide
  Target: SCN10A; (+) strand; PAM type: YTN; PAM sequence: TTC
catgtctcctcctagcttca

SEQ ID NO: 57980 - DNA, 20 bp, Artificial Sequence
  Description of Artificial Sequence: Synthetic oligonucleotide
  Target: SCN10A; (+) strand; PAM type: YTN; PAM sequence: CTC
ctcctagcttcagcaatctt

SEQ ID NO: 57981 - DNA, 20 bp, Artificial Sequence
  Description of Artificial Sequence: Synthetic oligonucleotide
  Target: SCN10A; (+) strand; PAM type: YTN; PAM sequence: CTC
ctagcttcagcaatctttgc

SEQ ID NO: 57982 - DNA, 20 bp, Artificial Sequence
  Description of Artificial Sequence: Synthetic oligonucleotide
  Target: SCN10A; (+) strand; PAM type: YTN; PAM sequence: CTA
gcttcagcaatctttgccat

SEQ ID NO: 57983 - DNA, 20 bp, Artificial Sequence
  Description of Artificial Sequence: Synthetic oligonucleotide
  Target: SCN10A; (+) strand; PAM type: YTN; PAM sequence: CTT
cagcaatctttgccattcct

SEQ ID NO: 57984 - DNA, 20 bp, Artificial Sequence
  Description of Artificial Sequence: Synthetic oligonucleotide
  Target: SCN10A; (+) strand; PAM type: YTN; PAM sequence: TTC
agcaatctttgccattcctt

SEQ ID NO: 57985 - DNA, 20 bp, Artificial Sequence
  Description of Artificial Sequence: Synthetic oligonucleotide
  Target: SCN10A; (+) strand; PAM type: YTN; PAM sequence: CTT
tgccattccttggcctgcac

SEQ ID NO: 57986 - DNA, 20 bp, Artificial Sequence
  Description of Artificial Sequence: Synthetic oligonucleotide
  Target: SCN10A; (+) strand; PAM type: YTN; PAM sequence: TTT
gccattccttggcctgcaca

SEQ ID NO: 57987 - DNA, 20 bp, Artificial Sequence
  Description of Artificial Sequence: Synthetic oligonucleotide
  Target: SCN10A; (+) strand; PAM type: YTN; PAM sequence: TTG
ccattccttggcctgcacat

SEQ ID NO: 57988 - DNA, 20 bp, Artificial Sequence
  Description of Artificial Sequence: Synthetic oligonucleotide
  Target: SCN10A; (+) strand; PAM type: YTN; PAM sequence: TTC
cttggcctgcacatgtatct

SEQ ID NO: 57989 - DNA, 20 bp, Artificial Sequence
  Description of Artificial Sequence: Synthetic oligonucleotide
  Target: SCN10A; (+) strand; PAM type: YTN; PAM sequence: CTT
ggcctgcacatgtatctctc

SEQ ID NO: 57990 - DNA, 20 bp, Artificial Sequence
  Description of Artificial Sequence: Synthetic oligonucleotide
  Target: SCN10A; (+) strand; PAM type: YTN; PAM sequence: TTG
gcctgcacatgtatctctcc

SEQ ID NO: 57991 - DNA, 20 bp, Artificial Sequence
  Description of Artificial Sequence: Synthetic oligonucleotide
  Target: SCN10A; (+) strand; PAM type: YTN; PAM sequence: CTG
cacatgtatctctccgattt

SEQ ID NO: 57992 - DNA, 20 bp, Artificial Sequence
  Description of Artificial Sequence: Synthetic oligonucleotide
  Target: SCN10A; (+) strand; PAM type: YTN; PAM sequence: CTC
tccgatttcttcctgtgtct

SEQ ID NO: 57993 - DNA, 20 bp, Artificial Sequence
  Description of Artificial Sequence: Synthetic oligonucleotide
  Target: SCN10A; (+) strand; PAM type: YTN; PAM sequence: CTC
cgatttcttcctgtgtctcc

SEQ ID NO: 57994 - DNA, 20 bp, Artificial Sequence
  Description of Artificial Sequence: Synthetic oligonucleotide
  Target: SCN10A; (+) strand; PAM type: YTN; PAM sequence: TTT
cttcctgtgtctccatacag

SEQ ID NO: 57995 - DNA, 20 bp, Artificial Sequence
  Description of Artificial Sequence: Synthetic oligonucleotide
  Target: SCN10A; (+) strand; PAM type: YTN; PAM sequence: TTC
ttcctgtgtctccatacagc

SEQ ID NO: 57996 - DNA, 20 bp, Artificial Sequence
  Description of Artificial Sequence: Synthetic oligonucleotide
  Target: SCN10A; (+) strand; PAM type: YTN; PAM sequence: CTT
cctgtgtctccatacagctg

SEQ ID NO: 57997 - DNA, 20 bp, Artificial Sequence
  Description of Artificial Sequence: Synthetic oligonucleotide
  Target: SCN10A; (+) strand; PAM type: YTN; PAM sequence: TTC
ctgtgtctccatacagctgt

SEQ ID NO: 57998 - DNA, 20 bp, Artificial Sequence
  Description of Artificial Sequence: Synthetic oligonucleotide
  Target: SCN10A; (+) strand; PAM type: YTN; PAM sequence: CTG
tgtctccatacagctgtctt

SEQ ID NO: 57999 - DNA, 20 bp, Artificial Sequence
  Description of Artificial Sequence: Synthetic oligonucleotide
  Target: SCN10A; (+) strand; PAM type: YTN; PAM sequence: CTC
catacagctgtcttttcttt

SEQ ID NO: 58000 - DNA, 20 bp, Artificial Sequence
  Description of Artificial Sequence: Synthetic oligonucleotide
  Target: SCN10A; (+) strand; PAM type: YTN; PAM sequence: CTG
tcttttctttgtgtgtgttt

SEQ ID NO: 58001 - DNA, 20 bp, Artificial Sequence
  Description of Artificial Sequence: Synthetic oligonucleotide
  Target: SCN10A; (+) strand; PAM type: YTN; PAM sequence: CTT
ttctttgtgtgtgttttttt

SEQ ID NO: 58002 - DNA, 20 bp, Artificial Sequence
  Description of Artificial Sequence: Synthetic oligonucleotide
  Target: SCN10A; (+) strand; PAM type: YTN; PAM sequence: TTT
tctttgtgtgtgtttttttc

SEQ ID NO: 58003 - DNA, 20 bp, Artificial Sequence
  Description of Artificial Sequence: Synthetic oligonucleotide
  Target: SCN10A; (+) strand; PAM type: YTN; PAM sequence: TTT
ctttgtgtgtgtttttttct

SEQ ID NO: 58004 - DNA, 20 bp, Artificial Sequence
  Description of Artificial Sequence: Synthetic oligonucleotide
  Target: SCN10A; (+) strand; PAM type: YTN; PAM sequence: TTC
tttgtgtgtgtttttttctg

SEQ ID NO: 58005 - DNA, 20 bp, Artificial Sequence
  Description of Artificial Sequence: Synthetic oligonucleotide
  Target: SCN10A; (+) strand; PAM type: YTN; PAM sequence: CTT
tgtgtgtgtttttttctgca

SEQ ID NO: 58006 - DNA, 20 bp, Artificial Sequence
  Description of Artificial Sequence: Synthetic oligonucleotide
  Target: SCN10A; (+) strand; PAM type: YTN; PAM sequence: TTT
gtgtgtgtttttttctgcat

SEQ ID NO: 58007 - DNA, 20 bp, Artificial Sequence
  Description of Artificial Sequence: Synthetic oligonucleotide
  Target: SCN10A; (+) strand; PAM type: YTN; PAM sequence: TTG
tgtgtgtttttttctgcatc

SEQ ID NO: 58008 - DNA, 20 bp, Artificial Sequence
  Description of Artificial Sequence: Synthetic oligonucleotide
  Target: SCN10A; (+) strand; PAM type: YTN; PAM sequence: TTT
ttttctgcatcttcccatgg

SEQ ID NO: 58009 - DNA, 20 bp, Artificial Sequence
  Description of Artificial Sequence: Synthetic oligonucleotide
  Target: SCN10A; (+) strand; PAM type: YTN; PAM sequence: TTT
tttctgcatcttcccatggt

SEQ ID NO: 58010 - DNA, 20 bp, Artificial Sequence
  Description of Artificial Sequence: Synthetic oligonucleotide
  Target: SCN10A; (+) strand; PAM type: YTN; PAM sequence: TTT
ttctgcatcttcccatggta

SEQ ID NO: 58011 - DNA, 20 bp, Artificial Sequence
  Description of Artificial Sequence: Synthetic oligonucleotide
  Target: SCN10A; (+) strand; PAM type: YTN; PAM sequence: TTT
tctgcatcttcccatggtat

SEQ ID NO: 58012 - DNA, 20 bp, Artificial Sequence
  Description of Artificial Sequence: Synthetic oligonucleotide
  Target: SCN10A; (+) strand; PAM type: YTN; PAM sequence: TTT
ctgcatcttcccatggtatt

SEQ ID NO: 58013 - DNA, 20 bp, Artificial Sequence
  Description of Artificial Sequence: Synthetic oligonucleotide
  Target: SCN10A; (+) strand; PAM type: YTN; PAM sequence: TTC
tgcatcttcccatggtattc

SEQ ID NO: 58014 - DNA, 20 bp, Artificial Sequence
  Description of Artificial Sequence: Synthetic oligonucleotide
  Target: SCN10A; (+) strand; PAM type: YTN; PAM sequence: CTG
catcttcccatggtattctc

SEQ ID NO: 58015 - DNA, 20 bp, Artificial Sequence
  Description of Artificial Sequence: Synthetic oligonucleotide
  Target: SCN10A; (+) strand; PAM type: YTN; PAM sequence: CTT
cccatggtattctcctctct

SEQ ID NO: 58016 - DNA, 20 bp, Artificial Sequence
  Description of Artificial Sequence: Synthetic oligonucleotide
  Target: SCN10A; (+) strand; PAM type: YTN; PAM sequence: TTC
ccatggtattctcctctctg

SEQ ID NO: 58017 - DNA, 20 bp, Artificial Sequence
  Description of Artificial Sequence: Synthetic oligonucleotide
  Target: SCN10A; (+) strand; PAM type: YTN; PAM sequence: TTC
tcctctctgtgtgtctctgt

SEQ ID NO: 58018 - DNA, 20 bp, Artificial Sequence
  Description of Artificial Sequence: Synthetic oligonucleotide
  Target: SCN10A; (+) strand; PAM type: YTN; PAM sequence: CTC
ctctctgtgtgtctctgttc

SEQ ID NO: 58019 - DNA, 20 bp, Artificial Sequence
  Description of Artificial Sequence: Synthetic oligonucleotide
  Target: SCN10A; (+) strand; PAM type: YTN; PAM sequence: CTC
tctgtgtgtctctgttcaaa

SEQ ID NO: 58020 - DNA, 20 bp, Artificial Sequence
  Description of Artificial Sequence: Synthetic oligonucleotide
  Target: SCN10A; (+) strand; PAM type: YTN; PAM sequence: CTC
tgtgtgtctctgttcaaatt

SEQ ID NO: 58021 - DNA, 20 bp, Artificial Sequence
  Description of Artificial Sequence: Synthetic oligonucleotide
  Target: SCN10A; (+) strand; PAM type: YTN; PAM sequence: CTG
tgtgtctctgttcaaattcc

SEQ ID NO: 58022 - DNA, 20 bp, Artificial Sequence
  Description of Artificial Sequence: Synthetic oligonucleotide
  Target: SCN10A; (+) strand; PAM type: YTN; PAM sequence: CTC
tgttcaaattcccctcatat

SEQ ID NO: 58023 - DNA, 20 bp, Artificial Sequence
  Description of Artificial Sequence: Synthetic oligonucleotide
  Target: SCN10A; (+) strand; PAM type: YTN; PAM sequence: CTG
ttcaaattcccctcatattt

SEQ ID NO: 58024 - DNA, 20 bp, Artificial Sequence
  Description of Artificial Sequence: Synthetic oligonucleotide
  Target: SCN10A; (+) strand; PAM type: YTN; PAM sequence: TTC
aaattcccctcatattttag

SEQ ID NO: 58025 - DNA, 20 bp, Artificial Sequence
  Description of Artificial Sequence: Synthetic oligonucleotide
  Target: SCN10A; (+) strand; PAM type: YTN; PAM sequence: TTC
ccctcatattttagcaacac

SEQ ID NO: 58026 - DNA, 20 bp, Artificial Sequence
  Description of Artificial Sequence: Synthetic oligonucleotide
  Target: SCN10A; (+) strand; PAM type: YTN; PAM sequence: CTC
atattttagcaacaccagtc

SEQ ID NO: 58027 - DNA, 20 bp, Artificial Sequence
  Description of Artificial Sequence: Synthetic oligonucleotide
  Target: SCN10A; (+) strand; PAM type: YTN; PAM sequence: TTT
tagcaacaccagtcattgga

SEQ ID NO: 58028 - DNA, 20 bp, Artificial Sequence
  Description of Artificial Sequence: Synthetic oligonucleotide
  Target: SCN10A; (+) strand; PAM type: YTN; PAM sequence: TTT
agcaacaccagtcattggat

SEQ ID NO: 58029 - DNA, 20 bp, Artificial Sequence
  Description of Artificial Sequence: Synthetic oligonucleotide
  Target: SCN10A; (+) strand; PAM type: YTN; PAM sequence: TTA
gcaacaccagtcattggatt

SEQ ID NO: 58030 - DNA, 20 bp, Artificial Sequence
  Description of Artificial Sequence: Synthetic oligonucleotide
  Target: SCN10A; (+) strand; PAM type: YTN; PAM sequence: TTG
gattagggctcaccttcatc

SEQ ID NO: 58031 - DNA, 20 bp, Artificial Sequence
  Description of Artificial Sequence: Synthetic oligonucleotide
  Target: SCN10A; (+) strand; PAM type: YTN; PAM sequence: TTA
gggctcaccttcatctgaat

SEQ ID NO: 58032 - DNA, 20 bp, Artificial Sequence
  Description of Artificial Sequence: Synthetic oligonucleotide
  Target: SCN10A; (+) strand; PAM type: YTN; PAM sequence: CTC
accttcatctgaatttgttt

SEQ ID NO: 58033 - DNA, 20 bp, Artificial Sequence
  Description of Artificial Sequence: Synthetic oligonucleotide
  Target: SCN10A; (+) strand; PAM type: YTN; PAM sequence: CTT
catctgaatttgtttacatc

SEQ ID NO: 58034 - DNA, 20 bp, Artificial Sequence
  Description of Artificial Sequence: Synthetic oligonucleotide
  Target: SCN10A; (+) strand; PAM type: YTN; PAM sequence: TTC
atctgaatttgtttacatct

SEQ ID NO: 58035 - DNA, 20 bp, Artificial Sequence
  Description of Artificial Sequence: Synthetic oligonucleotide
  Target: SCN10A; (+) strand; PAM type: YTN; PAM sequence: CTG
aatttgtttacatctgcaaa

SEQ ID NO: 58036 - DNA, 20 bp, Artificial Sequence
  Description of Artificial Sequence: Synthetic oligonucleotide
  Target: SCN10A; (+) strand; PAM type: YTN; PAM sequence: TTT
gtttacatctgcaaaaacct

SEQ ID NO: 58037 - DNA, 20 bp, Artificial Sequence
  Description of Artificial Sequence: Synthetic oligonucleotide
  Target: SCN10A; (+) strand; PAM type: YTN; PAM sequence: TTG
tttacatctgcaaaaacctt

SEQ ID NO: 58038 - DNA, 20 bp, Artificial Sequence
  Description of Artificial Sequence: Synthetic oligonucleotide
  Target: SCN10A; (+) strand; PAM type: YTN; PAM sequence: TTT
acatctgcaaaaaccttaat

SEQ ID NO: 58039 - DNA, 20 bp, Artificial Sequence
  Description of Artificial Sequence: Synthetic oligonucleotide
  Target: SCN10A; (+) strand; PAM type: YTN; PAM sequence: TTA
catctgcaaaaaccttaatg

SEQ ID NO: 58040 - DNA, 20 bp, Artificial Sequence
  Description of Artificial Sequence: Synthetic oligonucleotide
  Target: SCN10A; (+) strand; PAM type: YTN; PAM sequence: CTG
caaaaaccttaatgtcaaat

SEQ ID NO: 58041 - DNA, 20 bp, Artificial Sequence
  Description of Artificial Sequence: Synthetic oligonucleotide
  Target: SCN10A; (+) strand; PAM type: YTN; PAM sequence: CTT
aatgtcaaataaggtcacaa

SEQ ID NO: 58042 - DNA, 20 bp, Artificial Sequence
  Description of Artificial Sequence: Synthetic oligonucleotide
  Target: SCN10A; (+) strand; PAM type: YTN; PAM sequence: TTA
atgtcaaataaggtcacaat

SEQ ID NO: 58043 - DNA, 20 bp, Artificial Sequence
  Description of Artificial Sequence: Synthetic oligonucleotide
  Target: SCN10A; (+) strand; PAM type: YTN; PAM sequence: CTA
ttggttagaacttcaacata

SEQ ID NO: 58044 - DNA, 20 bp, Artificial Sequence
  Description of Artificial Sequence: Synthetic oligonucleotide
  Target: SCN10A; (+) strand; PAM type: YTN; PAM sequence: TTG
gttagaacttcaacataccc

SEQ ID NO: 58045 - DNA, 20 bp, Artificial Sequence
  Description of Artificial Sequence: Synthetic oligonucleotide
  Target: SCN10A; (+) strand; PAM type: YTN; PAM sequence: TTA
gaacttcaacataccctttt

SEQ ID NO: 58046 - DNA, 20 bp, Artificial Sequence
  Description of Artificial Sequence: Synthetic oligonucleotide
  Target: SCN10A; (+) strand; PAM type: YTN; PAM sequence: CTT
caacatacccttttagggaa

SEQ ID NO: 58047 - DNA, 20 bp, Artificial Sequence
  Description of Artificial Sequence: Synthetic oligonucleotide
  Target: SCN10A; (+) strand; PAM type: YTN; PAM sequence: TTC
aacatacccttttagggaac

SEQ ID NO: 58048 - DNA, 20 bp, Artificial Sequence
  Description of Artificial Sequence: Synthetic oligonucleotide
  Target: SCN10A; (+) strand; PAM type: YTN; PAM sequence: CTT
ttagggaacattattcaacc

SEQ ID NO: 58049 - DNA, 20 bp, Artificial Sequence
  Description of Artificial Sequence: Synthetic oligonucleotide
  Target: SCN10A; (+) strand; PAM type: YTN; PAM sequence: TTT
tagggaacattattcaaccc

SEQ ID NO: 58050 - DNA, 20 bp, Artificial Sequence
  Description of Artificial Sequence: Synthetic oligonucleotide
  Target: SCN10A; (+) strand; PAM type: YTN; PAM sequence: TTT
agggaacattattcaaccca

SEQ ID NO: 58051 - DNA, 20 bp, Artificial Sequence
  Description of Artificial Sequence: Synthetic oligonucleotide
  Target: SCN10A; (+) strand; PAM type: YTN; PAM sequence: TTA
gggaacattattcaacccaa

SEQ ID NO: 58052 - DNA, 20 bp, Artificial Sequence
  Description of Artificial Sequence: Synthetic oligonucleotide
  Target: SCN10A; (+) strand; PAM type: YTN; PAM sequence: TTA
ttcaacccaaagcataattc

SEQ ID NO: 58053 - DNA, 20 bp, Artificial Sequence
  Description of Artificial Sequence: Synthetic oligonucleotide
  Target: SCN10A; (+) strand; PAM type: YTN; PAM sequence: TTC
aacccaaagcataattcaac

SEQ ID NO: 58054 - DNA, 20 bp, Artificial Sequence
  Description of Artificial Sequence: Synthetic oligonucleotide
  Target: SCN10A; (+) strand; PAM type: YTN; PAM sequence: TTC
aacataaagttgaattatgt

SEQ ID NO: 58055 - DNA, 20 bp, Artificial Sequence
  Description of Artificial Sequence: Synthetic oligonucleotide
  Target: SCN10A; (+) strand; PAM type: YTN; PAM sequence: TTG
aattatgttcctatgtttag

SEQ ID NO: 58056 - DNA, 20 bp, Artificial Sequence
  Description of Artificial Sequence: Synthetic oligonucleotide
  Target: SCN10A; (+) strand; PAM type: YTN; PAM sequence: TTA
tgttcctatgtttagggagc

SEQ ID NO: 58057 - DNA, 20 bp, Artificial Sequence
  Description of Artificial Sequence: Synthetic oligonucleotide
  Target: SCN10A; (+) strand; PAM type: YTN; PAM sequence: TTC
ctatgtttagggagcataat

SEQ ID NO: 58058 - DNA, 20 bp, Artificial Sequence
  Description of Artificial Sequence: Synthetic oligonucleotide
  Target: SCN10A; (+) strand; PAM type: YTN; PAM sequence: CTA
tgtttagggagcataattca

SEQ ID NO: 58059 - DNA, 20 bp, Artificial Sequence
  Description of Artificial Sequence: Synthetic oligonucleotide
  Target: SCN10A; (+) strand; PAM type: YTN; PAM sequence: TTT
agggagcataattcaactca

SEQ ID NO: 58060 - DNA, 20 bp, Artificial Sequence
  Description of Artificial Sequence: Synthetic oligonucleotide
  Target: SCN10A; (+) strand; PAM type: YTN; PAM sequence: TTA
gggagcataattcaactcaa

SEQ ID NO: 58061 - DNA, 20 bp, Artificial Sequence
  Description of Artificial Sequence: Synthetic oligonucleotide
  Target: SCN10A; (+) strand; PAM type: YTN; PAM sequence: TTC
aactcaaagtaaaaatactt

SEQ ID NO: 58062 - DNA, 20 bp, Artificial Sequence
  Description of Artificial Sequence: Synthetic oligonucleotide
  Target: SCN10A; (+) strand; PAM type: YTN; PAM sequence: CTC
aaagtaaaaatacttttgag

SEQ ID NO: 58063 - DNA, 20 bp, Artificial Sequence
  Description of Artificial Sequence: Synthetic oligonucleotide
  Target: SCN10A; (+) strand; PAM type: YTN; PAM sequence: CTT
ttgagaatagtatcatctgc

SEQ ID NO: 58064 - DNA, 20 bp, Artificial Sequence
  Description of Artificial Sequence: Synthetic oligonucleotide
  Target: SCN10A; (+) strand; PAM type: YTN; PAM sequence: TTT
tgagaatagtatcatctgct

SEQ ID NO: 58065 - DNA, 20 bp, Artificial Sequence
  Description of Artificial Sequence: Synthetic oligonucleotide
  Target: SCN10A; (+) strand; PAM type: YTN; PAM sequence: TTT
gagaatagtatcatctgctt

SEQ ID NO: 58066 - DNA, 20 bp, Artificial Sequence
  Description of Artificial Sequence: Synthetic oligonucleotide
  Target: SCN10A; (+) strand; PAM type: YTN; PAM sequence: TTG
agaatagtatcatctgcttt

SEQ ID NO: 58067 - DNA, 20 bp, Artificial Sequence
  Description of Artificial Sequence: Synthetic oligonucleotide
  Target: SCN10A; (+) strand; PAM type: YTN; PAM sequence: CTG
ctttaatagaaccagtctga

SEQ ID NO: 58068 - DNA, 20 bp, Artificial Sequence
  Description of Artificial Sequence: Synthetic oligonucleotide
  Target: SCN10A; (+) strand; PAM type: YTN; PAM sequence: CTT
taatagaaccagtctgatgg

SEQ ID NO: 58069 - DNA, 20 bp, Artificial Sequence
  Description of Artificial Sequence: Synthetic oligonucleotide
  Target: SCN10A; (+) strand; PAM type: YTN; PAM sequence: TTT
aatagaaccagtctgatggt

SEQ ID NO: 58070 - DNA, 20 bp, Artificial Sequence
  Description of Artificial Sequence: Synthetic oligonucleotide
  Target: SCN10A; (+) strand; PAM type: YTN; PAM sequence: TTA
atagaaccagtctgatggtt

SEQ ID NO: 58071 - DNA, 20 bp, Artificial Sequence
  Description of Artificial Sequence: Synthetic oligonucleotide
  Target: SCN10A; (+) strand; PAM type: YTN; PAM sequence: CTG
atggtttggcacacttaatt

SEQ ID NO: 58072 - DNA, 20 bp, Artificial Sequence
  Description of Artificial Sequence: Synthetic oligonucleotide
  Target: SCN10A; (+) strand; PAM type: YTN; PAM sequence: TTT
ggcacacttaattctttcac

SEQ ID NO: 58073 - DNA, 20 bp, Artificial Sequence
  Description of Artificial Sequence: Synthetic oligonucleotide
  Target: SCN10A; (+) strand; PAM type: YTN; PAM sequence: TTG
gcacacttaattctttcaca

SEQ ID NO: 58074 - DNA, 20 bp, Artificial Sequence
  Description of Artificial Sequence: Synthetic oligonucleotide
  Target: SCN10A; (+) strand; PAM type: YTN; PAM sequence: CTT
aattctttcacatatcattg

SEQ ID NO: 58075 - DNA, 20 bp, Artificial Sequence
  Description of Artificial Sequence: Synthetic oligonucleotide
  Target: SCN10A; (+) strand; PAM type: YTN; PAM sequence: TTA
attctttcacatatcattgt

SEQ ID NO: 58076 - DNA, 20 bp, Artificial Sequence
  Description of Artificial Sequence: Synthetic oligonucleotide
  Target: SCN10A; (+) strand; PAM type: YTN; PAM sequence: TTC
tttcacatatcattgtaaaa

SEQ ID NO: 58077 - DNA, 20 bp, Artificial Sequence
  Description of Artificial Sequence: Synthetic oligonucleotide
  Target: SCN10A; (+) strand; PAM type: YTN; PAM sequence: CTT
tcacatatcattgtaaaaat

SEQ ID NO: 58078 - DNA, 20 bp, Artificial Sequence
  Description of Artificial Sequence: Synthetic oligonucleotide
  Target: SCN10A; (+) strand; PAM type: YTN; PAM sequence: TTT
cacatatcattgtaaaaata

SEQ ID NO: 58079 - DNA, 20 bp, Artificial Sequence
  Description of Artificial Sequence: Synthetic oligonucleotide
  Target: SCN10A; (+) strand; PAM type: YTN; PAM sequence: TTC
acatatcattgtaaaaataa

SEQ ID NO: 58080 - DNA, 20 bp, Artificial Sequence
  Description of Artificial Sequence: Synthetic oligonucleotide
  Target: SCN10A; (+) strand; PAM type: YTN; PAM sequence: TTG
taaaaataaacctgtgccca

SEQ ID NO: 58081 - DNA, 20 bp, Artificial Sequence
  Description of Artificial Sequence: Synthetic oligonucleotide
  Target: SCN10A; (+) strand; PAM type: YTN; PAM sequence: CTG
tgcccaaactctctgtccac

SEQ ID NO: 58082 - DNA, 20 bp, Artificial Sequence
  Description of Artificial Sequence: Synthetic oligonucleotide
  Target: SCN10A; (+) strand; PAM type: YTN; PAM sequence: CTC
tctgtccacttagctgtctt

SEQ ID NO: 58083 - DNA, 20 bp, Artificial Sequence
  Description of Artificial Sequence: Synthetic oligonucleotide
  Target: SCN10A; (+) strand; PAM type: YTN; PAM sequence: CTC
tgtccacttagctgtcttat

SEQ ID NO: 58084 - DNA, 20 bp, Artificial Sequence
  Description of Artificial Sequence: Synthetic oligonucleotide
  Target: SCN10A; (+) strand; PAM type: YTN; PAM sequence: CTG
tccacttagctgtcttataa

SEQ ID NO: 58085 - DNA, 20 bp, Artificial Sequence
  Description of Artificial Sequence: Synthetic oligonucleotide
  Target: SCN10A; (+) strand; PAM type: YTN; PAM sequence: CTT
agctgtcttataaacacttg

SEQ ID NO: 58086 - DNA, 20 bp, Artificial Sequence
  Description of Artificial Sequence: Synthetic oligonucleotide
  Target: SCN10A; (+) strand; PAM type: YTN; PAM sequence: TTA
gctgtcttataaacacttgg

SEQ ID NO: 58087 - DNA, 20 bp, Artificial Sequence
  Description of Artificial Sequence: Synthetic oligonucleotide
  Target: SCN10A; (+) strand; PAM type: YTN; PAM sequence: CTG
tcttataaacacttgggcta

SEQ ID NO: 58088 - DNA, 20 bp, Artificial Sequence
  Description of Artificial Sequence: Synthetic oligonucleotide
  Target: SCN10A; (+) strand; PAM type: YTN; PAM sequence: CTT
ataaacacttgggctagtat

SEQ ID NO: 58089 - DNA, 20 bp, Artificial Sequence
  Description of Artificial Sequence: Synthetic oligonucleotide
  Target: SCN10A; (+) strand; PAM type: YTN; PAM sequence: TTA
taaacacttgggctagtatc

SEQ ID NO: 58090 - DNA, 20 bp, Artificial Sequence
  Description of Artificial Sequence: Synthetic oligonucleotide
  Target: SCN10A; (+) strand; PAM type: YTN; PAM sequence: CTT
gggctagtatctcagatggc

SEQ ID NO: 58091 - DNA, 20 bp, Artificial Sequence
  Description of Artificial Sequence: Synthetic oligonucleotide
  Target: SCN10A; (+) strand; PAM type: YTN; PAM sequence: TTG
ggctagtatctcagatggct

SEQ ID NO: 58092 - DNA, 20 bp, Artificial Sequence
  Description of Artificial Sequence: Synthetic oligonucleotide
  Target: SCN10A; (+) strand; PAM type: YTN; PAM sequence: CTA
gtatctcagatggctttttc

SEQ ID NO: 58093 - DNA, 20 bp, Artificial Sequence
  Description of Artificial Sequence: Synthetic oligonucleotide
  Target: SCN10A; (+) strand; PAM type: YTN; PAM sequence: CTC
agatggctttttcatcatcc

SEQ ID NO: 58094 - DNA, 20 bp, Artificial Sequence
  Description of Artificial Sequence: Synthetic oligonucleotide
  Target: SCN10A; (+) strand; PAM type: YTN; PAM sequence: CTT
tttcatcatccacatgggat

SEQ ID NO: 58095 - DNA, 20 bp, Artificial Sequence
  Description of Artificial Sequence: Synthetic oligonucleotide
  Target: SCN10A; (+) strand; PAM type: YTN; PAM sequence: TTT
ttcatcatccacatgggatt

SEQ ID NO: 58096 - DNA, 20 bp, Artificial Sequence
  Description of Artificial Sequence: Synthetic oligonucleotide
  Target: SCN10A; (+) strand; PAM type: YTN; PAM sequence: TTT
tcatcatccacatgggattt

SEQ ID NO: 58097 - DNA, 20 bp, Artificial Sequence
  Description of Artificial Sequence: Synthetic oligonucleotide
  Target: SCN10A; (+) strand; PAM type: YTN; PAM sequence: TTT
catcatccacatgggattta

SEQ ID NO: 58098 - DNA, 20 bp, Artificial Sequence
  Description of Artificial Sequence: Synthetic oligonucleotide
  Target: SCN10A; (+) strand; PAM type: YTN; PAM sequence: TTC
atcatccacatgggatttag

SEQ ID NO: 58099 - DNA, 20 bp, Artificial Sequence
  Description of Artificial Sequence: Synthetic oligonucleotide
  Target: SCN10A; (+) strand; PAM type: YTN; PAM sequence: TTT
agacgttgaagaagctgcac

SEQ ID NO: 58100 - DNA, 20 bp, Artificial Sequence
  Description of Artificial Sequence: Synthetic oligonucleotide
  Target: SCN10A; (+) strand; PAM type: YTN; PAM sequence: TTA
gacgttgaagaagctgcaca

SEQ ID NO: 58101 - DNA, 20 bp, Artificial Sequence
  Description of Artificial Sequence: Synthetic oligonucleotide
  Target: SCN10A; (+) strand; PAM type: YTN; PAM sequence: TTG
aagaagctgcacagtcagta

SEQ ID NO: 58102 - DNA, 20 bp, Artificial Sequence
  Description of Artificial Sequence: Synthetic oligonucleotide
  Target: SCN10A; (+) strand; PAM type: YTN; PAM sequence: CTG
cacagtcagtatctgtgctc

SEQ ID NO: 58103 - DNA, 20 bp, Artificial Sequence
  Description of Artificial Sequence: Synthetic oligonucleotide
  Target: SCN10A; (+) strand; PAM type: YTN; PAM sequence: CTG
tgctcccgggttcagtggta

SEQ ID NO: 58104 - DNA, 20 bp, Artificial Sequence
  Description of Artificial Sequence: Synthetic oligonucleotide
  Target: SCN10A; (+) strand; PAM type: YTN; PAM sequence: CTC
ccgggttcagtggtacgaga

SEQ ID NO: 58105 - DNA, 20 bp, Artificial Sequence
  Description of Artificial Sequence: Synthetic oligonucleotide
  Target: SCN10A; (+) strand; PAM type: YTN; PAM sequence: TTC
agtggtacgagagaggaaga

SEQ ID NO: 58106 - DNA, 20 bp, Artificial Sequence
  Description of Artificial Sequence: Synthetic oligonucleotide
  Target: SCN10A; (+) strand; PAM type: YTN; PAM sequence: TTA
tttggttgaactcatctttt

SEQ ID NO: 58107 - DNA, 20 bp, Artificial Sequence
  Description of Artificial Sequence: Synthetic oligonucleotide
  Target: SCN10A; (+) strand; PAM type: YTN; PAM sequence: TTT
ggttgaactcatcttttaga

SEQ ID NO: 58108 - DNA, 20 bp, Artificial Sequence
  Description of Artificial Sequence: Synthetic oligonucleotide
  Target: SCN10A; (+) strand; PAM type: YTN; PAM sequence: TTG
gttgaactcatcttttagaa

SEQ ID NO: 58109 - DNA, 20 bp, Artificial Sequence
  Description of Artificial Sequence: Synthetic oligonucleotide
  Target: SCN10A; (+) strand; PAM type: YTN; PAM sequence: TTG
aactcatcttttagaataaa

SEQ ID NO: 58110 - DNA, 20 bp, Artificial Sequence
  Description of Artificial Sequence: Synthetic oligonucleotide
  Target: SCN10A; (+) strand; PAM type: YTN; PAM sequence: CTC
atcttttagaataaatcagg

SEQ ID NO: 58111 - DNA, 20 bp, Artificial Sequence
  Description of Artificial Sequence: Synthetic oligonucleotide
  Target: SCN10A; (+) strand; PAM type: YTN; PAM sequence: CTT
ttagaataaatcaggcattc

SEQ ID NO: 58112 - DNA, 20 bp, Artificial Sequence
  Description of Artificial Sequence: Synthetic oligonucleotide
  Target: SCN10A; (+) strand; PAM type: YTN; PAM sequence: TTT
tagaataaatcaggcattca

SEQ ID NO: 58113 - DNA, 20 bp, Artificial Sequence
  Description of Artificial Sequence: Synthetic oligonucleotide
  Target: SCN10A; (+) strand; PAM type: YTN; PAM sequence: TTT
agaataaatcaggcattcag

SEQ ID NO: 58114 - DNA, 20 bp, Artificial Sequence
  Description of Artificial Sequence: Synthetic oligonucleotide
  Target: SCN10A; (+) strand; PAM type: YTN; PAM sequence: TTA
gaataaatcaggcattcaga

SEQ ID NO: 58115 - DNA, 20 bp, Artificial Sequence
  Description of Artificial Sequence: Synthetic oligonucleotide
  Target: SCN10A; (+) strand; PAM type: YTN; PAM sequence: TTC
agagaatagctgatttgaga

SEQ ID NO: 58116 - DNA, 20 bp, Artificial Sequence
  Description of Artificial Sequence: Synthetic oligonucleotide
  Target: SCN10A; (+) strand; PAM type: YTN; PAM sequence: CTG
atttgagatggcttggtacc

SEQ ID NO: 58117 - DNA, 20 bp, Artificial Sequence
  Description of Artificial Sequence: Synthetic oligonucleotide
  Target: SCN10A; (+) strand; PAM type: YTN; PAM sequence: TTT
gagatggcttggtacctctg

SEQ ID NO: 58118 - DNA, 20 bp, Artificial Sequence
  Description of Artificial Sequence: Synthetic oligonucleotide
  Target: SCN10A; (+) strand; PAM type: YTN; PAM sequence: TTG
agatggcttggtacctctgc

SEQ ID NO: 58119 - DNA, 20 bp, Artificial Sequence
  Description of Artificial Sequence: Synthetic oligonucleotide
  Target: SCN10A; (+) strand; PAM type: YTN; PAM sequence: CTT
ggtacctctgctatcccatc

SEQ ID NO: 58120 - DNA, 20 bp, Artificial Sequence
  Description of Artificial Sequence: Synthetic oligonucleotide
  Target: SCN10A; (+) strand; PAM type: YTN; PAM sequence: TTG
gtacctctgctatcccatca

SEQ ID NO: 58121 - DNA, 20 bp, Artificial Sequence
  Description of Artificial Sequence: Synthetic oligonucleotide
  Target: SCN10A; (+) strand; PAM type: YTN; PAM sequence: CTC
tgctatcccatcatcatctt

SEQ ID NO: 58122 - DNA, 20 bp, Artificial Sequence
  Description of Artificial Sequence: Synthetic oligonucleotide
  Target: SCN10A; (+) strand; PAM type: YTN; PAM sequence: CTG
ctatcccatcatcatcttat

SEQ ID NO: 58123 - DNA, 20 bp, Artificial Sequence
  Description of Artificial Sequence: Synthetic oligonucleotide
  Target: SCN10A; (+) strand; PAM type: YTN; PAM sequence: CTA
tcccatcatcatcttattaa

SEQ ID NO: 58124 - DNA, 20 bp, Artificial Sequence
  Description of Artificial Sequence: Synthetic oligonucleotide
  Target: SCN10A; (+) strand; PAM type: YTN; PAM sequence: CTT
attaacctgcatctgtggat

SEQ ID NO: 58125 - DNA, 20 bp, Artificial Sequence
  Description of Artificial Sequence: Synthetic oligonucleotide
  Target: SCN10A; (+) strand; PAM type: YTN; PAM sequence: TTA
ttaacctgcatctgtggatg

SEQ ID NO: 58126 - DNA, 20 bp, Artificial Sequence
  Description of Artificial Sequence: Synthetic oligonucleotide
  Target: SCN10A; (+) strand; PAM type: YTN; PAM sequence: TTA
acctgcatctgtggatgctg

SEQ ID NO: 58127 - DNA, 20 bp, Artificial Sequence
  Description of Artificial Sequence: Synthetic oligonucleotide
  Target: SCN10A; (+) strand; PAM type: YTN; PAM sequence: CTG
catctgtggatgctgccaac

SEQ ID NO: 58128 - DNA, 20 bp, Artificial Sequence
  Description of Artificial Sequence: Synthetic oligonucleotide
  Target: SCN10A; (+) strand; PAM type: YTN; PAM sequence: CTG
tggatgctgccaactcccag

SEQ ID NO: 58129 - DNA, 20 bp, Artificial Sequence
  Description of Artificial Sequence: Synthetic oligonucleotide
  Target: SCN10A; (+) strand; PAM type: YTN; PAM sequence: CTG
ccaactcccagtaagcatct

SEQ ID NO: 58130 - DNA, 20 bp, Artificial Sequence
  Description of Artificial Sequence: Synthetic oligonucleotide
  Target: SCN10A; (+) strand; PAM type: YTN; PAM sequence: CTC
ccagtaagcatcttgagagc

SEQ ID NO: 58131 - DNA, 20 bp, Artificial Sequence
  Description of Artificial Sequence: Synthetic oligonucleotide
  Target: SCN10A; (+) strand; PAM type: YTN; PAM sequence: CTT
gagagcctctttgacttctt

SEQ ID NO: 58132 - DNA, 20 bp, Artificial Sequence
  Description of Artificial Sequence: Synthetic oligonucleotide
  Target: SCN10A; (+) strand; PAM type: YTN; PAM sequence: TTG
agagcctctttgacttctta

SEQ ID NO: 58133 - DNA, 20 bp, Artificial Sequence
  Description of Artificial Sequence: Synthetic oligonucleotide
  Target: SCN10A; (+) strand; PAM type: YTN; PAM sequence: CTC
tttgacttcttatgggctaa

SEQ ID NO: 58134 - DNA, 20 bp, Artificial Sequence
  Description of Artificial Sequence: Synthetic oligonucleotide
  Target: SCN10A; (+) strand; PAM type: YTN; PAM sequence: CTT
tgacttcttatgggctaata

SEQ ID NO: 58135 - DNA, 20 bp, Artificial Sequence
  Description of Artificial Sequence: Synthetic oligonucleotide
  Target: SCN10A; (+) strand; PAM type: YTN; PAM sequence: TTT
gacttcttatgggctaatag

SEQ ID NO: 58136 - DNA, 20 bp, Artificial Sequence
  Description of Artificial Sequence: Synthetic oligonucleotide
  Target: SCN10A; (+) strand; PAM type: YTN; PAM sequence: TTG
acttcttatgggctaatagt

SEQ ID NO: 58137 - DNA, 20 bp, Artificial Sequence
  Description of Artificial Sequence: Synthetic oligonucleotide
  Target: SCN10A; (+) strand; PAM type: YTN; PAM sequence: CTT
cttatgggctaatagtgaca

SEQ ID NO: 58138 - DNA, 20 bp, Artificial Sequence
  Description of Artificial Sequence: Synthetic oligonucleotide
  Target: SCN10A; (+) strand; PAM type: YTN; PAM sequence: TTC
ttatgggctaatagtgacag

SEQ ID NO: 58139 - DNA, 20 bp, Artificial Sequence
  Description of Artificial Sequence: Synthetic oligonucleotide
  Target: SCN10A; (+) strand; PAM type: YTN; PAM sequence: CTT
atgggctaatagtgacagaa

SEQ ID NO: 58140 - DNA, 20 bp, Artificial Sequence
  Description of Artificial Sequence: Synthetic oligonucleotide
  Target: SCN10A; (+) strand; PAM type: YTN; PAM sequence: TTA
tgggctaatagtgacagaaa

SEQ ID NO: 58141 - DNA, 20 bp, Artificial Sequence
  Description of Artificial Sequence: Synthetic oligonucleotide
  Target: SCN10A; (+) strand; PAM type: YTN; PAM sequence: CTA
atagtgacagaaaagggaga

SEQ ID NO: 58142 - DNA, 20 bp, Artificial Sequence
  Description of Artificial Sequence: Synthetic oligonucleotide
  Target: SCN10A; (+) strand; PAM type: YTN; PAM sequence: CTC
ggcaaatctgtattcttgag

SEQ ID NO: 58143 - DNA, 20 bp, Artificial Sequence
  Description of Artificial Sequence: Synthetic oligonucleotide
  Target: SCN10A; (+) strand; PAM type: YTN; PAM sequence: CTG
tattcttgaggcatgtgaga

SEQ ID NO: 58144 - DNA, 20 bp, Artificial Sequence
  Description of Artificial Sequence: Synthetic oligonucleotide
  Target: SCN10A; (+) strand; PAM type: YTN; PAM sequence: TTC
ttgaggcatgtgagatgtat

SEQ ID NO: 58145 - DNA, 20 bp, Artificial Sequence
  Description of Artificial Sequence: Synthetic oligonucleotide
  Target: SCN10A; (+) strand; PAM type: YTN; PAM sequence: CTT
gaggcatgtgagatgtatca

SEQ ID NO: 58146 - DNA, 20 bp, Artificial Sequence
  Description of Artificial Sequence: Synthetic oligonucleotide
  Target: SCN10A; (+) strand; PAM type: YTN; PAM sequence: TTG
aggcatgtgagatgtatcag

SEQ ID NO: 58147 - DNA, 20 bp, Artificial Sequence
  Description of Artificial Sequence: Synthetic oligonucleotide
  Target: SCN10A; (+) strand; PAM type: YTN; PAM sequence: CTG
tgctttgtaattatacaaat

SEQ ID NO: 58148 - DNA, 20 bp, Artificial Sequence
  Description of Artificial Sequence: Synthetic oligonucleotide
  Target: SCN10A; (+) strand; PAM type: YTN; PAM sequence: CTT
tgtaattatacaaatggaaa

SEQ ID NO: 58149 - DNA, 20 bp, Artificial Sequence
  Description of Artificial Sequence: Synthetic oligonucleotide
  Target: SCN10A; (+) strand; PAM type: YTN; PAM sequence: TTT
gtaattatacaaatggaaaa

SEQ ID NO: 58150 - DNA, 20 bp, Artificial Sequence
  Description of Artificial Sequence: Synthetic oligonucleotide
  Target: SCN10A; (+) strand; PAM type: YTN; PAM sequence: TTG
taattatacaaatggaaaat

SEQ ID NO: 58151 - DNA, 20 bp, Artificial Sequence
  Description of Artificial Sequence: Synthetic oligonucleotide
  Target: SCN10A; (+) strand; PAM type: YTN; PAM sequence: TTA
tacaaatggaaaatcttatg

SEQ ID NO: 58152 - DNA, 20 bp, Artificial Sequence
  Description of Artificial Sequence: Synthetic oligonucleotide
  Target: SCN10A; (+) strand; PAM type: YTN; PAM sequence: CTT
atgaaatgatcaaatatata

SEQ ID NO: 58153 - DNA, 20 bp, Artificial Sequence
  Description of Artificial Sequence: Synthetic oligonucleotide
  Target: SCN10A; (+) strand; PAM type: YTN; PAM sequence: TTA
tgaaatgatcaaatatatag

SEQ ID NO: 58154 - DNA, 20 bp, Artificial Sequence
  Description of Artificial Sequence: Synthetic oligonucleotide
  Target: SCN10A; (+) strand; PAM type: YTN; PAM sequence: TTG
gctatatatttgaatctttg

SEQ ID NO: 58155 - DNA, 20 bp, Artificial Sequence
  Description of Artificial Sequence: Synthetic oligonucleotide
  Target: SCN10A; (+) strand; PAM type: YTN; PAM sequence: CTA
tatatttgaatctttgtgat

SEQ ID NO: 58156 - DNA, 20 bp, Artificial Sequence
  Description of Artificial Sequence: Synthetic oligonucleotide
  Target: SCN10A; (+) strand; PAM type: YTN; PAM sequence: TTT
gaatctttgtgattgtggct

SEQ ID NO: 58157 - DNA, 20 bp, Artificial Sequence
  Description of Artificial Sequence: Synthetic oligonucleotide
  Target: SCN10A; (+) strand; PAM type: YTN; PAM sequence: TTG
aatctttgtgattgtggctg

SEQ ID NO: 58158 - DNA, 20 bp, Artificial Sequence
  Description of Artificial Sequence: Synthetic oligonucleotide
  Target: SCN10A; (+) strand; PAM type: YTN; PAM sequence: CTT
tgtgattgtggctgggaatg

SEQ ID NO: 58159 - DNA, 20 bp, Artificial Sequence
  Description of Artificial Sequence: Synthetic oligonucleotide
  Target: SCN10A; (+) strand; PAM type: YTN; PAM sequence: TTT
gtgattgtggctgggaatgg

SEQ ID NO: 58160 - DNA, 20 bp, Artificial Sequence
  Description of Artificial Sequence: Synthetic oligonucleotide
  Target: SCN10A; (+) strand; PAM type: YTN; PAM sequence: TTG
tgattgtggctgggaatggg

SEQ ID NO: 58161 - DNA, 20 bp, Artificial Sequence
  Description of Artificial Sequence: Synthetic oligonucleotide
  Target: SCN10A; (+) strand; PAM type: YTN; PAM sequence: TTG
tggctgggaatgggccaaga

SEQ ID NO: 58162 - DNA, 20 bp, Artificial Sequence
  Description of Artificial Sequence: Synthetic oligonucleotide
  Target: SCN10A; (+) strand; PAM type: YTN; PAM sequence: CTG
ggaatgggccaagagttaat

SEQ ID NO: 58163 - DNA, 20 bp, Artificial Sequence
  Description of Artificial Sequence: Synthetic oligonucleotide
  Target: SCN10A; (+) strand; PAM type: YTN; PAM sequence: TTA
atggaagatcatgactgtca

SEQ ID NO: 58164 - DNA, 20 bp, Artificial Sequence
  Description of Artificial Sequence: Synthetic oligonucleotide
  Target: SCN10A; (+) strand; PAM type: YTN; PAM sequence: CTG
tcattacaatccctatgtcc

SEQ ID NO: 58165 - DNA, 20 bp, Artificial Sequence
  Description of Artificial Sequence: Synthetic oligonucleotide
  Target: SCN10A; (+) strand; PAM type: YTN; PAM sequence: TTA
caatccctatgtcctatgtt

SEQ ID NO: 58166 - DNA, 20 bp, Artificial Sequence
  Description of Artificial Sequence: Synthetic oligonucleotide
  Target: SCN10A; (+) strand; PAM type: YTN; PAM sequence: CTA
tgtcctatgttgttataggg

SEQ ID NO: 58167 - DNA, 20 bp, Artificial Sequence
  Description of Artificial Sequence: Synthetic oligonucleotide
  Target: SCN10A; (+) strand; PAM type: YTN; PAM sequence: CTA
tgttgttatagggagtcttt

SEQ ID NO: 58168 - DNA, 20 bp, Artificial Sequence
  Description of Artificial Sequence: Synthetic oligonucleotide
  Target: SCN10A; (+) strand; PAM type: YTN; PAM sequence: TTG
ttatagggagtctttgcttt

SEQ ID NO: 58169 - DNA, 20 bp, Artificial Sequence
  Description of Artificial Sequence: Synthetic oligonucleotide
  Target: SCN10A; (+) strand; PAM type: YTN; PAM sequence: TTA
tagggagtctttgcttttct

SEQ ID NO: 58170 - DNA, 20 bp, Artificial Sequence
  Description of Artificial Sequence: Synthetic oligonucleotide
  Target: SCN10A; (+) strand; PAM type: YTN; PAM sequence: CTT
tgcttttcttcatctcaaaa

SEQ ID NO: 58171 - DNA, 20 bp, Artificial Sequence
  Description of Artificial Sequence: Synthetic oligonucleotide
  Target: SCN10A; (+) strand; PAM type: YTN; PAM sequence: TTT
gcttttcttcatctcaaaat

SEQ ID NO: 58172 - DNA, 20 bp, Artificial Sequence
  Description of Artificial Sequence: Synthetic oligonucleotide
  Target: SCN10A; (+) strand; PAM type: YTN; PAM sequence: TTG
cttttcttcatctcaaaatc

SEQ ID NO: 58173 - DNA, 20 bp, Artificial Sequence
  Description of Artificial Sequence: Synthetic oligonucleotide
  Target: SCN10A; (+) strand; PAM type: YTN; PAM sequence: CTT
ttcttcatctcaaaatctgc

SEQ ID NO: 58174 - DNA, 20 bp, Artificial Sequence
  Description of Artificial Sequence: Synthetic oligonucleotide
  Target: SCN10A; (+) strand; PAM type: YTN; PAM sequence: TTT
tcttcatctcaaaatctgca

SEQ ID NO: 58175 - DNA, 20 bp, Artificial Sequence
  Description of Artificial Sequence: Synthetic oligonucleotide
  Target: SCN10A; (+) strand; PAM type: YTN; PAM sequence: TTT
cttcatctcaaaatctgcaa

SEQ ID NO: 58176 - DNA, 20 bp, Artificial Sequence
  Description of Artificial Sequence: Synthetic oligonucleotide
  Target: SCN10A; (+) strand; PAM type: YTN; PAM sequence: TTC
ttcatctcaaaatctgcaac

SEQ ID NO: 58177 - DNA, 20 bp, Artificial Sequence
  Description of Artificial Sequence: Synthetic oligonucleotide
  Target: SCN10A; (+) strand; PAM type: YTN; PAM sequence: CTT
catctcaaaatctgcaacat

SEQ ID NO: 58178 - DNA, 20 bp, Artificial Sequence
  Description of Artificial Sequence: Synthetic oligonucleotide
  Target: SCN10A; (+) strand; PAM type: YTN; PAM sequence: TTC
atctcaaaatctgcaacatg

SEQ ID NO: 58179 - DNA, 20 bp, Artificial Sequence
  Description of Artificial Sequence: Synthetic oligonucleotide
  Target: SCN10A; (+) strand; PAM type: YTN; PAM sequence: CTC
aaaatctgcaacatgccttt

SEQ ID NO: 58180 - DNA, 20 bp, Artificial Sequence
  Description of Artificial Sequence: Synthetic oligonucleotide
  Target: SCN10A; (+) strand; PAM type: YTN; PAM sequence: CTG
caacatgcctttggcctaaa

SEQ ID NO: 58181 - DNA, 20 bp, Artificial Sequence
  Description of Artificial Sequence: Synthetic oligonucleotide
  Target: SCN10A; (+) strand; PAM type: YTN; PAM sequence: CTT
tggcctaaataaactcctct

SEQ ID NO: 58182 - DNA, 20 bp, Artificial Sequence
  Description of Artificial Sequence: Synthetic oligonucleotide
  Target: SCN10A; (+) strand; PAM type: YTN; PAM sequence: TTT
ggcctaaataaactcctctg

SEQ ID NO: 58183 - DNA, 20 bp, Artificial Sequence
  Description of Artificial Sequence: Synthetic oligonucleotide
  Target: SCN10A; (+) strand; PAM type: YTN; PAM sequence: TTG
gcctaaataaactcctctga

SEQ ID NO: 58184 - DNA, 20 bp, Artificial Sequence
  Description of Artificial Sequence: Synthetic oligonucleotide
  Target: SCN10A; (+) strand; PAM type: YTN; PAM sequence: CTA
aataaactcctctgacaatt

SEQ ID NO: 58185 - DNA, 20 bp, Artificial Sequence
  Description of Artificial Sequence: Synthetic oligonucleotide
  Target: SCN10A; (+) strand; PAM type: YTN; PAM sequence: CTC
ctctgacaattcttactcca

SEQ ID NO: 58186 - DNA, 20 bp, Artificial Sequence
  Description of Artificial Sequence: Synthetic oligonucleotide
  Target: SCN10A; (+) strand; PAM type: YTN; PAM sequence: CTC
tgacaattcttactccattc

SEQ ID NO: 58187 - DNA, 20 bp, Artificial Sequence
  Description of Artificial Sequence: Synthetic oligonucleotide
  Target: SCN10A; (+) strand; PAM type: YTN; PAM sequence: CTG
acaattcttactccattcag

SEQ ID NO: 58188 - DNA, 20 bp, Artificial Sequence
  Description of Artificial Sequence: Synthetic oligonucleotide
  Target: SCN10A; (+) strand; PAM type: YTN; PAM sequence: TTC
ttactccattcagttcatac

SEQ ID NO: 58189 - DNA, 20 bp, Artificial Sequence
  Description of Artificial Sequence: Synthetic oligonucleotide
  Target: SCN10A; (+) strand; PAM type: YTN; PAM sequence: CTT
actccattcagttcatacaa

SEQ ID NO: 58190 - DNA, 20 bp, Artificial Sequence
  Description of Artificial Sequence: Synthetic oligonucleotide
  Target: SCN10A; (+) strand; PAM type: YTN; PAM sequence: TTA
ctccattcagttcatacaat

SEQ ID NO: 58191 - DNA, 20 bp, Artificial Sequence
  Description of Artificial Sequence: Synthetic oligonucleotide
  Target: SCN10A; (+) strand; PAM type: YTN; PAM sequence: CTC
cattcagttcatacaattaa

SEQ ID NO: 58192 - DNA, 20 bp, Artificial Sequence
  Description of Artificial Sequence: Synthetic oligonucleotide
  Target: SCN10A; (+) strand; PAM type: YTN; PAM sequence: TTC
agttcatacaattaatcttt

SEQ ID NO: 58193 - DNA, 20 bp, Artificial Sequence
  Description of Artificial Sequence: Synthetic oligonucleotide
  Target: SCN10A; (+) strand; PAM type: YTN; PAM sequence: TTC
atacaattaatcttttgggg

SEQ ID NO: 58194 - DNA, 20 bp, Artificial Sequence
  Description of Artificial Sequence: Synthetic oligonucleotide
  Target: SCN10A; (+) strand; PAM type: YTN; PAM sequence: TTA
atcttttgggggcttaattc

SEQ ID NO: 58195 - DNA, 20 bp, Artificial Sequence
  Description of Artificial Sequence: Synthetic oligonucleotide
  Target: SCN10A; (+) strand; PAM type: YTN; PAM sequence: CTT
ttgggggcttaattcctatt

SEQ ID NO: 58196 - DNA, 20 bp, Artificial Sequence
  Description of Artificial Sequence: Synthetic oligonucleotide
  Target: SCN10A; (+) strand; PAM type: YTN; PAM sequence: TTT
tgggggcttaattcctattt

SEQ ID NO: 58197 - DNA, 20 bp, Artificial Sequence
  Description of Artificial Sequence: Synthetic oligonucleotide
  Target: SCN10A; (+) strand; PAM type: YTN; PAM sequence: TTT
gggggcttaattcctatttt

SEQ ID NO: 58198 - DNA, 20 bp, Artificial Sequence
  Description of Artificial Sequence: Synthetic oligonucleotide
  Target: SCN10A; (+) strand; PAM type: YTN; PAM sequence: TTG
ggggcttaattcctatttta

SEQ ID NO: 58199 - DNA, 20 bp, Artificial Sequence
  Description of Artificial Sequence: Synthetic oligonucleotide
  Target: SCN10A; (+) strand; PAM type: YTN; PAM sequence: CTT
aattcctattttatctcttg

SEQ ID NO: 58200 - DNA, 20 bp, Artificial Sequence
  Description of Artificial Sequence: Synthetic oligonucleotide
  Target: SCN10A; (+) strand; PAM type: YTN; PAM sequence: TTA
attcctattttatctcttgt

SEQ ID NO: 58201 - DNA, 20 bp, Artificial Sequence
  Description of Artificial Sequence: Synthetic oligonucleotide
  Target: SCN10A; (+) strand; PAM type: YTN; PAM sequence: TTC
ctattttatctcttgttctt

SEQ ID NO: 58202 - DNA, 20 bp, Artificial Sequence
  Description of Artificial Sequence: Synthetic oligonucleotide
  Target: SCN10A; (+) strand; PAM type: YTN; PAM sequence: CTA
ttttatctcttgttcttgga

SEQ ID NO: 58203 - DNA, 20 bp, Artificial Sequence
  Description of Artificial Sequence: Synthetic oligonucleotide
  Target: SCN10A; (+) strand; PAM type: YTN; PAM sequence: TTT
tatctcttgttcttggagca

SEQ ID NO: 58204 - DNA, 20 bp, Artificial Sequence
  Description of Artificial Sequence: Synthetic oligonucleotide
  Target: SCN10A; (+) strand; PAM type: YTN; PAM sequence: TTT
atctcttgttcttggagcag

SEQ ID NO: 58205 - DNA, 20 bp, Artificial Sequence
  Description of Artificial Sequence: Synthetic oligonucleotide
  Target: SCN10A; (+) strand; PAM type: YTN; PAM sequence: TTA
tctcttgttcttggagcagt

SEQ ID NO: 58206 - DNA, 20 bp, Artificial Sequence
  Description of Artificial Sequence: Synthetic oligonucleotide
  Target: SCN10A; (+) strand; PAM type: YTN; PAM sequence: CTC
ttgttcttggagcagtgccc

SEQ ID NO: 58207 - DNA, 20 bp, Artificial Sequence
  Description of Artificial Sequence: Synthetic oligonucleotide
  Target: SCN10A; (+) strand; PAM type: YTN; PAM sequence: CTT
gttcttggagcagtgcccat

SEQ ID NO: 58208 - DNA, 20 bp, Artificial Sequence
  Description of Artificial Sequence: Synthetic oligonucleotide
  Target: SCN10A; (+) strand; PAM type: YTN; PAM sequence: TTG
ttcttggagcagtgcccatc

SEQ ID NO: 58209 - DNA, 20 bp, Artificial Sequence
  Description of Artificial Sequence: Synthetic oligonucleotide
  Target: SCN10A; (+) strand; PAM type: YTN; PAM sequence: TTC
ttggagcagtgcccatcata

SEQ ID NO: 58210 - DNA, 20 bp, Artificial Sequence
  Description of Artificial Sequence: Synthetic oligonucleotide
  Target: SCN10A; (+) strand; PAM type: YTN; PAM sequence: CTT
ggagcagtgcccatcatata

SEQ ID NO: 58211 - DNA, 20 bp, Artificial Sequence
  Description of Artificial Sequence: Synthetic oligonucleotide
  Target: SCN10A; (+) strand; PAM type: YTN; PAM sequence: TTG
gagcagtgcccatcatatag

SEQ ID NO: 58212 - DNA, 20 bp, Artificial Sequence
  Description of Artificial Sequence: Synthetic oligonucleotide
  Target: SCN10A; (+) strand; PAM type: YTN; PAM sequence: TTA
ataacatttgcaggatgaat

SEQ ID NO: 58213 - DNA, 20 bp, Artificial Sequence
  Description of Artificial Sequence: Synthetic oligonucleotide
  Target: SCN10A; (+) strand; PAM type: YTN; PAM sequence: TTT
gcaggatgaatgaaagaaac

SEQ ID NO: 58214 - DNA, 20 bp, Artificial Sequence
  Description of Artificial Sequence: Synthetic oligonucleotide
  Target: SCN10A; (+) strand; PAM type: YTN; PAM sequence: TTG
caggatgaatgaaagaaact

SEQ ID NO: 58215 - DNA, 20 bp, Artificial Sequence
  Description of Artificial Sequence: Synthetic oligonucleotide
  Target: SCN10A; (+) strand; PAM type: YTN; PAM sequence: CTA
ctggccataccttttatcta

SEQ ID NO: 58216 - DNA, 20 bp, Artificial Sequence
  Description of Artificial Sequence: Synthetic oligonucleotide
  Target: SCN10A; (+) strand; PAM type: YTN; PAM sequence: CTG
gccataccttttatctactg

SEQ ID NO: 58217 - DNA, 20 bp, Artificial Sequence
  Description of Artificial Sequence: Synthetic oligonucleotide
  Target: SCN10A; (+) strand; PAM type: YTN; PAM sequence: CTT
ttatctactggatcatcatt

SEQ ID NO: 58218 - DNA, 20 bp, Artificial Sequence
  Description of Artificial Sequence: Synthetic oligonucleotide
  Target: SCN10A; (+) strand; PAM type: YTN; PAM sequence: TTT
tatctactggatcatcattc

SEQ ID NO: 58219 - DNA, 20 bp, Artificial Sequence
  Description of Artificial Sequence: Synthetic oligonucleotide
  Target: SCN10A; (+) strand; PAM type: YTN; PAM sequence: TTT
atctactggatcatcattct

SEQ ID NO: 58220 - DNA, 20 bp, Artificial Sequence
  Description of Artificial Sequence: Synthetic oligonucleotide
  Target: SCN10A; (+) strand; PAM type: YTN; PAM sequence: TTA
tctactggatcatcattctc

SEQ ID NO: 58221 - DNA, 20 bp, Artificial Sequence
  Description of Artificial Sequence: Synthetic oligonucleotide
  Target: SCN10A; (+) strand; PAM type: YTN; PAM sequence: CTA
ctggatcatcattctcatga

SEQ ID NO: 58222 - DNA, 20 bp, Artificial Sequence
  Description of Artificial Sequence: Synthetic oligonucleotide
  Target: SCN10A; (+) strand; PAM type: YTN; PAM sequence: CTG
gatcatcattctcatgatta

SEQ ID NO: 58223 - DNA, 20 bp, Artificial Sequence
  Description of Artificial Sequence: Synthetic oligonucleotide
  Target: SCN10A; (+) strand; PAM type: YTN; PAM sequence: TTC
tcatgattatactttttctt

SEQ ID NO: 58224 - DNA, 20 bp, Artificial Sequence
  Description of Artificial Sequence: Synthetic oligonucleotide
  Target: SCN10A; (+) strand; PAM type: YTN; PAM sequence: CTC
atgattatactttttcttct

SEQ ID NO: 58225 - DNA, 20 bp, Artificial Sequence
  Description of Artificial Sequence: Synthetic oligonucleotide
  Target: SCN10A; (+) strand; PAM type: YTN; PAM sequence: TTA
tactttttcttctgattata

SEQ ID NO: 58226 - DNA, 20 bp, Artificial Sequence
  Description of Artificial Sequence: Synthetic oligonucleotide
  Target: SCN10A; (+) strand; PAM type: YTN; PAM sequence: CTT
tttcttctgattatattaac

SEQ ID NO: 58227 - DNA, 20 bp, Artificial Sequence
  Description of Artificial Sequence: Synthetic oligonucleotide
  Target: SCN10A; (+) strand; PAM type: YTN; PAM sequence: TTT
ttcttctgattatattaact

SEQ ID NO: 58228 - DNA, 20 bp, Artificial Sequence
  Description of Artificial Sequence: Synthetic oligonucleotide
  Target: SCN10A; (+) strand; PAM type: YTN; PAM sequence: TTT
tcttctgattatattaacta

SEQ ID NO: 58229 - DNA, 20 bp, Artificial Sequence
  Description of Artificial Sequence: Synthetic oligonucleotide
  Target: SCN10A; (+) strand; PAM type: YTN; PAM sequence: TTT
cttctgattatattaactat

SEQ ID NO: 58230 - DNA, 20 bp, Artificial Sequence
  Description of Artificial Sequence: Synthetic oligonucleotide
  Target: SCN10A; (+) strand; PAM type: YTN; PAM sequence: TTC
ttctgattatattaactatg

SEQ ID NO: 58231 - DNA, 20 bp, Artificial Sequence
  Description of Artificial Sequence: Synthetic oligonucleotide
  Target: SCN10A; (+) strand; PAM type: YTN; PAM sequence: CTT
ctgattatattaactatgga

SEQ ID NO: 58232 - DNA, 20 bp, Artificial Sequence
  Description of Artificial Sequence: Synthetic oligonucleotide
  Target: SCN10A; (+) strand; PAM type: YTN; PAM sequence: TTC
tgattatattaactatggag

SEQ ID NO: 58233 - DNA, 20 bp, Artificial Sequence
  Description of Artificial Sequence: Synthetic oligonucleotide
  Target: SCN10A; (+) strand; PAM type: YTN; PAM sequence: CTG
attatattaactatggagtt

SEQ ID NO: 58234 - DNA, 20 bp, Artificial Sequence
  Description of Artificial Sequence: Synthetic oligonucleotide
  Target: SCN10A; (+) strand; PAM type: YTN; PAM sequence: TTA
tattaactatggagttctgg

SEQ ID NO: 58235 - DNA, 20 bp, Artificial Sequence
  Description of Artificial Sequence: Synthetic oligonucleotide
  Target: SCN10A; (+) strand; PAM type: YTN; PAM sequence: TTA
actatggagttctggacgcc

SEQ ID NO: 58236 - DNA, 20 bp, Artificial Sequence
  Description of Artificial Sequence: Synthetic oligonucleotide
  Target: SCN10A; (+) strand; PAM type: YTN; PAM sequence: CTA
tggagttctggacgccaggt

SEQ ID NO: 58237 - DNA, 20 bp, Artificial Sequence
  Description of Artificial Sequence: Synthetic oligonucleotide
  Target: SCN10A; (+) strand; PAM type: YTN; PAM sequence: TTC
tggacgccaggtaatgtaaa

SEQ ID NO: 58238 - DNA, 20 bp, Artificial Sequence
  Description of Artificial Sequence: Synthetic oligonucleotide
  Target: SCN10A; (+) strand; PAM type: YTN; PAM sequence: CTG
gacgccaggtaatgtaaaaa

SEQ ID NO: 58239 - DNA, 20 bp, Artificial Sequence
  Description of Artificial Sequence: Synthetic oligonucleotide
  Target: SCN10A; (+) strand; PAM type: YTN; PAM sequence: CTC
tcctccttaatgtctgatta

SEQ ID NO: 58240 - DNA, 20 bp, Artificial Sequence
  Description of Artificial Sequence: Synthetic oligonucleotide
  Target: SCN10A; (+) strand; PAM type: YTN; PAM sequence: CTC
ctccttaatgtctgattatg

SEQ ID NO: 58241 - DNA, 20 bp, Artificial Sequence
  Description of Artificial Sequence: Synthetic oligonucleotide
  Target: SCN10A; (+) strand; PAM type: YTN; PAM sequence: CTC
cttaatgtctgattatgaga

SEQ ID NO: 58242 - DNA, 20 bp, Artificial Sequence
  Description of Artificial Sequence: Synthetic oligonucleotide
  Target: SCN10A; (+) strand; PAM type: YTN; PAM sequence: CTT
aatgtctgattatgagatgt

SEQ ID NO: 58243 - DNA, 20 bp, Artificial Sequence
  Description of Artificial Sequence: Synthetic oligonucleotide
  Target: SCN10A; (+) strand; PAM type: YTN; PAM sequence: TTA
atgtctgattatgagatgtg

SEQ ID NO: 58244 - DNA, 20 bp, Artificial Sequence
  Description of Artificial Sequence: Synthetic oligonucleotide
  Target: SCN10A; (+) strand; PAM type: YTN; PAM sequence: CTG
attatgagatgtgaacagac

SEQ ID NO: 58245 - DNA, 20 bp, Artificial Sequence
  Description of Artificial Sequence: Synthetic oligonucleotide
  Target: SCN10A; (+) strand; PAM type: YTN; PAM sequence: TTA
tgagatgtgaacagactctg

SEQ ID NO: 58246 - DNA, 20 bp, Artificial Sequence
  Description of Artificial Sequence: Synthetic oligonucleotide
  Target: SCN10A; (+) strand; PAM type: YTN; PAM sequence: CTC
tggaatgtattcaaaagctg

SEQ ID NO: 58247 - DNA, 20 bp, Artificial Sequence
  Description of Artificial Sequence: Synthetic oligonucleotide
  Target: SCN10A; (+) strand; PAM type: YTN; PAM sequence: CTG
gaatgtattcaaaagctgcc

SEQ ID NO: 58248 - DNA, 20 bp, Artificial Sequence
  Description of Artificial Sequence: Synthetic oligonucleotide
  Target: SCN10A; (+) strand; PAM type: YTN; PAM sequence: TTC
aaaagctgcctctttagcta

SEQ ID NO: 58249 - DNA, 20 bp, Artificial Sequence
  Description of Artificial Sequence: Synthetic oligonucleotide
  Target: SCN10A; (+) strand; PAM type: YTN; PAM sequence: CTG
cctctttagctacacaacag

SEQ ID NO: 58250 - DNA, 20 bp, Artificial Sequence
  Description of Artificial Sequence: Synthetic oligonucleotide
  Target: SCN10A; (+) strand; PAM type: YTN; PAM sequence: CTC
tttagctacacaacagaaag

SEQ ID NO: 58251 - DNA, 20 bp, Artificial Sequence
  Description of Artificial Sequence: Synthetic oligonucleotide
  Target: SCN10A; (+) strand; PAM type: YTN; PAM sequence: CTT
tagctacacaacagaaaggt

SEQ ID NO: 58252 - DNA, 20 bp, Artificial Sequence
  Description of Artificial Sequence: Synthetic oligonucleotide
  Target: SCN10A; (+) strand; PAM type: YTN; PAM sequence: TTT
agctacacaacagaaaggtc

SEQ ID NO: 58253 - DNA, 20 bp, Artificial Sequence
  Description of Artificial Sequence: Synthetic oligonucleotide
  Target: SCN10A; (+) strand; PAM type: YTN; PAM sequence: TTA
gctacacaacagaaaggtcc

SEQ ID NO: 58254 - DNA, 20 bp, Artificial Sequence
  Description of Artificial Sequence: Synthetic oligonucleotide
  Target: SCN10A; (+) strand; PAM type: YTN; PAM sequence: CTA
cacaacagaaaggtccagcc

SEQ ID NO: 58255 - DNA, 20 bp, Artificial Sequence
  Description of Artificial Sequence: Synthetic oligonucleotide
  Target: SCN10A; (+) strand; PAM type: YTN; PAM sequence: TTT
cagcctcagaaaagagtgct

SEQ ID NO: 58256 - DNA, 20 bp, Artificial Sequence
  Description of Artificial Sequence: Synthetic oligonucleotide
  Target: SCN10A; (+) strand; PAM type: YTN; PAM sequence: TTC
agcctcagaaaagagtgctt

SEQ ID NO: 58257 - DNA, 20 bp, Artificial Sequence
  Description of Artificial Sequence: Synthetic oligonucleotide
  Target: SCN10A; (+) strand; PAM type: YTN; PAM sequence: CTC
agaaaagagtgcttttccca

SEQ ID NO: 58258 - DNA, 20 bp, Artificial Sequence
  Description of Artificial Sequence: Synthetic oligonucleotide
  Target: SCN10A; (+) strand; PAM type: YTN; PAM sequence: CTT
ttcccatataaatggggcag

SEQ ID NO: 58259 - DNA, 20 bp, Artificial Sequence
  Description of Artificial Sequence: Synthetic oligonucleotide
  Target: SCN10A; (+) strand; PAM type: YTN; PAM sequence: TTT
tcccatataaatggggcagg

SEQ ID NO: 58260 - DNA, 20 bp, Artificial Sequence
  Description of Artificial Sequence: Synthetic oligonucleotide
  Target: SCN10A; (+) strand; PAM type: YTN; PAM sequence: TTT
cccatataaatggggcaggc

SEQ ID NO: 58261 - DNA, 20 bp, Artificial Sequence
  Description of Artificial Sequence: Synthetic oligonucleotide
  Target: SCN10A; (+) strand; PAM type: YTN; PAM sequence: TTC
ccatataaatggggcaggca

SEQ ID NO: 58262 - DNA, 20 bp, Artificial Sequence
  Description of Artificial Sequence: Synthetic oligonucleotide
  Target: SCN10A; (+) strand; PAM type: YTN; PAM sequence: TTC
tacagcacgagatgcgaagt

SEQ ID NO: 58263 - DNA, 20 bp, Artificial Sequence
  Description of Artificial Sequence: Synthetic oligonucleotide
  Target: SCN10A; (+) strand; PAM type: YTN; PAM sequence: CTA
cagcacgagatgcgaagtct

SEQ ID NO: 58264 - DNA, 20 bp, Artificial Sequence
  Description of Artificial Sequence: Synthetic oligonucleotide
  Target: SCN10A; (+) strand; PAM type: YTN; PAM sequence: CTA
tagaaagcattcattttctt

SEQ ID NO: 58265 - DNA, 20 bp, Artificial Sequence
  Description of Artificial Sequence: Synthetic oligonucleotide
  Target: SCN10A; (+) strand; PAM type: YTN; PAM sequence: TTC
attttcttcccttcccacca

SEQ ID NO: 58266 - DNA, 20 bp, Artificial Sequence
  Description of Artificial Sequence: Synthetic oligonucleotide
  Target: SCN10A; (+) strand; PAM type: YTN; PAM sequence: TTT
tcttcccttcccaccaattt

SEQ ID NO: 58267 - DNA, 20 bp, Artificial Sequence
  Description of Artificial Sequence: Synthetic oligonucleotide
  Target: SCN10A; (+) strand; PAM type: YTN; PAM sequence: TTT
cttcccttcccaccaatttt

SEQ ID NO: 58268 - DNA, 20 bp, Artificial Sequence
  Description of Artificial Sequence: Synthetic oligonucleotide
  Target: SCN10A; (+) strand; PAM type: YTN; PAM sequence: TTC
ttcccttcccaccaatttta

SEQ ID NO: 58269 - DNA, 20 bp, Artificial Sequence
  Description of Artificial Sequence: Synthetic oligonucleotide
  Target: SCN10A; (+) strand; PAM type: YTN; PAM sequence: CTT
cccttcccaccaattttaca

SEQ ID NO: 58270 - DNA, 20 bp, Artificial Sequence
  Description of Artificial Sequence: Synthetic oligonucleotide
  Target: SCN10A; (+) strand; PAM type: YTN; PAM sequence: TTC
ccttcccaccaattttacaa

SEQ ID NO: 58271 - DNA, 20 bp, Artificial Sequence
  Description of Artificial Sequence: Synthetic oligonucleotide
  Target: SCN10A; (+) strand; PAM type: YTN; PAM sequence: CTT
cccaccaattttacaagtga

SEQ ID NO: 58272 - DNA, 20 bp, Artificial Sequence
  Description of Artificial Sequence: Synthetic oligonucleotide
  Target: SCN10A; (+) strand; PAM type: YTN; PAM sequence: TTC
ccaccaattttacaagtgag

SEQ ID NO: 58273 - DNA, 20 bp, Artificial Sequence
  Description of Artificial Sequence: Synthetic oligonucleotide
  Target: SCN10A; (+) strand; PAM type: YTN; PAM sequence: TTT
tacaagtgaggaaattgaag

SEQ ID NO: 58274 - DNA, 20 bp, Artificial Sequence
  Description of Artificial Sequence: Synthetic oligonucleotide
  Target: SCN10A; (+) strand; PAM type: YTN; PAM sequence: TTT
acaagtgaggaaattgaagt

SEQ ID NO: 58275 - DNA, 20 bp, Artificial Sequence
  Description of Artificial Sequence: Synthetic oligonucleotide
  Target: SCN10A; (+) strand; PAM type: YTN; PAM sequence: TTA
caagtgaggaaattgaagtt

SEQ ID NO: 58276 - DNA, 20 bp, Artificial Sequence
  Description of Artificial Sequence: Synthetic oligonucleotide
  Target: SCN10A; (+) strand; PAM type: YTN; PAM sequence: TTG
aagttaagaggggaaagact

SEQ ID NO: 58277 - DNA, 20 bp, Artificial Sequence
  Description of Artificial Sequence: Synthetic oligonucleotide
  Target: SCN10A; (+) strand; PAM type: YTN; PAM sequence: TTA
agaggggaaagactttagcc

SEQ ID NO: 58278 - DNA, 20 bp, Artificial Sequence
  Description of Artificial Sequence: Synthetic oligonucleotide
  Target: SCN10A; (+) strand; PAM type: YTN; PAM sequence: CTT
tagccctggtcagccagaca

SEQ ID NO: 58279 - DNA, 20 bp, Artificial Sequence
  Description of Artificial Sequence: Synthetic oligonucleotide
  Target: SCN10A; (+) strand; PAM type: YTN; PAM sequence: TTT
agccctggtcagccagacaa

SEQ ID NO: 58280 - DNA, 20 bp, Artificial Sequence
  Description of Artificial Sequence: Synthetic oligonucleotide
  Target: SCN10A; (+) strand; PAM type: YTN; PAM sequence: TTA
gccctggtcagccagacaat

SEQ ID NO: 58281 - DNA, 20 bp, Artificial Sequence
  Description of Artificial Sequence: Synthetic oligonucleotide
  Target: SCN10A; (+) strand; PAM type: YTN; PAM sequence: CTG
gtcagccagacaattggtgg

SEQ ID NO: 58282 - DNA, 20 bp, Artificial Sequence
  Description of Artificial Sequence: Synthetic oligonucleotide
  Target: SCN10A; (+) strand; PAM type: YTN; PAM sequence: TTG
gtggaaaagttaggattcca

SEQ ID NO: 58283 - DNA, 20 bp, Artificial Sequence
  Description of Artificial Sequence: Synthetic oligonucleotide
  Target: SCN10A; (+) strand; PAM type: YTN; PAM sequence: TTA
ggattccaactggcatttcc

SEQ ID NO: 58284 - DNA, 20 bp, Artificial Sequence
  Description of Artificial Sequence: Synthetic oligonucleotide
  Target: SCN10A; (+) strand; PAM type: YTN; PAM sequence: TTC
caactggcatttccagatcc

SEQ ID NO: 58285 - DNA, 20 bp, Artificial Sequence
  Description of Artificial Sequence: Synthetic oligonucleotide
  Target: SCN10A; (+) strand; PAM type: YTN; PAM sequence: CTG
gcatttccagatcccaggac

SEQ ID NO: 58286 - DNA, 20 bp, Artificial Sequence
  Description of Artificial Sequence: Synthetic oligonucleotide
  Target: SCN10A; (+) strand; PAM type: YTN; PAM sequence: TTT
ccagatcccaggacagtgct

SEQ ID NO: 58287 - DNA, 20 bp, Artificial Sequence
  Description of Artificial Sequence: Synthetic oligonucleotide
  Target: SCN10A; (+) strand; PAM type: YTN; PAM sequence: TTC
cagatcccaggacagtgctc

SEQ ID NO: 58288 - DNA, 20 bp, Artificial Sequence
  Description of Artificial Sequence: Synthetic oligonucleotide
  Target: SCN10A; (+) strand; PAM type: YTN; PAM sequence: CTC
tttcctgctccacccagcct

SEQ ID NO: 58289 - DNA, 20 bp, Artificial Sequence
  Description of Artificial Sequence: Synthetic oligonucleotide
  Target: SCN10A; (+) strand; PAM type: YTN; PAM sequence: CTT
tcctgctccacccagcctca

SEQ ID NO: 58290 - DNA, 20 bp, Artificial Sequence
  Description of Artificial Sequence: Synthetic oligonucleotide
  Target: SCN10A; (+) strand; PAM type: YTN; PAM sequence: TTT
cctgctccacccagcctcaa

SEQ ID NO: 58291 - DNA, 20 bp, Artificial Sequence
  Description of Artificial Sequence: Synthetic oligonucleotide
  Target: SCN10A; (+) strand; PAM type: YTN; PAM sequence: TTC
ctgctccacccagcctcaat

SEQ ID NO: 58292 - DNA, 20 bp, Artificial Sequence
  Description of Artificial Sequence: Synthetic oligonucleotide
  Target: SCN10A; (+) strand; PAM type: YTN; PAM sequence: CTG
ctccacccagcctcaatctc

SEQ ID NO: 58293 - DNA, 20 bp, Artificial Sequence
  Description of Artificial Sequence: Synthetic oligonucleotide
  Target: SCN10A; (+) strand; PAM type: YTN; PAM sequence: CTC
cacccagcctcaatctcaaa

SEQ ID NO: 58294 - DNA, 20 bp, Artificial Sequence
  Description of Artificial Sequence: Synthetic oligonucleotide
  Target: SCN10A; (+) strand; PAM type: YTN; PAM sequence: CTC
aatctcaaactgaaaaatat

SEQ ID NO: 58295 - DNA, 20 bp, Artificial Sequence
  Description of Artificial Sequence: Synthetic oligonucleotide
  Target: SCN10A; (+) strand; PAM type: YTN; PAM sequence: CTC
aaactgaaaaatatcaggat

SEQ ID NO: 58296 - DNA, 20 bp, Artificial Sequence
  Description of Artificial Sequence: Synthetic oligonucleotide
  Target: SCN10A; (+) strand; PAM type: YTN; PAM sequence: CTG
aaaaatatcaggatcccaga

SEQ ID NO: 58297 - DNA, 20 bp, Artificial Sequence
  Description of Artificial Sequence: Synthetic oligonucleotide
  Target: SCN10A; (+) strand; PAM type: YTN; PAM sequence: CTC
atgatacaggtcagcatcac

SEQ ID NO: 58298 - DNA, 20 bp, Artificial Sequence
  Description of Artificial Sequence: Synthetic oligonucleotide
  Target: SCN10A; (+) strand; PAM type: YTN; PAM sequence: CTT
tatgatataacgctggtgtg

SEQ ID NO: 58299 - DNA, 20 bp, Artificial Sequence
  Description of Artificial Sequence: Synthetic oligonucleotide
  Target: SCN10A; (+) strand; PAM type: YTN; PAM sequence: TTT
atgatataacgctggtgtgg

SEQ ID NO: 58300 - DNA, 20 bp, Artificial Sequence
  Description of Artificial Sequence: Synthetic oligonucleotide
  Target: SCN10A; (+) strand; PAM type: YTN; PAM sequence: TTA
tgatataacgctggtgtgga

SEQ ID NO: 58301 - DNA, 20 bp, Artificial Sequence
  Description of Artificial Sequence: Synthetic oligonucleotide
  Target: SCN10A; (+) strand; PAM type: YTN; PAM sequence: CTG
gtgtggacatacatttaaaa

SEQ ID NO: 58302 - DNA, 20 bp, Artificial Sequence
  Description of Artificial Sequence: Synthetic oligonucleotide
  Target: SCN10A; (+) strand; PAM type: YTN; PAM sequence: TTT
aaaaatattaattttaatgg

SEQ ID NO: 58303 - DNA, 20 bp, Artificial Sequence
  Description of Artificial Sequence: Synthetic oligonucleotide
  Target: SCN10A; (+) strand; PAM type: YTN; PAM sequence: TTA
aaaatattaattttaatgga

SEQ ID NO: 58304 - DNA, 20 bp, Artificial Sequence
  Description of Artificial Sequence: Synthetic oligonucleotide
  Target: SCN10A; (+) strand; PAM type: YTN; PAM sequence: TTA
attttaatggatatctcaaa

SEQ ID NO: 58305 - DNA, 20 bp, Artificial Sequence
  Description of Artificial Sequence: Synthetic oligonucleotide
  Target: SCN10A; (+) strand; PAM type: YTN; PAM sequence: TTT
taatggatatctcaaaggct

SEQ ID NO: 58306 - DNA, 20 bp, Artificial Sequence
  Description of Artificial Sequence: Synthetic oligonucleotide
  Target: SCN10A; (+) strand; PAM type: YTN; PAM sequence: TTT
aatggatatctcaaaggctt

SEQ ID NO: 58307 - DNA, 20 bp, Artificial Sequence
  Description of Artificial Sequence: Synthetic oligonucleotide
  Target: SCN10A; (+) strand; PAM type: YTN; PAM sequence: TTA
atggatatctcaaaggcttt

SEQ ID NO: 58308 - DNA, 20 bp, Artificial Sequence
  Description of Artificial Sequence: Synthetic oligonucleotide
  Target: SCN10A; (+) strand; PAM type: YTN; PAM sequence: CTC
aaaggcttttcatgacatag

SEQ ID NO: 58309 - DNA, 20 bp, Artificial Sequence
  Description of Artificial Sequence: Synthetic oligonucleotide
  Target: SCN10A; (+) strand; PAM type: YTN; PAM sequence: CTT
ttcatgacataggccacagg

SEQ ID NO: 58310 - DNA, 20 bp, Artificial Sequence
  Description of Artificial Sequence: Synthetic oligonucleotide
  Target: SCN10A; (+) strand; PAM type: YTN; PAM sequence: TTT
tcatgacataggccacaggt

SEQ ID NO: 58311 - DNA, 20 bp, Artificial Sequence
  Description of Artificial Sequence: Synthetic oligonucleotide
  Target: SCN10A; (+) strand; PAM type: YTN; PAM sequence: TTT
catgacataggccacaggtg

SEQ ID NO: 58312 - DNA, 20 bp, Artificial Sequence
  Description of Artificial Sequence: Synthetic oligonucleotide
  Target: SCN10A; (+) strand; PAM type: YTN; PAM sequence: TTC
atgacataggccacaggtgt

SEQ ID NO: 58313 - DNA, 20 bp, Artificial Sequence
  Description of Artificial Sequence: Synthetic oligonucleotide
  Target: SCN10A; (+) strand; PAM type: YTN; PAM sequence: TTA
ccctgggtcagagcagttgt

SEQ ID NO: 58314 - DNA, 20 bp, Artificial Sequence
  Description of Artificial Sequence: Synthetic oligonucleotide
  Target: SCN10A; (+) strand; PAM type: YTN; PAM sequence: CTG
ggtcagagcagttgtccgac

SEQ ID NO: 58315 - DNA, 20 bp, Artificial Sequence
  Description of Artificial Sequence: Synthetic oligonucleotide
  Target: SCN10A; (+) strand; PAM type: YTN; PAM sequence: TTG
tccgacagctctcacatgca

SEQ ID NO: 58316 - DNA, 20 bp, Artificial Sequence
  Description of Artificial Sequence: Synthetic oligonucleotide
  Target: SCN10A; (+) strand; PAM type: YTN; PAM sequence: CTC
tcacatgcagtcatgcaaaa

SEQ ID NO: 58317 - DNA, 20 bp, Artificial Sequence
  Description of Artificial Sequence: Synthetic oligonucleotide
  Target: SCN10A; (+) strand; PAM type: YTN; PAM sequence: CTC
acatgcagtcatgcaaaatc

SEQ ID NO: 58318 - DNA, 20 bp, Artificial Sequence
  Description of Artificial Sequence: Synthetic oligonucleotide
  Target: SCN10A; (+) strand; PAM type: YTN; PAM sequence: CTA
aataatattgccaatctctg

SEQ ID NO: 58319 - DNA, 20 bp, Artificial Sequence
  Description of Artificial Sequence: Synthetic oligonucleotide
  Target: SCN10A; (+) strand; PAM type: YTN; PAM sequence: TTG
ccaatctctgtatggtgctc

SEQ ID NO: 58320 - DNA, 20 bp, Artificial Sequence
  Description of Artificial Sequence: Synthetic oligonucleotide
  Target: SCN10A; (+) strand; PAM type: YTN; PAM sequence: CTC
tgtatggtgctccacagagg

SEQ ID NO: 58321 - DNA, 20 bp, Artificial Sequence
  Description of Artificial Sequence: Synthetic oligonucleotide
  Target: SCN10A; (+) strand; PAM type: YTN; PAM sequence: CTG
tatggtgctccacagaggac

SEQ ID NO: 58322 - DNA, 20 bp, Artificial Sequence
  Description of Artificial Sequence: Synthetic oligonucleotide
  Target: SCN10A; (+) strand; PAM type: YTN; PAM sequence: CTC
cacagaggactaccttggac

SEQ ID NO: 58323 - DNA, 20 bp, Artificial Sequence
  Description of Artificial Sequence: Synthetic oligonucleotide
  Target: SCN10A; (+) strand; PAM type: YTN; PAM sequence: CTA
ccttggaccttcagtaatgt

SEQ ID NO: 58324 - DNA, 20 bp, Artificial Sequence
  Description of Artificial Sequence: Synthetic oligonucleotide
  Target: SCN10A; (+) strand; PAM type: YTN; PAM sequence: CTT
ggaccttcagtaatgttctt

SEQ ID NO: 58325 - DNA, 20 bp, Artificial Sequence
  Description of Artificial Sequence: Synthetic oligonucleotide
  Target: SCN10A; (+) strand; PAM type: YTN; PAM sequence: TTG
gaccttcagtaatgttcttg

SEQ ID NO: 58326 - DNA, 20 bp, Artificial Sequence
  Description of Artificial Sequence: Synthetic oligonucleotide
  Target: SCN10A; (+) strand; PAM type: YTN; PAM sequence: CTT
cagtaatgttcttgttctat

SEQ ID NO: 58327 - DNA, 20 bp, Artificial Sequence
  Description of Artificial Sequence: Synthetic oligonucleotide
  Target: SCN10A; (+) strand; PAM type: YTN; PAM sequence: TTC
agtaatgttcttgttctata

SEQ ID NO: 58328 - DNA, 20 bp, Artificial Sequence
  Description of Artificial Sequence: Synthetic oligonucleotide
  Target: SCN10A; (+) strand; PAM type: YTN; PAM sequence: TTC
ttgttctatatctttggaag

SEQ ID NO: 58329 - DNA, 20 bp, Artificial Sequence
  Description of Artificial Sequence: Synthetic oligonucleotide
  Target: SCN10A; (+) strand; PAM type: YTN; PAM sequence: CTT
gttctatatctttggaagtt

SEQ ID NO: 58330 - DNA, 20 bp, Artificial Sequence
  Description of Artificial Sequence: Synthetic oligonucleotide
  Target: SCN10A; (+) strand; PAM type: YTN; PAM sequence: TTG
ttctatatctttggaagttc

SEQ ID NO: 58331 - DNA, 20 bp, Artificial Sequence
  Description of Artificial Sequence: Synthetic oligonucleotide
  Target: SCN10A; (+) strand; PAM type: YTN; PAM sequence: TTC
tatatctttggaagttctgg

SEQ ID NO: 58332 - DNA, 20 bp, Artificial Sequence
  Description of Artificial Sequence: Synthetic oligonucleotide
  Target: SCN10A; (+) strand; PAM type: YTN; PAM sequence: CTA
tatctttggaagttctggtc

SEQ ID NO: 58333 - DNA, 20 bp, Artificial Sequence
  Description of Artificial Sequence: Synthetic oligonucleotide
  Target: SCN10A; (+) strand; PAM type: YTN; PAM sequence: CTT
tggaagttctggtcctgaga

SEQ ID NO: 58334 - DNA, 20 bp, Artificial Sequence
  Description of Artificial Sequence: Synthetic oligonucleotide
  Target: SCN10A; (+) strand; PAM type: YTN; PAM sequence: TTT
ggaagttctggtcctgagaa

SEQ ID NO: 58335 - DNA, 20 bp, Artificial Sequence
  Description of Artificial Sequence: Synthetic oligonucleotide
  Target: SCN10A; (+) strand; PAM type: YTN; PAM sequence: TTG
gaagttctggtcctgagaag

SEQ ID NO: 58336 - DNA, 20 bp, Artificial Sequence
  Description of Artificial Sequence: Synthetic oligonucleotide
  Target: SCN10A; (+) strand; PAM type: YTN; PAM sequence: TTC
tggtcctgagaagtttgtct

SEQ ID NO: 58337 - DNA, 20 bp, Artificial Sequence
  Description of Artificial Sequence: Synthetic oligonucleotide
  Target: SCN10A; (+) strand; PAM type: YTN; PAM sequence: CTG
gtcctgagaagtttgtctca

SEQ ID NO: 58338 - DNA, 20 bp, Artificial Sequence
  Description of Artificial Sequence: Synthetic oligonucleotide
  Target: SCN10A; (+) strand; PAM type: YTN; PAM sequence: CTG
agaagtttgtctcagtaaat

SEQ ID NO: 58339 - DNA, 20 bp, Artificial Sequence
  Description of Artificial Sequence: Synthetic oligonucleotide
  Target: SCN10A; (+) strand; PAM type: YTN; PAM sequence: TTT
gtctcagtaaatataatctg

SEQ ID NO: 58340 - DNA, 20 bp, Artificial Sequence
  Description of Artificial Sequence: Synthetic oligonucleotide
  Target: SCN10A; (+) strand; PAM type: YTN; PAM sequence: TTG
tctcagtaaatataatctga

SEQ ID NO: 58341 - DNA, 20 bp, Artificial Sequence
  Description of Artificial Sequence: Synthetic oligonucleotide
  Target: SCN10A; (+) strand; PAM type: YTN; PAM sequence: CTC
agtaaatataatctgattac

SEQ ID NO: 58342 - DNA, 20 bp, Artificial Sequence
  Description of Artificial Sequence: Synthetic oligonucleotide
  Target: SCN10A; (+) strand; PAM type: YTN; PAM sequence: CTG
attacaacaaaaataaaagg

SEQ ID NO: 58343 - DNA, 20 bp, Artificial Sequence
  Description of Artificial Sequence: Synthetic oligonucleotide
  Target: SCN10A; (+) strand; PAM type: YTN; PAM sequence: TTA
caacaaaaataaaaggacaa

SEQ ID NO: 58344 - DNA, 20 bp, Artificial Sequence
  Description of Artificial Sequence: Synthetic oligonucleotide
  Target: SCN10A; (+) strand; PAM type: YTN; PAM sequence: TTT
tctggagagtaagagaaccc

SEQ ID NO: 58345 - DNA, 20 bp, Artificial Sequence
  Description of Artificial Sequence: Synthetic oligonucleotide
  Target: SCN10A; (+) strand; PAM type: YTN; PAM sequence: TTT
ctggagagtaagagaaccca

SEQ ID NO: 58346 - DNA, 20 bp, Artificial Sequence
  Description of Artificial Sequence: Synthetic oligonucleotide
  Target: SCN10A; (+) strand; PAM type: YTN; PAM sequence: TTC
tggagagtaagagaacccat

SEQ ID NO: 58347 - DNA, 20 bp, Artificial Sequence
  Description of Artificial Sequence: Synthetic oligonucleotide
  Target: SCN10A; (+) strand; PAM type: YTN; PAM sequence: CTG
gagagtaagagaacccatga

SEQ ID NO: 58348 - DNA, 20 bp, Artificial Sequence
  Description of Artificial Sequence: Synthetic oligonucleotide
  Target: SCN10A; (+) strand; PAM type: YTN; PAM sequence: CTG
atattgaaattcagaaggga

SEQ ID NO: 58349 - DNA, 20 bp, Artificial Sequence
  Description of Artificial Sequence: Synthetic oligonucleotide
  Target: SCN10A; (+) strand; PAM type: YTN; PAM sequence: TTG
aaattcagaagggaaatcac

SEQ ID NO: 58350 - DNA, 20 bp, Artificial Sequence
  Description of Artificial Sequence: Synthetic oligonucleotide
  Target: SCN10A; (+) strand; PAM type: YTN; PAM sequence: TTC
agaagggaaatcacagtgga

SEQ ID NO: 58351 - DNA, 20 bp, Artificial Sequence
  Description of Artificial Sequence: Synthetic oligonucleotide
  Target: SCN10A; (+) strand; PAM type: YTN; PAM sequence: CTC
ttagcttctgactcctattt

SEQ ID NO: 58352 - DNA, 20 bp, Artificial Sequence
  Description of Artificial Sequence: Synthetic oligonucleotide
  Target: SCN10A; (+) strand; PAM type: YTN; PAM sequence: CTT
agcttctgactcctatttgt

SEQ ID NO: 58353 - DNA, 20 bp, Artificial Sequence
  Description of Artificial Sequence: Synthetic oligonucleotide
  Target: SCN10A; (+) strand; PAM type: YTN; PAM sequence: TTA
gcttctgactcctatttgtg

SEQ ID NO: 58354 - DNA, 20 bp, Artificial Sequence
  Description of Artificial Sequence: Synthetic oligonucleotide
  Target: SCN10A; (+) strand; PAM type: YTN; PAM sequence: CTT
ctgactcctatttgtgtatg

SEQ ID NO: 58355 - DNA, 20 bp, Artificial Sequence
  Description of Artificial Sequence: Synthetic oligonucleotide
  Target: SCN10A; (+) strand; PAM type: YTN; PAM sequence: TTC
tgactcctatttgtgtatga

SEQ ID NO: 58356 - DNA, 20 bp, Artificial Sequence
  Description of Artificial Sequence: Synthetic oligonucleotide
  Target: SCN10A; (+) strand; PAM type: YTN; PAM sequence: CTG
actcctatttgtgtatgatg

SEQ ID NO: 58357 - DNA, 20 bp, Artificial Sequence
  Description of Artificial Sequence: Synthetic oligonucleotide
  Target: SCN10A; (+) strand; PAM type: YTN; PAM sequence: CTC
ctatttgtgtatgatggttt

SEQ ID NO: 58358 - DNA, 20 bp, Artificial Sequence
  Description of Artificial Sequence: Synthetic oligonucleotide
  Target: SCN10A; (+) strand; PAM type: YTN; PAM sequence: CTA
tttgtgtatgatggtttttt

SEQ ID NO: 58359 - DNA, 20 bp, Artificial Sequence
  Description of Artificial Sequence: Synthetic oligonucleotide
  Target: SCN10A; (+) strand; PAM type: YTN; PAM sequence: TTT
gtgtatgatggttttttcaa

SEQ ID NO: 58360 - DNA, 20 bp, Artificial Sequence
  Description of Artificial Sequence: Synthetic oligonucleotide
  Target: SCN10A; (+) strand; PAM type: YTN; PAM sequence: TTG
tgtatgatggttttttcaaa

SEQ ID NO: 58361 - DNA, 20 bp, Artificial Sequence
  Description of Artificial Sequence: Synthetic oligonucleotide
  Target: SCN10A; (+) strand; PAM type: YTN; PAM sequence: TTT
tttcaaaggtggttaccagt

SEQ ID NO: 58362 - DNA, 20 bp, Artificial Sequence
  Description of Artificial Sequence: Synthetic oligonucleotide
  Target: SCN10A; (+) strand; PAM type: YTN; PAM sequence: TTT
ttcaaaggtggttaccagtt

SEQ ID NO: 58363 - DNA, 20 bp, Artificial Sequence
  Description of Artificial Sequence: Synthetic oligonucleotide
  Target: SCN10A; (+) strand; PAM type: YTN; PAM sequence: TTT
tcaaaggtggttaccagttg

SEQ ID NO: 58364 - DNA, 20 bp, Artificial Sequence
  Description of Artificial Sequence: Synthetic oligonucleotide
  Target: SCN10A; (+) strand; PAM type: YTN; PAM sequence: TTT
caaaggtggttaccagttgc

SEQ ID NO: 58365 - DNA, 20 bp, Artificial Sequence
  Description of Artificial Sequence: Synthetic oligonucleotide
  Target: SCN10A; (+) strand; PAM type: YTN; PAM sequence: TTC
aaaggtggttaccagttgca

SEQ ID NO: 58366 - DNA, 20 bp, Artificial Sequence
  Description of Artificial Sequence: Synthetic oligonucleotide
  Target: SCN10A; (+) strand; PAM type: YTN; PAM sequence: TTA
ccagttgcattccctgccca

SEQ ID NO: 58367 - DNA, 20 bp, Artificial Sequence
  Description of Artificial Sequence: Synthetic oligonucleotide
  Target: SCN10A; (+) strand; PAM type: YTN; PAM sequence: TTG
cattccctgcccagttctga

SEQ ID NO: 58368 - DNA, 20 bp, Artificial Sequence
  Description of Artificial Sequence: Synthetic oligonucleotide
  Target: SCN10A; (+) strand; PAM type: YTN; PAM sequence: TTC
cctgcccagttctgacattg

SEQ ID NO: 58369 - DNA, 20 bp, Artificial Sequence
  Description of Artificial Sequence: Synthetic oligonucleotide
  Target: SCN10A; (+) strand; PAM type: YTN; PAM sequence: CTG
cccagttctgacattgtgac

SEQ ID NO: 58370 - DNA, 20 bp, Artificial Sequence
  Description of Artificial Sequence: Synthetic oligonucleotide
  Target: SCN10A; (+) strand; PAM type: YTN; PAM sequence: TTC
tgacattgtgaccagtggca

SEQ ID NO: 58371 - DNA, 20 bp, Artificial Sequence
  Description of Artificial Sequence: Synthetic oligonucleotide
  Target: SCN10A; (+) strand; PAM type: YTN; PAM sequence: CTG
acattgtgaccagtggcatg

SEQ ID NO: 58372 - DNA, 20 bp, Artificial Sequence
  Description of Artificial Sequence: Synthetic oligonucleotide
  Target: SCN10A; (+) strand; PAM type: YTN; PAM sequence: TTG
tgaccagtggcatgcattgg

SEQ ID NO: 58373 - DNA, 20 bp, Artificial Sequence
  Description of Artificial Sequence: Synthetic oligonucleotide
  Target: SCN10A; (+) strand; PAM type: YTN; PAM sequence: TTG
gtgaggctgtagctgggtgt

SEQ ID NO: 58374 - DNA, 20 bp, Artificial Sequence
  Description of Artificial Sequence: Synthetic oligonucleotide
  Target: SCN10A; (+) strand; PAM type: YTN; PAM sequence: CTG
tagctgggtgtgatctgcaa

SEQ ID NO: 58375 - DNA, 20 bp, Artificial Sequence
  Description of Artificial Sequence: Synthetic oligonucleotide
  Target: SCN10A; (+) strand; PAM type: YTN; PAM sequence: CTG
ggtgtgatctgcaatgggaa

SEQ ID NO: 58376 - DNA, 20 bp, Artificial Sequence
  Description of Artificial Sequence: Synthetic oligonucleotide
  Target: SCN10A; (+) strand; PAM type: YTN; PAM sequence: CTG
caatgggaaagagttaacac

SEQ ID NO: 58377 - DNA, 20 bp, Artificial Sequence
  Description of Artificial Sequence: Synthetic oligonucleotide
  Target: SCN10A; (+) strand; PAM type: YTN; PAM sequence: TTA
acacagagcagaaggacgca

SEQ ID NO: 58378 - DNA, 20 bp, Artificial Sequence
  Description of Artificial Sequence: Synthetic oligonucleotide
  Target: SCN10A; (+) strand; PAM type: YTN; PAM sequence: CTG
aacatatccaggctggagtg

SEQ ID NO: 58379 - DNA, 20 bp, Artificial Sequence
  Description of Artificial Sequence: Synthetic oligonucleotide
  Target: SCN10A; (+) strand; PAM type: YTN; PAM sequence: CTG
gagtgttctcactagggccc

SEQ ID NO: 58380 - DNA, 20 bp, Artificial Sequence
  Description of Artificial Sequence: Synthetic oligonucleotide
  Target: SCN10A; (+) strand; PAM type: YTN; PAM sequence: TTC
tcactagggcccaggggcaa

SEQ ID NO: 58381 - DNA, 20 bp, Artificial Sequence
  Description of Artificial Sequence: Synthetic oligonucleotide
  Target: SCN10A; (+) strand; PAM type: YTN; PAM sequence: CTC
actagggcccaggggcaatc

SEQ ID NO: 58382 - DNA, 20 bp, Artificial Sequence
  Description of Artificial Sequence: Synthetic oligonucleotide
  Target: SCN10A; (+) strand; PAM type: YTN; PAM sequence: CTA
gggcccaggggcaatcagct

SEQ ID NO: 58383 - DNA, 20 bp, Artificial Sequence
  Description of Artificial Sequence: Synthetic oligonucleotide
  Target: SCN10A; (+) strand; PAM type: YTN; PAM sequence: CTC
catactggtggcttcatctt

SEQ ID NO: 58384 - DNA, 20 bp, Artificial Sequence
  Description of Artificial Sequence: Synthetic oligonucleotide
  Target: SCN10A; (+) strand; PAM type: YTN; PAM sequence: CTG
gtggcttcatcttcattttg

SEQ ID NO: 58385 - DNA, 20 bp, Artificial Sequence
  Description of Artificial Sequence: Synthetic oligonucleotide
  Target: SCN10A; (+) strand; PAM type: YTN; PAM sequence: CTT
catcttcattttgtattgag

SEQ ID NO: 58386 - DNA, 20 bp, Artificial Sequence
  Description of Artificial Sequence: Synthetic oligonucleotide
  Target: SCN10A; (+) strand; PAM type: YTN; PAM sequence: TTC
atcttcattttgtattgagc

SEQ ID NO: 58387 - DNA, 20 bp, Artificial Sequence
  Description of Artificial Sequence: Synthetic oligonucleotide
  Target: SCN10A; (+) strand; PAM type: YTN; PAM sequence: CTT
cattttgtattgagctagat

SEQ ID NO: 58388 - DNA, 20 bp, Artificial Sequence
  Description of Artificial Sequence: Synthetic oligonucleotide
  Target: SCN10A; (+) strand; PAM type: YTN; PAM sequence: TTC
attttgtattgagctagatg

SEQ ID NO: 58389 - DNA, 20 bp, Artificial Sequence
  Description of Artificial Sequence: Synthetic oligonucleotide
  Target: SCN10A; (+) strand; PAM type: YTN; PAM sequence: TTT
tgtattgagctagatgtcct

SEQ ID NO: 58390 - DNA, 20 bp, Artificial Sequence
  Description of Artificial Sequence: Synthetic oligonucleotide
  Target: SCN10A; (+) strand; PAM type: YTN; PAM sequence: TTT
gtattgagctagatgtcctc

SEQ ID NO: 58391 - DNA, 20 bp, Artificial Sequence
  Description of Artificial Sequence: Synthetic oligonucleotide
  Target: SCN10A; (+) strand; PAM type: YTN; PAM sequence: TTG
tattgagctagatgtcctca

SEQ ID NO: 58392 - DNA, 20 bp, Artificial Sequence
  Description of Artificial Sequence: Synthetic oligonucleotide
  Target: SCN10A; (+) strand; PAM type: YTN; PAM sequence: TTG
agctagatgtcctcatgttg

SEQ ID NO: 58393 - DNA, 20 bp, Artificial Sequence
  Description of Artificial Sequence: Synthetic oligonucleotide
  Target: SCN10A; (+) strand; PAM type: YTN; PAM sequence: CTA
gatgtcctcatgttgactct

SEQ ID NO: 58394 - DNA, 20 bp, Artificial Sequence
  Description of Artificial Sequence: Synthetic oligonucleotide
  Target: SCN10A; (+) strand; PAM type: YTN; PAM sequence: CTC
atgttgactctatcactaag

SEQ ID NO: 58395 - DNA, 20 bp, Artificial Sequence
  Description of Artificial Sequence: Synthetic oligonucleotide
  Target: SCN10A; (+) strand; PAM type: YTN; PAM sequence: TTG
actctatcactaaggcctct

SEQ ID NO: 58396 - DNA, 20 bp, Artificial Sequence
  Description of Artificial Sequence: Synthetic oligonucleotide
  Target: SCN10A; (+) strand; PAM type: YTN; PAM sequence: CTC
tatcactaaggcctctagtg

SEQ ID NO: 58397 - DNA, 20 bp, Artificial Sequence
  Description of Artificial Sequence: Synthetic oligonucleotide
  Target: SCN10A; (+) strand; PAM type: YTN; PAM sequence: CTA
tcactaaggcctctagtgac

SEQ ID NO: 58398 - DNA, 20 bp, Artificial Sequence
  Description of Artificial Sequence: Synthetic oligonucleotide
  Target: SCN10A; (+) strand; PAM type: YTN; PAM sequence: CTA
aggcctctagtgacactctc

SEQ ID NO: 58399 - DNA, 20 bp, Artificial Sequence
  Description of Artificial Sequence: Synthetic oligonucleotide
  Target: SCN10A; (+) strand; PAM type: YTN; PAM sequence: CTC
tagtgacactctcataggac

SEQ ID NO: 58400 - DNA, 20 bp, Artificial Sequence
  Description of Artificial Sequence: Synthetic oligonucleotide
  Target: SCN10A; (+) strand; PAM type: YTN; PAM sequence: CTA
gtgacactctcataggacgg

SEQ ID NO: 58401 - DNA, 20 bp, Artificial Sequence
  Description of Artificial Sequence: Synthetic oligonucleotide
  Target: SCN10A; (+) strand; PAM type: YTN; PAM sequence: CTC
tcataggacggtgggaatga

SEQ ID NO: 58402 - DNA, 20 bp, Artificial Sequence
  Description of Artificial Sequence: Synthetic oligonucleotide
  Target: SCN10A; (+) strand; PAM type: YTN; PAM sequence: CTC
ataggacggtgggaatgatg

SEQ ID NO: 58403 - DNA, 20 bp, Artificial Sequence
  Description of Artificial Sequence: Synthetic oligonucleotide
  Target: SCN10A; (+) strand; PAM type: YTN; PAM sequence: TTT
cagatttgtctgggagtaca

SEQ ID NO: 58404 - DNA, 20 bp, Artificial Sequence
  Description of Artificial Sequence: Synthetic oligonucleotide
  Target: SCN10A; (+) strand; PAM type: YTN; PAM sequence: TTC
agatttgtctgggagtacac

SEQ ID NO: 58405 - DNA, 20 bp, Artificial Sequence
  Description of Artificial Sequence: Synthetic oligonucleotide
  Target: SCN10A; (+) strand; PAM type: YTN; PAM sequence: TTT
gtctgggagtacacaatttt

SEQ ID NO: 58406 - DNA, 20 bp, Artificial Sequence
  Description of Artificial Sequence: Synthetic oligonucleotide
  Target: SCN10A; (+) strand; PAM type: YTN; PAM sequence: TTG
tctgggagtacacaattttc

SEQ ID NO: 58407 - DNA, 20 bp, Artificial Sequence
  Description of Artificial Sequence: Synthetic oligonucleotide
  Target: SCN10A; (+) strand; PAM type: YTN; PAM sequence: CTG
ggagtacacaattttcattt

SEQ ID NO: 58408 - DNA, 20 bp, Artificial Sequence
  Description of Artificial Sequence: Synthetic oligonucleotide
  Target: SCN10A; (+) strand; PAM type: YTN; PAM sequence: TTT
tcatttgctgtgaatgcaac

SEQ ID NO: 58409 - DNA, 20 bp, Artificial Sequence
  Description of Artificial Sequence: Synthetic oligonucleotide
  Target: SCN10A; (+) strand; PAM type: YTN; PAM sequence: TTT
catttgctgtgaatgcaaca

SEQ ID NO: 58410 - DNA, 20 bp, Artificial Sequence
  Description of Artificial Sequence: Synthetic oligonucleotide
  Target: SCN10A; (+) strand; PAM type: YTN; PAM sequence: TTC
atttgctgtgaatgcaacaa

SEQ ID NO: 58411 - DNA, 20 bp, Artificial Sequence
  Description of Artificial Sequence: Synthetic oligonucleotide
  Target: SCN10A; (+) strand; PAM type: YTN; PAM sequence: TTT
gctgtgaatgcaacaaaacc

SEQ ID NO: 58412 - DNA, 20 bp, Artificial Sequence
  Description of Artificial Sequence: Synthetic oligonucleotide
  Target: SCN10A; (+) strand; PAM type: YTN; PAM sequence: TTG
ctgtgaatgcaacaaaacct

SEQ ID NO: 58413 - DNA, 20 bp, Artificial Sequence
  Description of Artificial Sequence: Synthetic oligonucleotide
  Target: SCN10A; (+) strand; PAM type: YTN; PAM sequence: CTG
tgaatgcaacaaaaccttca

SEQ ID NO: 58414 - DNA, 20 bp, Artificial Sequence
  Description of Artificial Sequence: Synthetic oligonucleotide
  Target: SCN10A; (+) strand; PAM type: YTN; PAM sequence: CTT
catctgggagtgatgcagcc

SEQ ID NO: 58415 - DNA, 20 bp, Artificial Sequence
  Description of Artificial Sequence: Synthetic oligonucleotide
  Target: SCN10A; (+) strand; PAM type: YTN; PAM sequence: TTC
atctgggagtgatgcagcct

SEQ ID NO: 58416 - DNA, 20 bp, Artificial Sequence
  Description of Artificial Sequence: Synthetic oligonucleotide
  Target: SCN10A; (+) strand; PAM type: YTN; PAM sequence: CTG
ggagtgatgcagcctcctcc

SEQ ID NO: 58417 - DNA, 20 bp, Artificial Sequence
  Description of Artificial Sequence: Synthetic oligonucleotide
  Target: SCN10A; (+) strand; PAM type: YTN; PAM sequence: CTC
ctcctcagctctgggcacac

SEQ ID NO: 58418 - DNA, 20 bp, Artificial Sequence
  Description of Artificial Sequence: Synthetic oligonucleotide
  Target: SCN10A; (+) strand; PAM type: YTN; PAM sequence: CTC
ctcagctctgggcacacatg

SEQ ID NO: 58419 - DNA, 20 bp, Artificial Sequence
  Description of Artificial Sequence: Synthetic oligonucleotide
  Target: SCN10A; (+) strand; PAM type: YTN; PAM sequence: CTC
agctctgggcacacatgggg

SEQ ID NO: 58420 - DNA, 20 bp, Artificial Sequence
  Description of Artificial Sequence: Synthetic oligonucleotide
  Target: SCN10A; (+) strand; PAM type: YTN; PAM sequence: CTC
tgggcacacatggggtgtta

SEQ ID NO: 58421 - DNA, 20 bp, Artificial Sequence
  Description of Artificial Sequence: Synthetic oligonucleotide
  Target: SCN10A; (+) strand; PAM type: YTN; PAM sequence: CTG
ggcacacatggggtgttaga

SEQ ID NO: 58422 - DNA, 20 bp, Artificial Sequence
  Description of Artificial Sequence: Synthetic oligonucleotide
  Target: SCN10A; (+) strand; PAM type: YTN; PAM sequence: TTA
gagagtgccatggagcggtg

SEQ ID NO: 58423 - DNA, 20 bp, Artificial Sequence
  Description of Artificial Sequence: Synthetic oligonucleotide
  Target: SCN10A; (+) strand; PAM type: YTN; PAM sequence: CTC
cgataggccttttgaatgac

SEQ ID NO: 58424 - DNA, 20 bp, Artificial Sequence
  Description of Artificial Sequence: Synthetic oligonucleotide
  Target: SCN10A; (+) strand; PAM type: YTN; PAM sequence: CTT
ttgaatgacagtggctgaaa

SEQ ID NO: 58425 - DNA, 20 bp, Artificial Sequence
  Description of Artificial Sequence: Synthetic oligonucleotide
  Target: SCN10A; (+) strand; PAM type: YTN; PAM sequence: TTT
tgaatgacagtggctgaaat

SEQ ID NO: 58426 - DNA, 20 bp, Artificial Sequence
  Description of Artificial Sequence: Synthetic oligonucleotide
  Target: SCN10A; (+) strand; PAM type: YTN; PAM sequence: TTT
gaatgacagtggctgaaatg

SEQ ID NO: 58427 - DNA, 20 bp, Artificial Sequence
  Description of Artificial Sequence: Synthetic oligonucleotide
  Target: SCN10A; (+) strand; PAM type: YTN; PAM sequence: TTG
aatgacagtggctgaaatgt

SEQ ID NO: 58428 - DNA, 20 bp, Artificial Sequence
  Description of Artificial Sequence: Synthetic oligonucleotide
  Target: SCN10A; (+) strand; PAM type: YTN; PAM sequence: CTG
aaatgtcttcttgcttccat

SEQ ID NO: 58429 - DNA, 20 bp, Artificial Sequence
  Description of Artificial Sequence: Synthetic oligonucleotide
  Target: SCN10A; (+) strand; PAM type: YTN; PAM sequence: CTT
cttgcttccatcggagagtg

SEQ ID NO: 58430 - DNA, 20 bp, Artificial Sequence
  Description of Artificial Sequence: Synthetic oligonucleotide
  Target: SCN10A; (+) strand; PAM type: YTN; PAM sequence: TTC
ttgcttccatcggagagtgg

SEQ ID NO: 58431 - DNA, 20 bp, Artificial Sequence
  Description of Artificial Sequence: Synthetic oligonucleotide
  Target: SCN10A; (+) strand; PAM type: YTN; PAM sequence: CTT
gcttccatcggagagtggtt

SEQ ID NO: 58432 - DNA, 20 bp, Artificial Sequence
  Description of Artificial Sequence: Synthetic oligonucleotide
  Target: SCN10A; (+) strand; PAM type: YTN; PAM sequence: TTG
cttccatcggagagtggttg

SEQ ID NO: 58433 - DNA, 20 bp, Artificial Sequence
  Description of Artificial Sequence: Synthetic oligonucleotide
  Target: SCN10A; (+) strand; PAM type: YTN; PAM sequence: CTT
ccatcggagagtggttgcta

SEQ ID NO: 58434 - DNA, 20 bp, Artificial Sequence
  Description of Artificial Sequence: Synthetic oligonucleotide
  Target: SCN10A; (+) strand; PAM type: YTN; PAM sequence: TTC
catcggagagtggttgctat

SEQ ID NO: 58435 - DNA, 20 bp, Artificial Sequence
  Description of Artificial Sequence: Synthetic oligonucleotide
  Target: SCN10A; (+) strand; PAM type: YTN; PAM sequence: TTG
ctattggttcataggatgat

SEQ ID NO: 58436 - DNA, 20 bp, Artificial Sequence
  Description of Artificial Sequence: Synthetic oligonucleotide
  Target: SCN10A; (+) strand; PAM type: YTN; PAM sequence: CTA
ttggttcataggatgatttt

SEQ ID NO: 58437 - DNA, 20 bp, Artificial Sequence
  Description of Artificial Sequence: Synthetic oligonucleotide
  Target: SCN10A; (+) strand; PAM type: YTN; PAM sequence: TTG
gttcataggatgattttgaa

SEQ ID NO: 58438 - DNA, 20 bp, Artificial Sequence
  Description of Artificial Sequence: Synthetic oligonucleotide
  Target: SCN10A; (+) strand; PAM type: YTN; PAM sequence: TTC
ataggatgattttgaaagat

SEQ ID NO: 58439 - DNA, 20 bp, Artificial Sequence
  Description of Artificial Sequence: Synthetic oligonucleotide
  Target: SCN10A; (+) strand; PAM type: YTN; PAM sequence: TTT
tgaaagattagttgccataa

SEQ ID NO: 58440 - DNA, 20 bp, Artificial Sequence
  Description of Artificial Sequence: Synthetic oligonucleotide
  Target: SCN10A; (+) strand; PAM type: YTN; PAM sequence: TTT
gaaagattagttgccataaa

SEQ ID NO: 58441 - DNA, 20 bp, Artificial Sequence
  Description of Artificial Sequence: Synthetic oligonucleotide
  Target: SCN10A; (+) strand; PAM type: YTN; PAM sequence: TTG
aaagattagttgccataaac

SEQ ID NO: 58442 - DNA, 20 bp, Artificial Sequence
  Description of Artificial Sequence: Synthetic oligonucleotide
  Target: SCN10A; (+) strand; PAM type: YTN; PAM sequence: TTA
gttgccataaacttctcctc

SEQ ID NO: 58443 - DNA, 20 bp, Artificial Sequence
  Description of Artificial Sequence: Synthetic oligonucleotide
  Target: SCN10A; (+) strand; PAM type: YTN; PAM sequence: TTG
ccataaacttctcctccata

SEQ ID NO: 58444 - DNA, 20 bp, Artificial Sequence
  Description of Artificial Sequence: Synthetic oligonucleotide
  Target: SCN10A; (+) strand; PAM type: YTN; PAM sequence: CTT
ctcctccatatttgccttca

SEQ ID NO: 58445 - DNA, 20 bp, Artificial Sequence
  Description of Artificial Sequence: Synthetic oligonucleotide
  Target: SCN10A; (+) strand; PAM type: YTN; PAM sequence: TTC
tcctccatatttgccttcag

SEQ ID NO: 58446 - DNA, 20 bp, Artificial Sequence
  Description of Artificial Sequence: Synthetic oligonucleotide
  Target: SCN10A; (+) strand; PAM type: YTN; PAM sequence: CTC
ctccatatttgccttcagag

SEQ ID NO: 58447 - DNA, 20 bp, Artificial Sequence
  Description of Artificial Sequence: Synthetic oligonucleotide
  Target: SCN10A; (+) strand; PAM type: YTN; PAM sequence: CTC
catatttgccttcagagaat

SEQ ID NO: 58448 - DNA, 20 bp, Artificial Sequence
  Description of Artificial Sequence: Synthetic oligonucleotide
  Target: SCN10A; (+) strand; PAM type: YTN; PAM sequence: TTT
gccttcagagaatccaactc

SEQ ID NO: 58449 - DNA, 20 bp, Artificial Sequence
  Description of Artificial Sequence: Synthetic oligonucleotide
  Target: SCN10A; (+) strand; PAM type: YTN; PAM sequence: TTG
ccttcagagaatccaactcc

SEQ ID NO: 58450 - DNA, 20 bp, Artificial Sequence
  Description of Artificial Sequence: Synthetic oligonucleotide
  Target: SCN10A; (+) strand; PAM type: YTN; PAM sequence: CTT
cagagaatccaactccccgg

SEQ ID NO: 58451 - DNA, 20 bp, Artificial Sequence
  Description of Artificial Sequence: Synthetic oligonucleotide
  Target: SCN10A; (+) strand; PAM type: YTN; PAM sequence: TTC
agagaatccaactccccgga

SEQ ID NO: 58452 - DNA, 20 bp, Artificial Sequence
  Description of Artificial Sequence: Synthetic oligonucleotide
  Target: SCN10A; (+) strand; PAM type: YTN; PAM sequence: CTC
cccggattctcctaggacat

SEQ ID NO: 58453 - DNA, 20 bp, Artificial Sequence
  Description of Artificial Sequence: Synthetic oligonucleotide
  Target: SCN10A; (+) strand; PAM type: YTN; PAM sequence: TTC
tcctaggacattcttggtga

SEQ ID NO: 58454 - DNA, 20 bp, Artificial Sequence
  Description of Artificial Sequence: Synthetic oligonucleotide
  Target: SCN10A; (+) strand; PAM type: YTN; PAM sequence: CTC
ctaggacattcttggtgaaa

SEQ ID NO: 58455 - DNA, 20 bp, Artificial Sequence
  Description of Artificial Sequence: Synthetic oligonucleotide
  Target: SCN10A; (+) strand; PAM type: YTN; PAM sequence: CTA
ggacattcttggtgaaagca

SEQ ID NO: 58456 - DNA, 20 bp, Artificial Sequence
  Description of Artificial Sequence: Synthetic oligonucleotide
  Target: SCN10A; (+) strand; PAM type: YTN; PAM sequence: TTC
ttggtgaaagcaaaaaggat

SEQ ID NO: 58457 - DNA, 20 bp, Artificial Sequence
  Description of Artificial Sequence: Synthetic oligonucleotide
  Target: SCN10A; (+) strand; PAM type: YTN; PAM sequence: CTT
ggtgaaagcaaaaaggatgt

SEQ ID NO: 58458 - DNA, 20 bp, Artificial Sequence
  Description of Artificial Sequence: Synthetic oligonucleotide
  Target: SCN10A; (+) strand; PAM type: YTN; PAM sequence: TTG
gtgaaagcaaaaaggatgtc

SEQ ID NO: 58459 - DNA, 20 bp, Artificial Sequence
  Description of Artificial Sequence: Synthetic oligonucleotide
  Target: SCN10A; (+) strand; PAM type: YTN; PAM sequence: CTT
atctccagggaccaaaggca

SEQ ID NO: 58460 - DNA, 20 bp, Artificial Sequence
  Description of Artificial Sequence: Synthetic oligonucleotide
  Target: SCN10A; (+) strand; PAM type: YTN; PAM sequence: TTA
tctccagggaccaaaggcag

SEQ ID NO: 58461 - DNA, 20 bp, Artificial Sequence
  Description of Artificial Sequence: Synthetic oligonucleotide
  Target: SCN10A; (+) strand; PAM type: YTN; PAM sequence: CTC
cagggaccaaaggcaggtcc

SEQ ID NO: 58462 - DNA, 20 bp, Artificial Sequence
  Description of Artificial Sequence: Synthetic oligonucleotide
  Target: SCN10A; (+) strand; PAM type: YTN; PAM sequence: CTG
gatcagtatatttcgattgg

SEQ ID NO: 58463 - DNA, 20 bp, Artificial Sequence
  Description of Artificial Sequence: Synthetic oligonucleotide
  Target: SCN10A; (+) strand; PAM type: YTN; PAM sequence: TTT
cgattgggttttgggattct

SEQ ID NO: 58464 - DNA, 20 bp, Artificial Sequence
  Description of Artificial Sequence: Synthetic oligonucleotide
  Target: SCN10A; (+) strand; PAM type: YTN; PAM sequence: TTC
gattgggttttgggattctc

SEQ ID NO: 58465 - DNA, 20 bp, Artificial Sequence
  Description of Artificial Sequence: Synthetic oligonucleotide
  Target: SCN10A; (+) strand; PAM type: YTN; PAM sequence: TTG
ggttttgggattctcagggg

SEQ ID NO: 58466 - DNA, 20 bp, Artificial Sequence
  Description of Artificial Sequence: Synthetic oligonucleotide
  Target: SCN10A; (+) strand; PAM type: YTN; PAM sequence: TTT
tgggattctcaggggaccag

SEQ ID NO: 58467 - DNA, 20 bp, Artificial Sequence
  Description of Artificial Sequence: Synthetic oligonucleotide
  Target: SCN10A; (+) strand; PAM type: YTN; PAM sequence: TTT
gggattctcaggggaccaga

SEQ ID NO: 58468 - DNA, 20 bp, Artificial Sequence
  Description of Artificial Sequence: Synthetic oligonucleotide
  Target: SCN10A; (+) strand; PAM type: YTN; PAM sequence: TTG
ggattctcaggggaccagag

SEQ ID NO: 58469 - DNA, 20 bp, Artificial Sequence
  Description of Artificial Sequence: Synthetic oligonucleotide
  Target: SCN10A; (+) strand; PAM type: YTN; PAM sequence: TTC
tcaggggaccagagagagtg

SEQ ID NO: 58470 - DNA, 20 bp, Artificial Sequence
  Description of Artificial Sequence: Synthetic oligonucleotide
  Target: SCN10A; (+) strand; PAM type: YTN; PAM sequence: CTC
aggggaccagagagagtgtc

SEQ ID NO: 58471 - DNA, 20 bp, Artificial Sequence
  Description of Artificial Sequence: Synthetic oligonucleotide
  Target: SCN10A; (+) strand; PAM type: YTN; PAM sequence: CTG
caaagtccgagagagcagaa

SEQ ID NO: 58472 - DNA, 20 bp, Artificial Sequence
  Description of Artificial Sequence: Synthetic oligonucleotide
  Target: SCN10A; (+) strand; PAM type: YTN; PAM sequence: CTG
agtggcctctgggtcaaact

SEQ ID NO: 58473 - DNA, 20 bp, Artificial Sequence
  Description of Artificial Sequence: Synthetic oligonucleotide
  Target: SCN10A; (+) strand; PAM type: YTN; PAM sequence: CTC
tgggtcaaacttctcccagg

SEQ ID NO: 58474 - DNA, 20 bp, Artificial Sequence
  Description of Artificial Sequence: Synthetic oligonucleotide
  Target: SCN10A; (+) strand; PAM type: YTN; PAM sequence: CTG
ggtcaaacttctcccaggtc

SEQ ID NO: 58475 - DNA, 20 bp, Artificial Sequence
  Description of Artificial Sequence: Synthetic oligonucleotide
  Target: SCN10A; (+) strand; PAM type: YTN; PAM sequence: CTT
ctcccaggtctcatagaaca

SEQ ID NO: 58476 - DNA, 20 bp, Artificial Sequence
  Description of Artificial Sequence: Synthetic oligonucleotide
  Target: SCN10A; (+) strand; PAM type: YTN; PAM sequence: TTC
tcccaggtctcatagaacat

SEQ ID NO: 58477 - DNA, 20 bp, Artificial Sequence
  Description of Artificial Sequence: Synthetic oligonucleotide
  Target: SCN10A; (+) strand; PAM type: YTN; PAM sequence: CTC
ccaggtctcatagaacatgt

SEQ ID NO: 58478 - DNA, 20 bp, Artificial Sequence
  Description of Artificial Sequence: Synthetic oligonucleotide
  Target: SCN10A; (+) strand; PAM type: YTN; PAM sequence: CTC
atagaacatgtcaaagtcgt

SEQ ID NO: 58479 - DNA, 20 bp, Artificial Sequence
  Description of Artificial Sequence: Synthetic oligonucleotide
  Target: SCN10A; (+) strand; PAM type: YTN; PAM sequence: CTC
actcaggggctcagtgctct

SEQ ID NO: 58480 - DNA, 20 bp, Artificial Sequence
  Description of Artificial Sequence: Synthetic oligonucleotide
  Target: SCN10A; (+) strand; PAM type: YTN; PAM sequence: CTC
aggggctcagtgctctcctc

SEQ ID NO: 58481 - DNA, 20 bp, Artificial Sequence
  Description of Artificial Sequence: Synthetic oligonucleotide
  Target: SCN10A; (+) strand; PAM type: YTN; PAM sequence: CTC
agtgctctcctccgtggcca

SEQ ID NO: 58482 - DNA, 20 bp, Artificial Sequence
  Description of Artificial Sequence: Synthetic oligonucleotide
  Target: SCN10A; (+) strand; PAM type: YTN; PAM sequence: CTC
tcctccgtggccacattgaa

SEQ ID NO: 58483 - DNA, 20 bp, Artificial Sequence
  Description of Artificial Sequence: Synthetic oligonucleotide
  Target: SCN10A; (+) strand; PAM type: YTN; PAM sequence: CTC
ctccgtggccacattgaagt

SEQ ID NO: 58484 - DNA, 20 bp, Artificial Sequence
  Description of Artificial Sequence: Synthetic oligonucleotide
  Target: SCN10A; (+) strand; PAM type: YTN; PAM sequence: CTC
cgtggccacattgaagttct

SEQ ID NO: 58485 - DNA, 20 bp, Artificial Sequence
  Description of Artificial Sequence: Synthetic oligonucleotide
  Target: SCN10A; (+) strand; PAM type: YTN; PAM sequence: TTG
aagttctccagaatcactgc

SEQ ID NO: 58486 - DNA, 20 bp, Artificial Sequence
  Description of Artificial Sequence: Synthetic oligonucleotide
  Target: SCN10A; (+) strand; PAM type: YTN; PAM sequence: TTC
tccagaatcactgcaatgta

SEQ ID NO: 58487 - DNA, 20 bp, Artificial Sequence
  Description of Artificial Sequence: Synthetic oligonucleotide
  Target: SCN10A; (+) strand; PAM type: YTN; PAM sequence: CTC
cagaatcactgcaatgtaca

SEQ ID NO: 58488 - DNA, 20 bp, Artificial Sequence
  Description of Artificial Sequence: Synthetic oligonucleotide
  Target: SCN10A; (+) strand; PAM type: YTN; PAM sequence: CTG
caatgtacatgttgaccatg

SEQ ID NO: 58489 - DNA, 20 bp, Artificial Sequence
  Description of Artificial Sequence: Synthetic oligonucleotide
  Target: SCN10A; (+) strand; PAM type: YTN; PAM sequence: TTG
accatgatgaggaaggagat

SEQ ID NO: 58490 - DNA, 20 bp, Artificial Sequence
  Description of Artificial Sequence: Synthetic oligonucleotide
  Target: SCN10A; (+) strand; PAM type: YTN; PAM sequence: CTA
cggctgggctcccacagtcc

SEQ ID NO: 58491 - DNA, 20 bp, Artificial Sequence
  Description of Artificial Sequence: Synthetic oligonucleotide
  Target: SCN10A; (+) strand; PAM type: YTN; PAM sequence: CTG
ggctcccacagtcccctctg

SEQ ID NO: 58492 - DNA, 20 bp, Artificial Sequence
  Description of Artificial Sequence: Synthetic oligonucleotide
  Target: SCN10A; (+) strand; PAM type: YTN; PAM sequence: CTC
ccacagtcccctctggtgcc

SEQ ID NO: 58493 - DNA, 20 bp, Artificial Sequence
  Description of Artificial Sequence: Synthetic oligonucleotide
  Target: SCN10A; (+) strand; PAM type: YTN; PAM sequence: CTC
tggtgccattgctgttgggc

SEQ ID NO: 58494 - DNA, 20 bp, Artificial Sequence
  Description of Artificial Sequence: Synthetic oligonucleotide
  Target: SCN10A; (+) strand; PAM type: YTN; PAM sequence: CTG
gtgccattgctgttgggcag

SEQ ID NO: 58495 - DNA, 20 bp, Artificial Sequence
  Description of Artificial Sequence: Synthetic oligonucleotide
  Target: SCN10A; (+) strand; PAM type: YTN; PAM sequence: TTG
ctgttgggcagattggggtc

SEQ ID NO: 58496 - DNA, 20 bp, Artificial Sequence
  Description of Artificial Sequence: Synthetic oligonucleotide
  Target: SCN10A; (+) strand; PAM type: YTN; PAM sequence: CTG
ttgggcagattggggtcaca

SEQ ID NO: 58497 - DNA, 20 bp, Artificial Sequence
  Description of Artificial Sequence: Synthetic oligonucleotide
  Target: SCN10A; (+) strand; PAM type: YTN; PAM sequence: TTG
ggcagattggggtcacagta

SEQ ID NO: 58498 - DNA, 20 bp, Artificial Sequence
  Description of Artificial Sequence: Synthetic oligonucleotide
  Target: SCN10A; (+) strand; PAM type: YTN; PAM sequence: TTG
gggtcacagtaggggggccc

SEQ ID NO: 58499 - DNA, 20 bp, Artificial Sequence
  Description of Artificial Sequence: Synthetic oligonucleotide
  Target: SCN10A; (+) strand; PAM type: YTN; PAM sequence: CTG
tgttgaggatggggctgagg

SEQ ID NO: 58500 - DNA, 20 bp, Artificial Sequence
  Description of Artificial Sequence: Synthetic oligonucleotide
  Target: SCN10A; (+) strand; PAM type: YTN; PAM sequence: TTG
aggatggggctgaggaggcc

SEQ ID NO: 58501 - DNA, 20 bp, Artificial Sequence
  Description of Artificial Sequence: Synthetic oligonucleotide
  Target: SCN10A; (+) strand; PAM type: YTN; PAM sequence: CTG
aggaggccatcccagccggc

SEQ ID NO: 58502 - DNA, 20 bp, Artificial Sequence
  Description of Artificial Sequence: Synthetic oligonucleotide
  Target: SCN10A; (+) strand; PAM type: YTN; PAM sequence: CTG
gaagaggcacagcatgctgt

SEQ ID NO: 58503 - DNA, 20 bp, Artificial Sequence
  Description of Artificial Sequence: Synthetic oligonucleotide
  Target: SCN10A; (+) strand; PAM type: YTN; PAM sequence: CTG
ttggcgaaggtctggaagtt

SEQ ID NO: 58504 - DNA, 20 bp, Artificial Sequence
  Description of Artificial Sequence: Synthetic oligonucleotide
  Target: SCN10A; (+) strand; PAM type: YTN; PAM sequence: TTG
gcgaaggtctggaagttgaa

SEQ ID NO: 58505 - DNA, 20 bp, Artificial Sequence
  Description of Artificial Sequence: Synthetic oligonucleotide
  Target: SCN10A; (+) strand; PAM type: YTN; PAM sequence: CTG
gaagttgaacatgtcgtcga

SEQ ID NO: 58506 - DNA, 20 bp, Artificial Sequence
  Description of Artificial Sequence: Synthetic oligonucleotide
  Target: SCN10A; (+) strand; PAM type: YTN; PAM sequence: TTG
aacatgtcgtcgatgccagc

SEQ ID NO: 58507 - DNA, 20 bp, Artificial Sequence
  Description of Artificial Sequence: Synthetic oligonucleotide
  Target: SCN10A; (+) strand; PAM type: YTN; PAM sequence: CTC
ccacctcacatggggaaagc

SEQ ID NO: 58508 - DNA, 20 bp, Artificial Sequence
  Description of Artificial Sequence: Synthetic oligonucleotide
  Target: SCN10A; (+) strand; PAM type: YTN; PAM sequence: CTC
acatggggaaagctggacat

SEQ ID NO: 58509 - DNA, 20 bp, Artificial Sequence
  Description of Artificial Sequence: Synthetic oligonucleotide
  Target: SCN10A; (+) strand; PAM type: YTN; PAM sequence: CTG
gacataccgaagatagagta

SEQ ID NO: 58510 - DNA, 20 bp, Artificial Sequence
  Description of Artificial Sequence: Synthetic oligonucleotide
  Target: SCN10A; (+) strand; PAM type: YTN; PAM sequence: TTG
aagagggcaggcagggacat

SEQ ID NO: 58511 - DNA, 20 bp, Artificial Sequence
  Description of Artificial Sequence: Synthetic oligonucleotide
  Target: SCN10A; (+) strand; PAM type: YTN; PAM sequence: CTT
ggccgctcggatcagtctga

SEQ ID NO: 58512 - DNA, 20 bp, Artificial Sequence
  Description of Artificial Sequence: Synthetic oligonucleotide
  Target: SCN10A; (+) strand; PAM type: YTN; PAM sequence: TTG
gccgctcggatcagtctgag

SEQ ID NO: 58513 - DNA, 20 bp, Artificial Sequence
  Description of Artificial Sequence: Synthetic oligonucleotide
  Target: SCN10A; (+) strand; PAM type: YTN; PAM sequence: CTC
ggatcagtctgaggatgcgg

SEQ ID NO: 58514 - DNA, 20 bp, Artificial Sequence
  Description of Artificial Sequence: Synthetic oligonucleotide
  Target: SCN10A; (+) strand; PAM type: YTN; PAM sequence: CTG
aggatgcggccaattcgggc

SEQ ID NO: 58515 - DNA, 20 bp, Artificial Sequence
  Description of Artificial Sequence: Synthetic oligonucleotide
  Target: SCN10A; (+) strand; PAM type: YTN; PAM sequence: TTC
gggccaggcggatgactctg

SEQ ID NO: 58516 - DNA, 20 bp, Artificial Sequence
  Description of Artificial Sequence: Synthetic oligonucleotide
  Target: SCN10A; (+) strand; PAM type: YTN; PAM sequence: CTC
tgaagagcgttggggagaag

SEQ ID NO: 58517 - DNA, 20 bp, Artificial Sequence
  Description of Artificial Sequence: Synthetic oligonucleotide
  Target: SCN10A; (+) strand; PAM type: YTN; PAM sequence: CTG
aagagcgttggggagaagta

SEQ ID NO: 58518 - DNA, 20 bp, Artificial Sequence
  Description of Artificial Sequence: Synthetic oligonucleotide
  Target: SCN10A; (+) strand; PAM type: YTN; PAM sequence: TTG
gggagaagtaactttgaagt

SEQ ID NO: 58519 - DNA, 20 bp, Artificial Sequence
  Description of Artificial Sequence: Synthetic oligonucleotide
  Target: SCN10A; (+) strand; PAM type: YTN; PAM sequence: CTT
tgaagtgacttaagaattgc

SEQ ID NO: 58520 - DNA, 20 bp, Artificial Sequence
  Description of Artificial Sequence: Synthetic oligonucleotide
  Target: SCN10A; (+) strand; PAM type: YTN; PAM sequence: TTT
gaagtgacttaagaattgca

SEQ ID NO: 58521 - DNA, 20 bp, Artificial Sequence
  Description of Artificial Sequence: Synthetic oligonucleotide
  Target: SCN10A; (+) strand; PAM type: YTN; PAM sequence: TTG
aagtgacttaagaattgcag

SEQ ID NO: 58522 - DNA, 20 bp, Artificial Sequence
  Description of Artificial Sequence: Synthetic oligonucleotide
  Target: SCN10A; (+) strand; PAM type: YTN; PAM sequence: CTT
aagaattgcagaaaaaatca

SEQ ID NO: 58523 - DNA, 20 bp, Artificial Sequence
  Description of Artificial Sequence: Synthetic oligonucleotide
  Target: SCN10A; (+) strand; PAM type: YTN; PAM sequence: TTA
agaattgcagaaaaaatcag

SEQ ID NO: 58524 - DNA, 20 bp, Artificial Sequence
  Description of Artificial Sequence: Synthetic oligonucleotide
  Target: SCN10A; (+) strand; PAM type: YTN; PAM sequence: TTG
cagaaaaaatcaggccttta

SEQ ID NO: 58525 - DNA, 20 bp, Artificial Sequence
  Description of Artificial Sequence: Synthetic oligonucleotide
  Target: SCN10A; (+) strand; PAM type: YTN; PAM sequence: CTT
taaaagaaggaagaaattat

SEQ ID NO: 58526 - DNA, 20 bp, Artificial Sequence
  Description of Artificial Sequence: Synthetic oligonucleotide
  Target: SCN10A; (+) strand; PAM type: YTN; PAM sequence: TTT
aaaagaaggaagaaattatc

SEQ ID NO: 58527 - DNA, 20 bp, Artificial Sequence
  Description of Artificial Sequence: Synthetic oligonucleotide
  Target: SCN10A; (+) strand; PAM type: YTN; PAM sequence: TTA
aaagaaggaagaaattatct

SEQ ID NO: 58528 - DNA, 20 bp, Artificial Sequence
  Description of Artificial Sequence: Synthetic oligonucleotide
  Target: SCN10A; (+) strand; PAM type: YTN; PAM sequence: TTA
tctaattagtatctccagcc

SEQ ID NO: 58529 - DNA, 20 bp, Artificial Sequence
  Description of Artificial Sequence: Synthetic oligonucleotide
  Target: SCN10A; (+) strand; PAM type: YTN; PAM sequence: CTA
attagtatctccagccatga

SEQ ID NO: 58530 - DNA, 20 bp, Artificial Sequence
  Description of Artificial Sequence: Synthetic oligonucleotide
  Target: SCN10A; (+) strand; PAM type: YTN; PAM sequence: TTA
gtatctccagccatgagacg

SEQ ID NO: 58531 - DNA, 20 bp, Artificial Sequence
  Description of Artificial Sequence: Synthetic oligonucleotide
  Target: SCN10A; (+) strand; PAM type: YTN; PAM sequence: CTC
cagccatgagacgtgacaaa

SEQ ID NO: 58532 - DNA, 20 bp, Artificial Sequence
  Description of Artificial Sequence: Synthetic oligonucleotide
  Target: SCN10A; (+) strand; PAM type: YTN; PAM sequence: TTG
gctgtgatgacactctgctt

SEQ ID NO: 58533 - DNA, 20 bp, Artificial Sequence
  Description of Artificial Sequence: Synthetic oligonucleotide
  Target: SCN10A; (+) strand; PAM type: YTN; PAM sequence: CTG
tgatgacactctgctttgct

SEQ ID NO: 58534 - DNA, 20 bp, Artificial Sequence
  Description of Artificial Sequence: Synthetic oligonucleotide
  Target: SCN10A; (+) strand; PAM type: YTN; PAM sequence: CTC
tgctttgcttggtatagact

SEQ ID NO: 58535 - DNA, 20 bp, Artificial Sequence
  Description of Artificial Sequence: Synthetic oligonucleotide
  Target: SCN10A; (+) strand; PAM type: YTN; PAM sequence: CTG
ctttgcttggtatagactgc

SEQ ID NO: 58536 - DNA, 20 bp, Artificial Sequence
  Description of Artificial Sequence: Synthetic oligonucleotide
  Target: SCN10A; (+) strand; PAM type: YTN; PAM sequence: CTT
tgcttggtatagactgccac

SEQ ID NO: 58537 - DNA, 20 bp, Artificial Sequence
  Description of Artificial Sequence: Synthetic oligonucleotide
  Target: SCN10A; (+) strand; PAM type: YTN; PAM sequence: TTT
gcttggtatagactgccact

SEQ ID NO: 58538 - DNA, 20 bp, Artificial Sequence
  Description of Artificial Sequence: Synthetic oligonucleotide
  Target: SCN10A; (+) strand; PAM type: YTN; PAM sequence: TTG
cttggtatagactgccactt

SEQ ID NO: 58539 - DNA, 20 bp, Artificial Sequence
  Description of Artificial Sequence: Synthetic oligonucleotide
  Target: SCN10A; (+) strand; PAM type: YTN; PAM sequence: CTT
ggtatagactgccacttggg

SEQ ID NO: 58540 - DNA, 20 bp, Artificial Sequence
  Description of Artificial Sequence: Synthetic oligonucleotide
  Target: SCN10A; (+) strand; PAM type: YTN; PAM sequence: TTG
gtatagactgccacttgggc

SEQ ID NO: 58541 - DNA, 20 bp, Artificial Sequence
  Description of Artificial Sequence: Synthetic oligonucleotide
  Target: SCN10A; (+) strand; PAM type: YTN; PAM sequence: CTG
ccacttgggcatccacattt

SEQ ID NO: 58542 - DNA, 20 bp, Artificial Sequence
  Description of Artificial Sequence: Synthetic oligonucleotide
  Target: SCN10A; (+) strand; PAM type: YTN; PAM sequence: CTT
gggcatccacatttgaggac

SEQ ID NO: 58543 - DNA, 20 bp, Artificial Sequence
  Description of Artificial Sequence: Synthetic oligonucleotide
  Target: SCN10A; (+) strand; PAM type: YTN; PAM sequence: TTG
ggcatccacatttgaggact

SEQ ID NO: 58544 - DNA, 20 bp, Artificial Sequence
  Description of Artificial Sequence: Synthetic oligonucleotide
  Target: SCN10A; (+) strand; PAM type: YTN; PAM sequence: TTT
gaggactctgggccctcaga

SEQ ID NO: 58545 - DNA, 20 bp, Artificial Sequence
  Description of Artificial Sequence: Synthetic oligonucleotide
  Target: SCN10A; (+) strand; PAM type: YTN; PAM sequence: TTG
aggactctgggccctcagag

SEQ ID NO: 58546 - DNA, 20 bp, Artificial Sequence
  Description of Artificial Sequence: Synthetic oligonucleotide
  Target: SCN10A; (+) strand; PAM type: YTN; PAM sequence: CTC
tgggccctcagagcctggca

SEQ ID NO: 58547 - DNA, 20 bp, Artificial Sequence
  Description of Artificial Sequence: Synthetic oligonucleotide
  Target: SCN10A; (+) strand; PAM type: YTN; PAM sequence: CTG
ggccctcagagcctggcatg

SEQ ID NO: 58548 - DNA, 20 bp, Artificial Sequence
  Description of Artificial Sequence: Synthetic oligonucleotide
  Target: SCN10A; (+) strand; PAM type: YTN; PAM sequence: CTC
agagcctggcatggtaggta

SEQ ID NO: 58549 - DNA, 20 bp, Artificial Sequence
  Description of Artificial Sequence: Synthetic oligonucleotide
  Target: SCN10A; (+) strand; PAM type: YTN; PAM sequence: CTG
gcatggtaggtagcacaaag

SEQ ID NO: 58550 - DNA, 20 bp, Artificial Sequence
  Description of Artificial Sequence: Synthetic oligonucleotide
  Target: SCN10A; (+) strand; PAM type: YTN; PAM sequence: CTC
agtaaatgcccattgcataa

SEQ ID NO: 58551 - DNA, 20 bp, Artificial Sequence
  Description of Artificial Sequence: Synthetic oligonucleotide
  Target: SCN10A; (+) strand; PAM type: YTN; PAM sequence: TTG
cataagtcctctcttcctcc

SEQ ID NO: 58552 - DNA, 20 bp, Artificial Sequence
  Description of Artificial Sequence: Synthetic oligonucleotide
  Target: SCN10A; (+) strand; PAM type: YTN; PAM sequence: CTC
tcttcctcctccgtcttacc

SEQ ID NO: 58553 - DNA, 20 bp, Artificial Sequence
  Description of Artificial Sequence: Synthetic oligonucleotide
  Target: SCN10A; (+) strand; PAM type: YTN; PAM sequence: CTC
ttcctcctccgtcttaccct

SEQ ID NO: 58554 - DNA, 20 bp, Artificial Sequence
  Description of Artificial Sequence: Synthetic oligonucleotide
  Target: SCN10A; (+) strand; PAM type: YTN; PAM sequence: CTT
cctcctccgtcttacccttc

SEQ ID NO: 58555 - DNA, 20 bp, Artificial Sequence
  Description of Artificial Sequence: Synthetic oligonucleotide
  Target: SCN10A; (+) strand; PAM type: YTN; PAM sequence: TTC
ctcctccgtcttacccttcc

SEQ ID NO: 58556 - DNA, 20 bp, Artificial Sequence
  Description of Artificial Sequence: Synthetic oligonucleotide
  Target: SCN10A; (+) strand; PAM type: YTN; PAM sequence: CTC
ctccgtcttacccttcctac

SEQ ID NO: 58557 - DNA, 20 bp, Artificial Sequence
  Description of Artificial Sequence: Synthetic oligonucleotide
  Target: SCN10A; (+) strand; PAM type: YTN; PAM sequence: CTC
cgtcttacccttcctaccat

SEQ ID NO: 58558 - DNA, 20 bp, Artificial Sequence
  Description of Artificial Sequence: Synthetic oligonucleotide
  Target: SCN10A; (+) strand; PAM type: YTN; PAM sequence: CTT
acccttcctaccatgttatc

SEQ ID NO: 58559 - DNA, 20 bp, Artificial Sequence
  Description of Artificial Sequence: Synthetic oligonucleotide
  Target: SCN10A; (+) strand; PAM type: YTN; PAM sequence: TTA
cccttcctaccatgttatct

SEQ ID NO: 58560 - DNA, 20 bp, Artificial Sequence
  Description of Artificial Sequence: Synthetic oligonucleotide
  Target: SCN10A; (+) strand; PAM type: YTN; PAM sequence: CTT
cctaccatgttatctttgcc

SEQ ID NO: 58561 - DNA, 20 bp, Artificial Sequence
  Description of Artificial Sequence: Synthetic oligonucleotide
  Target: SCN10A; (+) strand; PAM type: YTN; PAM sequence: TTC
ctaccatgttatctttgcct

SEQ ID NO: 58562 - DNA, 20 bp, Artificial Sequence
  Description of Artificial Sequence: Synthetic oligonucleotide
  Target: SCN10A; (+) strand; PAM type: YTN; PAM sequence: CTA
ccatgttatctttgcctccg

SEQ ID NO: 58563 - DNA, 20 bp, Artificial Sequence
  Description of Artificial Sequence: Synthetic oligonucleotide
  Target: SCN10A; (+) strand; PAM type: YTN; PAM sequence: TTA
tctttgcctccgcctagaat

SEQ ID NO: 58564 - DNA, 20 bp, Artificial Sequence
  Description of Artificial Sequence: Synthetic oligonucleotide
  Target: SCN10A; (+) strand; PAM type: YTN; PAM sequence: CTT
tgcctccgcctagaatatcc

SEQ ID NO: 58565 - DNA, 20 bp, Artificial Sequence
  Description of Artificial Sequence: Synthetic oligonucleotide
  Target: SCN10A; (+) strand; PAM type: YTN; PAM sequence: TTT
gcctccgcctagaatatcct

SEQ ID NO: 58566 - DNA, 20 bp, Artificial Sequence
  Description of Artificial Sequence: Synthetic oligonucleotide
  Target: SCN10A; (+) strand; PAM type: YTN; PAM sequence: TTG
cctccgcctagaatatcctc

SEQ ID NO: 58567 - DNA, 20 bp, Artificial Sequence
  Description of Artificial Sequence: Synthetic oligonucleotide
  Target: SCN10A; (+) strand; PAM type: YTN; PAM sequence: CTC
cgcctagaatatcctcttgg

SEQ ID NO: 58568 - DNA, 20 bp, Artificial Sequence
  Description of Artificial Sequence: Synthetic oligonucleotide
  Target: SCN10A; (+) strand; PAM type: YTN; PAM sequence: CTA
gaatatcctcttggtcaacc

SEQ ID NO: 58569 - DNA, 20 bp, Artificial Sequence
  Description of Artificial Sequence: Synthetic oligonucleotide
  Target: SCN10A; (+) strand; PAM type: YTN; PAM sequence: CTC
ttggtcaacctccacagtca

SEQ ID NO: 58570 - DNA, 20 bp, Artificial Sequence
  Description of Artificial Sequence: Synthetic oligonucleotide
  Target: SCN10A; (+) strand; PAM type: YTN; PAM sequence: CTT
ggtcaacctccacagtcaaa

SEQ ID NO: 58571 - DNA, 20 bp, Artificial Sequence
  Description of Artificial Sequence: Synthetic oligonucleotide
  Target: SCN10A; (+) strand; PAM type: YTN; PAM sequence: TTG
gtcaacctccacagtcaaaa

SEQ ID NO: 58572 - DNA, 20 bp, Artificial Sequence
  Description of Artificial Sequence: Synthetic oligonucleotide
  Target: SCN10A; (+) strand; PAM type: YTN; PAM sequence: CTC
cacagtcaaaaacttatctt

SEQ ID NO: 58573 - DNA, 20 bp, Artificial Sequence
  Description of Artificial Sequence: Synthetic oligonucleotide
  Target: SCN10A; (+) strand; PAM type: YTN; PAM sequence: CTT
atcttctgcagccaagttca

SEQ ID NO: 58574 - DNA, 20 bp, Artificial Sequence
  Description of Artificial Sequence: Synthetic oligonucleotide
  Target: SCN10A; (+) strand; PAM type: YTN; PAM sequence: TTA
tcttctgcagccaagttcag

SEQ ID NO: 58575 - DNA, 20 bp, Artificial Sequence
  Description of Artificial Sequence: Synthetic oligonucleotide
  Target: SCN10A; (+) strand; PAM type: YTN; PAM sequence: CTT
ctgcagccaagttcagctgg

SEQ ID NO: 58576 - DNA, 20 bp, Artificial Sequence
  Description of Artificial Sequence: Synthetic oligonucleotide
  Target: SCN10A; (+) strand; PAM type: YTN; PAM sequence: TTC
tgcagccaagttcagctgga

SEQ ID NO: 58577 - DNA, 20 bp, Artificial Sequence
  Description of Artificial Sequence: Synthetic oligonucleotide
  Target: SCN10A; (+) strand; PAM type: YTN; PAM sequence: CTG
cagccaagttcagctggaag

SEQ ID NO: 58578 - DNA, 20 bp, Artificial Sequence
  Description of Artificial Sequence: Synthetic oligonucleotide
  Target: SCN10A; (+) strand; PAM type: YTN; PAM sequence: TTC
agctggaagtgactgcagtt

SEQ ID NO: 58579 - DNA, 20 bp, Artificial Sequence
  Description of Artificial Sequence: Synthetic oligonucleotide
  Target: SCN10A; (+) strand; PAM type: YTN; PAM sequence: CTG
gaagtgactgcagtttattc

SEQ ID NO: 58580 - DNA, 20 bp, Artificial Sequence
  Description of Artificial Sequence: Synthetic oligonucleotide
  Target: SCN10A; (+) strand; PAM type: YTN; PAM sequence: CTG
cagtttattccacaggctca

SEQ ID NO: 58581 - DNA, 20 bp, Artificial Sequence
  Description of Artificial Sequence: Synthetic oligonucleotide
  Target: SCN10A; (+) strand; PAM type: YTN; PAM sequence: TTT
attccacaggctcacagtct

SEQ ID NO: 58582 - DNA, 20 bp, Artificial Sequence
  Description of Artificial Sequence: Synthetic oligonucleotide
  Target: SCN10A; (+) strand; PAM type: YTN; PAM sequence: TTA
ttccacaggctcacagtctt

SEQ ID NO: 58583 - DNA, 20 bp, Artificial Sequence
  Description of Artificial Sequence: Synthetic oligonucleotide
  Target: SCN10A; (+) strand; PAM type: YTN; PAM sequence: TTC
cacaggctcacagtctttgg

SEQ ID NO: 58584 - DNA, 20 bp, Artificial Sequence
  Description of Artificial Sequence: Synthetic oligonucleotide
  Target: SCN10A; (+) strand; PAM type: YTN; PAM sequence: CTC
acagtctttggcctgttttt

SEQ ID NO: 58585 - DNA, 20 bp, Artificial Sequence
  Description of Artificial Sequence: Synthetic oligonucleotide
  Target: SCN10A; (+) strand; PAM type: YTN; PAM sequence: CTT
tggcctgttttttcctatga

SEQ ID NO: 58586 - DNA, 20 bp, Artificial Sequence
  Description of Artificial Sequence: Synthetic oligonucleotide
  Target: SCN10A; (+) strand; PAM type: YTN; PAM sequence: TTT
ggcctgttttttcctatgac

SEQ ID NO: 58587 - DNA, 20 bp, Artificial Sequence
  Description of Artificial Sequence: Synthetic oligonucleotide
  Target: SCN10A; (+) strand; PAM type: YTN; PAM sequence: TTG
gcctgttttttcctatgaca

SEQ ID NO: 58588 - DNA, 20 bp, Artificial Sequence
  Description of Artificial Sequence: Synthetic oligonucleotide
  Target: SCN10A; (+) strand; PAM type: YTN; PAM sequence: CTG
ttttttcctatgacacagac

SEQ ID NO: 58589 - DNA, 20 bp, Artificial Sequence
  Description of Artificial Sequence: Synthetic oligonucleotide
  Target: SCN10A; (+) strand; PAM type: YTN; PAM sequence: TTT
tttcctatgacacagaccct

SEQ ID NO: 58590 - DNA, 20 bp, Artificial Sequence
  Description of Artificial Sequence: Synthetic oligonucleotide
  Target: SCN10A; (+) strand; PAM type: YTN; PAM sequence: TTT
ttcctatgacacagaccctg

SEQ ID NO: 58591 - DNA, 20 bp, Artificial Sequence
  Description of Artificial Sequence: Synthetic oligonucleotide
  Target: SCN10A; (+) strand; PAM type: YTN; PAM sequence: TTT
tcctatgacacagaccctgc

SEQ ID NO: 58592 - DNA, 20 bp, Artificial Sequence
  Description of Artificial Sequence: Synthetic oligonucleotide
  Target: SCN10A; (+) strand; PAM type: YTN; PAM sequence: TTT
cctatgacacagaccctgct

SEQ ID NO: 58593 - DNA, 20 bp, Artificial Sequence
  Description of Artificial Sequence: Synthetic oligonucleotide
  Target: SCN10A; (+) strand; PAM type: YTN; PAM sequence: TTC
ctatgacacagaccctgctc

SEQ ID NO: 58594 - DNA, 20 bp, Artificial Sequence
  Description of Artificial Sequence: Synthetic oligonucleotide
  Target: SCN10A; (+) strand; PAM type: YTN; PAM sequence: CTA
tgacacagaccctgctcctc

SEQ ID NO: 58595 - DNA, 20 bp, Artificial Sequence
  Description of Artificial Sequence: Synthetic oligonucleotide
  Target: SCN10A; (+) strand; PAM type: YTN; PAM sequence: CTG
ctcctccctgatactgcagc

SEQ ID NO: 58596 - DNA, 20 bp, Artificial Sequence
  Description of Artificial Sequence: Synthetic oligonucleotide
  Target: SCN10A; (+) strand; PAM type: YTN; PAM sequence: CTC
ctccctgatactgcagcctt

SEQ ID NO: 58597 - DNA, 20 bp, Artificial Sequence
  Description of Artificial Sequence: Synthetic oligonucleotide
  Target: SCN10A; (+) strand; PAM type: YTN; PAM sequence: CTC
cctgatactgcagcctttgg

SEQ ID NO: 58598 - DNA, 20 bp, Artificial Sequence
  Description of Artificial Sequence: Synthetic oligonucleotide
  Target: SCN10A; (+) strand; PAM type: YTN; PAM sequence: CTG
atactgcagcctttgggtca

SEQ ID NO: 58599 - DNA, 20 bp, Artificial Sequence
  Description of Artificial Sequence: Synthetic oligonucleotide
  Target: SCN10A; (+) strand; PAM type: YTN; PAM sequence: CTG
cagcctttgggtcatgccct

SEQ ID NO: 58600 - DNA, 20 bp, Artificial Sequence
  Description of Artificial Sequence: Synthetic oligonucleotide
  Target: SCN10A; (+) strand; PAM type: YTN; PAM sequence: CTT
tgggtcatgccctttcctcc

SEQ ID NO: 58601 - DNA, 20 bp, Artificial Sequence
  Description of Artificial Sequence: Synthetic oligonucleotide
  Target: SCN10A; (+) strand; PAM type: YTN; PAM sequence: TTT
gggtcatgccctttcctcca

SEQ ID NO: 58602 - DNA, 20 bp, Artificial Sequence
  Description of Artificial Sequence: Synthetic oligonucleotide
  Target: SCN10A; (+) strand; PAM type: YTN; PAM sequence: TTG
ggtcatgccctttcctccac

SEQ ID NO: 58603 - DNA, 20 bp, Artificial Sequence
  Description of Artificial Sequence: Synthetic oligonucleotide
  Target: SCN10A; (+) strand; PAM type: YTN; PAM sequence: CTT
tcctccaccctggtcctgtg

SEQ ID NO: 58604 - DNA, 20 bp, Artificial Sequence
  Description of Artificial Sequence: Synthetic oligonucleotide
  Target: SCN10A; (+) strand; PAM type: YTN; PAM sequence: TTT
cctccaccctggtcctgtgc

SEQ ID NO: 58605 - DNA, 20 bp, Artificial Sequence
  Description of Artificial Sequence: Synthetic oligonucleotide
  Target: SCN10A; (+) strand; PAM type: YTN; PAM sequence: TTC
ctccaccctggtcctgtgct

SEQ ID NO: 58606 - DNA, 20 bp, Artificial Sequence
  Description of Artificial Sequence: Synthetic oligonucleotide
  Target: SCN10A; (+) strand; PAM type: YTN; PAM sequence: CTC
caccctggtcctgtgctctg

SEQ ID NO: 58607 - DNA, 20 bp, Artificial Sequence
  Description of Artificial Sequence: Synthetic oligonucleotide
  Target: SCN10A; (+) strand; PAM type: YTN; PAM sequence: CTG
gtcctgtgctctgtgaaggc

SEQ ID NO: 58608 - DNA, 20 bp, Artificial Sequence
  Description of Artificial Sequence: Synthetic oligonucleotide
  Target: SCN10A; (+) strand; PAM type: YTN; PAM sequence: CTG
tgctctgtgaaggccaggac

SEQ ID NO: 58609 - DNA, 20 bp, Artificial Sequence
  Description of Artificial Sequence: Synthetic oligonucleotide
  Target: SCN10A; (+) strand; PAM type: YTN; PAM sequence: CTC
tgtgaaggccaggacccctt

SEQ ID NO: 58610 - DNA, 20 bp, Artificial Sequence
  Description of Artificial Sequence: Synthetic oligonucleotide
  Target: SCN10A; (+) strand; PAM type: YTN; PAM sequence: CTG
tgaaggccaggaccccttat

SEQ ID NO: 58611 - DNA, 20 bp, Artificial Sequence
  Description of Artificial Sequence: Synthetic oligonucleotide
  Target: SCN10A; (+) strand; PAM type: YTN; PAM sequence: CTT
atgattcctctccctacctc

SEQ ID NO: 58612 - DNA, 20 bp, Artificial Sequence
  Description of Artificial Sequence: Synthetic oligonucleotide
  Target: SCN10A; (+) strand; PAM type: YTN; PAM sequence: TTA
tgattcctctccctacctcc

SEQ ID NO: 58613 - DNA, 20 bp, Artificial Sequence
  Description of Artificial Sequence: Synthetic oligonucleotide
  Target: SCN10A; (+) strand; PAM type: YTN; PAM sequence: TTC
ctctccctacctcctactgt

SEQ ID NO: 58614 - DNA, 20 bp, Artificial Sequence
  Description of Artificial Sequence: Synthetic oligonucleotide
  Target: SCN10A; (+) strand; PAM type: YTN; PAM sequence: CTC
tccctacctcctactgtgaa

SEQ ID NO: 58615 - DNA, 20 bp, Artificial Sequence
  Description of Artificial Sequence: Synthetic oligonucleotide
  Target: SCN10A; (+) strand; PAM type: YTN; PAM sequence: CTC
cctacctcctactgtgaaga

SEQ ID NO: 58616 - DNA, 20 bp, Artificial Sequence
  Description of Artificial Sequence: Synthetic oligonucleotide
  Target: SCN10A; (+) strand; PAM type: YTN; PAM sequence: CTA
cctcctactgtgaagattga

SEQ ID NO: 58617 - DNA, 20 bp, Artificial Sequence
  Description of Artificial Sequence: Synthetic oligonucleotide
  Target: SCN10A; (+) strand; PAM type: YTN; PAM sequence: CTC
ctactgtgaagattgactct

SEQ ID NO: 58618 - DNA, 20 bp, Artificial Sequence
  Description of Artificial Sequence: Synthetic oligonucleotide
  Target: SCN10A; (+) strand; PAM type: YTN; PAM sequence: CTA
ctgtgaagattgactctgtt

SEQ ID NO: 58619 - DNA, 20 bp, Artificial Sequence
  Description of Artificial Sequence: Synthetic oligonucleotide
  Target: SCN10A; (+) strand; PAM type: YTN; PAM sequence: CTG
tgaagattgactctgtttct

SEQ ID NO: 58620 - DNA, 20 bp, Artificial Sequence
  Description of Artificial Sequence: Synthetic oligonucleotide
  Target: SCN10A; (+) strand; PAM type: YTN; PAM sequence: TTG
actctgtttctggcacccgg

SEQ ID NO: 58621 - DNA, 20 bp, Artificial Sequence
  Description of Artificial Sequence: Synthetic oligonucleotide
  Target: SCN10A; (+) strand; PAM type: YTN; PAM sequence: CTC
tgtttctggcacccggtcct

SEQ ID NO: 58622 - DNA, 20 bp, Artificial Sequence
  Description of Artificial Sequence: Synthetic oligonucleotide
  Target: SCN10A; (+) strand; PAM type: YTN; PAM sequence: CTG
tttctggcacccggtcctgt

SEQ ID NO: 58623 - DNA, 20 bp, Artificial Sequence
  Description of Artificial Sequence: Synthetic oligonucleotide
  Target: SCN10A; (+) strand; PAM type: YTN; PAM sequence: TTT
ctggcacccggtcctgtggc

SEQ ID NO: 58624 - DNA, 20 bp, Artificial Sequence
  Description of Artificial Sequence: Synthetic oligonucleotide
  Target: SCN10A; (+) strand; PAM type: YTN; PAM sequence: TTC
tggcacccggtcctgtggct

SEQ ID NO: 58625 - DNA, 20 bp, Artificial Sequence
  Description of Artificial Sequence: Synthetic oligonucleotide
  Target: SCN10A; (+) strand; PAM type: YTN; PAM sequence: CTG
gcacccggtcctgtggctaa

SEQ ID NO: 58626 - DNA, 20 bp, Artificial Sequence
  Description of Artificial Sequence: Synthetic oligonucleotide
  Target: SCN10A; (+) strand; PAM type: YTN; PAM sequence: CTG
tggctaattgtacggagcct

SEQ ID NO: 58627 - DNA, 20 bp, Artificial Sequence
  Description of Artificial Sequence: Synthetic oligonucleotide
  Target: SCN10A; (+) strand; PAM type: YTN; PAM sequence: CTA
attgtacggagcctggtgtt

SEQ ID NO: 58628 - DNA, 20 bp, Artificial Sequence
  Description of Artificial Sequence: Synthetic oligonucleotide
  Target: SCN10A; (+) strand; PAM type: YTN; PAM sequence: TTG
tacggagcctggtgttaatt

SEQ ID NO: 58629 - DNA, 20 bp, Artificial Sequence
  Description of Artificial Sequence: Synthetic oligonucleotide
  Target: SCN10A; (+) strand; PAM type: YTN; PAM sequence: CTG
gtgttaattacaagggggcc

SEQ ID NO: 58630 - DNA, 20 bp, Artificial Sequence
  Description of Artificial Sequence: Synthetic oligonucleotide
  Target: SCN10A; (+) strand; PAM type: YTN; PAM sequence: TTA
attacaagggggcctgagga

SEQ ID NO: 58631 - DNA, 20 bp, Artificial Sequence
  Description of Artificial Sequence: Synthetic oligonucleotide
  Target: SCN10A; (+) strand; PAM type: YTN; PAM sequence: TTA
caagggggcctgaggattcg

SEQ ID NO: 58632 - DNA, 20 bp, Artificial Sequence
  Description of Artificial Sequence: Synthetic oligonucleotide
  Target: SCN10A; (+) strand; PAM type: YTN; PAM sequence: CTG
aggattcgggcaactggctg

SEQ ID NO: 58633 - DNA, 20 bp, Artificial Sequence
  Description of Artificial Sequence: Synthetic oligonucleotide
  Target: SCN10A; (+) strand; PAM type: YTN; PAM sequence: TTC
gggcaactggctgacagcta

SEQ ID NO: 58634 - DNA, 20 bp, Artificial Sequence
  Description of Artificial Sequence: Synthetic oligonucleotide
  Target: SCN10A; (+) strand; PAM type: YTN; PAM sequence: CTG
gctgacagctaaagcataag

SEQ ID NO: 58635 - DNA, 20 bp, Artificial Sequence
  Description of Artificial Sequence: Synthetic oligonucleotide
  Target: SCN10A; (+) strand; PAM type: YTN; PAM sequence: CTG
acagctaaagcataagggat

SEQ ID NO: 58636 - DNA, 20 bp, Artificial Sequence
  Description of Artificial Sequence: Synthetic oligonucleotide
  Target: SCN10A; (+) strand; PAM type: YTN; PAM sequence: CTA
aagcataagggatttgaatg

SEQ ID NO: 58637 - DNA, 20 bp, Artificial Sequence
  Description of Artificial Sequence: Synthetic oligonucleotide
  Target: SCN10A; (+) strand; PAM type: YTN; PAM sequence: TTT
gaatgaccagctgtctgcac

SEQ ID NO: 58638 - DNA, 20 bp, Artificial Sequence
  Description of Artificial Sequence: Synthetic oligonucleotide
  Target: SCN10A; (+) strand; PAM type: YTN; PAM sequence: TTG
aatgaccagctgtctgcaca

SEQ ID NO: 58639 - DNA, 20 bp, Artificial Sequence
  Description of Artificial Sequence: Synthetic oligonucleotide
  Target: SCN10A; (+) strand; PAM type: YTN; PAM sequence: CTG
tctgcacaatgccttaattt

SEQ ID NO: 58640 - DNA, 20 bp, Artificial Sequence
  Description of Artificial Sequence: Synthetic oligonucleotide
  Target: SCN10A; (+) strand; PAM type: YTN; PAM sequence: CTG
cacaatgccttaatttgttt

SEQ ID NO: 58641 - DNA, 20 bp, Artificial Sequence
  Description of Artificial Sequence: Synthetic oligonucleotide
  Target: SCN10A; (+) strand; PAM type: YTN; PAM sequence: CTT
aatttgtttttttttttttt

SEQ ID NO: 58642 - DNA, 20 bp, Artificial Sequence
  Description of Artificial Sequence: Synthetic oligonucleotide
  Target: SCN10A; (+) strand; PAM type: YTN; PAM sequence: TTA
atttgttttttttttttttt

SEQ ID NO: 58643 - DNA, 20 bp, Artificial Sequence
  Description of Artificial Sequence: Synthetic oligonucleotide
  Target: SCN10A; (+) strand; PAM type: YTN; PAM sequence: TTT
gttttttttttttttttttc

SEQ ID NO: 58644 - DNA, 20 bp, Artificial Sequence
  Description of Artificial Sequence: Synthetic oligonucleotide
  Target: SCN10A; (+) strand; PAM type: YTN; PAM sequence: TTG
ttttttttttttttttttcg

SEQ ID NO: 58645 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttttcggtt

SEQ ID NO: 58646 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttttcggttc

SEQ ID NO: 58647 - DNA, 20 bp, Artificial Sequence
  Description of Artificial Sequence: Synthetic oligonucleotide
  Target: SCN10A; (+) strand; PAM type: YTN; PAM sequence: TTT
tttttttttttttcggttcc

SEQ ID NO: 58648 - DNA, 20 bp, Artificial Sequence
  Description of Artificial Sequence: Synthetic oligonucleotide
  Target: SCN10A; (+) strand; PAM type: YTN; PAM sequence: TTT
ttttttttttttcggttcca

SEQ ID NO: 58649 - DNA, 20 bp, Artificial Sequence
  Description of Artificial Sequence: Synthetic oligonucleotide
  Target: SCN10A; (+) strand; PAM type: YTN; PAM sequence: TTT
tttttttttttcggttccag

SEQ ID NO: 58650 - DNA, 20 bp, Artificial Sequence
  Description of Artificial Sequence: Synthetic oligonucleotide
  Target: SCN10A; (+) strand; PAM type: YTN; PAM sequence: TTT
ttttttttttcggttccagc

SEQ ID NO: 58651 - DNA, 20 bp, Artificial Sequence
  Description of Artificial Sequence: Synthetic oligonucleotide
  Target: SCN10A; (+) strand; PAM type: YTN; PAM sequence: TTT
tttttttttcggttccagct

SEQ ID NO: 58652 - DNA, 20 bp, Artificial Sequence
  Description of Artificial Sequence: Synthetic oligonucleotide
  Target: SCN10A; (+) strand; PAM type: YTN; PAM sequence: TTT
ttttttttcggttccagctg

SEQ ID NO: 58653 - DNA, 20 bp, Artificial Sequence
  Description of Artificial Sequence: Synthetic oligonucleotide
  Target: SCN10A; (+) strand; PAM type: YTN; PAM sequence: TTT
tttttttcggttccagctgt

SEQ ID NO: 58654 - DNA, 20 bp, Artificial Sequence
  Description of Artificial Sequence: Synthetic oligonucleotide
  Target: SCN10A; (+) strand; PAM type: YTN; PAM sequence: TTT
ttttttcggttccagctgtt

SEQ ID NO: 58655 - DNA, 20 bp, Artificial Sequence
  Description of Artificial Sequence: Synthetic oligonucleotide
  Target: SCN10A; (+) strand; PAM type: YTN; PAM sequence: TTT
tttttcggttccagctgttt

SEQ ID NO: 58656 - DNA, 20 bp, Artificial Sequence
  Description of Artificial Sequence: Synthetic oligonucleotide
  Target: SCN10A; (+) strand; PAM type: YTN; PAM sequence: TTT
ttttcggttccagctgtttt

SEQ ID NO: 58657 - DNA, 20 bp, Artificial Sequence
  Description of Artificial Sequence: Synthetic oligonucleotide
  Target: SCN10A; (+) strand; PAM type: YTN; PAM sequence: TTT
tttcggttccagctgttttt

SEQ ID NO: 58658 - DNA, 20 bp, Artificial Sequence
  Description of Artificial Sequence: Synthetic oligonucleotide
  Target: SCN10A; (+) strand; PAM type: YTN; PAM sequence: TTT
ttcggttccagctgtttttg

SEQ ID NO: 58659 - DNA, 20 bp, Artificial Sequence
  Description of Artificial Sequence: Synthetic oligonucleotide
  Target: SCN10A; (+) strand; PAM type: YTN; PAM sequence: TTT
tcggttccagctgtttttga

SEQ ID NO: 58660 - DNA, 20 bp, Artificial Sequence
  Description of Artificial Sequence: Synthetic oligonucleotide
  Target: SCN10A; (+) strand; PAM type: YTN; PAM sequence: TTT
cggttccagctgtttttgaa

SEQ ID NO: 58661 - DNA, 20 bp, Artificial Sequence
  Description of Artificial Sequence: Synthetic oligonucleotide
  Target: SCN10A; (+) strand; PAM type: YTN; PAM sequence: TTC
ggttccagctgtttttgaac

SEQ ID NO: 58662 - DNA, 20 bp, Artificial Sequence
  Description of Artificial Sequence: Synthetic oligonucleotide
  Target: SCN10A; (+) strand; PAM type: YTN; PAM sequence: TTC
cagctgtttttgaactttat

SEQ ID NO: 58663 - DNA, 20 bp, Artificial Sequence
  Description of Artificial Sequence: Synthetic oligonucleotide
  Target: SCN10A; (+) strand; PAM type: YTN; PAM sequence: CTG
tttttgaactttatgttagg

SEQ ID NO: 58664 - DNA, 20 bp, Artificial Sequence
  Description of Artificial Sequence: Synthetic oligonucleotide
  Target: SCN10A; (+) strand; PAM type: YTN; PAM sequence: TTT
ttgaactttatgttagggcc

SEQ ID NO: 58665 - DNA, 20 bp, Artificial Sequence
  Description of Artificial Sequence: Synthetic oligonucleotide
  Target: SCN10A; (+) strand; PAM type: YTN; PAM sequence: TTT
tgaactttatgttagggcct

SEQ ID NO: 58666 - DNA, 20 bp, Artificial Sequence
  Description of Artificial Sequence: Synthetic oligonucleotide
  Target: SCN10A; (+) strand; PAM type: YTN; PAM sequence: TTT
gaactttatgttagggcctg

SEQ ID NO: 58667 - DNA, 20 bp, Artificial Sequence
  Description of Artificial Sequence: Synthetic oligonucleotide
  Target: SCN10A; (+) strand; PAM type: YTN; PAM sequence: TTG
aactttatgttagggcctgg

SEQ ID NO: 58668 - DNA, 20 bp, Artificial Sequence
  Description of Artificial Sequence: Synthetic oligonucleotide
  Target: SCN10A; (+) strand; PAM type: YTN; PAM sequence: CTT
tatgttagggcctggagata

SEQ ID NO: 58669 - DNA, 20 bp, Artificial Sequence
  Description of Artificial Sequence: Synthetic oligonucleotide
  Target: SCN10A; (+) strand; PAM type: YTN; PAM sequence: TTT
atgttagggcctggagatag

SEQ ID NO: 58670 - DNA, 20 bp, Artificial Sequence
  Description of Artificial Sequence: Synthetic oligonucleotide
  Target: SCN10A; (+) strand; PAM type: YTN; PAM sequence: TTA
tgttagggcctggagatagg

SEQ ID NO: 58671 - DNA, 20 bp, Artificial Sequence
  Description of Artificial Sequence: Synthetic oligonucleotide
  Target: SCN10A; (+) strand; PAM type: YTN; PAM sequence: TTA
gggcctggagataggttttt

SEQ ID NO: 58672 - DNA, 20 bp, Artificial Sequence
  Description of Artificial Sequence: Synthetic oligonucleotide
  Target: SCN10A; (+) strand; PAM type: YTN; PAM sequence: CTG
gagataggtttttttggggg

SEQ ID NO: 58673 - DNA, 20 bp, Artificial Sequence
  Description of Artificial Sequence: Synthetic oligonucleotide
  Target: SCN10A; (+) strand; PAM type: YTN; PAM sequence: TTT
ttttgggggagtcagttact

SEQ ID NO: 58674 - DNA, 20 bp, Artificial Sequence
  Description of Artificial Sequence: Synthetic oligonucleotide
  Target: SCN10A; (+) strand; PAM type: YTN; PAM sequence: TTT
tttgggggagtcagttactg

SEQ ID NO: 58675 - DNA, 20 bp, Artificial Sequence
  Description of Artificial Sequence: Synthetic oligonucleotide
  Target: SCN10A; (+) strand; PAM type: YTN; PAM sequence: TTT
ttgggggagtcagttactgc

SEQ ID NO: 58676 - DNA, 20 bp, Artificial Sequence
  Description of Artificial Sequence: Synthetic oligonucleotide
  Target: SCN10A; (+) strand; PAM type: YTN; PAM sequence: TTT
tgggggagtcagttactgcc

SEQ ID NO: 58677 - DNA, 20 bp, Artificial Sequence
  Description of Artificial Sequence: Synthetic oligonucleotide
  Target: SCN10A; (+) strand; PAM type: YTN; PAM sequence: TTT
gggggagtcagttactgccc

SEQ ID NO: 58678 - DNA, 20 bp, Artificial Sequence
  Description of Artificial Sequence: Synthetic oligonucleotide
  Target: SCN10A; (+) strand; PAM type: YTN; PAM sequence: TTG
ggggagtcagttactgcccc

SEQ ID NO: 58679 - DNA, 20 bp, Artificial Sequence
  Description of Artificial Sequence: Synthetic oligonucleotide
  Target: SCN10A; (+) strand; PAM type: YTN; PAM sequence: TTA
ctgcccccaactccaactat

SEQ ID NO: 58680 - DNA, 20 bp, Artificial Sequence
  Description of Artificial Sequence: Synthetic oligonucleotide
  Target: SCN10A; (+) strand; PAM type: YTN; PAM sequence: CTG
cccccaactccaactatgaa

SEQ ID NO: 58681 - DNA, 20 bp, Artificial Sequence
  Description of Artificial Sequence: Synthetic oligonucleotide
  Target: SCN10A; (+) strand; PAM type: YTN; PAM sequence: CTC
caactatgaacaaagttgga

SEQ ID NO: 58682 - DNA, 20 bp, Artificial Sequence
  Description of Artificial Sequence: Synthetic oligonucleotide
  Target: SCN10A; (+) strand; PAM type: YTN; PAM sequence: CTA
tgaacaaagttggaaatata

SEQ ID NO: 58683 - DNA, 20 bp, Artificial Sequence
  Description of Artificial Sequence: Synthetic oligonucleotide
  Target: SCN10A; (+) strand; PAM type: YTN; PAM sequence: TTG
gaaatataaagaatgtatat

SEQ ID NO: 58684 - DNA, 20 bp, Artificial Sequence
  Description of Artificial Sequence: Synthetic oligonucleotide
  Target: SCN10A; (+) strand; PAM type: YTN; PAM sequence: CTC
tatatgatgtctaacttgaa

SEQ ID NO: 58685 - DNA, 20 bp, Artificial Sequence
  Description of Artificial Sequence: Synthetic oligonucleotide
  Target: SCN10A; (+) strand; PAM type: YTN; PAM sequence: CTA
tatgatgtctaacttgaaga

SEQ ID NO: 58686 - DNA, 20 bp, Artificial Sequence
  Description of Artificial Sequence: Synthetic oligonucleotide
  Target: SCN10A; (+) strand; PAM type: YTN; PAM sequence: CTA
acttgaagatgtttgatttt

SEQ ID NO: 58687 - DNA, 20 bp, Artificial Sequence
  Description of Artificial Sequence: Synthetic oligonucleotide
  Target: SCN10A; (+) strand; PAM type: YTN; PAM sequence: CTT
gaagatgtttgatttttggt

SEQ ID NO: 58688 - DNA, 20 bp, Artificial Sequence
  Description of Artificial Sequence: Synthetic oligonucleotide
  Target: SCN10A; (+) strand; PAM type: YTN; PAM sequence: TTG
aagatgtttgatttttggtc

SEQ ID NO: 58689 - DNA, 20 bp, Artificial Sequence
  Description of Artificial Sequence: Synthetic oligonucleotide
  Target: SCN10A; (+) strand; PAM type: YTN; PAM sequence: TTT
gatttttggtcttggggacc

SEQ ID NO: 58690 - DNA, 20 bp, Artificial Sequence
  Description of Artificial Sequence: Synthetic oligonucleotide
  Target: SCN10A; (+) strand; PAM type: YTN; PAM sequence: TTG
atttttggtcttggggacct

SEQ ID NO: 58691 - DNA, 20 bp, Artificial Sequence
  Description of Artificial Sequence: Synthetic oligonucleotide
  Target: SCN10A; (+) strand; PAM type: YTN; PAM sequence: TTT
ttggtcttggggacctgggg

SEQ ID NO: 58692 - DNA, 20 bp, Artificial Sequence
  Description of Artificial Sequence: Synthetic oligonucleotide
  Target: SCN10A; (+) strand; PAM type: YTN; PAM sequence: TTT
tggtcttggggacctgggga

SEQ ID NO: 58693 - DNA, 20 bp, Artificial Sequence
  Description of Artificial Sequence: Synthetic oligonucleotide
  Target: SCN10A; (+) strand; PAM type: YTN; PAM sequence: TTT
ggtcttggggacctggggag

SEQ ID NO: 58694 - DNA, 20 bp, Artificial Sequence
  Description of Artificial Sequence: Synthetic oligonucleotide
  Target: SCN10A; (+) strand; PAM type: YTN; PAM sequence: TTG
gtcttggggacctggggagc

SEQ ID NO: 58695 - DNA, 20 bp, Artificial Sequence
  Description of Artificial Sequence: Synthetic oligonucleotide
  Target: SCN10A; (+) strand; PAM type: YTN; PAM sequence: CTT
ggggacctggggagccttat

SEQ ID NO: 58696 - DNA, 20 bp, Artificial Sequence
  Description of Artificial Sequence: Synthetic oligonucleotide
  Target: SCN10A; (+) strand; PAM type: YTN; PAM sequence: TTG
gggacctggggagccttatt

SEQ ID NO: 58697 - DNA, 20 bp, Artificial Sequence
  Description of Artificial Sequence: Synthetic oligonucleotide
  Target: SCN10A; (+) strand; PAM type: YTN; PAM sequence: CTG
gggagccttatttgtaccaa

SEQ ID NO: 58698 - DNA, 20 bp, Artificial Sequence
  Description of Artificial Sequence: Synthetic oligonucleotide
  Target: SCN10A; (+) strand; PAM type: YTN; PAM sequence: CTT
atttgtaccaaaggcctcca

SEQ ID NO: 58699 - DNA, 20 bp, Artificial Sequence
  Description of Artificial Sequence: Synthetic oligonucleotide
  Target: SCN10A; (+) strand; PAM type: YTN; PAM sequence: TTA
tttgtaccaaaggcctccac

SEQ ID NO: 58700 - DNA, 20 bp, Artificial Sequence
  Description of Artificial Sequence: Synthetic oligonucleotide
  Target: SCN10A; (+) strand; PAM type: YTN; PAM sequence: TTT
gtaccaaaggcctccaccaa

SEQ ID NO: 58701 - DNA, 20 bp, Artificial Sequence
  Description of Artificial Sequence: Synthetic oligonucleotide
  Target: SCN10A; (+) strand; PAM type: YTN; PAM sequence: TTG
taccaaaggcctccaccaaa

SEQ ID NO: 58702 - DNA, 20 bp, Artificial Sequence
  Description of Artificial Sequence: Synthetic oligonucleotide
  Target: SCN10A; (+) strand; PAM type: YTN; PAM sequence: CTC
caccaaagatgaggcaaggc

SEQ ID NO: 58703 - DNA, 20 bp, Artificial Sequence
  Description of Artificial Sequence: Synthetic oligonucleotide
  Target: SCN10A; (+) strand; PAM type: YTN; PAM sequence: CTT
taggtaagagagggttcaac

SEQ ID NO: 58704 - DNA, 20 bp, Artificial Sequence
  Description of Artificial Sequence: Synthetic oligonucleotide
  Target: SCN10A; (+) strand; PAM type: YTN; PAM sequence: TTT
aggtaagagagggttcaaca

SEQ ID NO: 58705 - DNA, 20 bp, Artificial Sequence
  Description of Artificial Sequence: Synthetic oligonucleotide
  Target: SCN10A; (+) strand; PAM type: YTN; PAM sequence: TTA
ggtaagagagggttcaacat

SEQ ID NO: 58706 - DNA, 20 bp, Artificial Sequence
  Description of Artificial Sequence: Synthetic oligonucleotide
  Target: SCN10A; (+) strand; PAM type: YTN; PAM sequence: TTC
aacatctcacaggaaaaatg

SEQ ID NO: 58707 - DNA, 20 bp, Artificial Sequence
  Description of Artificial Sequence: Synthetic oligonucleotide
  Target: SCN10A; (+) strand; PAM type: YTN; PAM sequence: CTC
acaggaaaaatggtgaggga

SEQ ID NO: 58708 - DNA, 20 bp, Artificial Sequence
  Description of Artificial Sequence: Synthetic oligonucleotide
  Target: SCN10A; (+) strand; PAM type: YTN; PAM sequence: CTC
tcgctccttgccaggttccc

SEQ ID NO: 58709 - DNA, 20 bp, Artificial Sequence
  Description of Artificial Sequence: Synthetic oligonucleotide
  Target: SCN10A; (+) strand; PAM type: YTN; PAM sequence: CTC
gctccttgccaggttccctg

SEQ ID NO: 58710 - DNA, 20 bp, Artificial Sequence
  Description of Artificial Sequence: Synthetic oligonucleotide
  Target: SCN10A; (+) strand; PAM type: YTN; PAM sequence: CTC
cttgccaggttccctgggcc

SEQ ID NO: 58711 - DNA, 20 bp, Artificial Sequence
  Description of Artificial Sequence: Synthetic oligonucleotide
  Target: SCN10A; (+) strand; PAM type: YTN; PAM sequence: CTT
gccaggttccctgggccctc

SEQ ID NO: 58712 - DNA, 20 bp, Artificial Sequence
  Description of Artificial Sequence: Synthetic oligonucleotide
  Target: SCN10A; (+) strand; PAM type: YTN; PAM sequence: TTG
ccaggttccctgggccctct

SEQ ID NO: 58713 - DNA, 20 bp, Artificial Sequence
  Description of Artificial Sequence: Synthetic oligonucleotide
  Target: SCN10A; (+) strand; PAM type: YTN; PAM sequence: TTC
cctgggccctctcccctact

SEQ ID NO: 58714 - DNA, 20 bp, Artificial Sequence
  Description of Artificial Sequence: Synthetic oligonucleotide
  Target: SCN10A; (+) strand; PAM type: YTN; PAM sequence: CTG
ggccctctcccctacttgct

SEQ ID NO: 58715 - DNA, 20 bp, Artificial Sequence
  Description of Artificial Sequence: Synthetic oligonucleotide
  Target: SCN10A; (+) strand; PAM type: YTN; PAM sequence: CTC
tcccctacttgctctttgtt

SEQ ID NO: 58716 - DNA, 20 bp, Artificial Sequence
  Description of Artificial Sequence: Synthetic oligonucleotide
  Target: SCN10A; (+) strand; PAM type: YTN; PAM sequence: CTC
ccctacttgctctttgttgt

SEQ ID NO: 58717 - DNA, 20 bp, Artificial Sequence
  Description of Artificial Sequence: Synthetic oligonucleotide
  Target: SCN10A; (+) strand; PAM type: YTN; PAM sequence: CTA
cttgctctttgttgttatgc

SEQ ID NO: 58718 - DNA, 20 bp, Artificial Sequence
  Description of Artificial Sequence: Synthetic oligonucleotide
  Target: SCN10A; (+) strand; PAM type: YTN; PAM sequence: CTT
gctctttgttgttatgcaca

SEQ ID NO: 58719 - DNA, 20 bp, Artificial Sequence
  Description of Artificial Sequence: Synthetic oligonucleotide
  Target: SCN10A; (+) strand; PAM type: YTN; PAM sequence: TTG
ctctttgttgttatgcacat

SEQ ID NO: 58720 - DNA, 20 bp, Artificial Sequence
  Description of Artificial Sequence: Synthetic oligonucleotide
  Target: SCN10A; (+) strand; PAM type: YTN; PAM sequence: CTC
tttgttgttatgcacatggg

SEQ ID NO: 58721 - DNA, 20 bp, Artificial Sequence
  Description of Artificial Sequence: Synthetic oligonucleotide
  Target: SCN10A; (+) strand; PAM type: YTN; PAM sequence: CTT
tgttgttatgcacatgggtc

SEQ ID NO: 58722 - DNA, 20 bp, Artificial Sequence
  Description of Artificial Sequence: Synthetic oligonucleotide
  Target: SCN10A; (+) strand; PAM type: YTN; PAM sequence: TTT
gttgttatgcacatgggtca

SEQ ID NO: 58723 - DNA, 20 bp, Artificial Sequence
  Description of Artificial Sequence: Synthetic oligonucleotide
  Target: SCN10A; (+) strand; PAM type: YTN; PAM sequence: TTG
ttgttatgcacatgggtcac

SEQ ID NO: 58724 - DNA, 20 bp, Artificial Sequence
  Description of Artificial Sequence: Synthetic oligonucleotide
  Target: SCN10A; (+) strand; PAM type: YTN; PAM sequence: TTG
ttatgcacatgggtcacaat

SEQ ID NO: 58725 - DNA, 20 bp, Artificial Sequence
  Description of Artificial Sequence: Synthetic oligonucleotide
  Target: SCN10A; (+) strand; PAM type: YTN; PAM sequence: TTA
tgcacatgggtcacaatatt

SEQ ID NO: 58726 - DNA, 20 bp, Artificial Sequence
  Description of Artificial Sequence: Synthetic oligonucleotide
  Target: SCN10A; (+) strand; PAM type: YTN; PAM sequence: TTG
tgttggaaagaggaagaaag

SEQ ID NO: 58727 - DNA, 20 bp, Artificial Sequence
  Description of Artificial Sequence: Synthetic oligonucleotide
  Target: SCN10A; (+) strand; PAM type: YTN; PAM sequence: TTG
gaaagaggaagaaagtagaa

SEQ ID NO: 58728 - DNA, 20 bp, Artificial Sequence
  Description of Artificial Sequence: Synthetic oligonucleotide
  Target: SCN10A; (+) strand; PAM type: YTN; PAM sequence: CTT
gggaaataattataattttg

SEQ ID NO: 58729 - DNA, 20 bp, Artificial Sequence
  Description of Artificial Sequence: Synthetic oligonucleotide
  Target: SCN10A; (+) strand; PAM type: YTN; PAM sequence: TTG
ggaaataattataattttgg

SEQ ID NO: 58730 - DNA, 20 bp, Artificial Sequence
  Description of Artificial Sequence: Synthetic oligonucleotide
  Target: SCN10A; (+) strand; PAM type: YTN; PAM sequence: TTA
taattttggattataaaatc

SEQ ID NO: 58731 - DNA, 20 bp, Artificial Sequence
  Description of Artificial Sequence: Synthetic oligonucleotide
  Target: SCN10A; (+) strand; PAM type: YTN; PAM sequence: TTT
tggattataaaatctttgtg

SEQ ID NO: 58732 - DNA, 20 bp, Artificial Sequence
  Description of Artificial Sequence: Synthetic oligonucleotide
  Target: SCN10A; (+) strand; PAM type: YTN; PAM sequence: TTT
ggattataaaatctttgtgg

SEQ ID NO: 58733 - DNA, 20 bp, Artificial Sequence
  Description of Artificial Sequence: Synthetic oligonucleotide
  Target: SCN10A; (+) strand; PAM type: YTN; PAM sequence: TTG
gattataaaatctttgtgga

SEQ ID NO: 58734 - DNA, 20 bp, Artificial Sequence
  Description of Artificial Sequence: Synthetic oligonucleotide
  Target: SCN10A; (+) strand; PAM type: YTN; PAM sequence: TTA
taaaatctttgtggaagacc

SEQ ID NO: 58735 - DNA, 20 bp, Artificial Sequence
  Description of Artificial Sequence: Synthetic oligonucleotide
  Target: SCN10A; (+) strand; PAM type: YTN; PAM sequence: CTT
tgtggaagaccttctgtgaa

SEQ ID NO: 58736 - DNA, 20 bp, Artificial Sequence
  Description of Artificial Sequence: Synthetic oligonucleotide
  Target: SCN10A; (+) strand; PAM type: YTN; PAM sequence: TTT
gtggaagaccttctgtgaat

SEQ ID NO: 58737 - DNA, 20 bp, Artificial Sequence
  Description of Artificial Sequence: Synthetic oligonucleotide
  Target: SCN10A; (+) strand; PAM type: YTN; PAM sequence: TTG
tggaagaccttctgtgaatt

SEQ ID NO: 58738 - DNA, 20 bp, Artificial Sequence
  Description of Artificial Sequence: Synthetic oligonucleotide
  Target: SCN10A; (+) strand; PAM type: YTN; PAM sequence: CTT
ctgtgaatttccagtttaac

SEQ ID NO: 58739 - DNA, 20 bp, Artificial Sequence
  Description of Artificial Sequence: Synthetic oligonucleotide
  Target: SCN10A; (+) strand; PAM type: YTN; PAM sequence: TTC
tgtgaatttccagtttaact

SEQ ID NO: 58740 - DNA, 20 bp, Artificial Sequence
  Description of Artificial Sequence: Synthetic oligonucleotide
  Target: SCN10A; (+) strand; PAM type: YTN; PAM sequence: CTG
tgaatttccagtttaactag

SEQ ID NO: 58741 - DNA, 20 bp, Artificial Sequence
  Description of Artificial Sequence: Synthetic oligonucleotide
  Target: SCN10A; (+) strand; PAM type: YTN; PAM sequence: TTT
ccagtttaactaggacatgt

SEQ ID NO: 58742 - DNA, 20 bp, Artificial Sequence
  Description of Artificial Sequence: Synthetic oligonucleotide
  Target: SCN10A; (+) strand; PAM type: YTN; PAM sequence: TTC
cagtttaactaggacatgtt

SEQ ID NO: 58743 - DNA, 20 bp, Artificial Sequence
  Description of Artificial Sequence: Synthetic oligonucleotide
  Target: SCN10A; (+) strand; PAM type: YTN; PAM sequence: TTT
aactaggacatgttcccatc

SEQ ID NO: 58744 - DNA, 20 bp, Artificial Sequence
  Description of Artificial Sequence: Synthetic oligonucleotide
  Target: SCN10A; (+) strand; PAM type: YTN; PAM sequence: TTA
actaggacatgttcccatcg

SEQ ID NO: 58745 - DNA, 20 bp, Artificial Sequence
  Description of Artificial Sequence: Synthetic oligonucleotide
  Target: SCN10A; (+) strand; PAM type: YTN; PAM sequence: CTA
ggacatgttcccatcgtgta

SEQ ID NO: 58746 - DNA, 20 bp, Artificial Sequence
  Description of Artificial Sequence: Synthetic oligonucleotide
  Target: SCN10A; (+) strand; PAM type: YTN; PAM sequence: TTC
ccatcgtgtagggtacatta

SEQ ID NO: 58747 - DNA, 20 bp, Artificial Sequence
  Description of Artificial Sequence: Synthetic oligonucleotide
  Target: SCN10A; (+) strand; PAM type: YTN; PAM sequence: TTA
tttgtctacatactctggta

SEQ ID NO: 58748 - DNA, 20 bp, Artificial Sequence
  Description of Artificial Sequence: Synthetic oligonucleotide
  Target: SCN10A; (+) strand; PAM type: YTN; PAM sequence: TTT
gtctacatactctggtaaaa

SEQ ID NO: 58749 - DNA, 20 bp, Artificial Sequence
  Description of Artificial Sequence: Synthetic oligonucleotide
  Target: SCN10A; (+) strand; PAM type: YTN; PAM sequence: TTG
tctacatactctggtaaaat

SEQ ID NO: 58750 - DNA, 20 bp, Artificial Sequence
  Description of Artificial Sequence: Synthetic oligonucleotide
  Target: SCN10A; (+) strand; PAM type: YTN; PAM sequence: CTA
catactctggtaaaattttc

SEQ ID NO: 58751 - DNA, 20 bp, Artificial Sequence
  Description of Artificial Sequence: Synthetic oligonucleotide
  Target: SCN10A; (+) strand; PAM type: YTN; PAM sequence: CTC
tggtaaaattttctgccaga

SEQ ID NO: 58752 - DNA, 20 bp, Artificial Sequence
  Description of Artificial Sequence: Synthetic oligonucleotide
  Target: SCN10A; (+) strand; PAM type: YTN; PAM sequence: CTG
gtaaaattttctgccagaca

SEQ ID NO: 58753 - DNA, 20 bp, Artificial Sequence
  Description of Artificial Sequence: Synthetic oligonucleotide
  Target: SCN10A; (+) strand; PAM type: YTN; PAM sequence: TTT
tctgccagacaactggtcta

SEQ ID NO: 58754 - DNA, 20 bp, Artificial Sequence
  Description of Artificial Sequence: Synthetic oligonucleotide
  Target: SCN10A; (+) strand; PAM type: YTN; PAM sequence: TTT
ctgccagacaactggtctac

SEQ ID NO: 58755 - DNA, 20 bp, Artificial Sequence
  Description of Artificial Sequence: Synthetic oligonucleotide
  Target: SCN10A; (+) strand; PAM type: YTN; PAM sequence: TTC
tgccagacaactggtctaca

SEQ ID NO: 58756 - DNA, 20 bp, Artificial Sequence
  Description of Artificial Sequence: Synthetic oligonucleotide
  Target: SCN10A; (+) strand; PAM type: YTN; PAM sequence: CTG
ccagacaactggtctacagc

SEQ ID NO: 58757 - DNA, 20 bp, Artificial Sequence
  Description of Artificial Sequence: Synthetic oligonucleotide
  Target: SCN10A; (+) strand; PAM type: YTN; PAM sequence: CTG
gtctacagcacattttaatt

SEQ ID NO: 58758 - DNA, 20 bp, Artificial Sequence
  Description of Artificial Sequence: Synthetic oligonucleotide
  Target: SCN10A; (+) strand; PAM type: YTN; PAM sequence: CTA
cagcacattttaatttgctc

SEQ ID NO: 58759 - DNA, 20 bp, Artificial Sequence
  Description of Artificial Sequence: Synthetic oligonucleotide
  Target: SCN10A; (+) strand; PAM type: YTN; PAM sequence: TTT
taatttgctccaggatctta

SEQ ID NO: 58760 - DNA, 20 bp, Artificial Sequence
  Description of Artificial Sequence: Synthetic oligonucleotide
  Target: SCN10A; (+) strand; PAM type: YTN; PAM sequence: TTT
aatttgctccaggatcttat

SEQ ID NO: 58761 - DNA, 20 bp, Artificial Sequence
  Description of Artificial Sequence: Synthetic oligonucleotide
  Target: SCN10A; (+) strand; PAM type: YTN; PAM sequence: TTA
atttgctccaggatcttatt

SEQ ID NO: 58762 - DNA, 20 bp, Artificial Sequence
  Description of Artificial Sequence: Synthetic oligonucleotide
  Target: SCN10A; (+) strand; PAM type: YTN; PAM sequence: TTT
gctccaggatcttattttaa

SEQ ID NO: 58763 - DNA, 20 bp, Artificial Sequence
  Description of Artificial Sequence: Synthetic oligonucleotide
  Target: SCN10A; (+) strand; PAM type: YTN; PAM sequence: TTG
ctccaggatcttattttaag

SEQ ID NO: 58764 - DNA, 20 bp, Artificial Sequence
  Description of Artificial Sequence: Synthetic oligonucleotide
  Target: SCN10A; (+) strand; PAM type: YTN; PAM sequence: CTC
caggatcttattttaaggga

SEQ ID NO: 58765 - DNA, 20 bp, Artificial Sequence
  Description of Artificial Sequence: Synthetic oligonucleotide
  Target: SCN10A; (+) strand; PAM type: YTN; PAM sequence: CTT
attttaagggagaatggttc

SEQ ID NO: 58766 - DNA, 20 bp, Artificial Sequence
  Description of Artificial Sequence: Synthetic oligonucleotide
  Target: SCN10A; (+) strand; PAM type: YTN; PAM sequence: TTA
ttttaagggagaatggttcc

SEQ ID NO: 58767 - DNA, 20 bp, Artificial Sequence
  Description of Artificial Sequence: Synthetic oligonucleotide
  Target: SCN10A; (+) strand; PAM type: YTN; PAM sequence: TTT
taagggagaatggttcctcg

SEQ ID NO: 58768 - DNA, 20 bp, Artificial Sequence
  Description of Artificial Sequence: Synthetic oligonucleotide
  Target: SCN10A; (+) strand; PAM type: YTN; PAM sequence: TTT
aagggagaatggttcctcgt

SEQ ID NO: 58769 - DNA, 20 bp, Artificial Sequence
  Description of Artificial Sequence: Synthetic oligonucleotide
  Target: SCN10A; (+) strand; PAM type: YTN; PAM sequence: TTA
agggagaatggttcctcgta

SEQ ID NO: 58770 - DNA, 20 bp, Artificial Sequence
  Description of Artificial Sequence: Synthetic oligonucleotide
  Target: SCN10A; (+) strand; PAM type: YTN; PAM sequence: TTC
ctcgtacttgtaacaattag

SEQ ID NO: 58771 - DNA, 20 bp, Artificial Sequence
  Description of Artificial Sequence: Synthetic oligonucleotide
  Target: SCN10A; (+) strand; PAM type: YTN; PAM sequence: CTC
gtacttgtaacaattagata

SEQ ID NO: 58772 - DNA, 20 bp, Artificial Sequence
  Description of Artificial Sequence: Synthetic oligonucleotide
  Target: SCN10A; (+) strand; PAM type: YTN; PAM sequence: CTT
gtaacaattagatactcaat

SEQ ID NO: 58773 - DNA, 20 bp, Artificial Sequence
  Description of Artificial Sequence: Synthetic oligonucleotide
  Target: SCN10A; (+) strand; PAM type: YTN; PAM sequence: TTG
taacaattagatactcaatc

SEQ ID NO: 58774 - DNA, 20 bp, Artificial Sequence
  Description of Artificial Sequence: Synthetic oligonucleotide
  Target: SCN10A; (+) strand; PAM type: YTN; PAM sequence: TTA
gatactcaatcacctcttgt

SEQ ID NO: 58775 - DNA, 20 bp, Artificial Sequence
  Description of Artificial Sequence: Synthetic oligonucleotide
  Target: SCN10A; (+) strand; PAM type: YTN; PAM sequence: CTC
aatcacctcttgttggtggg

SEQ ID NO: 58776 - DNA, 20 bp, Artificial Sequence
  Description of Artificial Sequence: Synthetic oligonucleotide
  Target: SCN10A; (+) strand; PAM type: YTN; PAM sequence: CTC
ttgttggtgggaaagaagaa

SEQ ID NO: 58777 - DNA, 20 bp, Artificial Sequence
  Description of Artificial Sequence: Synthetic oligonucleotide
  Target: SCN10A; (+) strand; PAM type: YTN; PAM sequence: CTT
gttggtgggaaagaagaaag

SEQ ID NO: 58778 - DNA, 20 bp, Artificial Sequence
  Description of Artificial Sequence: Synthetic oligonucleotide
  Target: SCN10A; (+) strand; PAM type: YTN; PAM sequence: TTG
ttggtgggaaagaagaaagg

SEQ ID NO: 58779 - DNA, 20 bp, Artificial Sequence
  Description of Artificial Sequence: Synthetic oligonucleotide
  Target: SCN10A; (+) strand; PAM type: YTN; PAM sequence: TTG
gtgggaaagaagaaagggag

SEQ ID NO: 58780 - DNA, 20 bp, Artificial Sequence
  Description of Artificial Sequence: Synthetic oligonucleotide
  Target: SCN10A; (+) strand; PAM type: YTN; PAM sequence: TTG
atatgtgggttttttctgct

SEQ ID NO: 58781 - DNA, 20 bp, Artificial Sequence
  Description of Artificial Sequence: Synthetic oligonucleotide
  Target: SCN10A; (+) strand; PAM type: YTN; PAM sequence: TTT
tttctgcttattttccagct

SEQ ID NO: 58782 - DNA, 20 bp, Artificial Sequence
  Description of Artificial Sequence: Synthetic oligonucleotide
  Target: SCN10A; (+) strand; PAM type: YTN; PAM sequence: TTT
ttctgcttattttccagctc

SEQ ID NO: 58783 - DNA, 20 bp, Artificial Sequence
  Description of Artificial Sequence: Synthetic oligonucleotide
  Target: SCN10A; (+) strand; PAM type: YTN; PAM sequence: TTT
tctgcttattttccagctct

SEQ ID NO: 58784 - DNA, 20 bp, Artificial Sequence
  Description of Artificial Sequence: Synthetic oligonucleotide
  Target: SCN10A; (+) strand; PAM type: YTN; PAM sequence: TTT
ctgcttattttccagctcta

SEQ ID NO: 58785 - DNA, 20 bp, Artificial Sequence
  Description of Artificial Sequence: Synthetic oligonucleotide
  Target: SCN10A; (+) strand; PAM type: YTN; PAM sequence: TTC
tgcttattttccagctctat

SEQ ID NO: 58786 - DNA, 20 bp, Artificial Sequence
  Description of Artificial Sequence: Synthetic oligonucleotide
  Target: SCN10A; (+) strand; PAM type: YTN; PAM sequence: CTG
cttattttccagctctataa

SEQ ID NO: 58787 - DNA, 20 bp, Artificial Sequence
  Description of Artificial Sequence: Synthetic oligonucleotide
  Target: SCN10A; (+) strand; PAM type: YTN; PAM sequence: CTT
attttccagctctataaggg

SEQ ID NO: 58788 - DNA, 20 bp, Artificial Sequence
  Description of Artificial Sequence: Synthetic oligonucleotide
  Target: SCN10A; (+) strand; PAM type: YTN; PAM sequence: TTA
ttttccagctctataaggga

SEQ ID NO: 58789 - DNA, 20 bp, Artificial Sequence
  Description of Artificial Sequence: Synthetic oligonucleotide
  Target: SCN10A; (+) strand; PAM type: YTN; PAM sequence: TTT
tccagctctataagggattc

SEQ ID NO: 58790 - DNA, 20 bp, Artificial Sequence
  Description of Artificial Sequence: Synthetic oligonucleotide
  Target: SCN10A; (+) strand; PAM type: YTN; PAM sequence: TTT
ccagctctataagggattcc

SEQ ID NO: 58791 - DNA, 20 bp, Artificial Sequence
  Description of Artificial Sequence: Synthetic oligonucleotide
  Target: SCN10A; (+) strand; PAM type: YTN; PAM sequence: TTC
cagctctataagggattcct

SEQ ID NO: 58792 - DNA, 20 bp, Artificial Sequence
  Description of Artificial Sequence: Synthetic oligonucleotide
  Target: SCN10A; (+) strand; PAM type: YTN; PAM sequence: CTC
tataagggattcctgcccca

SEQ ID NO: 58793 - DNA, 20 bp, Artificial Sequence
  Description of Artificial Sequence: Synthetic oligonucleotide
  Target: SCN10A; (+) strand; PAM type: YTN; PAM sequence: CTA
taagggattcctgccccagc

SEQ ID NO: 58794 - DNA, 20 bp, Artificial Sequence
  Description of Artificial Sequence: Synthetic oligonucleotide
  Target: SCN10A; (+) strand; PAM type: YTN; PAM sequence: TTC
ctgccccagcggatggtgct

SEQ ID NO: 58795 - DNA, 20 bp, Artificial Sequence
  Description of Artificial Sequence: Synthetic oligonucleotide
  Target: SCN10A; (+) strand; PAM type: YTN; PAM sequence: CTG
ccccagcggatggtgctacc

SEQ ID NO: 58796 - DNA, 20 bp, Artificial Sequence
  Description of Artificial Sequence: Synthetic oligonucleotide
  Target: SCN10A; (+) strand; PAM type: YTN; PAM sequence: CTA
ccctgtaagccacaggaact

SEQ ID NO: 58797 - DNA, 20 bp, Artificial Sequence
  Description of Artificial Sequence: Synthetic oligonucleotide
  Target: SCN10A; (+) strand; PAM type: YTN; PAM sequence: CTG
taagccacaggaactggtag

SEQ ID NO: 58798 - DNA, 20 bp, Artificial Sequence
  Description of Artificial Sequence: Synthetic oligonucleotide
  Target: SCN10A; (+) strand; PAM type: YTN; PAM sequence: CTG
gtagttaagatatccccatc

SEQ ID NO: 58799 - DNA, 20 bp, Artificial Sequence
  Description of Artificial Sequence: Synthetic oligonucleotide
  Target: SCN10A; (+) strand; PAM type: YTN; PAM sequence: TTA
agatatccccatcatagaac

SEQ ID NO: 58800 - DNA, 20 bp, Artificial Sequence
  Description of Artificial Sequence: Synthetic oligonucleotide
  Target: SCN10A; (+) strand; PAM type: YTN; PAM sequence: CTA
agtacttggctatgttttat

SEQ ID NO: 58801 - DNA, 20 bp, Artificial Sequence
  Description of Artificial Sequence: Synthetic oligonucleotide
  Target: SCN10A; (+) strand; PAM type: YTN; PAM sequence: CTT
ggctatgttttatttctata

SEQ ID NO: 58802 - DNA, 20 bp, Artificial Sequence
  Description of Artificial Sequence: Synthetic oligonucleotide
  Target: SCN10A; (+) strand; PAM type: YTN; PAM sequence: TTG
gctatgttttatttctatat

SEQ ID NO: 58803 - DNA, 20 bp, Artificial Sequence
  Description of Artificial Sequence: Synthetic oligonucleotide
  Target: SCN10A; (+) strand; PAM type: YTN; PAM sequence: CTA
tgttttatttctatattact

SEQ ID NO: 58804 - DNA, 20 bp, Artificial Sequence
  Description of Artificial Sequence: Synthetic oligonucleotide
  Target: SCN10A; (+) strand; PAM type: YTN; PAM sequence: TTT
tatttctatattactgatac

SEQ ID NO: 58805 - DNA, 20 bp, Artificial Sequence
  Description of Artificial Sequence: Synthetic oligonucleotide
  Target: SCN10A; (+) strand; PAM type: YTN; PAM sequence: TTT
atttctatattactgataca

SEQ ID NO: 58806 - DNA, 20 bp, Artificial Sequence
  Description of Artificial Sequence: Synthetic oligonucleotide
  Target: SCN10A; (+) strand; PAM type: YTN; PAM sequence: TTA
tttctatattactgatacac

SEQ ID NO: 58807 - DNA, 20 bp, Artificial Sequence
  Description of Artificial Sequence: Synthetic oligonucleotide
  Target: SCN10A; (+) strand; PAM type: YTN; PAM sequence: TTT
ctatattactgatacacaaa

SEQ ID NO: 58808 - DNA, 20 bp, Artificial Sequence
  Description of Artificial Sequence: Synthetic oligonucleotide
  Target: SCN10A; (+) strand; PAM type: YTN; PAM sequence: TTC
tatattactgatacacaaac

SEQ ID NO: 58809 - DNA, 20 bp, Artificial Sequence
  Description of Artificial Sequence: Synthetic oligonucleotide
  Target: SCN10A; (+) strand; PAM type: YTN; PAM sequence: CTA
tattactgatacacaaacaa

SEQ ID NO: 58810 - DNA, 20 bp, Artificial Sequence
  Description of Artificial Sequence: Synthetic oligonucleotide
  Target: SCN10A; (+) strand; PAM type: YTN; PAM sequence: TTA
ctgatacacaaacaagctcc

SEQ ID NO: 58811 - DNA, 20 bp, Artificial Sequence
  Description of Artificial Sequence: Synthetic oligonucleotide
  Target: SCN10A; (+) strand; PAM type: YTN; PAM sequence: CTG
atacacaaacaagctccctt

SEQ ID NO: 58812 - DNA, 20 bp, Artificial Sequence
  Description of Artificial Sequence: Synthetic oligonucleotide
  Target: SCN10A; (+) strand; PAM type: YTN; PAM sequence: CTC
ccttctttaatataaaatca

SEQ ID NO: 58813 - DNA, 20 bp, Artificial Sequence
  Description of Artificial Sequence: Synthetic oligonucleotide
  Target: SCN10A; (+) strand; PAM type: YTN; PAM sequence: CTT
ctttaatataaaatcaaaat

SEQ ID NO: 58814 - DNA, 20 bp, Artificial Sequence
  Description of Artificial Sequence: Synthetic oligonucleotide
  Target: SCN10A; (+) strand; PAM type: YTN; PAM sequence: TTC
tttaatataaaatcaaaata

SEQ ID NO: 58815 - DNA, 20 bp, Artificial Sequence
  Description of Artificial Sequence: Synthetic oligonucleotide
  Target: SCN10A; (+) strand; PAM type: YTN; PAM sequence: CTT
taatataaaatcaaaatagc

SEQ ID NO: 58816 - DNA, 20 bp, Artificial Sequence
  Description of Artificial Sequence: Synthetic oligonucleotide
  Target: SCN10A; (+) strand; PAM type: YTN; PAM sequence: TTT
aatataaaatcaaaatagcc

SEQ ID NO: 58817 - DNA, 20 bp, Artificial Sequence
  Description of Artificial Sequence: Synthetic oligonucleotide
  Target: SCN10A; (+) strand; PAM type: YTN; PAM sequence: TTA
atataaaatcaaaatagcct

SEQ ID NO: 58818 - DNA, 20 bp, Artificial Sequence
  Description of Artificial Sequence: Synthetic oligonucleotide
  Target: SCN10A; (+) strand; PAM type: YTN; PAM sequence: CTT
tggaatctttcattttggaa

SEQ ID NO: 58819 - DNA, 20 bp, Artificial Sequence
  Description of Artificial Sequence: Synthetic oligonucleotide
  Target: SCN10A; (+) strand; PAM type: YTN; PAM sequence: TTT
ggaatctttcattttggaag

SEQ ID NO: 58820 - DNA, 20 bp, Artificial Sequence
  Description of Artificial Sequence: Synthetic oligonucleotide
  Target: SCN10A; (+) strand; PAM type: YTN; PAM sequence: TTG
gaatctttcattttggaaga

SEQ ID NO: 58821 - DNA, 20 bp, Artificial Sequence
  Description of Artificial Sequence: Synthetic oligonucleotide
  Target: SCN10A; (+) strand; PAM type: YTN; PAM sequence: CTT
tcattttggaagacaaacaa

SEQ ID NO: 58822 - DNA, 20 bp, Artificial Sequence
  Description of Artificial Sequence: Synthetic oligonucleotide
  Target: SCN10A; (+) strand; PAM type: YTN; PAM sequence: TTT
cattttggaagacaaacaaa

SEQ ID NO: 58823 - DNA, 20 bp, Artificial Sequence
  Description of Artificial Sequence: Synthetic oligonucleotide
  Target: SCN10A; (+) strand; PAM type: YTN; PAM sequence: TTC
attttggaagacaaacaaaa

SEQ ID NO: 58824 - DNA, 20 bp, Artificial Sequence
  Description of Artificial Sequence: Synthetic oligonucleotide
  Target: SCN10A; (+) strand; PAM type: YTN; PAM sequence: TTT
tggaagacaaacaaaacaaa

SEQ ID NO: 58825 - DNA, 20 bp, Artificial Sequence
  Description of Artificial Sequence: Synthetic oligonucleotide
  Target: SCN10A; (+) strand; PAM type: YTN; PAM sequence: TTT
ggaagacaaacaaaacaaaa

SEQ ID NO: 58826 - DNA, 20 bp, Artificial Sequence
  Description of Artificial Sequence: Synthetic oligonucleotide
  Target: SCN10A; (+) strand; PAM type: YTN; PAM sequence: TTG
gaagacaaacaaaacaaaac

SEQ ID NO: 58827 - DNA, 20 bp, Artificial Sequence
  Description of Artificial Sequence: Synthetic oligonucleotide
  Target: SCN10A; (+) strand; PAM type: YTN; PAM sequence: CTA
accaaccaaccaacaaaaac

SEQ ID NO: 58828 - DNA, 20 bp, Artificial Sequence
  Description of Artificial Sequence: Synthetic oligonucleotide
  Target: SCN10A; (+) strand; PAM type: YTN; PAM sequence: CTC
ctattatgctaagtgagata

SEQ ID NO: 58829 - DNA, 20 bp, Artificial Sequence
  Description of Artificial Sequence: Synthetic oligonucleotide
  Target: SCN10A; (+) strand; PAM type: YTN; PAM sequence: CTA
ttatgctaagtgagataagc

SEQ ID NO: 58830 - DNA, 20 bp, Artificial Sequence
  Description of Artificial Sequence: Synthetic oligonucleotide
  Target: SCN10A; (+) strand; PAM type: YTN; PAM sequence: TTA
tgctaagtgagataagccag

SEQ ID NO: 58831 - DNA, 20 bp, Artificial Sequence
  Description of Artificial Sequence: Synthetic oligonucleotide
  Target: SCN10A; (+) strand; PAM type: YTN; PAM sequence: CTA
agtgagataagccagacaca

SEQ ID NO: 58832 - DNA, 20 bp, Artificial Sequence
  Description of Artificial Sequence: Synthetic oligonucleotide
  Target: SCN10A; (+) strand; PAM type: YTN; PAM sequence: TTG
catttatataaggaatctaa

SEQ ID NO: 58833 - DNA, 20 bp, Artificial Sequence
  Description of Artificial Sequence: Synthetic oligonucleotide
  Target: SCN10A; (+) strand; PAM type: YTN; PAM sequence: TTT
atataaggaatctaaaatag

SEQ ID NO: 58834 - DNA, 20 bp, Artificial Sequence
  Description of Artificial Sequence: Synthetic oligonucleotide
  Target: SCN10A; (+) strand; PAM type: YTN; PAM sequence: TTA
tataaggaatctaaaatagt

SEQ ID NO: 58835 - DNA, 20 bp, Artificial Sequence
  Description of Artificial Sequence: Synthetic oligonucleotide
  Target: SCN10A; (+) strand; PAM type: YTN; PAM sequence: CTA
aaatagtcaaactcatggga

SEQ ID NO: 58836 - DNA, 20 bp, Artificial Sequence
  Description of Artificial Sequence: Synthetic oligonucleotide
  Target: SCN10A; (+) strand; PAM type: YTN; PAM sequence: CTC
atgggagcagagaatagaat

SEQ ID NO: 58837 - DNA, 20 bp, Artificial Sequence
  Description of Artificial Sequence: Synthetic oligonucleotide
  Target: SCN10A; (+) strand; PAM type: YTN; PAM sequence: TTT
ccaggagctgggaggagggg

SEQ ID NO: 58838 - DNA, 20 bp, Artificial Sequence
  Description of Artificial Sequence: Synthetic oligonucleotide
  Target: SCN10A; (+) strand; PAM type: YTN; PAM sequence: TTC
caggagctgggaggagggga

SEQ ID NO: 58839 - DNA, 20 bp, Artificial Sequence
  Description of Artificial Sequence: Synthetic oligonucleotide
  Target: SCN10A; (+) strand; PAM type: YTN; PAM sequence: CTG
ggaggaggggaaattgggga

SEQ ID NO: 58840 - DNA, 20 bp, Artificial Sequence
  Description of Artificial Sequence: Synthetic oligonucleotide
  Target: SCN10A; (+) strand; PAM type: YTN; PAM sequence: TTG
gggaggtacttgtcaaagtg

SEQ ID NO: 58841 - DNA, 20 bp, Artificial Sequence
  Description of Artificial Sequence: Synthetic oligonucleotide
  Target: SCN10A; (+) strand; PAM type: YTN; PAM sequence: CTT
gtcaaagtgtacaaacttcc

SEQ ID NO: 58842 - DNA, 20 bp, Artificial Sequence
  Description of Artificial Sequence: Synthetic oligonucleotide
  Target: SCN10A; (+) strand; PAM type: YTN; PAM sequence: TTG
tcaaagtgtacaaacttcca

SEQ ID NO: 58843 - DNA, 20 bp, Artificial Sequence
  Description of Artificial Sequence: Synthetic oligonucleotide
  Target: SCN10A; (+) strand; PAM type: YTN; PAM sequence: CTT
ccagttatgtgacatgaata

SEQ ID NO: 58844 - DNA, 20 bp, Artificial Sequence
  Description of Artificial Sequence: Synthetic oligonucleotide
  Target: SCN10A; (+) strand; PAM type: YTN; PAM sequence: TTC
cagttatgtgacatgaataa

SEQ ID NO: 58845 - DNA, 20 bp, Artificial Sequence
  Description of Artificial Sequence: Synthetic oligonucleotide
  Target: SCN10A; (+) strand; PAM type: YTN; PAM sequence: TTA
tgtgacatgaataaatccta

SEQ ID NO: 58846 - DNA, 20 bp, Artificial Sequence
  Description of Artificial Sequence: Synthetic oligonucleotide
  Target: SCN10A; (+) strand; PAM type: YTN; PAM sequence: CTA
gagctctacttatagcatag

SEQ ID NO: 58847 - DNA, 20 bp, Artificial Sequence
  Description of Artificial Sequence: Synthetic oligonucleotide
  Target: SCN10A; (+) strand; PAM type: YTN; PAM sequence: CTC
tacttatagcatagtcccta

SEQ ID NO: 58848 - DNA, 20 bp, Artificial Sequence
  Description of Artificial Sequence: Synthetic oligonucleotide
  Target: SCN10A; (+) strand; PAM type: YTN; PAM sequence: CTA
cttatagcatagtccctata

SEQ ID NO: 58849 - DNA, 20 bp, Artificial Sequence
  Description of Artificial Sequence: Synthetic oligonucleotide
  Target: SCN10A; (+) strand; PAM type: YTN; PAM sequence: CTT
atagcatagtccctatagtt

SEQ ID NO: 58850 - DNA, 20 bp, Artificial Sequence
  Description of Artificial Sequence: Synthetic oligonucleotide
  Target: SCN10A; (+) strand; PAM type: YTN; PAM sequence: TTA
tagcatagtccctatagtta

SEQ ID NO: 58851 - DNA, 20 bp, Artificial Sequence
  Description of Artificial Sequence: Synthetic oligonucleotide
  Target: SCN10A; (+) strand; PAM type: YTN; PAM sequence: CTA
tagttagcaataccgtgttg

SEQ ID NO: 58852 - DNA, 20 bp, Artificial Sequence
  Description of Artificial Sequence: Synthetic oligonucleotide
  Target: SCN10A; (+) strand; PAM type: YTN; PAM sequence: TTA
gcaataccgtgttgtctacc

SEQ ID NO: 58853 - DNA, 20 bp, Artificial Sequence
  Description of Artificial Sequence: Synthetic oligonucleotide
  Target: SCN10A; (+) strand; PAM type: YTN; PAM sequence: TTG
tctacctaaaaatttgccaa

SEQ ID NO: 58854 - DNA, 20 bp, Artificial Sequence
  Description of Artificial Sequence: Synthetic oligonucleotide
  Target: SCN10A; (+) strand; PAM type: YTN; PAM sequence: CTA
cctaaaaatttgccaagaga

SEQ ID NO: 58855 - DNA, 20 bp, Artificial Sequence
  Description of Artificial Sequence: Synthetic oligonucleotide
  Target: SCN10A; (+) strand; PAM type: YTN; PAM sequence: CTA
aaaatttgccaagagaataa

SEQ ID NO: 58856 - DNA, 20 bp, Artificial Sequence
  Description of Artificial Sequence: Synthetic oligonucleotide
  Target: SCN10A; (+) strand; PAM type: YTN; PAM sequence: TTT
gccaagagaataaatcttaa

SEQ ID NO: 58857 - DNA, 20 bp, Artificial Sequence
  Description of Artificial Sequence: Synthetic oligonucleotide
  Target: SCN10A; (+) strand; PAM type: YTN; PAM sequence: TTG
ccaagagaataaatcttaag

SEQ ID NO: 58858 - DNA, 20 bp, Artificial Sequence
  Description of Artificial Sequence: Synthetic oligonucleotide
  Target: SCN10A; (+) strand; PAM type: YTN; PAM sequence: CTT
aagtgttcctagcacccaat

SEQ ID NO: 58859 - DNA, 20 bp, Artificial Sequence
  Description of Artificial Sequence: Synthetic oligonucleotide
  Target: SCN10A; (+) strand; PAM type: YTN; PAM sequence: TTA
agtgttcctagcacccaata

SEQ ID NO: 58860 - DNA, 20 bp, Artificial Sequence
  Description of Artificial Sequence: Synthetic oligonucleotide
  Target: SCN10A; (+) strand; PAM type: YTN; PAM sequence: TTC
ctagcacccaataaataaat

SEQ ID NO: 58861 - DNA, 20 bp, Artificial Sequence
  Description of Artificial Sequence: Synthetic oligonucleotide
  Target: SCN10A; (+) strand; PAM type: YTN; PAM sequence: CTA
gcacccaataaataaataaa

SEQ ID NO: 58862 - DNA, 20 bp, Artificial Sequence
  Description of Artificial Sequence: Synthetic oligonucleotide
  Target: SCN10A; (+) strand; PAM type: YTN; PAM sequence: TTT
ggaggttatggacatgtttc

SEQ ID NO: 58863 - DNA, 20 bp, Artificial Sequence
  Description of Artificial Sequence: Synthetic oligonucleotide
  Target: SCN10A; (+) strand; PAM type: YTN; PAM sequence: TTG
gaggttatggacatgtttct

SEQ ID NO: 58864 - DNA, 20 bp, Artificial Sequence
  Description of Artificial Sequence: Synthetic oligonucleotide
  Target: SCN10A; (+) strand; PAM type: YTN; PAM sequence: TTA
tggacatgtttctggcattg

SEQ ID NO: 58865 - DNA, 20 bp, Artificial Sequence
  Description of Artificial Sequence: Synthetic oligonucleotide
  Target: SCN10A; (+) strand; PAM type: YTN; PAM sequence: TTT
ctggcattgatggtggtgat

SEQ ID NO: 58866 - DNA, 20 bp, Artificial Sequence
  Description of Artificial Sequence: Synthetic oligonucleotide
  Target: SCN10A; (+) strand; PAM type: YTN; PAM sequence: TTC
tggcattgatggtggtgatg

SEQ ID NO: 58867 - DNA, 20 bp, Artificial Sequence
  Description of Artificial Sequence: Synthetic oligonucleotide
  Target: SCN10A; (+) strand; PAM type: YTN; PAM sequence: CTG
gcattgatggtggtgatggt

SEQ ID NO: 58868 - DNA, 20 bp, Artificial Sequence
  Description of Artificial Sequence: Synthetic oligonucleotide
  Target: SCN10A; (+) strand; PAM type: YTN; PAM sequence: TTG
atggtggtgatggtttcatg

SEQ ID NO: 58869 - DNA, 20 bp, Artificial Sequence
  Description of Artificial Sequence: Synthetic oligonucleotide
  Target: SCN10A; (+) strand; PAM type: YTN; PAM sequence: TTT
catgggtgtatacttatctc

SEQ ID NO: 58870 - DNA, 20 bp, Artificial Sequence
  Description of Artificial Sequence: Synthetic oligonucleotide
  Target: SCN10A; (+) strand; PAM type: YTN; PAM sequence: TTC
atgggtgtatacttatctcc

SEQ ID NO: 58871 - DNA, 20 bp, Artificial Sequence
  Description of Artificial Sequence: Synthetic oligonucleotide
  Target: SCN10A; (+) strand; PAM type: YTN; PAM sequence: CTT
atctccaaactcataaagtt

SEQ ID NO: 58872 - DNA, 20 bp, Artificial Sequence
  Description of Artificial Sequence: Synthetic oligonucleotide
  Target: SCN10A; (+) strand; PAM type: YTN; PAM sequence: TTA
tctccaaactcataaagttg

SEQ ID NO: 58873 - DNA, 20 bp, Artificial Sequence
  Description of Artificial Sequence: Synthetic oligonucleotide
  Target: SCN10A; (+) strand; PAM type: YTN; PAM sequence: CTC
caaactcataaagttgtgta

SEQ ID NO: 58874 - DNA, 20 bp, Artificial Sequence
  Description of Artificial Sequence: Synthetic oligonucleotide
  Target: SCN10A; (+) strand; PAM type: YTN; PAM sequence: CTC
ataaagttgtgtacattaaa

SEQ ID NO: 58875 - DNA, 20 bp, Artificial Sequence
  Description of Artificial Sequence: Synthetic oligonucleotide
  Target: SCN10A; (+) strand; PAM type: YTN; PAM sequence: TTG
tgtacattaaacatgtatag

SEQ ID NO: 58876 - DNA, 20 bp, Artificial Sequence
  Description of Artificial Sequence: Synthetic oligonucleotide
  Target: SCN10A; (+) strand; PAM type: YTN; PAM sequence: TTA
aacatgtatagctttttaca

SEQ ID NO: 58877 - DNA, 20 bp, Artificial Sequence
  Description of Artificial Sequence: Synthetic oligonucleotide
  Target: SCN10A; (+) strand; PAM type: YTN; PAM sequence: CTT
tttacatgtggatcatacct

SEQ ID NO: 58878 - DNA, 20 bp, Artificial Sequence
  Description of Artificial Sequence: Synthetic oligonucleotide
  Target: SCN10A; (+) strand; PAM type: YTN; PAM sequence: TTT
ttacatgtggatcatacctc

SEQ ID NO: 58879 - DNA, 20 bp, Artificial Sequence
  Description of Artificial Sequence: Synthetic oligonucleotide
  Target: SCN10A; (+) strand; PAM type: YTN; PAM sequence: TTT
tacatgtggatcatacctca

SEQ ID NO: 58880 - DNA, 20 bp, Artificial Sequence
  Description of Artificial Sequence: Synthetic oligonucleotide
  Target: SCN10A; (+) strand; PAM type: YTN; PAM sequence: TTT
acatgtggatcatacctcaa

SEQ ID NO: 58881 - DNA, 20 bp, Artificial Sequence
  Description of Artificial Sequence: Synthetic oligonucleotide
  Target: SCN10A; (+) strand; PAM type: YTN; PAM sequence: TTA
catgtggatcatacctcaat

SEQ ID NO: 58882 - DNA, 20 bp, Artificial Sequence
  Description of Artificial Sequence: Synthetic oligonucleotide
  Target: SCN10A; (+) strand; PAM type: YTN; PAM sequence: CTC
aataaagtgttaaaaaacag

SEQ ID NO: 58883 - DNA, 20 bp, Artificial Sequence
  Description of Artificial Sequence: Synthetic oligonucleotide
  Target: SCN10A; (+) strand; PAM type: YTN; PAM sequence: TTA
aaaaacagagcagcaatatc

SEQ ID NO: 58884 - DNA, 20 bp, Artificial Sequence
  Description of Artificial Sequence: Synthetic oligonucleotide
  Target: SCN10A; (+) strand; PAM type: YTN; PAM sequence: CTG
aaatccccggaaatacacgc

SEQ ID NO: 58885 - DNA, 20 bp, Artificial Sequence
  Description of Artificial Sequence: Synthetic oligonucleotide
  Target: SCN10A; (+) strand; PAM type: YTN; PAM sequence: CTG
tgtttcagcaccaaggtggg

SEQ ID NO: 58886 - DNA, 20 bp, Artificial Sequence
  Description of Artificial Sequence: Synthetic oligonucleotide
  Target: SCN10A; (+) strand; PAM type: YTN; PAM sequence: TTT
cagcaccaaggtggggaggt

SEQ ID NO: 58887 - DNA, 20 bp, Artificial Sequence
  Description of Artificial Sequence: Synthetic oligonucleotide
  Target: SCN10A; (+) strand; PAM type: YTN; PAM sequence: TTC
agcaccaaggtggggaggtt

SEQ ID NO: 58888 - DNA, 20 bp, Artificial Sequence
  Description of Artificial Sequence: Synthetic oligonucleotide
  Target: SCN10A; (+) strand; PAM type: YTN; PAM sequence: TTG
atgaaatgctgttaagttgt

SEQ ID NO: 58889 - DNA, 20 bp, Artificial Sequence
  Description of Artificial Sequence: Synthetic oligonucleotide
  Target: SCN10A; (+) strand; PAM type: YTN; PAM sequence: CTG
ttaagttgtatttagatact

SEQ ID NO: 58890 - DNA, 20 bp, Artificial Sequence
  Description of Artificial Sequence: Synthetic oligonucleotide
  Target: SCN10A; (+) strand; PAM type: YTN; PAM sequence: TTA
agttgtatttagatactctc

SEQ ID NO: 58891 - DNA, 20 bp, Artificial Sequence
  Description of Artificial Sequence: Synthetic oligonucleotide
  Target: SCN10A; (+) strand; PAM type: YTN; PAM sequence: TTG
tatttagatactctcagctc

SEQ ID NO: 58892 - DNA, 20 bp, Artificial Sequence
  Description of Artificial Sequence: Synthetic oligonucleotide
  Target: SCN10A; (+) strand; PAM type: YTN; PAM sequence: TTT
agatactctcagctcttgtt

SEQ ID NO: 58893 - DNA, 20 bp, Artificial Sequence
  Description of Artificial Sequence: Synthetic oligonucleotide
  Target: SCN10A; (+) strand; PAM type: YTN; PAM sequence: TTA
gatactctcagctcttgtta

SEQ ID NO: 58894 - DNA, 20 bp, Artificial Sequence
  Description of Artificial Sequence: Synthetic oligonucleotide
  Target: SCN10A; (+) strand; PAM type: YTN; PAM sequence: CTC
tcagctcttgttactaaatc

SEQ ID NO: 58895 - DNA, 20 bp, Artificial Sequence
  Description of Artificial Sequence: Synthetic oligonucleotide
  Target: SCN10A; (+) strand; PAM type: YTN; PAM sequence: CTC
agctcttgttactaaatcag

SEQ ID NO: 58896 - DNA, 20 bp, Artificial Sequence
  Description of Artificial Sequence: Synthetic oligonucleotide
  Target: SCN10A; (+) strand; PAM type: YTN; PAM sequence: CTC
ttgttactaaatcagtggca

SEQ ID NO: 58897 - DNA, 20 bp, Artificial Sequence
  Description of Artificial Sequence: Synthetic oligonucleotide
  Target: SCN10A; (+) strand; PAM type: YTN; PAM sequence: CTT
gttactaaatcagtggcaaa

SEQ ID NO: 58898 - DNA, 20 bp, Artificial Sequence
  Description of Artificial Sequence: Synthetic oligonucleotide
  Target: SCN10A; (+) strand; PAM type: YTN; PAM sequence: TTG
ttactaaatcagtggcaaat

SEQ ID NO: 58899 - DNA, 20 bp, Artificial Sequence
  Description of Artificial Sequence: Synthetic oligonucleotide
  Target: SCN10A; (+) strand; PAM type: YTN; PAM sequence: TTA
ctaaatcagtggcaaattaa

SEQ ID NO: 58900 - DNA, 20 bp, Artificial Sequence
  Description of Artificial Sequence: Synthetic oligonucleotide
  Target: SCN10A; (+) strand; PAM type: YTN; PAM sequence: CTA
aatcagtggcaaattaaatc

SEQ ID NO: 58901 - DNA, 20 bp, Artificial Sequence
  Description of Artificial Sequence: Synthetic oligonucleotide
  Target: SCN10A; (+) strand; PAM type: YTN; PAM sequence: TTA
aatctacagctacaccccga
